United States Patent 10,900,036 (RNA INTERACTOME OF POLYCOMB REPRESSIVE COMPLEX 1 (PRC1)) - sequence listing, part 11

SEQ ID NO: 21742 - DNA, 1327 bp, Mus musculus
gagcatgtatgcaaaaactatacgaagaggggaaagagcaaattaaggaaagagtccttactctgtttcctgcgttcatagcggtctgtttgtgctttgtctaacagtgaacactggtacttgattctcctcccaccaagtctaaagtagccttctccagaccagactttgacttctttgcatcaagtgtgtggtgtcgagtggttgccctgcagatgtgatgagttatcctgtagtgagacatcatcttactcccttgcccgaattgtgagctcctgctctcttgccctttcaagtttactgcgtttaaaactgaacagctgcaaacgttcttaacggtcttctccaatcacctctatatacacatgtacggacacacagtcgcacaagctagtcccatgcctgctggacctatgtgtatgcagatggctacatatacatagctgatcccttccctttccactgtagctcttctcctctaagtgtcattgatacacgcattgctcttatttgtcggcattacagctgcagttttgccttggggcaaaaccattcatcccattgccaaaacagttgacagtgtctgtgtgtgttgtgtgcagttttcaggatgatataacagatagcgcgtccacgctgctgcccctttggaaagagcagggcctggttatgtagctgcccagctgctcagtccagataaatacatggactagcaactatgcagtcatcattcctgcctttacgtgattggctggacgagggggcaaaagaacctatttataaaagctcctatatacttccacgttctatttatgcaactcatcttcacagatcattctaaaatgaacgaggtgatgtatgctgtatcagaaaccatctgtaacagttgtgttctcagtgctgtgtcattccaaataaacctttggtaatctccaagttacatgggttctttttcaagagtggttttttttttttcttctttttgaattcttgttccagttggacaagctacttgaagcaatttatattggagttgttatttgtgcagatgtgtacccgttccacctctgggttgtgttctgtggccctgcctcacttccctatcactccatcccagtcattgctggtcaccagtgcttcctggaagccagcaattactagagcgcaaataacagctgtgggagatctccttctattgctggctgtggacactcagtctgtgaatcactggcaaccatagatgcacaatcagcctcacgacagcttcatctttagtcacttttctttctggcatttttatgttcataaggacataaagaagtagctc

SEQ ID NO: 21743 - DNA, 1194 bp, Mus musculus
cacagcataaagtggggagctgagctcagacccacccaggtgtcccccagggacgtgtgcagctccccacaggagcctctcataggaaaactgtgagctcgagcatggaggacgccggtgagtgtcttcacaggacaggtaagtcactgaacatccagagacagtagcaagcagaggggcagcagtgcttctggggaagaggctatcagactggctcaccaagcaaggcaaggctgataggccgctggcccagccactgccacagcagatgagccctgtgtctgtgacactgtcagcacacagcccagcccagcacagcagctggacacacaagagacaaaactgtcagcatgaaattaccagtgtttatgttaaagcctttgaagtaaagccgtgtgttgtcctgccagtgtccttcatgtgtctctgtcacagcctgcccgcagtaccgtgaggaaactgacaggcagcacagaacttggctctggccactgctcactgtttcttcactctttctctaagtgtgaagaacctcactgcgagtcatccaaggaagacagctgaagtggtggctctgcttgctgctggatgctgaggagctagtgagtttatttatggtgatacctcatggacatcgctccacctccactcaaaccatccctgcctgcggccactgggtcatgctgtgctccttcctctagtctgtgagtttcggtctgacctgataatgaataactcggtcttgtgctgcatctgaatcaaaagactgcttaatatattgaaataacaattttgtagtaagtgagagatacctttttgtttcaattctcagaatgtattttttttttttggtttcatgtctcagatttcttttgtatttcttttttaactccttacatttcacttgtgtttttaaactcatgcacatgtgctctttatacagttttaaaataataaatccaacgtatcaaaatgatgattgtgtgttgtctgtattatatgtttgtccaggagtggtgggttataaaaggaagagggtgtggcctgggtgcatagaaactcttggcctgtgttttgtatgactctcttgggacttcttgttctgcgctagggtctgatgtgctgcacacaaacaacctgcaaaggctgtggctgcttttgctccgccttttcctgcacgtttacttccttagg

SEQ ID NO: 21744 - DNA, 1099 bp, Mus musculus
agggaaaggaagttttaagagggaggcttggacaatcttagtatttacacgtgagatgaaatgaagagtcccgtgtgctgctctgtgtgcaagagtactgaccgctctgctgaaccttcatgtcttttctagtgggcaaccaggcttccaaaatagcactgacctgggaggcccccaagtaaggccaagaagtctctgctactctaatcttttacgtattaaatgcactaggctagtagcccttgcctttcctttcctgaaactctttcaacacaactgtgtctatatgactacggctcatgcttccaaggtcagctcacatgtgacctctgtgagctgttccctcgcctgaattcattgcatcttacaccttggcatgccttgctcacaatactcattatgctgtgtgggatttcctgattactagaagctgacctctgctatcctgggtaagaacgccctgagtacgggtaccatgctctgtttactttaggatctccagcaccaagcaagtgcctggcacatagtctgtgcccttaacatttgtagaaaggagctcaccagctctgtcagtgtttagtttcttcatctattaaacagggttggtttttctggttgctagggagacttatagtaatacaacttactattctagattcttcttatcgctgtgttttatttgccatgtatcatcttttgttatcaagagaagtgtatgatgcttgctttatgccatagccatctatattgtaatttatctatacaattaaacaaatttaatgaaccctatgaattattctttgatgtgtttgtttttgtaagaaatatggaggaactgaattataaagaaaataaaatccttctgtaataatcaaataaagtacttcccataatcaaaaccaaattggttatcttcagagcctattaagtctcatcttttataaagttcggctttcagttgcctgggtcagaaggaagcttcaaaggcagtactgatctgttttcctgagtcagtccttaccactaatcaggatcccaggtaacatcacagtgcagttcttatagccaccacttctatgcatctcctcaactaccacta

SEQ ID NO: 21745 - DNA, 1189 bp, Mus musculus
gtcagctgtggcaggtgtacacctttttctgaacttgaccttagatgtaaaagagcgtttgagctggtctacattcaatattggcatttttactagcataattttcttattaaaggaaaggcatattcttttcacttagtggatgaggaaaacgaggttccatggagtaaagaacctgaccaggtcaccagagtggtgagaactagggctggaagcccaacctcctacttggttttaactgcaaagaattccaatgaatgcttggcaatcagagaatcccagaagtcatgaggaaatgaggcccactttctcactccaatagattaaaatattacctaagtatttataccttgaattttacagaacaccccctttaaagattgatgattaagcctgggacattgtatccattgtgctactattgaacaatttgttgtcctgtttggggccatacaaagtcatagcaagccattgtcaggatttccttattaatctaaatgtatgaaatgaatttggaaggtccaagctttggtgtctccccttggcgccgtggtcctgctggtcctatgcgctggcaaatcctttcttgctgcaaggatgaaggaatgtgctcttcggttctgtgggagaaggcacagctgctgagtggccagatggatcttttcctttgctgttattttaatgaaagatgtgttgagacgatgtcttccaaatttctttacaaatacttaatagcattataagcactatttgaaaataacctttcgttaacaaattcaagatggagaaggctgaaggacttttcattcgggtccctgggtggagccttacagtccttgtgctcaaacatacccatagcatggttctctctttattctgtggacattgctttcacgtgtgcattttcccaccaaagggagccacccacccatgtgcattgttttttatttacagacctattttaaaagcctacaaagatacttgtggccaacttcccatgtcagttgatctatagctacatctccatctgaatgtttatgccatccaaggctatactatcctccctgtgagtgctcatggttattgcaacagttcacttagagttgacatatgtccaccaggaggacaaggatccttttggtttctctctaatccagctcctcctctaaaggaaaattgtataaaacac

SEQ ID NO: 21746 - DNA, 1102 bp, Mus musculus
tagagtttttatattgtactcaactttcttattaactttcaacttttgaagtaaagaggaaagacaaagtaaacacttaaattcaaatatggcttgagaaaacctattttagcattttctctggcattcagagtctaaattcctgagtgggcatgtaggtttctgtcagggtggctaacctggctccctctttaccctcgacatctgggacatgggatcatcacccccttctcttcccccttcgtcttcctcctctgccccgatttgatgattgagcaaggagcgaagagagagttctcggttgactgtgaagtgctcgtgtgcaggcgatgatcttcatcaggtcgtgcacacacagaccaggagacacggcatatctggccggaaagccagctctgctgcgccgcattctgcagttcataaacgttcagctttgtggtttgtttgttcatgtttgcaagggtaatgctacatagggtttctggaattacaagaaaatgtttgtcctcatgagattggactgtgaacagaaacttgacagtttaaaaggacattatacctagcatatctccattacaaatagaggaaaataacttatgttattctgggctttttcttagcacttacttcactttatactatccgtgaaataacatgtgaactggaaacaagcagagtctattcctgttgcctgtttgagtagatttcagattgtgaagtgagcctgcaggtttgcccagccctgaagggaagggagatgcaggcctattgagaaagcctgctgtgccatagaagcccttctcgaaatccttctctccaagtgcccctccagcatcacctgggcatggctctcctgatctcagcttgctctgccatgtgaggcatcattctccttgaaacaccatagcattttacctttgtctcctttgttctactcctgatttcttgataactcttggttttgttttgttttgttttttatttgtttttgaatttttttgttggtttgttcctttttttgttttgttttggtggtcctgtttttcttgaaatggtttgtttatacttaaaaaatataagatttttttaaaaagaaaaacaa

SEQ ID NO: 21747 - DNA, 1194 bp, Mus musculus
tcaccagcatttgtttgttcttccattgtcattacttgtgggaatatgactttcctgctgcgatagatgtgagaatttccgggtcaacttagaggagtttgaaacagagtccctacttttagagattaagaacatatttctctttgcaacagacatgtataacagtaatggctaattatgtctagttttagggtctggacaggtatagtttagcctgtaaccgttgtaacatgactctaaacaaggctccagccctttgctcaaacccactctcctggttctaaggatcataactatctaagaatttggtgtgctacttctgtggccttgggacatagataacatctaaacttctaacttcatttttctccctgttaccttctgtctgaatgtttgtcacctctattttgttttgtttccaaattctgttttgtgttatctttaaccactcatggttgaaaagaaaggaaagcaggaaatgggctgaagcctgagccaggcactgccctggcatagttacctcatccacaggtcatttccctctgtggtgccttccatctttcctttaccatccaatgtgtccccgttgaaccccgatcagcaaggtgcatttgtctgaacatcattgtctgagtaggcatgattcaaagaagcctgagagcgaagaagccattaattcacttgcaatcacagccacagcctcctctgtgtacttcacttgattatgagagactttgctattcaggtgcaaatcaccccagagaaaggaggccttccccactcaagtcacaagaggagacttaaatcaatagcctttcaaagtggctgtggccactctgccctggatcagcgtgactcttcatgtgctgtgggggcaggccagccaagcaagtctctgtgttctgtgttaggacactcactcctcgtggaaggctacctcaccatccgtgatatagattaacattggttcaagaattagtgtcagagaggggtcaagcatagaaaagacacgggattttaatttcccataatactctgcttttcccctgcttattaaagaaaagcatatttcaagatgaatgcataaacacatacatgaatttattgaaatataagtacacagatacatagatatagataaatagtaaatagcatatgtattcattttcttttcctactaccacaaatgactgc

SEQ ID NO: 21748 - DNA, 1128 bp, Mus musculus
tacattcagagaagagaccactcagatgaatatcaacacagtaccctaattgtttaatatcattattattatttatttgttattattgttatcatttatcattgttgtcattattaacattaccattactcgtgagatttagagactaggtttgctagcattattgattgagggagggaggaaggaaacacctttatgttgtggaatcatagattagcagtttctttccattgcagattctgcctcaggaggaacagtccttgtcatgtgaagcagtgctatctgggaatcagtacatggattccaggttttagcaatcttccttaaagatttgtagtcttagtgatccatattacaacaaagaatcccaagtctaaatagctgagccaactgtagattcagtctgattcccattccacaaatggtttcccaggtatacagccagtttgcactgaagtgacattaaagtgcatattggcagaatgccacggtgtgtgacttccacagtaataaatggctggaaggaggcaaggtaatgcaagatttcaatggtggtgcactctgaaaggaaggaagccagagggtctgggaattagtggtggagctacaggggggaaaatacagctctattacagcacacacttgcctcttcttccttcccattgcctgcctgagatgattgggccgagtttaaaaataaatgaagtgtattcacgttttccttcagaattttgctttgaagggattctgtaaaggaaaaagatggagtacttacatgagcagaatgcagcaatcaagacatgaaagcataggccttgtagatagcaggtgtacccttacatggggagagacacatgcttccaattaaagccagtcgcacaggtgagcatgttgcttctgtacaatgttaatgattggataggtgatgctgacatgatgacatttttgaatgggttctgctctcatttgtacctttctactgccatctttatggactgaactatacagtgacggggactgaattttcaatagaaacttaatgtcaacttttagtgctgactagagatgcgattccacacacacccaggctatcatttatgttgatatgcttttcacattttattttag

SEQ ID NO: 21749 - DNA, 1146 bp, Mus musculus
atcatgaatcaacatcaactaaacatgtggtactagcaggggggctggtagtatggtgaaaggatctagggatttaaaatcaagccactttcctgataaagtttgcacaatgtgaactggtggactttggttaagtttgactctttgaatccttcattttttacaatatagacagtaataattgtattccccactttcccagatccaaaccatgctctaaatggcagagatgcaaacaaggactcagaacctgcagcaccaggttcagatctccactctgatgttcactacagagtgatttgtatctaatggtgttatctttctgagcgcaactttaaaatgaggtgagggtggtttgtggcttagtggaagggcatagccctggattaaatcccaaacacaaataagtaaatgcatgaagtggctgtaagtagtagttggtgttgtgccattctttgaacagtgcgacacataagtagttcacatatgctatgtcaggtggcactgagagcacactgcccacagtcatttccccaccacatgtgtctaactctcaagctttcttagaagcttctgggtcactttaaaatgtggaacaacatatgctatcatatcccgaaaggattatacatggcattatctaatgctgcttccctcaaagggaaccttgtactggctcctcacagagccaagaagaaagcccttgaggccccaggagagagcaaaatggatgatattaggtagaatggtagttcaagtttgttttttcttgtggttgtgaaaataaattcttaaattggagaagaaaatgactgcatggtattctgaaaacaaaagtaccatccatggttattgaataggatgtgatttgtgattgatctgtttgattgaagctagggcatgtcttatcattcaagatgagaggcaactattccaatcctttgttcattcacttaaagtgttatatatatatatatatatatatatatatatatatatatatatatatatatatataatttgtgtatgtgtgtgtagtcattgtacatttagtcctaccttgggtagaaataagatcctaaattcaatcaaattggtaaaatcaatgaatgactattgctgatacacgctgttggcaacaatctg

SEQ ID NO: 21750 - DNA, 1105 bp, Mus musculus
tgttaaggactttcacacatttgttattaatggctgttgctttcatgtttatcaagcttacgaaagaaggtgggggtgggggtgggggtgggggtgggggtgggggtgggggagggggtgggggtgggggtggggggaatctgtgaagtctgcagctggtcactcaaatgatttctgttacccaacaagaaactacattcctggaagctgggatgatcctcttggaaaggggtggcccatccatccgaagcacatgttttgcactgtgttggtccttcagttggctatcccattcctcactctgtctttggatcttccccaaagctctggtgaatctgaacatattgaacccgaggaactgctagcgtcttcccgacaagcgtctctagaaacaaccagaccttgccaaactgccatgagtgaaattgaaaacattcaatgaggaaaacatatctctgcattattttgaagttattcaaatcaccagggttaaatggatgcatctagtctggactatagccatggaatacaaactcactggggttccagctgcaattcagcaccagccgctgtgcaccacagcttaaatgctaatagagtgacgtcagagccatttgggcttcctggatactagcaaggatttcaggaactacgctagtaatttagtcccagtttgtcagagaaataagtagagggaacacttggggcatagcacagtgcctgaatggagtacggaagccctgtctcaagctgctatattcaaatcgtagagccgtgttgcatctgtagaactggacgtggaagacagatctggttcccagcatgaagcccttctgttgctggcacttttcaaaatggctttctcctcctctattattttaagacagagtactagacaggtcttcccatgctagcaaacttctgaccccattccttcctttagaagaaagagcagccccatcagaccctacaatctagttcaattggggtttccaagttggagtcaccactttatagacacagaaatgggggggggggagtgcaatcctctcttcatttttaacatgctctatgggtaaccagctcatgaattctacctatatct

SEQ ID NO: 21751 - DNA, 1175 bp, Mus musculus
gtggtgggattcgaacccacgcccccgaagagactggagccttaatccagcgccttagaccgctcggccacactaccgttgatgtagagttttgaaccatggcaaaaaacctccacttagtcgcaataaaacattaaaagaaaaaaaaaaaaaaaaaaaaccggttggcagcggtgggattcgaacccacgcccccgaagagactggagccttaatccagcgccttagaccgctcggccacgctacccccgtcgagggctgcttacgtctcgtctttctggaggatccataacagtccagactcctttgcacgcggctctctgcagcgagctttcattgtgcactctatgcgctaatgcagaagcgcaggctctgttctggcgttgtatcatgaggcttcgcagcaaaagctcttttaggtgctatcatatcatcactaagaaactacaactatgaaacgttaaaaaaaaaccagcgctagtaacagcaggaatacgtgattacggaaactctgacaacgggtgcctccttagcgcagtaggcagcgcgtcagtctcataatctgaaggtcctgagttcgaacctcagagggggcaacctcagcttttattttttttttaatacattaaacctttaattttaattcctacgaagagaattgagttcgtgtgtacggagacccaaaaactactaatgaaatggaacgggtagttttatttgtgtaatataatggtctgttagaaagttataaaatagcgatttttcttttctttttttttttaaagaattaaacacgtgaccagtgtgttggactacacctataatattccagcattcgggaggcagaggcaggtggatctctacaagacgatttccgaagcccagactttacaattaaacttactaatttttcaccatccatactattggagccaggagaattttcaggtgcctttcaaatgcacttggcattggttattacataaataccaaggccaggaaactccctgcccagggtgtaaaagaaagggaagccagagagcgagtatgaaaggtgtaagatatgtgtaattgccggtttggtcctttaaaccattcttctggtattgcttattatcggatcatttcatccaactcctcacgatactccatgtcaaaaacgaaacaaaactaaa

SEQ ID NO: 21752 - DNA, 1110 bp, Mus musculus
gagtgtgcaaaaattcaaccaggagattaagtctggatatccagggctctttgggggaaagcaaactgcatggaggtcagaaaaaaaggcaaaatgtacactacctacctctgatcactttttgtgttttgtgagatggagtctcacataacccaggttggccttgaatttagctttttacctcatttcccaagtgctaaagttgcaagctgtttaaaactttattggagccgggcttggtggtgcaagcctttaatcccaagcacttaggaggcagaggcaggcggatttctgagttcgaggccagcctggtctacaaagtgagttctaggacagccagagctatatagagaaaccctgcctcgaaaaaacaacaacaacaaatctttattggaacttttaactacttgaattagagaagaggcaaccttgtcataagaattggaggagggaggacctggtgtggtggcacatactcagcttcccaacatttatgaggctgactctaaattgctatgagttcaaggccaagctaaggctacagagtagccccgtcacttgggaagtagaggtaggatcaggagtttaagccttattgggccacatgagaccttgtctgaggaagaaaaaaagtttgaaagaatatcctgtgagaaaatgagcaaaactcacaaaaagacaagctgcagaaacataaaattgacccatgaatgtaagcaaactgaccagcatttacaaaaaaggagggaatgccagctaaagctacactaaggtgtcccatattagatagtgggaatcaaagttttcagaccaagtatgaaagtatatagcaaaatgattgtttcaacattgtatctctctctctctctctctctctctctctctctctctctctcggatattgacattgtgatattgcaaacaatctaacttctaaacctaaaagattgatttagtcagctaaacacccaccccacagaatactgtgcaacttttaaaaagaagaaaggtaactagtagaagcattaaatagttctgcatccccatattaccagtgcagaggtaggggactcaatgccacattaaatctagactacactgcatagctag

SEQ ID NO: 21753 - DNA, 1183 bp, Mus musculus
tgggaagtaaaattgtattactttcattgttatccatacagaggcaatcagctaatctaaccgtaaatttttaggttctgagtcagggtcttactatgtaacactgaccatgcaacatgggctggtctggaactcctgaagataacttctgcctcagtctccacgtgtgccaccatgcttagttccaagagaatttttttacataatcagttcaccgtgtgtctgatatataatgagtacagcctctggtgggcatctcctacagtgttctggggaagtcagtgaaataccaggtagtcttgagtgggctcttctggccctcagatgacacccccccccctttgtttctacagttgatgtaaccctggacccagacacagcctatcccagtctgattctttctgataatcttcggcaagtacggtacagttacctccagcaggatcttccagacaaccctgagcgattcaatctgtttccctgtgtcttgggctctccatgtttcatcgctgggagacattactgggaggtagaggtgggagataaagccaagtggaccataggtgtctgtgaagactcggtgtgcagaaaaggtggggtgacctcagccccccagaatggattctgggcagtgtcattgtggtatgggaaagaatattgggctcttacatccccaatgactgcactacccctgcggacccctctccagagagtagggattttcttggactatgatgctggtgaggtttccttctacaatgtgacagagagatgccatacctttactttctctcacgctaccttctgtgggccagtccggccctacttcagcctaagctactcgggagggaagagcgcagctcctttgatcatctgccctatgagtgggattgatgggttttctggccatgttgggaatcatggtcattccatggagacctctccgtgaggaagtgaacgtagaccacaagtgctgttgcctgtaatcctaccccaggcacaagggatcttgtcctgattcctgtccatcaaaattgggtgtccttaccatttccgtgcccctacagtgagagacaagatgtccatccatggtctctactgcattttcccttcccttgcagattgtgagatgtaatgaaaagtattgctatttcccagaaataaaaactagattcctcctgtg

SEQ ID NO: 21754 - DNA, 1231 bp, Mus musculus
cgacaatctttgcgggggggggggggggggaggtccttgtgctaataaaaaaaatataaaattctatcagtacaaagttgattaaaatttgcaaataggtatgcctactctctaaacttagccccagatacaccagagtttaaatactgaacattcactgctctgccctgagtggcatttggccgtcaaatgtcgctttcgtacagcgtccctgacctctagagtgaattctgagggccaaagacacgaagcggcaaagaatagggctgctgaccctgttttccatctttcttcataatcttggcgaaccagacagatggagagcacagacgctctgtcttcaaaacatttacatccagttttatacatggacatttcctcccttcttttcctcggtcaaatattcttccattttactccacaggaaacttttgtcagcgtttccaacaaatcttgagaatgctgctgcagctagggtgctggggcaatctctatatcaggaatatatgtgcggcactttctcgtgtgtcaggatggccgagtggtctaaggcgccagactcaagcttagcttccctgtctggggattctggtctccgtatggaggcgtgggttcgaatcccacttctgacacagtactctttttctttttttttttttctttctcacctcagtatcgaaaaatacatatcgacttgatcacatagttaagaaatatcgaaccacatattcttaaaaattgattttgaaaacgttctaataggagcacccgacactaacagtagaagcggaagcgcggctatggttttgaggacgggagagtggctttgcggtactgtctgcccgctgcgggagacgactgcggaccgcgaaaaaactgatcctggaggtctggtcaccgaatatcacctacaccgccgcggttggccacgcgcctagcccacgagtgccgcaaccctgaagcactgcgatctccacagcgcctccttgcgggccacgggataaataatcatttcaccgccttagtccaaactcctccttccaggccaaacagaatccgtgctaacagcttgccctgttttaggcaaggctctcttacgagcgcacctgtcatcaacaactcgataggttttgttgttggtttggtttggtttcatactattctctgatatgttttcactcaatatttgttggatcgtaagttgaacattgatttcgtttttcctcatata

SEQ ID NO: 21755 - DNA, 1197 bp, Mus musculus
gaactcttggtatttaaggatgactgtgaactcttggctcccttgcctccacctctgatttcattttctccatccttcctaaactcactttgcaagtttactggttgtttgtttgtttgtttgtttgtttgtttttttccagtcttatgccaacttcgcaagttcacacaagctttctttaaagctcgccggctgcgtgcggatcctttctgatttccaccctccaaacattctcacctccctccctcctctgcagcacaaggtcccctgagttctggctggacatccctgtggttgtcgggtcacagaaaatttagcagcgttcacacgaaggatcattgagctacctatctgcttacagcttcccgaacctactttttcgaagtctttgtaaattttgattccaaattaggaacttttatgttaagctgaatttttgttatctctatagtgaagccctgcccatatctggtcacatttcatttgactcttacgtattcacccctccctaccacttggccgcgtggcctaatggataaggcgtctgattccggatcagaagattgagggttcgagtcccttcgtggtcggtgtgcttttacatttttcttgcttaattggtgtactcactttctggaaatgtgaaatgtattttccttcgtgtaggtattgtactatggcatgactgctggctcgtgcttaaagaacccttgtttaactgtgtagttgaggagtgggggtgggggtggggagtactgtatactacacaaacaaaaaggcaaaattagcccagggtttcctaaataagacctgaataaggactctaaattacttgctaacacagaaggaagacatctcaccagtccgtaactttggacaaagaactacagtcaactaaggaatgcggagggcaggagaaatagtcttccttggggaaatgaccccaattggttatccaatgtctagtggttagccctgaaataatatgcataaaagtatcattctttggactgagcagcttgtaatttatgtatttagaagcgtgcgagtgtgtgaaaaattaaagaaacggaggctatgaatttgtccagggctgagtggaggagtacatgggaagatttggagggaggagagagaaaggaaaatagatgtaattatattttaatttaaaaacactctcaaggatctcctttcctg

SEQ ID NO: 21756 - DNA, 1585 bp, Mus musculus
acccacactggggaaaagccctacgagtgtgatgactgtgggaaaaccttcactcagagctgcagcctccttgaacatcacagaattcacactggggagaagccataccagtgcaacatgtgtcccaaagcctttaggcgtagctcacatcttctgagacatcagaggacccatactggggataaagatttttttgttccagaaccttactgggaaagtcagagtagggtggaaagccattgggaaaatattgaaactcctgtgtcttatcaatgtaatgattgtgagagaagtttcagtaggattacaagccttattgaacaccaaaaagtacacactggtgagaagccctttgagtgccaaacctgtggaaaaggcttcacccgaccttcataccttattcaacatcagagaagacacacggggaagaaaacttctgtcacagtgacccctgctgtacattccgaagttggtgttcaactgtcattgaactgaagccactctgtagttcttaatgactgcagaagtcataggctggggctctatttgataatgtacattctcagatattaggaatctggctaagacttatcttctacattctagaaggtgactaggaaaaaaaaattaatttcatagaagagttgtctacaagagtcctcacccattggaactaaatgggcttcctgactgtcaaattgccttcccttgtcctgcacttcatatctcttgagggaatggttatgctttgggggtgttgctctgatccttcattaggctattgggcccttcacatgtggtcagacttggaactcttatgtcctgctttgtgccttgtatacaggtgctaatagacatttattaaatatactggtgagatttcctacatagctctaaaaacccattatctggaaattctcaccaaaaccatttgtatatctttttaaaaaaaatgatgttttagattgaatcaatgtagaactgctttgtttttgttttttgccaagtaccccaacttggcagggcagaggtgaaggtgaggttactgtgctaaaatcctttaatcctttacctaatttaggaattctgtgagagtgccttaaacagctttcttagcattaaatcattgtgaatgtgccacccatggaattccactaatattttttttcttgttaattttgttactcttgagagaacaaaaaaaaaaaaaaaagaaagaaaaaaaaacctttcctactcatgtagtgtgaaaatgagtttcagaataaagtgatcaatgtctaaggctcagcctgttggttcttacttgggtggttatcttgggtctaaccaagagctcctgcatctcataaccactgcgctaagacagtccatatgatacagcagagttactaaaggatctggtacgtgtgggacaagagttggccggagcttcactactgagtaagtaagcagcagttggtctcttgatgtgctgtgttccacactgcttagtatagggaggggggtttcataagttacactccataagcagtgacattgctagctcgctgtgtccttgtatgacaagattcctaaggaagaa

SEQ ID NO: 21757 - DNA, 1209 bp, Mus musculus
caaggctggacgcgaaaacggagagatttcattggttacacattggttaccaatggcgccctggttttgaaaatcccttgttttgattggactgttagtacatgacgtatggtgattcaggttcggcatagccgtaagtttgtttaaaatgcagccagaacagtcattaacttttagttatcctttttcaacttagttcacttcatcctctcagtatgcctgagcccgccaagtccgctcccgccccgaagaagggctccaagaaggccgtcaccaaggcccagaagaaggacggcaagaagcgcaagcgcagccgcaaggagagctactcggtgtacgtgtacaaggtgctgaagcaagtgcaccccgacaccggcatctcctccaaggccatgggcatcatgaactcgttcgtgaacgacatcttcgagcgcatcgcgagcgaggcttcccgcctggcgcattacaacaagcgctcgaccatcacgtcccgggagatccagacggccgtgcgcctgctgctgcccggggagctggccaagcacgcggtgtcggagggcaccaaggcagtcaccaagtacaccagctccaagtgagctcgtttaactcacactcctaactcaaaggctcttttaagagccacccacactttcctctggaaaagctgttgcacatgcgtggttattgatgacgcttctcttgccttggacctaacaaggcataaggtaaaatgccaaaagatgcagtaagcagtttgcgtttggaagttaagggttaatggacagtcaggctttgcctctccggtcagttgaaatataattcgcagcagcctgtagtttttatttacgagtgtgcactgtatcctgaagctttaaattaagcattaactggtattcacaccccaaccaaccaacctttcattcctcctaactgaaaagtatgctgcgtaagcacaggccagttgtcctgcgtggttgtgggtatttatcgtacaagcgaaaatggaacctgagtgtaaattcacgagaaagtatgcttcagagaagccatcttcaagactgatttgaatgtccatggtcctaagtccagctgcaagcgtcaaaactgcatttaaagccagtgggccccagcatgaccgctgagttggaggtgaattaaaagcgtggggtagccccccaatattagtgggacttccatgcaccatccagg

SEQ ID NO: 21758 - DNA, 1213 bp, Mus musculus
gggattttcttttcaatgaggaaattgcacacttggttaaaccatgttcagactgcgaaaacaaaaggactcaccagccaattaagttgatctggcagccattttgaccaatcagaactcggccgtctgtataaattttggtggttgaagctttccctccatcactttgctttggaagctcgggtgttaccatggctcgtactaagcagaccgctcgcaagtccaccggcggcaaggccccgcgcaagcagctggccaccaaggccgcccgcaagagcgccccggccaccggcggcgtgaagaagcctcaccgctaccgtcccggcaccgtggcgctgcgcgagatccggcgctaccagaagtcgaccgagctgctgatccgcaagctgccgttccagcgcctggtgcgcgagatcgcgcaggacttcaagaccgacctgcgcttccagagctcggccgtcatggctctgcaggaggcctgtgaggcctacctcgtgggtctgtttgaggacaccaacctgtgcgccatccacgccaagcgtgtcaccatcatgcccaaggacatccagctggcccgccgcatccgcggggagagggcttaaagttcgtctttctgtgtttttcaaaggctcttttcagagccacccaaacctacacaaaggtgctgttgacttataggccaattggagttttttcttggaacggtagccaggttctaacagtttttcttagctgagggatgctctttagagtgtcttaagttggtgagtattctgcaaaatccaatatacttaaactgaacattacctctaatttccccaaatgcacttactgttcggtttcttgaaggatttttaattattttgccagcaatataaggccggcggagtcaattataggcacttaaattcatggtttcctatgtcttatacatggaattgctggaagcattttaactgctcagctatccagtcccaagagaacctgagttagttttgtataccagaagtcccctggttaaatggttggatgggtggagaaacatgaagaaaaccatagggaagacgtatagcccagaacaacccaaagtgctacaaccagcttcttggcctatgagggctgcctataattctaacatttccttttcaccaaagtgttcagctttttatggcccagtgacctatgcaccattcctgtcactttgcaagagaag

SEQ ID NO: 21759 - DNA, 1180 bp, Mus musculus
ttggctttctgtattttgtgcaatcagtgtactgattgtgcgctcgattctccaaactcttaaaagggcgtgaggagctagttccctcagaaagcacagacagggaaacaaaaggcgccctttttctttttggtaagtcttcccctcccccacggccgcgggcgcaacttcccgcctcctccctgcaggttctcatttcggtccgcccgctacagtataaaaagacggcgctcaggctcccggtcagcatctctgttctgagctgtcctgagtgcagtcatgtctggcagaggtaagggcgggaaagggctcggtaaaggtggcgctaagcgccaccgcaaagtgctgcgcgacaacatccagggcatcacgaagcccgccatccgccgcctggcccggcgcgggggagtgaagcgcatctccggcctcatctacgaggagacccgcggtgtgctgaaggtgttcctggagaacgtgatccgcgacgccgtcacctacacggagcacgccaagcgcaagaccgtcaccgccatggacgtggtctacgcgctcaagcgccagggccgcaccctctacgggttcggcggctaagctgctcgcttacactatatttccctaaaggtccttttcaggaccaccacatcttttacagaagagctgacgcttgttaactgagaactggagtgaaaacggctcgtaacaggttgtccaatcagaacgaacatgtatgtgcttaatttgcatgcggaacaatgctaggaaagctgaatagtcctgtcaagtggtgagttcactaggtgttcacatggtttcactctttttatttgttctaggcagttttattatacttgcccatttttctgcttccacctcttaaggatgcttccctacttaagtcatttcataccttgcgacagaccacttaagttcaggatttgtacattcagttgtgtagaatgaggttgatctggctttataaactatgctgtctcggatgcaataaaattctgaataaaactgccaatatgggggaggtgtgaatttctgaattgagtttttataagccataaaactttaattaataaatcataaaacggccaagagtcaacagttaatgaaggtacactgttactacgtttacacttccacataaatgtcaatagaaacaatttaagttgtc

SEQ ID NO: 21760 - DNA, 1204 bp, Mus musculus
ggggttacgggttgttaaggggccgcttggctttctgtattttgtacagtcagtgtactgattgtgcgctcgattctccaaactcttaaaagggcgtgaggagctagttccctcagaaagctcggacagggaaacaaaaggcgccctttttctttttggtaagtcttcccctcccccacagctgcgggcgcaacttcccgcctcttccctgcaggttctcatttcggtccgcccgccgcagtataaaaaggcggcgctcaggctccctgtcagcatctctgttctgagctgtcctgagtgcagtcatgtctggcagaggtaagggcgggaaagggctcggtaaaggtggcgccaagcgccaccgcaaagtgctgcgcgataacatccagggcatcaccaagcccgccatccgccgcctggcccggcgcgggggagtgaagcgcatctccggcctcatctacgaggagacccgcggtgtgctgaaggtgttcctggagaacgtgatccgcgacgccgtcacctacacggagcacgccaagcgcaagaccgtcaccgccatggacgtggtctacgcgctcaagcgccagggccgcaccctctacggattcggaggctaagtctttgtcttttatttctgctacaaaaggcccttttcagggccacccacttaattctttgaagcgctgtactcatgtcagaagggttagaaagtcctcatgaccaagaatacaagtaatgtctctgacatgggtgacctactttgtaatggtcagctttcacatttttgtgtaaagtgaactaattggtgtatcagagagttttaacacgtcaattagtaaatgccattttcctggctttgtgcttaagacatgatcttttctgtgatctcacttatcggtataattgacagtattacatcacacacacacacacacacacacacaccagctggttctctagctctctagtacagatatgccatagagggggggggggggcttttgagttttaggagtagtgctggagattgaattcattctgtagatacaacattaccagcatcccataaccttctgtttgccattgctggcctcaaacctgtgatctttctgcctctgcctcagaagtagccagtattgctcccagatcatgcttcagagctgattgtttttccctcccagcaactctgatttcagagtcgctg

SEQ ID NO: 21761 - DNA, 1074 bp, Mus musculus
ggggcgggagcggacttagcgggttcaggcatggtaggaactgaccaaaagcctaaagatacagaaagaaaagaaatgtaaagtgtgtctgcacaggctgccttttaaacaaacttgtggctatagctatcgcgaattagcagtcgtcatccaccaaatacccaatcatagcaagggcttttcaatgcaactctgttattggtctaggtgcaatgcttctatgtaaccaatgaaattcctactttttcatgccctgcattgactataaatactgtcagctttgccttcaaaccacttactgagcaggcttatattctaggttctaccatgtcaggaagaggcaagcagggtggcaaggctcgcgccaaggccaagacccgctcctcccgggccggcctgcagttccccgtgggccgcgtgcaccggctgctccgcaaaggcaactactcggagcgcgtgggcgccggcgccccggtgtacctggcagccgtgctagagtacctgacggccgagatcctggagctggcgggcaacgcggcccgcgacaacaagaagacgcgcattatcccgcgccacctgcagctggccatccgcaacgacgaggagctcaacaagctgctgggccgcgtgaccatcgcgcagggcggcgtcctgcccaacatccaggccgtgctgctgcccaagaagaccgagacccaccacaaggccaaggggaagtgaggcccttgatagaaagcaaccctttccaaccaccaaaggctcttttcagagccacctacaaaaacacttggaggagttgtgctactttggatcattattgggctaatgagtgcaacactgagataatgtgaacctaaccctagttttattaatgcctttagaattgttgcatccaacctatttatacaagccagtgtgaaatttaatttactgacctataaatactagtagctattactacgttttaatgtttcaggccacgaagtttgcttgtatcttcctgtagtgcattctaggaggaagagcaagttacagcttagggactacttagttccctcagcatttacaggatga

SEQ ID NO: 21762 - DNA, 1167 bp, Mus musculus
gccagctgcaggtggcgcgggataatgcgcgtcttcttgttgtcgcgggccgcgttgcccgccagctccaggatctcggccgtcaggtactctagcacggctgccaggtacaccggggcgccggcgcccacgcgctccgagtagttgcctttgcggagcagccggtgcacgcggcccacggggaactgcaggccggcccgggaggagcgggtcttggccttggcgcgagccttgccaccctgcttgcctcttcctgacatggtagaacctagaatataagcctgctcagtaagtggtttgaaggcaaagctgacagtatttatagtcaatgcagggcatgaaaaagtaggaatttcattggttacatagaagcattgcacctagaccaataacagagttgcattgaaaagcccttgctatgattgggtatttggtggatgacgactgctaattcgcgatagctatagccacaagtttgtttaaaaggcagcctgtgcagacacactttacatttcttttctttctgtatctttaggcttttggtcagttcctaccatgcctgaacccgctaagtccgctcccgccccgaagaaggggtccaagaaggccgtcaccaaggcccagaagaaggacggcaagaagcgcaagcgcagccgcaaggagagctactcggtgtacgtgtacaaggtgctgaagcaagtgcaccccgacaccggcatctcctccaaggccatgggcatcatgaactcgttcgtgaacgacatcttcgagcgcatcgcgagcgaggcgtcccgcctggcgcattacaacaagcgctcgaccatcacatcccgggagatccagacggccgtgcgcctgctgctgcccggggagctggccaagcacgccgtgtcggagggcaccaaggctgtcaccaagtacaccagctccaagtgagttcctttaactcacactcctaacccaaaggctcttttcagagccacccacactttcaactaaaaaaggctgttgccctgtattcactttggggttcctctaactcactcctgaaacaaaggctctttttagagccactcactttattggaaggatgtgcactttgtgagataattgcttagaaatctaaagacttatggaaggtgtcaattccagaggttcatgactaga

SEQ ID NO: 21763 - DNA, 1661 bp, Mus musculus
agtctggagccaaccaggcactctagcctgtgttatttgctacagacacaaacaacgtttttgcacaaaccaaaagaactattagttctactcttgcacaaattaaaggcggcatctttgtacaaattctcttaagtaatgttccttgcatacttcgtaaaagttaacagaaatatgcaagtaactctcacgatgcgctctgcttggtggatttttttgtaaacactggaaggatttttaaaaatatttttagtcagttgcgcgtgattcaaaaaagcacacacaggtacgtgaaaccgaaggctgttctcccttggaactccaaactgccaatttctgtgttattattttcggcagtaagtaaaaatttggggactaacaaacacaatttgggattgtaaccttgagtcgccgcgggcagagggcggtggattggccgctccaccaatcacagcccagcaccggcttatataaaccaggagcctgagcaaaggagcatcgcaaaatttgctcttcgcgttagatttcttttagttttctcgcaactagcaagctttttgttctcgccatgtctgagactgctcccgctgagaccgcggctccggctcctgtagagaagtctcccgccaagaagaagacaacgaaaaaagctggcgcggcgaagcgcaaggccactggccccccggtgtccgagctcatcactaaggctgtttctgcctctaaggagcgcggcggcgtgtccctgcctgcccttaagaaggcactggctgctggtggctacgatgtggagaagaacaacagccgcatcaagcttgggctcaagagtctggtgagcaagggtaccctggtgcagaccaagggcaccggcgcctctggttccttcaagcttaacaagaaggcggcttctggcgaggccaagcccaaggctaagaagaccggggctgccaaggccaagaagcctgcaggtgctacccctaaaaagcctaagaagactgcgggggcaaagaagaccgtgaagaaaactccaaagaaagcgaagaagcctgcggcggctggagtgaagaaagttgccaagagtcctaagaaggccaaggctgctgccaagcctaaaaaagcagcaaagagcccggccaagcccaaggcggtgaagtctaaggcatccaaacctaaggttaccaagcctaagaccgctaagcctaaggctgccaaggccaagaaggctgtttccaaaaagaagtaggtttgcttgcgacagcaacaaagccccaaaggctcttttcagagccacctagagagctctgtgaatgtagctgtacacacttatgctttccatggtctgtctcgattgggacagttaactggaacccttatctgccacgattcctgtgctcacaatctacaaggtaagactccgttacgatggctgttaggtactatggtcacctggtgacctttgtacgtgagccataactgcacacattcatttccctacctccatgtgctagctggttgagcctgcgtgagtatggaagcactggtaacattaactttgttagggtgaagtgaggcttccacacagtagccaacgcagggcgcgaaaaagatcgaattcattggctgtatgctaaagtatcacctaaaccaatggtacggtgttttat

SEQ ID NO: 21764 - DNA, 1103 bp, Mus musculus
tgacctaccacagtccttgcctagcttgcccaaagccctgggtttgatcacggcctgctggcacactcctcctgtgccaacaaaagaggagcaaaagcagggggacctctaagcttgaggtcaacctggtcctggtgtacatgtagcatgtggtgggaccttcctgtaatctcagtactgtggagcaggaggctttccaaaacccccatgtaactacaccgtgtcccccccccacccccacccccgcctacccaccccccccacacacacacacacacaggtggctttcctttgcatatcaaggaaaagcaaagatttatttgtaacattggaggtaatcatgaaaaacgatttcttaaaatgtagaaaaagctttcagtattataatcgccataggccaaggaatctttaacgagtcagcataggtttatgctcttgaatagagaatgatccgaaatgatccttagggatctgctatcagtactgggatggctgagtggttaaggccttggactttagatccaatgggcggatgcctgcgtgggttcaaaccccactcccagtattagtgaccgtactgcttgactgtctgctgtggtgcttttggagtttatccaccccatgaaggagtattatttttgcatttatttacttacttttataatacatcctggtagcacgggctggcttccctatttccctagatctcccaagcatagggcaatagtggctccatcttcacaggcagtggtttgccagtgggtttcaacaacagtcttctcaggtttccaacatgaggaaaactaatccaccagtattggtttttctgagcttttaacattccaagaggattggccaaacccttgcacatgttgtctgtatggaaatgtactccggttctctgaactttgctgacccagaattccctgaatgaagaaaaggccaggacccttgatgggaccttgctaaattaaaatatttaataaaagttttactgttagcctttgccccattgttcctcagagggaacctatatccctatattagggtaactgtatattgagggaaagaagcaattgaactttctaggggctatttaatac

SEQ ID NO: 21765 - DNA, 1181 bp, Mus musculus
tagatattaaaaagatcagaaatactaatcacaaccaaagaactttctcttaaaatggctgcatatcgtagctggattgaaggagcgaccttccgttggcaaaggccttttgcggaagccagaggaaagaatcttgtctcatccatcgcagcgtcaaagccgcacctgcggctgtgtagttccaagtgagagccgcatctttggaagtctcaagcggagcaaagaaagccctttcttaggcgcggttcatctggtttaaggaaaaacaaaacaaaaactcaaaaaaaatttgaatgatacagcacttcttgaggctgaatcccaaacaagataagtcagtgcgattacttacttcaaaaattaaaggtcaaagaagagagaaagaatggaagggagggagggagggagggggggagggagggagggaggagggaggaagcaaagaagagaaaaagcaagcaaataagcaagccagccagccagctagccagccagcctgtctgagatcttttataagaagtaaggaaagccaacgctggcgacctggccggttagctcagttggttagagcgtggtgctaataacgccaaggtcgcgggttcgatccccgtacgggccagtaaactgcttagattttacaactggaaatgtaggactctgtcctctacagttctattctctctataaacacagttcatcccaccaaaccttattaagataccggaacttgaatgaagtgaagttgttcactcaccacttttgtcaaatatcattataaagcctttcagatcactttgtctgtctttctctagctggaatttccacatcactcattgcctatttgtactcattactggcacctggcttttcttcacttccactagacctggacatggtatgtttgttccgttattgttctagaatgctctcctatctgatagctccaaaccttgagcatcaccagtaagcatcatcccttttccttatttttgctttcatcttcatatcagcgagagtaataatttattccttgagaattgaagctctgggcaattctcatgttttaactgttagatcttaagtgctggcatataatagatagagtccatatgttttttgctgtatgaaggacaataggcacatatgcaggcaaaacacccataaaaataaaaataaaataa

SEQ ID NO: 21766 - DNA, 1237 bp, Mus musculus
caaacaaacaaacaaaactccaaaagaaacactagcccaagggttaaatctttctttatccgggttcagtgtgacaaaaggaaggagataacatttgtttagagaagttgttcaaagtgggtcacatttggaaccatgtctgtttttttaaactttaaaaattttttgtggtttagcccaagctaactgcttttcattatctcttgtagtctgcttgctttctcttgcttgcccagcaacaaacgttgtgtaaaagactgtttactgcagacagcgggcatttctttccagagtagaagtgcctcccgggctactgtcagctaataaatcgagactttcccattctctctcattgggtttgggcacagtgtccaggccattacaactgtaattctggttccctgtactgattgttttatgtttctctgtctgagggatagaaaaagagctgtgccgttaataagcagtcttcctgactccagctttgggctctttcctgtgtctgtgtgtccgtccgtccatctgtctgtctcttctttttgtcccagatcctcctcctggggactgtctagaacactgagacagctaatcaaactgttgttaccgagccgaaatagctcagttgggagagcgttagactgaagatctaaaggtccctggttcaatcccgggtttcggcaaaggttcattttgtttctcattcattgttccttttcctttgttaaagtccctgttgcataatttcactgttatcatagaaaaagactttcgatttttaaaaaatcattctccttttgaaaaaattggatattttctttatttacatctcaaatgttatcccctttcccagtccccccaccctgaccccgaaaatccttttgggtatacgaagctaagttgctcctcagtttccagtagtcccaagaatgaaaataagaaaaaaaaaaagtaatacagtgcatttattcgtttgaaagtagatttagtaaatgcatgtataagattcagggaagggagtagggttcaggggtagtctcatatgctaggctctgggttctgttcctaggaccatcttggtttcccgggtctcttcgtaccaagaagtaaagccacagcttttgctatggggtagcccaaacctatatgctaatgtgtgcgaaagttagaggctccgttcctcaataccgcaagtctctgaggatttactttgaaccaacttgaaagaaatatgagttat

SEQ ID NO: 21767 - DNA, 1227 bp, Mus musculus
tagcaaatttaacgtctataattagggtctccagaaataaaaggaagcagatgtgtgtcacagagacacactctctgaaatgatcctctgaagaaggtcagacaggagaagctactggtgtgcacaggactccgtcctttgtgcgcgctgcacaaaagaggaatggcgatcctcaggtttccttaaagagcgccagatcaggaagctctgcgatacagaattggcttttcaggtaagatgactgtggctcaggagggaaattcagggagcagggaagcgaccttggtaatttccagactgcggaggcaggcgggctctgcgtcttgtacctgatctagagatcagcatctggatccagcaggtgcgcaggaatgctgtgagtctgtccatcagctttcgccttccacaaaacccattgggtgaatgctggtcccagttgaaccggggaaaagtcacgtggacatttccagattcttgaatactctacaaaggaaggatgctttgtgcaccaggcgcgctcccgagcatccctctgtagagtgtgcacagcctttacagagaaagcatgctccagtggcgcaatcggttagcgcgcggtacttatacagcagtatatgtgcgggtgatgccgaggttgtgagttcgagcctcacctggagcatgttttcttccctttccgcctcaaacacgctaggaaatgcatttttccttccaagaaaacaagaaatggtaatattttccatggtgcgaacacataaagtccttcgataaagggcatctgatccatataaaatgtagaaataaaaccaggattcaagaggtataggttaaacctatacgccaatttctagaaaagcacaaagaggctcgtcctttccccttaccccactccatcacagaacaggattcttcagcttttgacgtctgagtccgtacctggtaacaccatcactggtcttatgttctgctatttttacaaggcttgtcgtgaggcctaaatctacaattgtgcttagtccagccttaccacctgttttagaaaagcctgccttgataacaacccctgtagtggagaggttgaggcaggaagattgccgggagctgacggccagtctgggatacaattcggagttcaaggccagcctgggatacagagtgagataaacttaatcatcccagttccatcccttgtcagcttgggtcgtataaacatctccataaaacata

SEQ ID NO: 21768 - DNA, 1187 bp, Mus musculus
aagtgtgtgtgtgtgtgtgtgtgtgtgtaaatatatgtatatatgaatataactcaatggtagagcatttgcctagctccgagttgaattctccgtacaccaagaaagaaaggaataatggaaaaaaaaaaaaaaatcatgagagcaattgcatgtcacagacttcctaaagcaaagcagtgtgggagtgtgagaaggaagtgacaattagactttctgaatgtatagggagaacggagcgtatcaaaagtccagtacccaggctgagaccaaagtggtatgagagggaggatctgtattctaaattttcagtcaaaagcaatataataccactgctaatgaagtatatgttcttagaaaggtttttggctttggctttcttaactagattgcaaagacacgttactctttttaggcgacaactttgaaagaaagcataaggtgaaccctagaaaaaagatacaaatttcagaaaatggatacaaaaggataaatcgaagtttatgccttgatatacaaatgggaaagccataccttatatagcagagtggcgcagcggaagcgtgctgggcccataacccagaggtcgatagatcgaaaccatcctctgctagtttgcattttccttccctttacattgccagtgaaatcttgtccaaagggtttgagagcaatcagaaaggaaaagaaatggtactggagaaacagaaaactgggcgatacagaaatcttcaactttttaaagaatcacgacaccacagaacaccacagtgtcttattttctctattgcaggttctgtgaccatctctgcctctcgtccataccttcttgactgtaaactaacactggagaggctctggctctggctcactctcatagcttgcactaggccctgaactcagtctggagtactagacccaaaaccagattttaaaaatgtaacaaatataccgaagcttggttagagcttcggggttaagtaagctttcagaaaactggcaagtctgaaagagcatggagaacgaaggactggaaccgcctgtccccgccacgacttcccgcgacttctgcaaagctggaaaaggagcaggagtgggtcataacctaagagctcctctgagggtctatcaccttgcacttggtcatcccctctcccgagataaatacatgataattgtgcaactca

SEQ ID NO: 21769 - DNA, 1192 bp, Mus musculus
cgccttactcagttcattccgttcatccatgtcagatatcacaggccttcagttcacatcccctttcccagatcgtcaaataaagttagggatatcaaaatctgtagaagagaagtgacaagagtatcaggatcagggtggaaaatgccaacgagaaggggcaataaagctgcgaatttcattgccagaaagagagagcgctaccggattggccgaagtgctactgggttcttagaactcttgcctcggattcaagaaatttcacatcatagcaccgactccggcactcggatccaggatatcctaactgcaaaccacagcctcccagggaagggctgtccaagtgtgtgtcacttccctactttcccctcctcctaccactctctccccacagtttcacttcttattttcagtaggttcaaaccttccattccagtaccctgggtacaactaggatctggctcattttcttaacaatcgattattccgacaggctagagcgtgtgtcaggatggccgagtggtctaaggcgccagactcaagcgttcgcttcctctactgagggttctggtctccgtgtggaggcgtgggttcgaatcccacttctgacacagttgctttttattattattatcatcttgcacctttcgtaatgaaatctctgttttgctgattgtatcagctaggaaagactttctttaattccgttttctgactttgagccatctagcttttttttttttttttaacacgatattttgacccgttgtttttctgtcttgtgcccttgaactcaagctaacccttttgcctcagctatctatacagctggaaatgtctttaatatgctttggtttcttagtgtttagttctgattattccttctggccatttgttacagttttgcacatgatcgattcaatcacataattcatcagttctgagttccttcttgtccgggtgtgtgtgtgtgtgtgtgtgtgtgtgtgttgcattctttcaattgacttccatttgattttaggcaacgctggctgatatgtgggggtgccccgctattttgtgggttttcgctctcttatttatagactgttccacccctctgtctgtccttcttaagtctcatttattttcttctgtcgttgtgctgttttggtgaagactgtgctaaacttcttttagattatgataa

SEQ ID NO: 21770 - DNA, 1064 bp, Mus musculus
aattaaaatcaatgtttgattaatgagtcagaagaaaagcagtatctagggctggggtaacgaaaggtacgctttatttttgttaagacgaaatatatatgtacaccatatagccaagttagtcccaagctgacaattgccttgtctcagtatcagtgctgggacacaggaatgagccaccacccgcggcctgacagtacttcattgtgaggtcgtctgggttctggtgagggaattgaagcctccagtcgtcggaagatgctgtcctaggacactttcactctccattacgaggctggacagagacttcagccttccgtattttcccttacacagcacaagattctgttcctttttgggcttttagagccttgcaaatctggcagccctttgctttttttttttttttttcaatctttcagctactgaaatttaccttcatagattttaagatatagctctattcatgtagtcgtggccgagtggttaaggcgatggactagaaatccattggggtctccccgcgcaggttcgaatcctgccgactacgggctcttttaaatctcaaacttgttgcatctacactgatctctattaagaggatttccaggtctggcgatgtatttcaggtctggctagtgtatcatgaggttcacttccattttctttctttttttttttttttaatgctgcaccttcgccgcagtctcttttcggtgaagctcacattctggtctagtctttatttcctgtcttacatgtttggttagaagcttcaggtactgcacggtttataatttcattttaggataggaactagtgcacaacaaaggctgaaacaaggacttttttttctttttctttggcctttcctattcctatcgaatactctcagagccagccgacccatcacgcaggcgcagcgatcgttgacttggcagcgaacgaagcaattccaggcttgggcgccggtcacatggcatataataaataccggaaacaatactgtactcagaggctaagggaacttcagaaacttccagtactgtccctgaactacttgc

SEQ ID NO: 21771 - DNA, 1134 bp, Mus musculus
taaatatttatcctcagtttttttttgtttgtttgtttgtttgtttgtttttaagtatgaggccaaaacaaagaaacaaacctaagatctcagtcgtttgtgagtcgagaactaagtaggacagataagtagggcggtaggggaaggttagcactcataccatgaatccagtaaagagagcgcggagttgaaggacagcagaaagattttcgttgtagggtggaaagcaagtgtagtacagagaaacgaggaggattgaggatagagaggtacaggtactacgatgggatcatcaaatgcgaaagtgtcctttcagaggaagaaaatgattgcatgtgagaattccttaagtagtcttttaggttggaaactggtagcaccacacggattacacattcaaaatttaagacggccatcaaaataagacttaaaaatgaagggaagaaaaaaattcccgtggcagagaggacgaggtggccgagtggttaaggcgatggactgctaatccattgtgctctgcacgcgtgggttcgaatcccaccttcgtcgtctccatattttaaattacccaaagcaatagtcggtgattcctatgctccacgtttttcaaattcaactccttgtgtatccatcacagaaaccacaacacttaccagctgtggaactttcaacaatcacagcacaccatttctcatctgctatgaaggctttgatttgtacctcactacagcaccactaacctagtgggagattgtattgtacctttctctactttcagcctcgatgtcacaggaaagtgcttgggaatcccctttgttttgtttcagtactagatggtagataaacacaagacttcacagcttctttaagttacttaacaggaacttcaagatttattttcaaaattccattaaaagtttccttttaactttatgcttagaagaaatttcaaatttatggacgatgttgtaagaaaaccacatatacttttatgagaatttacctacttgttctttctctcccacaggcccttgctttctggcttgctctgccctttcttgttctctctgttgctttttgaaacacacccaaccctggtgccaaaaacaaacaaacaaacaacaaaatagtaac

SEQ ID NO: 21772 - DNA, 1194 bp, Mus musculus
agtattcagtcgaacttcttttatattttaaagacagctctctaggtaaatccggaatgctgggatctaaaggcttgccaccacttctgactcagcttaattttcaactgcactctgggctttcaaattgctgcacgaattgagatcgtaaaacgtaaaatacttaactttgtgatgcacacctgtaattccagaactccaggaggctgaggcagaagaactgccagtcagggctacagaacgatactatttgtaaacataaaaatttaaagaaagaggtggggaaagaaggaagaagaggaaagagtggatttttgttttactctattattctgtcaacgggctggcagtaggggttgtttcatgtcagaggaaccaactgcgtgtgttagtaatggaaattgcaaggtgaaaagacgagtttctgtaacacaagtggtttaaattgttcaaatcaaacatttgttgaatttacttagcttgaaactagggctataattaatttaaggttacagctaataataactagagtagaacttcatccctgtggcgggccagtggcgcaatggataacgcgtctgactacggatcagaagattctaggttcgactcctggctggctcgaccatgtctctttttaatacaaaggagaaactttcttgtattcagatccgtaagaaaaacatattaagtcttgaaaatctgactcttactatatctttgtcttgtatgtcagtgaacagcatacaaacagaaaaggactatctatagacatcacccaatagggtatgtggaaaacactgtgttgaggaaaagaagtcagtactgcatgttgtaattaaaatgaattgtccagaccaccaaacctagagttaggatgtatcaccggttgccaggtgatggagaaagataattttgaagtcaggaaacaacgacggcgttgtaacacatgtacacgaaaaaccagtaaattgaacagtttaaaaggctgaacttttttgaaaatcagagtatcagaggaaaaaactaaaaattgatcaatattttattggctcatccgcaaccacccgtccccgcccggagccgggctccacagttggctatacttctgtctctgagcacttccgggagtggtgagagtagggacagagactgactcgagaaagcgggctgagaaacttacatatttgaaac

SEQ ID NO: 21773 - DNA, 1387 bp, Mus musculus
ccaagtggatctcgaagttcgagaccagcctgttctacaaagctactatcacattagatacattaaggcgactgtcacaagataaatgagaacagaaataacagcagtttaaatggttcacgtactaaaacactgtagaggttttttgtttttttgggttttttttttagctgtgtgattccattagtgatttttctcactatcttattgattcattaaaagatattccaagtatccgcaaataaagggagaatgacgagatctgcttcttttccacttacatcctatacagtctttttcttgtttaagaatgtgccacattaaaaggtggaagaaacttgttcttatataaaatgaatgagccgctaggctcctgggctgctgagcgcccctcccccgcccgcaggcacttccgcctgacgtttctgttttcactccggtccgcaagttccctataagagggaccggccttctccacaaagccatctgcttcgtcttagagcagtacaatcttgtcttcatcatgtctggtcgtggcaaaggaggaaaaggcctgggcaaaggcggcgccaagcgccaccgcaaagtgcttcgggacaacatccagggcatcaccaagcccgccatccgccgcctggcccggcgcggaggagtgaagcgcatctccggcctcatctacgaggagacccgcggtgtgctgaaggtgttcctggagaacgtgatccgcgacgccgtcacctacacggagcacgccaagcgcaagaccgtcaccgccatggacgtggtctacgcgctcaagcgccagggccgtactctgtacgggttcggcggttaagctgctcagtttcttccaatgctacttaaaggccctttttagggccaccacaaaatcaaaagagctaagttgcttttcagtgttctttttgtcctggaactctgtagaccaggctggccttgaactcagaagcctgtctgcctttgcttcccgagtgttgggattaaaggcgtgcgccacaagacctggccagtgttaagcttttgtagaactatttactgcagacttaggggaatcccaatagagccttctgcttgggacagaaggttaattttctcgggggatgaaaatagtgtatgaactcaaactagatgtttggtttggctggattgggctgtatggaggttctgtttacattaaaagtattctatgctaaccaatggaaaacagctggttttttacccttatcttgaaaattgcatcctcgttcagtccataattgggattacaaaggcaaaaccactgggtggttttgcacgcatttagttccagtaggcagacacaaggctgggctggtctatacagagaactacactgagaaactcctgtctt

SEQ ID NO: 21774 - DNA, 1187 bp, Mus musculus
gcctgggaaaagacgccagggatcaagtcctaataagaagaaaacagcggattctgagtactgtctactctaatccagcgaccacttttccaggaactagctccccggagatctgcggcgagtcaccggggtggaaatccgcacaggtcacgggctccagggggcgctgcgggcagcgaggcatggcccacctctgtctcgcccgcctagccacgcccaccaccgtcttctgcaccgccacatcctccgacctctactcggagggaccgcccaggatgctccttccggatgttcccgtccagatcacgacttttctgaatgcagcgaaagcacgcacatcccagttccttttgttgttgttttttgttgttggggtttttcgcccctcacattttcttcctttctaggtcattcctctacgcacaagccatatgtccacgactgctcccagtgagcactaccttgtggcccggcgcctctaaactctgaccgagccacgtggctccttctgcatgctctgacgaggtggccgagtggttaaggcgatggactgctaatccattgtgctctgcacgcgtgggttcgaatcccatcctcgtcggtctgggtcttttatttaagaatgaagatctatacgtaattgtaaattcaagtctagtcagagattttacatttaactatgaacccaattctcatttgcttctatcagcgtggtttcagcatattaagtcttactatgctctgtttggcttttaaccattgtgtttcgcttggtgtcacctgtgagcgaagtgtctggatgattgttttaatgcactttctcctggtgaattcgttcctgaccaccgtaagaaaaactaaaaaatcgaggtgagaacagagagaagagaaagaagggcaaggaaaggagacccagatgaagctgaagtccgttctttccctcactctattactttagtttcatttttggcattttcattaagtccctcttttagaaatcaacatgactacgagcactgaaaaatgaaagatcagagcgcgtacacacacgagaaccatcataccagactggaatcattactgcttagatactttgtacataatgaaacataggctgtattttcacatgtattttggaggatctactaagagtggctagcatcttgcaaattccattttctaatcat

SEQ ID NO: 21775 - DNA, 1162 bp, Mus musculus
gactatcaagttatggacaaattaagactggtaaaggaaaccctgtatggagtagtagaaacagaagaaggaaaactagtcctcccacgggaagaaggacacaagtatgttatcaacttggattacttgacccacttgggggccaagaaattaaaaggtgtggttaggtcctccaactactgttataggactctgacttggcagaagaaatagtcaaagctgcaaggcctgtgctatgactaatacgggacacttcgtatatactcctgagaagaagctcaggggcaactgattagaggcgtactgggaggtaaaatttacaaaaattaagccagctagatatggcaacaagtacttagtgtttatagacaccttttcaggctgggtagaagcttttccaaccaggactgagacagccaatatgatgaccaagaagatactagaagaaatcttcctgaggtttgagatgcccagataagtcagggactggccaagatattggagattgattagaagttacaggtagagagagtgaatagaaccattaagagacccttatcaaattgacagcggagactggcgctaatgattagatagctctcctaccctttgtgctcttcagggatagaaacacccttagacagtatagactgaccccccctataagttactctatggaggccccctccactggtaaaaatagcctctgtacatagtgctgacatgctgctttcccagcctttgttctctaggctcaaggcgctcaagtgggtgagacatcgagggaagaagcagctccagaaggcctgctccagaagacctagaagccccacatctagggcttccacgcagaaaaccttgagacttggtggaaaggcccttatcttgtactcttgaccaccctaatttctacccttatgggatcccttttgattttgcttctgcttttaattataggtccatgtgtgttaaataggcaagttgcctttattagaacaagagttagtgcagtgcggcttttagttttgagacaacagtaccatgccctaaaggatcaagcgtgtcagggagaagatagtgtctagttataagattataactactaacaactagaattgaagaatgaaaaattataacgtaaaaacaaaattctaggccttta

SEQ ID NO: 21776 - DNA, 1175 bp, Mus musculus
aactatctgggacctccagtttcttgaaggttatgctcatcatctcttgtagcctcccttagccttgaagcaggctgattcagactttgctgccactgaatatgagatcacctggggtgtagccttctgaatttgatggctatattgttatgtcaactaccactgctcttctctgagactctgctacctgctgagagacccttgagacattccagagacacatcctatcctgcacatccacctacaggctggctccaggcaccaagaatggattggtgggggatgggcctcccccccttataagcacattctcttagtaaactggcaggcagagaaaaatttgtcttggcttcattcttttctcgccatctagtctctctttcagccccagcctgccttccagaaatacctggttcatgtaggccatgagcctgcttactactttaacagattggcacctgaattgggggcctggaaacagtgggaaaacactgagggaccgctgtcttgtgtggagcgccacgagaagagaataatcagaagattgtattgggcacagtttgcaacaggtatttatgccagcactgtttgtttttgtttttgttttgtttttgtttttttttattaggtatttacttcatttacattaccaatgctatcccaaaagtcccccacacgctccccacccactctcccacccacccactcccacttcttggccctggcgttaccctgtactgaggcatatgaagtttgcacgaacaaggggcctctctttccactgatggccgactaggccatcttctgatacatatgcagctagagacacaagttccagggggtactggttagttcatattgttgttccacctataggattgcagatccctttagctccttgggtactttctctagctcctccattgggggccctgtgatccatccaatagctgactgtgaacatccacttctgtgtttgctaggccccagcatagtctcacaagagacagcactatctgggtcctttcagcaaaatattgctagtgtatgcaatggtgtcagcctttggaagctgattatgggatggatccccggatatggcagtttctgccatatccatcctttcatctcagctccaaactttgtctctgtaactccttccatgggtgttttgt

SEQ ID NO: 21777 - DNA, 1107 bp, Mus musculus
ctgaattgaatacctaggacattcactcagacaactttaatcctgttgcttttaacctttgactttgtatcttaagcagataggttgccttcacacaggatcaccttcagcaagctcagttagtcaccttagcagttactcatcactatgaagaaatgcattgagtgcatattcatatgtcctttgtggctttggtctgaacaggaaaagggtgtgcttatgagggtcagtcgtcagagaggggcagctggtttccttgagttcctatttacctaagacagagacaagtgccaaaaggccatgtttgtccaagcaaaaccaacacactgcactagttctcttgagactggtaagaagaagcaatacatagacccagacctaagacagacacagctacctagccaccgtatttccaagaagtgatcaagaaaaataagtaaatcttgtgccctcccccatcttcaaaaaataaaaaaggggggaattgtgcccttctcccagtcttgaataggctaaacaaacttggacaggtttataacctggctagagtcagtgcctggccttgccacattggtatttactacagagccttgaggagctgaccacctgctgagcttgttttgcaacacaatccaactgaaacaaagcaacaaaactcagctaaaaaaaggataggtctttgggttttccttacgtaaaagcagagctgaaaactaaactttgagccttcatttttgtctcttccagctgtcctattgcattcccagtctccctttcaggtgtacccagttctctgtgactactggacagttacaggaatatatctaccttaagactcagctataccactcttgggctaatacccaaaagatgccacaccatgccacaggggcaagagttccactatgttcacagtggctttatttgtgatggccagaagctgcaaacaactcagatgtcccacaatgaaagaatggatcataaaatgtggttcatttacacaaaggaatactacttagctattaagaatgaggacactatgagttttgcaggcaaatggatggaactggaaaatatcatcccaagtgaggtaactcaaactcaaaa

SEQ ID NO: 21778 - DNA, 1128 bp, Mus musculus
gaagcattttaatagagaaacaggacactgattttgaggatcctgactccaaagctaatgtccttcttcagtctattatcctgatactcgcagcaattaagcttcataatgacatttttttttcatttatttcagttctatcaaggaaagaaaaatacaatttaattccagagacaggattgcagtcaacacaatataaggtatattcttggtttggaatgcaggattcaaattgttagaaaagtagtccgcagattgacctgaagtttaaggataaatgtgtgtttccagtccagtggggtaactgattgtctttcacactctttggatagctcatgacccaagcatttgtcaaatggtcacttctcatttgctttctttgacttaaaagacttaattcaaatatatcaagttcctgtatatttgagactgtatagaattataattattttattgctaatcaataattgtcatggttttagtgtaagttctctagtgaactcctgaattccagggggtattagtgtttggagtcacaaaattattctggtgctaccttacctgtgactgtaagctctcgacctgataattgtttgataatcataatcctgaggccagtgaatttagctcagtaaagaatctggttcaagtatttttcctttttagaaaactgattgtgtcagttgttttgttcgattttgttggtttggtttggtttggtttggtttggttttctgagactgggtttttctgtatagccctggctgttctggaactagctatgttgaccaggctggcctcaaacttacagagctcctcctgcctctgcctccctagtgctaggattaaaggcatgcactacaaccacctgtctctgtgtcaaattttttgatctaatatgttccagtaattttataaataactttagtactatgaacaatttatccattgtgataaatacacatgagatgcatatttttctttttggggaaaatcatgccttatcactagtaaaagtttaaaattgtgatatttaatactgggtgtgtaacaatggcagtttacaaaagaaaaaaaaaaaggttattataatagaaacaccatggagaaagagacaaacttaaacca

SEQ ID NO: 21779 - DNA, 1146 bp, Mus musculus
gccaagtacgaaggcaacgcctgagagcagaggtcgcccaagcaaagagagagactgacttctatcttcgaaacgtagaacagggacaacacttccttgcagctgatggggatgctactcggccaaatagctcctggacattcacccagcgtcccactgagcaggagtttagggcccggaaagctgcacggccaggagggcgggaaagagcacggctggctaatgtcgaggaccaggcccgatccaacagagggctccttgccaagatctttggagcccctctacctgcagagagcaaggaaaaaccgtagtcaataagggactcctggtgatggaagaaatacctaccagccctgcgccattctgatctgcttcctgaagagtgtgaccatctaggcagatgttttctctattccacacaccaagagtctggtaaaggccttttgttggtgtcttttacctactttgaacaaatcctgtaagtgccagcctgagaaccttactcgtcctatccagggtgaagaccactggaggtgcctgttgtgttttgtttgatttctgattgcctgcctctttctcagtggacagctaacagtttctgactgaaagagtggacttgccctccactagggtagtggtctgtggtgtttgttcactgtggtggaaggctgaattagcaggaattggattagaggtccaatttgaggcttatatttgaaaataaaaaataatttatttttatatgctttttagtttttcattaagtaagtttcaacttcttttgaagccatacatgccgctcagttactttagcacaggcatgattctcctccacccatgaatctcagttactctatcagatatgatcccaatgctcctgtgttagtcagggttctgtagagtcacagaacttatgggtagtctctgtatagtaatggaatttgttgatggtttaccgactgtagtcttaactcccaacagtggtcaggagcacctgtgaatggaagtgcaagggtctagcagttgctcagtcccacaagacaagcaggtgaaggagggtcttccttcttccaatgtcattatgtaggtctccttagaagatgtggcccaggttaaaggtgtgtgccgccattcctggatctggga

SEQ ID NO: 21780 - DNA, 1188 bp, Mus musculus
ccagtctcagcacctcctttattaaaagtgagtgaaaatgtcagtggtaacatagacaaactaccatcctgaggcagagctattgcccacttcaaggaaacttgtgattctcctttttgaacaaggaaaaccccggggtaaacacaaatgcatgagacacaaaacttaagaggcctttgacaagtaggacaggagtagtccatactattttccacaattgtagtggagcaaataaatgaaacatgtcacacacacacacaaaatcaagcaaaaatgttaactttttcattttaagtgtgctgtcatgctcggccagcaaatacctatggtgccattcagtttcctgatcctaagacaaaaaaaatgaatctgttatgaaaaacaagaagccatccagggatattttcatggaatatgtgagttatgaaaagtttgaatattatgaattatgacatgtataaaaatgtttcttgcaaatgctaaaagactcagcgtcttccttcgatagctcagttggtagagcggaggactgtagactactaatgtggtgatccttaggtcgctggttcgaatccggctcgaaggaatgatcttttgaaacggtctcactatggtgggaatattaggactttcagagaatgcagtgaaccaatgtcacttgaaatactcaattgtaggatttagggtaaaataaacaaagctcaggtgctgtacacactatttttccacagctcttggaagatggagaagaaaggaaggtgctgcattcttcaaattgccaaaagcaattactttccacgaaattcagactgggtctgaaaatatgcctgtatatataaagatcgtctcaaattaaaggcctaaggtcctttataggaataaacttgactctccaaatatgaacttgtaaagattgttaattagtattaaagttcttattgtatttggggtgggggtgggggggttcgagtcagggtttgcttgcctctgcctcgagtgctgggattaaaggcgtgcgccaccacgcccggctcttattggatttttatactatcttttggtggtataaatgtcgattaaaaggcacctccttcgagccggattcgaaccagcgacctaaggatatcaacacctatactacagtcctccgctctaccaactgagctatcgaagggagatatatagcct

SEQ ID NO: 21781 - DNA, 1114 bp, Mus musculus
gcacaaggtcccagcaccgttgtttccgtgctctccgcgtcctggtccatttgtacgcacccctgtgcgattcccagaactggcggtaccgtctttcatttatagagggcgcaagtaaccccgggactgttccgtgacaaccaagccacaatctcactttttgctatgtaaaacaagatggcctcaaagagggggcaattctcctgccttaggacttctttcttccccttccctgcagttctgggattataaaacaccaaccctaactcaggaaactctttcttaaatactccattttactttctccacttcagtttttatcatcttgttcggattttattagacataaaaaaaatcatatcaacaaacacactaacaccccctccaccccacccccacccccaccccactcccactcccacaatttctgtttgatgagctgaaaataacagcgagcattgaattacatccagttatcaaaagggagtaaggtagcagccacttaccatcagaaggggaattagctcaaatggtagagcgctcgcttagcatgcgagaggtagcgggatcgatgcccgcattctccagttttgcatttatgcctgtttcttttcccatcataccctgctagaacaagaacaaccaaatccgttacttctaacctctatagttaaatttcagaagttctctcagcaacccggaagggcctagttcctaccacacactgttctccaggaaatggcttggagctctggagttggtatttcctgttttcctatcaagttctcacagctttccctttgttaacgcgcaaacgcgttccctttgttgagacagggaagcgtatatagcggtgtttggatctaggtcgtttgctttttttgtttcagttcagttaccggcactggaatatcccggaatacagcccaagatatggaaagaaatgtaggaccagctcttgtgggttggaacttactgtgccttgcagaaacgcctagtccaggactatctaatatattttatatccgaggcccaaacgttatctttaaagaaaaaaattgaactattttctatctttctgaaaattatttgcttagagaaaagttctgacaca

SEQ ID NO: 21782 - DNA, 1224 bp, Mus musculus
tctcccctttcacagttctacaggatacagaaaaattctgagctctagaaaagtatccttaaacaacacctcaacagctcttcatattcaaaagagtgtgtatgaaaaatttaaactcattttatgaagatggccatcacttataaaagataataacaacatcgaggttctaagtagccaaggtcaattttgaacttctaatcttcctgcttgtatctcccagttgctggaattacagggtgttacttcccagttgaaatatcatacacaaacccacaagtatatgtgaatataaacatatatttatgtacatatatgtatatacacatattttcatgtatatgtatatattatataatttatatattatataattttaggatgcctttccctaaaaatgatatgagcgttatatttggtacattaaatatggcaaaacatggcaatgtatttttgagctagggatacagttaagttgatagattcctttcccaacatctaaagagcaggtgtgtcatcgtccggaatccttacatgggaggaggaggcaagataagtatgcatagcagttcccacatggtctagcggttaggattcctggttttcacccaggcggcccgggttcgactcccggtgtgggaaactcattgttttacgaatgatcctagtacttgataaaggacttcaaagtgttcttaaagctgtagagtttgagacactatgtcagctcctttcttaacggagcaaggaaaatacctaaataaatgagaaaggcaatatgtgtattatacacagtagtctaaggtgtaggaatttctttataagcacatgatgttttatcattaacaaagcatttttcacttatctagttccttgttgcaaattcttgctggatttagctttctggtttcacagtaggaaaaactgagtgggagatttgcttgatttggatcactaacagggagggaaattagagctcaatgtattctttccttatgatctcagacagggagaagaagacaacatgagtaatatgagtaaaaccattttggaggtggataaagaactttagcaacggaccacactctgttagggtgtcaatccttaggcattaaaccacgaagctgttcagagcatctaagatgctcaccacaaccttacgtaaacgtgaaaatacgtttggatttggagaatgaacacgatgattctccccaaagtgagagt

SEQ ID NO: 21783 - DNA, 1195 bp, Mus musculus
ctctaattccattggtagatcacgaattcaacaaatcattaaatcctaaaaccagaagggtaggtagtcaatgtgtgatatacgttaagatgtagaacactgaacacagattactgcacttgtagtcgtggccgagtggttaaggcgatggactagaaatccattggggtctccccgcgcaggttcgaatcctgccgactacgattgtgggtttttgtggtttccaagtgtacttcaaagtaaacaatttatctcggagattttataaatgacatcaatgacttctccatttctctaaattagatataaacttactggttggtattcatttaaaatagaaaataactgctataacataatgaagtttctgtttagtgtttcacaggtgttttttttagttttttttaatgaataaattgtaaagtaaattaacttaaagacagtaaaacttcagctctagttttgcacctttgaaatgaaataaaaagtatttcccaagtgtaaccctaagacctcagcataatactgtcacttcctctttctatatgaacacaaacctataggtgggccagtggcgcaatggataacgcgtctgactacggatcagaagattccaggttcgactcctggctggctcggtacttttttgtagaattctcaagtttctcctgtattgaatttctgtatattacttttatatttcactttattgttttaaaattttcaccttacacaaattaaatataggctagaatttaactttgccactcttctttcatacaaatcggttttatgaaagcacatcactctttacctacaatacatgactgtgactcacactctccttaaggtcttcccttaatatcaaacctcatctacagaaataaatactctactctcaagacctctgccatttcccacttccctcttttattgctactattgctattttatatataccagagatgcgctcagtatgttttatgttaaaaaaaaaaaaaaaagctctagcagaggatggtttcgatccatcgacctctgggttatgggcccagcacgcttccgctgcgccactctgctcctctagacaggctttcttaattaccttttggtatttctctgttccgtttttgtttttggttttttttgtttgtttgtttaattggttggttggttggttagttggttggttggt

SEQ ID NO: 21784 - DNA, 1149 bp, Mus musculus
ctttgatatattcaaatctggtttggattggctcatttcaccggctgagaaataacgtatcatgtgcagtctaggcacaagaagcgggaaaataaaaccaaaggcgggtagagaacatattttccagagtggtttgtggatatctagggtcatgagatttcaaattcaagatttctttgcctcaaattctttaagcgactcgatacaaggatggaaacataaatttaagaaagctcgggtgtgccagactaaaacatgagtgtagcagtctgtactagcaggagactgtgtgcaggagttaaccaatcgggtgtgcaggagttaaccaatcaccacttgaattcctcagccaatagtactactgcgcgggacacttgaaaagcagacacgcctatcaggatgcttctcggtgggaaggaggggtacgagcgcgggtacgtgtgttgcgcgtgtgcgaacgcaagcgtacttaaaggccaaagtgcgctacttaggtatctcacttttccctacggttacttgccatggctcgtactaagcagaccgctcgcaagtctaccggcggcaaggccccgcgcaagcagctggccaccaaggccgcccgcaagagcgccccggccaccggcggcgtgaagaagcctcaccgctaccgtcccggcactgtggcgctgcgcgagatccggcgctaccagaagtcgaccgagctgctgatccgcaagctgccgttccagcgcctggtgcgcgagatcgcgcaggacttcaagaccgacctgcgcttccagagctcggccgtcatggctctgcaggaggcctgtgaggcctacctcgtgggtctgtttgaggacaccaacctgtgcgccatccacgccaagcgtgtcaccatcatgcccaaggacatccagctggcccgtcgcatccgcggggagagggcttaagggtttctgttaatccacacaaccactttaaaggctcttcttagagccacccatcttccaaaaaaagaactgtagcgctttttccaacttgtgggtattaatcagtttcatttgtgaaagtgctaggtctcctttcatcacaccgatctattataagcaagcaatattttggtaagtgatatctttaccctttttcatggaaattgtactctta

SEQ ID NO: 21785 - DNA, 1186 bp, Mus musculus
tagacaatttcaaaacaggaaaccaactttacatgtagctagaatttatatatgaattttgtatctagggagagatttttattgatactactaacaaaataacttttaaaagaaaaatggctttgactttagtacagtatcaaaccaactttttcctaaaaactatttcgtctagttttcatagagtctattggctaaacttggccaatcagaagaaagaaacgagtcttcatttgaatagagccctgtaaagttcggtccgcttctccgtgatacttacgcaactaaccactgagcgaatatgcttcctttgattggacagttagtgcttgacgtttgcagactctctgacaaggacagccaccgctttatttaaagagcaggaaaggaacggaacagttcaatatctcttttcttggcctaccttcattctctgttcactatgcctgagcccgccaagtccgctcctgccccgaagaagggctccaagaaggccctgaccaaggcccagaagaaggacggcaagaagcgcaagcgcagccgcaaggagagctactcggtgtacgtgtacaaggtgctgaagcaagtgcaccccgacaccggcatctcctccaaagccatgggcatcatgaactcgttcgtgaacgacatcttcgagcgcatcgcgggcgaggcgtcccgcctggcgcattacaacaagcgctcgaccatcacgtcccgggagatccagacggccgtgcgcctgctgctgcccggggagctggccaagcacgccgtgtcggagggcaccaaggctgtcaccaagtacaccagctccaagtgagtgctcaagactcagctcttaacccaaaggctcttttcagagccactcaagacttcaaaattggagctttaatgctgacttagtgactaccgggaaaataactgacttcatctgcaggattgtgtacaaacacttatggtttagtaaatcaaaagatagacattgcccatcagttctgtctggtccacttaaatatgctttttcttagaagttctaagaaccctgtcatacctatctaggtccagtccttgagtttcaaaaggccaaatacccaaatgtttcagttttccagttcagggaagtaaatctgcatggtttgccactgtactggctagttttgtctcaacttgacacagctggagt

SEQ ID NO: 21786 - DNA, 1160 bp, Mus musculus
ttttggtccggatagtaaactgctcccttacatctccttaaatataaagtaaggaaaaagaaaaaactcagttcgggtaaccaagttcaacaagtaatccttggggccgctgtggtatcgccaaaatctacatagtatctcttattaaaatgttttgacgaaaatgtaacaattacggtacttaatggtaacaatgtggctgaggaagcaatagttaacaaagaggagtaagccaggtaataaaccagatttctattggtcacaaatttgaagttgagacctgttatccaattaccaagtacttccgcatacatcataggcatttgaagatttcaaccaatcaggagcatgttccttctataaaaggaacccagaacctaacctctgcatttcctatttctttgtagaaatggctcgtactaagcagaccgctcgcaagtccactggcggcaaggccccgcgcaagcagctggccaccaaggccgcccgcaagagcgccccggccaccggcggcgtgaagaaacctcaccgctaccgtcccggcaccgtggcgctgcgcgagatccggcgctaccagaagtcgaccgagctgctgatccgcaagctgccgttccagcgcctggtgcgcgagatcgcgcaggacttcaagaccgacctgcgcttccagagctcggccgtcatggctctgcaggaggcgagcgaggcctaccttgtgggtctgtttgaggacaccaacctgtgcgccatccacgccaagcgtgtcaccatcatgcccaaggacatccagctggcccgccgtatccgcggcgagcgggcttaataggcacgctttctacactggcacgtaaaccaaaacggctcttttaagagccacctccattatccaccaaagatgctgtagtacaagtttgtagagtgttccagggtttcctattatagcctttcttgacaatgatgagcaccacccgacgaagcagtctgagctgcctgtttttggaaacaaggctttcaggatatcatttcatcttgtatgctttcaactagagttggggtagccattttaagccagaaacaggtacgcacttcagtttgggattgtgttacaatccacacagtaaaagtccaacagagttaacgttttactttgtttcaccattcaa

SEQ ID NO: 21787 - DNA, 1117 bp, Mus musculus
ctcctgaaggacacaaactagtgactaagaactccaagagaaaagcggaaaactcatattcccctcgccacaggggctgtgccttccgcctagcaataggattcagccagtgagttagaggggcggatacagaatcaccttcccgcccgcgccttttcagtcctctaaaaggtccgcattcgccatatatataccagctgtagagggcgcttaaggaatttcaactcagtgctccatagccatgtctggtcgtggtaagggaggaaaaggcctgggcaaaggcggcgctaagcgccaccgtaaggttcttcgcgataacatccagggcatcaccaagcccgccatccgccgcctggcccggcgcggaggagtgaagcgcatctccggtctcatctacgaggaaacccgcggtgtgctgaaggtgttcctggagaacgtgatccgcgacgccgtcacctacacggagcacgccaagcgcaagaccgtcaccgccatggacgtggtctacgcgctcaagcgccagggccgcaccctctacggattcggcggttaagctcacctggagcttctttctcaaaggcccttttcagggccacccactttgtcataaaaagctgtttgcatttctcgacttgtaattgttctgtccctaaagttcaaaatggcggctgagacttttcaaaaggtaaatctaggcaatgaaagtgcttccccagtagtttgtagtaattataacacatcaaatccagacaaggtctactgctttctcccagtgcttaagctgagtcttattcccttgaaggtgctaaatacaaagggcaaaagatacttttgaagagatgatgaacaaaattcttaggcctaaagagctgttttaacctgtgtgctctttcccctgtatccttgattacaaccctaacgtttcacttctgggctaaagctcaaggctgccagctcttcctgacaacgttgctccagagggaaaactccattactagttaacagactggttcatattttttaagtggccttattacttagcaacttagacttgttaccctgctatgagccaggctttccacattgagaaggattcgactactaaatggcttgttga

SEQ ID NO: 21788 - DNA, 1216 bp, Mus musculus
ctacaataatcattcccccggtatgcactgctttcccatctagtgccaattcctacagcttggtgcagatagccctggaagcttgtgttgttgctttctcgaaaaactcaaatttccctatgtatttccgtgaaaacaagttatttcatagagtcctgaaatgataagaatgtgaggaaccatgtcctgaaacaaaagtttgctaatgaccgcgagagaagtagtatttttaaggaaaaccttaaagttgtcccaattttcgtcaagtttgaaagagagttggggcaatcagagaagtttcagggtgccgattttgaacataggtgcacaaattaaggcaagaatgtagcctacaggctctcggatcagtttcccccaagtccctaattatttcgtgcccatattttttatatttttatacttttttgaggggcaacaaacacagccacaaggcaaagctgaagatcctttctctggcaacgcggcgcacggcgcacggcgcagggaaccaatcaccacgcagcttctctctatataaacccagagcctgcagcactgggaacaaccttctctgactgtttgtgcttactttttgctttactagtaaagcttagaacatgtccgagaccgctcccgcggcgcctgctgcccctgcacctgtggagaagacacctgtgaagaagaaggcgaagaagaccggcgccgctgctgggaagcgcaaggcgtccggacccccggtgtccgagctcatcaccaaggctgtggccgcctccaaggagcgcagcggcgtgtccctggctgcgctcaagaaggcgctggcggccgcggggtacgatgtggagaagaacaacagccgcatcaagctcgggctgaagagcctggtgagcaagggtaccctggtgcagaccaagggcaccggcgcctccggctccttcaaactcaacaagaaggcggcttccggtgaggctaagcccaaggctaagaaggcaggcgcggccaaggccaagaagcctgcgggagcagccaagaagcctaagaaggcgactggtgctgccacacccaaaaagacggccaagaagactccgaagaaggcgaagaagcctgcggcggctgccggcgccaagaaagtttccaagagtcccaagaaggtgaaggctgctaagcccaagaaggcagcaaagagtccagccaaggccaaggctcccaaggctaaggc

SEQ ID NO: 21789 - DNA, 1101 bp, Mus musculus
cgatgcgctcgaagatgtcgttcacgaacgagttcatgatgcccatggccttggaggagatgccggtgtcggggtgcacttgcttcagcaccttgtacacgtacaccgagtagctctccttgcggctgcgcttgcgcttcttgccgtccttcttctgggccttggtcacggccttcttggagcccttcttcggggcaggagcggacttcgcaggctcgggcatggtagaaacaagcaacaaagagaaagataaaacaggaaatgagatgtgggagaagcttcgttcttgccattttatagaggttctatgcaaataagggactcaaaagtagtcaactctgatttgaaggccagttagtgacaccattacccaaattagattgtattgtacctctttccttattggctgcagaggaaagatagttttaaccaatcacacatcagcttttccacttccatgtacgagtataagtagcttctcgtctggccttttagtaccgcttcgttgtaattctttgcaattataatttcctaccttcttgcgtcaatgtctggacgtggcaaacagggtggcaaggctcgcgccaaggccaagacccgctcctcccgggccggcctgcagtttcccgtgggccgcgtgcaccggctgctccgcaaaggcaactactcggagcgcgtgggcgccggcgccccggtgtacctggcggccgtgctggagtacctgacggccgagatcctggagctggcgggcaacgcggcccgcgacaacaagaagacgcgcatcatcccgcgccacctgcagctggccatccgcaacgacgaggagctcaacaagctgctgggccgcgtgaccatcgcgcagggcggcgtcctgcccaacatccaggccgtgctgctgcccaagaagaccgagagccaccacaaggccaaggggaaataagatctttcttctaatctcgtaaaaaaaacaaaggctcttttcagagccattcacttaattcagtaaagtgctgaaatactataagccttaagtggatttaggactaaaatttccgatttgtattcaatggcataagaaaattcaacctgtcaattgtcccc

SEQ ID NO: 21790 - DNA, 1179 bp, Mus musculus
gcggatggccagctgcaggtggcgcgggatgatgcgcgtcttcttgttgtcgcgggccgcgttgcccgccagctccaggatctcggccgtcaggtactccagcacggccgccaggtacaccggggcgccggcgcccacgcgctccgagtagttgcctttgcggagcagccggtgcacgcggcccacgggaaactgcaggccggcccgggaggagcgggtcttggccttggcgcgagccttgccaccctgtttgccacgtccagacattgacgcaagaaggtaggaaattataattgcaaagaattacaacgaagcggtactaaaaggccagacgagaagctacttatactcgtacatggaagtggaaaagctgatgtgtgattggttaaaactatctttcctctgcagccaataaggaaagaggtacaatacaatctaatttgggtaatggtgtcactaactggccttcaaatcagagttgactacttttgagtcccttatttgcatagaacctctataaaatggcaagaacgaagcttctcccacatctcatttcctgttttatctttctctttgttgcttgtttctaccatgcccgagcctgcgaagtccgctcctgccccgaagaagggctccaagaaggccgtgaccaaggcccagaagaaggacggcaagaagcgcaagcgcagccgcaaggagagctactcggtgtacgtgtacaaggtgctgaagcaagtgcaccccgacaccggcatctcctccaaggccatgggcatcatgaactcgttcgtgaacgacatcttcgagcgcatcgcgggcgaggcgtcccgcctggcgcattacaacaagcgctcgaccatcacgtcccgggagatccagacggccgtgcgcctgctgctgcccggggagctggccaagcacgccgtgtcggagggcaccaaggctgtcactaagtacaccagctccaagtgagttcatttaactcacactcctaacccaaaggctcttttcagagccacccatactgtcactttaagtgctttgtaatgcttggcttttgtattataacgctgggaaatgacacaatattagctaagtgtatgttagtgtgaagaatatgtttgcctcagtgtaaccaacgcgctgccagatacactatcaatttgtaaactacacagt

SEQ ID NO: 21791 - DNA, 1464 bp, Mus musculus
tcaataaaaagtctcagaacaggaaatagtaagtgttcttaaaattgtacttaaaaccttggattcagtggtcctaaaccttcctgatgctgggaccctttactacagcacctcatgttgtggttaccctcacccataaagttatttcactgctgcttaactgtaattttgatactgttatgaattgtaatgtaaatatctgaaataatacggggggtgtcccgatttataggttcacgagactaataacattactttctatttggtctgataaaagacaaatttcttttttcacaatacataaattgtcactcttgagggcaatgtgttgaattttcaactgctggctctgctcttgtcttaggacccgccttgtctcctcagccttttcataggataaacgccagaagggcgggaattgaccatggttcacgcccccttcccttcaggttttcaaacaggtccgcattggtattataaaagccaggaaggccgcttgttacagtcactggctagtgagcttccttcctagtttgctaacatgtctggacgcgggaaaggcggcaagggtcttggtaagggtggtgctaagcgccaccgcaaagttctgcgcgacaacatccagggcatcaccaagcccgccatccgccgcctggcccggcgcggaggagtgaagcgcatctccggcctcatctacgaggagacccgtggtgtgctgaaggtgttcctggagaacgtgatccgcgacgccgtcacctacacggagcacgccaagcgcaagaccgtcaccgccatggacgttgtctacgcgctcaagcgccagggtcgcaccctctacggattcggcggctaaacgtactcatttatttttcttcacccaaaaaccaaaggcccttttcagggccactaccttctcacttaaaggagctgctcttaggtggttttctggaatggggtgggtgctgggactggctcgatacatagtatctgtttaggcaggtccacctgtctatcttcagtattgatagcctaaaagcaggcctgttgtctcattctttaatgctgacattctcaggagagggctgagggtcagtcaagatccttttttccaagtcccttaaggtatagatgctatcctgtctcaaaaccaaaccctctaatcaatccaggccttggaaacctaggaacactgaattatgttcaagttttctaacctggagctttctacaatttcttcccctccctcctttcattctttccatgtattctgtgtaatagccctggcctggaacttactctatacaccaggctcacagatatcttcctacctctgcctcccacgtactgggattaaaatcgtggtccaccacacccagctttctctaacttcctaatctgtaaaataagcaccagagattgacgtgtaaatcttctatctattcctcaaggaaaacttcatatggt

SEQ ID NO: 21792 - DNA, 1157 bp, Mus musculus
ctgtttattcttttcaaacaagacgtcttatctctgtgtctctctaacttttgacatctgtaagatttactcccaaccgtttactttcactctatgatttcctttctgtagactaaattgcactgccttggggactccgggaagcttggaggtcgactggatcttttctgatcttccttttcctttactgaaccgaaagatcaaagttttaaaatacagtttttccaggaacgtttcgatggtttcagaatatttggtattaaattgagcccaagctttaacttctggaatttcaaaatagagcaacttctgtttttaaaaatatatatacaatttaatctaaagcgtttagaaagaaaccaatttgattaaggagtgttaagaagcacagtcgcttgaacattattatacaagattactgcttgaccaatgggaccgtcctttgtaacctctaaccaatcaaacagaatgaaagtaagacttaatttgcataagactgcctacaaataaggaaaccgttcacagcagctcactttctttttcttcctaagaaagagatctgaagatgcctgagccagccaagtccgctcccgccccgaagaagggctccaagaaggctgtcaccaaggcccagaagaaggacggcaagaagcgcaagcgcagccgcaaggagagctactcggtgtacgtgtacaaggtgctgaagcaagtgcaccccgacaccggcatctcctccaaggccatgggcatcatgaactcgttcgtgaacgacatcttcgagcgcatcgcgggcgaggcgtcccgcctggcgcattacaacaagcgctcgaccatcacatcccgggagatccagacggccgtgcgcctgctgctgcccggggagctggccaagcacgcggtgtcggagggcaccaaggctgtcaccaagtacaccagctccaagtgagttcatttaactcacactcctaaaccaaaggctcttttcagagccacccaacagttcaaaattgagctatgcgcttgttcttagtacccgcagtaccacctttatatggttctttatttactgggacaaagttcctctagtctattcaggctcgtcaaatcaagtatttaagataaaactgccaaattggctacttctgcagtgaagagag

SEQ ID NO: 21793 - DNA, 1410 bp, Mus musculus
aggcaggactctcggaggagcctgtgttacttccttcacttaagtgcagatttgtaataaaaatcataatgccaaaggcaaggttttgggctacacaagaagctaaccacttggagaatcgtctttgatgggtcagaaaactgtacagtccaagatcagtttataatttacgaagaaaatagaaagttttgtttctctgagttgaaatttgctgaacaccgcaggaaatattgcaagtttttggcagaaggcttaatgctttgctcactttttgagatgtgcatgaagcccgagacttcggggaacattattttttaaaaatcgggcaattcgatgtagggaattttgacatttttggctttttttgaggtgtaacaaacacaactccgcatctgagaggacactccgcggctgccagcgaggcgggctggacagcgcaccaatcacggcgcagctccgccctatataaacgggcgggcgcagcgccgcggcccgagtcctggccagtccctctgcttccggctcgagttctctctcctcacacgcttcgccatgtccgagaccgcgcctgctgcgcccgccgcaccggcccccgccgagaagacacccgtcaagaagaaggcccgcaaggccgcaggtggcgcgaagcgcaaaacctccggacccccggtgtccgaactcatcaccaaggctgtggccgcctccaaggagcgcagcggcgtgtccctggctgcgctcaagaaggcgctggcggccgcggggtacgatgtggagaagaacaacagccgcatcaagctcggcctgaagagcctggtgagcaagggtaccctggtgcagaccaagggcaccggcgcctccggctccttcaaactcaacaagaaggcggcttccggtgaggctaagcccaaagcaaaaagggcaggcgcggccaaggcgaagaagcctgcgggcgcagccaagaagcccaagaaggctgcggggacagccaccgccaagaagagcaccaagaagactccaaagaaagcgaagaagccagctgcagctgcaggagccaaaaaagctaagagcccgaagaaggcaaaggcaactaaggctaagaaggcgcccaagagccctgccaaggcgaaaacggtaaagcctaaagcggccaaaccaaaaacctccaagcctaaggcagctaagccaaagaaaaccgcagccaagaaaaagtaaattttctttggccaactgcttagaagcccaacaacccaaaggctcttttcagagccacccacaactctcagtaaaagagctgttgcacattcacagggggtgtggttagggtgggaacaaaccttagtgggctgagcttagcagaggaggctggggatatgtgggtgtgcgcaatggtgttaactctagcttagctat

SEQ ID NO: 21794 - DNA, 1158 bp, Mus musculus
gtggcgcgggatgatgcgcgtcttcttgttgtcgcgggccgcgttgcccgccagctccaggatctcggccgtcaggtactccagcacggccgccaggtagaccggggcgccggcgcccacgcgctccgagtagttacccttgcggagcagccggtgcacgcggcccacggggaactgcaggccggcccgggaggagcgggtcttggccttggcgcgagccttgccgccctgcttaccacgtccagacatagtaatagtgctgtgtaagtaacagaacagtaaaaacaagttaccaagactgtacagacgcggcagcttttatagtaggttcctgggtagtaaacgctactacttgattggttacaagtgagctcattgatatagccaatagaaaatctgcttctggaaacttcatttgcataatcccacccatgaacccactactttttcttcttccaattagctgagactggttcgaaatccttcattagcataaacgccctataagtaggagaagtccgttcccagcccacactgaggttcctgtgtttggaaatccgaagatgcctgagcctgcgaagtccgctcccgccccgaagaagggctccaagaaggccgtgaccaaggcccagaagaaggacggcaagaagcgcaagcgcagccgcaaggagagctactcggtgtacgtgtacaaggtgctgaagcaagtgcaccccgacaccggcatctcctccaaggccatgggcatcatgaactcgttcgtgaacgacatcttcgagcgcatcgcgggcgaggcgtcccgcctggcgcattacaacaagcgctcgaccatcacgtcccgggagatccagacggccgtgcgcctgctgctgcccggggagctggccaagcacgcggtgtcggagggcaccaaggccgtcaccaagtacaccagctccaagtgatcctgccaagtaagcctccgtagcgaattccaaaggctcttttcagagccacccactttctcaaagagagagctgtggtagaacagtgcgttcagttttacccagaagcagatgacaggtgcttataaatcttaaaggcagtgggatacttttagcttaatttcagtcttggttacatttagctacaaccattttgttgggagaaaaaaaaaaa

SEQ ID NO: 21795 - DNA, 1192 bp, Mus musculus
aaaaaaaaacaaaacaaaaaacaaacaacaacaaaacccctaacagttgagagtcccagactgatttcctcctggcattgtatgtgatcttccccaggaaaatagcaccctatgcacttgacatccgtttggtttctctgacccttgttcacacacaaaatttctaggtcattaactatcagtggcatctaagcatcagggagatctttacagattcgcagaatatattcttctattgctttaaaagtaacatggaatgcatttagtgaagatttaggtgctataatttaaaatccagaaaacaaaaaagcttggattcatattttgtcccaggcagctgaaaataagcattaagaaaaaaaattacatgcacaaagctgtccaggtttgtcttttgtttcccagtatagtcaaggctacccttcagctcccagtcttcttgcccaaggctcctcagtcagtcatggagttacaagtcaccacattgcctcctctctctctctctctctctctctctctctctctctctctctctctctccttttctctttgaacaacagtcctagggactgagaataggccttccacacacacacacacatgtgctgtagctccatcctgcacattccacttcaattgctccatctaatgttttcccttcaagtcaaaaaaagaaaaaaaaaagtgaaaatttataaagatttgtgatttgtactttctaatattccacaaaaaaatagaggctcaaaataactaaaaacacaaacaatcacataggtatgaatacataaatcatgatttctaagcatgagcctagttacttaaaattattcttatgacgtgatataacatgacgcattttttttgctttacatgacatttattatatatacatcatatatatccatacatgacaaacacttaaaagcattcttttgctaggagcatcttaattttgcagcaagtattctcattttctacgtctgtgtgtctttcttatcacaaatttctacagtgaacatttttatagaatttaaaatggtgcttctcagttgttccttgagttctgaaactatggtggttaatctgctagtatcacccatttgcactgtcttgaggttacagcatccagcactgttgagtggtacaaacgatgtcaggtctgctcctcctgtagagagggagagagaga

SEQ ID NO: 21796 - DNA, 1450 bp, Mus musculus
attaggtctctgactcgagatagggaatatgaagtttgcagttagggtgctcaatttgagatgccttttcaatgtttatgtctacccaaacaaaactgccgggaatagattaaactttactgacatgggacagtcttggcatattttacctctgttttggacatctaacctgagtcctcacaaagaaaccatcaactaatttaatacaagacagaaataaaagcaaacgagaaatggggatgtctgctttgtggaatggccccaataagcctttctttcatgagaaagaatggggtcggggtggggaggagggaatgaagtttttctgcaggatttaaatgtggtctttaagagacaccgcatgcaaagaatagctggggcttgctagccaatgaaaacattcagattccaatgacgcatccttttttctccacccccttccaagacccggattcggaaaccccgcctaacgctctagttttcaaccaggtccgcagaaggcctatttaaagggacgattgctgtctccctgctgtcataaccatgtctggacgtggtaagggtggtaaaggccttgggaaaggcggcgctaagcgccaccgtaaggttctccgtgataacatccagggcattaccaagcccgccatccgccgcctggcccggcgcgggggagtgaagcgcatctccggcctcatctacgaggagacccgcggtgtgctgaaggtgttcctggagaacgtgatccgcgacgccgtcacctacacggagcacgccaagcgcaagaccgtcaccgccatggacgtggtctacgcgctcaagcgccagggccgcactctctacggattcggcggttaatcgactaacaaacgatttccactgtcaacaaaaggcccttttcagggccacccacaaattcctaggagttgttcacttaccgaagctttaatcgagcctgctaggtagtttaagtgttattctgtcctatacttatgtggtgggtagtaattatgccatgcagccgaatataccctgtaggtttaactgggtaatataacaagcccataattttgaactgtcagaagttaatactgaacgaactgttttagaattatttgaaggttttccactgatcgtgtcacttctcaatccacttttgataccggtcatttaagagcttattcccttctggagccatctagaagctcaggagagagcaggaaccattgtatctaagcaaggcaaaggctgattactacagaaactgaagacgcttagctgttattaattgtataccattaataaggcctaagtacacataatctatattagggaccacctaatggtatgtttatatacagtttagttgtgcagtggcttgataatttaaattcttgtgggtgtgccatgtttgccatctgccacaagagggcggcgttatttccaggaagtt

SEQ ID NO: 21797 - DNA, 1107 bp, Mus musculus
attaaccaatgggagaaacacaaacagaatacctccagttagtataaatgcttgctgttcagttgcagaatttactatatattcttttcctttctctgctttgcctttactgatacttaaacgcatacatgtctggacgcggaaagcagggtggcaaggcccgcgctaaggccaagacccgctcctcccgggccggcctgcagttccccgtaggccgcgtgcatcggctgctccgcaagggcaactactcggagcgcgtgggcgccggcgccccggtgtacctggcggccgtgctggagtacctgacggccgagatcctggagctggcgggcaacgcggcccgcgacaacaagaagacgcgcatcatcccgcgccacctgcagctggccatccgcaacgacgaggagctcaacaagctgctgggccgcgtgaccatcgcgcagggcggcgtcctgcccaacatccaggccgtgctgctgcccaagaagaccgagagccaccacaaggccaaggggaagtaatctggcgattgtctgtactgcccagttgaaagttaaccaaaacaaaggctcttttcagagccacccacatctttccataaaatgagctgccacctcgtgaaacgttcttccactacagtttttatactacatatgaaaaagttacgaagtagctttcaatcttagtaaattgattttaatactgttagtccctgcgataaatcttacgaccttccttagtttgagtcaaaagtgtgtaagagatgaaacctttagaacatactatataaatttttagtagaaatttggcacccaggtttgtcattcacgtcacgattgtctagagcataatggtagtaagggctaagggccattaaatcccacttccatagtttcggcagtattttaactaacatgatctgcctgtgtgtatcggtttgcaaatatttgattttagaattgataaactacatttatttaaactaggtcttgcaaagctcacaaaacctactttaaatttctatgttcacttgtttgattacctgaattgagttttcaaagcttgagacaatttgatgtatgtatgtaagtaaaattatgtaaaact

SEQ ID NO: 21798 - DNA, 1328 bp, Mus musculus
tccagacagggaatagccaagtgcatctatatgactaggcaaaggggcttgacctatgttgacaagtagaattttaataaattctacttataccgattctatttcaatttctattaaaaaaattctcttgtaatttatttttaaaagtatctttcacatttgaatttttaggttttaagaaacaataatcacatggtcttttggcacctgttgaattttttaaaaagatgttttaaacctaaatactttacaggggtatttgttttaatcctccaggtactggtccataaaaatgtaactccttgctaaaatccttatagaacaatataacatataataaaagcagtatactcaaatctggggaaacctgagagactccatgtctgcatgtgccctatacagtactccagagtcaccgccctgaaatgggctgagcaaaagaagcctttggtccccgcccacttgaagttctcaaccaggtccgataagagcctataataacacagcgaattcttagttcaccagcttcctactgaaagcttgtaagaatttaactatgtctggtcgcggcaagggaggaaaaggcctgggcaaaggtggcgctaagcgccatcgcaaagtgctgcgcgacaacatccagggcatcaccaagcccgccatccgccgcctggcccggcgcgggggagtgaagcgcatctccggcctcatctacgaggagacccgcggtgtgctgaaggtgttcctggagaacgtgatccgcgacgccgtcacctacacggagcacgccaagcgcaagaccgtcaccgccatggacgtggtctacgcgctcaagcgccagggccgcaccctctacggattcgggggttaagggactaaagcgattttcttaactgttacaaaaggtccttttcaggaccactcactgaattccttaaaaagctgtgcattttgctccctcacccttcccccacactggcagcggccctcactaatagcttcagctttaactcaggctgtggatagtcagcatagttgagattccccacccccacccctccaggctgaatttgtgcacaaagtacagcctcaccttgtacaaattgttaaaagtaggacacttcaaggctcttttctcaggattggttcaaggacggttaaacagtcttgaaaacctggaattttggggaaaggtgttagaacctctaggttcaacgactcattaccaccgcctgaaaataaccttgggtaggtgaacaaaggtaaccatccagatgagaatttactaaagaaacaggctcatcgggtcctggaggtaaaaacaattgagt

SEQ ID NO: 21799 - DNA, 1376 bp, Mus musculus
gtctgtgatgtcacttttcccgccgtccggctttcggggcggggctgatgggcgagatatgtgacatcactttcccgccggcgcgctttctggtcgtgactgaggggcggaatttgtgaagtcactttcccgccggcgggcttttgcgtctttcccggcatggctgagaggagggatcagtgatgtcgctttcccgccggcgcgctttcgggtcttggctgaggggcggggtttgtgatgtcattttcccgccggcgcgctttcggggcatggttgatgggagggatttgtgacgtcactttcccgcccgggcgctttcggttctttcccgccaggtcttattggcggggtttatgacgtcaccgtccggcgggcgggttttcgtttgtgtgattctgttgggggtgggagatcaaggccaagcagctatataaaggaccgactctcagctctgactccattttccattcttcctaagacatgtcgggtcgcggcaagggaggaaaaggcctgggcaaaggcggcgctaagcgccaccgtaaggttctccgcgataacatccagggcatcaccaagcccgccatccgccgcctggcccggcgcgggggagtgaagcgcatctccggcctcatctacgaggagacccgcggtgtgctgaaggtgttcctggagaacgtgatccgcgacgccgtcacctacacggagcacgccaagcgcaagaccgtcaccgccatggacgtggtctacgcgctcaagcgccagggccgcaccctctacggattcggcggctaagacttttttaatttgtattttctaaccaaaggcccttctcagggccgcccacattccctgaaaaagcgctgtaatactgaaccacctaacagcttgggcatctcagaatatagagaaattgagtaaataaaccttgagtgcctttggagaattgtaaggtcaagtttgcaccattttcttggaaaagaaatactgccttattaagtgtgcgcagctaaactctgttccttgaggaaagcctgagtgagggataggaaagcagttaagcatggttctcatctaaccacattaaaaacgtctgtaagtccgggcggggttcaagtaaagtccatgtaaggcagaactaaacattcctcataattctcaaccatttgccctgagatgtggcctttttgccaacaatgcaatggcaaaaattgttttttgttttgttttgtttctctttctcagaacaggcagagtcccagcggattcatgtcttaacatggtgattacacaactaagataaatggcattgtatttgagaactctaatgccgtgtaagtatagtagcttccatttcatgaccccctttacagcttcac

SEQ ID NO: 21800 - DNA, 1396 bp, Mus musculus
ccacctttcactagttgagctcctttttgataggcatctaccactttctgatgataaaacaggagagtacaaggagaatctgctgtggttgaaattccacctcaagcagccagccggagaagttttgaggccgcctcctctacctgcaaaaacacgaagctaggtcggtggaatcgcaaaggagttagtttctgaaatcttgcaggcagacaggcgcacgggaggcggggccttagggtccagggggcgggcgttagcattcaccaatcacagcacagcactgctctataaatactccgtgcaggggccttgtctttctacttcttttcttcgtcttgggtatagctgttgtttattcatcagcaaccatgtcggagacggcgccagtcgctcaggctgcttctactgccacggagaaacctgctgctgcaaagaagaccaagaagccggcaaaagctgccgctcctcggaagaagcccgcgggaccttcggtgtcggagctcatcgtgcaggcagtttcttcttccaaagagcgcagtggcgtgtccttggccgcgctcaagaagtcgctggctgcggcgggatacgatgtggagaagaacaacagccgcatcaaactggggctgaaaagcctggtgaataaaggcacactggtgcagaccaagggcaccggcgctgctggctcttttaagctgaacaagaaggctgagtccaaggccatcaccaccaaggtgtcagtgaaggcgaaagcatccggggctgctaagaaacctaagaagactgctggggctgcagctaagaagactgtcaagactccgaagaagcccaagaagcctgcagtttccaagaagacttccaagagccccaagaagccgaaggtggtgaaggccaagaaggtagccaaaagccctgccaaggcgaaggcagtgaagcctaaggcttccaaggcgaaagtgacaaagccaaagaccccagctaagcccaagaaggcagcgcccaagaaaaagtgaacagttggaggcttcttctataaataacccaacggctcttttcagagccaccaacataactcaaagagcctgacacttgtttcacactataacaactgcatttgggtacaagcctggtgggatttaggcattattaatttcccccagtaaactgacaatttgggtcagtctagtttctagttttatttccctgagattctgggaaaacagccttgttagccctgggaggcgctaccctctccaggtgtggtggataagctctctatggtatggtagtgcaatggcctgggtgcctcaaccagataaggtcctattttgccaatgaggatgagaactcaggtgcttgatcagtaagagtgggctgcagcaagggttcacatgcaata

SEQ ID NO: 21801 - DNA, 1211 bp, Mus musculus
ttttgcaaacagtgcctgagaaagttttttccctgtgttcaagaaaaattctttttaacagtgttacagatctattcagatgtttaaaataatgcttaaattcaaagagttttgcttctagtgaactggtaattactaaaaaaaattttgcctctaggtatggctaatgtaactttacattatgtaagaaaaatttttattgtttctgcttctatacaagaagccaagagttttaatctttcagtgtatattgtttcctaagtgaaaagtattttattaactaatgcttcttgaagtttaccttaaatccttgctctcacccaaaagattcagagacaatatccttttattacttagggttttagtttactacaaaagtttttacaaaaaataaagaaagcttttataattgttattaattggtaattaaaaattggttgtgcccaaaacaattctttggccagaaaaaacattattgtaaagtcatttttctcatcctcccagccgatcgttggcccacgtgggcccaactagcttctgtgggacaaagtcttaagacacagtttcccctgttccagcacagatgatctagttgcgtgctgtagatggtgttttaaaatgctgaacaatcaaaccttaatttgtatattaatagtcaatgccatatctctgagctcgcaattgcttaaattgttcatccctcagatactattaattctcaaatttacaattgcttatacatatttctagttaataaataaattatgcacatgtgactcttaataactttgcaagccttctagttacaaccgctccctaagaaaattgattgaaagtgcaattagtcactgcccctttacagccaagtatttaaaatatttggtcaactagttattaattcaaaagtttaggtattgtgaaattttaaaaatttaacttcttaaaagacaaaaaagagaaaaattgtatccccgtacatactatttagtgcattcccatgcacactatttaagtcttacctttattttcaaaatttaatattttaatgtcaaaaagtttaataaatgctttatagtatcttaaagagatctacttattggcttatagattgatcctaaaacagctaccttattagaaaagggaaaaacaggttttctccacaaaacgctgcagaagcatattagtaaattcgtgtcacgagctggtaggta

SEQ ID NO: 21802 - DNA, 1169 bp, Mus musculus
ctgcctcccctccccaaaagataccgagagccacaggtgtgggtcttaacaacatccacgggaagaatcgggtcaatgtccacccaagccaaggttaaaagcccactcatctacggatgaaaaaatcatttgatcacctcagttaagcgttgccttattttaattaatagggaggagagagattggagaccgtactgtcttcactgcctcccaccccaaaataaaaaagccatttggccttgtactacagagccggtcgaaccccttctccctgtttcccacctatcatccaaaaatgcggaggaatatcaacttagtgttattcttattatagtgtatttcacatttgttcagtcaaacttagccagagttccaacgccctacttaaaattcaactagaaagttacctaccaagtactaattagcattataaagtcagagcctacagctccaggcttttcagttagttgtttactaaaataagaaaggacagtcttagccagatacagtttaccataagaaaagttaaaaaatcccacgaaagcaagttttttctttagccctagattccaggcagaactattgagcatagacaatttttcccccctcaggccagctttttctttttttaagttttgttaataaaagggaggaaatgtagtctcccctcccccagcctgaaacctgcttgctcaggggtggagcttcctgctcattcgttctgccacgcccactgctggaacctgcggagccacacacgtgcacctttctactggaccagagattatttggcgggaatcgggtcccctcccccttccttcataactagtgtcgcaacaataaaatttgagccttgatcagaataaatgtcttggctacattcctttctctcgccacctagcccctcttctcttccaggtttccaaaatgcctttccaggctagaacccaggttgtggtctgctggctggacacaacatatactggctagttttgtgtcaacttgacacagctggacttatcacagagaaaggagcttcagttgaggaaatgcctccatgagatgcaactgtaaggcattttctcaattagtgatcaagggggaaaggcccctgtgggtgagaccatctctgggctagtagtcttggttctataagagagcaggatatg

SEQ ID NO: 21803 - DNA, 3208 bp, Mus musculus
gggcggagggagtggcgggagacccttgccacgccttaggactttccatattgataaataggggaaatgtgtgttctcaaacacccctaggaaaagaagtatcttactgaaagcctaatttcaaagctactcactatttataccgacttttatatgtcacacattactagcttttcggtttttctgtctccataactgtgaaaaccttcacgcttcttttcccgcctcccccttcagtttttgccacagatggtagcgtccggggcgcgcgcaggcgtagagcgctcggggcggtgccgcggaggggcgggtgacgcagcagccgtcgctgccattttaagttgtttgttcttgtttcttttcctcaaacgcgactcagccccggacccgggaggttccagcggcagccgctgcttctgaagccactccggtgcggggggtgggggaaccgaggctgtggccccgcggacgctcgacctcctcctccgttgcggctctctccccccatccgtcggggctctctcttggactatcttcctgaaccggactgttgggcgaagcaggcctcgggagccgacgctcgaaccgagacaactttgccgggctcactccgcggacaggccgtagcgcagggctcccctccttccctcttccctcccgcgcgctttcctcttcctcgccgtctcccccctccccctaccaaccccgcgccgcgtccttccctccgtcgccgcccggggcgccgagcccgactatggggcccaggtgggggctgagtggcggcagcagcgcgcgtggcccggccacagagcgcagcgcagcgggcatggaggggctccgtcggcccgtcgtgttctcttgacatggctcccgcccgcgccacgagcagcgcccccgccgccgccgccgcctcctcctccgcagccgccgctccgcccgcaggctgcggctagacggcccaccgacggtcggcctgcgagtcccgctctcctctccgcggggaccccgccctgccgcctagatcccggcctctctgtccccttgggaaaccacccagccgcccccactcgggaaacatgggctgttgaacgggaaaagcgaatctagaacccgggaacttcattccttgcttttttttggggtgggagggtgggcttccttttaagaagtaattattattaacacgattattctcttcttttcccctcctcccaactgatccttcctacttaactctcttcccgcctcctctacccgggcgggaattgtttccacattgaaatgagtgagaacccgagtgatccagtgtctcccgtggtgcgagtgagtcgctgccgctgaaggccaggggttgtgggtgggacctgggggtcgaaggcaggtgatccccgggcccggcctgggacgtgggagaacccgccaccttagcctcagccatgctcacacgaagataatcgaactccctaccatcccgaacttgaacggggtcaaatttatacggagggctccccggggaatgtagaacccaccgcagggctaagggtgcttggatcccgggcattaatcagggctaatcacagagccggaataactattaataccgtttaatagacccccctttccctctgccatcatggttctccttggcagcagcgttcgcagccgcctgagggtgaaaacgtgggtgatggggaagttggtaatgactccgctgttttttctcatgactcctttgggcaacagctgtccacccccggtatacactgtagttgattgcagggaaaccctgtacctctccccttctttctctgctgattttgcacttttctctttgctcaccaccaagtgtaatcaatagcaaagcactgacagttcatagcagtagtgaaatctgaaataactaagaattaatcaggtactacagccatggatctggctgggtaaaatccaactggggatttcagtttcattcacctaccctgttttggtggttttcagtttttgggttttttgttttggggggggtattttttttttccctgtatttgggaagcaacatcacaattttccctcccttttctcaatttcttaatcccttttctgaaaagggactatgcgaatgggtttcaaggattggaccggtgtcagctgtgttttactgcgcacctaaatcctgatgatcggtttttcattttcccctcaatggcttttattttggcagtttagccacatgtgttttccagaaagttagttccaagtttttttctcctctttctttccttccccttcaccttccccatctaacccccaaacattattgtccaaacatgactggacagcaacttttgtttcttgaccctgtggtatgacagtctgctaatattgttagaaggtgcagtttgggggttacagttgtgatttagctattcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtacattgcctttgtgttcaaggagaaggtaatttaaagttcttactgtgaattagtacaagtgggtttgtaagtgtgtattatttgatacttcagtgttttataaatattaggtttaagagtgtttggagtaagactactgctttttactgctggggttagtctgtgaatagagaccttagagaaaatggagggctcatcatattgactgaaataattctaagggcttagtagaatacacttttagttgacattggactgtataactgaaacttttatgtagaacaaaagggaactttagtaaagttacataggatgtctccatgtaggtgacatttcttaagatatagttaatgaaggaatacatttaaacttcagaagcagctaaaaactgaaatggtaaatttttgtttagaattgctatttttttaacgttaaaaatcaagaggatgttgggtgtgtgtttatgatctagttccatagttaaatattagatgaatttgagtgaaaggcaaacagaattcaatgaaagcagtattgttttgcaattcaagatggacattt

SEQ ID NO: 21804 - DNA, 2148 bp, Mus musculus
aagatgttattttcacattttctgttttttgtgtgtgtgcttgttttttaacatgatggcaaaattgttaagatggattagtgttgtgatgtaggttctcggaatacaagctctaagtgatgacactagatagatttttccataagatgcattctatagtgttatgctttgtagtatagagttagattggtcatgaacacttaaataacttggagacacaatttgttttttaccttttattaaacattggtaattgtagtcagataatatccagaaatattgactatcattgaacttgactccatttcaagaataaaattgttaatttgtttgaatatttgcatgttttaaactcgtgagatttttattgcctgtagaaccagttaaatcaagttatatcaacagtgtatcactgaattttttcttttagaagaaaaagtcagcactttttgaagtgtctgaggttataccagtcatgacaaataattacgaagaaaatattctgaaaggtgtgcgagattccagctattccttggaaagttcgctagagcttctacagaaggatgtggtgcagctccacgcccctcggtaccagtctatgagaagggtaagcctgggaggctgcactgaggaaatgagttggtgtgaattaaagtgtgcattttcctcctgaaaatcctgagttagctagccttatgcttcaaggctgcagatgtgtaatgtttttgtctcaagacaaagtaaaagacacggataaagcatgtagaagcacccatcactccctgttaggtacttagtattataaataaaacagtttgtaagtacctttaagtgcttttttaaaagattgatttctaataatagccttggtcacttgacttagatggaatgacaatgatgtatgtgattactatgattggtctctttttgaggggagaatatcatgccccattgtaataagaaaatctaaagaaaatatattactgctaaccttcaaaactgtattacattgaagttaatttggtgtatactccaaaattagttgaagcagtggaaacatggagctaactatactagtctggaagaagttcattggccttaaggaacagataatgttatgtgatgtttggaagataagtggagaaaagtagccagcaacacatgaaactatgctgtgtaataaacttggtttgtatacgtttggagacgttttagccagattacatttggttttgaaagatgaaaataaaggcatattcactaataacgttagctccctagctagagtttaggcacatactgaggaatgtttctgcgtgagaaatattggctaagtgactggactctacagtgtaaaagttagtactacggctggaattaggttgtgtgcagtctgttaccctgaaggtacgaagcgctaatgcacgactctagttgagccatgtttttgtaccttttgtactttgcttctttaacttttaaaagaaaagtctttgctctcgttttctaggatgtaatcggctgtactcaggagatggatttcattctttggcctcggaatgatattgagaaaatcgtttgtctcctgttttctaggtggaaggaatctgacgaaccttttaggcctgttcaggtttgttttaaataaagtagcgagcactttggtgacaatacctataataggacttaagttggagtctttgggaatacgcttctaatagttcataaatcttttctgtctttttaaatattatattagaaaaaaacattagaattctagaatctcttagtgtctctggttttaaatgaactttattaaaatcttttagactttttttctttgacaaagtctcatgttgtctagattgacctagaattgcctttgtacccctggtgaccttgaacctcctgatcctgctggctccatgcctggtttacttagctgaacatggaacccaggcctcctgtatcagaggcagtcactcagtcacagagccccaactctagtcctctttgctgacttgtagctatagttttctacagtgtatactcagattttagaattagaaaaacagtgatggctcaaccattaaaggctaggctcacaaccaataataataatatgtttgagcctattttaattaggta

SEQ ID NO: 21805 - DNA, 1816 bp, Mus musculus
acaggacagttctgttgacttcccaggtgtagtattttaatcttaaatatgcacaaatttatgcataaattatcagcatttatttcaaactactctttctcatatcctgcataggtaatgaactacatatctcttgccttattacagtcttatagccgtaagtcttaaattactgacagtttaaaactattaaaattattaaaaatgtgtttctctctagactccaaaaaacaaagccaccatcttcaagttatgcagcatctgcctctacctgccacaggaacagctcacccactgggcagttggcaccatagaggatcacctccgtccttacatgccagagtaaataagagcattgaccagcaaaatggagaagaccagagaatgcagcagctattttcttttcttgttttcttaccacttttctttcagagtttaaagaaaatggactcatgcacagaacactatgcattttgaaacttgttcatcctggatttattttaatcatttgtatcacagaactttaaaaaaaattagatgtcttctgcacggactgtgtgaaagaaggtgcattgcacattgctgcactgcatcggcatcttactaaaatgtgaaggaaggactattgtacactgaaatgcttactgtatctgaaagcacaggtgatgctcagtgttgtggtcttcatgtttgtgctggtgtttgcctctgacatctgtcatcagtattgagggtgagggtgaatgtagcaggtataagtgacacttaaaaccttaatagctttgctatgatcaccgttgttccagagcactgtcagattccttataatgaccaggtggttgttacaaaaagaaattacaaccacgggaaagaaatcttaatgaaaaaaagcatctcattgaggcatttctgcctcgtgtgcactgggccatgtttgttttcttggtactcattagtacacgtattttttcccagatctctttccccgagttgctgttatagagtactctgctgtgtgcagatgcatttatacacattaaagcagatctggagtctggtgtggccaacgcagctacaaaaccgagaaacattcatagctgcaaaaaccatcataagtagaggacttttggtttttgttttgttttttggtgttagaaattttaattacaaataaaaatccagtgaattttgcagaaatactggtttctacaccatcctaaagaagttgagtgtttgggatagaaaacgaaagtggggaatattacattgtaaaaataactgcagagtgaagagttctgaaagcagaacttgtttgtgcaatgaacataaggaaagactactgtatagcttttactttttttgtttttgttttttgtttttgtttttttcttttaaatgaagaaaagctttgcttaagggttgcatacttttattggagtaaatcggaatgattctactcttttggagtaaaactagtgcttactggtttccatttgtatttagcttctggttggaatttgaaaaaaaaaaaaaaagggaaagaaacctaaataaaataggtgaaagcttcccggctactcagatggatgtataaaaatagcagtgataaggtttttttttttttttttttttaatcccatgtctggtcacttaaggttgttttatcagaagaatttgatagaacattttgaaggtttgtgttgcagctatcattctgtcaaagtttggagtagaagtagatatacatttggagagatttgcccaagatcgtataaatagaggatttaagtcatcagtctggatccagaggccagtg

SEQ ID NO: 21806 - DNA, 1166 bp, Mus musculus
gctgggaattgaacatgggtcttctagagcagccagtcctcttagcttctgggacatctctccagtccactccttgtagttcttctgtcattttggagttgaataaagtatgctgataagctatagacatccagatacttcccttaggaagctaagcagattaaatgaaagctagaggtaagtgttcagtggtttcaaatatgaaataggaaactttttaaaaaggcatggaaatcccatttttatgtgaaaagaaacccatggataaatgaaggatgggtcaggtagagccccatgcagcccagccgtttgaatctggtaccaaaattatttgtaggttgctacacaggaaagctggtaggactgtcacaatctttcaacagttccttaccactaactatacttaaacctgttttctctcaaggtacatgtcacctgctaagataggagaagaaatagtgatcacagcacacattctgaagcaaggaaagacacttgcatttgcctcagtggatctgaccaacaagaccacaggaaaattaatagcacaaggcagacacacaaaacacctggggaactgagaacagcgggaagacccgaagaagcccaacaatgccaagtatggtttgtgaacaactttctgaaataaattatcaaaaccagaagtagctaaggaagtattttctttggaggggggaaaaaaaaccctaagaaaccaaaatgaaactaatatgaaagttagggagggggttgtttcttctgaaacagaagtctgactgttcaggaattatgtagaccaggctggcctggaactcagagagctgccttcctctgtctgtctctgagtgctggaactaaaggcatgcaccacaacacatgtataggtgggtgtatctttttcttttgaagcatcttgtttaggtgacgtgcctgatgattggatgaagtagttctcggctcagagttttgagttttggtttttgagcctggctttatagcaccaggatggccttgagctcagtcttctgccccagcctcctgagtgttgggattatagggaggaaccacctttgtgcctggctagtttgctttgggttgtataggtttggggttttgttttgttttgttttttgatttattcaaattccacaccatgcaccccagtc

SEQ ID NO: 21807 - DNA, 1136 bp, Mus musculus
acctgcgtctgccagtcgttctcccgcaggacgctggggaccatcgtggggtcgcatccccccaccaacgcaaagcccaggcactgaagccgccgcctcttcacccggtcctcctccgcctgtgctgcttcgggcgccgacgccgcccgccctgccggccctgcgggctccgccgcatcggaactgctgccagacgccatcgccgcagggtcccctcaaaacacccgctcttcacgctgcttcccgcgcgactgatcgcgaacgccggaacctgcgcaggcgcgcagcgtgcaagcgcgtccgcgtcaaccttccggcaagaagaccgccctctctggtccccgtccgcggccagcgaggcgcagatggggagggggagggggaggggaggggaaggaggggccgaggaggcctgaaggttgcgcgtgcgcgctggggcgctaaagagtgaaggtaacccgtgatcatctaggaccagggcgaccggggcgcgcgatcctttctcccgagcacgacgcgacagcggccgggcttgcagacttgaccttccacacccttgtcctctcacaaacgtctcttccagagttcattctcgcagagcccagactcttgctttgcgtccacgatgagcagcatgacccagaacctacgagaagtaatgaaggttatgttcaaagttcccggttttgatagagttttggaaaaggtatatttattgtaggcgaagtatctggtgaaggggacgaacctagtaaaacaccttagtggcctcgcaaacgcaggggaagtgcgtggcgtggattctcatcgaaacgtaaataagcatgtttggttttttgttttttgttttttttttaaccagcaaactgttggagtgtgtggagaaaaaatgtcagcgtaccatttaagggacgctggagcctgcagggctagtatataggaattgtttcttaagagtcaaggaggtttgaggtacggaagtgaatgcgagaaccacctgtacgtgtgttgtatttcttgcttttgagactaggtctttgtaactaggtctatgtaactatgtaacgtttgttggctgagaacccttgtagtccaggctggcctgggagtctacagagttaaccaggaccagtgcc

SEQ ID NO: 21808 - DNA, 1327 bp, Mus musculus
tttaaattgggggcagggagtaagtatataaacctttcataatattctttctcttgccaggttatcaaatgtggtggtttacctgacaacgtttttgatgcctgggaatttttaggcaaacctaaacattgccagtatacatgggatacgaaagcaaataacaacctcaggatccctgctgcttataagcatcgttttgatcgaatatttttcagagcagaagaggggcaccttattcctcaaagtttagaccttgttgggttggaaaaactggactgtggtagatttccgagtgatcactgggggctcttgtgcaccttgaatgtagtattgtgaaaagcttcccacttgcagctttacacgtttgttagcactagttctgaatttgtgtaggtctcaacctttcaggacatctgggtctaatacagaagaattaataaactggatgattactacagcaaaagcagctaacgttttactttgtatcttgtgtcctcagaattaagaactggtgtttgtaataaatcaaagcatgcttatgtcagaatgtgtgggctttggtttaaaggacataacctctccgcttgtgacaaagtcattgttgccatcaggatttcaagtaatgggcgtatctcagggctaactattgtttgaattaggcaccaatatattttaaatcattttattaagagaaaaagtaagccattgaactcttgagactgcattgtcttatattctgtaagttcagaaatgtaagtgaaaaagccgtgaccaaccgtagtaaagtagatgacagctgttgtatatcagacttaattttgtcagctgatagtatatagtgactgatgagtcagtcacagttccactgactcccagttactgttctgattagtggtagttatttgctgggaactgacaaagttcatcttggcaatgattaaacccagcttagcaacgtgagaattatttttttttttctaagaagaaaattcagaagaaaagtaactgagttttgttactggtaaaatggaaatacttcacagagtgaataaagaatacttttttttttgtaaatgttctgtaaagaaaaaatgtacagtaaataaagtgttttatttgtagactgactacgacttttttcttcatggtgggatttgttgctctactgccattgggaaagcagccctgcatgttacttttcagtgggaatcaccaaatgtgttttgttatattaaattcctgacattttggaggctggggcaggaggattgtcattaatgtaaggctagccaggactgacaaaataaggaaatttagaatgaagtga

SEQ ID NO: 21809 - DNA, 1197 bp, Mus musculus
tcaggacaaggtacagagtgaatgttcacataccctctggcacctcacaaagtatagtcattgtgtgggcggggggggggggtccccagtccttatgggaccgtgcaactttggttcagaacgcagggaaagggacgaggtaataggacagctaggttaggaggaggtgcgcatccctgcctaggcacctgtcagcgttgatgatcagctggctgcctgttccagggggttgtggcaaaggctttgggttcctaagacttctttataaaacgcacagacttcctgtgctctgtggaatgagggggtgtttctccttgtttctgggctgctgtttaaattactgggagcagaattgctttgggtttgttttgttttgtcttgctttctttggtttatcctggtttggtttggctttatgcgacagggtcttgctaagtagcctagctggctttcaaactcacaggtctcctctatcagcctccgaagtgctagggtcccaggcatgctctaccacagctgggtaaatggaagtctccaatgccctaaactttaaacttacggctcatgcttcattttgttcctcgtagaaaatcaacctaaactggaggcaaaaatcagcagagtcgggttggtaggatggaaaacatggctttgtttcttctccagagctgggtgttgagtccatggccttgtgcatactagcgtgtgttctgccactgagctatcgctagctcttttttctttaattttaatttttgagacagggtcttgataagtcacactggttggccttgagctccttattgtcctgcctcagcatcctccatagctgggtgacagaccaggccaatggacagcaggggctcccagctgcctcctactgccttaggtatgctgtttagggctctgtgccccatgtgtagagattcatgcttggcttaaaggactttgtgagcctggaagggaaaaaaaatgcttcacaaaatggtggaaatgcagctcaactccaggaaccattttgattacaagcagtacctcgctgccccctccttgaactcaggaggtgacttcgtggaggaaagaaaccaggtgcctccttgttcacctgaataagtctgacccaggctttctgtgccagggtgtggccactgctaaccctgcagaagagcaaatacattttaaccactgtgaaaaatt

SEQ ID NO: 21810 - DNA, 2775 bp, Mus musculus
agtctgctgcaggttgtgaaacattgtagtaatggcaaatcttcacaacagttcaatttgatcttggggaatagccaaaagttattttagatttttgttggtgagtagtgtagctggttatgctggctgatagcactttagacagcaggctgtgacatttatcttgttggttgtattttaacattaataatcccaaaatgataataatggtagcaatgtattgtggcctgatcatgtatcaggattctaggtggggcccttactggcaccgccttataatacgccaaggtcagtcaacacaagagaaaaataatcttttcagttggcaaagtggtaatttcttctcttccattttttatgtaattactaatttactaaatgtgcttttactttggctatattctatgtctcctttctatttcctggtcaaaccatgctcctccccaaaagttaaacttcctggctgcttgccatctccctggtctaaccatctcagaaccacgagttctgcatagacagccactgtctgtatccctgtgtcattgtaccttgatgccaaaggtcttagctgcgttttatgctttggtctaagctgtaagcggagacttggccgtgtcggactgctctgtcttctcggctgtccagtgaagcagagtcaatgtcctgctgaggctcaccaactgacatgggcacaatgacagtgccagtgctccttacacacgtctccagtcccaccagctcacgtgtccttccttcctgagtcctacctcaggtctcagggaaaggccactgagctaatagcctgtcttagttgtgagatgggaaagtgggggatgttaatacacaagtgaactgcagttaggaaggctaacttgtagagttaacagagttaactgtaaagtcctttccaatgaccttgatcactgctacccttggtcagtgttccagacaatgtctaatttcttgaaaatgcataaaattgtaagtaaaagccaagcatatcctttagagaatccttccataaacttaataactgctgtttctagtagctaaccctggtctgtcatggtctgtcagtgaggactgttggccaccagagggcaacttcactgtgagtctgccaagcacctcccaagcctttaccagattgctgtcaccagtttaggactgcccacgcttgggactcctgctcacgttgccccccagcgttgccccccagctgctcgtcgtgtgccagtctcacagacctgtgtgtatcttccgagcagtcggcatccttcctttgttaatagcctggcacagtcttaaaataccagtcctgggatgagcaaatgcttttgtgggttagtttggtttcctttgttttgacacagggtctcactctagctcaagttaacttggaactcttgagtcccaggctggcctcagatgcctacctcagattcccaagtgctgggattagaggcatgagtcaccacacctggctctttattagtatatattaaggtaaatttcttatatttattgaaatattaaatatatagaagaaacttttaggagtcccactgctgtgtttcttgcctacaaggatatttgcataattatgtaaaaatacaggtgcaaaaatgttcactacagcactatctgcaataataaaaaaatggaaatagcataaatataagagtgtaatttaattgaattatggactgtccaaaaaataaagtattgtgtaactattggaagtactcattgaaaggaaacaaaggtgcctaagagtgtagccatggtgtaggtgtctgtccagaccagcaggtctcaacctgtgggttgtgacctcttggggatcgaatgaccctttcatgggggttgcctaagaccatcagaaaatacagatgtttacattacaattcataatagtagcaaaattactgttatgaagtcgcaacaaccataattttatggttgagggggtcaccacaacatgaggaactgtattaaaggattgcagcattagggagattgaggaccactggtctagacttattaaaagacggaccaggcacccaggatgttacccatgaggttgctgccgagcctgacagcctgaattcagtctctgagacccacgaatggtgggaagagagagcaaaggctctcccctgctcctctgagcaccacgagtatactgtggctcatgaacatacttgtaacacaaataaacatgttttaaaaatcagcagtctggacattgtcattgcagtgatctgcaaatgccataaagggccaggggatactgggggttatgtgagaactgtctcagaagctgtggtgcagtgtgtacagccagaggcagcaggagtgagagcacgtcctcagcaccacatgcaaacacccttgagtcatggaccctgagagccaacgccataaaaacctcatgtcagcaaatattctatcagctacttaaagtatttttaaaaagtaaatatagttgtcccacaggccctgctaagccctctgtagagcaacagagggagggcatgggggggggggcatgggtctcacacttaaaaaatagtgaggttaagttcctgtttcctttcttttctaaactaagaaaggcttgtcagagctggtgtcaaagcgcaggccctgtactcacccttcccttagaccgcacggacaccagcgagctcccaaaccttgaacttgcctgtaaaacacgcacaccatggttggttcagcagttgaaccaataagtacaaggggctggggtgg

SEQ ID NO: 21811 - DNA, 1202 bp, Mus musculus
ctcattgttcactgtgctggaatatctccgtaactatctctgaccagcctgtttgttgtttacttttaagatttcattttaattacatctctcttacccttctactcattcccaaacttttaaatataaattaaggaaaggataatgtaggaatctcgtattttaaaatataaacaccattttctgaaatgtatgattacattcatcaacacgtaaagtgagaaatgcagtttgatcccgtctcacgcactaggtacgcgtgtcccacttcccagagcctgcagtgaagatgtcccacccatcccgggcagccacgccctccaactccaagaacccgcaagtcttctttgatgtggacgttggcggggagcgagttggacaaattgttttagaattgtttgcagatactgttcccaaaactgcagaaaattttcgtgcattgtgtacaggagaaaaaggaactgggtccgcgaccgggaagcctctccattttaaagaatgccctttccaccgaattattaagaaatttatgattcagggtggagacttctcaaatcagaatgggacaggtggcgaaagtatttatggtgaaaaatttgaagatgaaaattttcattataagcatgatcgggagggtttgctgagcatggcaaatgcaggccccaaatacgagtggttctcagctctttatcacaacagttccgactcctcatttggatgggaaacatgtggtatttggtcaagtcataaaacgactaggtgtggcaaggacgcttgaaaatgtagaagtgaatggtgaaaaacctgctaaactctgtgttattgcagactgtggagaattgaaagaaggggatgactggggaatattccccaaagatggcgatggtgacagtcatccagacttccccgaggatgcagatatagatttaaaagatgtagataaaattttattaatatctgaagacttaaaaaaacattggaaatactttttttcaagtctcagaactggaagatggctattaaaaaatatgcgaaggttttaaaggtatgtggatagttcaaaggctgttattgagaaagcagatagatccagactgcaacctatagccttaagtcgtgtgctgaatattggtgcttgtaagctgaagatgtcaaattggcaaggggtaattgacagttgcttagaggctcttgaaatggac

SEQ ID NO: 21812 - DNA, 1149 bp, Mus musculus
aatccccaaagtgacaactgatatgcttgtagagaaacttccagagatgggaatcaagctttcttctttgtaagcttgtcatgggcacatgcttcatcaacagaatgctgacacacaggatttagcctacaagagaggaaagattttattttgtttggtgacctgttgttcagagaatggtcatgttgtgtaactacatcctcagaactttaaaagcctcctggaatgaggaggagatgttcttaagatgcaagaaaaaagggggagggagggaaatttgccagaaacagaagttgctttgagactcccatgttcctacaactaacctcgcactagtgtcccataggtaactccaatgacctcatcagctcacagagattggcctgagtagaaattatttgtttgtcatcggtgccctgtctgagaagagaaaatgtagaaaaagggtgccatgcaagttaagtgtgtcttcctgttcctctgaacctcaaaatttgaattggaagcactgatatgtgaggttagaataaactgtgaaggaaaggtgaaaggctagaagaggagggattccaaatcaattttaaagttctagctcatctttgcaacacagacttttagcctgaaattcatccagaagtttttaggcatcatggccatttatctttgagttggcacatgttttctcctagtctcatttcaaatttgtcctcttggaaccatgttacttggttttagtttgatgctcaggagaatatctccagctgtatcccatcatggagagcatttgccttgcctaaggttggcaaatccactggaacttttggaaatttgtgacatttctcccatcagaaaaatatagatgccgaggaagattgcaatccaccgtgtcataactcagagtacaagaagtatgatcagaacaatgtgtgaaggtgtcctgccttttctgttctgattctggtggaggatgttcatttctgaagacactagaccaatcgctcacgtggtatcgataatatcatcagtggaaaggaactggccaagaaagtttgccctgaatgtctaggaagtacagggtctgttgcactgcacccatcaatttgaggcagagttggaacagataactggggtctctcagctgttgtcttt

SEQ ID NO: 21813 - DNA, 1271 bp, Mus musculus
atcattttttattaaaatgtggaatgtagatttaaactctgtgctggtgtgtatgtagactctgggactataaagtgactgagtatataggtagactctgaagaaaaggcaagcactcagctaaatggaagaagaaagaaattaatgaactagagataataaacaatacaaaaaaatcaaccatagcattagctccttgcaaagttagtaatattgcttccacaggaggcctacacgccgccgtctgtgccgctgccatgtctctagagatccctgagaagttccagcacattttgcgagtactcaacaccaacatcgatgggcggcggaaaatagccttcgccatcactgccattaagggcgtggggcggagatatgctcatgtggtgttgaggaaagcagacatcgacctcaccaagagggctggcgaactcacggaggatgaggtggagcgagtgatcaccatcatgcagaacccacgacagtacaagatcccagactggttcctgaacagacagaaggatgtgaaggatgggaagtacagccaggttctggccaacggtctagacaacaagctgcgtgaggacctggagcggctgaagaaaattcgagcccatagagggctgcgccacttttggggccttcgtgtccgcggtcagcacaccaagaccactggccgcaggggccgaactgtgggtgtatccaagaagaaatgagtctctgggcctttgctgttaataaatagtttatatacctatgaaaaaaatttagtaatattgataagacattagtcaaaaagaaacaagatgaagaagcaaattaataaaattagggatcaagccagtgtaatcagaatttactccagaacagaagaacattagaaaataattataaaaacacatactctgaaaacttgaatgacccagaagaaataaaggaatttctaaattcatatcatcaccaaaattaagctctgaaggtataaataatttatagatattacaagcaacaagattgaaaatgttattaaaagtgtcccctcaaagaaaagcccctgaccaaatggaattcaccgctgaattgcaaactttcaaggaagaccttataccaattcttcttaatttgttccactagataaaaagctatggaacatcacaaagctcattttatcaggtcaggattttcctagcatcaaaaccaggtagagaccctattacactcctccctttctcttgcctcttgcccccttactcccaattccctttccccct

SEQ ID NO: 21814 - DNA, 1213 bp, Mus musculus
tgagtgtcagaaagatactggtccacaccaatagccaacaaagatacccttatcagatgacacagaaatgtcccccagctgacaaagcaagagagtccttcccaccatcaacctaaggctcaagaatcttctcatttttttttaaaattaggtccatatttctacctacccattagtatttctttacccagatgttccatgcactatctcacctgagtttgaaagccagaccatctttgaattcttgactgtttagttgttggcagtacatttataggtgtcgaggctaagttttcccaacatctaagcctcaggtgtggtttgatagtctgtatgggtttcttatactttccccttcttttactcctgacacttggtttttgtttgtttgtttgtttgttagtttgtttttgagaggaggcttcttgtagcataggacgcccttgaattccctctgtagccaaagacgaccttgagcttcagatccttctgcctcttcttctggagtctttggattgcaggcacacttcacctgccactacttcacaatgcaggcctcattagctggtataggagctcctactttactgttatccttccacgtgcctgaccgaagcatgcctggattctagggttaaatatgatcatttgtcatctgtctaccttgagtgataatctaatttcatttcttgttactgtgataaaatatgatgataaagaacttaaacgagaaagggtttgttttggcttcgatttcaaagtacggtccatgatggcgggaagttggggcatcaggagcttggggcagtcagtctcattatgtctgtatttacaggagaacaatgcatgcctgtgctgcctcatttcctttctgcccttacagagtttgggagctcctacccagggaatggtctgtgcacagagggaaggtcttcccgtatctattagtgacaatcaagataatcccccatgagcaggcccagaggtccaccttccaaagcctccagattgtatcatgtttacaagctacatttaatttctatggacctgcctttcccccattcatcaagtttaggcaggatcaaagaacttgaagaatttctcagagagttaaggggaaagctaatgtgtgaggtcagtatagcctctggtcagcaaagggtactcaaatcctacttccccttgtgtgtgttgaatgtcaatttctttattg

SEQ ID NO: 21815 - DNA, 1234 bp, Mus musculus
ctgtcatgatgataaaacctacggatgcttccctgtgctttggctctggcctccatcaccactagtagggagcaaatgcaggattctgttagagttgagcacagaatctctggcctgaaatagaaacagtatggtgcatgaacagatgtatctgtggctctggctttctgagccccccatcctaagtcaccaaaattacttattccccaacaaatggaaagcaggctgcagtgtgaggaccacgtcacttagcccttcttttccatgttgtccatggatacaccttccattttcttttctttatcttgtacaagactcttcacactttattgttaatctttactacctcttctgtgtgtattatctcttttcctttctacttcgcttatattagttacactgggtgttgctatgtcaaaactcctgaccaaagtgacttggtttgaagtttgagaataacttccatcatgcagggaaaggttgcggggacatgggacatgaggtagtgggtcacatgggcacaggttgataaatattggggctcaactgcccctcttttcctcaggcagaatctgagcccatgggatgctgctgtgcgaattcagggtgagtcctccttgttctgataaaccttttacgaactgccgatatagacacacccagaagtgtgtttccatggtgaccttaaatcgaatcaagttgccagtgaagcttaatcttatcttaacacagttccacataacccaggctcagtaaattcctcatagagcctcttagttataagtggctagctcatcttgaatattcatactttacagtatctgagtttgagagactcaaacactgacttgacacatacaggccagattgctaacctgcaaatctaagacttgggatgcctcaaactctaaacaggttctgcatcagtctgaagccaagagtggaaaattccatgccatgaatctttgtttcaggcacgacattattaaatatgtcatataaaatggtctgtaggctacacgtgtaaaatgtctatgaaaaataaatggacttagtgtttgaatattggtcctctccccaaggtactatattattattacatgtatttagacattccaaaatcaggaagacttctggttcttgtcacttgggataaggaatgccaaattatgctatttacatgtctatgtaaacatgtatgtgtgcagtttgtatgtttataatctggtttcag

SEQ ID NO: 21816 - DNA, 1109 bp, Mus musculus
tacctgttatgtttggatagcctgcctagggcgaagccatagtctctacaaagggatatttcatttttataggcaaatagccttctactgaggagcacagtttgaaaggtattccccaaagagtttcaaagacaggagagccatgctctaaacagcctgaattcttataactgtcctttgaagatggacatttccctagaggtctcccccaggacttggaaaatggtggggttagaccagggacagtgaaagatttccttccctatctcatgctatgccaaacatctccttgtctccagttacagctgtgattcaggtatcttaagcatgatgctggatgtatccattcctttgttgggcctcttggatactgccatggtcccacttgcacctgaaattgtagggcattgagtcttcattgtcatgaatccagtttgtgatgtctggcaatgcatttattaaacacattctctctttctgtttgagagactcattagttttctaagcaaagaaggatgtttcatccatgccagggtctggggaaggaggagagtaatttgcgctgactgcatctttagaaagtagggaccaagatgaatagttggagacctaagacgaacagaatgttcataaaaggctttacacaaggtctctcatcttgatgctggccacccacatcctttaaaaagattgatttttacttttatgcctgtgtgtatgtgcctatggaggccagaggatgatgtcggtctcctagagtccacgttactggtggttgtgagctgcccagcctgggtgctgaatctctggaagagcagtaggtcctcttaaccactgagccatcactccatcgcagtcactcttccctttgcatgtggttagctgaaatgaggttgtggctttactgctaagaggtgtgtcctggggcttgggaagcactccgccagatgctttcgagtatggtaattaaaggggaagcagagggctgggaatttgggtcaccatcctggcaggcggtccatttctgtggggttatatgaagcatgttttctcaggtgatgcccaggaagcttcacagagacctttgcctcccatttcttacagtcgct

SEQ ID NO: 21817 - DNA, 1154 bp, Mus musculus
cccttttcatttgctttcttgtcttttaacctcgtttctttatcttcttttttattttctttctttttcttcgttttttttttttttctagtgttgttacccacgccattttacgtctccttcactgaagggctagagttttaacttttaattttttatatttaaatgtagacttttgacacttttaaaaaacaaaaaatgacaagagagatgaaaacgtttgattattttctcagtgtatttttgtaaaaaatatataaagggggtgttaatcggtgtaaatcgctgtttggatttcctgattttataatagggtggctggttaatatctcacacagtttgaaaaatcagcccctggtttctccatgtttacacttcaatctgcaggcttcttaaagtgacagtatcccttaacctgccaccggtttccacctttcaaccccctggtcttataaggggaggagagttcagcccagcaccataatgctttaaaaaaaaaaattttttttttttaacgaattgctgttctgtccagaggtttttaaaactggtgcattcacagcaaaaagggattctgtagctttaacttgtaaaccacatcttttttgcacttttttttataaagcaaaaacgtgccgtttaaaccactggatctatctaaatgccgatttgagttcgcgacacaatgtactgcgttttcattcttgtatttgactatttaatcctttctacttgtcgctaaatataattgtttcagtcctatggcatggtgatagcatatgtgttcaggtttatagctgttgtgtttaaagattgaaaaaagtggaaaacatctttgtacatttaagtctgtattataataagcaaaaagattgtgtgtatgtatgtttaatataacatgacaggcacgaggacgcctgccttttaagaggcagttccgttaagggtttttgttttaaaactcttttttttcctttctttttttatttctttttttttaaccatccatcctgtgcaatatgccgtgtagaatatttgtcttaaaattcaaggccacaaaaaaaagcaaaaaaaaaaaaacaaaaaaaaaaacaaaaaacaatatttgggggaagagaaaaagaaaaaaaatcatgccagctaatcctgtccgt

SEQ ID NO: 21818 - DNA, 1304 bp, Mus musculus
gaaagaaagaaacagaaaaaaaatgagttaaaaagaatagatggagagtagaaggagaaaggggaaaagaaaaggaagaaaaagtgcatagagctggcctggaacacgtcccgccgttggagaaggagcgcgggggcgttagtggacccgcgctcccatcccccactctcagggctggggactcgaaggaggcggagagtagacgggggcgacctttttttgttgttgttattgatgttggtggtggctaaaaaagctacttcgagtttcctccccaattttgcttgaagagactcccccccaccccacccttccaacgagcttccggacttggttgcacccccagcaagaaaagaagccaagcaaagcttctaaagaccgaaggaatctttccctcacccccaccccctcgccttggtgatttcttgtttgattttgcctcatggtcaagaaaggagggggaaaatccagcgtgccccatctcctacccaccccctctttgtattctctttgtatttttccccttcttaaaatttctttttctgcaatgaagacagaaagaaggctctggggtgatgcgtttggcatttgtgttgagcttaggggagcattggcatggagaaactccacgctggcgaagtcccgggctgggctttctcctcctccccccaccttttttccccttgtccttgcagctggagatgtgctgggagtagcaggccagcctcggaaatggacatggggacctcgtggaagccacagcaacctggttggggatgcagaaggacccggagcacagagggcgttggggttcccgggcctccgcctggggtctgtgcaaaaataaagaattaaaaaaaaaaaaaaaatcagagaggtgaggctacccagagccggcgggaggacaggagactgtgggatgtggtccaggggccgcggagtggtttgggggggaaaagagatttttttcttctcttaatgggaatcgtgatggtgttgagttatttcactggtggggttaatatagcatgttatcctgtctatcttttgaagatttctgtataagactgttgagcagtttttaaaatagtgtaggataatataaaaagcggatagatggcgctatgtttgattcctacaacgaaccgatcaccagctccttttcatttttaactctttaaaaggattcaaacgcaactcaaatctgtgctggacttttgaaaaaccacaattcaggaccaaattttttctccgtgtgtgtttattccttataggtgtaattgagaagacccgtttatttttac

SEQ ID NO: 21819 - DNA, 1099 bp, Mus musculus
tgtccctggaggctgaaagtgcattacaggaaaagagtgggtgtggcctgtgagtgacacacctctgtcattgtgctgctctaggggatggagcagaacttcacagtgatatatgatatctgatgcttcaaacactggatatgagggtttagtattgtgcacatcaccctggacatgtctggtctcatgtttgtggaaatgtgcctgaattgtagtattcctgcctttagtttgcttttgctgtttctttgttggcctagatttaatgaaagcacaaaatctgactggaagttattttctagtgtcagaattcatacatggtaatatctgaaatgcccatgttactgtggtctcataagcagtatttgttcccattctaaaagtttcactgggacccgtgtgatagctaatttcagtagtcagcttgacacacctgagaagatagaacctcagttgagggattgctaccatcaattggcccatggatatgtttgtggggtctttttcttatagcgaatttatgtaagaggactgagctcatgtgaatgatgtcaagcccattgttggtggtggcatcccctaggctctataggaaaactagtagaatctgagcctgggagcaagccaggatgcagcattcctcatgatttctccttcagttctggcttaaactcctgccctgactttggtaatgatggattatgacctgaaattggaagccaaagccaaaaccaaataaactctttcctctccaagctacttgggtcagtgttttatctgagcaacagaaagcaaactagaatggtatgttagctctgtgagtttagtaagttcaatgcactcaggtcagggaacacatttactgaacataggacatgtgcaaggtactgggagataaagtgatgaagcacaaatttagcctcctacagctgtgttcagaacatgagggtgtggctgctgtgggtgccatagtatcaggtgtacctatggcctgagcagccatgtgatcccaagaccagtgcagctagttaagctttactgcaggctatgttgttaaatggagaacaaaaataggttcttaagcaatttgtaaaatttg

SEQ ID NO: 21820 - DNA, 1193 bp, Mus musculus
ggggttggcggacttggatgaaaggtcatgctttagtgttatgtataattgtatctagactggattgaagggtgctgggcttggagtagaggttaattactgaggctagagggagtttccaggtacataactaaagcccctataaactagctttgggtgtccccaagtagttaaagatttggaatgacatactaggaaacaaaattatatagaggaaaggtattttcattttaattttgttctagagtgagctgctttgtttcttgatgaaacagaacaaggaagtagaaagcaagatttgaattattggagagcaacctcttagttgatgggagaatgatttcagaggtgatggaacactctgataagcttagccaagctagggtccaggaacatgacctatcttggtatgacagggaaaagagctgaagtggcggcagagatgggggtggggtgggtggtggttcgtgtaaaatataccctgagaaattgggatgacagtctaagactttgaaaatcaatgctccctagctctctcagtaagtgggagattcatggagaacctttctgacctcttaatactctctctctctctctctctctctctctctctctctctctctctctctctctctcgtgtgtgtgtgtgagagagagagagagagagcgacacacacatttgatttaataaaattaagttcaaaaatttcaggaaaactttgaacctgacctagtgtttgacttccacatctcagtttcactgttcctaggcagtggggaggggttaggatcaccgagtccaggagagggcagcagcgccgcatcagcctttgagtgttggccactctttctctgtgtacttggctattcaaaattaagcaagtgatttggtattttggtcgccattgccttaagtgatgaaaaaggggaggggtctctagagatatttaataatcttacaatttattaaactcttagtctccccggaatggcagggctagagaacacaaaggcagcaacatgccttgtgagaaagggttctgttgcaaacgtttaggcctaattttgttccaactttgcttgtaataagacattcagaaaaggctcaccagctaaatagcttataaaatacaaactgtgggaatagaggcctaattgggcttgttgaaagaatttttaacatataaacatta

SEQ ID NO: 21821 - DNA, 1234 bp, Mus musculus
gatggttttagctcccttgtcaaagatcaagtgaccataggtgtgtgggttcatttctgggtcttcaattctattccattggtctacttgtctgtcgctataccagtaccatgcagtttttatcacaattgctctgtagtacagcttttggtcaggcatggtaattctaccagaggttcttttatccctgagaagagtttttgctatcctaggttttttgttattccagatgaatctgccaattgccctttctaatttgttgaagaattgagttggaattttgatggggattgcattgaatctgttgattgcttttggcaagatagccacttttactatattgatcctgccaatccatgagcatgggagatctttccatcttctgagatcttctttaatttctttcttcagagacttgaagttcttatcatacagatatttcacttccttagttagagtcatgccatggtattttatattatttgtgactattgagaaaggtgttgtttccctaatttctttctcagcctgtttatcctttgtgtagagaaaggccattgacttgtttgagttaattttatatccagctacttcaccaaagctgtttatcaggtttaggtgttctctggtggaatttttaggttcacttatatatactaccatatcatctgcaaaaaatgatattttgacttcttcctttccaatttgtatccccttgaactccttttgttgctgaattgctctggctaggacttcaagtacaatgttgaaaaggtagggagaaagtgggcagccttgtctagttcctgattttagtgggattgcttccagcttctcaccatttactttgatgttgactactggtttgctgtagattgcttttatcatgtttaggtatgggccttgaattcctcatctttccaagacctttattatgaatgggtgttggattttgtcaaatgctttctgtggatctaacaagatgatcatgtggtttttctctttgagtttgtttatataatggatgacgttgatggatttccgtatattaaatcatccctgcatccctggaataaaacctacttggtcaggacggatgattgttttaatgtgttcttggattttgttagcgagaatttaattgagtatttttgcatcgatattcataagggaaattggtctgaagttctctatctttgttggatctttctctggtttaggtatcagagtaatt

SEQ ID NO: 21822 - DNA, 1096 bp, Mus musculus
tcagtgccatcttgtaacggcgaatgtgagggcggctccccacagtataggaagataggaaagatgaagttgcaagggcagtcagcaagttgtctgtgacttgtacaagtgtccagttgtctggagagtctagcatacttcagaagcatgaagtagatggtcttatgtgtgaaaactctgatcgctcagggagaaaaatgcaagtcagttcacttgctagagacagggaaactgctaaagtcaacactgggattgtttttctgccagcagtttgtcatgtgggttagtgtgggaagatgaagagctgcagggataggttggcagggcagagactggagcacacctgtaatctcagctgacgggaggctgtcacagggtgattacaatgagttcaaggcaacggggcttccagagtaagactccttttcagagagagagggggtgtgtctggggtctggggatgtaagtcagttagtggaatgctttcctagtatgcctgcctcccgccccaccacacacccatagcttatagacatatatgaaccatttccatactctgtgaaaatgagagacttagacatcagtgaggtttgctatgggagagtactttggaatatagtaagaaaatatatatatatatttttttcatgcctgttattgtctcttgttcttctactgtcctcattattcctttccctatttatcctctacattcatgtgtgtgtgtgtgagagagaccacataagtttcattagagtcttttacaggaagtgtgtgagggtaccttatcagtggctccaaccattgtaagcatgatcttccaagaataacagccatcattttcatcacagcagctgtgaacacttacaagcgacccttgagattgaagcgctaattgatattctctcgtagaaaggaggtagtggaggatcattccaactacagtccttgggtctctccttcccagtctgccgtatgtaattcttccctaattgcatgtggccctgaggtgttaactgtctagaagggggaggataactggaggtgaggactctgtgaggctatacagaagttgtcatgtctgctgcagtagttt

SEQ ID NO: 21823 - DNA, 1198 bp, Mus musculus
gaaataccatggccagtatttttcctattaaaataaaaatattaaacatcctacatataatttactttgtttgccaataaattttgcctgaattactataagatcttgcatgaaagttgttgagaaaaaaatggcttcttataaagagttatactttatattataaaaactactgagtattttctattcacgtttctataatctatgttctctgtattaaatattttgttgaaattttgaagtacttgggctggggagataactcactcacttgtgtggtgcacaggaccgagattcagctctgttatctacttaaaacaaagacatgagcaaaaccaaaatccaaacaaaacagaacaaagcacccagtgaagtgctgtgctttggtgaccctagctctggggaggcagacagacagattcctgggtctcttgccatgcttgcttggcaaggtctaggccagtgagaggctgtccacttgcctccacacacatgctcatacatttgcatgtgttactgtgcacacatgcatttgcatgtgttactgtgcacacatgcatttgcatgtgttactgtgcacacatgcatttgcatatatactcatacatgcacacacacacaaatattttgtagtaccttattgaactataactatatttagaagggtgtttaagactttgttgccgaggtataaagtgggatacacaatgatttgttgcctctttgaagtggctgagattacaaacttaggctatgcttggatttgaacttagggattctggagtgctaggttgacactcctcacagagctactttcgtgatttctctgttagtttctgtttcttctttatatacatgtttgtttttcaggcagcacagaaataattaatatatatatcaaatcaaatatatatatttgatttatttgtctagttggctgagaaatttccccatatttggcttcttaggaagtgcccaaactcattttggacagaatgctaagcagccctgatttgtcctatactgtgtcatctgtacaaaccaaggagtgtgggcctttcctgtgtcctttgtacttcaagcagtattctccttatgtttaaataatcttgaatgattgaggagaatgttggctttcttgaaggattagttggaaaatctggtttggtctccagaatttgaatgattgattagaatc

SEQ ID NO: 21824 - DNA, 1987 bp, Mus musculus
agccagaacccattctccgaatccactgtgagtgggtgagtttggactaagggaggtcaggagacgggaaatgcactgatagaatgccagggcgactcccttgttactcctcaggaatggtgtcccaaactggaggctttgtgtcagcaaggacccttccagttaacttccaagaatagcgttcccactggcaggtggcaagggccatcttgtcctggtgttgaatatggcatagtacctcaaatccattccttggatgctaagggctgcggaaatgagttagtcacgaaaactaacctccagctgagcagtttgaaacactacgtgcctggccttcccgggaggcacgtagtaggcactcaactcatacacgtttgatcgagttgaaaatatcccttgggaaaaccttttactgaaaccacaagaaccctggccagtttactctagatagatttccacaatatgcaaagtggtggtggtggggggagggtggagacagaagacaccggcactttaaactctgtgtgtgggtatgcgtggtgtatgtttgggaagaaaaaacaaaggtgcagactatcttcctctctcttcagcctccagccccggcctcctcccctcacacactctggacttggtaccgaataatcccgtgtggtcctagctgaagcactggggtggaggagggagggggagcttcgtgttaagtgcctactggaaatgcactgtggggttttttcctgtatgggaaaccgtttatgccaagctttcccccaatgccctatatttatctcatctggttagctgcctctgcttctggctttgtgtaattctctttgccagctgcatcgagctgggtttctgtccccaaagtctaatgactaaactcacctggctctaggttgttgtgtgtttggttgacttttcttgttgaaactattcgtattgtgatgccgtatttattgttttaagaaacgaaaaggaatactaataagtcttcaagcgttctctcaatgcataataagactttctccagttaaggggcttaactggcgtacacagtgtgagacatccatgctctattctgtttgcattttaggcattttctttgctcgtagtatctggcacacaaagtagatgagtactacagtatttttgttactttaagtcctgagatgcaggttccctggtaccattgagttgctgctactaaaagctcacatgcggaatggctgaaagttacacatgtgcgaatgaagacggcgtgagcctcagaactaaaactgtataaagggcaacacatgagctgtcaaacagtgttaggcgtgtgtttgtgtacatagccgttttatttaagtcgatacagtccgctcacattgccattatttaccaggtttgtacagagatagcaattcatttgtaaacactgccagaatattttctagctggtttgtaatttttttaagaccgtcgccttgggtttttgtgttttgtttctgttgttttcgcctgtgactctcgtttgcctttttttttttctgtcgtacatgtagctctgtctgtaaatagaatcgcagtatttaaagctttagctttcaggaaaaacgaagtaagaatccaagcgtgtgcatgacaggttgtgtgtgtgagaagggatctgaggaagatgccttgcggaggaggctgggtgacagttggcagggtgtgggaatgtctttcctacggggtgcaggcttttgtaaaaaaggaagtgtttctcccaacactgggagtaggcaaactactaatcagtttagctttgtgttgtatgctagtttgaaataaataaataaataaataaataatgtaatataatgtaaaaatagacaaacaaacaaacaaaagcttttatgatggattttgtaaatagatttgttacagggtgacctgttccagctgtgatcttaccacttcaaatggatgtaatttgaataaattttgtatggtaaag

SEQ ID NO: 21825 - DNA, 1184 bp, Mus musculus
agaaacgtgtatcgcagtgttgtcccttcctaccttcttcctccaagagtatcatgaagtaaacttcagaacaaagctgacattttgatgaattaattttttttttctaagcgcacagttgcaggctcccttgggaaagccctgcctggtcccaggctcccaaatcttcctgatgagtcagcaagtgagaagatgtgcaatcaggtgtctctcacctgtccttccctcccctccttcctctcctttccttgcggactggcttgctgtgcctaacggatgggctgttgactgggtccggccgcctggcccgttggaaacagcgccctcccttaacagcagttcaagccgtgccttctcttgcagaatgcatgtctttgtgagtctgctaccacggaatggaattctgccacaaatgcaagcttgaagtcatgcaaaggaatgacacggatttctccagctcttaggaatatttaaattactctcataattcagtgtaagctatgggccgctagtgtcccactaggaggcggcaagagcctccacagcctttttggatgaagaacttgtttgcaagtactcgttgcagatacagagactggtagagttctgctgctcgaagctgttgtggatttccctgtctccataccccacttccactgcccccatcctgcgtatttgtgagttttcccggttgattacttgtgacttaggagttccttgtgggttgttttagaagtttttatttttctagctgccattgaagcattcctgtggcgcccatcactatttcaattgaattgtttaccttaaagcgagttttgcaaattcttattcctttagcagagggagagcacctctactgataaaaagcatctaaccccgtgtgacctaaggtccaccaaccagcctctgcgagaagcatcctctgtcttgcctcctttcccaggaggggagcttggagcgagaacagctccggggcttgctgactcgagtggtccacagtgaggacctcgggccagatacagctgtcccgtggagcagcaggcatggatcccctccatccttgggcttcccgggcccctgcgaccggggaaagggctctaatgccacactcagggagaccacttctcaggatgcggtcaggtggagaggccctagggagaaagacatcccatggtgtgagt

SEQ ID NO: 21826 - DNA, 1172 bp, Mus musculus
agaaattagatgagctgatccaaagctgtaccctggacctcaaactgttaaccgaggattcagagaatcaaagatatcctttgtgctgctggtggtggttagagccttctgtactgtttgcagagctgacagactaacttgttcatgatgtagatagatattactctggcatggtacacactatcagtgtgtgtgtgtgtgtgtgtgtgtgtgtgtgtgtgtgtgtgtgtgtgtgtgtgtgtgagataaagtacttttagactatgtggtatcattatcagtgttgatagccaggtgagaacagtttttcaaagcatggtatgtatggttggaaaatctgaatacactcacatcataagaacacactattaaaagatgtcataaggtgtctggatcagtattgatgacagcatccagcaggtttgaccttggcttcccagagttttaatgtgggttagctgtcattgttggagttctcgacctttatcttctttctttcttcttttcttttcttttcttttcttttcttttcttttctttctttccttctttctttctttctttctttctttctttctttctttctttcttttgtagcatttggagtttgctgtgtctgggtggactgggactgcctgcaatcctgtcaatagggaaactgagtcctgagtgcacagccaatctggctacaaccgcagggccctatctcaagaaaagaaaaaaagaaaaaaaaaaaaacaaaggagaaatgatacttttcaaagtcaggtgtgttgttgcacatttgtgacagcaatatttgaaagataaagacagaattatcaggggttcaaagacagcctgggcactataaagtttaaagttcatctagggtgcatgagcacttgtcaagcaaagcgtaaaagtcaagagttcaggttgtgtgtgtctgcctagggagtttgaggccagagtagaaatcttgtttttaaagaaagaaaaagcaagatgtggaggtatgtgcctttaatgccagtatttgggatgcaggtagagttccagaccagcccttctacataatgagttccagactagctacaacttcatagtgagtatgtcctgtccaccttatctcaaaaaattaaaatgttaagagtaaaagagcctggtgtggtggtgcagagacagacaga

SEQ ID NO: 21827 - DNA, 1199 bp, Mus musculus
tactcagttctgtgatgctttctgtcgttccagtaacagcaagtcttcggaggaagttgagatgatctgaaatgcttttacactttcccttggctgtgtagctgtgtgggccctacatcccgatgtgattccttgcacggagccatgtagacaaagcctttcctgagcagtgggtgtttcgaatccttgtttctttgtgtggcattaccttcaacttatgaagcctttaggggcagcaggtggtttgtgggtgccatcatcttcttaatagataaggaagatgccaacacagacattcttggatctatctccccaagagttttctggggtgccatttgggggcactagggaggagccaggccatccactttcctttctgtgaccaacctccatagacagtccccaggtccggggcaaccaacccttcttgacattggtttgttgctgattttctcatggaatcaccaccgtgctggattttgtatgtgcgcacggtaaccatggtaaaccattcaatcaagatctgaaatcctcagctggggaccgttcctaataccatgtttaacatgattgattgtggtactttggatggcatgtgaattctggtagggctggccttcacacgtgatgtgacgtgtgtctgctgccacatgtcttccgaaaacccacggggctttgcctttatgtcgtatgaatttcctgtccatcctctgatatttattagcttcagaatggcggcggggtgctctctcagctcagtcccccactgtcccagacacttttaacagaccacatgtttacaacatgacatgctgttgttttaggtagatattaacattaacaaagtcattttggttgagacagtctcttcgtggttaggcctggctttaaacttatgttaatcctcctatccccactgtacctgggctaacgtgtgtgggccaccgtgcttgattaacatgtttatcataaagtaagcttgattcaggccctcagaatagcatttctgtgtagctacgtagttgacgcttgagactgatgaatgatgtgtttggttcttagctcattcctcctgaaaagaatagctaagtacccactgatccccagtgagccgtcaggcattggccgtcacctcttccgcaagccgggctggggtgtgttttgctggtgtgcccagaagacagtgcaggaagccagcc

SEQ ID NO: 21828 - DNA, 1173 bp, Mus musculus
tttgaaaagtagtttgttcctgtagtgttggtggattgttctcccgaacttaagtaacagctatgttcactcagcaaaggggaatgggaaactttggagcaaaagcctctagcgtccagtggaaaaacagtggtctgttccaatctgagtgtgtgcgggggggggggggggggggacggggacggggacggggacgacactaaaaccactttgtttcatagcctggtggggaagggactggggaatttcctgtctcttttcccctatcctggtttggtaacgactccagcagcaggggcttgctcaggaccagcctgagcattgtcgtgtgcacccacgctctgcttggctgtaagatttatttaatgacatgtgtgactctgagactattcatgatagtgaataccacagatttggctgggtaacgtgacagtttttatttgctttaagttaactttagcttctagtgtggtgtgtggcaaaagggcaccaaacttggatcccaggttcaagtttgatccttgacattagccttcgcctgagcaaacttgagagctctgttttcttgatccatgaaatgggaatcctaacacttgtgaactttctcttaggcggtggtgaggggctttgtcaaattcaaagcaatggcaggcaggcaggcagcgaggtatcacccctatgttcgtttttccgatttttggataatcaagttaacattcccccgccccgccccgttttgtatttctgcttcttgtttgtgatgggttctcatgttgcctgattacctcctaactcccctgtgcgtgggaggcaagccctgagctccgccttcctattgcctctaggttccaagcgcttagcttacaggatgctttctttaccttctctcccctttgtatttttacccagtattttttttctctatggaagtctaaatattgtaagttagggtatttctcttgcagcctttgtctctagtgagcaaacttcaactttccactccatataattcatcattctcttgacaaatatttttgtttgtttttgttttccttcacttggttaggtctgaaacggtctctctgtagcccctgctgctctgggactctgtgtagatactgtaactcgctctgtaggccaggctggctgctaaccagtgatcagtctgtttct

SEQ ID NO: 21829 - DNA, 1191 bp, Mus musculus
ctcacacttgaactatggaattaggttattttaaaagtaccctcaaagcaagtgctggaagacaccctagcaccactacaatatggcatggagaggtgggacagattggagtggcgcttgtgctagggacagaggtggaactggtaatgtgatggtggtgacaggcgagagaggactgaggtctgcatgctatcattgcccggtatggtcagagagatgttttgcaacagcctggacacagactccgcccccacccctctggaccttctgccaggctggggaatccccaacaatgatggaggccagggatgaagaaaggttcactttgtggattgaaggaccaccatgatcctcgatggcctcggaggccatgttgatatccgtggtccacgctgctgccccagaccgtgatgaagcctcccattcatgatgccttggtgatggcttcaggctttgccgcctcagggagccatgccaacgtgagtggcatgtgtgagcacctgagaccatgttgaggctcatggcatgggctaagggccatgctgatgtctaatggcctgtgttaacactgaagcccatgtggatggatgcccgagtgggtggggaggggtgctctgccgtcctcagtgctgtatgtagtacagaggtgtttgtggtctaccccacagctctcctcagctgatgccttctggcccaggtacagccagagaaagactcatcgtcccttgggggctagcattctgaccgtactccagtgaatatacaaaccacacaaattatacttttaggggaggcatgggaggtagacatgggaaggctgggaggtatgaactattggggcagtttcccaaataattgtcttagaaaagtaccctcgtcgggcatggtggggcacacctttaatcccagcacttgggaggtagaggcaggtggatttctgagttcgaggacagcctggtctacagcgtgagttccaggacagccagggctacacagagaaaccctgtctcaaaaaccaaaaaatacccataatggtctaagtttatgtgttgggctacattcatagctatgtggcttcagtttgggcctgatggatccccccttttcaccaagtagggtagccccttgagtcttcctctctctggtgttttctgctagctctcttggctgaacatcaggagagtgattttc

SEQ ID NO: 21830 - DNA, 1157 bp, Mus musculus
gtgtgcacgtgcgcgcatgagcactcagagagagagagagagagagagagagagaatttttttatagggcactaccttatcacattattgatgctggttggactcatttttaaaattaaattttgcatttcaaatgtgaatataaatactgaagaatttaaaagtagagaggagattgggcatcgagttgtgaatgttgtctctttaaaacacagtgatgaatccgaatgtcatttgggaaaactggcaggcaatccggttgcctttttacacgtagggcatgctggctactaaactgtgtaggagtttataatttgttaggtcattgtgacttggggtagttttcttcatcctatgcatgaagggttgacctctactaagggttatttagaaacatgatagcctctaagtagtgcctccgagtgtctctcccgttccgtgtcagaaaaacagttcaaaggtgcaaaaaagaggctagccgcaacatctagcgtgtgctgcacactcagtgctggggtgggtgctatgtgcatcacctgacatggattaattctgggagagcaactacagtagtctaacttttgtgtatgtattttatgtgcgtacatttatttgcttatctgtgtatgtgggtttgtatgtgtgggtcccggggattgaactcaggccattaggtttggcagcaagtgtctttacctgttgaaccctcttgccaaccctgtatttccttgatagagacacaggctgcgtgattcagctgaggttatagcaggggacaagttggcacttgtgccactgtttattgcctcctagtttctgcagactgaggaactgtgttcagctcatctgggtgttgctccctctcttcagtgaatgcttgaggatgttagatagtctagtgaccacggaacccctgcctaaaggccagccaggcagggaaatgggctcaattactaatcagaaaatcggaagtagtgcccctcagtttctccccacctgattgaaaactacagggcagagtcctccatccaatgccagccgcaggaggggctgtggcaggggaagaaccagtcttactagtagcagttgaaactggcttcatgtttggaaaacagaagtaatgggacttagaattttgaataactctatcattgggt

SEQ ID NO: 21831 - DNA, 1897 bp, Mus musculus
agtatgaaaaagatatttttaataggtgttgttactctaccaaagggggagatatatgaaagtcacctctttttattcttattaaatttaataattactttgcagattttattgagtgctgctacctgttctaatagttgttattctctgacactagaggcttttttgaagataaagtaatatcaatttatgccctggaatttaaaattatcaatccttaagttttctataaagtataccaaaaaacacacgaggcttattgtcttgtaattagtatgttacaaacttttagctagtagtttttacagaaagcacatagcagagatacaaggctaggctgagtgaaatggtcacacagcaatttgtaaggtggactaagtttatttagtgtagttggatagtctacctaagcaattggttttttttaaacttaaatatctgtttattgtgttatttgccattataactcaaaagtctttgctaatgtgtacccttttcaagacatccttttaattatgttggttttttttttttttctttttgtcttgcagttcctgcttctgtccgtttttcccatacagatgtcaaggtgcccgacttctctgactatcgtcgtgctgaagttcttgatagcacaaaatcttctaaagaaagcagtgaggctagaaaaggcttctcttacctggtaactgcaactactactgtgggtgttgcttatgcggccaaaaatgtggtctcccagtttgtttccagcatgagtgcttctgctgacgtactggccatgtcgaagatcgagatcaagttgtctgatatccctgaagggaagaacatggcttttaaatggagaggcaaacctctgtttgtgcgccatagaaccaagaaggagattgaccaggaagctgcagtcgaagtgtcccagttaagggacccacagcatgatttagatcgagtaaagaaacctgaatgggttattctgataggtgtctgtactcatcttggttgtgtacccattgcaaacgcaggagattttggtggctattattgcccctgccatgggtcacactatgacgcctctggcaggatcaggaagggccctgcacctctcaacctggaagtgcctgcctacgagttcaccagtgatgatgtagttgttgtgggttagacacgtggactcagggcctaggtttctgtcggtcttcaggtcccctcagaagagtggagagtaagccttgtgtacgtctaggttggttgatttaaaatatttaagaattgttaataatgtattggcaaacattaatgtgaagtaattgaattcactgttaaatattatcaagcattagcataataaaaccactgttgaacatcattagattcagtcatagacttgaaaggtgcaatgtctttgatagctaattctaataaaacattacagattgttgtattggtgttctcatctaaatttcttttcgtatcttgaacttgagaaaaggtggggacattatttttcatctcaaagtggatgggaaaatcattttgatatctaatatttttctgttttgatattaaacctttcacagttatggaagtatgtattattttgttgaaatattttcactttaaagactgaattttactctctagccaaactggcctcaaacttgtaatcttcctgtgcttgctgggtctcggatgagaggcatgtgccatcacatctagttcttaagtttgtctccaaatcagaactaacaagactgccttgaaaggctggaaaagacaaggaagaaaaacacaaattcaagatattattctactcaaagataaacattcccagtatttatttgcatgtttcactatacaacatttttatagagatgcgttcatgagtcgttcttgatga

SEQ ID NO: 21832 - DNA, 1362 bp, Mus musculus
gagacatttgagaagagatttgaagtcacagtttttagagctttgtcctaaactttaaaataaccatttcatacaagtggttctaagctccccaccctgtttctgtaaagaaaaatatacagtctacacataaaaatgttaatatttggataaatttgtgatccacaagtcctcgtatgaactctgaatttcatagtctgactttcatttctcccagtgctaaacactgaagcttgtggttctcactcagccttaagctgatggatcactgcagtggtgtggggagggttcacaaggacctgtatgtggaggccctgtcacacccacaaggcctggggaaggcttgtggtcttcaatgcagcctaaagatgaagccaggctcctcggcaaggcagcactccctccccctctgccacttcccacgcggtgaaatgtcttgctccatagctggaaagaggctgctctggcatgggctgtgttttgtaaagatttgaggtgccccaagtgaccaggcactgagctgtgactcagtggtgagtggcttgcgcagtagagtcaggtcattgtgacctgcaggcagctttcacctcactccatccttccgtcagcctctgttgcacttcactcttcagactgatctgtggataatgtaggctcctcttctagagttgacaaaactaattccagagcacagcatatgtaccctgtggattatttaaggtaaatgagtgtatgtttatttatcacagtgactggaagtagaaattgtaatcctttgttgcaaaataagtatgtaccgcattgtctcctccctgtgtgctgttattatatctgacataaacaaactaaattccaaagcagaagtacagaaccatttgttattttaaacacctaataaatacagtgcacaaagccagtagttgtccttctctgtaagacccctatctttatttcaccatttttattagctctgtaattgcttatattcctgattttaaaatccacaataaatagtggagttctctcttttatgttgtgtttgtgtcttcattgttaaacaccatgtatcaagtgtcttgttagtttcagtaggagtgtgccatggacactacttcattgcagacagtgctagggcaccaaataggcaggccaacagagagatgagttgcttctgagacgttaaggctgggaggcacctagagacccatgcttgcactcacaaccctggtttccctttaaggctgggaggcgcctagagacccttgcttgcactcacaaccctggtttcctggcgctgaacttcaccacaacccacttcttcctcccaggtcaacacagtttctgtcatccttcccctggggc

SEQ ID NO: 21833 - DNA, 1195 bp, Mus musculus
aacatagactttatgagtaaatagaaataaataattctaaaatgatagaatgtattcactcctaagatacactgcgaagaaaacagtgatttataaataaaaataaagggacagatgtagtgcttgtgtttttgataaatatttaccaatttcctttggcacagatgttgtgtgctctccattagctcagcgtttactctccctttgttgctttgccagacagtgagatgtgatgggaagagtgccgtcctgggcacgacgcaccatgtggttcagttgcaagttgagcattgatgggaaatggcacacctaattcacctacgaaatttgtagtctcagcttggttcttgagtgtgtgcctcgatttgtagcagagcttagaaagacgaaggctaactcgttttggaataagaaaggttttgtttctggttatgtcttaacattcatttaatcaggttaagtctcatgtcttcctgtatggatgctaaagcatttcttaacttttctaagttatttctaaaagatagctaatttttttttgtcaatttcttagacggctgagaagtcaggccagagtgaaagatcaaagaatgtgaggcagagacaaaacgatttcaaggtgagtgaagggtgagaatgctgacttctcagagcactctctctcctggcgttattgaagactttacagtcaagatactgtcttatcatttagaacaaactctaccaggttgatgaccataatgcagttttgcttttcattttctagaaaatgattcaagaagtaatgcactccctggtgaagctgatccggggagccctgcttccactcagcctccgagaaggggatgggaggcagtatggcggctgggaggtgcaggcagagctttcggggcagtggctcgcacacgttatccagaccataaggcaagtgtgggcacgtgggagccatgctcatggaaagggctcagtgggtttacatgcatttgtttgctgtagtggtttttaaaacagtcaacaccccagagtaagatatgctacttaacatgtcattgaggaatttatcttctgcctctctgtcctgaggctcctatttctcacttatctagccaagcagttcttcagcatgtctggtatatgtgctggatgagagtgtcatactgtctgtgcacccatctgctgcagagaccctgtactg

SEQ ID NO: 21834 - DNA, 1212 bp, Mus musculus
aacctcagcttgaatgccagcaagagcttgagcaaggtgcacaaactcccattttaacagccaagaaacagggaacaagtcctaccaaagtcaccagggtgagtggaaatcacaaatcctaacaaattttttgcaagttacattgaaactgtaacaaaatggtcccagcaagaccatggtatcagtcaaaaaggatggcatcagcacaggatttgctgatctgtaggtttcttctcaagttataagcagggtttttgttgttgttgttgtttgtttgtttgtttgttttaaggaactgaaagtataacaaagtaaaaacagaattctaggcctttaggcccaggcttgagaatgtggcctttgtaaaggtatgctaatcataaaacagatagcgacattcctccacccacccacttcctgggttcaaagagtgctcattcaaagaaagtcaccctgaccattaccagaacctgcaatgcaaatgtgctattgttaggggctcttagaagctgtcttgagagtttacaattaccaggtattccttgtgactcttgtaactttgcacttccttgtgactcttaactggtatctttggtatcttccaacagcgccctccccacttccttgagttgtggtttcttcctttaaatacccccttacccagctactcggggcaccacggtcctctacccctgcgtggtgtatgaccatgggcccgagagcgctcttgaataaaaatcctcttgcagtttgcaacaagaccgtttcttgtgggtgattttggggtgttgcctctcctgagtcagaacatgggggagtcctcacgttgtgggtctttcagaactagatttagatttattttgaatgtatttatctatagtaagctttcttgactataagtggtttattgaatatcctgccaccttacagaacccaaggcctctttaatttgtatggcagatacatggatggattgaaattgatggtctttttacataactggagttgtcttataaatattaaatttcagtctgcttcctttctgtttatcccactgtctgattgttctctgtgacacctcctcttttcccctactgcaagtgaggacctggcacatgtgcgtagaactccatccatgtctgtctaatgagctgggtctacacactgtctcacatagacatatgcagaggcatcttgctgcttgtctcctat

SEQ ID NO: 21835 - DNA, 1202 bp, Mus musculus
catgtgggtgttgggagtagaatttgggtcctctgaaagtcctcttaatcactaagccatctctccagcccctcaagctcctgttttgaaacatatctctcagttccaactctaaatcccatttagagcagttttccttggtcatttccttttgttctctaaggtgaacaagcagtgacttactaactgtgtgagcgtgtctagctaatcaagttcttgtgttagaaaatagagaagtgccttggccatgtcagttgtcatttctcttcataatgatcagctaaaaatatgagtgaaatgaaacctctccctggttcctgaggacagacagtgaagacccttgtggagctgggacgtgtgccatggtttgagggtgtggcatctcttccccatcttcggaagcatggatcctccgtatgatgtcctactctgatctaggagcactgcctttactgtcctcattgcagatgaggaaactagcccaacaaaggacttccctgaggatgcactgtgtgacactggcatttgccaggctagccttccccatcccttcctttttccaggaccatgttattctggctgcctaataatctgagctcctctaccctttaggcctttagagataccctctccctgtctccactccctctctcagttcttctgcctaggacctcacagcactatggagatgggtgctgccttcccacttcgctaaggactgtcctgtcttgctcagcctctgggcacctccttagtaggctgaaactacaaaccatattcagacctaacttgtcatgactacctgtggagctggagatcccagctggctatgtgttttctgccaacagtgcaggcaccgagcctggatggagcctctgaagaatgttctgagagtgggaagtgtcaagacccaacaatggctctttgtcctttctgtgtgtaattgacacattctctttctgagcagagctacttctgagctgcattaaaaagaaagcccagggccagtgagatggctcagtagataaaggtgattgccaccaagtccgacaacttctgacctccatatgtggccatggtgtgtgtatgtgtgcacacacacacataaataaataaataaaaaataaatgtaaaaaaaaaaaaaagaccagacaataaaaaaacaaaacaaaaaccaacagatatgcaggacatagactatg

SEQ ID NO: 21836 - DNA, 1194 bp, Mus musculus
tctacacagtgagtttcaggacagccagggctacacagagaatccctgtcttaaaaaaaaaaacaaaacaaaaaaaataaattaataaaaacaaacttcaacaatggtcttcagtgtgtattagagcaaatgcttaaaggtagctggaaagaacaccaaacataaagctgaaattcttgtagcatgtttaatttattatgagaagacgagctagcacattgtttctgtataagtaattgtagaggcttgttacagattccaccctatacagggtgtttcagatattcaggtgttttaatggaaatctctaaacaatgcccttggccttattttggctaaagtgaataggtagacctatgccaggttctgttaattgatgttcttgctgcttctaaagtatgggcttgctcttgggttgcaataacttaaacatctgtagtagttcttgaattgttatataaacaatattctaataacattatacattaaaacacagcaatagttctcagtttaaaaatcagcagctgtttttctacgttttttatttctgtctatattttcctatgtttgctgtgcgtgcatggtgtataagtgttcatgcatgtgggtgtgtgtgcacatggagagcaccagttgaggtaatgtgccttctttgattgctctccaccttatgtattgaggcaagttacttgaacccacaactcagtgatttgtcgtaactagtttgcttgccccgtggatcatttctctgcttcttggtggtaggattaagtgagctatcccacctatatgacatttatgtgggtgctgaggaactctattcctcatgcttttgtggtaagtactttatctccccagatcccacacttaattttatagggcaaagtttattgcacatatttagggtggatcttcctaccatagttgatctaatctagatattcacagatgtgcttagagatttgtttctgtgatgatttttagttgccaatcaagaataaatataaaagccccatttttttctgtcaacttgatacttagacacctcttgtttaatccataaccccctatctgttgtctctataggctcatggccatttcatagtgcaatagacatacattcagtccaacttcaaaagtccttatcgtctttaggaattctagcactgttcaaaagttggaagtctaaatctt

SEQ ID NO: 21837 - DNA, 1235 bp, Mus musculus
gctctcaaagctgttctccagctactctctgagccagcttcccgacaggaggccggagactagcctcagttttacaatttgcatttgaataaagtacctagacttccccgaaagaagttctgctttcctactttctcactgtctttcaagattttgtctttcaagcaggtaaatcaacattcccgaggcggaccagtggatgtgcatccccgcccccctagagcacacaggtggcagctgttacccccagtctcaggacatttccagcacgtggttttcagtctgagttaaaaatttaggtttacctagagggctagaagagtagatatttccatattaataaagattggtttttattttgatagacaggcttagccccttagctgacctctggcttttcacccttgctgttactgcaaggtgtccttagctcaataggctgtggaaaaaacagggatgaggaggaacgacttccagctcctattttagccacaaatcgtggtgttactaacgacataattcttgcttaggctttgctaattctgaggttgataattctcctttaggagctgtacagcactcagaactgtgcatactggtttgtgattgtacaaattcagtatgggcaccgcttggtgcagagatacttactgcaagggaaggtctggcttgaccatttctgagtttcctgtgagataaacccggtttgaaagaggttggtaccaaattttggttaaaaataaaaaatattctccggctctacctcgcctccccaaaaggtaccgagagccacatgtgtgggttttacccacgggaggaatcgggtccatgtccacccaagccaaggttaaaagcccactcatctacggatgagaaaatcatttgatcacctcagttaagcgttgccttatttaacttaattaataggggggagagagattggagacgtactattgaaagggcaagcccttcactgcctcccacccaaataaaagagccggtcgaacgccttctccctgtttcccacctatcttccaaaaatgcggaggaattcaacttagtgttattttcacatctttcagtcaaacttagccagagttccaacgccctacttaaaattcaactagaaagttacctaccaagtactaattagcattataaagtcagagtctgcagctccaggcctttcagttagttgtttactagaaaggacagtcttaagccagatacagttt

SEQ ID NO: 21838 - DNA, 1185 bp, Mus musculus
tcagtggcccagcatagccagctgtgagtgctgtgctcactcccctgccccatgtatgttttcgggtggccctgcccccattcctttcccccttgtgctgctggccatgaatctgttccaagctctggtgaggaaggaatgcgccctctcagggcttctcctgcccaatcagcccactggtagagccctgctctctgggaactcacctcctgcccatcacggaaggctgcaagcactgctggtgcagagccccaggcggcagtctccaagttccttatgccaagggcagagcagtcctcactggagattactggcacatggacttgactccaaggtacaccgtgccccttagaaaggcagcccacgggacaattgtcagcaattgttgcaagttctcttcatcacacaggaagaatgtcctggaagcagatgggaggccctctcagctgctttggtgacatagacactaggttcatggaaggtaaggagcatctgaaaatcttttgccaggctctgatggaagtgcccgaccaatatgaccaggtacagaagttagagagaaagcagagtaagtcggtaagaaagttagcacaagttgataaaaaaaaaaaaaaagtacagaggaggagacataaagaaaggaaggaaagtgctgctaagaagtgagctaataaaagaaaaagatttaacccatagagaatctaggcaagatcacgaaggtaaaaaagagcaaagcttcagcagatgcaggagagataatgacagtggcaaatagagagattaacagtgaagaaagaaggaaatagaggtgaaggggattagagagaggtctgagataggagagacaggcaaaaggaagggttgttatatagaaatagaaagcaagataggcagaaggataaagcacaagtgatgaggcgcatggacaagccgacaaagacagagacatgagtcagaatcagagatgtgcagtaagaaagaaagataaaccagggcagaggcaaactatgagggaggataggtgacaagatggagacatgataattggataacatccaaaatagacaagagaaaaacttgcataaaataatgaccacagttgtcagggaagctagcaagccttgagaatatagtaagatagtacctggcaacaaaagagagcctttggctaaagatcaatgagtt

SEQ ID NO: 21839 - DNA, 1172 bp, Mus musculus
ccccactctgttctcagctcttttgaggcatccagccacggctgggtgtctgagagcctgagaaccaggtggccctggcctccttgcaggacctgcttcagctgtcccacacctcagtctgtgctccccaacccctggagccatgtcccactgattccctacagcccaacacctgccaggaagcatgctcaaaactcttgtgttcttcctgaggggccaagccctgtggcagagcagacacaggaaccactaaccctacaactctgttctccagggaatcagactttgtacctcataaatttctcccaatgaaaccaggagatgttaggcattatgcctttggattagaaaaattgagcatgcatgtaagatcctattttattagtttcttttgagatggagtatcagtatgtatctttgtctagcttggacttgctacatagatcaggatggacactttctgcatgtgacctttactttctatgttgtttgtgtgtgccttgttcactgagtcagagtatcacagtgtaggtgagagtgaagattcggcccatacatcagcctgtgtcgtgtgatgtttattccaggctcaccatgatggatcctctgctggaagcaaatgctacttttgccttaaaccttttaaaaatattgggtgaagacagatccaaaaatgtatttttatcacccataagcatctcttcagcgctggtcatggtcttattgggggcaaaaggaaccactgcgatccagataactcaggtaaccaacactatatataatacagcagataaatgctgtggactgtcagttgagctggtgcaccacattccaaattgctcttacagatgatgtaggggtgtgactggagacatgatgggcaggatgtgataccctgctgggatgctagctctagcattctgatccactggtggtgacagtgtatgtaagggttaattgagggcagaaattcttaaggcatagcaccacagccccatgacctccattgtctgtggtctggccctaatggatctaaaccttcctacagatgaggtctcctcctaggatcttgaagtttattctcaaatggggtcattctaggctagaagaccaggaatagaacctttgaggatcttgttaagtacagtgctttatctgtagacattatgaac

SEQ ID NO: 21840 - DNA, 1197 bp, Mus musculus
gggcttgcttgcacatgctaaatccacccaaggtctcctagaatcatgttatattatagccacatgtatatgtgccatctttctcactcttctgggctaccctgtgactctagagcagtgtttctcaacctgtggaccgcaacccctctggggtcaaaacatcctttcacaggggtcatagatcagattatcctgcatattcaatttttacattacaattcataacagctacaaaattacagttatgaagtagcaatgaaaacaattttatggatgggggtcaccatgacaaagtgtcacagcatcaggaaggttgagaaccactgctctagatggaagactgaaagcatgccttatttacagctgaggaaagggcccagtgatgcacagtgacaccccttgacttccccgatgccctttgtcttatcagcctcacttcctagctaaaaatgaaaccttgggatgcagaaaggctggctgagcaggcaccgctcaattgtttgtctgtagctcatttcctaggagctcctctatagctcctgcatggaaagttcatgcaggaactccaaaaaaaaaaaaaaaaaaaaaaaaaaaaaaaaaaaaaaaaaaacacacaagaaagcattggtttgacattgtgtggtttataccaggaatcccacttctccaaggaggtttgcttaccctctgaaaagctgttgttcagatgtgtttgtgaagcagccatgtgaggcctacacttagtgtcctgacctcagctctatcttccatcttcccttttatttcttccagagtgctacaataaccaaggagagtaacagtacctgaaacttttggctgttataccaaatcagagaatctatctcctccaacatggcaggtaatgactagctatggggacgttagacatttagtcagaaattatattatttgctattaaaaattctaagcaacatagaagtacatataaacccatttggtttatgacatggatcgccgtgtgcaattaacgtttgtggtactttttatttactctgtccattttaacctccaacagagtgggccacatgcctttcctacctttgtccaaaaaccattcttgagacataaagttctcaaaaagaacagtgaagaaactagcttctgtttagaccaaggtttgattccatctttacctttcccctccttttgcaaacc

SEQ ID NO: 21841 - DNA, 1116 bp, Mus musculus
ccattgggatctccgtcatttctaagtccttagagagctaatacccagaaactatcaaatttgaaagtttatttcagtaaggtttatttaatccttccaaaggaggcataggaagactaaactgtaaggctgtcaaaagcgcttcaaaaatactggtcccgagcctcactctgggcctatgtcttcctcaaaattaccactagagggagaccggagacaggtcctaactccatcaggcttggcaatgcgcctctgtgtggagccattgcaacacaactccccacccccactaggggtttttctggttaattttttagagcaccaagaactgtcttttaaaattgttactgcttctattttgctctggtgttggctatgctgagaacattcagtggaccgtaacccagtgggtgttttcaggtagcggaaagaccgattttgcacctcagcttcagagcctaaataagaagcgcttcacattggtggcctgggaccctcgaggatatggatattccagacccccagatcgagattttccacgggatttttttgaaagggatgcaaaggatgctgttgacttgatgaaggtgagacccagagaagtgctggagtggggagagatgactgggcccatctttatttgttctaattcctggtgttctttctttttacaaaggcaataccaagtgagtctaatataaggaagagctaaaggaccaagtaaaaacagagcccagctatctaatgatgctactgccaagacaccaaggctctgcctttcccaccagtctcctggcataagtgcagttttagttttgttttgtgttactttggtttgagacagattttcattgtatagtcttaatgggccttgagatctcaacccttctgcttcaggctctgacatactaggattgcaggcctacaacaccacaccacacatagcaaaatacacagctttatacagatgaaaatggagtcctaaaccagaggttcaactccatggcttccacccaaaaaaagcaacaagaaatgctggtgaagagacaggaaagtgttctaaaaccaaaactgccatttggagaagatggaaagtaagcccttcggaccatcttc

SEQ ID NO: 21842 - DNA, 1100 bp, Mus musculus
gcttccaaccactcttccctgccagtctgacctatcatggctctcctttctcactagaagctttctgtgtctctactaaactacagatggcctaacagaagaggtttgcccccagtgggtccagcattttctctcctaggctgtgcctatactatgtctttgatggatatcttggccttcggagcctgaaatatttactccctggccccaaaggaaaagtttgcagagcccagcacgtgcaaagtctcttccaggtattctgctattctcattgtaaactacttggaggctagaatcttaagttctagaatcttagttctctgtgctcttcctgtttttaaagcaatctgaaactcttaagtaacagatgacttagaaagcaaccctaatctggcctccacttgtcctcaccaccctggcttagagtagcctgttcctcttttgccatccgtgagcccccgctgcctctggcacccagtgcccttgcttcttccaaatcctccacttctcttcctgggctcttgctctctgcctcaatgggtaaacactactcctgctccagaacactgcccccttcccctgcagttcctctttattacactgtgtcccactccataactttacaaaataggtgtctgtgttctctctacttcagtggcgttgtggtcgttctagtcttctgctgcatgggtctcaccatagcaagtatggtatcgtcaaagtgccgtacttttaactcatcgggagcactccctcactaccctctagacatttgagtcatgccttaagttgtaaggtctgtagaaacacctcctgtgtccacattggtcatctgtgtcacatcttccttgcccggccagtcactgatcttttaaagtatctgtttctaatgttggcttggttttgttttctgtcttccattatttctgtcctcctcctgcttgctttgggttctgattcgctttattccctccaatctcagagtagaaatcttagattattgctttgagatgtttagtcttttctaatatatcatttaatgctgtaaattttcctctagagctgctagagctaagcacctgtgcatataaagatctatt

SEQ ID NO: 21843 - DNA, 1142 bp, Mus musculus
cagggtctctcagtgaacccttagctcactgtctcagctagaacagctcggtaacagactccaaagaaccatctgtctctgcccactgggactgcagttagacgttcctgatttttacgtgggttctggggatctgaactcgaatctttatgtttacactctgtcctagttttattcctgttgctgggatagatgccctgacagaaacaactaaaggaagaaggggtttcttttagcacacactacgttacagtcgatggtcgtggtgaagccacggtggttagagctcaagactctgggaagcattacatagtgaggagacagaggaaggaggtacttactctggcttgctccaatcccctgccttcagttttacagcccaggccccacaggaaatggtgccagacatgtttaggctgcatagcctcaattcagtggcaccaatcaattccccccacctcaccccccacaggcacctgggactgtttcattcaattgctgtgtcaaataccatgctcaaaagcactttagaagaggaaaggctttattgtggcttccagtaacagtccatcactgggtgaaaaccagggcaggaactcaggcaggaacttgaagcagaagccatagagatgcagcatctactggctcactcacccctaaacccacactgagccagctttctttcatttcccagggccccttgcccagagagaacattgccctccacagtcagaagggcctctgtatctcttaaaaaccaaggcaatctcacagaggcacaccacagaccaacctgacagagataattacttgagactcttcaagtgattccaggttgtgtcaaatccacagctaatgctaactaggtcactgtcaatctcaacagttcttcaccaggcctcccttccacagtgtgtcgacttgacaagactaccacatacaacaagcactttatcctttgagcaatctccacatccctaagtcatcctaacagagccttccactgcctctggaccagctggctttccacgatggagacaaaattccgaatgtggcggactgaacagaggaaatactatttgggttcatggttttgggttatgtcctgttactttgggactgtggcaacagagcaagcacat

SEQ ID NO: 21844 - DNA, 1103 bp, Mus musculus
aggatgtgctcatgtgtttctttgcttgtttgtttgtgcagacgtgcatgggggtcagaggtcaacatcaggggtcttctttattcaattcctgacttagattttggaatagggtttatcggattctgccatgctggctagccagttcctgtctccatctccccagcactaggattatcagcatgaaccgctacacaccgcctttttaaatagttggatggtggggatttgaactcgggtcctcctactttcatggcaaacacttttaccaactgaaccaatgccccaaatcccctgcttacttcttaaatggtatccaggtttcatctgttctgttttgttttgtttacttggtttttcgagacagggtttcactgtgtagctctggctgtcctggaactcactttgtagaccaggctggccttgaactcagaaatccacctgcctctgcctcctgagtgctgggattaaaggcgtgctccacaacatgcggccaggtttcatctttctaagaaaacttttgttctgatgtcttgtgctcccactcttcccacatttggtatctattttaggagatgcccagggaacctggctggtcctgacatcttttgcttcaagtttagctactgctaacttgttatctatggttttctctagttccacttttatctccactactggcttatgtatgtttttggtgtttgcactgtggtttataatatatacgttgccacaatatgtctccaaacagtgcctccgagcacctggccccagatgtgaacctcctgcgttgtgcacttcctcctgctccagctgtccaactggagcctgagtggtatcttactcccacatctttcttttgtaaacaaagtcactattgctttaaacaactcatgaagagattcaaacgaactcatgcacatagtagccatttcagacctctgcttttctttgggtacgaatagtttcttccctgcttataaaacttactttggtatatccttaaagtggcaatgagttggtcagcttttgtttgactttatttatattttttaaattttacctcattgttcaaagatgttttcactggagatagaatttta

SEQ ID NO: 21845 - DNA, 2177 bp, Mus musculus
ctgtgtcatcctcctggctgtatgtattcctgcattcactggttcaccaagctagacttagaagaaatcctccctttgatctgttggtggtgacccatctcgaaggggtagtggtttgttcacattttcccaggaaatgtcacacaacagagagctttcggagaagtgaacacatagaagttcctagaggttgtatgtccagcaaagacaccacaccttgtactttttaccatatgccctgtgctaggtgtcaccttgtctgatgcccatagttaattattccttttatatttaaaccagtaaactttagtgcttccctaagcactgtaaactgctttaggaaattagtcaaatctgaggagagattaatggcagccacaatttacagccgttggtcagaaatacagggagtgaccaactggttgccactggcatctgcagtgtggggtagttgtgtgggacagagcccttaaactgtgtatgacaatatcaatactgctgctttcaggaagctagcatcgtatctggattgaactggtggacatccaggtggtgcccgctgtagaatgacttgctttggtgaggagaaatctcatgtttggggttatgaaagtattctgtattgaatgtggcaggaaaacccatttttccatagactaatataaagaagggtctcttacattcaaagatagcactaggagaggcgataagcttctgaagtgttttctactgaggagaagctggactttctaaagcaactgaaaataacattcaaaacttcttggcccacatttctgatgagatctggaaatgtttggatggagatcattcagggtggtatggctatagacattgtccatgtctggatccaaacatttcttcctcttattttgaggccttcctaattttaagctaatagatacaacatatccatgacttacagacgacgtgtttcagtgacctacaatgaaatgttcatgtcaggttatgctggtcacaaacattaaacagctaatggtaggggttgtttgtttgtttgtttgtttgttgtcttcctccaccacaaatgtgtttgctgtcacttgtgtgtgtggtcaccaaggaaaagggatctattttggcagattgggtgatagaaggtacagagtacacttaaaaaaaaatgaacctctatggccacagggagggtatctccaggattttggtaggggacaggaactattaagacaaagtgttagagagggatggaaaggagcccgtgagatatccacggccagagtccgtgactggtgtctcgaaggattgttgagacctgtgagcctttggaagtgaagataggcaggcacattcagcagctacataatacatagtcacaactctgaggcataaacattccctaaaggaaacaggatctagcaagctgtcattcaccttcacagcttctttccttcagttctctgactgaataaggtatgtggcacagtttgaatatggttcatttccaataatcatgtggggacttcattctctgacataatgatggtgaagtgtggtgacttttaaggatgatcagaggtcatggggcatcctgggaaaggattaatgcggtctctaaagagattagctcctttagatcgggtgattgtgagactgaacatgaccctttctctcccatcagtggcttctttttcctctctcacacacatatgttcctaacacatatgttgtggaatagccacgactctcaccagagcccagaagatgcaaatgttacaaacttagaggaagtgtggataaaatgagcctctatcctttataaagcaataagattcagaaattttattataacaacacaaaaacagaacagcacggtatagttttaatagtgagtggatagcaaaagaaaagagaatccacacgtagtgagcacctactatgtgctaggtttattaccatttagtctatagtggagagagacctcagttgtcattgatgaacctgggaaacttttattgtttcagctttgcatatctctatataaaacagtttatagtatccgtacagaggttcaaataacactaatgtatacaggaataaggaagtgatcatgcctggtatttgtgaacctgtactccctgccatactttaataccacttaatttttccaggaataatat

SEQ ID NO: 21846 - DNA, 2040 bp, Mus musculus
gtggacctggagccaggcacaatggactcagtcaggtctggaccatttgggcagatcttcaggccggacaacttcgtgttcggtgagtatgtggcatagctgaagacagaagagcacaaggtgttaattatcactagcacaaagggtggaggagtgtgatagacagggagcatacatagcagtggcgcctaagccttatcaggctttgaggcaattgcatcttagctttttcaaaggcaggtgtgctctgttaactcatttataattgtattgataaccaaatagtttattgctttattatttattggccatttgataataatttgaaatagccttatctgagaggtgattctttttttttttttttttaaagaaggaattttcccaatcatggctgacttaatcctcctttgctctttcaggccagagtggtgcaggaaataactgggcaaagggccactacacagagggggccgagctggtggactctgtcctggacgtggtgaggaaggagtcagaaagctgtgactgtcttcagggcttccagctgacccactcactggggggaggcactggctcaggcatggggaccctgctcatcagcaagatcagagaggagtacccagaccgcatcatgaacaccttcagcgtcatgccctcacccaaggtctctgacactgtggtggagccctataatgccaccctctcagtgcaccagctggtagagaacacagatgaaacctactgcatcgataatgaggctctgtatgacatctgtttccgcaccctgaagctgaccacacccacctatggcgatctcaaccacctggtgtcagccaccatgagtggagtgaccacctgcctgcgcttcccaggccagctgaacgcagacctgcgcaagctggccgtgaacatggtgccattcccacgcctgcacttcttcatgccaggctttgcacctctgaccagccggggcagccagcagtaccgagccctgacggtgcccgagctgacccagcagatgttcgactccaagaacatgatggctgcctgcgaccctcgccatggccgctacctgaccgtggccgccattttccgtggccgcatgtccatgaaggaggtggatgagcagatgctcaacgtgcagaacaagaacagcagctacttcgtggagtggatccccaacaacgtcaagacggccgtgtgtgacatccctcctcgtggcctcaagatgtcagccaccttcattggcaacagcactgccatccaggagctgttcaagcgcatctcggagcagttcactgctatgttccggcgcaaggctttcctgcactggtacacgggtgagggcatggacgagatggagttcaccgaggcggagagcaacatgaatgacctggtgtctgagtaccagcagtaccaggatgccacggctgatgagcagggcgagttcgaggaggaagagggcgaggatgaggcttgagttccccaggccaagcaggttagggaaagctgagatgaaaggagggggtgggggggcttaatctgtgaaaataccttggcagttgaaggaaggagaatggtcttaggtttgtgctgggtctctggtgctcttcactgttgcctgtcactttttttctctttttgtaataccgataacatcaatgtaacacttgagatctttctgaactcctgttgtaatggctaaaatcacataaacctttgtgtcctaacggtgtcctcttttctttctcttcctttctccctatcaagctctttgttatcaacttaaatccacctttctgaacacagaaaattttcttcctttagaaaagactgaaagctcaggtgtttgtttcttctttgggtatgctattaatataagttgaaccaaaaatggccttactcaatccaacaatgagaagaaacaatggattttaagatgtcctttggtacacgacttgtttattgagagtgtgtttttatgaagatgttgccagacctttatttccttaaaggtttatttgagcagttacttag

SEQ ID NO: 21847 - DNA, 1176 bp, Mus musculus
tctgacagagatttcacaagaagaacatgattcacaacaaactggtcagttggactgcatcaaaatcaaatgtttctgctcttaaaaatcagtaagaaagtgaaaagacaggccacagtctaaaagaaaaatatttatagagtagatgtcttatatagaatttacagtcaggatatataaataattcccaaaacataataataaaaaactaacattgaattttaaaatgggtgagtctagagaaatagctcagtgattaagaggactggttgatctttcaaaggacaggaattcaattcccagcaaccacatggtagcttataactgcctaacttcaattccaacaaccttttttgagttctattggcaccaggcatatacatggtatacaaacatacatgtaggcaaaacacatacacacataaaataaatggcttttatttaaaaataaacaaatgcaaaaataaacaaatccaaacatttaaacctgtaatcccagtattctggcagcaagaggatcatgaatttgaggctagcctgggctacatggaaattttcaagttagcacaggctatatagtgagatcccatctgaaaaaaaaaccaaaaatcttttttaaaaaaactcatgcctaaaccaggtatggtggcgcttgtgcctttaatcacaaaacagaaaaaggtgggtggatctctatgaacttccagggtaaccaaagctacatagttacctagtaggactttgtctcaaaaaaaaagggggggggggatgaaaaggaagagaaaaagaagaagtaaagagttgactaaatgtgttaccaaagaagatacatgatgacaagcctttgctcactccaaaacattgttatagcactctagatatttccaaggagttacatctcagtaaacccattagggtggcttcaatgagaatggccctcataggggcatatgtttgaatacttggtctccagttggtggaactgtttgggaaggattgggaggtatggccttgttgggtgtatgtttcactggaggtagactttgaggtttcttggtgtatgatcagcctttgcttgcaggccaagatttgagctctcagctctagccacctgctaaactctattccaccatcaatggatgataaccctctgaaactataatccccaaataaact

SEQ ID NO: 21848 - DNA, 1242 bp, Mus musculus
aacgttaaaaggtcttactctccacccatccctacacctgttttcataagttatgcacaaatgtcaacagctgagacggggtgggacaagttcttcattttgctctttattaagtcaaatattatggaaatatctacttattagcacccaagacaaataggggaaaggtttagatgtttttgtgtttttaagactataaccacctgcaactggaggacagggctgataacgggtttggccacaaaatggaaagcaagcaaaatcagacctcgtaaggggagtatcacacacagtcacgactacttcccagagccaaacgagaagtccctgaactagaagtgccattcaaagaatctcgtgaccatcacacacccagcccctgggtggcacatgggttgagggaggcccacacttcaactcctccctgttctgaatgacaccacctcactctaatgtattgtgtgtgttttagagaaacaatatggtgtgttgtgtctagtgaggaacgcctccctacctctgtcctttctgcaacccaaccatgcgtgcttttcctctaagagccgcgtgactgtacgtgttgaagggggcggtacctgttcacagcacaagtttatgttgagctctgaactgtcattcacagctgcgtgtctgcatggtgtcgcatctgttgtacctttggggaaaatttgtatgtaaatgtacagaaataaaaatgttgccccattaacagatttcctctggaatgtcttccctacctcacctgatggtatccacaaagggcatttcactaccactgaggacgagtaagaaaatcctccacgttgatcagacctccccacgtcactactttcaaggcttcttctgtgagcggccttcattcgccctgcagatggtggggcctctcactctgctttaagagtcctagtcttaaaaggtagtcagaggctgagatcggattaaacttaaatgcttatgtagtgtaattctcaaaaccatctgagaatcctgcacatttaagatgaatttttttccctcctttgtgttctgctaatccgtggcctgaggattcctagagaggacaaggaatgactatctacactgtgattctgggaggaaagactgataacacaaaactctcttctctaatgtagtattttttaacaagaaaataatatttctttaataaagcatttataccaaactcttctctccatagctgattttgtgtcacttactact

SEQ ID NO: 21849 - DNA, 1179 bp, Mus musculus
cctcggcgcccctcggagggcgcgcgggctccggcagcagcgcggagatccagccactgcctgcgctgcaccccagcggcggcccgcactcgagctgctgcgcggcgacagccgccccgagcctcctgttgctggactacgatggctccgtgctgcccttcctcgggggcctgggcggcggctaccagaagaccctggtggtgctcacctggatcccggcactgttcattggcttcagccagttctcggactccttccttctggaccagcccgatttctggtgccgcggggccggcaaaggcaccgagctggcgggtgccactgtcaccggccgatggggtgacatgggcaattggaccagcccctcggccacccccttctccactgcctcctgggggaccacgagcaaccgaagcaacagcagcgacacaccacccctcccatcccctccaggcaaggggaacaacgactcaaattgcgactgccacgcgtgggactacggcatccgcactggtctcatccaaaacgtggtcagcaaggtaagggccacgaccgccgcgtccccgcgttcttcttgtgaacctttttcttctgacctcggtcgcctctgctctgtgctccatctctcattctctgcagacttaggtccaaacctacccagttgaggaacccaaaatgttagcctgtgtacgcacaaccccgcattgactgggctcccggctgtccctcaaaggagatgctcttacttggatgtgaagccaaggcttttttgccgccctctgcggtgcccgtgacgctgcatccgcttcaaagagaccgacttagccttttctaatatccacacaaactcctgtcccagtgcacatatggaaagggctcccctcccccgaaaggttcaaatcctctcctctatctagctaaggtgtcagactcactgatggctcagcaggggccctggaagactcaatccctcttctagggcttctccttggagccaggacatagccatgttctttctgcaggctgcctgtccctgtgtctcccactaagaactaactatccaagagaaatagtgttctactctcagatattctttctagcagatgtcagcctccccacacgtgccttgaacagattaaagccaattgaatccaagttatagacaaagaagcagagccc

SEQ ID NO: 21850 - DNA, 1151 bp, Mus musculus
cacatggtttttggggagacattttagcagccagtatatctatttgtatgtttgtttctgttttactacactacaaatgattttgtgattagactacgtttcttctatcattttgtgcctaggttttggcaatacggaacacagcagtaggtaatcataaaatatgttgggggaaatcatggaagaagttaagagccttgattattgtgatgtcattgaaaacatggaggtcaaaagttcaccttaccacacatacaaaacccccaaaagaattaaaaacaatcaatttaaggagaaggaaggctctttctgttcccagcacatccatggcttatggtcccaaaaaaacacttgaagtgtgtagctgctccaaaacattggataagttggctgacgtgtttgctcctcatccatccactggtcctcacaggctgagggaatgcctgcctctcatcattttcctaaggaacagagtatgtatgccctgactggagatgaagtaaaaaaagatttgcatgcagctattcattaagattgattggaaagtcaggaccgatataacctaccctgctggttttatggatgtcatcagcattgacaagaccagagagaacttccgtctgatctatgacaccaagggccgctttgctgttcatcatattacacccaaggaggccaagtacaagttgtgcaaagtgagaaagatctttgtgggcacaaaaggaatctcaaactggtgacccatgatgctcgtactattcggtaccctgatcccctcatcaaggtgaacgacaccattcagattgatttggagacaggcaaagtaactgacttcatcaagttcgacacggggaacctgtgtatggtgactggaggtgctaaattgggaagaattggtgtaatcaccaacaaagagagacatcccagctctttttgtggttcatgtgaaagatgccaatggcaacagctttgccacttgtccttccaacatttttgttattggcaagggcaacaaaccatggatctcccttccctgaggaaaaggaatccgcctcaccattgttgaagagagaggcaagaggctagcggccaaacagagcagtgagtaaaatggtctctaggagacatgctggaaaagtgtttacacaagc

SEQ ID NO: 21851 - DNA, 1942 bp, Mus musculus
aatccaactaaggacctgttggctgacttgattgggtgccagcgacttcctgaagatcaacgtaaaaaagtacaccagctaaaggacttgttggaccagatcctaatgttggacccagctaagcgaattagcatcaaccaggccctgcagcatgcattcatccaggaaaaaatttaaatgagatgaagaaactccaagggtttgagtaattaaatacaaagactgaagaaatttcacagcagtttattattaatgtatataaacttataaatatttctgcagcaaatttgaggaagcatgatatatttgaattaacaccgagggtgatatttcttttagaaatgttagttaatctgttttgtgtcttatgtgaaatttcactgtagaaatgttttaattgccaagactgcacagaattacagtgctaatgtatatggttgcagttcacataaaagacaaaagcgtctgttatgagtggcagtgctgggtggttgatttgtttttagcagacttggcttcagtttgctcttcagatacaatggccagcataaatgctgtttatattcacgttttcctaggtgtgtgtgtgcaggccacagcagcatgcccttggtgtagtcagtgccgaagggagtctgttccttcttgagcctgcctgcagggatgtctcctcttttaaagcaggttgtgtacaacattcagtacactgaaggtaagctaaaccatcaacatcaccagtgttttagatgttattttattggaataactgaaaatgagggatagctttgtggcagaattccctgcatgtgtgataactgatcttgttttattttttcgcatcgcaactgtggcatagttacagtttctgttctgtcatcacatttaaaattggaagcatatgcgcttgatggatagagcgccttcagtgtactgtttcttatcaactttacttttttttaaatcaacttgctatagactttatacattttgttaaatacagttcttagtgacatagagactgcatagttttcatttactaattaaaatgttgaggcctacttctgaaagtcctcatatttaaaagatagacaacataatgagatttttaactatttgtatgtcattttgaaagtgtactgctttatggtaaaagtgtttttcatttgttcattgtttgcattatttgtgatcatgttgtctttcaatacaggcataaaccttccactcttgaacaaagcagctgctttttaaaagcggtaattgcttctttaccttttatttcttttgtaaatgaagcttttcttttaaaatgtgactttaaagtgttgtctattgcataaacagttgacactcacttactgtaatgagaagattgttctgcatgggaagtgggccgtgcagatctctgtatgttctcagtatgcatcactagataataaagtcttttgtgaacaaggcatttgtagccatttttaaaagattttgtcttcagtgctggtaagtcaggtaaactgtaaatagttaaagcagtctttgtttttctcctgaaaggattacctgctaaagatgtaactcagtatagccttatttctaaattgtttttaataattaaggtcttaattatttcatccagaaaaagttcttcaaattttgtcagctttcagtgtagtgaggttattcctcagtgtagtaggttatggggtctaactcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggttatttctgacagcatgtgtagataaacatttagcagcaatttaaaacaaaatcatgtaaatcggcttggttttgcgacacaaagga

SEQ ID NO: 21852 - DNA, 1190 bp, Mus musculus
cctctgaacctacacccgtctcctcatggttagacttactaaaataaacacacggcagtttccagctacaggtagagtgaggccttttaaacaaggcatcacgggcgcagcgtccaccttaacgatatgggtagggattttcccaccatgcttactttactttggtgctaatatgctgcatattcaggtcttttatagttgttttcactcaaaatagtaactgctttcttctgatgattttcctggcttcattttgtagttatttaataagttgatttccactagaaacagttcatcttatgccttcaaagcttttgcttgctctttaaaaacacaaagttgcttgttacttgttctttgtgttttaggtgcagatcactggaagatgacggcagccagaagacatgagccaaggtttctgtcccataaaagatcttttcagttctcatttagtgtgtgtctgacttgtagtttcagcgttacagtttgggtttcattgctgtggtataagaacagtgctgttgtgcccatctgtaaagtgctccttgtatatcatagttcctgcagctacagccttcctcgaaagtaaaaagcaagtttagtcctaaaaagcccacatttcatagctgtcagaattaggtcctgaagatcactaagaaaaaaaaatagctgccaggttagtgtacatttgaaaataacctgcaagttgcatgtgctagccacacctgtaacctcagcacgcttggagtggaggcagaaggatgtggggttcaaggtctgcctggcctatcagagctctttttttttaatgctttggctttaagcaggtgcctaaatcataaaagtagcctaggtttaacaagctggtcaacgcctttaatagctgtgctttgttttagttcgttgtgaccaactttttagtgtcagagacataaaatagtaatggcaggtgttgtggaggtgagaaaggcggtactataccatcatcttcccgacctttaaggaaccggggagctgcactagagaaacgtccttctgtttgatgtggtaatgtcactgaggtagagtttgcagttgtgtaagacctctcttaggttgaggtcagttgtgaatgatcctattggacagacctgcgttcatgtttctgattagctgaaaagtcttcaggggaagctgacaggaagtttacg

SEQ ID NO: 21853 - DNA, 1099 bp, Mus musculus
ttttttttccccccgtaacaagattaaatttctcaggacacttttgggatacaaaatacatattttatggtatgtagcagagttagtgaaatgtaatgttctcattttggccccagatttgcatttcttctagtctactctggcatcatagggagaaatagactcggaaatgaaacaaaggaattacatgtgttaaaatttaaattatttaggaaatgagtgtgtattttttggataagattgtatagtgagatgtgacaatatctccttatggtagcatttgggccctataggtaatattttgtggctcttatacattcaacatgaatttattctacatgcaatgtcctaatataaatgttcactgcaaatcatttgtaatttttccatgtcagtgttgaatacagttgactaagatttgggattttttgttttttgtttgttttggggcttccttgccataccattgtagcatccttactttttcttcttctgtgtatagggtaagggactgttcttctgaagagccattccatttagtgatcaagatacggaagctgacctaagaaaatgttgtgtattctaattgttcttgataccatttgagttgtaacttacgttgtagcagcaaatgatcccaaactacttaataggaagcttaataaagtgtgcctcttgctaccataccgtctactggcattttctttatacctggtattatttctgagctcttgttttacaaatggcagatgtgctttgtaaagaactttgcttaaatgtaatttagggcttgtgcattaaagctaaattggaatctttacctaacagattctcagaagaagggcctccggaaatggctcagtcggtaaagtgcacccacatagaagctggacactggcttgtgtcctatagcctagcgctgctgggagggcagacacaggatactctggactcgctgccatatagaattagaccgtctcagaaatcaaagtggagtgacatggaaagacacaacatcagcctttggccttcacgtgcgtgcccacacataaaccatacatacacacaaagatcttaggagacttaaatgtgtactttg

SEQ ID NO: 21854 - DNA, 1118 bp, Mus musculus
acttgaaggagtattttatatctctgtttgacacgtcttaattcctaatctctggggccattatgtaaaatacgagttccttaactgtgagccctgtggtaactgatagttttacagcccagatggctatcaggtgactaatggtgggtagtatatacagtcaggatacattttatgggggctgatgggcacacgcaggcttctgtggggttgcatcatgctgtcactgtggtgtggagttagttctgctctcttgttcttttttaccactcccctatctacctcagaaagatcttcagattagcatgtcactaaggttctactcctacatgccttctgagtgtggtttggttaaatggatgaatacatatctgtcaattccttcctgagtagcttcagatttatagtggttatgcagaataaaacttaaaatgtcacagaatacatttcttttttgtttggttggttgtttttttgtttgtttggttggttttttttgaaactttgtttactctctgtgtagccctggctgtcttggaacttactctgtagatcaggctagcttcaaactcagatctgtctgcctgtgcctcacaagtgccgggattaaagatgtacgccatcaccacctgggctgcaattaaaaaattgttttaaattgtacgggtgcgtcacgtgtgcacttagttgcacgtgtcatgatgtacagaggtcagaagataacttggtggagtctgttctctcctttagggatagcattgatgtggatttcttcgcttccactttgacgttgattctagggttcaagcccaggtctgccaggcttatgtggcaagcacctttacctactggaccattttgctggtcccgaaaatgagaccttgttgagatagatgttctcatgttggtaggagggaatcagatgttaaccgttagagctcggtagctgtagggacacccagtaagtactccctcccctgttgtgagaaggcaggccccaggggggaaaggagcactgggtcagcgtggtggtcagcgtggtggtagggagcagctgttctaacatttttcagagtcacaatttcactaaaggggagggtgaagccttgggagctcgc

SEQ ID NO: 21855 - DNA, 1166 bp, Mus musculus
acattgtatttattgtaagctttggacactagctggacagattctccacctttctaacctgacaacactggcctggcttacatcctgtcatgtggcctgctacttgtcccttttagtcttctcctggcacttgcttcttccatatctggctggtgacctccctttgccacctggaagacccaccttaacactgtagcacagctattggctgttcagctctttatttgaccaatcagaaggtggtagagatacaaattactaagactagctacgcttcataagaagacaataccgaagactggtctgcactctactctcagctggtaaggaaatcagcacttgagtaacacaagggcacactttacacgcagtgcacaaagtcctgtgcctcaccatttttgttagtctcacagccagagacaacttctgcgtttctctagattcttcttgctggaggttttgtcaggcttatttcttggagtctgtaattgtgttgttttattgcagcagttctgagtagatatgatcctttaatctgaatgtaagagataggaggaggttcgttccctgtagtacgtgttggtgccctgaggagttacatagttcctaatggccttcccttgatccgtagcagagcgaacactggcttttctccctgcttcttttctgaaattggttgtgctcacattggtgtttagacagtctccttgtattttctgggctggtcttgaactactggacccagactctcttgcttacttaattgtgctagatcccccatgcctgctttttcttttgcccatcttttgcattattgtgcagtgttagaatctccaacattagcttccccctttgtttctgttttgcatactttgaagctgtcattaaatggatatgtatttttaacattcatatgtcatgactatgaatgactttttaaatcattgtagactctagtaacaccctttagagctacttgagtgtggtggtgcatgcccttaatcccagcactcgggaggcagaggcaggaaaaactcttgcgttcaaggccagcttgttccagaaagagttccaggacagtcaggactgtttacacagagaaaccctatctcgaaaaaccaaccagccgaccaactttgaagttgacttcattttgcagtagctgt

SEQ ID NO: 21856 - DNA, 1178 bp, Mus musculus
aacagaaccacacctagttccttctggatagtcactctctgacaaatgacaaatgtgtggcttctgaggtgtgacccagtcagcagtgacatgccactatctttacaacatttgtggaaaatacatagttttatgttgggttcagttcctttagaacacaaattacctactcttattaatggagtttccttgggtgggaagaagaaattcgtatgtaggggaagttacaccagcaacctcagacttaaccacaaaacagtctcgaatctggatttcagccaagtccatgcgaacctgaatcacatcatgactttttgttttgttttgttttaactggcccatggtgttactcttggcacccacccacttggtcatggtttgtccatggtctgtgaccactagaggatatgaggtagaccccctcagaactccatcctcagcttgtgtctctgaggattggggttccaagacatcatctccacccatcccctctggtgtctcacagcatgtcaactctttttccttttaggcgaatgaaatgctgttcagtgggcggaagttgacggcacaggaggcctgtggcaagggtctggtctcccaggtgttttggccaggaaccttcacacaggaagtcatggttcgaatcaaggagctggcttcatgtaacccagttgtacgttacagtatcttgtcttattttgttttcttttgtttctttaataatgaatgaaaagcttttcctccacagagattaagttagactggcagcgtgttccaatgtgttcccctagtcttccttgtcctgtgcacgggtgccaccaccagtgctaaccatttactggctgcaaagtcctttggtgcagtcacgtgcttaggtacccataggtggaggccagggttttcagtgactgggttccatgccatcccacagcagtagtggtgtgtcagggctggtccagtggtgggtgtgggtctgagtaacaaaccatctcaaacaaatagcttgggctgtttcaagtttgagtagcactgttaaatatcctgacagccctctgtatccaccacgcatccctccatggagatcagaatccacaagcactgaaatcccttacacaacatggcctgctgtagtctgcgtgtacctctgcatacacttgaggtcacctctgtaggtgact

SEQ ID NO: 21857 - DNA, 1292 bp, Mus musculus
gctctacctttcttactgtcccattcttacccagccaccgtgaagagcccagtgtctggaggaaagcaggtggtccagtgtctgtgagtcactccgtagctcgagtgttacttgctaagttatgaattagcattagtgggtttaaatagtttttctgaccctttttgaaaaataactacataagtactccttgtggctgggtgagaaatactactttgcatagttttgtttgtctatctgcagatatgattgctgtattacaccaaaagtattttttatgtttataaagtgtaatttttaggttcacttagaatatattttatttaatttaaaattctcttggcacactattaaatacgtaaactcctttcagaacagaaaagaactaccttatatttgacatttattatccagtctctgctcttatgtctgccatatattgcgcacggtttcgtgttcacgagtaccccatggtgtggggactaacttcagatgcctattatgactaaggcttctaggtttgcaatcatattgaatgtatgaagactgaaataaaataaaaaaccttatttttgtacagttttgaagtttatactcagaactgacgcctccccggccatgtggagcgctgtgcagtgtgtacatctgtctttaccttggatggattggtacagtatttttgcatctgtgggaccttctctttggttcagtagtttgaactatatatataaactgtacactctgtaaagtttttatagaataaatattcagctgtgaaaactggttaaataaaactaatatttcttaacacattgggagtgtttctctgcgtgtccttcccctgccaggtttcctgtggaggtgtcttctctgggttgttttttttttttttttttttttttgaggttcacagatccatagcccactgttcactactccttctcacactcacgtggatggctgctgcaacttctccaggaagcaaggcatgtttcaccaggaagcaaggcatgtttcaccaaattggcacctacaaaatactgatgctaggtctgtcacttcctctgctgaatcctgctctgtgggccccgggcacctttagtgacctctcttactgtgtctctcatagccagcttgccccagcctgtcactttcctgtcctaagatgggaatcacctgaagcttgtgagaaagcccctaatttgtgccataatatgtgggaagatatctcaaaagataatgacatcccagggggagtccagaaaggaagggagagccctggggaagttgga

SEQ ID NO: 21858 - DNA, 1131 bp, Mus musculus
aaggattctcagagcctttgtgtatcttaggctagcaaaattatgcctggcaaaccaggaagtctcatgtggctgagcatcgttgaggtgaagggtctttcaagacaacccctaggtgagataagttttcttaagtggaagtggacttgctgaaggtgccttcttgtgtaacaataaacttctaggaagctgtcagggttcagtccttcagagcctgatatctccactgcttgagaagcccaaattcatccttcagtgccttccatcaaccaatagtctgaagtaattcagagcactgacctgtgccatgtgctacctacttgttactgaagaaatggccagaagccaaatgagcctcattttcatctcacaatccgtgtcttgttttgctgcagccccgggttaagatttctcatttggacacaggcttctaattccaggtggcattttccttgtcaagctcttcatgagtcaattgtcatctgttgtaaaagctaccaagcatctagcttgtacctgatccagtcgctgtggggctggcaggacagagggaaggacatttaggatgatagttactcctagttcaatatgaattcaagttgacatgactatcatggctgaagtcttataggcaagactataagaagggtgggaacgggaggtaaaggaccttttccctgtggaggaaagccaccagggaacttcatcataggactgcttcctccaccctccagccacactctgggttcttagagtacaactttgggaaggcatgattctctgcaggattccagttccccagcccgagtttcttctgagccatctttctctaaaggtaaaggaaagtgtattatcaggacaacacactgctttattggcaacaactttttctgtgacaataatgaccctatttacaaaactgagcattttgtgtattgtctcatttttggacagggggactcatggggtgaattaacacaggaagacaacacaagggtatgaatcttgtgtgtttcattgagcagctccgaagcaatgtttaaccatgggctgcgtggttgatattctatatggctgagaaacgccccttccccttacactccccagatggagcttaagtgatgtatggat

SEQ ID NO: 21859 - DNA, 1099 bp, Mus musculus
gtcttgtcacactggcaggcattgtcagggttagatccaaggtcagggttttctttttcttgctgctgggtgcagtgataatctatgctgtatgaaccaaaacacatcagaaattggacaatgtctataccagattgtatttgagactgacaaggcaaaacaaaaccccttttgtcgctgacctcatatgtcaagactgggattagtcttccagatccagaacgtgttggttcgtgagtgtcatgacagtgtcgtgtccatgagaatggcttgggggagcagaagagagagggagctctcccttgacagatctgcccatgctggcaccccatccacctggcttcctaccctaccaggctctacctgggattttagacaaggtctcttcttagaattctttcctgtagccatcagaaaaggagtgagtaccaggccaagcactgggacagagtgtggcgccattgtgagctgtctgtgaagctagcagaagaggggtgcggaggttagtcagagtcaggctataaagaagaaagatttgtgtggacttagtctttcacaggtttcagtccctggttggctagcttccttgctttgggccacatctcactgtggaccacataggctggagaaaaactcttcaccttgtggcagccagaaagcaaagaaagaaggaaaaaggaagaggtcccaatatcccaatcatggccatactcccagtaacctaactttcttctagactccaccacctaaaggttccagaaccttctgactgcctcacgccgatgatcaaaccttcgttatgagggccttggagtactaagatgccaaccataacaaagtgtttgtctactgcccaaattccgctgcagaccacacccatcctttactctcaagccggagaagggacaggttagagtgagattagtaaactgtagccatgtgttccgaagactgatgtagcctggagtggccctgtgggtggcaccagcagtttaagatacactgaagtaaggaagggcattctgtgtctgcaccagccacatctgaaggaccatgaacaccaacctactggccaagtttggcttccctggtttccagg

SEQ ID NO: 21860 - DNA, 1173 bp, Mus musculus
taaccttgtggatttataactggtgtaggtcccatctgagcacagagtatttactatctgttaccttcctaacaaggacaaaaaaaaagaatatcttttttattctttaaaagaaccagttcttgggaggaagggagactgccgaattgtagtaaagctctttgttgtgagatctcagtgcacactgtctacctcaccattggtttctacagtgtatttgttatgacatagcatctacaggtgtgtagctcagaggtagaattccttcctagcatgtaggagttaagtccagtcgccattgcctcactgaaagaaaccacagggaaaatcatttgtcttgaatgagagtaattgggaagataggaaagtggatcgactgccccatagtcccttacacagaagttttgatgatactacttttattgtacccttatttttaattgacaaatatagattgtatgcttttagtgtggagtgcattgcattgatttctatatgttgtaagatgattttatcaatctagcttccatgactatcacttcacattcctgctgcatgtatatgagtgataagtacatttgaggtcttgtctcagtggatgtagatagaaagttaccactgaccacagtccctgtgttggtcagtagattccaatggtagcttcagaagcctggttctctgtcatagtctttattctcctctagtttacctttagccatcagcaaaagatgagagacgatcacctctatccaaccatttatttccaggatctgagaagagtatgggaatagtagataaatgagacttggtgtggcattccaaataggagattctgtatggcacatcacaataaattttgttctccagaattttttttaccaaatagaatctaagaatcattttgttagtatacagctcttttaggaagaatagccttacttgctataataactatcatttattgaattgccagatattattcctgttgtcactgactagggtgaatacaaacaacaaatgcctcttcaggctgcagaattagacattcagtatagaagtggtttacccagcagcaggtagaaaatgtagtgtaagattagagggtgcagggaacctctggtttatacagaagaagaaaaaaaaaggacaaacattacaattcagtacatgtga

SEQ ID NO: 21861 - DNA, 1650 bp, Mus musculus
tccttcttcctgatatgttagagacagtttccatctttttggaagaattttagtaagttcaagtatctcttgtatgtagtaactccttccaaacattgttcaatggaaaggagagttactatggttacaaagccccaaactgcaaacacagcacaatggccccttaatgtgaagataaaagcataggctccttagactaagataaatactgtttattctagtaaataagtgatttagcaggaaacagctgaagggttctaccctctccttttccttctatctgcttgagaataatgttaccctttacatctctgacattgctacataggtcagcctttctcaaaactggtccagagctgcatctggggaggacagttggacattcctagtacttgcttcttatgttcgaaagtagatgttagagaggatatagaaatggggaactgaacggaactgaaagaggcagtcagattctggaatatgacaacattatagaatgccacttccaattcagctctgagaggagcagtggtagcagctatgttgtatatctagggtatgacatgcacagggcttaaacaatgaagaacacactaatgtgtgagcctgcatgtcatggtagaggagatgcagcgaaggttgagagaatcacagtgacattttaatgagagaagttgaggttgcaataggaagttagcaataaaaagtacacatggaagtaatccttcatttgttcatattttttgtaatgcacttcagctttctaggcaccatgcgtagctcatccagtctgatactgtgactgctttctaagtcattgtttaataaattatgcacctacagatatatgcaactgccttcctttcatgttgcaaggtgattccatttcaatacttcatttattcttcttaataaaaacttatgaaataggttatctcacttcagcacagagactctggaaaggcctttctgctctctcaggattgcaccgccagtcagaggtagaactcagctggaagacaggtttcctcagtccagagcttcacctactatgttctgctgatgtctgtgcttgtcagtgcctctcgtttatgattcaaggtaagtttgacacagcagtcatgaacactgcagagggtcatttctgaattcttgtcttctgttgaagtcttgattctaaatcttctctactcttaataacaaagagttatttcttgtttttgtttatttttctacgaataagactttaaaatttttcttttaagatatgtgtacatatgtgcttaaaacagtcgtttcattttttgctatttaataatgtttgtattcattattacatgtgcaagacagtttatgagaatcctagagtaaaagaaacactgatgctgagtatggtgtgtgtgccagcaatcccagtacttaggaggaagaggcataggagttcaggtttgaggttagtctaggctacatagtgaggccctgtctcaagaagagaatgcagagagagaaatatcgatcataacagaaatgagtaaaggacaactgtgtcttactgagcactgactgagtaaaagtgtgagtgacagtaacctctgcaaccctttccgcggagtaattagcagcaagcctgctgaagctctggttcagaga

SEQ ID NO: 21862 - DNA, 1195 bp, Mus musculus
atgaaacacctgcctacagtcctcagctatgaggacagcaggatttctgaatccattcagccttaccaagattttgtgtggtatcacagtttcacttgccccataatttcccacctccaattaataatattaataataataataataatttagtgatctttattcaaaaatgtcttttatttggagtaaataccatcattttatgcacagtttctcaagtaatgtgagtatatgaggcgtggaagcttagttatgttcatgctttatattacgttctttattctgtctgtctggtcctttctatattgaagccagagtgagggagctgggtcccaaattggatcacaattgtagagttggtttggattcagcctctatctcttgctgtgccatggtgcacctcacttaacttctgaactccctgatttcttactgaagaatctggggttaacaagcgttataagcattaaatgaaagcatgtaataggtaaggcaatgactttgcaaggtagaaaatacctgttaccatgagcttatgattctatgagctgcagcagtgtcaaaaggtctgtcacagaaactcagagaaataggcagcatgggtagactatagcactcacagtaaggcttgtggtgcttaaggagcacgtggtctctggatatttcagtgagcaaagagaaaaggaattgtgcattgaaaccatagcccagacccacacaaccacctgtaattctactttcctctaatccctttccctttgcatagtgagaactttgcatgtttgtatattattcttttgacttcctcttcctccttctcttcctcctcctcctcttctttttttcccttgaaatgtatgcttaacatctagggctctttgaaaaaaaatcatttttgctttctaaaatttagatttaattggcttttgttgtccactttccttattaaaccgtatctgaattagtttcttgcatctcttctattctcatttgaactattcccctggcttctgcagtcgggatagaatttgtatttagggtcatttgggtttgtatcgggctgcgtaataaaaatgtcagaaataagtgaaggcctagtgtgaaaagaggtggcactgcctgttttgtgtggttgatggaaagctaagtgtccatcaacattgtggatctgtctctccatcacaagattaaggga

SEQ ID NO: 21863 - DNA, 1146 bp, Mus musculus
atcatctcttactacattttcacagagggtatacccaatcactgccattttcgcaggctcccacaggggtcttcactgggagaagttcttctccagggcgacagcctggctctctcgggacagaagggatttacttaaggatatatttgaatcataactgcaagggtcttgggaactgaggcatttctgaaggtctaaggccctccacatctggatattctatcccatttcttctgtttctcaaccagcctatattcagcttcccacttcatacacacacctcatggtgtttcctgtgtaatcctcttcattattacttgtggcttctgtagggagccactagctcaactggtgtaatttattaccaccatctttggggcaaagggctttgatcaggctgccttctggggctctacagtctgtggatggccatgatgaggccaggaatccagttctggagtagttggggccactcagcaaacagccctgctctcccatacaatctctaggagggctgataggactggactttcccaaccaacccataagtgctgcctcccttccctgtccaggctgctcatgtgccagctctgtgatgtctctccattgctcgctcctgtcttacactcatttacatggctgcaggttcagggtgagagtgtcctgagggctactgcatagtaggtgctgtgtttggaatgcttgtttgtttttccaaaatcatgctgaggtttaattaccactgtgatagtcccaagaggtgaaccttttgagatgagacgtgtgcatgtcacaggctgtgccctcgtggatggggttcttgcccttctggaggaggattcagagctccttgtcctgtgcttcccatccatcctgataggacacagtcttggtgctggtgtccttttgtccctccagccttgtgagctaagaggagctatacgaagataacaacacatgtccctcccagacatcggtctgctgcccctcatctcatacttgcagactgggagaaattactttgtatttttttttaattgtccaggctaagtaaggtactttgtaataagcagtaaaaataaactaagagagaagtagctcccttccatctcatctcagtgtttgtaatggtggtgggagccttac

SEQ ID NO: 21864 - DNA, 1146 bp, Mus musculus
gaaagggccttggtgtgccttgattttcctctatgaaaaggagcacagctctgagttggcagccaagggcagactctattcctgcctcctcctgtttcttaccggaaccccaagagctgtctttttctgagtaccagtggactgagcagggcgaagtcagaaatgagggcatgtcagatgctaggacacctatcctggtaaccatctgtcaatcttcctgtgggagaaggaaagcagaggcatccaagaagacaagtatgtggtggggaaaaggaaaacatcttcttgatggcacagatgctctgggtcagccctctcttcctagactgctcctcccttccctctgtcctcagcttagacacagaatcaagaaggaggaatgctcccatctcagattttagagttttgatgagaactctcatagaataagagaacagattttatgtccctaggccaagttgtagtcactctccttagattctctatggtaccgatggggctgtggagttggcctgtgaattccaggacacgtcttcatcttctggagaggatgttagtgtgaggcagaggtggatgatggggcttctgagggcaggctgtccaatgaatccttggagcctggccctataagagaagagaaagatctatctcctcagagaccatgagaccagccaaggtcactgtgctcgggacaagaggaaggaaaccctgggacatgaaggtttatgaacatcagtgtgcacactgaaaatgcggcacagaacctgggctgagcaaggcatcaagacactattctaagcctccctcccatgccaccttcctctcccttctgaatctgacggttctctcccaggcacttaccagtacatcgtactgagtctgtgcctctgttcccacagccaggaggaagccatcagtcactaggtctccagtgcttatatgggattctctcttgtaaataaggcttggggagagaagacagaggcattcaaagagcatgcatttatattaagtcacatagctgatgcatacattacacattctgtacattgcatctttgttagtctatgtatcacatatgtatttattttaatgaaacccaacaaaacaagggaggtaatatatgtacttgaattaatcaacaaa

SEQ ID NO: 21865 - DNA, 1195 bp, Mus musculus
ttgtcctgctggcgtggtaaagtttgggtgcattgaagaggcagaaaaacagtacacccctgttcaagcagtcctcccttgccttccgcagccctctcccgttctctccatcccagtttaaataagaatctgaccccacgattcctgcatctcatgtcctggagaatacttgtcaggaggaagaacgggaacacagccatgtgtgtttgtaactggcaagaggttgtggcgacttgaccctcccccatctcccgtccccccaccccaccccgccctgtccccgtttctaccacctcagcaaattgatgtgagcttttcccttacagttcgaatgttggcggcagcctgctctcttgcattcttcagggtcaggtactcacacagagagaatggtattcagctggcttttgtagttcaaggtcatctgaacagaataagttatacttagtatactgacttagcgacgaccccttgtgaaaggttcaacatcactatttcagatagggactgtgtagagaggtgggctatggggggggggtgatttctgaacggaatactgtgttggttcacactttagaacaaggtgataagagcagggactttagaatgtcacagcctcactctgtgaccttggtgacttaatctctctaaaacctctcttccataagtggggcatcctgtgtacctcaaagggtgatctcaagggttaaatgagatcatgtaggctaatcacttggctcaaatttaagccagggtttttagtacgcacgtgcacatttattcttaatcaacttcctgatccaaatctgtggatggtggtgcccacgtgcatatggcgagggcatggagggatctcactatttagcctggggtacacatggccacattcctagcatgtggcagcgcaaagcaggaggatcataggttgcaggccatcctaggttacaaagccagatttgcaggaagggggatcctggggtctggggctcagtaaagcacttgtctagctggcggaagagcctagtttcaaggttcaacattatcagtatctttggatgcttagaaaatggatgggaagccgggcagtggtggcgcacgcctttaatcccagcacttgggaggcagaggcaggaggatttctgagtttgaggccagcctggtctacagagtgagttccaggacagccagggataca

SEQ ID NO: 21866 - DNA, 1150 bp, Mus musculus
tattccgtagatgtgtgtatatatgcacgtaagtgcaggtgcctgagagagtgtcagatacccccgagctgaagctacagtagttgtcagccacccagcatggatgctggcaaccaaactcaagtcctatgcaagagcaaccagccctcttaactgagctagccctaacctcactgggtgtgcatgtttcttttgttttaaagagacagtaccctactttgtagcccggacatgctttaaaactaattcctgtccttttgcttcagccttccatgtgccaggatggaattgtaggctcagaaggaccatgttctaataatctcataggtacatttgaatactcaatacttcaatatattagctttcttctgtgcatttaggtttgctgtagcacatttctaacactgaggaaaagcataaacttttatgttcctttccaaacaagcccttggtgtttttcataagtgaaactgttcatttgaatatttaacaagagttaaagttgggtcttgcagtatccagggaaactctgactgcagattgccacactaaaggttgaaagtattatcttacatggtagtcactgttgacactgtccagcaaaggaaaatgcatttgaactacatataagaaataggaattagttgtctgcatgctagatgttcagaacagctggaaaagtaattaaaagcccagacttcccaagaagcaagtagcaggtttgagagctgactctttgaagtggggttaacacagggtacatgtgcagaaggggtgttgctgaggggttgcgatagtttgtctttgaaatccgttgcaactggcagaagtgacctctagcaggttgtgatggctactcttgtttttagatggatcttgtcatatccgctggtgggtggagcctcagggacaactgttagagtggagtggcagaactggaggtgcaggtagggaagtgtccaggcatggaatagaatagcctctgggtgccaggagaacagcccttgtgaatcataggcatcgagagcttgctcccgttggagctaatgggtagagaacaggaaagtgagtgcagttactattctgtccctgcagagctctgaatctgaagataccacagacattgctgggctgttagtggatcctcagt

SEQ ID NO: 21867 - DNA, 1238 bp, Mus musculus
cttcactgtctctgactggccaggtcctgtgtctgtgggtcacaggccacgtggatggaggttctatctagcctgtggatagcatagcatagcatagctcctttgtatgtgcatacaagcacttgctctcagttccaatacaaagaatagtagcacataggagttactttaagaatactaatgtatggaccaggcgtggtggcgcatgcctttaatcccagcactcaggcagaggcaggtggatttctgagttcgaggccagcctggtctacagagtgagttccaggacagccagggctacacagagaaaccctgtctcgaaaaacaaaacaagacaaaacaaagcaaacaaagaatactaacgtatgtagatggaataatgacttacatctctaatccagtatccaagaggttgagacaagaggatcatgggttcaaggacaacttggtcttcatcgcaagatcctttcatttaagaaaaaatgtatatatgtaaatggtgctttattctagttagtttatccaacttaaagacagatattgtgttttctgaagacacagcaaattcataagtgaccccagaaagtatgttaggcatgtcaggtctctcccacaccaagactgcagacggtgagatgatggttcagtgggtaaaggcacgtgccaccaagcctaatggcctgggttttatccctcaggacccacacagtgaaaggagaaaatcaactcatataagatgtcctctgacctccacacatgtgccccgggtacacttacagcacatgtgcacagaaaataaatgcaaaaacagttttaagtgggctactttattggaccgcaaggttgttgactttggagctaaaatgggtgttgggtaggtgttgctcagacactgtgactggcaggagaggcaagtatttggaacaagtcaaacagcccctccaggatagctacaggaagtccagctcttggctttgagtggtcagtgggagataaggtgtggactgttagagacttggcccctcctatcactggatggcaaactgtgaaaggaagataaagagagtgggggtgttttgaacaacaggagagtgcctttatcacacgcttggtttatgattatatttttggagaactctgcttgagatgcaggtctgcgttccacagacatgtgaaagcaattccatgtctttttgattgagagtgtgcaaatcacttcttacctatgtaaataggca

SEQ ID NO: 21868 - DNA, 1722 bp, Mus musculus
attgtgttacttgtcagtttgaggtccttcagtggcactaatgtgactgttcatggaatacagcaaaagcatgtgaaaattaaaaagtaaattatttcataccaaaaaaaaaaaaaccaaccctaccattttcttaaaatctggaatcccagcctagtggagtcgggaagatggctggattaaatacagagttcagttgcccgcatccatgtgtaagttgtacatcttacaaatgcttgtaactccatctcgaagagattccacaccctctcttgcctcccacacatggtgtacatgtattcatgcacacagaggcaccaataaaaaataattaattaaaggaatcccagtatagtagcctttggcccttaagtcttttttttttaaccccttttggtgctggtacttgaaccagtgcttcagcattctccatagctccctgccagctccttgtttctccgttctcttcctccctatctgaccagacctgaagaagctgccatctttcttttagacaaaggaaatttaagatattctgttgttattaatgaaaagcaaaagagccacttgaaaaatacatggggaaatgttttatacccggtcacttcaagatttaaaaaaaaatgagggtgttggggctggagagattgctcagaggttaagagcactgactgctcttccagaggccctgagttcaattcccagcaaccacattacaggtggctcacaaccatctgtaatggggatctgatgccctcttctggtgtgtctgaaataaataaataaatcttaaaaaaaaataattgagggtgttttcagtgcttcaagcatttggtaggtcctctactagtgtgcaagggtccttgtctatacacatagtgggatttttatgaggcctttccaaggtctctaagtatgcttggattgatgcaaatattcctgtctgtttggtcaccccatccttatacatctcttgtatgcctttctactccattgctcattgctggggttggggtcgttggttggtttcatgggtggtggttgttgctgctgctgcttttttcagtgctgtagtttgttgtgggtggctctgggctgcttgctttcctggaagaggctgtctggaatgagtaatgagtcacacacacaagtggattcctgtgaaccaatcgcctaatgaataaaggagccaatcactaggcgagtagacagggcttccaggttggagagaggagagcaagcagcacagagccattcacaacatttccccctttctgttctaataaaaaaacaaaacctttctcacagtatagagtacaacaagattagacctaacacccagtccatcatctatcctaaattaaaaggctggagagatggctcagcagttaagagcactgactgcacttccagaggtcctgagttcaattcccagcaactacatggtggctcacaaccatctgtaatgggatctgatgccttcttctggtggtctgaagacagcgacagtatactcatataaataaaaaaaataataaatctgaatgataagtcttttttttttttaaatcattctatacctgactcatgtcctggctttagactgtaagccatctgaaaaccatcctctcaaagtaaatagcctgggttggctatgaatctgcaacaccatcagagacccaagaatgactgatattaactgaaagtatataggaagcctaa

SEQ ID NO: 21869 - DNA, 1194 bp, Mus musculus
cacccacagcccctcagagccgctcaccatccctccccacgtgcccctggccaggtttgtgttcaaggtcctccccatgtgttgcctacaggtgcaggagcatgtttggtttctggcctctacctggagatgtgcctgtggaccattcacacagaatctgcatgtgggctcattttctgtgaaactctttgaggaccacatttggaagatggggggggggtgttcttgtgtatgttgcatgtttgtaaaaagctctttgcactggaaagataacccttacaacttggcttcctcaacctccctagtgctgcgagtctctggaatgcacgccctctctgtctgcactgcctgagtcactcacaccttcctgggggtgggggcagctgagtgtacgtgggcgtgatggtggaagtcaggagttctgaggcacgagagcccatctgccttccttgggagtgtgaaggctggtttggcctttataactccagattcaaaaactcctcattaggtttagtatccaggattcaagggtgggtctggccaagttccattagagcccttgagaagggcttgcctagtgtcacctcgtctgaacctctctcctgtctgcttgcttacacagacagccagtcagacacagacacgttgaccaccccaggtgaggtgctggatctcacagcacaggctaaagagcagccgccagcagagggagccagtgagatcagtccggcttcacaggaccttgctatcaaagaggccaaagcagcagcagctccctctgaggaggaggaagaaaaggagacagaggagaacccagagccagaggaagagtgtcgtgtggaagagagcactggggctgcagatgcccccgaggaagacacagccagcaaccagagcctggatcttgacttcgccaccaagctgatggacttcaagctggcagagagtgaggcaggctctgtggacagccaaggcccagcccagcaggagccaaagcatgcctgcgatacctgtggaaagaacttcaagttcctgggcaccctgagtcgccacaagaaggcacacagctgccaggagccgaaggaggaggaagcagcggcaccttcgctggagaatgagggcgttggcagagcggttgaggggccctcgccttcccctgagcctgaagagaaaccagccgaatccctagcaatc

SEQ ID NO: 21870 - DNA, 1244 bp, Mus musculus
taacattaccttttgtatttgtgtgtttgagcttgtttttgtgagtctgtgatagtactgtttttgttctgtgagctggaagcagaaaaccttccccttggatcctgtagccaataactggaagaaaatgatgtgaatttcatgtacatgacccgagggaagagggtgtgaggctaatttctaagctagacctgtattctctggttcacgtcggggaggagccgcggcctggcctctgtcattagtagatgtggttgacgcagggttcctgtgtggtgtgagccaaagccaggaaagagtctagcttcaacctcgcgagtgtttccaccctctccgtgttagaaatggctagtgttcccattcttaatttacagagaaaagtggcctccccagcaccctagcctacagaggacacggctggaggtcatatagccactttcccttcttcccattcggtatatgttattaatattattattattatttttatttttacttcttcagttcgctgggctctgcattcagcagaaacaaatgggcaatatttgtcctgggtgacctgtactgctccctggtccccccttattgtgtgcctgaagcttctggtggcacgccagtgatggctcttctactgtactcagacaaacctttcttccatgactgtagaatccagcaggggccaggagtggtcctccaagcgtggccaaggagtggctcagaggggagagcaaggatgcacaagtggtggggagcaggcatccgagacaccaggccatacctggggcacctcagagtcagtttgcaaggcaccccagtcttcctgctaagctgggtcagcgccttcccccagccgtgctactaccgtcatttgggaagcattgagatactactgccagtgatgaactgaagtgcatgcgcaaggtctagatgcgagagttgtcttcacctttctgcagtgtggggttgctgcttggagagaggagtgcttttaaatccctaactggcccaagcccctggtgcacagagacagggttcctttagttcctgggtgttctgtacaaacagtagacctcgctcatcagcaaaaagaaactcttcctactgtagctgagctcggttcagcaccctgtcctttagccgagacccgaggatgcctgagccacactgctactagagccctgtttgtcccttgccttcagggcctcaagatttccccaagagaggccctccactgcttcaccccc

SEQ ID NO: 21871 - DNA, 4183 bp, Mus musculus
cctcgtgttctcggcctcctgggaatgagtgcagagaggccacgccaccatagacgccaactgctgcttatgtgtggactgagcagtcggagtctgtggccatacgattgctgaaaatgcactgcattgcttttctaaagtaacaaatttggggttttttttttttttttttttttaaaaaaccattaaactgtgtgggtgtggatgtctgtgagcagttgtcttaccagaatcaatgttaaactacctgaaacacacctttagcatactcagcaaaacgctctcgccacttcccttatgctagtttcctgttttgaccccaagttcaattaatatttttttcccagtgtggttttaggtgaattgttttgagggaataatttgtttatttcttggaatcgatcaaatccaaactgagggcacaagccggccttctgcttgctgtctgtcccagcttgtatctaactgcacagcaggggtggctgctgtgagcatcagaggcatgctgggtagtttctgctgtctgctgtgtgcacccttcaggaacttaacaatggagtcaaggaattttggaatcactagcaacaaaatagtgaagcctgacaattctactgacactagtatataaatcttaattctatgcctgtttttgtttggtttttaacaaagaattgtctgtctgtgcagactggactgttgggttgtccattgtccacgtggcctgggagcctcggggtggcctggagcctctggggtggcctctttgctttgcttgtttgttgttggctttaaacagacatttgttcttagtagatagaattttaagaaaaaaattgtcacggtctataatccaagggatcacattttaggagcaggaatacattttaattaaccctgatctccagagatcttaattggaaagctttaaagcggctacaaggtttatcctttgaccccatctctggggagttttgaatgctgacctacttttttgcctttattaatatgaaaaattcccaaacttcaagcacttaagatttcaagaccaaaattaagttgggtttgataagttgacttgagtcatccctgcctgacctagcgacttcacttggcattgttgtcacacttacaagaagttacagtaatgttgaatgggacttgtaagaggcttccttccctctgtctttgaagccatattctgcctgcgtgtattataaggaagtggtaatttcagtagcttttctattcctgacctttttcattcttgttttcttgtggtccaatcccttccacacacagctaaaggaaagctacaaaataaaacacacacagaaacaaacttataagctgtttaacgtgtaagccaaagccaataatgattgaaggttttctgtgtcttctgtaattgttaatcactttgcaaaagggggtgaaatgtcaaattgcctgtatttgcatttctggactgtaaactttgtatgtaatataatgtgtgtggtttttaattgagctgtataatctgtttattttgaggcctacagaactgtatggtttttttacttaatgtaatataggggacccttctcattctcaaaaaaacattttccaaaacctctgaatatctaaatttggtaagctactgtaacatactacagtaaggtataagtaattaaaacctttaaatggcccatagtgtttaactaaaaacctgataaaacatggggaggtggagggactactacacttaaaagctgccacgtcgtcatccctgagtaactgccttatagtccagctctgtgtgtctgaggtccgaattagagccttgggagtgtaggatgtattacttcttagtgtagactgggaacagttgacaacttgagtcttcaggtgccaggcgtctactatagcatcagtaagtatttagcagaaactaactccataatgaatggaattcaattccacacatggtttgttcaagcacacttaataagtagtctacttttaaatgtctttttttaaaaatgtaaatacttggatgaagcttttctttgtttcaatatagtcatttacatcatgaacattgttttcagaatttatcttttgaacaagttggctttagaatctgtcaagtgaatgtaaggatcacgagtatcaaactctgtcactggacattgagaagagtggactaaagcgcggacccgctagctcaggttgtatggcttcatcatttggatcatgtgctgtgtgtagtaagggagctgtccgccaaagcttggcctgagaggtttggaaaggagaagtgagtgaggctcagtataaaaggctacgggggaagaatcaggtagaaatgagacgtagcagtgacgtcagaaagtggaacttggtaggcatcagcctggcatcatcattagagcagtgagcactagaacactgagagtggaggtggaggtgtggttacgcccttcctgcagtgtgcagaggccttcctgctcttgatagaaaggacggtgagcttgagggtgcatttgacccacgacttttgtttgtgtttatttggggtcttacaaccttgaattccttcagtatggtgtgaaatcattacagtttaactcagaacagtgtatatgccctcatcaagactgtgatagactagatccttgatttttctttgagctccaaaattgttagcttaaatgaagtagagttaaattaggtagagttgaggtactttacttccgtggtgttgggtagcatcggcagccatgtaacgagtccgtgaacttggcctgtgtttcctaagtaaatccttactcggttcagagaggagcagctggttctcatttcttgttagcggtgtgcttgtatgcttgtgatggatgatagatgcgaggtttcgcctctgcaaagtacttgctagggtgcacaggactcagcagttgcaggtagctgagcaatagttggttcagggcattaattgtattgatgtctgcttggttctgtccctttttcctttacacaaaactagactgattctctctgaagtgctgggagtctttctggattttagaattgggtgggaacacacacactgaggctggggaccctgcagtcagtcgccgttgtaagaaagtgggaagggaagctggtttgttaaacgtgagtcctgagctgtgttctgcggtgtcctcctatttatgactccttacaacagctccctggggcaggcgcgttgtcctctgtacatggaaaagagccactgaattgaagtgacttggagcctaactgttaaatgtggcttcagaagtggcttttaaacaaacaaacaaacaaacaaacaaaaaaccttagtgtgttttcctttcacgcatacatcatttcagaaattttacaaaaccaagcatttaggcagcttacaaatctttattttctagaatccagcagctataaagtagagatggtattggtattgaatatacagatgtgcttgtaccatgcacacattgaacacgcttaccacctagctcatgggcactgtgggaaatgcattgtgcatctctgtacttagctctgtgtgtgtgtgtgtgtgtatgtgtagaattacttgaataggagatttaatttttattcgttaaccacaacaccccattaaatcttcattaaataatatatgttatatgtctccctattaaaacagccatgttctttacaaacatgtggcagtgtgtggtggttcatgcctgtaatcccagccctgggaaggttgaggtagagggaacacggagacagatgcctggcaacatcataagttcccgtttcaaaaacagaaaccagtatgtttggattgtttgattggattttgtgtttaagctgaaatacccatattcatgttagagatggagtgtattatacaggcaggttggggttggttcaggtctggggttacaagacttctgatttagtttctattcagtttgggttttctttaggcacagtaagacatcacaaagaaactccagtgcatctggaaagcccagaggatagctctctggtgttgaaggcacaggtaattcgtgcctgtgttttcccctagatggacttctgtaggtggtcgtgacagtttgtcctcccattagcatatctccctctgccccattgtgagccctgagtcttgtgtacggtcttg

SEQ ID NO: 21872 - DNA, 1108 bp, Mus musculus
ctcctcagccagctgcactcaagagcacaggcacacactcgtacacacaggttacaactaagtaaacctttaaaataagacgtagaaggacacacacagttccgtttgatagagggacatcaaaatgacagaagcagatgcctattggagctggttgaaggaccagacgcctctaaagccctataaagatgcccatttaaagggtgtgcgggcatattcaggtgtccttggatgccagaagagacgtctgatcccctagaattggaatcacagacacttcacgtgtgagctgcccagagtgggtgttgggaaccgattcgggtcctctgtgagactggtgtacgcgcttaaccactaagctagctctctatccccaagttcagcatcatgcagtatattcgtccaccatttcatacatgttaaacataaattgatgtgctgtacatctctattaaaccaagtggcagtaggcagggctgcggcttgattgataatcatcaaattaagaacgtagaacgagccttgttgtggcaagaaacttctgctcaggagctggtccatctttttcctcacactgagatgtccttgctcttacagcttcttggtgtgactgtggaaaaatgtgtgtgtgtgtttttgtttttttgtggaattagctttgctcttgtctcctgtggctggccatagaaggacatgtgctgggaacttggcttgtaggagggagggagggagggagggagggagggagggagggagggagggagggagggagggacaagggactgacaggccagatgagatcaccagctgcccatgtgtcactggccatgtggacctgagggaaaattgctttgaaggacattttggggttaattctatgagattttggtaacacaccaaaatttgatcttgggaggcagagacaaagaactttgtgagtttgaggccagcctggtttaccgagccagggatacacagagaaaccttgtctcaaacaaacaaaatgttctataggttagaaaatagtatggcaaccattttaatttccctgacttggacgatcgccttctggttatattgttgtcttcattctcaggaaatatacact

SEQ ID NO: 21873 - DNA, 1161 bp, Mus musculus
ataggatccaggagtcaaagagtcagtgcactcaagttgttcaggagagagagagcctgctggtgaagatcaaagtcctggagcaagacaaggcgaggctgcagcggctggaggatgagctgaaccgtgccaaagcaacgctggaggcagaaagccgggtgaaacagcgtctggagtgtgagaagcagcagatccagaacgacctgaaccagtggaaaactcagtattcccgcaaggaggagaccattaggaagatagagtcggaaagagagaagagcgagcgagaaaagaacagtctcaggagtgagatcgagaggctccaggcggagatcaagaggatcgaagagagatgcaggaggaagctagaggattcttctagggagactcagtcccagctggaatccgaacgctgcaggcttcagaaggagatcgagaaactcaggcagcgcccctacgggtcccatcgggagacccagacggaatacgagtggaccgttgattcctccaagctggtatttgatgggctgaggaagaaggtgacggcaatgcagctctatgagtgccagctgatcgacaagacgacgctagacaagctgttgaaggggaagaagtcagtggaggaggtggcctcagagatccagcctttcctgcgcggcgcaggcgccatcgccggggcttccgcttctcccaaggaaaagtactctttggtggaggccaagagaaagaaattcatcaccccagaatccactgtcatgcttctggaggcccaggcagccaccggtggtatcatcgatccccatcggaatgagaagctcactgtggacaatgccgtagcccgggatctcatcgacttcgacgaccgccaacagatctacacagcggagaaagccatcactggtttcgatgacccgttttcgggcaagacggtctctgtttcagaagccatcaagaagaatttgatcgacagagaaaccggaatgcgcctgctggaagcccagcttgcttcagggggtgtagttgatccagtcaacagtgtcttcttgccaaaagatgtcgccttggcccgtgggctgattgatagagatttgtatcgctccttgaacgatccccgagatagtcagaagaacttcgtggatccaatcaccaagaagaaggtcagct

SEQ ID NO: 21874 - DNA, 1196 bp, Mus musculus
tccacaggaatagtggacgttggctgaattgcacttctcccacaggcttgtacagcctcaggacgtgtcttttattgtttttacacctgttttacagtgctgcgctaagctgctctgtggagcaggggaggaactctcatgaatctggcgattgtttgcctgcctcagttcttgccagtttagtgtgctcagagccccttccctaggtcctccagctagagtctgaagtatctgctggccgccattttcctctttgataatatttctcttggcctttgctgttttgtcttgtgggggtcagtggtaccgcttggccaatccattgtgaggtctacaaatggatggcctcgacagatgatttcctttggcaattctaggttctgctccagtcactgatttacgatcccgcatgacacgtctggggaagagagggccatttatgccattgcaagctcgagagtccgatgttgggactgtgcacgagtctttgttttatcagatgaccattggagttgttactatcacttttttttttaaccaggtgatgtgtagttgtagttgtctctggtttcttgtgcctatgaaatagcacaatgccctcaggactctgagcatcactgggcatgagtctattgctacctgggaaaaaattcttcttcttccactcttttccactcacctgaacatgcatctcttaagccctcttgggaaagtgtgggtttccaatagctccatgtgctgtgaatacttgttatctccagcccctgacgtttcccactggggtccatttgtatgctttgagcacaggagaagtaacacgtctcagaaaatgtcctcagtttatttagaacgtgtgatctcgtgctatagagttcagggaccttcagtcccaggttgagggtcgcatctcacagtgttgctggtacttcatctctggctgccatggactgaggatgctgaagctgaggggatcgacctcctgtgagcatcatggtttattagatgtttcggaagaagctgtggcctgggtctgaaaatgccaactcttcttatttttcaaaggagagagggtttgtgctttgtcattttgagcttaagttaaagttctggagcctgagcttggcttgtagatcctcagcttagaaagagccctgttcagagtgtgttaaatgacacccattcttaactttgtagag

SEQ ID NO: 21875 - DNA, 1992 bp, Mus musculus
acttcactgaacctagcactcactgatggcttgggctggctcgccagtaagctctgagatcctctggtctcaaccccagcaggactgagattctagatgggtactccagcacactttttgtacatggatgctggagaaccaaattcaagtcctcatacttactctgtgtgtggcactttacagactgaaccatctctctctctgtgtgtgtgtggcttaaagcactctctctttctcctttaaaggtacgaggttatcccacgttgctgcttttccgaggaggtgaaaaagtgggagaacacaacggaggtagagacctcgactccttacacagctttgttctgcgccaggcaaaggatgaactataggagaccccggggaagtcatccagcctgggcttaggcgtgacctcacacagacacacgtgttttcactgtggttagtcagaaagctgaatgtattgagcttgtgttgcttcctgtgtgctctctgagccaccacacactacggaccttaagtttctctaatcatggctcacagtccctgggcaaaccaaacgttttcagtggcgatccatcctgtaacccttctcttgacagaattaaattggctccctttgcaacttaaaatacagtcaaggaaagccaaattgctgaactctgctggctcccagggatgtaaggacatcatctcgcaggagcaatttgttgcattgcctgagttttgggaaggaggcctgcggcactgttgacttagtaaggtgtcggtccatagtgtacagatttcaaaacaaaagcccacagagccctggagatcccttcatagccactgctgggttcctgggtctcattacttctctagtggagagaggtaagccataacaaatggtacttctgatgtgtgccccaaatactcatgctgttcaaaggatcctcttgtctgcttcgcatagggtggagtgtggagatgtacgtcttctgcagaaagggagggtatgggatgcaccacaaggtgggtcctcacccgataggctttcccaggtccaaggaccagggagtctctgcagctcctctcgggccttcctagaaacagcttctgattctcttcctaagtagttcttttagcagctcgctttataatctccaccttaaaggaggctgaccatctctctaatgattgagcagtgggattcatctgacctccagaccaaagactgcagtcggcagggctgcccttgcctaggaagcccaaggttggatatcgcatggctacttccggttcccgccttccaggttattagacgccgctgctcgtaactctgtgaagatgcagcccacgtcatgcctctgtctgtcttgttctcagaaccactgtgtttgtgcccaggcccttcacctacctcccacgagcggggtgaaatcagcacctggcacaagacgtgtagcaaggagacttgaaaccagaccacgtctgcttccaaaacatcaggagcagaggcgccccgccagcctgttatgaacgtttattattaatcacgtgtgggtcacagctgtccttggaaaccagttctgttggcccagctcacagtggcttcagcttagcatcatggtcttatatgaaaagaaaactcaagtggtacaatttggtttatactttctaaataaactttttttttttaaagaaaaaaagtctggtctttgcttaaatgttacagcaaaatggatataaaatagacaataaattatagtttctatttacaaagaaggctgtaagtacagttacagattgtaaatgtattatttaatcagtttagtatgaaattggcttcccggtacatgattgtgaaaaggacatttaaaaaatattctaagattcagtctgagtcttactttctacaggaggaaatggtggttttggtttacacacagcatgctcaccttgacaaacccattcttacaggcagggcccttccctctctgggtttcggcttta

SEQ ID NO: 21876 - DNA, 1174 bp, Mus musculus
ggtcaaatctctggtagatcacataccaccttgtcatggttttcccgtatatgctttggaggggtgctggagggccttatgactgctagtgcctctgacgatctgttgcctgtgattggagcagtactcatggccactgtgtgggccctccctcatcagattagttggtgctaacttcatttatcacttgcagtgttaggtcgagaaaaagaggcatggtaaatgtgcagctctttccctttttgccagttttcttttagcatgagttggttctctgttacccttcaaagatgaccaatttggttttgagttattgttttgaatgcccatataaacaaacataggtggtggtgagccccttttctcagaaggacttgagatctctaagcaagggaacaaagctgtattcttgagtccagcatttggttctgtggtgtaaacccattgcctcttcctgttcctctccgccttggccttccccgcaggcaaccactttatcaagttcttcgctccgtggtgcggtcactgcaaagctctggctccaacctgggagcagctggctctgggccttgaacattctgaaaccgtcaagattggcaaggtaagtccaagcccgtgttaaactggaacagtctgccttgggccagattaattagcagagtagtccattattcattctgtgtgcaaagttgcaaacttgatttattaattccagttagtgtgccacttgacaattcatttcaccttcacagatggcagcctggttttggagtctgctggcttttccacaggatggagatacattatggccttggccaatttattctgaaggaatggccaattctgaattggcagccctggagctgtgcaaagatatggggtagagccttgtagaatgttcactgggtatctgtggagctcagccaatagctttcctgaagggtccttcctgggttctgcactcacacaggatcacagcagaccctttatggcgaaccctcttttccactgctagccacagttccttccaactgttcaaacagagaagccagaaggaatgtgtaacaacttctgtgtgcccgggctttctggaactgtctagagcagcccctgggcttctggctacttttaatcttattgactttgtgatgctcaccagtcgctcactctctat

SEQ ID NO: 21877 - DNA, 1181 bp, Mus musculus
aaacagagagtagggacctgcagtggatggagggatggagggacggagggaggagcatagacggactgcagcagcggcatgccctggtgactgggatccatcggtgactgggtgtccatctgccatggtggcctacctacagtaaaacagtgttttgtctgctgcaggcctaagagaaacctcaggcaggaggagctacaagggagaccaggagcctgaggccaggaaggagaagcctaggagaagcactggttttttacctcgatgtattttccttgagtaacttcaaaaatgtgtgaaagtttaggatcatgcacatgcgcctgagctgtctcctgcagcatggtttttgttacctcattggagttttgcttgagtggcagataggtgcctggctgcagcccctggttgctccattcccgtttgctcgctcgctacccagggcagcttttaaactttccaacttctgctctttctaatcccttgctcttctttcagcctgaagttttttaagcctggacaagaagcagtgaagtaccagggtcctagagactttgaaacactggaaaactggatgctgcagacactgaacgaggagccagccgtgagtgtcccctcctccctccctttactgcccagaggccagaagaggtgacatgctgaagtttcaattcttttgaagttgtaaatagaccttctccgcttgtgccctttctggttggccaaagagttcaaatttgcacacaggagctcaagaacatagcatagctgccccccacccccacccccccaagcaggttctcctgagcacaagagtaaacaggaatcattcttagaagaagtaaatgatggcatttctacgttggattcttctgttgggtatactcctgttgtcaggacaaccgcagactttcagactggctgtttggaacaggcactctatcatattggtcttgcaaagacctggtcttggttttcttggggaagaaccacatacaaattcttcctaatattctttagttccatatctatggccctcaggtttctcttcttgtttagtgtgtttttcactgtgtagcccaggctggccttgaacttaggatccctccgcccccgccccttgcctccccacggctgggattgcaggtatgtgccaccacgcttccatccctgctcctgtt

SEQ ID NO: 21878 - DNA, 1099 bp, Mus musculus
tcaagagttaaaaagttttgcgttaagacaaacatgactctaagtgtccagataaggcacctctctgcttagccttctaaaataagttggcatatccaacgagaaggtgcaggttaggaagcagtccctaactcttctggctttaacaggatctgacagtttcttatttagggagagtgagcttcatcgttgacatgaaaagttctgaggacacaaagccctaattagcttccgctctctgcaagagctgagtccttaacacaattctgggtgacatgtcttcgcctttcttgctattatcagtctccacccatgggtcatcacctcgcactcaacctgcaaagacaaagtcccaaatcatttaatgagacccttatctactgccagctttgaagccattatagaactcttcaccagtgaccagcgtcaaggaacgctttcattagaagagatgtgtccttctttgagatgtcaggtttggggtgcctggcctcagaagctggataatgcattgcttctttgctaggacaaggtaagggactcactggaatgattagagtgattatttgtagctctctgccacggataatcagccccaggtcagctgatgggaagaggtgacccaaacctgccttttcaggctgagtgttgttatcggttgacatcttcgccttcagcatctccctagacatgttcgagtttcaaacatcttttggccacatttaactttcttgggtttgtatttcttctatattttaatagtttgactccgaggaggtcatctgaggcttactatgatctatttttcttctgcaatttctcttttatcctacttgacatattttcttgctaagttcccttgtgcaagagctcttcgggtatggaaaacgtcttttcttttatcgtgtcaagtcatcccaaggagcagataaaagctgttcagtgaaacttgatatttattacaaacaaggaaagagatttgaaagtcataggaaatggctactccatgatgcagacattatagaagaggaagggcttgttaatgacagctgtgagcctgccgttccctccatcatcctcatcaacagcatcttcgcta

SEQ ID NO: 21879 - DNA, 1198 bp, Mus musculus
gacaccaacactcctcccctcgacactcgagtggggtgcaccatctagaccagcctccccgccagagtaggaaggaggagttttggggtggagacttcttctccactctgcaattcacagctgaccttttacatatatttgctgacatgtcagagaaatgattggaggccggttctttgttcttccccaagtcccgacgatagtagcgccaggagaatgattgaggctgtcttgggtgctccaggctcgcgctctgtataacctgaaacctcatggtccccgagaaagtgactgccgcaactgtgggagcagggcacccacccccgggcgaatctcctctcgcctctgctcctgcccaggtgtgattgctgacagagatgagcgagcaagatgggagccccaaatcctgtggcttcttttaaactcccctctaattagaaacagcaatgaagtcacctgaacgattttatctgtcatgggaaagcaaaccccaaccccaaacctcagctgcctatcccagaaccaccaacgccccaattctcgcttttaaaagtttttaatgaaaaagataaagagcctgaaagtcatgggggcttgggggaaggggggcaggaaccgtgaacgtgggttgttggtgggctttatacttaagtgttaatattccaacgtgaaagagcacgtgtgtgtttgtagtcccctcacccccaaccctctgcccatggaaggggactgaatttcggagacacaagtaaagcagaattgcgaatatcttcacctattgagcaacacttgatctggaatccacagctgaggccgccctgggggtggcaatcagatccgctaaagctggcagtgccttgaagatcgtgggcgggtgaggaggagggggcgggggccctgtcccaccgctagcgtccaggtgcgcccggactctccatcggccctttctccagatctggcccagccacccccccagcccctcccccacttctaacccaaaagttcggggggggggcgaggaaaccggtggaatgagcttgcagatgtccccactacacgagtgctcaaacacacgctcacacccgcgtgggactcagcaaccttcagcagccagtccctggcttcggttcactggccagggactgaccgggaaagcgggttagggctgttgggaaaagctggagctgatggtgagatt

SEQ ID NO: 21880 - DNA, 1161 bp, Mus musculus
aaaaagtcaaggacagaggaacccccctttctcctcagccctcttcctctttcctaccagtcaatagacaagactagagataaagaatgatgcagtatagggtgggagtggagagatgactcagcagttaagagcactgactgctcttctgaaagtcctgagttcaattcccagcaaccacatggtgggctcacaaccatctgtaatgggatccgatgccctcctccagtgtgtctgaagacatctatctgccatcccagagtagggatgctggagcaggagggttccatgagccattgaggctattagatagaccccatcattaaaataaaataactaactcttggttggggggtgtggggggtgtggcctgtagtgtgggtatgctggcatccaccttctcgcagcagcagagaatacccttgaggaaagtttggaaattcattcaccccctagttgcaaaactgagagatccaggcaggaagactcccagattccactccttcctacttgtgccaccctctgcagacgacacggtgcccagaacgccatcagatcttccacacagcccctgtggtaatacaagtggcagtgctcagagcccccggggttctccatctccttgccagagctgcaggagacagctgctcagctgggcaagctccctgtaaaggaaggcaagggccgcccatgccagcggcctgactgctgtgcatgggacacacttcaggctaataggacacttcctggggttctgccttcttcctttcttggacagttaggagcatcctggtttagagagaaaggaaatcctgtttcttaggtggggccttcccaaattgtaagtgaattagagaacaagccattaaaagaactctccagtcttcaaatcgatataaaatgtaatcatgtactcagctaattcccgtatttgtactttaaaatccagggagtgtatctgattttctactcccagacagcttttaatcccattagctaactcactcaccttttcaccttttaaaggcaaagctccccaatgccaacgctttatgtccatgttcaaacagtgttaattcttccttgaaagtcaccatctgcttgtctcctgaagactgcaaagtgtttgtgttggaaagatgctgcccaaaacatccccat

SEQ ID NO: 21881 - DNA, 1170 bp, Mus musculus
actaggaaagagcagcatgagtcagaatgaaatagcttaaggaatgagggataaaaagtgagatactactttaagatagagggctgggagtgtagcttagtggcaggacccttgcctggaagtcaagaccttaagacaaagatggggagcggaagagagagaaaaaagaggagacaggtggagagagggaggagaattgggagaagggggaggaaagagaggatgatggaaggaagaggcagaggggaaaggagggtgtagggcgggcggggaggaggcagggattgggaactagtaggtagaggaaaaagaaggaagaaaggaggagggataagatgtctgggacgaacccaaagaggtccaaggggccccaggctcaggttttcttcagaaagccagagagcacgcctgcccttcggaggtgactctcgtgcaagtgggggagctgaccttgtcccttctagcagcccttctcagaggaggccctctgggatcccaggttgctgacactggggagcttcgggtgtgaaggcgtccaccagctgccttgacatccatcccttgctgtgctctctgacttgttacctgccaccttgaggagaggctggggggaggggaggctgtttttgttttttttttttccctagcacttcctgttctgtcctgtgtcttttgtttgcctgtccaagaaggagctctagagatcatataactccacatggccgagtagcactcactgtatgatcatggagtgttgtgtggtgctttgctgtatttgtgggggtgaggctggaaatgaagccaggcaaggctctccaatctccctcagaagctccccaccccccacccatcccccaagttctcctgaagatttctgtctcaagacttgtgaaccattccccatctatggtagtgttggctgctctagttttcctacagcctgctgggagagctaagttgtcttttctcccttcagggcaggtctgattctaagaaaaaagatgaagttactttggcttctatacgtctccctccctgaaccgccatgtttgttcttaggagtctttgctcatttgcagatctgatcttcctctgcgggattgtttccctgacaccagtattttcatttgcttcttttccccctcttttgtgtgtgtgtgtgtgtgtgta

SEQ ID NO: 21882 - DNA, 1137 bp, Mus musculus
attttaggttgcaagggccaggaactcagctcaaagtagcttcaggagatcccagggcgtaactcatgaaggtgcatccctaggacctggcttggcctgcacatcaatttggcgcaagggtaaagtgaagtgttcagtatctttcttaccgagccctctctctaggaggaccagccctccatgtgtacccaagtctgaggggtggggtgcggggcctgggactttaatagctagaaccagacatgtccttgggcagcatgaatgggctggtctccccttctctgtctcattctgtcttagcttccctccggcagattttctccacactgggtcagacaggccagaaatagctcccacttgacttggtttggctttcctgggaggaagggaagagcgtttcctgatgtcccaggaacagatcaaggaggccttcgcatcggctcttctttgcccgtattcccatccggaatagaaccaggggctgaaagggctgacataactttcttgggtcattgtcccaccctgaaactaaaggcacagagccagccttggttcagaatggcactgtggcagggtgcaggacagacagaagcacacgcctgtgataggatgtctccttatcctcacttggtgttagagggaaaccacctatgtggctttaacgacctcagaaattagaacttggaaatttatttttgtgggaaaggtatgacctcttcaccacatcttttttcctcagaaaaatatttattttctatttttctaaagatttatttgtcttatatatgtgagtacactgtagctgtacagatggttgtgagccttcatgtggttgttgggatttgaatttaggacctctgctcactctggtcagccccgctcactccagtcaactccgctcgctcagtgcctgctcgctctggcccaaagatttatttattattatatataagtacactgtagctgtcttcagactaccagaagagggtgtcatatctccttatgggtggttgtgagctaccatgtggttgctaggattagaatcaggacatttggaagagcagtcggtgctcttacctgttgagccatcttaccatcccgaaaatatttatttttaatatatagtattttaattat

SEQ ID NO: 21883 - DNA, 2383 bp, Mus musculus
tctctgtgccagatactcatattagtataccctgttcaaaggagaatggtggataatactgtctgaggaaatcagaacttatttgagaaggaagctctcgttccacattcctagcaactatattctcaggcacacataggcgcacagagacagcttcctagtaactcacatcaatttcgtttaatacaaactgatcctgaagagctgaggaactatgtaagttcagtgtccaagcatttgactgacatttgtgcagagttaggttccatctccagcatcacgcacgggtcttgtgaacaccgacatcttcagtttacttgtgtctgcagttctgtggacagaacaaagccattcacaagtgaccgacagcacgtgccgtgagacgggaggtggctgcaggaagaggatgcctcagggatgccggacatttccgtgttctattccagagtgttctcttctcccagagaacactggaacgtcctcacagggatgaaggaattctttctttcccacaggaaaggtgctactgtgtgggtctggaacctgtgaatgaatcactcctggggtttcgtttctatgtgagagacggggacccggttctgttgtgtgcagctttagcggcatcaggacagcttccagcttgcaatgattgctgctgacaggaacacctggatctcaagagctttttatgacaggtggacatctgtgtcatttttccttgttccctcatccatccatccatccatccatccatccatccatccatccatccattcgtcagcctacattcaacaaacgcctcttgaatgtctatgattcccccagacacatgctgacagacacgagggaagcaagacagattctttctccactgttaaactctggggagtggtatcagcttttgaaaccctgctctagactcttacaaaatggctacacttagcacatactctgccctggctatatattatattgggccatagagatcagcaatgtatcaattaatagattaatccagagacaggaaggaggaaacgaaagctagagcctctttgtgactccaccaactccttcttgtctccttttattgaagagtccgcacacatactcacccctctggtgggccacatgaggacctgcatcttgcagatgatgtagcaagccttaggatggttcatgatcagtaggaagcaaattctaagacctcagggtgtctttctgagtctctcatttctttagggatgtggagagaagatgaagtatagccgtgtgtagtgtcgccagagaaggtggagtttaagaatggtctcagtgttattaatgagaaaaagttctgtcattcaggaaaaaaaagcaaaaaacgtgaggttgggactcagtaggtgagggtgcttgcagccaaacctgatgacctgcattcaattcctgggtcccacgggacagagggagagagtccactactgaaaggaacgctcaaacctcctcacacaggtccttgtgcctgggcactcccccgccccatatgcatacacacatacatgcttttgtgattttttttattagtgcttttacatttagaaatatttatttattctagcagggaaaaaaccccacatgctttaaatgatgtcactttccacaacttcattcttgtgctgtcattggactgaatgttatgcatctttaaagggaatcacttcgtgtaaaactctcttgtctcttctgctgaaaagtaaaatgggttgtgtcgggtaataaagggtcgaggggtaggaagcacttggtcaaggcgaagtctaaaaccggtctcttttttatttgttacttggatgagagcacctgaagactaatgttttacactggattgagatctcatggaaaatgaaacattctttttctggagaagtttacatgcccattgttggtcacctctttactgtaaatactattgaaaaaaggagcgtagcatttgcatagcagggattgtgcctgtatctactgtgtccattttgttttttcggatgttttctggttttgtttccttggaaataaattaatatattgttttccaccttcaggaatagtggatatttatttgatacctggttaatatgcactgggtcccccagcttttgaaaaggacaaaagaaacacatttatacatgtatagctgtcttaaaattatctctccactaaaaaacataattgacctttccatttgtggactaagggacactttgcactgcacttgggccatcttcaggtgaacacagagactggctgggcattgggtttgctttcatcattttagtttctagtcttggtaaaattccagtcagccacagacttcttgcagcagagctggccctagagcttgggcagg

SEQ ID NO: 21884 - DNA, 1149 bp, Mus musculus
agaaagttcctccatctttgctgtgtgaggccaaaactggtgccaggctgacatgtcttactgtgtggttagacagagcagcaaatggaatggcgagccttcctccagcagcagagccctgccctggtgagttacgttgattgtttaaagacggagcaggctgttgttgaagagtccagatagcgtcatttgaggggaagaaacaggccttaatgcattgtctcatgttttagaccaacctaagacaatcgaaaaggaatctggtgacacagttcaggaagaaacatcagaacctaactcggagaaatctgatgtaagtggtgacagcaagcagccaacaaaaggaaatagcccagtgacagccaagaagaggaaaatggcaaccatgtcggaaaagaagagaaagaagaaaatgtaactcacgtggcaaatcccagatttctcctccctatctgaatgtccttttgacggaattctccatgtccctgtgagaagaaaatatctccttccgtagaaaatgtgcagcttaagaaaaagaaccgctctttaggtggtgctttgttttgttaaatgataaacgttattttggcagatggcattttattatagattgtaatatatagtgattgtttactttagctgttcagagcaagtaaagatctgaaaattgtatttgaaataatacagagcttaattacatttatttggcggtgcttgggatgaagtccagacagagcctcgcatgtgagctttctctttgccccctgatcagtcccttggcctctggccctgctgcctccacacacctgttaggaagtctttaccagaagtggatgaaagggattttccagacaatctgcttctaagccgcgggtaacaagcaaatctaagggcaagaagacaacacttctcataatttgttgtctttcagagcatcagtagtctcagctcacttccttgttgctgtgttggctcagtgtcaccataaccatttgcttcagactggtgttggataaaggtgtgtcagtgtgtgatggtcttagaacaagcctagcacactgcgggtacttaatgaccatgacccgtgtcttagggtttttattcctgcacagatatcatgaccaagaagcaagttggggagtgtactgg

SEQ ID NO: 21885 - DNA, 1378 bp, Mus musculus
agaatttgaaaaacaaaacaaaacaaaaacaaacctgtctcaagaaaccttgtcattggctatggttatgctgttgatcaaagccttttacactggaaacgaagttttcatagatcaaggtcacagccgctaaactaggaggcgggagacctgccatgaatcagcactgtggcccctagggtgctggtctctcttgcccttccttcatccttcaagttattggcattggcttaggagtttcgtgtgccactgttaagacttggcatggtttttctatgcctcctggggggggggatgggggggaggggtgggggtgggggaggggtgctttgctttagcatttctcacacacagttgtgagccacctgcacactttgctccttaaaataaaaagccacctgttgtgtacttttcctgatgacttcccccccccctttaaacagtttgctgatggttgccaaagttggaattagtctgttgagttcacctcatccgtaacagctgtaaccccgagtgggctcgtgaagacttgaagctctccagacctccacattacaatgttgaagagataagtgcagcatatttacatagtgggacgttttttcaaagacccaccctgagcacactgaggcaaccatgtgctgttgctgtggtgaccattcattcagaggtggcaagcgtccgacttcagctcacgctgccttcaggcggcttcgttatgatgcctcgcctttctgtactcatagcgggggtaaaatgttgactgtcaacacgggggtgggggcagagctgtgcgtcctgcccagaagtgtgtgaaatctcttggagacattggtgatgtgggatcttttgcacaggtctgctatgaaattatgttacagtgacattatcagtgaaaataaagttttctattaagaacacttctctggtgtcgtctttgttagaggtgtgtgcgatgtagcttgagacatggtttgtagggcgcatggctctaatcccaggatcttagatgcagaagcaggagtcaggagttcagggttatattcatttttgtaagtttgaagctaacctgtgctatgtgaaactgtgtctcaaaaaaactaaaaccaaaacactcactcacacagaaccctttgagaatttctaacataggcctgtgtaataacaacagggacttggcgtcacatctgtgcttacgtgtcttaaaagcgggtttcatgtattcagatatagtttctctttgtgagcttgagctgcctgtctctgctcactacctctcaagtgctagggattataggtgtgcctcccatccagttcaccccttaatacagtgatgtttataccatagataggaactctcttgactttcatgtctttt

SEQ ID NO: 21886 - DNA, 1099 bp, Mus musculus
tacagttcctcatattgtggtggcctcaaccatgaaatcatctcattgctactctatcattgtaattttgataatttatgaatcataatacaaatgcctgtattttccaatggtcttaggccatccctgtgaaaagggctcagctcccaagggatcatgatccacagattgaaagccactgccctaaaatagtgccaccagacagaagacaggtgttcaaaatgcgagtgtgcgggaacttttgagacttaagcccaccagaggaatggaagagcaaccatggtaggcaagggaattaaagagctgatttagacgctacttagatgaaagatggctaattaaaccgtgagcttgagcactggggacgcgtctttgaaaaaaaccaccgagacttctctgagcttggttgaagatgcagtgtcgatgttgtcccccggcaagggaatgccattctgaagagatcaattgaattaaacacttataccaataaacaggaaaaacagcttgtcaggtgcagcgtctgacctttgatctccggcagcagcttttctaagtatcagctctgtcctggcaactctgctcactggctggcatgtagcatggtgcctcctggcttttgagcatctaaatgtaagcccagcagttcagcatggaggaccctatcctctcggagacctcccccactcccagctcctgcaccatcccctttctgtggctaggaaagaataaagacagtccttcccggggctcagggctcttggcaaattttctgtgcataaggttggagacaataagtgaccagagtgttttacagggaagtatgttttgagtttattttctggggtgacaggagccaaagctgcctcggacctctcttcaaactttgtttctgcctctctaactcacctggtccttacctttaccttaccgtgaacagtgatacaggattgccagcagagtcctgatgtaaggcaggtgaggctaaatcctgacaccggctgatgtcataaaggcacatattcatctggataattttgtctctactacagtgcataacattatatacagcattgatttgattttatttgataaaaacctt

SEQ ID NO: 21887 - DNA, 1167 bp, Mus musculus
ttccatgaaggaacagcctcttgagctgggtatggtggcacccatctgtgagtccagcatttgggtattgagacagcctagggtacacaggcacaagaccctgtctcaaccagaaaagaaaaatgtgtttgccaaatcataactcaggggctttgaacagagctgtctctgtttcaattggcatccttgctcatccattcctgtctacctcccttgttagtctagatttctggagttatgttccccacatccaaagccagtgtctacatacagctgccatgccctttctgaacaaaggctggagttgtccaattgcagttcttcttcgcatagaaatgcaattggaatatttacaaatcataatcaacagagccccaggggcaaaatagacattctatttgtcagctgttgctgctgagcctgctggtgaacaccattgcaagcagttgctgagcctgctggtgaacaccattgcaagcagttgctgagcctgctcgtgaacaccattgcaagccattgctgtcaagcttcatgagttaaatttaactgttagagaggagaaaagcatagcagtcatttggaacgatctcgtggggtgggactaagccataatgatgtgtctggctcaagcagcaatgctgtccctgctcagaactgtggtctctgtggagaacctagtacagagcctgagcaaggcaatggaccacctccttttcctcaaactgatggatcaccactgttaatctataccaggtgtgaaaaagggcatttcccaaaacatacacaaaacacaacttactctatttcccctccatttcagcaaatgtgttcttggttcatggcactggcacccagcgcatgggcaccaggtaggtgttcctcgagtgccaacggcggggcctgcccacccctgtcttcctttctgggcaagctcccattttaacttttccctgttaaaaattgtactgatgttttaaactcgtaactataccacccttctcactggtgtattttgaaaaccaccacagtccgatgtcctgtgccatgtctgtcattcctgttgaacagactcttcctgtctggtgaccacctatgcttcagtgcattttctaaacaatttctcaaactgatctgctcccgggtgctttcttaccaccatctctggtg

SEQ ID NO: 21888 - DNA, 1349 bp, Mus musculus
ctgccattaagacatccaaggttttatccaaagctgtttgctggtattagacagaaggcagtgtcgagcagcccttctggaaatgttgcatggccagtgctctagacgtgggtgggaaggtacagattcctaccgctaatctgagaagtgatgtggagggggggactgaggttacagttagagcttaaccagtttatttcacacatttgttacagaggcacaagatttacgtgatagaaatactttagaacatggaataaatgcaaaataaaacatgtttctgtgataccaggcacatgccatagcttaatgggcgatgctttcttcgtagacacacatggtgcatcctaatagatggttatttagattaagtaaaagtgataatatgtaaatttacttttcaagatagcagttatttattggagaatttaagtataaatcttacagtgttaacagttattttttatgaaatacttttaggttaaacctattggggaaaagttttagcgttgtagttaggaatctaagagctgtcttctcctttatggagaatgttatcagtccctcctttatatgaggacttatgttctgggcttctgttgtggagaaagtacttcacgaacagcaattcatcgacaagacctcaagagtactagggcttgagaaagtactggttgaaaatacctgcttggctgtgtaaaatgcctcttgccaggagtccatgtttgttctacccgaactttggactgttaactagagaagtgatagactgatgaaccttctagtgttgtctgctccatacgggaaatgagcttcaaggccaagctccttcctcatccttgttctttacagccctgtttaacctcagttgttacctcatccttcgctctggcagaggctggttgttaatcgtctactggcactgcccaaggtgagttcctgaagatgtagacagcgcagccccttgaatacactagcagggaagttacagaagccaaccttcggctatacattttctggggagatccccaatagcttgagagtggggtacagtcattctgtgttctttatgggggcatgactagaaggcacaaagcagtgacattgttcctagcattgatctttagcatttaatatttttttatactaactaaatattttaaaaccggtcaagatgacccaaggcatcttgataccgggaagatgtttacattagattttttttttcataatctaatgttttgagcttcaagctttcattgttgctaatgttttgtggtggatatctaagggttagatgccaataggaaaaactttaagcagcaggtgagctctctgttgtatcagta

SEQ ID NO: 21889 - DNA, 1208 bp, Mus musculus
gcatgttttaaaacttaagtaaaaacattttggatgccagtatgaggagactaaggcatagtcctttgtgtaagattggtttcctggcctcctttacccagccaagagagggaagagaaagtgttttctctgcagggtccctcatgtgctgtggatttatgtcttgtttcctgttgttttgttttaggacttttatagctgttataacagtcatacctgtattctcaggctctcggtgcaaggggtgtacttaactttaaagtttaaggatacaatatacatatactagagtcttgcctgcacccttccagaaataatgctatcatctctgaggattgtagattcttgaggacttcttggtagattgctgcagttccttcttggccaacccttcctaaagatgtatgtgtgtatgtgcacatgcgtgtgttcatgtgcgcatgcgtgtgtatgtgttttcaaattgcccatgtgatagcatggctcagatttaaatgccaaatgcattaaagatttgtataacagctgaggcattaagcacgtttgagctgaatggattctcacagtggaagtagatactggttagccgtcgacatcttgacccctttctttagattaggcttaaaaaccatttcaaagtggcattttgctaaaagtttaggataagtatgtactgacatctaaaacatgattcgaagtagtctgtgtttctcataatctgtgatactattctgagtccacagtgcaatctttttttaccatcagtttttctcagaaggtgtctgactgtgactggtagccagtataactgcagatctcagctggtaaactaagtgcttttatatttgaaattgacttcataaagccaataagcagtcctcagagcatggagatatgctcaggtgactgtagaatggcactgggttatagaatatagaattaaggaaccttgtattgtcttctgttaaagtgtcccagagtttgaaacttctaacaagttccattttatcctgtatcagtagaagctgcatctccatttgttagcacacacgctacctgttgaggacttcctagcattaagctccacgccagttctatgcataaccattcgccagatactgctactgtggtttacaggagcctttctgtcttgtgccgcgatgcatgatcatcttgctgcttgacaggtcctttgtgaggaattggaa

SEQ ID NO: 21890 - DNA, 2697 bp, Mus musculus
agcttctcaggagacatggttaactcaagtcctcgtgtgtgtcagctcagccagtggtaaaggcttacccaggattctttcttagtattcgaaacacagaattccatggctccttttctaagccttcaggagatttttttttttttttttttttttttggtgaaagaagggaaattaggtgtgttgtgaagaacaaggataattaagatctgaggatgctatagaaaacagtgcctccaggaccttccattcacagcgtggaaggctgggcgccctctttgagatgcctaggctggtactcaccacttagctcagtttgctgagttctgttctatagatctcctgtgtacaaagatggctgaaataggatttcctcagactctcccaggaactggacaagcagtttcaaagtctaaaaaggttggggtagtaccttactacttcctgagactcaccctttctccctccccggacctcatttttctttttccatctcatcctctgagttggacatttcaatgtcttaggtgttgctctgacaaggaccagactctaagccaatgagatagatctgagtccatgctccgtcacgtggttcactttgatctgagcatcatttaaccactctcagctttaggtctcactttgaattgattaatacctcctatgggtaaacagtatgtttgtgacagtaagtcagtagaattctaaagttatatttttccataaccattgggttttatgaaattcaccttcatccatttctttttttttctatatattttaagaaaaaagacttttatataattttactttcattacctcctctttgccccttaaaatctacagataacttttctaaggagactttgaggagttgatggtgatgggcgtgatgggtaaataggaatatattacaggttctgctcacctctggttaatgtagagagaatggatgtggccagcatttcctccactgccatttcctacttgctccttttggtttgactcagaacatcctttgactgggtcccatatgcaaagtactgccctcgtattagctcccgcccctcctagtcatctgtcactgtgacgtaaagaatatggaaacattactgaggaatttctgatgatggctttagattatagagaagtgtggtaacatagcttaagtatgactgggtagttactgaatctttttaaaatcagggggctgtattctcagtggttagacttgacagtcagccagtagtgtcctagttatccataatttctcatcctttgaaactgttcaggatataaaggacattattcagttttaaaatgtaatgtttcttgaatgtgcaatgccatttgtaacagagagaaattcaaagtgggggatgttagagaggctaatacacaaaacaagagcatatgaaaaccccctgtgtttgcaagcatagttcctccatcctgttaagaccataaccaccatggagagagaagtttgctcatgccttggttcagtgtgtgtgggctctacaaaacacaggtgctcatggcacgttctgtggggggatttgtcctcccttgaggatccctgttttctgtaggtgatcctgtatggtggcttagtttctgaatttgcctatcttagaatctagctggaatctgtttgggagaaattaatgtttcctatgtgaaatgttttcaggaagcaggtgctgcactgctacacctttctgagcaagctgagctgggatgcagtaccctttcttcatttagatccgctttcacattctttacctacatgtggggcacatgtattgaacacacataatggccttttgggttttgcaaactaatatatttagcagtttctctaacaatctcctttccaaagcagatgtcatacatcctaacttagatgtgtgcatttcttgacagaagctgacgtgctggtgtagagagactgttcagtgcccatgtttatgctgtggttatctcattgaaaaggatgcattcaaggcacagggctgggggtggggtaggcagagagtccatgtgatgctcctgctctcctttgcacgatgtcctgcacccacacctgctgtgtaggctccgtgacacggcctttccctttggggaatgcctagctccatactctgatgctgatcatctggactcaccccatgagcggagcacttccctcctagacgtgcactggggattcttttcaagacattcacttgttcagaggcttgagagcgccactgattgtaaaggttttggtttggtttggttgttgttgttgttttttttttttaagttttatatttttgagatagagtctcactctgtagcctagactagctttgaacttgtgatccttctgtctcagcttgtcaggtaccaggattgcagatgtgtaccactgtgcatggctcctcctttttaagtcaaaaggtttacatttcatctctgaaagtggttagaatagaatagttttaaagttttctttctagaaagaaaaatactcttgtttgcctaggtttttttcatagtgcttatgatagtagctgtgttttccttggggcactcttgctcttcccctgtacacacctttattcatgagctccacctgtttcatgaacaagtaggacgctcccctcagctcattgtcgccatatgatctggcagaatgctcacccgtgg

SEQ ID NO: 21891 - DNA, 1154 bp, Mus musculus
ccaaaatcccccctgaggaatcctcttcagacaaaacacaagcaaaacacagaagagccgccgttcagtgtcctcccgagcgcatcagagtctcataagaaacacaactgtgtccctgctaaacaggggaggcaatttaccaagcaaaatggagaaactccagggatgactgctgagtcctcagaatctggggacttggtctccccaaagaaaacctcctctcctcaccagcggtcagaactgcggagatggaggtcggagggttcagacccaaccaggctcagtggcctcgatgggcagcgggactccagctcctcctccagtaaagccaggactgacaatagtgaatgtagctctccttgctgtagcaccacgcccccctcctatacaagtaccgcgttcgatgtcttactgaaagcaatggagccagaactgagcaccttgtcacaaaagggctcatcttgtgcaattaagacagaaaaactgagaccaaataaaactgtaagatccccttctaaattaaagaacagctccctggatgccccaaatgctacgtccccagacctggttgtcgagtcgccctgtcctccgtgtacctcgtacccagtacatgtggcctccactcagaagagtgaacaagtggcagctcagtgtgtttctcacctgtacagctcacaggaccaccttgttcccaaacttagccaacagaatcagcagcttccggggcatctgggcttcacaggctcactgacaaacctgcacacccttgagagcactaaacttgagccgatctataatacagcagtgacatccactgtaggtctcacttctccctccactagaactcaggtcactcctccacaccagcaaatggattctgtgtcacctttgtcagtaagccctgccagttccacacagtcacccccagggccaatttacagctcagcccatgttgcttctgttgtcagtcaaagtgtagaacaaatgtgcagtctccttcttcgagatcagaagccaaaaaaacaaggcaaatatatctgtgagtactgcaatagagcatgtgcaaagcccagcgtgcttttaaagcatatccgctcccacactggagagcggccttacccctgtgtgacttgtgggttttcatttaagactaa

SEQ ID NO: 21892 - DNA, 1174 bp, Mus musculus
aaaggttgtggtccacccagtaagcatgccccccttgaaaactgactgtcttcaggtggccaatcccaatcctgaacttcctagtccacagagcccgagggaccttcatgttgcaagcatactgtcacattcagccagtgtgtcatccttagagatggatgagtcgtgccatcagaaaggggatgtgattcagtcagaagggaagccagattctcacagtggaacagcacatgcgcagctccagagacagcaggccacagaggacccccaggaacagcaggggaagctgctgctgagtccccggagcttaggaagtacagactctggctacttttcacggtccgagagtgctgatcaagccgtgagtcctccaactccgtttgccagaacttttcccaccatggacccagacccagctaagaacggtggagccccagggcctcgaatcagtgctccagcaccttctgctttggctaccggagagaagtcatcggtcgtcacaggccagatgcgcccacccttggccaccaaaactctggaggaaaggatttccaagctgatctcagacaatgaagccttggttgatgataagcaactggatagcgtgaagccccggagaacctcactttctagacggggaagcattgactcccccaaatcatacatattcaaagattccttccagtttgacctaaaaccgatgggacggagaacaagctccagctctgatataccaaagtccccgttcaccccaactgagaagtcaaagcaggtgttcctcctgtctgtcccttccctggactgcctgcctatcaccagaagtaactccatgccaaccacgggctattcagcaatccctgcaaatataattcctccccctccctctttgagaggaagccagtcatttgatgataaaattggcaccttgtatgatgatgtctttgtgtcaggacccaacccatccatgcccccaagtggccatcaccgtcccctggtcagacaggctgcagtggaagactccacagccagtgagagtcatgttccaggctctgggcagtctgtggatgagagctgtcaagggtgcccatcctccagtgaggctggaccagtacagagcaaagcagcgcagacccctcacctagagaagaagaagtcacatcaaggacgaggaacc

SEQ ID NO: 21893 - DNA, 1098 bp, Mus musculus
tcgccaggggttagacatgaagagaacaaggtcatccaagggcagaggccgcctctagtgtctggtctttcattggtgagcagctcagacactcaacagccgtcatttcccagcctcaagactgcaactagctttacatggtgttacctgctgagacagaaggcattgccgttggctcagaatgaccagaaaacttcagcctatacggggtggacagtaagctccagtaacccaaatccacttggtttgcctacaaaagttgctctttctcttcttaattctaaacagaagactggaaagtcactgtattgccaagcaataaccacccattcaaaatcagatttagtggtctattcaagcaagtggaaaaacaacttaagcaaggtacttgagatataatttatcttcaatggtgtttgtgcaaattagtttcaacaagtctcaacacctttaagtatcttaaagtattttaattgtgagtgacaggttgtactatgtgattattagatgggaggtgacactttccccagcagtcccactgggaagagtcacctacaattctggcagtgattctgtctaaatattttgcaagcaatgacttctgcggggcactgattgttagtttgttcgtgcttttcccttcagctgactctgctcagaggaggctagcactttgatttttctcgtcactgaggagttatcagttgagagaagatcatggctacagtctctcaaggctcatttgggaaagccagcatgtagatttccagaggtgattgtattctgctgtgtactgtacaaagaatcagtaatatttgtcatgtgcctcctgcagactggtctgttcttgacatacccattgtaatattctgagtgaccctctgagagccactggctaccatcagaaagatgcatgaaagagctcattccattagtagctgatttggtcaaagatttgtgggataatttaaggtcatgacattgtaatttgtggaattctctttagatttgttggctttataaactaggggaaatcatttaaatcaaataaataagggcattattttagactctgttcattcagaattattgattagc

SEQ ID NO: 21894 - DNA, 1176 bp, Mus musculus
atggatgaagactttatttccagggaatattatgttcactgaaaagaaacgatagacatctttcttggaaaaaaaataatgatgtggttgttcttgcctgcaatcccagtacttgggaagtggaagcagaattgtgaccacaatatcattctctgttagacaatgagttccaggacagcctcgattaaatgacacccttcctcccaaaaaagttttttgttgttattgataacaaaacttaggattcattgactcttgtagatcattattttgaaaaatgcataatatttgagttttttaaaaaacagcacatttaaaacaaagtatccagagccctaaggtcagcgatagagacatggaatacttgaaaacttacttagaacctctagacagccaactgccattgcccaagtggacatcttcgtttttgatgaatcccttttcaggtggaagagagtgtctagcaggtgcaaggcactggttcaattccaaatacctcaggaggtcattcgggctttgcacacacagtgcatcaacagatgtacaacaagctaaccaggcagatcttatatagggtacagatgaagcagatctgaggaccatgggtcaaagaagcaatgctgagctacctaacccatctggggttccgatccttgggcttcttgttggagatcttccactactccaggtttctctccttgaagaactaggaatgtccacccctcatccagcctgatggtctgtaaagtccatgctttgtatctgcatcagctggtacatcagggatgctggcaacacagttcaaacaagtcactcctccaggaatcctctgtttagaaccatgtgtatcgggtctaaaactttaaaactatacacacgcttaaacgaatgtatgcagatagatagatagatagatagatagatagatagatagatagatagatagatatctcctgttgtattccagtggtggactgtaggatttccatcaccttgaagctccaaatctatcctgcatcacctgacactcatcaaagaagccctcttccagctctgtgttgaagaagaatattggtatgtctccaatattcatgagcatctctagtcagcaatgaccgaggtggattttaataattaactcattagaccaatttatttctctaattgcttgtgaag

SEQ ID NO: 21895 - DNA, 1606 bp, Mus musculus
gacctgcactgcaccggacagtattcgctgagctgtcacaggaagacccgtattttacagatgtgttatgtgttagggatagaacccctagctctgtgcatggcaggcaagctctctaccgctcagccatacctccaacctcaattaaatcttgaaagtattcagaaaaccttgtgacaacaacaaaagggcaatctctaattatgcatctctggaggctaggggacagagagccaggtattcaccctgagaagaacgcaaggcccactctactcataggctattgtcctattgctggatgtgaactttcactctgactagcctgtgactctggctccattcactggtgatttcttttgcccaccaaaaccccggatcttgcaggacaggatgacactggggaactaagtacctgtcagacaatcctatttgtttcctttgggcaagggaggtgtcagaagtctgaagtatggctccagagccatccccagcacttgtattctgctagctcactccggtcagcgtccagcaggtgggttacgctctgcatttagctggggcttctagaacttctctgcagtgatgtggtttcctcagagtttatcagtctgagtgattgcattagtacaaagaagctagcagacccaactggccttttctcccctgcatcagggtccttatctgctggagcccttaagagggccactgaagcctctggctctcttccaggcgactgacgcattgcactactgagttccctgaagtctgctgcagccccttgtttacgccagcagagaacagagtgataagaacaacattcgagtggacacgcttgacgcttagtgcagcgttcaaaccttgcctggacctggaaattgtcagggccatagagtcccctgtcactgtgtgtctcctgtgccctgcccagctctctgctgtcccctgcagccaccacaagggctaggctgtccaatgagccccatagcttctaagaaatgcagtggcttatttgtagtactccgtgacatcccaggtgaagaagcaaaagcctatgatctgatctgatctcctttattctgccctgtccctggtttaggggagggagaaccttctagcaactacggctttgtttgctgcctggtgcttttatagtctgtcatttttttttcatttcctttttttaaaaaaaaaaaaaaaaaaacacaaaccaaaattgcattggtttggttgtcattgtctagtctatatttattgttttacaaacatgggtgtatatgtatgtatatgtataaaaaccaaacttatatatataaaaagtcaaggcatgtatactagatattttaaagttatttatcaaagggaaaagatgtgtgttataaagtaaaacagagtctatattttatatataatgtagatagtaaaaaaaatagcttataaattatagaaggttttactttttgttttctattattaaacaaagaaatttaaaagaaaaaaggacagtgactgcagctgtgcttggtgttctcaaggcaaatcactacggagctggaggtggcttgccctccctcgggatctgcagttccaggctcctgagtggatgatg

SEQ ID NO: 21896 - DNA, 1156 bp, Mus musculus
aacaccaagcacagctgcagtcactgtccttttttcttttaaatttctttgtttaataatagaaaacaaaaagtaaaaccttctataatttataagctattttttttactatctacattatatataaaatatagactctgttttactttataacacacatcttttccctttgataaataactttaaaatatctagtatacatgccttgactttttatatatataagtttggtttttatacatatacatacatatacacccatgtttgtaaaacaataaatatagactagacaatgacaaccaaaccaatgcaattttggtttgtgtttttttttttttttttttaaaaaaaggaaatgaaaaaaaaatgacagactataaaagcaccaggcagcaaacaaagccgtagttgctagaaggttctccctcccctaaaccagggacagggcagaataaaggagatcagatcagatcataggcttttgcttcttcacctgggatgtcacggagtactacaaataagccactgcatttcttagaagctatggggctcattggacagcctagcccttgtggtggctgcaggggacagcagagagctgggcagggcacaggagacacacagtgacaggggactctatggccctgacaatttccaggtccaggcaaggtttgaacgctgcactaagcgtcaagcgtgtccactcgaatgttgttcttatcactctgttctctgctggcgtaaacaaggggctgcagcagacttcagggaactcagtagtgcaatgcgtcagtcgcctggaagagagccagaggcttcagtggccctcttaagggctccagcagataaggaccctgatgcaggggagaaaaggccagttgggtctgctagcttctttgtactaatgcaatcactcagactgataaactctgaggaaaccacatcactgcagagaagttctagaagccccagctaaatgcagagcgtaacccacctgctggacgctgaccggagtgagctagcagaatacaagtgctggggatggctctggagccatacttcagacttctgacacctcccttgcccaaaggaaacaaataggattgtctgacaggtacttagttccccagtgtcatcctgtcctgcaagatccggg

SEQ ID NO: 21897 - DNA, 1197 bp, Mus musculus
catcctcacttgggttctaggagttacaaaggccggtgccgtcctgagacggggacagccaaactttcagaactggcaagaaaattcaggcattctgtatgcttaaggctgtcactaagggctacaactaggtgtgtgcatatatgtgggtatctgttgtgtttctttctgcagtttgcaacagtcacatttgtttggctagcttgtccaattggagaattgagagggctcctctagcgggtactccctcggtggccgcagcgccccctagcggcggctccctccagacagggccactgatctgctgttcttgttctctccaggaataggcaagaatgtcatctgtgaccgtaccgccacgccgctggacgccttccgcatgatgtcagcggcccactactacccgaagctcatgagcatcatgggcaacgtgctgcgcttcctcccagccttcgtacgcatgaagcagctgattgaggagggctacgtgggcgagctgctggtgtgcgaggtgcaggtgcacagcggtagtctgctgggcaagaaatacaactggagctgcgacgacctgatgggtggtggcggcctgcactccgtgggcacctacatcattgacctgctcaccttcctcacgggccagaaggctgtcaaggtccacgggctgctcaagacctttgtcaagcagacggaccacatcaagggcatccgtcagatcaccagtgatgacttctgcaccttccagatggtgctggagggtggagtgtgctgcaccgttaccctgaacttcaatgtgcctggagagttcaagcaggacgtgaccgtggtgggttccgctgggcggctcctggcggtgggcaccgacctctatggacagcgcaatagcgccccagagcaggagctgctgcttcaggacactacatccgtgagcaactccctgctgcctgagaaggcattcagcgacatcccctcgccctacctgcggggcaccatgaagatgatgcaggcagtgcgccaggccttccaggatcaagatgaccggcgcacgtgggacggccggcctcttaccatggctgccaccttcgacgactgcctgtacgctctttgcgtggtagacaccatcaagaggtccagccagactggagagtggcagaacatcgccatcatgaccgaggagccagagctgagccctgcctacct

SEQ ID NO: 21898 - DNA, 1108 bp, Mus musculus
ctcctcctgaccaccctatttgtgctgacagccccttatcctctggaagctcctgggcagctgtgccagcagactggcaaaactcccaaaaggccttcttccatcagatccatcagatagggtcccccttgtctgaggataaaagagaaaccctttctgcagctaactcctcaccctaacctacaccctgacccttgatcttgtccgcaggtaactccttaatagtctaaccctccaatgctcccagactctgggactgacaagatgcataggggcccccaatccaattagcagaggaaaagagccaggctatgagtgcttgcttacaggatgcagaggtacaaacaatgcaatacagcaggaaggaggagatgcccagctgcttagagcaagtgggaaagctctgcttaagaggtaactttttaactgggttctgaagcatgtataggagtttgcctattcaacattcagttgatttccatttagaaattgagctaaaacaaaggtacttacttgagatctcagaagccaccgactatggatggtttacaaaatattataagtctattgtgaagtgtggatttttggaattaggctcattagatgcctaaaagaacctaccattcaaaaaaaaaaaaaaacttaagctgtgagtctagagaaatggttcggtggttaagaaaaatgtactgttcttccagaggacccgagcttggttcctagcaccctcatcctgtggctcacaacagccttgtagctccagccccagggagcctggtgcctctggctcccatacacagagatacaaagattttgctctttgtctgagacagagtcttactatgtagctccggctggccttgaacttaaagagatccacctgcttctgcctcctgagtttgggggactaaaggcgtgcatcaccacacccagctctaatttgtaaaataagatctttttgttctggttttttttttaaaggttaagcagaaccagatcttgaaggaaaagaaatgaacaggactgaaagccagagtcctggctacagtagcacaaccatcctctccagaacatttagccagctccactcacagcagctcgccattta

SEQ ID NO: 21899 - DNA, 1141 bp, Mus musculus
acaagtctgcagagagagggtgaggaactgagtcgtcttttctgtggcctccaaagtgactgcctgggaatgcaggaggtgatggcgggggcagatttgagtgtgtgtgggtgtgggtgtggggagaagtagtgtgggcaagtgacgtcacgatttgacctttgaccttttcctgttcccccacactgtgtgtggctatctgagcttaattgggcagagctgtttgcttcttctctgaatgggtttcttgagttcagtcaggatgtcaggtgctgggatgggctcaactgacaggcactgtcgggacctgggatttgcaatggttatggcttaatgacaccccttctcgaatctctgacatccctgtcaaactgtcacagtattggtgagttagggcggggtttcctctttaaaataacactcgctgtggtccttggtgcctgcaaaacagtgacaaggtggcttttctattcactaggcgcttctgagcttctctgagcctggggttggctttccctttcaggaaaccaaaaccctcgaagggcaaagggtggcgtctggaattactatggtgattcagtgatagggacttctgagagaagcaactggggatgtgccctcaattctgtggggtcagaaacctgacctatacacatactcacacacacacacacacacacacacacacacacacctctacatgcatccactcattgccaagcttccagagttgttaaggagccacacgcttctgctagatgtgtgcaaggccaagagctgggagccatgagtgcacgtgtgtatggagcatactcagaggtctgagggtgtcagatgactaaattctgaacttgagtgagaaccacaaaataaggtggcagaaaatcttagctgcaagcattcatcgtgttgttgagggtcttcatttcaggacaagcagagctttttctgtcagtggcagctagaggtaaagccaaggtcctgggatctgaagagctgcctctgagtcacttgttgagctgccctgcccctttgcagcccacaaaaggaccaggcagtgtgctatccctccctggctgccagttatcccctccaaattctgagtggcatgtgggaggatgaagaacacttggtagaattg

SEQ ID NO: 21900 - DNA, 1198 bp, Mus musculus
catttgatgtagatactgccagacgagctggcactcgacacactcactgtgtttggtcagttttcttcagagctgctccctgcaaggccctggaccacagatacctagaggctgcttgcctagaggatgcccagagtacagtgtgactcacactgtttcatccagagcggctaacagctcaggacagtatcccttcccagtcagccttgggtcagacagaacctgccaaaagtcagagtcctcctgcagcagggcctctctccttagcgaatgccgcctggctgctggcctaggcccaatctattctctgtaccatgggaaaggtgaatgtgtatataaataacacctgcaaatggcatttcagtgggtcccaaggaagctgggcgaacactgatggatgctcaggaggttcttggcttcatgttgtcctgcctccgctatgcctcttacatcgttggcaattgagctctctcttggatgcaccaccctccaagaccaaggcctctgctgtgttcctgaaattcccctgccacttatctgactctggctctctgcactggctcaggatggttgtctagactgctcgctctctctctctcctccctttgaatggctggatctctctctctctctctctctctctctctctctctctctctctctctctcttctctctctcctctctctccactctcctctctttgaatggctaactctttctctccagatccagctcatgtgttattttgagggagtgacttttctggacctcttattctaccaaagttcctcttccagcgctctgggtctttctatgtctcttgcttcctttctgtccttggtgacattctcactgctgatgagtctcgtgcctgctcgttgtccctctgttggaaggtagcccttccagggctgagctttactctgtgtcttctttaccctcactagatcatgccagataccaagtcatctagcagtcggctgccaacagctgcaggatgaccagtgaaatgtggaagaccttttcattgtgtggacacatgatcttaggaatcacaggttagggacaagacacatccatccacccagcatttctgttccgggtatgataatctgcaccccattccaactttactgtgcattgatattacccggagagccctttaaaactcagattcctgggtggtatcggggatgc

SEQ ID NO: 21901 - DNA, 1233 bp, Mus musculus
ccacactgtgtcttgcttaaagcaagtttttataactgtctttgtaaaggcaggccttacaaatagtctggtaatgattgtagtgatttttaaatggtactttctgtgaaccagctataatatacattttttagatatgtagtttatataaaggctgagttaattttaaagcttaataactgttatatgatattctgaagacatgggttaaatttccatgcattagaaatgcaaggccacatgggttgtgtggcagggccccagagtcacccatgtgggtatcttagtttatatttttttgatggttacagtgaaggaaagaacactttttcatccagcatataatgtattttgttttagttgtcctctgctcatatttagattgaggttttaaaatactcattatataatttatgcttctatacttgcaatgcaaaggcaatgaagtccttagtgtacaataactagatacttaaggaaatatgttgtcttacagccaaatttgtatcctactgtggggcttcagacaccaggagaagtggttgatgccaactttgggcaacatccttttgtgtttgatatagaagactacatgcgagaatggagaaccaaaatacaggcccagatagaccgctttcctatcggggatcgagaaggagaatggcagaccatgatccaaaagtaagagcaaggaattttaaatgtacagattcaaacactgaacgtttataggcaaactattctttttgtcttcaaagatgtatctccagaagtctagtttaaatcctaatcatttgtgtgtactagtgattatattttaatctcaaaaggtaatccaccaattggagtaaaatagcattggtttaagcaccctcagaattgtgtctgtctgatttaactggatggaggtagtaaagagacacttgaccataaaagtagcgtaattcagtttttttacccttactaagatgactcagtgaagtctgtaggttatgcagtcaaacttctaaaaatgttgacaaaaaagagataagtttagagggtgacctagatcgtatgttattgtgggttctgtgatcatcgtcagcagtagttcaggtacatatggaggaaaaagaatggttgtttgatgcttcctctcaatgcagacaagtatgagggtacagccagagtgggcacacgggatggtccagcgctgaggagtgtgggttgctcgtctctgtaagagtgtta

SEQ ID NO: 21902 - DNA, 1151 bp, Mus musculus
gaaggtttaagtgaggtcttaattataataggtaagaatgtgtatagttgtgtgtataaaatggttacaaattacatgacttttacctctggatcaccttgagaagtttgtggtaactgaaagttatactttacattaaagcatgtgtgtgttattcaaataaaagcaaaactcctatgctatattagctaaagaactaatgcatggaaaaacataacctggcatgactgctgtttatgttcacattcctggtagaaattctttctcctcagtacttgtttttactgttctgggtggtgagtttattttccttaatgttgtagacagcatcctaatgctgaaatcactatataatttagttattgagaatgtagatggacacttggagcttttatctgtataatatctgtcgtgccgttctgagtcatcttacaacgttagtggtaagtgactgatgaagagccttgtttatcattgtaaatatactgaacctgtctctccaggttgggataaacattcatatggttaccatggggatgatggacattcattttgttcttctggaactggacaaccgtatggaccaacttttacaactggtgatgtcattggctgttgtgttaatcttatcaacaatacctgcttttacacgaagaatggacatagtttaggtactgagatgttgttttaaatacaaaatagccaaatattgtgattattttactaagcatgatggttttgtttattatgtgattctgtttaattattctatccatgtccatgttaaggaagtgataaaaacttgtattcagttaaggctaacttatgtacagaagtaatactagaagtgaccacccagtcctagtgatagaaatgccaagcttggcttggacaaaaacttcattagttattcagttctctagtacaatttaaaacattcagttctaagaatatcgggggagcagttaacggaagtgaactgtaaaagagcagagtggacatgcttacaccttaggcctgctaatggtgttgctgaaggatggtgtctgagacaagtttgtggcacaggaaagaattaagtaaataacagaaataaaaagacacgtgggctaaagtatggcaatgaaacaaagaatcatgttgtaggaata

SEQ ID NO: 21903 - DNA, 1099 bp, Mus musculus
cgtaaccaaggtgaagaaagttgggatttctgtgatcgttctccggagcagctctgtttagttggctttttggctgagccgtgtggatggaccacactttcaagactcctttcaggcgaacctgcagcatttgacaagaaataaatgtactctctacagctttaagcagtttgtaaggtggagagcgtgggaaggcatgtggaaaacaaggtagctttaagtctaaagaatccttggcatcagcccagagcccttctgtgcctgaccagcagccgttccccacgcagtcttgcctctgctgcagcagctgcagtgttaatgatgcaggactcgccacaccttaggggcctttgtctctgggttcccattgtcttagtaacattgttaatgtgccttgcaactgggagtctaggtacctaatgaaactttgtgactttagcacaagttctcttactgctgccacacctgcctttctggttttgagacaaggtcttgctttgtaggccaggttggctttgaactcactatccggcttcaacaccaccgtgcccagcctctacctttccgaatgctagccttccctctccctcttcttcctcttccttcccttcctgatgtgggagtctaacaccacactcctggcattatctacctagaaatcttgtaattcttggaatgaaaccctgcttcagtgtgtggtttggagtgaacttccttctggtgtccacctgctttgcctaagatgacacgcggcacttcgctcctatgggctatctagacagtgtgcacgcatttagaataagtacacttttccctgtgagcggctcaggttgtcacttgcccagtgagagagccccagtgcttggcagtgcccccctgtgcattgacttcttctgtggtagcagacacccccacagccgcctcagctctccatcggaaacagataggtcctggagcagctgcagttattttggagaagtgcgttctcttttcctctttaaattgctggcactcggatgagagtgagcatttgggaagcagtgacactgggggacccttcctggcttgccccacacaggcacaaatgcacaagctggtg

SEQ ID NO: 21904 - DNA, 1203 bp, Mus musculus
gctgggttgaggtagaggaagggagacggaagtttagctcagtgtttatgaatctggagctttgccaggactacctgagccggaaggcagtggctggctacttatctttccattctcttgttaattcattagtagatttgcgatgttaatatcactccatagcagatttgctgtgaggattaagagttaacaggttaaagtgctttgcaagggctcctggtaaccactcgaccgtcattatcatgagcatctctgattcatattttctaagagaattcctgcagagaggtccatgtgctttattgcacttgagcgcagagaatcagggacagaagtggattttaatctcccttaatttaaatcctcatttccgggcccaggcagccaatggatggacaagaagtgttctgccgagtttagaatccaggtctacaagccagaattctggaaaccgccatttttctcagtacctgctacttctcaaatactattacagttttctctaggaggggcgggtcacagttttgaagggtatttgctgaaaactcaagatagctttatattcagccagctttcttcttgtctaatcttacaagagtttgggcaacctagccccagttgacttgaggggcccagacactctgtgttcttcttagcaacatgagacatgttgggttgaacatgaaagggggaggggagagatgaaaggtttaacaatatgtgaccctcattcgccaagcctcaggagcagggcttcttggtgtgggaagctgaaccctgctattctgttttctcttggaaaaatatcacacggccaagcttcctatcatacagccaaactttctaggccatttggacctattaaccaaagggagtggagggtaaggccggtgtgtgcgccgtaaagctaaactcctgtgaactgctgtgtttctgctagactttgtacagtatcatctaagaggatctgttccttccatctcctcaatcttcctttgttcctcatcccccacccctctggttagtgctgctcagatcttcccactcatctcctaatggtgattaggacctaatttatgctggagtccttgtgagtctggtttctgcaaaggggactcacggcacatctggaaatggacacattagatgttctttcatgaaggcctgcagttcagtgaatgccgggaagctgagagacaggag

SEQ ID NO: 21905 - DNA, 1100 bp, Mus musculus
ccaaactgtacaaggagaagctcatgcatagaggtgaattcatacctctctggctgttagaataggcacttattgacatttagtggaggagaggctgggttactagacacttccaaacacaagatcaaccttatacaacactgttgttgatggtcccatagggaccactgcactaagactgctactgatgttcctattgggagcacggcactatctagcatggctgcattatacaactctccttcaagtctaagttctccttcatacttgtgtgtaatctgtctcttctacctagaacacttgcttgtccccttgcttgtcccagagtttcaagtgctctgggacacttgcaatctgctcagtgaggctctccatgactgcaaagtatatagttggccactccctttcatagcagccttcctatgtcgatgctgtcgggtttgtccatctccttccgtggaagccgaagctcggtgggggtaagaagcaagagtggcctctctcaagatccaacgtagagactggcatcctctccggattcatacacaaatgcagggtcatgcatgagttagcagttctggtgctagaatatgtgagaacctaaggactagggatggagacaaggaagaggccaaaagagacaggagcaagttggtatgatgtgttggccgaggcgagaaggcactgatagggtagcgggttccccgagactgactctcatgtaccaacggagctcagtcctacagagattttggtgggacactttgttccgtttcatgctgtgtgaagcttgtatcttgcttgtgaacctcaagatctccaagatggtggacatgggaatgagcctggcttccctatggtttagagtaacccatgcatgacaagttgcccattcattgagttattaggaaggttggagtttggaagggagggcccaattatagctgagtgtaaagtttggaaagaaatatccactcgccctggaccacctcttcttgttctggtgagagctgggcactgcttggctgggaacgtctctggtgtgtccatgttcaccgttcaggcatctagagttgctttcacgtctgtgatagagtatc

SEQ ID NO: 21906 - DNA, 1216 bp, Mus musculus
gaatcctccatttcaacaaggcataggtgaatttgctttgccccaggactgggcaagttgaaaatatttaagatttctccactcttgcttcctctgattgaagagtagccagggaaaccaggatacctatatccctttagaatttgtagaaccaaccttgttagagggagtcttatgaatttgtcacagttgacatctggcctgaagaggatggagcagttgcaacactcagggaaggagctatttaaaatgaatgtatctacttcgaggcatatcccgtgatggatttttagcatttaaaagacttgtgtaagtcttcatctttaagatctctgacctgtctccctcttgggggccaggaagacagtgtgtgaaggcaggaggcactgtttcaaacactggcaatagctatgcagtgtacaatcaagacaggtaagcatcctgttaaaatgtaggcccctgaggtttggtggtggccaggcccaaaattctgcttctatgaaggtgtcagagggtgttcatgagtctaaatgatctgcggcttccttcctccttagccgtggtgggggatgggcaaaggtagcagaagattcctcccccaggttggagagcaactgccagcattctgctcctttgggggcccccttcgaaggtgtttggaaagaatgaactagctctatgtttttaggagccagcccgtgggagcctggaaagagaagggattccggaaagaatgagatgaggcagatacagagacagataaagacaggctgaggcgggccgtctcgcctgcaatgtctgtctgtcacagcctatctcatccttccttctctgtttcaatttcttttttttttttccctctccatctcatctccctcattgcttttctgtctgtagtaagataacaggatgatttcgctaaagctcagaggcggttaagaaggggacatgcgtgccctagttccagtaccaaatgtggcagacgcttggggggggttgtctatgagcctcagtttccctttttgtctcatgatggaggttcattaggtggtacccagacccttcctaactctgctgtcctatgattagactgactcttcatgcaaatctgtttacctgtaacttggggcaaatcagctcaacttccaatggaaatgagttagctgtgatgcggatcagggttaccggagcgcataatttccatttccgccgggca

SEQ ID NO: 21907 - DNA, 2035 bp, Mus musculus
tacaaagattgtgtttctgagtcatcttcagctcttacaggatgctccagttgtttgaggaagaggatggaaattaatgtggctatttagcacttgcctttttcactaaggtgtgctttttccttaagtaatgggaaaattctgtgattgaatttttcttgctcctgcaggtttttgaggttgagataagtagctaagaagcaacattttttttttcttggtgtgtgtctgtgcccatgtccccagtcctattggactttttatatggaatctaattcctattccgttttacccaagttgctccctttctcattcttacactgcccaaagcagtaaagctctgtttgttctattttcagtcttgatgttggaggatgaaagagccaatgtgaatggaaagcatttaataagtagtcatggtctgggttcctatttaaattagtagcacatgcttttatctgccttgaagggttttggttatgttgcctggttgtggctggagctgtgacatcacacagcttggccctttacagatgctacatgattgattcctaatcagatgaggccctggcggacctggaacttgatctgaagatcaggttggcctgcctctgctcccccaagtgctgggattaaggtgcatgccacgactttaatgccagagacactgtggattccgttccttaatattgcaaggtttgtgaaaacagttaattgccgtgcagttacgattgcaggagtgttggtaagaaacagacagaccttcttatgagtgatcctcattattcctagttttgttgttgaacattaggttttgttcacttttcagctgtttacctgaagttttcttaaatttaagtagctttttttttttaaaaaaattattttttgtgattggggcttctgagtagccctgtctgtctgtcctagaactctgtagtctgggctggtcttaaatgaaagagattttcctttctgtgtctcctgagtgctgggattaattagtggctttcaataccaccgactgcttttgcttaccaattttttgtattgaaggctctgctgccacatctggctgaattacatacacttttctttgtgtgtgggtgtgtaagtggttgtctggtgcctgcagttgtgcaggtcggtcaaaggacagcttttgggaggagttggttctccttttgtgtgctttctcacctgggcactgaactcaggttgttaggcttgctggtatttagttgctttcacccaacttttacttagtaacagactatcaaccaacctacctttctttctttctttctttctttctttctttctttctttctttctttctttctttctttctttctttctttctttctttcgatgtacaatgttactctgtcctcttgagtgctgggaatgtaggtgtatgtatgccaaatactaagatgtttgcctctttttttttggatatattttatatcagaatggtagttttatttatttatgtatttatttattttagttttttcgaggcagggtttctctgtatagctctggctttcctggaactccctttgtagactaggctggcctcgaactcagaaatccgcctgcctctgtctcccgagtgctgggattaaaggcttgtgcgaccatgcccagctagttttattattttttttatgtatttcctacatgtcacacattttccctaaaagactgtacaacaaacacagtgagttgtcatcccaggaacaatttcttttttcttaacctgacaagttcacttgacatgcaaatgtgacacaagattaaaatgtggatcaggagcaacagttgccctcaaacagtagtattggtgctgagcagctttaaacgttttcttttcttttttagttgagaactggactgtgtttaacttcagctgtccttgaacttactatgtagactaagctggcttgaaacttgcatccatccacctgcctctggctggaagcaaagacagtgccaccacacctggtcccatttataagtttttgagata

SEQ ID NO: 21908 - DNA, 1190 bp, Mus musculus
agcttaaggcttcttctcttccagaggttctgagttcaattctcagcaaccaaatgatggctcacagtatctataatgtgacctaataccctcttctggtatgccagtgtacatccaggcagaaatctgtatacataataaatttaaaaagtcacaaatgggcagaggaagtaataatggctaaatcaaaagtgacaaccagccaagtagggaacacacctttaatcccagctcttgggaagaagaggaaggtggatctgagtctgaagccagcctggtctacaattgccttcaaggatatacagaggtacacagagatagatgccctgttttggaggagagtgaagagggatggagaggcgagcactggctgctcttctagaggactcacattcaatttccagcacccacatgacagttcacacctgtctgactccacttccagaggatccagcaccctcagacactaatgcgcatgaaataaaaattaaatttaagctctggcatgttgaacaaggtaggaggtgtcagaaaagttgccacagggataattggctaatggtggccaagtgcccatagcaacgtagctttttgatcctttgatgtcagttcctctatcattgtgaagcagaattcaccaagcactcaccaattaatagggaatgtgcgctgggtttagaccacagtgagacagggttcccaggctgccctttgggaatcaaatggaggccagaaccaaagtctattttgatgaagcaccatttggagggactggctgccttccttcccaaagattctcccagcatggaagggtggactgcccaccggccctccctctcccttgacccacttcccctcttccactgtacactcaataaatgaatgaattagttaatttaagaaaaaacagtggcagccaatcagaaaaaggacccccactgaaccccagaggtggagggccttaaggcaagtatagaaataacttatctgtagtaaatagacttagtgataatgagcatttttgtactttttctaaccatttactgcattttctaacaaatgctatcaatcttattgccacataaaagcttgcacacaacaggaaaaaggtgtacataaccccaaatgtatcctcctagtctggtttctggtgttgtgattaaaaaaaaaaaaaaaaaaaaaaccaacaa

SEQ ID NO: 21909 - DNA, 1134 bp, Mus musculus
aaatagtactcaagatttagccttgtgagattgaatttgtgatgtgagacagctttgggaattgctttcttttcagcaatctagaagttaggaccacttgacatcagacccacttggtcaggacggtttctcttagttacattgacttcttcaagtcctgatagaactatgggtccacgtccagtttttgtttggcaaggaggccttagggaccagtatacatagtttttcattgatatttctttcacatgacagtaaatgttcctccttatcttcctgtgtctctgccccttgaaggcctgagccttgctatgcagccttgctttgggtttgagaccctccagccctgtggtattgggttgaccataggacttcatacattccagaccaacctttaacccattcaacccattcagttctctagtctttgtaaatgttggagggcatggctactctgccccaactgtaagaatatagctttttaagcctcttaagccaactaggatgaagaactgtgtttctatattttattcccagttgggaaggccacaatagtgctctcccacattacagaaggatgtcacaatcttgaggggctccaaaggaaaggtcagttatcccactgagctttatctggaataacgatcactcctgcttaccaaataaaccatagctatacccaggatctgacctattcagtgggttttcctacagtcaagtgaccctagtttctggattcctgagcagagaccgtcttaatctctttgattctaggaagtgtttgaagcctaaaaggacagttccacatggtgggctgattaagcagggtttggggtaagtaagtccgtgcttggccataaagtattccttaaggtggtatatatgacatgtatttatttacctctcagtcatagacaacttccaacagagaacaaatacagatagccttctaacaccctttctcatgtgctcactctgaacagcagtgatagaaacagtgctggccacatctcccccaggggaaggactaattttacagggccccagaagggaacagcagtttcatggtcattgttgttagcccctgtgcagtacttggttgcacttcccttgcttgacccgtttctcctgctt

SEQ ID NO: 21910 - DNA, 1142 bp, Mus musculus
attgctgaaatgtatctgtattatgagatttaataaaagaaactctcagggtatagtttctttgaagttcattctctttgcactttaaaacgagtcagccgggcgtggtggggcatgcctttaatcccagcactcgggaggcagaggcaggtggatttctgagttcgaggccagcctggtctacaaagtgagttccaggacagccagggctacacagagaaaccctgtctcgaactccacaccccccccccccccaaaaaaaaagaagctgttcagagcacacacaccgctccttatttctttgtgtatcctgagctgtcactatgaagaaaaggccagccttgaacttgagatctgcctgctcctgccagatttaagacctttaaaaacatctttaaaaatgcaaaggagttaggaaagctactttgaaaagctagatgtagtggttattagcaaagtttttgatagccaacagagctagattatctgtgatttggacctccctggcttgtattttctcttaacagtacagcactcacattcacgataaaaaggatgaaaacggttcctatgtgtaagctgtttgctgggaatgcttcataactgtagatgccgatcataacatcatcttatgcactacatgtgtaaaactagggataaaaggccttggcaaggaggaccttaagcaagaagggtcactgagccagacacagcggctcatggtttctttaatcctggcactcacaggcagaagcagctggatctctgtgagtttgagtccagcatggtctgcagagtgagttccaggacaaccagggcttgtgcagagaaaccctgtcttgaaaaggtaggtagatggggctgcaggcatgactcagaggcttctctttgagaggactcagatgtggttctagtgtctgcatggcaatccacaaccctctataactccaattcgtagggatccaacaaatgttgtgcacacaaatacattcaggtcaaacacatttttttttttaaatgacataccagtcttccagaggacctaagtttggtttctagcacccacatagaacacatgcccaaatagataaaaacatacatcattaggaataaatcataaccaaaagattgatagaaatcca

SEQ ID NO: 21911 - DNA, 1199 bp, Mus musculus
aatgtcagctatccacagaactggtgtgaattggttgggaaaaggtctggaaaagctcacactctgagggtgagtgaccttgggttagtcatttagccaggaaaggaagcatgcaaaagcctaataaagactcacaggttttttatcatatggtagccttggtctttcaatgactaatgtctggtgtggaatgcctttttttgttttttgtttgtttgttttgttgagtctcccaagtgctggcattaattaaggggtgagccaccactgcccggtgtggaatgacttcttgaagattcattcattctttctctctctctctctctctctctctctctctctctctctctctctctgggggggaacaatctttaatgaccatgtcggtgattcattatggaggtggggtggcaccagggtgtggcagacatgccagagttgtccctgtcttctccagcagcctctagctcctgaggtaatctgtatttgccagactttctttatcatgaagatgggggtattaatgtctgctggttgagggttcaagatgacacagttgtagctgatcctcggctaattcctccaatctggccagatgtcgtagcctggcttgatggcaactcgctacccatgtcctgctttcgtgttcagttggagttgggtccatagtgtgggctcattgatggcgtctgggttggtggactcaatctctcagcatgatggcacctctgtgggactccaggagcgagtccttgaagatgctcttaagtattggtttgggttcatacttatgggttccatcagttttaattctgtcatgtgctatcaactttgacctcttgatcgtctctgaagttacctgagaaagtagcaagatacaactctcaggccagtcaaaaaaaaccctgtactaacacactaggtgttactactcactcaaggtcgtcatttgactaaggcatgtttaaaggtgatgtgtgatttgcaggaagaccataggagtttttgtttgaaatcacaaacattcagcaataaacctgtattttttcctgttgaacataacttttatcttgtatatataattagtaatacttttcttcctccaatttacccaagttgcctctcacataactaaaaggccattatcccagtcagaagcaaattcttaatacgtgactgtatctgtattttttagttgg

SEQ ID NO: 21912 - DNA, 1174 bp, Mus musculus
aacaggaaatagtggtccccccctttcccaaatcatgaaacatacttcacctgtgctctgactcatttctttctcttgtttatttgtatttgtgtagtccaggctggcctggaactcagagatccatcagcctcttccttctaagtgtccaactcagctgtctgctcataggtcagggttagtgtatttcataaattgtctcatgtctctttcttgctgtgtttgctgtactattctgatttcaatggctgtattaataacagttaaagatggagaaagttagtaatagatgtgagctataagagcagtctacttagaaggggttcttgataaaacaatgtatactgcagtatattgcgcagtggatggacaaatcttcatagctcctgttgggtagtatagtaaatggattcctggtgcagtagtgcacctttcagtctgggatagcacagctgcccgggaccaggatttcaaggttggtctgggtaactcaacgaaaaaaccctcaaaacaacaaaaaattaaacataattttagaagaatcaaagatagtgtggaattatataatgatttggtattttgcgctcacggattaaagacttggacacaaatggacatttttttttcttctgcacacacacacctccgtggacctcttgcctttggaattgtagattttaggtaatggatgtactttgtgaacaattagcatgttcaatatattactgggtataagaggctatattgtagacagtgtttcactgtacagaactggctgtcttgggacctattattagcctaggaccaagctagctttgaatttagaaatgaacctgcttatttatgcctcccaagtgctgggattaaaggtgtgagttaccacacccagttcatttagtgttttttaataatagcatgagaaatgtttaatgttaagtgtttaatgactctttcaaggattagtttcttaccaaatcctgagcaatattttttggccaagtgtcaggaaacatctgcattaatcccgtgactgaagccaacttcaaacaagcagcaagttaagaatccctagctcactttggctgatctttttatgagcaatgtctaaaccctaacaggtggcacaagggaatttaaggatagagaagcctagctgacttctacctatttctga

SEQ ID NO: 21913 - DNA, 1116 bp, Mus musculus
tcctcaccttaatgtgctttcaagttaaaatagcactctccttatactggcttgcagtagcaaagtgcagtagcatttgtgatctcctgttacatgcaagatatgccttccatgcatacctccataccatagaaactttgcttcctctttctcctttcctcccttctttctctgattgcagagagaaattagtaaaataattactaaaaaaagtggaagatagtgaaagttagtagtgggaatcctaatgtatgtactatttaagatgagttaaaattccattgaatacatacttttttcaatagaagttaataagtttgtatgaggcagaaacaaaagatactgttttactgtgtactggtgtacttgcatgcctgtgtcagtgtgtacattcatgtacatatgtacaccttccctaggcctacagttccttggggctagcctgggattctctggttgtaccattttatttcccttctgtcatctctgtggttgcaattgcttccagtatggacttgggaagactgggatattagctgctgtccctgggatttttgcagaacacgctcctggcatctacctaaaattgttgaaataagattcttacaatgttgcccctttatccagatcagattctgtgtaaggcttcagagtgtgtataggcagtatgcattagatttttttgtctcttttgccattgctgcacccatcagaggacacaaaccttatctgtctccattacatgtagaagctttcctctctgataagcggaggcatggagccttctatgtactctgaatgtacatacagcattttgggttttgtcttctcatatatacatgtcaagagtttgtgttcaaatttggaattttgctgtgcccattcctgcccctcctccccactttatttttgtggaatagaaactgtgtagcaagcactggctagttctgagactggctatttagatcaggctgtcatcacagagagccacctgtctctctctctatattattagcccacacatgaacagcttttcactgttacgagtatatgtatatttggtgacctttattttgtgggtgtttatatatagtggtacaatctgtatgatttaca

SEQ ID NO: 21914 - DNA, 1102 bp, Mus musculus
ctcagaccataggaaaaacattatatttatactatgattcataatagtagcaaaatttcagttgtgaagtagtgaaaatattgttatggttgggaggggtcaccacaatatgagaaactggctctattaaaggggcacagcattaggaaggttgggaaccactaatctaggaaatccttgatggggatattgggggtacatgaggaaatcagggtatttgctgcattccttcattggaggatttccttgagttttacgcagaaggaatgtattaccatttcatactctggcactggatcatataatacttgttaggaatgtgacatgcaacaccccatcaccccactctgtccaggatttttacatcatagataagggtgtccttaaatttatctgtttttaatcaagtgttagatatatccactgcacccagtaggaattttacagtgaaatatgggtctgaatatttgtgtgcctgattttcagtaattctccttccacaggatgacagcgatgggatcccgtggtcagaagagagagttgtacgaaaagtcctgtatttgtccctaaaggaattcaagaatgcacagaaaaggcagcatggggaaggccttgccgggagcctgaaggcggtaaatggtgagttgaaagtggaactggatggagtctttctgtgccttgttctgacctgggcacaagcaagcttactaagctaagagttttggctgtatgaatatatatttcagacatcctattgtatttatagatatatttttatgtttctttacaaaataatatttgggaaggtgtgtcagtctgttagaggttataaactcaatgtgacatctatttacttatttatcattcatgtatgtatgtatgtatgtatgtatgtatgtatgtatgtaatcaatctacccagtgagtgcataggaacctttaatgatcttgttggaatatggagacttgcaccctacatgaggaaatattctaaaaacctactgccctttgtgctatgtgctaccaacctgtgagcaccctgctggcttccttgttgaccagtagctacaaggcctgggtgcctaacagaatgctcagtctc

SEQ ID NO: 21915 - DNA, 1193 bp, Mus musculus
ataatatatcatctataacttcagagtggtttgtaaatacttgaggtgttgggggggaattctatacttggcttttataataagataatagagtggcctttaaaaaaacaattcagtttcttcttcctcatcagtaatttttttctctcttatttccaaagctttaagttaaatgcagagtaaacctccaacactatggttggatgttttcattttactcacattgagttatccattccttgctgttgtttatggtccgtttctccacagaaatattacagataagattctcaaatatttatctcctcctgggcgagttttgcttgaaattactcatggatacaaatggggtcatatttcgtggggggaatatttgaaaataaattagaagtggtatcatctagtagtggtaattagctttgttttatgcgattggcatgcagttagggtcctacctttataagcctctcctttgcattactactcctggaaggggtgaatgtcaagattggttttgatgaactacatatgttaaacccatcaggttctcctgcgctgcccaacagtatggtatattttggaagctctcaggatgaggaggatgtcgaagaggaagatgatgagacggaagatgtcaaagcaaccaccaacaatgcttcatcttcgtgccagtcaacccccaggaaaggaaaaacccataagcatgtacacaacgggcacggtaggttcaccgtggaggctgtgtgaggggcagtggaagccaggcttgggtgagagctgagaaaacatttgaagcgtttcagccagatttcttcagagtaattcaagttccagactcttaatgtacaaagaacttagtagttcagcccaaaagtattctagatgaaaatgaagatgttctatgtggaaatgattataaatgttgtaggaactacagatgacaaaagaggaaacttgaataatgacgattaagatcacttttgtgatcaggtttctctatgtggcccagtcagtcccaaaactcactctgtagaccagattggccttgaacaccaagatttccctgcctctgcctagtactaacttggtaaattttatatatatgtgtgtgtgtgtgtgtgtgtgtgtgtgtgtgtgtgtgtgtgtgtgtgtgtgtgtgtatcatacattatgtgtatgtatgtaattcagag

SEQ ID NO: 21916 - DNA, 1136 bp, Mus musculus
ggtcaggatggcctagaactgtctgcttagcccaaagtggtcttcactttcgggttagggttgtcttgcttcctgagtgttagttttaggcttgagccacgatgatccgttgcctacagtaggtagtttttgaatggattttaaaaaaccaagatataggaaatacatagttcctaggatatatttgaagtgttttcaatcgggttcatcatcacatttcatgtccttgtgcatcttggtgctggccatttatttccctggagaatggttgagttacatggtaacttacacagtattcacatcccaagttacatggtatggttcctctgttcaaggtagtgacttccttcttcccttctcttccttttctagttttcaatggctccagtaggtcagcacgggagaaagagcctgctcacaaacacagaagcaaagaggccactccggggaaggagaagcacagcgagcccagggcagacagccggagagaacaggcttcaggggctcagcccacggccgcctcggctgcggcttcctctgccaagggacttgctgccaaccaccaacctcccccttcgcatcggtctgctcaggacttacggaaacaggtaaccctcagtgagggcctttctagtgtcccacagaaggcccagtttattaatcaaggtgaattcaggctgaccgagctggaaaagtagagcatgattggacagagatcacatgaggtgtctctcttaccctgggaggatccagatctggcctccctttctttcctggatagcttgagcttacacagtattcacataccaagtgctgctccccctccaatcattgctcctcttctcttctgagagggcacctcccatccccttcctagctcatcaagtctgtgctggattaggcacatatttcccactgagggcatccaaggcagccaaggatactgagctgaatactacacagcttagttttgtgcatgagataaaatggatggagactaaagatagactagtttctagtgaagcaggcatataaaatattatttccttgtctttgtgtaaaattatacactaatgcacaacacaggtcatcctttcataattttatttttattttatgtgaatttgtgttttgcc

SEQ ID NO: 21917 - DNA, 1805 bp, Mus musculus
tgtttttgtttttgctgttttagtagcattattgggtttcatgttctgtgggtcggccaggctgttaacatggaacacacaaaggatagcaaacagctgcttttggaataagaaaaaaatatatttcaaaaacttattgcacacctttcttaaatgaacagcatcttgctgttgcaggttcctgggtaactgatgggtcaatagagagggtctttattctggaccctaagcttcctgaaagagccatctagagagatgttaggatgcagactcatcggggccgagcgctaggcaggactacacagtgggctgcacaatgctgtgtgtggtatgaaactcgtcattcagctagcacagattaattcttagtgggctttctgctgcttatcggatgtcctcatgtctcttctgagccagcaactgtagaagtcctttctcactggatttgcctgggtactaattctttctctttcccctgcttctgctgcctccataggtgtctaaggtaaatggagtcactcgaatgtcatctctgggtgcaggtacaaacagtgccaaaaagatccgagaagtcagaccttcaccatccaaaactgtgaagtacactgccacagtgaccaaggggactgtcacatacaccaaagccaagagagaactggtcaaggaaaccaaacccaaccaccacaaacccagttcagctgtcaaccacacaatctcagggaaaactgaaagtagcaatgcaaaaacccgcaaacaggtgctatcccttgggggggcgtccaagtccaccgggcctgctgccagtggcctcaaggccagcagcaggttgaacccaaagtcatgcactaaggaggtgggggggcggcagctgagggaggggctgcggaattccaaaaggagactggaagaggcacagcaagtggacaagccgcagtcaccccccaagaagatgaagggggtggcaggcaatgctgaagcccctggcaaaaaggcctcagcggcttcaggagaaaagtctctgctgaatggacacgtgaagaaggaagtgcccgagcgaagtttggaaaggaatcggccaaagcgggccgcggctggcaagaatatgctgggcaaacaagcacatggcaagacagagggcaccccctgtgaaaatcgttctacctcgcaacccgagtcctcgcacaagccgcatgacccacagggcaagccagagaaggggagcggcaagtctgggtgggcagcgatggacgagatccctgtcctcaggccctccgccaaggagttccacgacccgctcatctacatcgagtcagtacgtgctcaggtggagaagtacgggatgtgtcgcgtgattccccctccagactggcggccagagtgcaagctcaacgatgagatgcgctttgtcacgcagatccagcacatccataagctgggccggcgctggggccccaacgtgcagcggctagcctgcataaagaagcacctcagatctcagggcatcaccatggatgagctccccctcataggtgagttaattcggggattgccgggtgggttcagctgggccgtcatctctaactcgacaatagttgcacttctcaactcatttccctgctcttgtagaacctctctctctttcgtaataagtttggggcttgctcttggtgctagagcccctgagctgctgctgctgctgctgctgctgctgctgctgctgctgctgctgctgctgctgctgctgctgctgctgctgctgctgctgctgctgctgctgctgcatggctttttattgctctagagtt

SEQ ID NO: 21918 - DNA, 1465 bp, Mus musculus
tttttttcttggatgagacaaaaaagcctttctgagtgaaagctaggctatttggaagagacttggctttgatcacatgtgtctgacctttcacaatattgatgatgcagtaagctatgggggagccctggccatgctctgctgtagtcacctgtacccctctgtgtagtagtgccctggtctatgctgagcacagctttggtaccatttcagtggtcctctccttctgtgcatggctacctctttccttctgatcaattcctcagatactatttctggtcaccttcctaagatgatcataccttagtttgcttgtctcctggtacttagccacgactctaagcagtgctcaaaactgtttgtacatacaagctggctgctggctgctttagagcagcagttttgtagtaaggctttcaggactaatagggcataggaaaacaacttgtgatatccttgttaaccatttcaccccattgctgcccaggaggctgtgagctcgacctggcctgctttttccggctgattaatgagatgggcggcatgcagcaagtgactgacctcaaaaaatggaacaaactagcagacatgctgcgcattcccaaaactgcccaggaccggctggccaagctgcaggaggcctactgccagtacctgctttcctatgactccctgtcccccgaggagcaccgacggctggagaaggaggtgctgatggagaaggagatcctggaaaagcgcaaagggccattagaggggcacacggagagcgaccaccacaagttccactccctgccccgctttgagcccaagaatgggctcgtccacggtgtcacacctaggaatggattccgtagcaagctcaaggaggtgggccgggccccactgaagacgggccggcggcggctgttcgctcaggaaaaagaagtggtcaaagaggaggaagaagacaaaggtgtcctcaatgacttccacaagtgcatctataaggtgagtgggctgtgcggtagggtgtgccctgccctgctggagccggaggaagctgacttgttctgtgggatgagcgctaggacgctgtcttaggactgttctgagctgctgtgaccaaatatcacagaggagactttctgtgttgcttctagaggttgggctctttctcatttacagcattaggtgagtctttggcaacacagaactgtcatgaaatggcgtgctctccatgcctgttggtagttatttaaagccgatactatgatagtatattaaaccccaggaaatatttcttgttgtttttataaacctgatatgttaaataaagatttagttggaaaaagctgacatggttggcccaggtgcccacaacttgtctgtggcactgcgggtggctgcaggggcatgcccatcacccctgtctgttgcatctgtggtagtgtttacattagatccttcttgtacttagggagct

SEQ ID NO: 21919 - DNA, 1219 bp, Mus musculus
acaggggtgatgggcatgcccctgcagccacccgcagtgccacagacaagttgtgggcacctgggccaaccatgtcagctttttccaactaaatctttatttaacatatcaggtttataaaaacaacaagaaatatttcctggggtttaatatactatcatagtatcggctttaaataactaccaacaggcatggagagcacgccatttcatgacagttctgtgttgccaaagactcacctaatgctgtaaatgagaaagagcccaacctctagaagcaacacagaaagtctcctctgtgatatttggtcacagcagctcagaacagtcctaagacagcgtcctagcgctcatcccacagaacaagtcagcttcctccggctccagcagggcagggcacaccctaccgcacagcccactcaccttatagatgcacttgtggaagtcattgaggacacctttgtcttcttcctcctctttgaccacttctttttcctgagcgaacagccgccgccggcccgtcttcagtggggcccggcccacctccttgagcttgctacggaatccattcctaggtgtgacaccgtggacgagcccattcttgggctcaaagcggggcagggagtggaacttgtggtggtcgctctccgtgtgcccctctaatggccctttgcgcttttccaggatctccttctccatcagcacctccttctccagccgtcggtgctcctcgggggacagggagtcataggaaagcaggtactggcagtaggcctcctgcagcttggccagccggtcctgggcagttttgggaatgcgcagcatgtctgctagtttgttccattttttgaggtcagtcacttgctgcatgccgcccatctcattaatcagccggaaaaagcaggccaggtcgagctcacagcctcctgggcagcaatggggtgaaatggttaacaaggatatcacaagttgttttcctatgccctattagtcctgaaagccttactacaaaactgctgctctaaagcagccagcagccagcttgtatgtacaaacagttttgagcactgcttagagtcgtggctaagtaccaggagacaagcaaactaaggtatgatcatcttaggaaggtgaccagaaatagtatctgaggaattgatcagaaggaaagaggtagccatgcacagaaggagaggaccactgaaatggtaccaaagctg

SEQ ID NO: 21920 - DNA, 2111 bp, Mus musculus
cgaacccatggtcacttatatattttttgtaattactatattctagtttggagtacttgctgtaggatacaagctgtctttgcactagctctaaagaagaatttcttctggttttagagaactgattttgttttagcattaaactgttcaagtttttgtacgtagatatctagatactgcagtcaggtttggaagctgccgtacactcactgtctaaaacccttgaggggctgtattaatttgtatcgccccatggctgtgaaatgcctttttttttgtttgtttgtttttgttctgttttgtttggtaactgttgaggaataaaggctttttaacccatttttgaagatggtgaagtttggagaacaaattttaaaaccatcagtcagatgagatttttctagattggaaaagggatagaagatacacacacacacacacacacacacacacacagaaaaaagaaaacttgaaatggctttactttggctgtcttttcttctgtcatgtgcgaagggagtttgtaacttttggaaccggagagccctgtttctttggctgggcggttatggcagctgaaggcaaactgtgaggtttgagtgacgaggttctcataccagcacatcactatgcatccgttcgagggagagagagacaaagacaaagactgcctgccttggagggtcactgagggagacctgtgcctgatttcattaggaaatccattctgttatttttttttggtgctgttggctactttatcaaaaaaacaaaaaacaaaaaaacaaaaaacccttcaatagcatccttgaggaaaaggaacagcagttgactgtaagtgcttccctgtcatccatgtgcaatttcccgacattccacctccatctctgcttgtgtccctcacatcagcattaatctttgtttccctcacacttagagccactaagtctgcagttctttttgaatgtgaaacacatctgtgctcctcttgtctattttttctcttcatgttttaacaaaaaagaaaaaaagaaaaaaaatcccatcccttttgtacatactcctgtaaattgttttaaatacttgagccttttcttggagggggagggaaggggtgagaagatggagaaaagccttacgtttccgtttcttcatcggctgattggatgcttacagggttctcttgtgacatgtataagtgctgcttacatcactcaacagcaacagaacgtggtagtggagtagctgttgcccttctccggctgtgtgtacagtatgtgtggaataaaaaagggaaactgttttcacaagctgttgtttgtttcataattggatcagtccatagctacccacattgcactgagcttgccagtggtgactgccaggaacgcctaggatccactttggtggctgttgttgcagaagactaaactgctttggactatttaacgattgcctgacagtcgagtgtttccaatgtggtcgtccagtttctatggccttgctgtggactttcccctctttgtcggtaacctttcgcctatggcttacagttcgacatttaatttattagcgctgctctgcacccctcctgccgggaggctctgtgtggttattgccagttctttgtttacttttcaggtttgtactacaaggtttaataataaaaagttttttggacattttgtctgtcttgtgggaagggattgggctttctttggtcagtggggcaggggctacacatcctctcttaggccagggagcggagctacagaggcatgtccgtggcactgctcaccactctgggctgcaactaggctagctcatgccctggggaccttggggaagcaagtttctttcccaggttgtcacctgatgctaggtaaaattaagttcttcagatcccaatttgaccactattggttatgctaacagactctgcctcccagtatggtagggcacggtgcccacatagcctggcctaggtcctatttccttcaaggccctctccagcagacctccacacctgtgtttctttaggaactcttggtcaatcagctctaagcacctgtcaaggcaggggcctctatacgacccatatactcaccagc

SEQ ID NO: 21921 - DNA, 1099 bp, Mus musculus
agcccgagctgggaaccattccgggactggtaccctgcacacagccgcctcttcgatcaagctttcggggtgccccggttgcccgatgagtggtcgcagtggttcagcgccgctgggtggcccggatacgtgcgcccgctgcccgccgcgaccgccgagggccccgcggcggtgaccctggccgcaccagccttcagccgagcgctcaaccgacagctcagcagcggggtctcggagatccgacagacggctgatcgctggcgcgtgtccctggacgtcaaccacttcgctccggaggagctcacagtgaagaccaaggaaggcgtggtggagatcactggcaagcacgaagaaaggcaggacgaacatggctacatctctcggtgcttcacccggaaatacacgctccctccaggtgtggaccccaccctagtgtcctcttccctatcccctgagggcacacttaccgtggaggctccgttgcccaaagcagtcacgcagtcagcggagatcaccattccgatcactttcgaggcccgcgcccaaattgggggcccagaagctgggaagtccgaacagtctggagccaagtagaagccatcagcctgctgcctatctcccatagccattgctggccacccctctctgtcaatctgtgcgctcttttgatacatacatttacctgctgtttttctcaaataaaagttgcaagctactgctcaaaaaaaaaaaaaaaaaaaagaaaagaaaaaaaaaaaagaaaacgcctctatcagttgaccttcaggccatgtctgttgggggttttcttggttgctggaggatgggggatgagggggtacactgaggacagtgctgtccctgggcaggtgggcctgggctatgtaagacatgagcctggagcataccaataagaggttttcctctacagttcctgcctctatccctgcttgaatttctgccctgactcctttcaatgtaaagtataagctaaactatacatttgcttattacagccattgaactcaagctagcacactcaggaaggcaaacctgatggggctggttatgaaagatgatgcattaggaacactgtgtc

SEQ ID NO: 21922 - DNA, 1170 bp, Mus musculus
atgcacacgcacacacgcacgcacacacagtttgacagaaaatagttttcttcagtggatgtcttttcctaacattcgttgttaatctgtataaagtataaatattcaagcctgttccagagcacttgaaagcttagaactggatcacagtggcgtcgtatctagaaaactgactgtcggggcaccaaggctgaactcccaggtcccacaaatgtcctaaccagtggtggcttcttttgcagtcctgtccggtctgcagatcccgtgtggagcatgtccagcacgtctacctgcccacccacaccagtctcctcaatctgactgtcatctgatgcgtcctgcactcgatggacaagccatgtccccacaagctgcagtattgtaaactataagaataataactttgtgaagagctatttcactctcaacacccatctgccatgagacattttcagaaacaaggaggaaaagaaaacaagaatgtgaccacacctcttccgtgaggagaagcaacaggccccatggccaccaggaagaactctgggacacggacacattccttgaactttagggttggtttttttttttaatgatcaagtaaaggagtagatagaatcgtcttcgtcagtcaagtggcaacatggcccaaccgtgggcaccttttaggaaatgacgtcatatgtctccttcactttttccccgggcagcagattttgtaagtgttttaaggatttccttggttctttttgtatggtcatggagcgctgaatatttttaatagggattttttttcttaaagaaatagtcctcattataaaagtcatttctgtctttataactcattcaagaacaactggaaaagctggcagattgaaaaaaaaaaagcaatcctgtgacttcccaagggttgacagcaatgttgtcagattggaagcagtctggctgagagccaataggtaactcaccgtgggtgacttccttcctagagcccttccgtttcccctcattccacaccccatgcctttcactgataaaaatgctaccagtttggttaagagacatacatggtagagtcaagcactccctgggctttggagattggaaagcgagagtagcttccttgaaggaaaaagatgagagagagagagagagagagagagagagagagag

SEQ ID NO: 21923 - DNA, 1179 bp, Mus musculus
ctcagaaaacacacacacacacacacacacacacacacaaacacacactctgctctctggctaactccgaggagtgaactgactgcatccactaagctgacactaaaacaggtaaaaacacacatggctcagagcaataggaatatcataacttgtggttctatttcaggtataggaattatacaaatcattgattcttccgaagcatccgtcccatctcattctctggctcccttagcatgtgcaatactttgtgtgccaatagtgtgctatctagttaaagttcattcccttttggccttttccttgttcggtgggctgacctttcttcccctcgctggccagagaaaggctggaggagtgagccaggagaggcgagccccttccatttctccttaacaccgatggatgcagagtgctagggtaggcagcctatgggagcctgtgtgtgtctgtcaccaggacacagtgagagccagccaaggagacctgagggaagcactttgaaggtccgtcaccacactctgcaaaggcccctcgctctgtagtgaagctggaatggagccaggaggcggagtggctcctaggacgaactctggagcggaatggtcttcagtcaactcattttcagtctcttctgtgtccttgagactttgatccctgcctttgacacaagcaacttattgcatatgtgtgtgttctgagcatgcccaccagtggctttggagggcaacctggcaaccacagtcaccattcccttgggacagctttctcttcaaacaggaagaacacacagaggcaggagccacctcttatttgcagacattggtggggtcctccaggctcccggagcacctttggtcaactgtgtagggagcacggtaatagcagtgccctcatcggacaaggatcagccacgcgcctctgtacctgtcctctttgcaatatttaccaacagccgacttttccttcttctctttcctgctttccattttaaaacaaagtaacagcaggccttttttgtgtttacaacggaacacaatcaccaagaaattagtcagggcaaaaagaaaacatagtaatattactcataagaaatcagcaaacaagaacctctttctagggatttctaaatacacaacaacgtgactgttccttagactgtttaactttagaatt

SEQ ID NO: 21924 - DNA, 1198 bp, Mus musculus
gtgtgtgtgtgtgtgtgtgttgcctgcacttgtaaagtaatggggtctacttatattcaataagaaaattgctagtgtgctaactatatatctctctttataaaaataactaaagtagcctttgatctgcctgaacttggtcctctaggctcctattcagttttccatctttagttttttactttgagctgggaaagagcccctgccaaaagacagccaggttctctctgagcccagcccagccagccatctgtaaagaagaaagaagcttgtttgtcttaaaaggcagcccaagagaccgttacaatagcgattgtcagagcagaaacacttggcattggttgaaagtgtttgaaacaagatttgcctaaaaaagatcttcggtgcttgcttgcaacttctttatgttgtgtatctgtttgtatgtgcatgagtattcaatgtgcctgttggtgtgtgtgagagtgtgggcaagtgtggagcttcctgaagccagcctacagtctgagtcttcacctcccacattgtttgagactgggtctatcttgtttgctactgtgtataccaggctagccagccaacgggcttctgagaatcctccagcctctgcctcccatctcagtgtgggagtgcagggactgcagatgcacactaccatgggagtacaagcagatgtacatgactctgggctcgcagggactgcagttgctcactgctgcatctggctcatgtgtaaggtatgacttcagatcgccttacttctgctgacattgccttatccatccactgaactgtctcattagtctaagaatttcacattgatagagatgtgtgcattatctctagatcaaagaccttaaactcgagacccgagaacgtaaaaaagaatgggactgagaaccgtgactgtggttgcctctgcggctctgggccctgggcatctctcttctaagttatgctatgttttaactccatggcttttatgcattggctttaccttcaccatgcctggctggcacatttggtgactctcttcagtgaaggaagcgccgtcttctctactgttgaagcaagtggcaggagtcaaatgcacgtgagatggttgttagaatttagggccaaggagtgtagctggaggaacaggtcttcttgggcatctagccactgacaaaaggtaaaagaaaaaaagatcgcattc

SEQ ID NO: 21925 - DNA, 1113 bp, Mus musculus
tatggaaaaggtaagcaaagagatgttcttttcttctgacaaaatagagagtactgttacactgtttcctcattggtgtttttagatgttcctaactgccatgcatatcaaagttctagtcttgtatgtagctttctttagaacaggtagttcaactatattgtttgaaaatgtcaggacaagctacctagtcacccatgactgacacagcctgacttgctacttctgcttgtttcctttaggtccaccatacgagctttgatcaagaatttttctattgcttcttttttccctgctttcatcacactgctgttttttcagcataatcgaacagcctatgacattgtagcaggaaccattgtggtaaagagaaatggggtcagatgatgtccagaaccctgaatcccactctaaggaataacgacaagactaaattatgtatcaaggccatcattatctatgggttacattgatgatttaaaaattaaagcagtcattccggtgtgatcaggggtctgttctcaaagtgttgactgtacttgaatgtcaaggaacttcttcagaaggaaaaactattaaatttaagtgttaaaatatttataggacaacaaagcaaatttcataatcgatataagcaaatacatactttaacatttaagataaccaaaatttgctggaagcattttcagctttaaattctctaaatcaagttttactttaaagttttattttggcttatcctagagtgactgagaaatatccaattgtgttttataaacacctacagaactcccacagctcttcttatggaagctgctttttgtgagcattgagaaatcatcaactcaacaacccacttactccatggcaggtgttgggagaaaagggctagtgaggaaggcctgagagtcccctcaccccacacttgcagggtagtctagagcttgctgcagtagtggtgggatgtttcagcttcttactgcttatgtatttggaggcaagattttcatgatgatgaaaatgtactgagcatatcattgatatttttaaaaggtaagttagttgccttctgtagggactgggggtgggagtggggattggagtggggatttc

SEQ ID NO: 21926 - DNA, 1858 bp, Mus musculus
agattctatttatgtacagtaaattcctaaggcactgtgtattctatacaattccaaaactgtcaagacatcaaggtgttaagagtgtattttgtgaataacttgtactagcagcctgtgaaatattagcagttttcctattatgaattgttctctctaaagcaaggcagcatataatcttcggactttattctagtttaagctcattttggcctgttagagatgaaatttggaggggggtggggatgtgtcattgtactttgctctgttggtgaaacattggatttatgtctgtgtgcttttgttgtgtcagttagctagctgtaccaaaatgttagtttaaaactttacttcttactcattcttgtgtaggattttcctgagaaacactaaatcatattgcacaagagagcaatcttgacatttaaaactgtgaaatgcatttaatatctacagatactttaagaatctcctaagagctcattgttcatcaaccatggtttctcagaataattttatttaaattaaatacaacttcacaggaagtcttatttgtcaaaagcagtacatagagcatgtgcttgtggctctggcaagattttaaagctcttcaaacactacaaattgggaagcttggtgtggacaatcgccattgatgagagaattcaagttgaaatgtgcttcacccacacagctctggagtatttaattattgtttctactgcgagtattgaggtcttcactgaggatatttttatttatacggtaaataagtagttaaaatttgttatagtttaaataccagttaactcgacaagttctttagatctagctgtgaattcaagttgtgccatataggatgtaagataaaagtattgctttgcctccacaatagaacctcagttataaggagaaaagggaatctggcacatttttccatgccgaagctgtatcctgaaggggcaaaatgaagatctttaatgagcatgccctaagcctggagtcttgttgctgcattgccattcaggctaaacaactggcaagtgatagtctctcagtactcatcactagggatgttctacactctaggtaacagcatgacgacaaaccttactgagtattcgtgactataaacacatgccacttttgacagtgttcattgcttgactctgcctacaaagcatttacctaattgcccaagcctcaaaattgagtcttcaaagtatctttaaaagcattttaactttaaatgaaacaatcacacccgtttctggccaagggaagtagttctgaaggaagatggggcattaagctttctcatctctgaggacggttcctagatcaacagtattcctaaacaagtactggttcagctccttgccaccaccatccacataaccaaagaccaaagtccttactcgtgcctgggtgaagttcctcattttggctggtatgtgtagatttccttgtagttcactatagtagggcttaccctgaaaacagcactctatttttaatatttgtatgtcaccagtttgtattttgtgtctcaataaatacgtcaatgtcaacagtgttgtctgtgcctatttctacagctacagcagtgtattaaaccatgttctttaacagggctggagttcagtgataagaataccttgcctagcacatgtaaaaccctgcatatccaaatacctaagtaaaagttacctgcacatgagctcagcttcatgttaaaccagtccacagtggactgcctttcctcaagggcagttatctgactgtggtaatgttaactgtgtaaagccagaactcaggaggctgacataggaatattgctgcaaatttaatgccagcc

SEQ ID NO: 21927 - DNA, 2111 bp, Mus musculus
gagctttgggagggaagattttctgttggtcatgtattctgctgtgggatcactgaatggaaaggtatgccctcactttttagaagttatttattacaaacttttcttgctggtatataccacatgctgtcactgctggatgacaatttgcttatttggatactatgtattttccttttttgtgaattatttttaagtattttgttccttagttttgtttcatcattggtttgtaaggtttatcttctattcttgtgtttgtatttagccatgtgtactccaaaatttctcctgttttgtggcagccctggctagcctgaaatggtctgtagacctagactggccaggaactctttagtctctgcatcctgagtgttgggactagaggtgtgctccaccatgcctggccaaggtcttctacccacgtttaatatttccaggtcagagtgaatcctaaacaacattttgtgtcaccaatgggatattttctgcttaatttgtataggttcggttttccaatttggtagcagcactacgaatttcaacttcacaaacaataatccatcaggagtgttcacatttggtgcaagtcccagcacgcctgcagcctcagcccagccctcaggttcaggggtcttttcattcagccagtctccagcatcatttacagtggggtaagattatttcattgagaatttacattggtaaagaggtgtatctgtctgtttctaaaattaaatcaggatgcagtaatatagtttggataatagtgatacccagtatcagtttataacattgtaaatagggggattatgttataatctgaaacaaaagcagcaagttatagtaacattttcctcactgtcctctccactttgttgtaggtcattttaaatggtatgagtcctctgtcttgggcattgtgtcacattgtaatgtttttattttttcacaggtcaaatgggaaaaatatgttctcttcttccggaacttcagtttctggtcgcaagataaagactgctgttagacgcaagaaataaaagtcacaaaggtgttatacccaacagttttatcaacagctggtgccctgctttcagatactggattgtactacatgctgggcttatctgaagtcagatctgcctaaggacttctttaattttggaattgtcctcttttttttctttatggaagtcctgtccccataacccattctctttttgaaaataatagctagactggtgactgactgattcttcagcagaaacattttatgatccagcacattattcactgattggcatagtctggctgtacccaggaatagagcctgcacggtgaatggctttgtatagaacctgtctgcaccgctatgtgcattgataaagcgttaatggagcgtgttgaaattgtaattatatctggggaattctgtatagattagaatcctgtatagattagaggacgttgaaatgaatgatttctatgcggagtttgtggtggtgtatgtgtgaagtgagtaagtgggacgtattgtgcacagaaaaattctgatagagaaaacctgattaaagaacggtccatcctaaggacttgttagatctagttcattctccacttaataagtatatgctatttctatattttcattctatcaactgtcttgcctttttcattattttattatgagacttctgtaaatacaattttgtttctgtacctttttggcataacataaatctgtgaacttgaaattttaattttatgttagacatatttttgttgtttgtttagtcttgtctcagattttattatgtaaatcccattattcaaagttgcctaaatccatttggaaatctttaaaaaaaattggggattcttaaagttgaatttattggcttttctgatccagttttgtttggaccaaaaaccagtattgtacaaagtattaagcatatatttttatatttactgaaatggactgtggtgactttggataataaggaaaaagtttaatattaaagccatgtttattacagtataattaacatgttaaaccatgggataaatgccatcaataaaactttatgaagcaaatttgttaacagttt

SEQ ID NO: 21928 - DNA, 1178 bp, Mus musculus
atgagctgtaacttgcaggggttaaatttgtaacaaggataagcacattaatttgatatcattttgtgtgttgtctgtttttgaaggcttcgggacatcttcatctttaaatccagcaccctcagccttcaaatttggtattccatcgtcctcttctgggctttctcaaactttgacaagcactggaaattttaaatttggagatcagggaggattcaaattaggcacttcatctgactctgggtctacaaacaccatgaatacaaactttaaattttctaaaccaactggagactttaaatttggagtgttatctgattctaaacctgaagaagttaaaaacgacaacaagaatgataattttcagtttggatcttcttctggcttaaccaacccagcttcttcagctccgtttcagtttggggtatctactcttgggcaacaagaaaagaaagaggagctgcctaaatcttcacctgcaggctttagctttggtgcaggtgttaataacccccctaatgctgctattgacaccacagcgacctcagagaacaagagcggcttcaactttggaaccctagacacaaagagtgtctcagtgactcctttcacatacaagacaacagaagcaaagaaagaagacgcacctgctaccaagggtgggttcacatttggtaaagtgggctcctcttctttgccatcttcctcaatgtttgttttgggaaggacagaggagaaacagcaagaacctgttacttctacttctctggtgtttgggaagaaagccgacagtgaggagccaaagtgtcagccagtattttcctttgggaattcagagcaaaccaaagatgagagctccaagccgacattcagcttcagtgtggcaaaaccatctgggaaggagtctgagcagctagccaaggctacttttgcatttggaaatcaaaccaatacaacaactggtaaatagtaaaagactttttttctcaagttgtatttgataccttgacaaatgcaggaagtcaaggagttgctgcctgaaaataatggagagtatttgtttcaaagtttttaagagctcactcaggcttttctgttttaactgaaagaaattcccatgattctgatgaaatatctacagacccaattttgagaaatgcagctgtaacagaaagtac

SEQ ID NO: 21929 - DNA, 1199 bp, Mus musculus
ccaaggctagaattgtagatggactgtgtccacccagcgtttatctgagttctcagggatctgggatgtgctcctcttttgttttttgttttggtttttcgagacagggtttctctgtgtagccctggctatcctggaactcactctgcagaccaggctgacctcaaatttagaaatccgcctgcctctgcctccaaaatgctgggattaaatgctggtgtgagcccccacgccaggcttgaatgtgctcctcttgtttgttaatgcaagcacttgaacgaccaagccatctcggccacaagcaacacacacacaattgggaatagttcatacttaagaataagctcaccattgagaaaagttagagtgagatgtttatttgcaatgataaattaaatctgagaagtcctatttataacactgtaaggcttattttctggttcactctggttctcgctctctcttcgtgtgtgtgtgtgtgtgtgtgtgtgtgtgtgtgtagaaagggttaatgaaatttgaaaatgttcagttggtggtgtcattaagatggtaataaatttaaaacttgcctccatttcccaattcttttaggtttggtatctgcctcaagcagcagccctgcccctgtctctctgtcttctggaggctgtttaggattggacaagtttaaaaagcccgagggaagctgggactgtgaagtgtgcctagtgcaaaataaagcagactctgccaagtgcatagcttgtgaaagtgcaaagccaggcacaaagtctgagtttaaaggtgaggctatggtaaagaacccctttagttcctagctaaagtaaaatgtgtgtgggcgggcaggtttggtttttaaggtacccattctctggataattatataaaatgaaacccagtccttggttttttgtttttgtgggtttttttttttttttttaaatttgtgaatgatggtaaaaatcaaattaggcattcctcaggatgccatctatgtatctggataaggaacttctttgtgttactcagtttccaggtttaagtatgaacttgactcttacttgactgagaacttacactcttagggccttattgtaaaagccatctagcttctgagtgtggctgagcaaaagagagcacttagcaagcacggctgagtaagcttttatgctatccattttactatatgaatataa

SEQ ID NO: 21930 - DNA, 1112 bp, Mus musculus
agaggcgctgggaactgaacccaccactagtcatctgtctagtccttgtaaaaaaaaaaatcattttaattcttgattagaaaaatataaaaagtggtttgagaagatggagaaaaataaattttaaccatgttcaaaattcatcttacctaaagttgttcagttgtcttgaatattgtatagtttcatgttatgttggtataaatgttcttgtgtgtgaaaagccatggacatgagctatagaggcctggtttaacatgacatggctaaaatgtcagtttgtctgcaaaatactttagaattttatatatatttgcatattaatagatttaatgtctttggtttgtcagcttttttctgtttatttgcatctatctatttctcaaggaagtggtctctaggtcacattaactattttgaaaatgtttgttttgatttctgttttcttttaaggtggactctcagtatccccctgttcagagactaatgaccccaaagccagtttccatagcaacaaatagaactgtctattttaaaccatctctgaccccatctggtgacttaaggaagactaatcaaaggatagataaaaagaacagtgtgagtttgtttgtttattctgttttcttaagacagtgtcatgtatctggtctggaaatcagtagataacagggttaacctcacattcatgtcagttacattgcttctatctttcaagtgctgggttatataggtgcgcatcaagcaccacatctgtctgagaatatttatttttaatcagtctattttttcttctttaaccaatctttgaatattgcctggagtgaataaaaaaaaagcaaagtagaggacctggtgtcatctggcaactgtatggtgtatgatgcctgtaaactagtaaagagaattggtatcccttcaaaaatagcctttagcttgatcaaaccctaaattggtgtgtgtaaatttcatatattcattgtctagataagtttttacttatctgtgagttttatttgtgtgactgatttctaaaaggtttcagatgtcatctcctttgatgatatttaactgtattaactcaacttaaaaagacaaaacttacacatttt

SEQ ID NO: 21931 - DNA, 1403 bp, Mus musculus
ttgttacaaagtgacccagttgactgctttgacaggagcagatgagaagcatatcttatgttctgtaagaatgaggctctgaatccctctctatagaaaaggttacaggcactgttctttataaccaaagaacttccaggagactgaacgtctttgctgtccactcttgttttgtgtgagtatataatctcactccaatctggtgccatacttcccttggctaccaagccacgtgctgcccttggtccctgtcccctttcctaagcacactgagaaatcgcacagctgtaaccttcagtcttccacatagcctggtacctactgactcgatattgaccactgacatggttgagtggctgggactcctactccaccctagcagttctcacatcctgtccacctatccaagcaggtggagtgcacagggaagtgttactgcacacaacgcagcgatgtaccaagagttggggtacagccttgctggcggcttctttatcagtctatttcaggtcgctagattctcttgtggtgtgggtttgctgtttttgcctgactctggaaaaatgctgaagagaaggactaagctatcaagttcgtaggtttgcacgtcaccttgtctgagggggattaaacatcagactgctccattgtcattttttttcccccgttttggttttcaaagtatcctgcaaggagagacactgtaggatcgtggtgtggaaaattttacagatatattttatgtccttactctgtagatgcctgtacagtggacctctatgtacagctacacgtgtgttgtgaggaagtgagagagcatgtgtgcagtctgctgtacttttctggtttttaagttcttagcattggtgagggagatatgggagactctcttgacaagctgctgtttgtgtgtatagtgagctgaccggtagtattttactaccatctgtttaaaacaaaagctgtaatttatattccctatcaactttattgtatttaattggtacagatctgtgtgtgttttagaatacaaactgtctaattcagagtccaaagtgttgatcgtctgttctttgttgttgttgttgttgtttttttttttcgagacagggtttctctgtacagtcctggctatcctggaactcactttgtagaccaggttggcctcgaactcagaaatccacctgcctctgcctcccgagtactgggactaaaggtgtgcgccaccacacccagcttgatcatctgttcttaataatgctaccatggggtgggatcagaactcagtggctaaaatgacgacctgggtttgaatcacaggacccatatttcttaaaggaaaaggaaaaggaaaagaaagagagaaagcaagccagccagtctagtatagtggtacatgcaga

SEQ ID NO: 21932 - DNA, 1099 bp, Mus musculus
cccaggaagcaatggcagcagcatgccagtagaacacagtagcaaacccgagaagaagattgtaagttctgcaatgtttctatcatatcacctggtggtgggtctgaagccctttcccaatccgccatccaaatgctttcaaagaaattaagacaggtgctgagtcctgactttacaaatgaagtgttgctcttggtaatgccgtttttgcatgagtgcaaccttgaactgtgattttttccccctctctctctctaagtgtgctattttatttaactcctttccacatcatcttaagtttcgtagctagtggggggaagcacctttgatggctctggtcattataaagaaaagtgtaacagcaagatcagtttaaataataccaaaatctctctaatgtgtctacgcacattgcccagattctgaagttaatctacctagaggaattgcatttacttggcgtaagtaatcccgcacttagttgtgggtgtgtttgaaagctttcttgtgtggctgctaccaagatacctgtgtagtttgtagctgctctgcccagtcatccttcctcagctcgatccccccagcaccagcagcttctgtttacctacctgacaaaacattccaacctggttcttcttggcctggcttttagattggtgaatctgtgttactcagcacaagtaaggtagacctctgcctgcaaaaccttggtctccagcatggttccaaagctgcacgttctaagtgctgggaggggcggctcacacctgagatcacacgttcaaggccggcctggtctgtagagtgagcagtctccaaataaatgaataaagtgaaacaaaacctatgaaatgccagtttttcaaacaccatggttcctggttacttttcgttataagatacacctcaatttaaaaccaatttttttttctaaacctgtaggtgtggaagtctgggaagaatcatgtgatgtgatttcatggttttcactctcctgtgccttcctaggcttgagcagggggtggggggaaacccagcctgggcaagaggaagctgtttgatgtttgctgctgcctatgacccgctgtcttaagcagtg

SEQ ID NO: 21933 - DNA, 1164 bp, Mus musculus
gtgtaggtcagtgtaggtcacttgcctatcgtccgcatgcccagccaccatcttcaggactacagaggaagaaaagaagagatacctgcacgcttgtgtgcgcaaacacatgcataccattttgtcttcttgggtgtcttgttttgttttgaaatagggtcccattatctagccttggatagtctcaaactcacagagatcaccagactttaccacctaagtactgggactagaggtatgcaccactatgcctagctaattgaaaaaaaaaatttttttaaggcactctaccaattaactgatttatcaaggaagaccttataatacagcttaaacgtatatagaagtaactgataataaaaatatatataaccaacagttgcggaatataaatattggtacttaaatggaaatcattagctctaaaatgcctacttcactacatcccagtgagaattctagacagtacaagaaatgaaagaacaagaatattattaagaaacctaagagcactgcactaaatctttcccaggcctgctgcttggtgccggtctggggacagacagtgctatactagagcagaggaaatccagacaggtcgtttccatctgcctggggcctgtctctacaactctgccacactccctgagaatggagacagttttgaagatgctgaagctaggggtgggaacttagaacagaagatatgtctggaccagcaactccaatgctaactccacttcccacaggagtgtgggattatagtgtagcttcagaggtcgaataacgcagatgatcagtccagcggggaatgtttttcttggtgttctggactctgctccagaagacgactatgtctctgcattatatatgtcttcattaaagatttaaaaagaaagaaagaaagaaagaaacataagtgcaggagagatggctccgtagttaagagcactggctgctcttccagaggaactgggatcaattcccagcaaccacatggtggctcacaactgtctataactccagtttcaggggatctggcaccttctcagagatatacatgcaccagtgtgcataaaataaaaataaataaatcattaaaaaaaataacagtgtaaggggcttgtgagatggctcagcagaaaaaagcacaggctggctaac

SEQ ID NO: 21934 - DNA, 1185 bp, Mus musculus
ttggcctcaagccagtgcattcactgtgtgaccagatgaactttgaaatggaaaaaggaccctcctgcctcaacccctcacatactgggatttttagatgtgagccgccatgcccagctttttttaagttcaggggttttgtttttttttgtttttttttttctgttttgttgaaaatatctattctatttgaataatttataatacttttccagttggcagaatatgaagtgttcatcttagatttgtcacacagtttaacccagcttgcctttccttttctaccagagtttcacccagagtttgaagagacgaatatcactgatcaatatatgttactcctgcggcgtgacctatgagatagtatccaatatcccaaaggtaacacctgctgctgtttcagatgccactgtgcgagtgtaaggggagcggtagctctcaacgctttgagagcacgtggagacacttccggaaacaccattcacagaaaaacagtcgcctcctttctgtgccttaggcgaccgaggagattgaggaccgggaaaccctggccctcctggcagcgcggagtgagaacgagggcactttggatggggagacatacatcgagaagtacacgcggggcgtgctgcaggtggagaatatcctgagcctggagcggctccggcaggtgcgtagctgactgtctagccctgaggatgccattgccagctttccccagctatgggcagagatgaagcagacacctctcagagttgctcagagaaggagtgcgtgggtagccatttcctcagtgaaaggactctgacaagtatgtgtgtgtgtgtggtacatgtgggtgtttgtgtgttatgtgttgtatgtatataatctgtgttgtacatgtgtggtgtttgtgtatgtggtgtggtgtatgttgtacatgtgtactgaatgtacgtgtatgtttgtgtatgtgtatgtgctatgagtgtctgtgtgcatgtgtgtctgtgtgtgtggtacctatgtgtgttttgtgtgtgatgtatatatgttgtacatgtgtctgtttgtgtgtaatgtgatgtatgtgtatagtgtatgttgtacatgtgtgttgtttgtaatatgtggggtgtggtgtacatgtgtgttgagtttatgtgtatgttatgtgtattgtatgtgtgagagctttgaggt

SEQ ID NO: 21935 - DNA, 1123 bp, Mus musculus
cagttcccatgtgtcgcgttgatgagccaggaagagtttgttcagtgctggaatgttggacagcaagtctaacaatagacccgtgggcacagatgcggggcggcgaaggacagtgctccttatcttaaaaataatttgaacaccttctgtaactgctcagatgtggctaagatggactccgttggaccctagcattgctgaatggcttgtgtgtccggccagcagtgttttggtctggctggctctgggtgtttaattacatttgctgcctgaaccatgtttgcaggactgctgacccgtgtgcaaggcattcaggcgcaccgtgacgtgtttatgcaatatttaggcagctttcaaaatagggatctgacgccgctgccgatgctgccaagtgtgaactttaaattttaaacactgtgtgctccacatccccatgttggggacagaggagttgtatgcgtgtataactatctgcatgtgtatgcgtgagcccagactgcagcaggcctcagtatcatagcaccgaggactggttaaagtccgtggctgtgcctcaccccgagaatgtcctgtccagtaggtccacagtgggcagatgtgtctgtcgttggcagaagttggcagttgatgctgatccagttccgtctggagaccgcaccggggatgaaagagatctaggaggagtcaacattcaccggtgtatcaccaatggttgttcatctccaggcaggaggattaggaaggcttctcattttgcctttgaacttttctgttgtttccagtgacagggtgtggctgttatcatcaggagtggtattggagttattttaaggctatttcttgacattttgtgggcccatacaatgtttattgtcttctactgtctggtcttaaatgttttggagtaaaatcaaagactccatggtgcagtggattgtccctagtctttctatagaatagccatataggaaggcctggtttgaagctggagtgatggcctcctggttaagagaatttactgtcattgttaatgacactggtttggttctctgcaccacatgttcgctcacagccacctgagaccccagttccaggggatctagtacacactcttctgacctct

SEQ ID NO: 21936 - DNA, 1108 bp, Mus musculus
tcagtaaataggccaggctggccttaacctcagagatcatctgcctctgtctcccaagtgctaggattaaagatgtgtgtcactatgcccacttcctttgattgaaaattgtgacacattcattttctactctcctggaggctgaagggaccattactctaggtcagcctggacggtggtctgcagtcggattcccctgatgtctctgaagtttactgtatcgactagaagaatattgagttccttggattctctgggtcctctggccactccagagcacagatgactataggattttactggcttaaaacattggccaataggatgtggtagtggctgtggtcccagctactcaggaggccgagacaggaggattgctggagcctagaagttggaggccagcctaggttaaaaaacaaacaaaacaacaacaacaacaacaagacaattgaccacggagttgcctttatattatgatctatgttgaattttattttacagttctacatttccttatttattgtttgtgtgtttgtgtccatgcacatagaggacaatatgagggacccagttctcgctttctatttgagggactgaaccatggtcatcagccctggtagttcctctccacactgagccgtatccgcagcccagcactggattttctacacagcaagctgtctttctctgtgtaatttgacatactgagcaaatccgtcatttgcaaagttaccttgagcagaattttttaaaaaaatttaaattattgtaagctaccctggacaggttgagcctcccttgttgaaaatgcttgggactagtatttcagcccttgactttgtcaagctgcagagtatttatgcacacgtgacaaggcatcatgggaggaaggccctgctctaaacactaaatccatttgtttcatctgcactttatacacgtagcctgcaggtaacgatgcaatattttcagtgaacatgtgagctgcccatgacttgtctcatgtggaatttcctatgtgggacatagccactctcaagaagctttatgatttggaatctgtggggttttagattttcagattagagttactgaatctacatccgaa

SEQ ID NO: 21937 - DNA, 2232 bp, Mus musculus
taaatatgcttttatgtttttaggtatatgaaaattatcctgcttatgatttgactgagaggaaagatttcattaaaacaactgtaaaagaggtaaatatttctttcctatatgatcacttggcatagaaactaaaggtttatcaaatattacattttcttgagtattcatatctgtgaaaaatcacatttgacatctcagagttaatatggatgaggaaatacagttaagtttgaacatagagtaagataggttcatagtacacatggtagctttgtatctttgaggtactcactagcttcaaaccaaggcacaaggtctgtttcatattgatacttcctgatttctggttgactttaatatgttgcaaataagattttatgatatatgcatatttggtgttgtttgtggtaaagcagttttctttttcattgcagctaatttcttgagaagcggacagatggcttgttctcagatttgaagatctgattttataccagcaaagagaatgtattcttttttaaggctattgttggtagaacttgctgctgactcttttgcgtgttaacatatttgagcttgttttaaattgtattttcttgtagttttcagtttaaatcttgcatggcagtaatcgttccttgctttttatagttgtacattttgggtttctttattgtaaggtcacagattcctgaactattgtgaattttagtgaacttaatgttagcttgcttaagacattacttttaatcaaagcaaaaactattataaccagcatttatatgtgcaaagactattgcagtatttagtatacaaaatattttgaatacgccttctgtcagtgtgaaaacatagcggcagtctgttcatcatagggcacagctgttcagatgaccgagtcggaaccttttctgcatgtgtatatacgtcaagttgttggcatgacagaagtgacagatgttatttttgtatttttaaaaaccaatttgttgtatataatttttttatttcttttgtgcaaatcaattttttaaactcttgtgtctttaaacttgtaactaaatgtcagtgttcatccaggcagcagtgacagcgcagagttcagtggtgatggcactgaggactgtccagttctgctttgccctcaaagtgtcatcaatgtggttgtgttaactctaagtgtcatagaaattttataatgaggataaacacatcacagcttcaaaaactgggaaggcgtgagcacacatggatttatatataagtgaactgacagtagtaaactgttgaccatataaatatattagatacaggaaacctggttaccttcataattatgattaaaagcatcaagtgtaaccagagttggtgtggacaacataggtatctctgaaagtatttatcaaaaaccatacattaatattgaagtattacagaatcaaggctgtttgatttttaaagtgatgaaacatggactgccccttaaattttgactgtcctaaaaacctatttctgatttataatatgctgcctgataaagtgacactagatgtaccagctgagtgtttaatcttcccatcacagatcagatttgagcattaacaggtattttcacatacttgacttcaatatgcttaaagtgaggaacaagcaattaagtggggactaaaaatgttggcctttaagcaatttgtcataaatcttcacaataaagaataaatcaatgttttaagtgtcttgtatttaatctttgtctgcttaagtgttatttctctcctactctatcctatgacaataactgaccattttgacacagaactagttttgtatgctgaccacttactattaaggaaatagggtagcaaatgcttatgaccaagaagcttaaaggactggaaaggaggttgacacagtgatgctatgaccatttattacgggtatttgcaaaagtctacttattaagcagttttacataaccaattattcatgatatgtagttattaaatcaaagtatacttgtgctcattaacaaaagtctcagagattggagaacataactcaaagtaccatagttcctttagaacaaatatgaaactaagtatgtcactcagtgggagaaaattactcacttatacttgaaatagcacacaaagctcaagtgcctagaaactaactgacttagaagggccatttaacattgtgcacttaccgtttcacacatgctaaaca

SEQ ID NO: 21938 - DNA, 1208 bp, Mus musculus
atttatgtcgctggtggtgtgagcacttaacgtggtgggtccctgtcacggtgcagcgtaccggcgacgggaagcctcgcaagtaggtctcatttggaagccttcatctcgaacgacccctcggaaacaaacgtggtggctccgaatcaaccccgtccgcggggtgatcgccgcgtgaagtcgagtcgagaaagacttcggcggatccctcaacttcgtcacctccagacgctccccggctccgcggcccaggacggccggtcatttttctcccgggatcgggaggctggaagctcgcaggccccctagcgtccaaccgttcagcgcggaggccccggctcgcgcccgcccgccaccccgtgcacccacccagccacccgccggacgccgcgacccgggtcctcccgcggaccgcagaccccccgagaccccgcccgggcagcccgcgagagacgccgccgccccgcctcccgcccgccctcccgcgcgcgccaactcccagcgccgcgcgctgattggccggcgccttcccgctctgcttcccgaaccgccattttgaaaatcttgttgattctgaggagcggggagagagagagcgcgagagagagcgagcgcgcggcgcgaggacctcggccccgcgcgacttctacacagcggcggccttctcgtgcgcacccgcggtgaggacggcggcggggaggcgccggggcagcggggaggggacgcggccagaagcactgaggcccgccgcgggggaggggactcgcaaggctcggctcgcctgggccacactggccgggcccgagccggcccggggcggcgcaggccgggcgggagcgcgcgcgggcggctgagagggcggtgcggtttcccgcctcgggcatccccggggaggcgggccgagtgacagacccagggtaggcgacttggaggggagctgacgctgggcgctcggcacgctccatgcccgcgcgagcgagagaaccgaagcgtgcggcttcctccccgcccgcaggcccccagcatgtcggcggcggcggcccccgctgcggagggagaggacgcccccgtgccgccctcatccgagaaggaacccgagatgccgggtcccagggaagagagtgaggaggaggaggaggatgacgaagacgatgatgaagaggacgaggaggaagaaaaaggtgggtgggcagggatacgcatccctc

SEQ ID NO: 21939 - DNA, 1213 bp, Mus musculus
atgtctgtatcagggagccttgttcatatgattcttaatctcagtctcttttcacttatttttggttgattgggttacaggtctatttgtcttgtttatatttttaaatgaccagttcttagatttattgatcttgtattgttgtcttcatttctacttaaccaagtgaaatttctattttgcctcttgcaggtgtttccagcagattccagccaacgcttaggcatgatggtaggactgaatgggaccagggcagagcacttttagctcagaggcctgtgtgttttgcttcagggaatctcctcagcctgcttgagttttgatttttggtttttgttgttgttttgttttgttttgtcgttgctattttgtttgttttttaaatcaaattattgattaagaattcatccacacatacaaagtggcttgatcctgtttacctccattctctcccctcaattcctccccatcctccatcccccatccccacttttccttcccaacttcatgtgctcttaaattcactgagcttacttggtgctggctgtgtgggaatggggtcacctgaatcatggtagctcctctgtaactgttcgtgcttttctatgtccgccacagctccccagtgatgacgcttacgtattattttcaatgcttaaggccataagctaggcttactccccaactagctcttcacgtgtattaaccagtttatgctcgtctatgtctaccacatggctactattctctcctcagtttcattcctctgactttctcagagtccgggtcgcaaatcatcccgccccggactctttcccagagttcttttctctctctctccctctttcctgaactcccaccttcaactttcttcctttgctattggccattcagttcttcattgacatgtgatgctttgacacagtgcctaagagattatccctacaattctcagtaatcacacaccttagaacatgcccttttccagcagccaccaataggcagtagctcttcaaaactaaatgattaaggttttctggttttttttttttaaacaaatcagcagcttgagccattctacccaattccccttaaagttttcccctttacagagaggacaaacctccaacacaatctgaaccccactgtcacattcatagttattttcatcaatgcatctttaaggcgttttgtttgtttgtttttatttatg

SEQ ID NO: 21940 - DNA, 1275 bp, Mus musculus
ttcccatgagcatgcttctgtcttgctcctggcatccgggggcttttctggctccaacaactgttgaaatgcggcccaacctgtgtgtttctctctggctgctgcctccccatgtgatacccacagttccaattcattgttacaagctcatccatcctttccctggagagagaagtcctttcagttcattgttctgtgctcagcttgagctcccaatataaaagagacataagagaatctgtttcttcttcttcttcttcttcttcttcttcttcttcttcttcttcttcttcttctttttgttctcctcctcctcctgctcctcctgctcctccttcttcttcctcttcctcttcccctcctcctccttctcctcctcttccattcctcccttcttccttctccctcctttcttttctctctgtgtatatacatgcatgcattctgtgagtgtgtatgggcacatgtgtgtgtgtgtgtgtgtgtgtgtgtgtgtgtgtgtgatgctgggaactggaatcagaacttctttcatgctaggaatctaggcaagtgctctgccactgagttatagctccagttccaggctctcgctctctctctctctctctctctctctctctctctctctctctctctctctctctctctctctctgctaaaccatcagccaaagcaagatctaaaaacaatctagacttagcatgatcgctcatttcactaacagcatatggactctgttcttggaagaattcccctgggtcatttctttcctcgaggctccatgatttcagtccatggaagtctgggagagtctagatcagcactgtacacctttggctatcaaaggtcatttgcatatatttatggtcaagggtatcggcttctactcatggtctttagtgggaattttctaacattgattatttatggtcttgttactactataatctttattattataacaaagagtcactatgtagtgtaaggctatctccaaacttgtaatcctcctgcctcagcccctccagagctggcatcagaggaatccaccaatgtcaattatacttgcatcatttgaccatgtcagtccagtctgtacttggtcagcactacagaagacagagaaatccagagatggctaaaagggacaaagagggaaaacaggattcattgagtggctctcatttcttcttgaaaagggtatgtctcttatttacttttccagaaaagaaggtggatagaattaaaacatagaatttcagagcagggttc

SEQ ID NO: 21941 - DNA, 1237 bp, Mus musculus
tttcttttttattcttattcttattcttctttttccttttgttgttctgttacataccctggctatcttggaactcaatgtgtagaccaggctggcctcaaactcagagatccacttgactgtgttactgagtgctggggttaaaggggtgagcagcccgagagctcttcccttttcctggagatgaacaacaaactgcttggagctctactggtcttctctttagaaactctgaagtccaaaagtctctcttcattttaccccagtctctttaaagctctctgtcccccagggctagaggagatggctaattaactctggttcacactaatgctaatctctgttgaaaatagtttccagccatctactattccctccacacacacacacttttgtgtgtgtgtatatatatttattttacagtatgaataaagggagaattttccaaattttttctcaacaattccatcagtttatctctgtcgtcccattttgctagatgcagcaagagcaaataagggcacactttgatcatctgtgtagaaatcttatctggctatttttaacttaacatttcttaaaatacctccatttgggggtagcaagacagcacggaaatccgaggacctgaggttcatccccagaatccacatagaagagacccaacactatcttctgacttccacatgagctgtggcatgtgtaccctcaatacactccagacctgatccataacaatgacaaacactccatcctacaaaacactagaattcagttcagccaagttccatgtcactgcatatcaaggatactgtagctgggcttttctgctttggggttctctttcctatcttttatccacaggtttcaccctaccccccccccccccaatcaggagagaaagaaggatggggtgggggtagatacagagatccttggatctaatttcttgtttctttgctaatagctgatctttgctactttgtgagttctttttccaactctttattgccaggtttcacctcctatcactagataggagagaaagaaggatggaggagagagagagagagagagagagagagagagagagagagagagagagagagagagagagagagagagactgactctaatttcttatttctttaagtacaactactataaccagtccccctggatgaccaccaaccccacctagcatttatgtatcctctgaaaatttttcagaattcca

SEQ ID NO: 21942 - DNA, 1206 bp, Mus musculus
tgctagaaatactgaaagtgctttatcaaagaaaagcaaaaataccatagaagagtttgttgagcaagcataagcatcaacagtttgttcatattcacttgaatatttgagagagagacatagtattctaattttgaattgtgtataataagcaagtgaaattgaaggtcagactagaggaaacatttttattttactcattagaaagttggacccaagtgaattttttttttaagaaaaaagtagcactctgagctactctatcaaaaccctaatgttacaaagtcacttctgacctccagcaagtgttacatagttgccagttgtcttaatttctaaatgctgttagattggttttctggtctttatctaaccttgttttcactatagattttagtttccagtgtttaccctaatcaagctctatatagcagaccaggagcagttattactaaaaatcagtttgtgaatataatattcaggagttgaaggttagtattaatttgtgaacaacattatcttttatattaatatcaggcaagcatagagaagggtagaagagtttagcattatagatactgattataaatactgagtgtggtggctcatgcatctgccaataatctcagcactggaaatctggagcaagagggctgttgttgaattttgggcctgggctgggttgatgtctcacacacaaaccaaaaaatactaagaagaatctcttgttgggttggaagaggtgaaagtgattctgtgtagatttctgtcccccttgtttcaacataacttaaaaaaataccttgtaactttttaaaataacttttttaggttttatgtaagtgtttcacacacatgtatgtctgtgtggcacagaggtcaagagggcattcagtcccctgaaactggtgtaatgaatggttgtgagcctctttggatgctgagaattgaacctggtttctctgcaagaaagtagtagtgcctgtaactgccgagccatctctccatcctgggaattgtgttacaagctcttgtcttgaattattccattggcctgaagaaacagtgttaaagcaagcatgttacactcatcaagattgaaaaatcttgtattttaggactgagtatttctcagggccagaacacttgcttagcatgtatgaagttctgggttgccttttagcaccatttatataggcacactcc

SEQ ID NO: 21943 - DNA, 1164 bp, Mus musculus
ttgttgtgttggcatatttagtatgttgtatctgtgcccttactcttgttgacatttgagaggaaaaaataaccctttcaaaacagttatttttttgacaaaactctttgtggagtttttaccaaatagatcattttagtagtaaaacttcactatgtatccttcccaagacatgtgtcccctccctcagaaatatgacctaagatagtcaccaagtgtcttaaacagttttatatttgttactactaagaaggctattaatacattttaaagtactttaaaaaaaaaacttgaagccttttgttcttcttttctttctttacagatgtggtcaggtctttgaaggaatattattttcagtgattcggcagttcagcttaccttagcagactggctggagtgggtcggattctgtacttatagaaagtagacttgctctttgtcaggcttccagacaacctctcccttggctgtcaggggagggagcagctctcaacccagagaccttatcctgcttcccccacctgctgctgagccaggtccctgctgtacagagaaacggaccacaagtggccaggatgggcagctgctaaggagcagaagtgacccttgtcctccccggactgtgcagaaaagacagcagtaccagggcacagctcctagccagccctgctccctgggggcagtgtgaccatccttcacaggcgctcagagctagagtaagccaggccagccactttctgtcaggagtgctggcattgctgcccggcttgtgcccagccccaaagctgccctttcataagcccattgcctcagcctgccttggcctgctctgttgctagtggctgttttgctgtaaggattataatttttaagttgaatttgaccctaactggcttcaaataaggacaggtggctggtcaaacttgttcctttagattaaacaggtaatcagcaattgaggccttatttaaatcgaattaatacataggagtagcagagcccatgccataatagttttcttgacaaaggtggtaactagaccaattcaaactaaagaattaactctttgattctcagaattttaggaaacaagcaagactgaattagaacaaatgaaatttccctaactcatgcatttctgaattacagtctagtgtatcc

SEQ ID NO: 21944 - DNA, 1180 bp, Mus musculus
catggtctcttagacccacatagatctctggtaccgaccccctggcagcaacagggagctgttagtcaaagtagaggccagctcagctcaggtctgctgttagaatggctcaggtatgaggattcgatcaagaagcaagagttccagtgagagatcctgggcagaatcactctgagcatcactgaacatgtgggacctcaggtactcagagaccagccaagatgcccccacagaagcaactgagaaagcctagccagcagcccatctagagcagattccaagccctggtcctggggggatgtggcgcggtgtgactaaagggcacaatgtgaggctaatagaaagcaaacaggcctccgtgctggggagagcctaggctgcgcagtattttctcaggagctctgtgttggcgggagcgcgcagagcgggctgggctgtcaatcatggcccggttgtttgtctaacctcgccaagtgtgttttttctttattagcagaacacagatagggaagcagatctgtcctcagatgcaaggctgcaggaatttgtcctagcagcagaacggggaggaaggtggggagggacccatcctctccagcaagattgttcagagctcccagccatgctggactagggcggagtctaccctggacgcttgaagcctcccccgccccccgccccgcccccgccccctcccgtcccccggggcagcaattatgaccattttgcacgtgtagtgctgaggctagtgggggtctggcccacccagaaccacactgttggagagtcagggcctggagggtcttaaccaaatttcaccgcccccccccccatcctggtgcctctgaaatgatctgagcctgtgtagtctccttgcttactgtagcagcctcctgaagcaggcctgtgccttcagattctcccttctgcagttgatttgggggtcagcaagtatttttagggaaaggatcagatgatgcgcgttggatcttgcaggtcactttgttgtactttctgaattttgtgtgtgcgtgcacgcatgttttttcagtgttggagatggaagccattggtaggcaagcattctcccactgagtcacatgctgcttaatttctttagtagtgtgaaaatatctataggtactacagaagggggaatggctaagtgtcaataaaattt

SEQ ID NO: 21945 - DNA, 1176 bp, Mus musculus
atagagagctggcagctggacctcaggccaactcaaaagatgtgagaactgttgcattgtggtgcaagattttatcccatctgccttctggtgtgtgtccttattccacccaaggcctcattccctccctggagtgtgactgggtgtacagaggggcctgccagaccttctccactgttaagtttccagcccatatcattctgttagccgctggctgcctgggccagcgagtatacagccaagggctttgggctgcagttacagcaccttggactgcaaactgtgggctgtgggctctagtctgtggtccaagtgtcctggctgtgagccaagggccatggctgaatgcttgttgtttctctctgtccccagccagccccctgcctcccccagcacacaggaagccattcagggaatgctctccatggccaatctgcaggcctctgactcttgcctgcagaccacatggggcacggggcaggccaagggtggctcactggcagcccatggtgcccggaagattggtggtggcaacaaaggcacaggcaagcgcctgctgaagaggactgccaagaacagtgtggatctggaggactacgaggagcaggatcacctggatgcctgcttcaaggactcagactatggtgagtgtggctgcagggcagggctgctgcctgtagggggcagcactgactaggaacatgccaaagaggcccaggagctacagtcaggactgtaaaatccatcttgggctggggtgtggtggttcacactttcaattccagcactctggaggcacaggcaaggtgattctctattctgcgctctgggccagcctggtccacgtagtgagttccagggctatacagtgagaccttatcttaaacaaaacaaaatacaacagtatcctctggaagcctgtcattttgtggcctgggtaactaccaccatgctccatttgagaatatctttcttataaggaaactttgtccccatccacagtttgtccttccctagctttggccacttgtcacgtacttcaggtctccgtggatctattttggacacaccatctaaatggatcgtataatgtgactttttgagggcccgtgcatgctgtggcacatgacaggatttccttcctttctcaggcttagtaatattctttcctctgta

SEQ ID NO: 21946 - DNA, 1190 bp, Mus musculus
tcacctgagccttgtgggctctgcttctgttctagtgttcctagtacctatggcttctcccccacctgccacccccagaaacctggtgggctctgaccttgccccagagtcctccgcatccagtaggctctaccctcaactccagtaccctcaacacccagtaggctctacccgccacaccagcatcctcagtcagattactgtccacttcagcagccccagcaccaggtgggctctgtcccacatccccggtgtttcggctctgccagtgagttcttttggcagggggagaagatcttctatctcatccggccagcctcagccaacatctccctatatgagcgctggcggtcagcctccaaccacagcgagatgttcttcgccgaccaggtggacaggtgctataaatgcactgtcaagcagggccagaccctcttcatcccctcaggtgagtgtgctgcacaggtacagggcccattcttcacgctgcattcccctgacagggtgtcttgctgtccctagccaggcctgccctggtcagcaccaggttagctcagggctgtgtggccagccgactttggcatgggagacctggctcagtcagtagctctagaggaaaagggtggtcgttcagaagtcttcctaaggaacacttcaactggtgcaatgtaaagtcctgagcagctgaggccgccagcctctcccgggaagatgaaccgtagagctgagcagtccactctaaaagacttcttccttctaacgtaatttgaccacattttgagattgaagtgtgagccccactgtaccatccagtagctgatccacatgctggtttcctagtgattatgtatgtgctttaaaatcaggatccaaatgaggctgcagaacatgactgaactcagcctttgactggctctagggtctctccttcctttaaggcatctttatagttactctgggagggaggcactatggcttttctggagttcagccccacctccatccccctgggataacctagaaacaaatccctgcctctggggagaatgacagtcccagccctatctcttctgacctgtgtggacaggtctgagacttgggctccctctcctgatggcagtgctgccctggggtgtgggcatgtccccttggcacctaggcctcagtttctatctgtatggtactcgagt

SEQ ID NO: 21947 - DNA, 1210 bp, Mus musculus
gtgatggagcaaactattcatatcataagtcaggaagcaaaaggaaggccagggttctacaatcccctccagggacctcctagcatcctctgactagacaccacatactaaaggttctactcttccaaatagcagcacaggctaggaccaagcctttatattcataacaaacaagtggccttgaaatgcagggctcttggcttttaattttaatatttttctggaagtacttatgccaagatgtccatcattatctgaagctcaagttggctaagcatctgtgtatttatttgctgatgtggcctttctggctgaggtgagattcaccactttacaatgtcacagggtccagaaaagcagcacccatgaatccacagcaattataggtaggagagagaggctcagcccctatttgtcctgggggtgtggtacggccatgcacaaaggcagccgaggacaggtcagtgtccaccccaccatgtcctccagggaggccatagcgctttcccggcatgttcatgtcctgcttcctccccagggccggagaggagtgtggatgtgacagacgttaccaaacagaaagactgcaaaatgaagctgaaagaattcgtggactattactatagcacgaaccgcaagcgtgttctcaacgtgaccaacctcgagttctcagacaccaggtgacaggctactctgggttggttggcaggttcgactcaaagccaatgtcatcagcctggagtttgcaggatggtgttgggcctgatgtgagggctgcaagcgctgtctcaggtcctgctctgggttccggggctgtgagcctggtttggggttctaccctggtgtggggactgtgaagcgttgcttgaggttttgctctgggtggacgatgcaaagcctggcttgcagccctactctgcatggcctgctgctgtcctgtgagctgcccagcagtcaccatgcaggcctggttctcctttctcttaaagcacactgaacagctcagatcaaacaggagccaaaggaaaacacccactcgcagagaaagccactggggcagcatggacgagtcacttccagatgaatgtgctcctcgtgcatactaatgacatgctgggatggcacactgacatttacacacacctgtggcacacaaacacaaacacataacaaattgacacacactcataacacacagaccatgcgcaca

SEQ ID NO: 21948 - DNA, 1925 bp, Mus musculus
cagatccctctttgatatcagagatataaacaacacatttttttttttttttttagttttaaccagttgtagtcaaaatgctacaataaaacaaaaaagagaaagaaaatgaagagcatttgactcccgcacttaaaaatgaagtacacaaagtttaaactggttacgacaaaagcctagagttgtgtttcttgaactataaagaaaacaaattttggcagtgtttaagtatatatagcttaaaatataatttttagcatttggcaccatatgtatgccactatatttgattttgcattactgtttcacaatgaagctgtgttttgaggctttgatttatgattatgagagaagtaaggcacaaccacagtttctttcttacttaaatctcatcactgttgatgtggttcttttgtgttaaaaaaagtgcaactatcaaaactaaaaaaattatagattaaactgctgttgtgctgattttgaatacacagtacatcatacatcctttacaagcaagttcaatggagattacgttgaaatcatagaagatgcaaatgacctttcaaagtcaacacaatgtgttctgaaacctcgtgactaataccatgcatctgtgatcagtgagctacgtggttttgaatcggacgtagaccattagtgctactacttgagctaatcttctgcatggttcataatttttaaagtgtgtagttaatattatgcatgttattgtcctttcttccattcttaccagtatgtgcccatttgcaaaacaaaatgctaataatcagtaatagtcctataaaagatgttaactctgtttagtcattgactgatcttgctctaaccttaaaattttgtgattattgacctctgttgcatttattctaaaccccccaaaattatctagccgtttggaatatcaacattaccctggtgtactcactgctgtgtgcattattgttctttgttgctgttttatgccttcatattcatattagcaaaatatgaaattctgtaaagaaagaaaccccctatgatcttaaaaaacaaaacacccccttccccttctgtagcaggaaacaaattgcttgttcttgagaagtgtcccatcaggaacttagtagaagcaggtagacttcgatcattttgatgttttgttactgtttccaaacaatgtactttgaatcagaatcacttcttatgtttcatctacttccgatgctcttcatcacattagtgatcagaaatgaggtgtaactccccagcccctgcccgcaagagctaagtaggacctcactgtaagttgaagggagttccgccctaactcatggattgtgaagaatgaactgctgttgggtctgattgactgttgatggattgtggtgtggtttatccagaggctattgaatgcaacttacaatgcttaataaaaatctttattcttttagtataaagtatggtgtggcttttaaattcacttgtaaagtatgaattttacagaggtttaaatttaggtagctcatgaagagctccataagacaacattaagtttagaattaccaagccctgtcaaagtaattttagaggaaccttaatggttaatatgaaaattatgcagagcacagcttttgcgttcctctgaccaatcaggctgcgaagtacaaagtagctttataaaggcctaacggggaaatctttgtttttaaatgtagagttacaagtgtcgctgccctttggctggttctctgcagcctagttcaagcgtgcccagcaaagcggccaaggagctactggagcgcctgctccgagcagaggacgcgtgctttacgggcgggggcgattgtgcagcagatgcgcgcgcatctcggggcggagccgaaccatacccaaagccactggcttcttacgctgcagcgccaggg

SEQ ID NO: 21949 - DNA, 1134 bp, Mus musculus
ttgtttgttttttgttttgtcttttgtgcaggagtccaacctattccttctcagggagggaagctagaaatagctggcactgtggtcggccactgggctgggagcagacggggccgtgggggccgagggcccttccctctgcaggtggtgtctgtgggaggaccagcgcgagggtaagctctgggctgggctgctggactctgtgtaagtgcggaaggcagccttcgactgctcctcctgtgttacagaaaactctcttacatatcattagataattgtttgattcatcattatttaattattaaataattaaccatacattcattattcagttattgaactgttatctaaaaatgttccaagcattagttttgaagtcaaatgccttgggtatgaaccagaaaaatgattccttgcatttgatctgaccatacttaattcttaatgtctcacctagcataagatcgattcgagagtaatttaaacatcatctttgagagacttaagtctgtttgctcttgttttcctgtattgacccaggcgtccaaggggtgttatttccactccggtgattagaacgtttggaagaggtggaaggtactacggcagaggctacaaaagccagggagcaattcaggtaatgccctcacagtcctttcactcctgccatgtctcccctctaggagtgtccctgcctctgttctgactgtagagcagtgagtttatttggtacttgtcaggcttctgacttgatacttgaatcacttccctgtgctcaggaaccccatcaggtgacttcttgtttaggccaaatggtgtctaggctgctctctcttccaagatagccactctttaatggaaaatagattttattttattttatctaatctaatttaattaattaattaattaattagagtcaaggtctcactgtgtagccctggctgtcctggaacttgctaggtagaccaggctgatctcaaactcacagagatccacttacctctgccttctggttgcttttttattttaagtgtataaatatttgcctgcatgtgtgtctgggcaccatgtgcctcagagagcagaaggcgttggatttcctggttctagagtcatagaagctccatgcag

SEQ ID NO: 21950 - DNA, 1507 bp, Mus musculus
ggtttttattctaaagattttattcttgaaaagccattgaggtgacaagaaagaaaccatcgtagaattaaacctttgtcctagataatccacaaattaggcctttcacatatagatgatcaagagttgattgcactgtgtcaggtgtcttaccctgcccactgtctgaggtgacagttctggccaggcgggccccagtgctcactcagcatagaagaaagacacaagtttccgagtgccagcaaagcacagcttgaggacagggtttctctctgtgcattctttcacttctcctgaaacattttgacagttttaaagtttctttgaaacaacatataaagttacagatatatagtacaaatttatttcaaaatgagattatgccaactaatttcttaatacagttacttgaaaactgttccgttaccgcatggtcagtgttcagatctgaagagctaggccttactgaagagattgtggagctctgggcccagaaggagactgtatgtagctcatcaggtccctcgtcatgtctatccttaagcatcatattatcctcactgtaataattcacagatgtcaaactagttagtatgttcataaaacatgatttttaaatactctaagagcataaaatctggctttctttgagtaagaccggggctgggtgaagccaaggtgtgctcctcttgtgatgaggatcgagttctattaactttggggagttgtagcaggaaagtatgatactgtagtactcttactccatataaattactcttttccattaaaagattgacaacttagacccgagaggaattcagctgtcggctctcttcatgagtggagtagacatggcactgtttgctaatgacgcatgtggacagcccatcccctgggaacactgttgtccttggatgtatttcgatgggaagctcttccagtccaaacttcttaaagccagcagggagaagaccccactcatcgacctctgtgatggtcaggtatgtcggggacagggcagccatctctgactagtgtggaatggaatgcgtgagctaacctgctgtctaactcatggttaccattgctgtgatatagcaccatggccaaagcaacttggagagcaaagggtttgacttctgcttccatgtcgtcatttgtcattgacatcagagcaggaacctaggggcaggagctgatgtagaagccctggaggaattttggaattttcttttaaaaaccacagaaatattataagaagatgtttccgttttactcccaggtgtgggatgtggggctgcttcagactgtccacagcagttgactgtgatttgccccatgcttgttctagccaggacttggttttgtcacctgcagatagtttctgcaattgtgtgacctttggaattctggggacttttcagagagtgtatacatgctggggctctaagagattggtgggttgctgactggttgttggtcgaggtttgttaagtaggtgtgcaca

SEQ ID NO: 21951 - DNA, 1107 bp, Mus musculus
tacactctggagtgatacagctgttggctgcttgacacatctatcccagtggaagttgaatccttttagccacccacacccagctgttccagatgtgaagatgcccttattagtcattgagtatcctcttcatgggcacttcctatatcattcccatgttcagctgctgccacggattccttaattcaaatgagacagatttcaacctcacagagaaccacttgcctctctctgtctctgcctcctgaatgctgagaataaggcatgtggctcccaccagtctgggcaagcactgtccaacattctagcacgctgggtgttgatcaggggcacactgttcccctggcatcctctcatggaagcagtggttgaaagacaatacagaggcagcttcctggcttgcctgtcctggattattgagaagctgctgctgtttttccaagtactggccgactctctagtcatttcactccttctgttcctcacaggtatatggtgcagtggcctggagctcgcattctgcgaaggcaggagctggatgccttcctggctcaggcattgtcccccaaactctatgagccggaccagctgcaggaactcaaggtactgtctgatcagccttgtgtccttgtcctgggaagtcttgctttggatttggtgtaactttgctaaccctcaccagacagttgtttgggcaccaaactaatactactaatgtcctatgtgtcaaagccttcaaggcaaaggggatattcctgtccaggtctggctgtgccagcagggtttgtaagcaagtaaacaaatagccaattctatgtttatcagattttacctgtttatcagttgatgtttattcttgttttttacatcggaaaataaacttctcttttttattttaccaggggattcccgccctgggagggctcagtcttaggaatgttctaacatctagccaggattctttttcttatttcattgcattgttcctagctgcactttagttttctctaaagcatattctttgcccgtctggtgttgcacagtccctttttaaagaaccacttgaagagcggtgttagcatcatcccgacaccccttttcgtgagt

SEQ ID NO: 21952 - DNA, 2027 bp, Mus musculus
tccccacccagacatccctatgcctcctgtaaatgctgtttgcaagtcatgttactctggacttttttattctgcacagtttcccagtactagcactgacattgttctcccagatttcaaattaaccagcacaagaagtagttactcaggaccagcaccaccagcagtctgtatgtactgtgactcttttgagtagattcttacttcgtaagtccttgactttatgagtttctaaatgctaagagccacatacctgagaagagggaggactgggcagcactcatctgcctgtctttgctagtgtgtttgccagtgtcctacggactactgagcatcaactctctcgggtggtgcctgcctcagatataaagttttaagaagaagctgggcagtggtggagcacgcctttaatcctggcactccggaagcaaaggcaggcggatttctgagttcgaggccagcctggtctacagagtgagttccaggacagccaggtccacacagagaaaccctgtctcgaaaaaacaaaaaaaaaaacaaaaaaaaaaaaaaaagttttaagaagagctggtaccccttgaggattgtggagtgcttagagtgaggaggtagagtgtactgctcctcattgccctccgcctgctgatcggggggtggggggtggggggtgggacatccacgaggaggaaagagcagatttcatggtgtccagtttttctttctatcctggggtaaagttgttaacataattttccctggacggtctcaggcataacagtagcccctccctagtgcgcatacactcaggtcacagggctgggaaggtgctttttttgctgtatcttcctccccttgtaaaggtggtgtggcatgctgccactacccctgcaatggtgcttctatggcacaaagctgtagaggcagctactgtgggcccctgggaactcccatataaaacaacctctgcttattgctcttgggttagcaatagaggcccagattatctgtgatacaagcacatgactaatatctgggtttttattaacagctcaagtatgacacttgttttatggtcccaaattgcatttgagggtatgtttccggtaaagtaagtattataaattgagcctataatcccacaaatgcttgctgttctacaattggtttttactaaggtaaaacatggttttagagtatggtcagaaagctaatttctgctgctttgtagaaatgggctccttctagaagcagtagcttttctgttgtagaaaaggtgacattaatgttcattgaggtgacaggtcatgcatgacctcttgggcactcttacttgaacatgacttcctgaaatggtcctaccatgatcacactcttactccaggccagacagcaccaccctggcagcctggggccctgtcaccctcataggtctgtaatttaaaatgcttttagagaggtaggtatagatctgggaggagtagtgtttgaatatgatgaaaacacattgtatggaatgctggaaagaataaaatacaaggtaaaaatttatatgaaaaattaatttattataataagttattataagtatcataactataacataaatattataagctatgatataatatatagttttccctgcatggtgagagtactagatgctttttaggttaataattagtattttgttgcatagcaaggttttatcccttttttgtagcctttgaaaccaggccagggctgcacttgttcctgcaactgtatttttttcccatccttgcctgacatatgaggtacccactaggtatgaggagtgattggtcagcgattacacagctattgagtggtaatatactcaaaagttctccaagtattagagtgtttgaaaacagccacgcatctgagaacaaaacaaaataagtcccgcacaccagtgtctttggagcaagctttgtgtgttcatgacaactttgaactgcactcattaggactattgcaggtggacacccaatgtttagtgctatgat

SEQ ID NO: 21953 - DNA, 1104 bp, Mus musculus
ctcatctatgtggttttcttttgttcttggtttttggattaaaaataaagtaatgtaggattaattttgagtctctggacatacatttggaccacagatcccagtggactctcctaaacatctcactgtaggcaagttgttaagccattggaatagactagctatgtcattattggagatgatacagtatattgctgtgagtttcttgtaaattcaacatgaaaaatgtgcaatattattctgctttcttccatgcaaagggtgaaatcaaaattgctgtttctattgaagatgaagccaacaaagacctgcctccggccgccctgctctataggccagttcgtcagtatgtttacggagtcctgtttagtttggcagaaagcagaaagaaaactgagagacttgcttttagaaagaacagacttccaccagaatgtatgtactgtaacaatccattgtttgtttccctcggtacctcgtaatctcttgtgcattttctaaagccttagaagtatggtggctgagttgcctgagactctccttgtacaggaggtgggctgtcctctgggctgtaggcaaggatcgagccctcagaacaggagaagccatacttggtacagttttagtaatgatgtttatttggtaaaagaataaaatagcaggtttccaatgttaaacttgacgacattactctgaaaacatcttcaacagccgccactctctgttattagcctgtttaagtagccgagacgcacatgtctgcccatatgctcaggatccacagatctgtctctccaggagctcagaggtctggagagctagctcctctaaggttctaccgccatagtggattcacttcaggactgctatgcttttcctggctatggctacttcagttcatcaacatgggggaggggagggcactagagaggactgtttggaatactggtcaactttgaggtccaaagctttgtctctcatgaggcccatgtcatatttttgggaaagttgtgctttcttcttcatacttttatctgctaatttaagaattaaaaaatcaatatatgctaggaagtacagaagtgttatctaaaacagagtcta

SEQ ID NO: 21954 - DNA, 1215 bp, Mus musculus
ttctcacaatttgtggcttaaagtggtaatgcaagccctaatgccctactagttatatgaacattggcgagtgctcagggacattccaaagctgcatgagtgaagctagggtccttattatctcagctacctttctgctactgtggagagacaccatggctaagtgtcttttaagttccagaggatgagaccatgaccattgtggcagggagtaaggcagcaggcaggctgggcactgaagcaattgtacacatctgatccagaagtgggaggcagagtgctactatggaatggcattgacttgagaagcttgcttcaataacacaccttctccagtaaggccatacctaatccttccaccaactggggattaagtattcacatgtttgagcctggggatggggtgaggggagggggagggagaggggctatgattctcattcaaacaccacatttaagtaaatgaactatacactcttggtcagagggttaaaattgtcaaagctactcttgagatgactcagcaggcaaaggcacttgctgccactcctgacactggagtaagggaaagataacttatacatattgtcctctgacctccaaagacatgttgtgtcatgtgtacgtctggtgtgcacacagtgcacccacacaaaattaatgaataaagatgtaataataataaaaactttgttgctggtgagcgtaactttaatttttttcaaagccaacctttttttttttgtttgtttttttttttgttttttcgagacagggtttctctgtgtagccctggctgtcctggaactcactctgtagaccaggctggcctaaaactcagaaatccgcctgcctctgcctcccaagtactgggattaaaggcgtgcgccactacacacctggcttcaaagacaacttttaacgatggttcttaaatgcttaacctcccttctagccacctagactttctgttgtttcacatcttcaacagcatttgacagttttaatttccacccaccagaggtactggaaaagaaaggctattatgatacgggggaagtggacctgtttagaaatggtcttttggagcaaatcccatctgcattgtcaggaaatcagcagttcagttcataggtcagcagcggcagctcagtccactcacaaacatgccacagatatatcagcagtccatttcagtcgggtcaggatagcagc

SEQ ID NO: 21955 - DNA, 1211 bp, Mus musculus
ctgataggtaatgcagacttttatttaaaggaaaagtatagtgttgctttccaacacttttgaagagattgtgtcagctatagcaaaggcagctcctttgtcttgctctctctacttgtattctctttctttattttaccccattttcctttcttttaaaatttggttgcagggatcagtcagattagtttcctttcaagcagggtagcattggaattgtcgcaagtggagaatttaatttgtactctagatgggatggtaagttactgactgacgatttgaattcacttcatttctgagactccttttggagcagtgtgtcacatgattggtcctggcactttttgatcatttggatgattaatgctcatatcagtagctctttaaagatgtcaggtacatttgcctgttgaacctgctgctgcagttagagcctgcatctgatggcatctccttccttttctgtgtgtaggttgcacagagcattgaggatcatcatcaagaagtgattggcttctgcagagagaatggtttccatggcttggtggcatatgactccgattatgcactgtgcaacatcccctactacttcagtgcccatgccctgaaactgagccgcaacgggaagagtctcaccacaagccagtatctgatgcacgaggttgccaagcaactggacctgaacccaaatcgttttcctatttttgctgctctgttaggtaggtggagtggtacataagcatcctgacattatctatcttttgaaggttttccgcctggatgctttgctgttttatcagggggagaatgggctcttcacttgcactctcttggttttgttttctgctggcaatgcattgttcttctttctactttctagcatgtttatatgttgcttacatgttcttctatcaaggctggaaaacttactctgtgataggctcaaagttttagagaaagaacatttctgaattacaaatcacggtggctcacagccatccataacgccagttccaggggatctagtgccctggatgtatgggcgccagggacacgagtatgtggtacacatatatacctacacacatccaaaacacttattatgcacatacaataaaataaggctacaattagggaaaaaaaaaatgttgccaggcagtggtggtggacacctttaatcctagcacttggggaggcagaagcaggcagat

SEQ ID NO: 21956 - DNA, 1154 bp, Mus musculus
ctcgctgactgtcttagttgaggttactattgctgtggcaaaaacactgtcaccagaagcagcttcaggaggagagggtttatttgccttctacttccgcgtcacctttcatcacaggagaaagtcacactgggcaggagcctggagccaggagctgatgcagagggcatggagggcactgctttctggcttgcttggcaccttgacttgctcagcctgctttcttacagaacacagagccatcagcccaggcatggccccacccacagtggatcactaatgaagaaaatgttctacaggcttgcctccagccctccagcctcatcttagggaggcgctttctcaacggaggcgctttcttctctctaaggactttcacttgtgtcaagttgacataaaactatccaagaccctgacccccctaataatttttttttaaattacgtttagcttctaaaagtttattgatgagctgggctggctgccctccggcatcccttccagcagagggagtgtgtgtgcagaaaagaagtggcccctgaccctgcaagggtggctaagcaaatacaggtctaagtgaatgttgctgttcctaagagatagtgcctgaatttccaatctctcagcccacccggggctgtggatggtgtgttgccacaatgaagtctatggactcctccttctcttacttttgattccccaaagaagtgttagagagaaacacccacggggcaggagagggggaagtatagctagaattctgcatcacttgagagatggcaggtacctgagtactcttagggtgcacctgcggctagaaacagctacccgctgctctgaactaggttgaaggccagagaagcaggacactgatatgccagggaaaccaccggagcccagctcagatactaagtgtgtgttgccttgtgactcttcatctgggcttatcctgaagttcttaggcgtctaggccgatgtattcccacacagaggtgtgtgaggaggctcgtgtatgatcccttctgccaaatccatattatcccaggtgtgcttttggacaaggattgcttccggggaacatgtggataggaaagagtcatttctttatcctccctaacctgtgtgctcactgatgtggctgggcacagcctctg

SEQ ID NO: 21957 - DNA, 1185 bp, Mus musculus
ggtagggacataagattattattttctttctctttagctctcctcatccatattgacatttgaccctattcttgtttgttgtctcatagctgcaaaagggctgccacagctccaggcagcataaccacacttgaaagcaggaagcaaatgcatagttgggtagataggaacccaacagcctttaaagacccatttctccaagggctaatctgtattttaattcttgttttgtttcgtttgtttgtttgtttgttttaagacatagtctcactatgtagttctgagtgtcttggaactcactctgtagaccagggtggcctggaactcagagattcacctacctctgcctcccaagtgctgggattaaaggcatatgccacccagcttgtatttcagctcttaaaggaaaatgtttataggtatcttctttcatctttctggccgcaaggtgatctgtggcctccattgatgcaagggtgtctgggaaaggcttgatttgcataacgttttgatctgttacctgaggctgagtaccctggatgtccaggatggggtagcagacagtgaaataatttctttctctaggggagtgttggtgctttgtgcaaaggagccctcatctgcctgggtcagtcccacctgccagctagcctgtccattcttatccacagctggccacagtgggcatctgcaggccctgaggccgtttgctctctcctcccaagtgtcctgttccttgctctttacccaccatctggaccccatgacagtgtttttctcctcccagctgtccggttttcatttccctcaaacttttaattttcgaaaacccctagctactggcagagtggagttaggagctgggcgctcagccgtctctccatcaccgcatttgtaaacgttttatctgacccactttgggttcctctctgaatacttcggcaagcatctcctgacaggaatagggacaggtccccacagagcctctgcagggtcatgcccagggcccaggtgggtggatcctgctggatgtgtctggtgtgtggccttgtgattcccacaattgttctctctgggttccctgtttgcacctgggatctagtcagtgaagaaactggtgtggtgcttgcttgtcacatctattttaatatagaatggtggttctctgcctgttggtcatgaccc

SEQ ID NO: 21958 - DNA, 1219 bp, Mus musculus
atctcactgctaaccacatccaggatggcagtcccagagggaatggaccatctctggttgcagcctgtgttctgcagtgagcccccacacctcagacacgataaccatagcccaggcagacagcgcagctgctccatctcaaagatccgcatgctgctgtgtcctgaaaggtgacaaattagcagggcctgaggtcctaggttttctttcttgacgagagtgttccaagtgcctggtcagaccttggtccttggttcagagcctattatttggtcctttgagatctgcagcttgtgcttgggtcttttcctagaagttgtcagacccaaagaagcagtgttttgagaactactagtgctctaccaaactgcacggcacagtagagcccagctgtgtgctaggggactttttgtgggcccggagctgtgctcaaaactggcaggtaagagttgtgtggttctcggtgcagtttgtggatactacagaaggaagaaaggcctccgagggctctccttttccagatgctctgtcagtgcggagctgtggcatcagatcaggtgtgtgctttagtgagttgtaaaacaggactctgctcagtatttctctccctgtccccatggggcatctagtcttgagactccatctcccataatagctgcttggctgtctctccctgtggaaaggcatctttcatgatgtggaacaattactatccaatatggccctgtagtctctcaaacagctttctctttctctcccctggatcctggggtaccccagtctgctcagattcttggcagcacatggtcgtacactgggggcagaacaggccacacgtgtcccttgcatgtccatcctgggaatggctgcccgcatgcccacccaaccttctgcctttctttctctttgggccagaacgcagcttctcttacactgtatggggctttgtggacacttggagccccatcccctaacacacatgcaggcctcctctgccaactaatgtgctcgcgcactcccagaacaagagctttagctgtcagtgagcagggagtggctctcgactgatttctaatgctgtcttgttttctcctgttttcagctgtagagtagctgctgggaggaggcggccacccggccctgtcacacagcagcccctccccctcccctcctgtggcccatgcagaggaaggaagggcagcctaaagtccacttagaa

SEQ ID NO: 21959 - DNA, 1192 bp, Mus musculus
taagcaagctgtacagacatcacgtttgtgaagagctgagggcgtcaggagagccggcgaagtcggcatgcgagtggggaagagggttagccatagtattctttgcaaatgtgaaagtcagacattatatcttctcttgcttggtgtaactaatcactgttaatttcaggaaacagaagtcagtaaaactccttagtaaactccttgctaagtgaggttcagggtgtggtcaaattggtactagtggagggagggaaattgtcctccagcctaaaaagggacaaattataataatataaattgttaagaattgaagaattctgtttcctggaatgagcatttcttattcctagttgttgggactctttgccttctgttacagtgttgattcatacaaaatattgttacatttaagataacatcatctgtatggggtatttatttgcaatgatgtctaagtactgtattttttctgtgtgttaccttagtgtcagaatgttggtctttattttaaaagtcatatgcatgttctcctgccaaggcaccttacacagacccaaaacaaaacaatgagcagatgccttcagcttctgagaaaatgaggccaagtgaggagaaggcataggaaggtgagactagctgagacttctgtcatggctgatggcggaccgtctccacagccagcacacataggaaaactgggcctgggtgaagagtcgcattggtaggaccaataaagaataataaaacaattgaagcacatgcgtgccctctgtgattgcttcactcctgcaccaggtgaccgctctcagcgtgcacggtaagtctgggaccccaacagtcaaccctaacggtcactgaaggtgtgggccggaaacaacctgggatttatccttgggaggcaggattctcctccagggttgcccacattattcaacgtgaagactggcagcagggtggtcagaacccattgcagtttgtaggactcgtggcacaaataacttgtgtttcctgtgctggccaaatttcttgcttcagacctaggaatgaataactcttggggacaagggtgattcattgtcaatataaagctgtatttaactgtagaaataatgtacagagatacacggtgctttggaataactgcgagtgtgagaacttggggcattgtctaactccttagacagatgcc

SEQ ID NO: 21960 - DNA, 1193 bp, Mus musculus
tggctcattgcacattctctcttgattccttacctggtgtttgccaggttagaatttatttccattttccctttggtgatgtctagttttgtgtttgtctttctgcatttacattgtcagaggtgaccttcccccctccctgactctttcctgtttggttaaaattcagtcagatttcagcactcaggtcatttctttcttctgagagcagtaatgcaggaggcttttgtgtgtctagagagcaagactttgctgtgctggtccatccatcatcgcagcctgggtgggcaattcaagggcctctgatgtttgcttgtatttctctgactctacctgtggcttctgagagcctgactccttttcatgttggggttattacacgttagggtcgcttagctggcgtggcctgtctccatagctccacaggatcacatcagtgtacgatacactcttcactttgtgacctcctgccatggttcactcttgtgtcttcttcaccctgggaggatggctgggaggttgagctagagctacaaagggttaggaaggaggttggacaaggtgcctcttcctactgatgccgatctgccttgttctctctgagggtattagttgtcactgaggctaagctgtgctgatgtgaatgccttagccttggcagccttattctcaggtcctggggatatgtatttggctatgtcacagacatcagtggcttggcatctcttccctctggtaactagcaccgtagatgttttccttataggttgagtgtctttaaggaagttgggttcaggagacacatcttggatataccatagctcccacctgaacatcatcctcacagttgggacaggctgggtagagtgctgtttctggtacctggggccacatcctgatgggtgatgttcttttgtatttcctcccttgacagtgatctgagcttcctggtatctctcatgggctcttttctggaatatctcctcactaacttgtcaaaggacatggtccctgggacatctgattcagagagtgattctttctactctgagagtatcctgtaggatagcttatcttcactgaagggctttaaaggtaccctccaccccaattatggtttggatcttaactgacctccaaaggccatgttgaagtcttggtctccaggtgatggtgctgttgaagcctttaga

SEQ ID NO: 21961 - DNA, 1155 bp, Mus musculus
tgcatatctctgcatgcaatgcacgctcatgcacgcacacactcaccacaaacacacgactttggaactttgaacagttactgggtttgattatattaattaattaactaattaattaattttgttttttccaaacagagtttctctatgtaaaaaccctgactttcctgtaacttgctttgtagagcaggtgactcgaactcacaaagatctgcctgcctttgcctcctggctacaattaaaggtatataccaccacggcgagcccaatattaagaaattatttttttaagatttatttattttatgtatgtgagtacagtgtctatctcttcagacacaccagaagaaggcatcaggaaagagaggcccattggacttgcaaactttatatgccccagtacaggggaacgccagggccaaaaagtgggagtgggtgggtaggggagtggcggggagggtatgggggacttttgggatagcattggaaatgtaaatgaggaaaatacctaattaaaaaaaaaaaagaaggcatcagatcccattacacatggttgtgagcaaccatgtagttgctgggagttgaactcataacctctgaaagaatgcgtttaaccgctgaaccatctttccaacttcaggaattaattttttgatgtgatagacatgttttttgagaatggagaattggcaaggctctgtagcacatgcctttaatcctggtgctcaggatacacacatatgtttttattgaggatattgtgaaaggtattgtttcccaagcagttctcaatctatttttcatttatataaagaaaggctactgagttttctgtattctgttactttgctgaaagttttgttagctgtagaaatttcttcatagaatttttagtaatatataagatcatatcatctgcatataaatagactttgacttcttcctctcatctttcccttgatcttcagttctctcaatgctgtagctaagatttcaagtactttactgaataggtattgagagagcgcacatccttgtctcattttggattttagtggaaattctttgagttctctcccaattaagttgctgtgggttgctataacttgcttcttcttcttcttttttttttccttttttctttttccttttttg

SEQ ID NO: 21962 - DNA, 1173 bp, Mus musculus
tggcaatagaactacaggtttgtgcagcaagtacttttgcctgcagagccatcttattgattctccaagatacttttaaaatgatcctgatagttgagtggattggcagccagaatattggaactaagttgtttagttatatccctgtgtccatattctttgatgtaaaaattgagtgccttcagaacttggttttgctattggctggagacggccaaggcgtgtagaagagagaactttaaatatgggtttcacagatgagagaaaactagtatttgcctttctggtttatttagtgtgatttcctgttgcatccattttcctgattttctgagatgttctttctctctttctttctttcttggagtaatcttttttgtcttaccatgacacttgtccttcagaccctacagaagcagcctgtaccgttttacttggcagtccctaagctcaccaagcctgctttcactacttgtatgtctgagtactactgtgtctggtgcccactggaggccagaacagggtcttgggttcccctggaactggagttacagagtgttgtaaactatcatgtgggtgctagaaggaagaatggggtcctctggaagaacagccagtgttcttagtctagccactgagctacccctccaagccccaccttcggtacgaggggtggaatctagaggaacatttgtatagtaagtaaaacatttgtcagttgtcaagtaactataatatttgcttttcaggaaatcatttcaaaaaatttcccaatcagattctgaggagtgggaatctttgaaagacttgagaagtcagcttgaacatttaagatctgagcactcatttctaagtaaacttactggcttcaatataagaaactattccaagatggaagacattgtaaacactgaagagacagaaaaaggtacacatcattttttaacttcaatgtggtttttaaatttcattatgagtatattttggggtgaggtgcattcatactatgttgtggtggtcagagggcagctttcaggggtctcttctctctctgccttgttgaggcaaagtttctcttctagtttccgcattacatcctccaggctaggtgactgatcccttagctctcagtccttcaactccctgcaaatctttttttttttttttttttcc

SEQ ID NO: 21963 - DNA, 1098 bp, Mus musculus
aaagcacacctgtgagctggaaagttgtggtgcacagcacacctttgatcccaagactccagaagcagaagcaggctgggctctcaccaaaacaaataacaagcaaacacacaaaaacctaaaacacttgtaatcccaacattcaggagggtacaggccaccagatcagaaggtcagcgttatccccagctacccaaggagttcaaaaccaccctgaactctatgggactgcctcaaaaaggaaatgaaatcgcagaggaggaagcagagctaaaatgtcccgaagggactacaaaataaggaagaaaggcttggattgtgtgtggaaggaaaatgggtttctgtgcataacctggcagttttaccggcccttctccacccacatctgccccccacccccaccccccaaactgccctgtggttgctggaggctgttgtgcaggtacggttctccagtggatacaatgggctagaaaaaccctgtgatttatgcatgggagctgtttcttctcagcagctgccatagcccggtcattggtacattgttcttcctacaacggtctgtgctgttgcaccccgcctttgtatttgctggaacaatagtgtggttctcagtctttggagaacagcagaggcagcataggaagtccagtaaaagctctcctcttgcttcccagaaagtttagatctcatgttcttaacagagggtggggtagaaatcactggatcatcagggcactgtgagtgatagtgttccaagtgtgttctgaaggagcctctcctagggatctaatttaagtgcacacatcctgacccctgatgagtctgcgcttctgatggctcccaaagtcaggagcagtcacagcaggcgattagaagtggcaaaatgaatgtgtagacctaacagtctcttaccaacgtcttactcaccgaaccgaaggacccttggtaaatcaataaatgcagaaacctctttctgtctttgaaaggctgaatcctgacgtagcagctgatccaaaatgccatgcatctctcagtaatgtctaattctgtgctctggttgaaatggactattttaggtaaatgtcccacctgtct

SEQ ID NO: 21964 - DNA, 1161 bp, Mus musculus
ttacaatcatctctgccctgtgtggctgggtcctgcagtatttcctgccttagtctctattgctaggaaagactactaatgtcaaatcagtgaattccttatgaaccttccctgttggaaaatgttaggatgggcgtccactgccctgcttcattgatgaggtgcctcaggatcactggtaacttgcttatgttttggagataataaaggaagaacagatgacagggtagcagtccccccagctctgtctgaatggcctttgtgaaggctggacctccagtagatttctagtcatctatgtctcttttctagtcctgttgatcccacttccctacccctgaacattttacttttatattatagctacttgatacaaaaatcgtcctggatgtctgccatttttaaacaacttgctgtattttgtattatctgttaggtttaccttctatgatgggcctccctttgctactggactgcctcactatggacacatacttgctgggacaatcaaagatatcgttacgagatacgctcaccagagcgggtttcacgttgacagaagattcgggtgggactgtcacggcttacctgtggtacgtctgagtctccagtcctgtgatgttctcactgtctgtgaatatatcaggcgttccctttgaattcttttctgtattattatgtattgtgtggtctcgtgctagagttttctttgcatgtatttctgttagctgttttggtttctgttgcggcttacttgtattaggtgtggctgttagcataaccatcttgcttaatattttcaggagtacgaaatcgataagacactgggcatcaaaggcccggaggatgtggccaaaatggggattgcagagtacaacaagcagtgccgagcaatcgtgatgagatactccgctgagtggaaggtatgctgggtactttcagaagaacgaacagcagatctggctttgatgcgggactagatagaaatggctaagcacccttcatgctttttatgaaatattccccaaagtatggctgcctgtgtgagcttgtgtcacaagaggagcactacatcccagtgttgcttttggtgtctggttcttttttatttttctctctatcctcttgctacagtcatattctctttaaaagtctctgtac

SEQ ID NO: 21965 - DNA, 1099 bp, Mus musculus
gttttgctttgcagttaataagtatcctatgggaatactatttctgttatgccttctcttatgatactttcagacattaattttagcaactgttggtaaattcttcctagctatagttatttctctgatgttcgccaagtaatagttgcaaaagacttttatcaatataattaatatctctgggcatggtgggacacacccataatcttagtactgggaaaacagaaggtggattatcctaaatttgaggccagcttggtttatatttaacagctttcaaaccagaaatacactgtgaatcctaccccctcaatccataatgacttaagtaattacttatatttagaaataacaatatctacgtataagaaatgaatgttaagacaacttgttaaccttaggtgttgtttgaaacaatgtttcaaacattgttggaccattgattgattgtttggatttcccaaaatactcataggttgtgataacagcagtaaaaagtcaatatggtgttatctcctaatgctactctaccactcttgtttttaagtctactgttaccagactcggccgatggatcgactttgacaatgactacaaaacactatacccacagttcatggaatcagtctggtaggttaattttaaattgtaggaatgataaacattgtgtctcgggggtcagaggaggaggtgcctgcctgaagaagtttgttgacaagttcagtatttgcttttggagtaaatgtgatatatatcttctagctttttctaatgccatgaaaatgatttatgccccctccccccgccccatttgtttccccataaaaattacatttgggcaaatattctactcaaacccttacacattgggcaaatattctaccattgagccctgtgggagagcatttaatcccctcattaccgaagttgtgggtagtggcccataagcacactccaaacagtagtaatgcagggagattatgagttcaaggcctgcctgcctgggctacttactaagaaagactctgtctcaccaaacaaagttccctagggatattttaactccagcgaaggttttaacaaaagaaaaggcagaatt

SEQ ID NO: 21966 - DNA, 1144 bp, Mus musculus
cttcccaccacacgggcttttgttatccagataggcatgtatatcattacaaataaaatgtaacttaagggggggcttttggttttcatttttgttgttgttttagtgggtgggtttattcggttttgttttgggtttttgagaaatgtctcactatagtctttattcttgactgacctggaactcactaggtagacccttgaacttgggcccacctgcctctgcttcctgaatgatgggattaaagatgatcaccactccacccggctgtggttgagttttaaaatgttcgtgtgtggtatctaatggttgagatgactgggctagataatgtaactgcagttcagctgtaaggccgagattctatagatggtccttaagtcaccacagttcgaagtagaaggttacttagatgtatccaagacagtattgaaaatgtacttagaaatctatgtaagttcaagctctcctttatcctgagacacttttatcccccagcctgtgttcttgtctgtctcaggatgatcatcgtgtctgtatggacttcaacattattcagaaagactcagtccctgtttgtcctgtggatgcttcaggctgcttcacagaggaagtgacacattttgtggggcagtatgtgaaggtctgtgctttgtgtgtatggaagggtgtaatctgtcttatcacgcttagaattaccataggcatttaacattttaagcacttaaaacaaggaaagacagctattagccacactccgagggtctgacctgcttagacgggggagcgtgctgtggtttcatcagtaggggttgggagcagtacactgccgtctgtcctggcatggccttctgatgctcaggtgaactttcatgtttgagaacttcagtggctcatgcatcctgggcaggcttctcagcttctctcctcctagccgtgcctccagccccagaacagatgttttcaaaagacatcaattgtttgtgccttttacccattataaaatatcagctcttagccatgtatttatattgttagtaagtatgccaaggtgttttagtgactgactaatttattaacaggatgctgacaaaaatatcattaggatgttgaaggagcagggccggctgctggcggcgggcac

SEQ ID NO: 21967 - DNA, 1164 bp, Mus musculus
gcacacacaccaagctcatgtgcatacacagtcacaaaaataacatgaatataaaaggcctaacagatagacaccaaccacccctgccattgcgactttcaccagtacacatttgaccctcttccattagcacttgcgtgtctgcttgcagtccccatccgtctataagagcaactctatttactcacttacttggtatctcctttctgttttacaagtgatggccaaaaaatgagcaagcggaaaaagaactacccagatccagtttccatcatcgataagtatggtgcggacgccctcaggtacaaagcagccctgtgctcaggtgtatctcgtgtcatcatcctcagagtgccttgcaattatgctttaactgtcgggcctctgtatggggagttaggcttttgtagttggtgatttccaagtctagaagtcttttgaggactaaaaactgtcccggatgccatcagccatccatgacctcccgggcgtgtgcatactgtctctacctcagctcctttctaggtccctcgtcttgttggtattaggattctctctctcttctcttctcctctcccccaaccccaccagaagaaataaataaatgcatgaggttttagagaacttttagctacagcttgaagcgttcctactcctgaagtctatcctgtttaggttgcaaaggcctagagagcttgttcagaatctccatgtcataggtgaatcctacaccctgtcccatgctgtgtaccttcacacagctccctgtggcctgcaaacaagagagaggctggccctccactcattcgtctgtctatcaggactgggccattctccacagtgagggtgggcttccagagtgtggcagatctcctcatgagcccatgtgcacctgtggtgggggtgccagtgtttaagggctgtccctccgcagaggaaagcagagtttgacttggccttcttcatctttagtaaaaggaaaaagactcaggtgatctgacaagaacaggaatttttacctcctcaaattagtaatacttggtttgccatctgtgtaacttttctgtgtaaattttgtgcttctgccaggttatatctgatcaattcccctgtggtaagagcagaaaacctgcgcttcaaggaggaaggtgtgcgggatgtcct

SEQ ID NO: 21968 - DNA, 1686 bp, Mus musculus
tgtcctattctggtgccccagtatcctgtcccatgctatacaacaagccttctgtgagcctgtgacagtcacaggggaatttgcccgtagacaagatcgtggtgctgtccacatctaacttcctgcacctgcatcccgagattcaagtgcggtttttctgctttgcagatatgatctgtaggctttaaggtatttaacctctgtgcatattgacttacctgacacatttgatctaactggcacttgttctggggctcctggcttggtttgtttttggagagcaagatatccagagatattttgagtcctgtgaggtagctctactattacacctcatacatatgaagtcatttttctttgaaaagggacgtctaataactagcctatgcctgtctgtgtattgctattctcctctctaaagtgactggttttcatttctcagtctaagtgagatcgacggatgatgggtgcatctgagtgatactctctcctccattctgctgcaggccccttacacgccctttctgactgagctgatgtaccagaatctaaagctgctgattgatcctgcttctctccgggacaaggacacactcagcatccactacctcatgctgcctcgagttcggtaggaatcaaatagagacgagtcacccgggccacaggaaagggaagtccacatagggtcccaaggcccgcaggaagagatggggagagggctcatttcccttctccacctcctgagccctcctttcccctgggctgatgcagctactcctcaggctgcaggggcctgcagtagcaggggtatagcatcctccttaggaatggtagttgggtgagatgtgagtgcaacctttgagtaaccctgggagcaccgtgtgtgcccctgaaggtggcagtgggtgacatcttttctcagttatcgctggagacctagccagatccccctcttcacttaagagtaaccgtgtcaggttttcaaccttcaaaagtaatgatcttccctacccctgtgttcatcaatcagagaggagctgattgacaagaaaactgagaacgccgtgtctaggatgcagtctgtgatcgagcttggaagagtgatacgagaccgaaaaactattccaataaaggtgtgaaattgtcttcttatatcgaagtgacccagacctgtgtcttgggaaattttagcttagactttgcagcagtggtgtaattctttgtccttttctgtggtaaggtatgaatggcctggagctagcttagctaaatagtaaccagacagatgagcgttcaacattttgccgtttggggaaactgacccttagttcatttccactcccttccttctagtatcctctgaaggaaattgtggtcatccaccaagacccagaagctctagaggatatcaggtccttggagaagtatatcattgaggtaagtgaggctcagcccagtcagaattttctgtttcctagaaaattattctttggtaaattgctacatgcataaccatccatgaaattgttaaaaaaaaaaaaaaaaaaaaaagccaggcgtggtggcgcatgcctttaatcccagcacttgggaggcagaggcaggcagatttctgagttcaaggccagcctggtctacagagtgagttccaggacagccagggctatacagagaaaccctgtctcg

SEQ ID NO: 21969 - DNA, 1068 bp, Mus musculus
tgatgttgtgtttctgatcagagaggcattggtggaagcccagcagagagtaagaactccttccgtagtatccctggccagaagtcctgatcttgatgtcatgtaggctgatagagaactctgtcctagccattcccttctggggataactaaatagtgccaccctttccctgtcagtgtgacatcagagtcagctaaaataggtaatggtgacacctaacatatctgttccgggtaagtgattcaaagtgcaaaataagggttgtaaatataaaagtttgtgccttgcaaaggatgagggcagatggcttggtagttttactccttggcccactggggtttgccaaggcccctgtaagcgggaaagtggtatttggttgtgtgagggttggaaacccctttacggcacttaacttccagacttaacattttctctaaagttttacttcactaagtaagctcttatttccgtggccttccaggtggagtgttgctcctggagaatccgaaaggtgataatcagctgaacctggtgaaactgaagactgttgttaccagcgtatttggtgttaaaaatgcaaagctgtcagtcttccacggtgaaacaggtatgtggggagctagaggacatcttgtcatttgctcgaggtggcttcgaggtcttcatttggtgtccactgtttggcagagccgtggtcttttcctgactctgaggcaactggctctttagcagtgcctgcctgctgtgtctctcctgtgcccttctctgtggtatggctgaaacctgggacttacaggaagccctcatcctcccagtccctgttagccatgaggcagatcaggactcagccctccctgctgcgctgtgaggttatcggacagttcctgagccttactgagtccagacctgggatccgcttttaaagaattacaacctgggtctgggaggtggctcaggccgtaaagctcttatgtgatgaatagcgtttggattcccagcatccacctataaagctgcattagcggcacagcacatatgagatcccaggctctcccgtgaggcggtag

SEQ ID NO: 21970 - DNA, 2082 bp, Mus musculus
gtctgtgtctcaaaggttaccaaccagtccacacacttcgcagctccctgccctcagtcacctcactaacataagataatatgtaatcaaagccgtactgtaagcaacaaagacaaacctatcaggacgtgccaagagttgagagattccccactaaaagctaggacagaagtcaaagtggccttagaatgggcctcaagataggcagttaacatttttttatatgtttactcatatagaatattgactttttgaaatttttctctcttctagaaattacagaagatatcccaatgaagactttgaatatgaagactgtatatgtttctgtcttgccaacaactgcagatggctaacagctatcagtatgccttcagtcagtcttccttgaatctacccatctccttatacacacactcacacactcacactctctatgtctctctctctctctctctctctctgtctctctctcacacacacatacacacacacacatgggttcagtgaagttatctccttgggcacttgtcaaatatgctgcttttaaccggcgattctaatgggattgactgactggagacctcacatcatgttcacatttaaccttaaacacctatgcagtcatgttgggggagtgtcccaatgttacctcaacaccacgaagcttatttctatactggagttcttcagtatagaaagtggaagtggtttaaatggcatagtacatatacatatatatatggccttgtaaaacagatttgagaccttgtgaagaaatggatatgttatatatttctgctacctggattttcctgggtaatttgatggaatattttacgtttgattaaatcaaaacagtaaacactctcttagatactgtgttggaagtagttattctcccatagtttaatgaaacttgaaatctgtaatctttgaaagactaaatttaaccacgtctacatattaagacatcgaatgaacatcgaatattacctcttcccaaaattctgggtcctcaaagaagcagctgccaagacaaaatgagatggttgtacactttgttatggcagtagacataagtaatgggtgtcagcaggagcaggtgttacagactccacactcccacagtcggacagggagaaagggatctgggaaagcctggggtgcagaggagcgtggatcacagcagagacaaccattgctagaaaaggaaggaaggaaggaagcgggaacactgggcgtctagtgctcaaaggctccactgtacagagctgggtcttcatgccagctcgctcaggacttagggctcatttatagcatggacgtttttgtttaaccttattttaagggtgctctggtggagttcttataagtacatgcgttgcatgtctaagaagtatctgaagtctccgcccaggggtgtgttttggtattataatgagcctctggactaggacagcggagggatttagtttgcttcttggggtttccagccatcttctttggcagtaggtttctgatcgttttgtaacatttgtgggaggctttcttgccttcactctccactctgctttcctaactcacaactctgtaacagtcattgcaagcacaaagttatcaggcaaagattttatttttttattttattttattttttttagcatgtcagtttgaaggacagcctggtttagtgtccctgcctctcatagtcagtgtctaggaacagcttgaggtttatggccttggcacagatgcctcagtgtatgttacggtgcggtagctgaatgctagcagccaactcatcagattcttcaaaatggattctttggaaaagccatctgagtgatgcaggcccacagccatcaaaacaccacaaacccaccaattggacgagatgggaaacaacaacagctaaaataggggagaactgaaaaacggatgggtgggtgactgaagtggtagaaaagtggtggaaaagctcaattgtaaaagcaacaaagcaacgaaaacctaagcaatgtccagctcagaatcctcagcaccagccgagagactgggagaactggtgagtggagaaag

SEQ ID NO: 21971 - DNA, 3099 bp, Mus musculus
gggggtgataacgttttctccagttcaacaggagtgcttgacccaagtcagtcatatttataatatgcctgctctttgtttaaaattaaatttgggcacaggaagcacacagagacatttaggttgtttaaaaagtcagaatttctgagtaccatttcagtctggaggcttttagctgagtccaggtataaattagccataaacagtcaatgacccacagtagtctttagtaaactgttgagaaatctgggtaaaaggctgccttcaattctaagctttgtttttttgtggtttttgttattatttgtttctgttgtttactctttaatcgtaagtacttttaaaccacgacccaggtccttggttcacatggaataataaagatgtgtttttagatggcacattggtccatttgtacacacctgtcatcgggatcttagtacatggacttaaaaggcaacactacatcaatggtttgtatatgtggtgaattcctgcaagaacagtgcatttgtattagaaatgtaagttttaaggatggccttgttgccttctatcaagttctctgggactttgtaattttgattactactattgatacatggttatggtcagaaggcctcttctcccttcctccctcactccctctcctcctagctttccccacagagaatgttagaccagtatggcttcttgccttgatcctgttgtggcagtgtctgttcctgccccaggtgtgctattcacgcaggtttattccctccatggcctccgggctttgcatgtctatgatgtgtgtgtcgctgggaaggtcatgcttgccagttatgggtggatcgcagctcttcgccatcaagtgcattcaggattattcctgggaggttgcttaaagctgaaatagaactgaaatgcagttggtagactagccaaacatctgcttgctctcactttgttttggaagaaccatggtagcttgtcagctggtagaaagatggtttgtaaaaaccagtttctcacggaggttgaacctatctgtggctggacagtcttggatactgtcaagcaaacaccagaggcttggccaagtatagttacaattacctagttggggttcttcctgatgcaagaaatttttcactgttcgaggcacatggttattggctatccatttagttttcacagaggctgaccaccttacactgctgggtggtcacaactgctcaccatgtgaacatagtacctcagttctgtccttggctgcaatcgttgtgtgctcagtgttttctcataggcaccagggacaggcttctcaaggcagtatgatataccctagtctttggtgcctctagtatatgtgaccaggtgtcgtcctgcatgtaaatctccgagctgagtctgactcacagcccatgctgtcatctgtggcacaagtgggtgtgagtacgtcctgcatgcactaacggtgcagaacatggcatggtgactagaaagtaaaactccttttgaagtgtcccaaggactgggtcagttagaacctgtctgccactatctgatgacttacattgtggttttctacaagccacctcagttaactttggttccccgtggactcccaggctggaggaggaaagcgtgaggacggggatgattttgatcacgattccatttattgcctttacataaggttgagggaaggggaaggtttggtttgtttgtcttttaattgttttttttttcttttttttttttttaattcccccaccccaccctctttcttttggtggcttccaccacccttaatggtgacagactcctgggcctgccaccttggacttcccttaggctcacagttcagatctgcatgcattgcttgcattgttctggtatctgaatgttgattcctcatttaggagttcagcattaatttccaaaattttcatggggcttgtggcaacacgggccgtgaatctgtgtataaaatttactggccttcttcacttacctgctctagtatcgtatcgtgtgtgcgtgcgtgtgtgacgtcaggctgccacgtaaacttcagagaagaaccttaaagcagaccatccatttttgcatgctctcttctaagtagaatgttcaatgtaactaaaactaaaattgcatgtcaaagagacctaggttctttctttctttctttctctctttctttcagtttgcttttggtttcctgtatatttgcttactgtgctgttctagtggttgtagggtaaagacgaactggtgaagcagtcgtagcgccgaccgaaggtgattccagttgtatatgtcacgcagcattcgaagggactgtgcacgctctaaagatcacagttgcttctaagccagatttcatttctattcttgttttatgtgccaaaccccaaagtgcattgggcctgaatctctgaacactgtagacccattagaaggaagattgttctgaccgtcacaaattgtagtgcctgaaaacacttaacactgattgtctaagagatgaaagtcctccaaagatgacacaggaaaaatactacaagtaattgtggtggaaatgtctgtgttccttgggaatgctgcgctctctgtagtttccatcattggtgcagttcgaacgaatgagtagagttcagaggtcttcgtgttcacatttaaaactagataaatgacctcattttcttgagcttgaattcatttttaattttaattttattttatacaacgtgtagacggttccctgttctctgcatttagaagtatacacagtacaactgttaattctgtaagtaatttttataattatgatgtaactcttatccttccttaaaacattaaaataaaccctttatgtgcaacttgtggctgtgaactttgtgctgctgtgttgaatctgctgaaaggggtctggaagtcaggcagtgtttccaccacatggaaatgtcagggttgatagaaaaagaaggaaatgaaggtttgcttgagcggtgacagcagtgccatctgatctgggccggcattgctgtcatctcggatctaactgttgatgttttgatttgacattaataagaaatgttagttaac

SEQ ID NO: 21972 - DNA, 1200 bp, Mus musculus
ggcaggtggatttctgagttcgaggccagcctggtctacaaactgagctccaagacagccaggactacatagagaaaccctgtcttgagaaagaaagagagagagagagagagagagagagagagagagaggaaggaaggaaggaaggaaggaaggaaggaaggaaggaaggaaggaagaaagaaactgtcattatttaatctggtgactgagcagaagtaatggtcactgggggtttgctcagtgagaaaagctttctggaaccttctgtagttacctagtgtatgtgggactttggagtctatcctcagcactaaaaaaaaaaaaaaaaaaaaaaaaaaaagggcatgaccaatgtcagagacctgaaattccagtactaaagaggctgaggaaggaggattacaggttccagagcagcctggactatatagttgtcttggttagtcatcttgacacaagcaaggaggcaaggcccgcgccaaggccaagtcgcggtcttcccgggccgggctacagttcccggtggggcgtgtgcaccggctgctgcgcaagggcaactacgcggagcgtgtgggcgccggcgcgccggtatacatggcggcggtgctggagtacctaacggccgagatcctggagctggcgggcaacgcggcccgcgacaacaagaagactcgcatcatcccgcgccacctgcagctggccatccgcaacgacgaggagctcaacaagctgctgggcaaagtgacgatcgcgcagggcggcgtcctgcccaacatccaggccgtgctgctgcccaagaagacggagagccaccataaggcgaagggcaagtgaggccactgctcgcgtcggcccgcgtctctgtgatataacccccgcgagctcccaattgtcacgtccactcttgaccagcaagaacgacacgaccaccagtccttctaacagcagtttattcagcaaacttccgtcttcatctctctcgcttcaactttatctctctttctctcttccccaaaccccgggcctctcactcttatacattctcagtccctatccactcacagcaggccacgtcacctcaccaggcacacagcttcagccaatcagggcggcaggggcatgtctccaccaaatatggacttgtttaaaccaccagcatcatggtgcacctgtgcagctctcacgatggtcgtggct

SEQ ID NO: 21973 - DNA, 1196 bp, Mus musculus
acttccacgtggggccttaagagatcttaactctggaggtctgcttgctgtggccagactgtgtggtatctcctgaggaggagacccaaggagtcaccaacgcatttcagcctggacttggatgtgacttatctgttgcgggctccatccttctgaatgtaccaagctgctgacacggtgcactgccttcggatgccgctacccctggtccagggaaggcaggtggtgatgtgctatgcacatgcacattgggatgatgtctccctgcgttcacactacatttattttccatagaatgggtgctcatgtgtgtgtgtgtgtgtgtgtgtgttcgttgctgtgttgtacaggatgtatacgattgattttcccaggtggaacccattacaaagtgtcagtcttccacacatcattggtccaaacctgcccacactgctgtcccaggttcagcatgtgataaggtcatgtccccttcccagtgcccttgcactggtgttctaactcatagctgtgaaaagttactaaagtattctgtattctcaaaagcctcacccaagagcagcccaggtgtgtgggtcttacccttacattcctgcacccctcctccctcttgggtcccttgcgtaagcttaggtacacctaagagccaaattatgcgatcattgaggcatttctgaaagccacagaaaagccagccgggatctctcggaatgcaggcaccactaaaggaagaactcctaaggagaggcaaggtgctctccactgtgggcaatctttctaggggactgcagtctgtctgctgcatgtagagagtttccagcagtgacgttcacaagccagcccttcatctgtatggtcctgagttcaagtctatagagagaagcttgaggctgcttgtcccctttgctgtcaccctttgctggcaaggagctggagctgtcagcaaagcttctcaactccctcagttatggaccctgtccaggactattcagtgagaggattccgccaggctgggaggcgtgatgtagttatttgtgtgctctttagagagaaccattccaattcccatatgatggacactccagccactctcctccgcttggacctgcgttcatttgtccatcctgtaaagaaaatgcgtagaagacacctctgaacatcccctccccaaggattccgcccacagggcacacaga

SEQ ID NO: 21974 - DNA, 1126 bp, Mus musculus
agccagcctagcaaatgggtgttggggggaagagagtagagctgaccagggacctgagcagagtgagcatctgtcactcattcctgcctcggaaggagctttggacctattagtgtctgtcacttgggctgttctcctgtttcagttgagatttggaaaaagcacctggaagcgtacagtcagcgtgccctggagctggaagactcactggaggcgtcaacctctcagatgatgaacttgaatttataagaagagttcttgcctgtgtgtctgtgtattgggtaaggatgggagaggcaggaaaagacttccttctcagttctttactgacatgatgtatttatgtgactgtagagttggaaattcactgggcctcagggcaaaggaagcacctggttgtagcactgagtccatcagatgggcactcagatgcgcccgtgggcacctttccttaagagcctattgatcagcttcggttctttctctctgcactctggatctggaaaacgctggagaacgtggtcctgggtaccgtggctgcctaggacccactattacagtgctgctcaaccaagtttggggatggtgaaccaggagctgtgctccggggtgtgcagggcccttcctcgggggtggagtcctgccattgtgctgccaaggatttgctaagatgagcctcagaagaaaattagtttctaacatgactttttgacataaattaatgcttttagtttttattttccaaagaagcagtatatatcaaatttgtagatttcagtttggtgtctacaaatctttttaatgaacataggatgaatgtgtttctgtcctagaggacagagcttactaacatattttcctgcaagcaagagggcttatttgttttgaataaagagtgattatttaatttcatctcaggctattgtgatcttaggtgagtggtatcagtctcacaggttagcaatggagttccttactgacttggtcctcttttgcactgcggtggtgtgacgggcccagtcatcatacccagttccagacccagggactatggcatccctaatagacctttgcgtctcttttgcccgagtctgccccatgtcaggaatgcagctgcactcaacat

SEQ ID NO: 21975 - DNA, 1893 bp, Mus musculus
gaaggtagtaagatcacatccaaaatgccggttgcatctacccaggggtcctctccccctaccccggctctgtgggcaacctcccccagagccgccaccctacctcccaagtcctcctccggcacatcctgtgaaccaaagatggtcatcaacacggtcccccagctccactcagagaagacggtgtatctcaagtccagtgacaaccgcctgctcatgtctctcctcctcttcatctttgtcctcttcctctgcctcttttcctacaactgctacaagggctacctgcccggacagtgcttaaaattccgctcagccctgctgcttggaaagaaaacacccaagtcagacttctctgacctggagcagagtgtgaaggagacactggtcgagcctgggagcttctcccagcagaacggcgaccaccccaagccagccctggatacgggctatgaaacggagcaggacaccatcaccagcaaagtccccacggatcgtgaggactcgcaacggatcgatgaactctctgcccgggacaaaccgtttgatgtcaagtgtgaactgaagtttgcagattcggatgctgacggggactgaggccagcgtgtcccagcccatgcccctctgtcttcgtggagagtgttgtgttgagcccattcagtagccgagtcttgtcactctgtgccagcctcagtcctgtgtccctttttctcttgggttgagcctgtggctcatcccctttgtccttttgggaagcaagtatctattccagtctcaagtcctgcagttgctggagcgcttacgcacctgagccctttgtgtcctgggggagagatggccacctccgtgggctgcgaagagccaccccttcctcttccgattctcctagcagccactcagagataatttaattccagattggaaacgcccttttagtttatcagattggtaacttacatcctgctgcccagatggcacggacagttttctttcacttaattattattttttttttaaggattttcgctcctattgtgttgatgtcttaggtcattttctttttttctttctctttttttattaccagaggagatgttttaatattcatgagaagaggaacattttctagatttttttgttgttatatattgagatataaaatatggctatgttgcttaagattctcagggatagacttatttttgttaacttcattctttcctgctgttaggaacataggcctaaaattgtctcttgagtttgctcacccttttgttttggtagggtttttttgttgttgctgttattgtttctagtttttaatcttattcattttgaaggatttttctttctgaactttttaaatttttatattttcctgccatacatctacaaagtgggttttgagtgagggcaggtggcccagtggctttgggtggcgactgagctggtcccacgaggggaggagggtttatataccccatgaccctgcggcttcttggcgcctcctgcccatgaggatcacatcctgtctctccttgcttccatctctcatcactgcccttggacttccgccttgactgtccatgaaagacagaaatgggttgggtagttgggctcccaacctcggatggtgaccgcaacatcccgtgtgggcggccggccgctcctgcagcccgactctcctgccagtgtctttcaggatgtcaacgggtggtacgattctggcatttgtttctcgctcaccgtgtgtggaacactcattccatgtagagggtgacgaactctggattcccccccacccccaccccgtgccgtgtagacactcatcttctgcatgacatgatctaccattcggtgtaaacatttgtgtttataagatttactttgttt

SEQ ID NO: 21976 - DNA, 1189 bp, Mus musculus
cacactgggttgcacccaccctaattacttagcaaataagaaaatggcccacaggctgggcggtggtggcgcacgcttttaatcccagcacttgggagggagaggcaggaggccagcctggtctacagagtaagttccaggacaaccagggctacacagaaaccttgtctcagaaaagaaaaaagaaaaaaaaagaagaagaaaatgtcccacggacatgtccacaggctaatctgatataggcagttcctcagctgcagttgtctgccccgcaagtgtggcaaggtgacaatgaaaacccatcaggacactgtcatttaggtcttagcggtcgggccttgtggcctattctgagtcagtgagtccttccctccatgcagtgtttgactgtgctgtcttcccaggagctggtggagaagctagcagcccctcccagtgcctgagtcctccttacacttgccatccgtctctcatacacaggggaggaagtttgtctatgcaggctccaactctggagtggtccaagcgcccctggcattctgcgaaaagcacggtagctgtgaagactgtgtgttagcacgggacccctactgtgcctggagcccagccatcaaggcctgtgttaccctgcaccaggaagaggcctccagcaggtatgcctaaggatggggctgtgtgcctatgccccatgcacaagccatagagtaatgtgcgcctgctgtcttctaggggctggattcaggacatgagcggtgacacatcctcatgcctgggtgagtggatctcctttgcttcccacccctgggctggcaaagctcccggggcgtcagttccatggttttcctgtgcggtctgtcttcctttctcctctctgaacagaagtcaagtgtcacgcagcagacctgtgacctctccttgtggtgaacctgtgatctttctctgtccctttggttacagaaagagggctcaaaggcacacagggtgtatcggttcactggaaagcacaccctggcccacaccatgctcctctgttctgcttagctgggccccgtaaacaaaactggagcctgctaggaatgagagcgaaggagcccttgggtatgaccagatagccctagcctaaaaacaatactcaggaacagtgtgggacagtgtcatgcttcaagatgaaaatcctaccctagaaaga

SEQ ID NO: 21977 - DNA, 1207 bp, Mus musculus
gtcttgctgaagtcttacagatgagaacacagcctctgacaaactgtaaattctcacctcctcaccttaaatagtgagggtggttctgtgcatatggagcccccacagccacagcttcctgaagattgacccagtctcagacaccaagtattcaaagacacctcagcctctgtcctgtgtgcacgctgtccttcatgccctggttccctgacagtacagtgtatttatacaacattcactatgtgctatgtatcatagggaatctatgtgagcacactgttgctgtcttcagacacaccaggaaaggacatcagatcccattacagatggttgtgagccatcatgtggttgctgggaattgaactcagacctctggaagagcagtcagggctctcaaccgctgagccatctctccagcccagtatcataggtaatctagcgatggataaagcctgtgtgaaaatgtgtgtgtgtgttggtttgagtgagaacagcctccataggctcatatgtttgaagacttcgtctgtagttggtggaactatttgggaatgattgggtctctctctctctctctctctctctctctctctctctgcaacacaaatgtgtctctctctgcatgtggatctaaatgtaagctctcagctactcctctagtgccatgcctgcctgttgccctcttccccaccataatgtctcaaactctgacccatggaactgaaagccctgataactgggcatggtttcctttctaagttgccttcacagcaataggaaagtaactatgacaacaggcatgttctgcacaatgctaagggctcacacagctgcagagcctttgtttctttgagtttcagagttctgtacttcacttctgtttcattactctctctctctctctctctctctctctctctctctctctctcggggagatgtgagcaaatgtctgctcaccccaaagagaccatttgcaccaagtctagcttggtgtcttagttagggttttactgctgtgaacagacaccatgaccaaagcaactctctctctcttttttaaaaagatttatttatttattatatgtaagtacactgtagctgtcttcagatattccagaagagggtgtcagatctcattacggatggttgtgagccactgtatggtttctgggatttgaactcaggacctttggaagagcagtcaa

SEQ ID NO: 21978 - DNA, 1767 bp, Mus musculus
aatgattacacagtgtggtatcctgacagagcgggtgagccatctcaggtctgtccccttatgagccccgtttaccatcccagattcccccttgggacccccctcatctggatcattcccctccccccaggccctatctccaaacacctaggtactaagtgaacctaggtactaagtcttcaacacatgaattctgaggggacacattcatactggagccgatggcagcctggtgaccaagaccatctcaggatgagtttctgaatggaatcttcattcgccataaaaccagagatgtgaccttccccacaaggaagccttgctaagtgcgacattgagctgaggacacacaagctgagaattccccctctgtcctcctagccttggctaactactgaccatacaccgaatgtcacccattcacggcacttttgctgaggacctaaaagctacaaaggctgcatagccttccatctaggtctagggacatgtacagatgggagcatctcaccttcacctctgagacactgggacattcacagccagggatggtacaggagtccctgctggtggtgggctcaatgaacagagacgatggtgaaatgggtgcctctctttagaccagtggttctcaaccttcctaatgctgagatctttcaatacaggtccttgcgttgtggcgactcccaaccatgaagttattttgttgctacattgtcactgtaattttgctactatgatgaatcgtagtgtagatatctgatatgcaggatatcggatatgtaaatatctggtatgcaggatatgtgaaatgagggcacatcccacaggttgggaaccactgcctttgatagggaggcactatgcttagagcatggttaggaagtatttagaagctattggtgtgtcttggaattgtgttagtaggtcaaccgtcctgtggagggaaggaagggggtggaggaaatccctgtatgttgaattcattgagcagacctgcagaacacagccttggtgaggaagtcccatgggtcagaccacctgtagatttagtcaggagaggaagggccactgtatagttatggagacaggactgtctgctctgagcaagaagttctctgctgagctcctagcctaccttcccttgtccccagggctatagaaaggccacctcgaagaccagggagcatgtgtgagaagtctgtggaggcctctgccttcttcctggcctctctagcagtgcctctccttcccagggatttgggactgaccgttatctggctatgactgagcagagtggagggatgggctttgccccccttcagaaagccgaaaccggttcccatgtgcagagtcacatgtggccatcgaccagggctctcatctggtgaaaactgtgtcttactgtcaagattaattctctcccctgggccactgaggagggcagatggcaagaggatcctccctagaggatttagactatgaatgcccactaaatttgcaaggtcagaaactagccaaggtccttctcaggcatctatccttaacttggtctctccacaagctgcctctgatgctccgagccccttctgcctggcagctgggctccctgtgtgcttttacctatgacccttggtcagcagagtacaaggagcacctaagctgcctcgccacctcccactgactgcaaacaccacatacctcatgcggaaccgaatgtctctccagtaaacaccccagccagccattcataaaaacctgtctctg

SEQ ID NO: 21979 - DNA, 1157 bp, Mus musculus
tatttggggctggcttatacttttagaggttcagtctattatcaacatgtccggaagcatggcatcctgcaggcaggcaaggtgctggagagttttacatcttttgcactgggcagagcttgagcataggccctcaaaacccacctccacagtgacacacacttcctccaacaaggtcacacccactccaacaaggccacacccactcatggtgccacttctcatgagccaaggctattcacactaacacactgtcagagtttttggaaaactgtgtgaaggtacattttaaggtctttgtcccaccagaagtgtctcttacactgctagttgctaaagccagaaacccagtagatactgctagccctgccttccagggtaaccagccctcaatcaggtttgcattcccacatctcgaataagtcttgaatcttttcagttcccttggtttgtactggtgtcagcctccagatgggcagccctgccccgggatcacatgagtatgtgcattgtgtagaaccagtttctgttagctgctactccttgttcttaggctaaagagaactttgatcttggcctgcagccgttttttgacctgtgctgacttctttacttggttgaccgcttgctcttctcacccctcccatcatgcactctccgtggctgctttgtgcttccttctgtgtgtcctctgccccgaattcagtctctctattattcatttttcatgtatgtcaaaatatctgtattgtacagagataatgtaaataaggaaggagttgtttttgggctagtggcttcagaaggttcattccttggtggtttgagcccaccatgcatttcggcagaacaccttactggtaggaatgtaccgtggaggaagctgtttctcctcctggaggactgtgagctgagggaaggaagataggaaggggccagggaagatataaccccacactcagtgacccatttcctccagccaggccccccccccccccccgtctttgctactttctcataatgccatcacactaagactctatcgggggtgccttcattcccgtcagtaattcataaacaggcaggggtggtcacagccacccctagaggtgtccttcagtagttctgggcatatcttaatccagtcgagcctcttt

SEQ ID NO: 21980 - DNA, 1102 bp, Mus musculus
gggactatttcattcttctgagcctgagatctgggcatggcctctttgaatctgcacaggacagaggcacgtgctccatcttcattccctccatggcagaatgccacgtggatccccccatctcccccgtgcctgtgggctagaggttttagtcagctccacgagccctggcaggtggacagaggccagtcagggtaggtttagcatgctctgtcaggtttagcatgctctgaggactgcatggggtgtttctagaacaggtagggagggagacccaggcctgaggcttctttcccgaagactctaaggatatctgatctctgcggttcatctgggtgttccagaagtgggcaactccttatgctactaagctggtggagatggacaaagcctgagttaagatttagatgtatcttaggatagagtttgcagtaaacacatgtgcagcttaacagacacatcccaggttctaacgcctgtatggaggcggggtgaagtgtgttctcacgtggagctgagccggactctctttagacagcaaatgtggcctctgaggggcacaggaccaggcctgggacttgccctagttgcctgtgcagctccattttgcttctagaacaggctgctgttgacatcagcatcctggcctgggtggttggatgtgggggcctggtgggtcccataggattcagtccctctaatgctacccttcaggtcacatgtaaaacccttaggtcttttgggtttcctgccagaaggcagggtggctctgttgttcctttctgaaaaccctcagggcaggagggctctgcatacaggcttgccagcgtccctggatgctcaggccgataactttctgtttctctcagaccaccagtgctacaacggctctggcgccgattacagggggatggccagtaccaccaagtcaggccaccagtgtcagccttgggctctgcagcacccccacagccatcgcctatccagcacggaattccctgagctgggaggaggccatgcctactgccggaaccccgggggccaggtggaaggcccgtggtgctttacgcagaataaaaacgtacgcgtggaactgtgtgac

SEQ ID NO: 21981 - DNA, 1142 bp, Mus musculus
agttgctcgtggaggctggaggtcagcctcagctcctctgtggctttccattttgatttttgacaagcagtgtcctgtggatcctggaggtagccagcatggataggcgagccctagaggtgttctctcgccacttctctagagtatggataacagctgtgtgcattgtgtgtgggttctggggatagaaattaggtccttctgcttctctaggaggagctttaccagctgagcatctccccacttccacctccgagaactagtttacgctacagaatgtgtagaccgatcgttagtttctgaccttgtcatgggctagggcgacactagttaagagttgcctgacttacaacttgggccctggtgctgcccaccagcaggtgattcttgacaaggaacattgaggaaagtctctgcctggtagacagaactgtccccagaacaatggaatttcagttgggtggagtgaccatagcccccctgtctttctgctgtaacctcaggtgacatagaccacagtacttcgtctttgctggggcccaacccatgctgcaataggctattcatatctgtctgtctggccctctgaatgtgcgcctgtccctttaagaggtggtgggtgtcaactgtttgcaggtctgtcttccctccacattccttcttcttcatcttcagatcttcaggctctatgttgagtaacctaatatgtggaaagctaaatgaagcttgtaacagagcttcacatattgggacatagcctatcgaggcagagatacaatctctgagttctggatgttcaaaattcagatgtcagcaggagtggccccttctgaggcttagaggtacctctgtccgtcatctccctgaactttgggagtttcaggtggcctttggcatcccttggcacttcttgtcttagggtgacattgttcaggcttctgacacttttcctgtatttgtttgtccatattcacacctgctttgcaggaccctggccagtgcttttgagcccactctgcttgtcttaagttgaaaagatacccaatgaacccaagtcagagaagaccacacccaccgttacctggcttcagagctcagcgttaagatttggggaatggattcaggctatagttaagatgaag

SEQ ID NO: 21982 - DNA, 1124 bp, Mus musculus
gtgttgactgtccctcccaagtcagttgagagccgtgctttttccaggacactgctaattttacagaaccgacccacggcccatcgctagcctcctcttcatttctgattacccattagagacacgccactctgctttttcaagtctgaacataagcactgatggtgtgggctcctgggtgcagaggagagctgcgcctttactgggaccatcatctttgtgcgcatgcgcaagcgcacctgcacgtgcgggtaggattttggtttgttttcgggctgtggcgatgagggccaggacagtgtgtgtaggagatgggtagtggaggctttcccctggtgcagcagtagaggttagactgtgtgccttcctaaagaagccactgagttggtgcttaggcagtgtaagccgctccaagggtggccccgcatatttgctgatcaaggcattagcaaatgtctttgcggtggacccacggtatgccaggcgatcacttggttgattggttggtgggtcaagagcagcgaggcctccacttctgcttcgtccaacaaggagactgtacctgaagacctcagggctgtgtgcctgcagggccctccttgggcctcttgtattgtaagacagactccactggtttagagctcctcttcctcctgcctaccctctctcagtgatgtttttgcccagagacataaggcaggacacattcctgggccagactggaaaagcagtcatttcctggcagagagcgtggtcctgttataaagtggtctcctgtgaacagagcctgcgctgttgagttttattggggctgtgcttgtcttgagccccatgggagtccgtagctgcagcaaatggaacttttcagcggacctgcatgtgtgcagcagaccacaccttcctcggtctcccagcctgtggttaaatcacaaaggaatccgtgggagggacctacaccctttaaggtcttgcaggtttccccaatactcaagccacacttgggtttgggtactacatgggtcttactgagagtccttgtgactctcgggggcagcccttctacactagaaagcattttgtccctaccgtgctcctatatcttagtctttgagagcaaggcttct

SEQ ID NO: 21983 - DNA, 1217 bp, Mus musculus
tgccaatatgtatatgcaccacatgttcacctgatccccaaagagccagaggaaaacctcagatctgaatggtgttgagagggggtgaggggctgccatgtgagtgctgggaatcgaactctggtcctcgggaagacaagcaaatgctcttaacttccgagtccacttccagcccttcatgggttaatcttctgcagtatttctcagttcctcctctcctgtcacagaaggacagaagtttaagtaaggccagcctgggctttcacgggggacacaatgtgttggggaaggagatggaatgactccttcctcatttgactcccacaaatatttattagctgacagtaattgtgtatttatagggtacagtgtgtgctttcatttaggcatgcattagaggaagattctgccacctaattagcatataagtcaccaggatgatggtgtgtgtgtgtgtctgagtgtgtgtgttattttgaaatatacaacacttctttaactggtcaccacgcagcactgaaatgtattcctttgagactttggtaaacactttccccgtccttagcccttactctgacttgcacccagacaccctggtgtctgccttctgacccgttatttatacatgattatcaaaccgttgtcctggggcctcagtttctaaaggaaggtagtatcaaattgagcttcccatgattgtgagaaaatatcagtggccctggatttataaagcaagagggtggagccggggagacagctcaggggatgaagtacgagcgtgtaggactggaacgtggattcccagagaccaagtaaaatgctgggctggcctggtagcctgccagggattccagtgctcagaaggtggagaccggagaaatccctgaacaagctagttacatacctagctagactagcccttatgggtaagccctgggttcatctgagggactaacgggaggaagtaatgtcacctatcaggaggaagtgatgtcaccgagggcgcatcctagagggatatcgcatctcccggggcttcttgtccctttctgcttcaggaccactacaaggtgaagatttcttctatactgtgtgcgctgcctgtatcctgtctcagtgaatgttgtggagcaactggagaacgctggatgtcagcctccccttggacctccgcatgcatgcatgcttgtaggtgcacctgtacctgcatacatact

SEQ ID NO: 21984 - DNA, 1109 bp, Mus musculus
gtgggatggtctttgggggcactaaatgagttaataggaaactcttaggaccagtgctcggctaagagagcttgagagatgggcgtggtttagaataatttctcaaaggctgcctctgttctctgttccctgttcaaagtcattaaaagattatatttttcttgttacactttcaaagatcctccaaatctacaaagcaccccccccccattctgagacctcacccatgctagaatataactattgatctgtatataccccaagtcctagaggatattttcaacgatttttttttataccattgactactgaagatggcacaggatatgtctctaggtaccacaaggactgcatctatgaaagctaacttgtacattcaagttagtgtgtagtgtccccgtggtctggctgtctcccatcagaactcagattaatttttttcttgaaagatttactctgtctgtgtgtgtgttagtatgtatttgcaagtgccagcagaggacaggagatggcatagagttctagaattctctggagctggagttagaggcagtgatgagaaccaagatggatgctgggaaccaaactttggtcttctggaagagcagcaagagcgcttaagtgtggagccctctctccagccttcacagtgaaattaagcccattgtgaggtctgagaaggtggaaacttaatttgtggtgtttggagtctttggcaggtaattaaggctgactgaggctataagggtgggccctgatccagtatgtgtggggggtatctgtggtgcataaggaggagaaaggtctgagctgagatattctgtgatgtcctgtatcaactgcactctccactagctagaaggacctcactaaatgcagctgcttggtattttgaataaacccttttccttaatcattgaccagtccgtagcttcagctacagcaactgaaaacatattcaccttgacccaagacccaaactagggatctacttccagtctcctccccaagcctgtcacaggtacctctggactgatttttggttcttgctatgtctgacctcactttgtcctgggggtggggggtgtcgtggtgcttttcactgtgac

SEQ ID NO: 21985 - DNA, 1133 bp, Mus musculus
gtgtgaaatgtatgattcaacttttccactgtcgggctcctattttaataacggctttctgtgatttacatgccagagaacagcacttgaagggaaacaacccagtgttctttagtgtgttcagtcctaaaactgacaccgtaatcagttttagagcgttgtcactgccccttaaagaaaccttgtacccgttacagccatggctttctcagggttccggcagctgtgtgtgctttgggctctgtgagctcatttttttcccctgatatttcatataaatacaatcatttccatatgtggctttttgtggttgatttctttcatgcaatccagtgttctcaaggttcattcatgtcctgtgagtgttggaactctgttcctttcagaagtaaaacagttttttgtttgtttgtttgtttttagaatagttttaagttcatagaagtataaagtcagggctgagatggcttagccaggagcagggacccgagttcgattcccagaacctctgtaagaatgtgggtcacaggagtatggacttgtaatcccagggctggggaggtggagtctggtggtcctggaggtcactggccaacaagtgtagctaaattgtccagttctagccaatgaaagaacccataacaaaaaggggggaattgtacagttgacaaagaagttgttacacaaccatgaggaccagaatttgagtctccatcatatacataacagacaggcacaggggtgtggggctgtatagcccctgcactgggagggcagggaggcaggaggaacttcagaatttgctggctagctagccttgctagtcttgctgagtcagtgagttctccattcaatgagacacccccccgcccccaaatggtagagaccaatagtggaagagtctaatactgactactggtatgcatgtacatgtacacacacacacacacacacacacacacacacacacacacacacacaccacacacataggcaaactctgcctgagaattgacagctatggttaacacatagcctccatgtgggtactcatacatacgcatgcacacctaagccacgcgtgttcatgaatatgtccgtgcatacatgcacacagccccacaagtgtaggc

SEQ ID NO: 21986 - DNA, 1961 bp, Mus musculus
acttgatacaggtgagtggggatggccgagaggcatggcttctgcctgtggccacagagaaccggtgtgttaggcttgcaggttgcaaatccctcacagctacttcctcctgctgcatggtaggaaatcagcagcaggtagaaggctggctcccttcagagccggaacagtctgccgcacaagcatgtgacctcgtgttcctgtgctttgtctttctcagcatcagggttgtggtcactgtggagcagacggaggaagagctacagagggctgcatccaccatcagggaggcggcccaggctgtgctgttgtaggctcctgcccagtgcttcagccatgtcacctgcggacggaactactcagagacctccagctgcccagggtgtggctgtgcttgaatacacagccagagtggatggttgtatccagcaggagctgacttgtagaggatgacagatgacagcatatccctggtgtttctgcagtgccgtgtgctctgtcaggatgcttcactgtcatttgtattcgcttttgtttaaaactggagcttccattttccctctgtcgtctgtgggaatgattcaataagcacttctccgtatccatagaaaaggactttgcagctaagagggactctccatgtatccagttactgtgggagactgagagactgtgtcctcccctgtcctcaggcagagctcagtggtggctgctatgcagatactctgtgtgtgttataaacgtcatacaacatggtgatcctaggactctatgtgctccagttactgatactgtcctgtctaatctgagcttcactaacagatcttcataccgcttcctaagcaataatctgaatcaaacgttattttatttttgtgtaattgactttatattttttatatattctctagtcagttttgggaagagggttattattctgatccccaaatacaaatcatgcccttggtattttctaatatgtccaatgtcctttttcatggtggttttgtccaggagcatagacctgtgggctttttctaagctgagaaaaatgagacctttcctctttcactctataaattccagatgcctccgaaaaatagggatgctctaaacgtgatttccgagctctacactggctgccgttgtccttagcgagcgtgttgagtgatataaaggcttgtgacatgtgccacggatcgtgtgcatggaaggccttctcttgttgcacgggcagaggagtcaggtcatttaaatgtcattttctgatgtgcgttcatgtgaaccatgggtcggcatcttcttaagtgatctgtgacatttttaatgtttctatttcatacgtgccttgtgattgctgctgctgtgagggtacactcctgtcggggaaaagtctgttttggtttggtttttaatgaaataaacctccaagagcttacattcctgaaaaggagtctgtttggatagcagcttgctcagctcagcagtctcttgattttaaccttcattttcccctgtgtgtttttcttttgttttagaacataactaaatttcttagtcccttcttccagcccaaccaaagactatgtactatctcaaaattcgtaggttccttctgattgaacactgtctacttcggactataagaaggctggagtggggccagaagacttagctccatgggagagttcttgcctgccaaacacaggccctgggtttgatcctcagctggggaaggaagcttggctaagtggcagggcagttgcctctaatcgctgggaagaggcggcccagaggcagcacagcgccttaggtgctggccaccatctctgttggtgtactcccccagcttcccatgaaaccatcccatgtccttcaccatggagcccacacagaaccaacatgaagttcaagcctcaggatccctgtggcccctgggtcagacccagttaccatgtcgt

SEQ ID NO: 21987 - DNA, 1167 bp, Mus musculus
tctctgtggctaagtgagcatccacaccgtccccagtccccagtattggtgtgagactgagcaatagaaggcctttctgcaggcaggcagcagcctctctcagctaactcctctgttagagaacccacatcactgattaccacaaatctcttgtttcctgtctcaagaatactcctctaaagagtagtttgaactctgcccagtctcaaccttcaggacaaacaagcctttaactatagccattggacgcctgctctctgcatgctaaccaatccatcccgttacttcacctagccaccaccacaacctcacttctcaaaagttgtgtgtgtggtattcccagtcaggatgatcagtctgtgcgaagagggcaccccatctctgtatgccactcgggccgctaaccccagtaccctgtgccaccaccatcccagctgcagtaggacctgaaacaaactgaccaaatgggcaggaggaaggtggtatgcccacagtcccacgcaacagccccttccttggcccactcttgacccaaagtgaagctggccatgcttcctccacctgacatacacagggcgcctgagtaccaagtacaaaaacaaccctgttcctgcccatggctgacccaagtgaacttgggagtcagagtcggggtggggctgggaggaggtaggtttttcggttttctttttgttttttgttttgtttggggtttttgttttgttttgttttaaataaaactaatcggttcctgaagaaaatagaagtggagaaagtgaaagcactgcttgccgatggaaattgatactttaaaaagggtttggctagtagatcatagtaaatagttacattgtacctggccctctatcagccgtgtcaggcaagatgctgatgcagcgttactgatgaatctggtggcctttctttttctgggcgtggggagcacaggttactgcatccagtttgtgccggtagaaagccacttggactcacagtgagggaatggagccctgtttgttccctttgccacactaacaaaccacacatttagtacctaaaacaagtttatttactctcttagtgtgctggaggtcagaagtcagactggggcagacttccccctgggaagagtcactttgcatttccagccactggaagcccctgctc

SEQ ID NO: 21988 - DNA, 1167 bp, Mus musculus
tttccatggtaaagtgtctcaacctgttctcacctgtcactccgggtgcttctgtcacttctcaagatttctagtcacttggcttgcttgtagccatcttcaaccacatattttaattgtatcttctagtggctcaaggaagggttgtaattagaagcatcatccaagactggtctgttcccagctctgaggtttaactattaaatgccttttctaaaaagcccttctgagactggaatgggagtccggggatgtgccttgaagaggtagagctactatctcaaatcaaagttctggtatttgaggactccaaagtctgtgtgctttcagcagctgatctaagctatcaaagtgtctgagatggatagattgtcactgtatgtccttgccagagatacagaaatacttctaagcgtttgagggcctcttagcctggctctatccagccaggactgcagtgtttttaggagaatataagcatttgcattcaaccatccaggaaagtaagacgacgcttctggaattatctttcctacagcgtgtctccccactgataggacgttttgttcccttcgctgctgtagctgctgctaactgcattaacatcccactgatgagacaaaggtaagatgaaatatgtgcactgggcaagagaatagagtttagaaaggacgtgaattctgagctctgctttgaaatactctggaatggctgacccgttgggttttcacttactgaagtgggccgaagcagaggtgtgtctctagcctacaccctctgcaaagagagaattctgtatgatcgagaccagagagaaaaaccaagcgttccttgagttttccttggaattttcttacggtgatttcagtctcttagaacggataggaataaaaggagaaaaaaaagagtgcgcatttatggatggataacaaaccaaagcaataacaggaattgggctcccatcgttaggatccaaagctaatgaatatcccacagggctgtgttgcaatgacttcactgcttgagttcactcaaaaacagtatgtactgtatctatttctgatttagaaagttgttcaaatctgtacaggaacatagaaatcaacctcgcctttgagctggcatatccacccctcaaatctatcattattgaaaggtacatccgtg

SEQ ID NO: 21989 - DNA, 1919 bp, Mus musculus
aacactggttatcagtcattggaaaggttacctgtgcaaccaccagattccatttctacttctcttccccagaggtctcagcaatgaatcgggaagacacgaaaggtctaagactaaatatccaaattataaatactaaggaaactttgtttccagtttggcaatgatccagtctaaagtagaacctcaatttaaaagattgaggttcagagcatcaacactccatacacctccccaagtcagccatagactgttttttttttcagaagtgaaaccatagtccctatatgcctcttttttccccctctttttttttccatccttatagaattctccctgctttcaggaagatacaaagaaaccacatgaactagaccagcatctgtgaacattgtgctatgttccaccttgtttgaaaactgtgaaacagtgtggcatgccaacatctctatagtgatttttacacgtgatgtattcggtgtagctgaggtcactttggaagtctgtggctgttccatgtcctaggcaagccacttgttaaccctgagtgacaatctttataaatcattgttaattcagagatttgtacgtgagaaaacaacaacaaaattagagactatctagtttctgtaggttatttttcccaataatgtttccagatcgaatttcctcatagagaaaaaaaaaaaggtgtgccttgtgtctgtgcttctccgctctctgaaaggatggatggatctgaagttctcagccctcaccccacactgctggaatcttctgtagagctgcctgccaagccacctgaaacacagtggctccctgtgacactcaggcctcagatgagcctcgcttgccttcactgcttctgttttaaacagtagtaaaaaactggcgttcaaggcagagtccacaggtgcttaaaggacactttcagaagaagctgaaggccttgaggtctgcccacccagctgatctcggagtcctggccccagtccatgtgtagctctaagaacatgaagtagctggttgcaagatggaccaactcaccaagtgtcagcccaggtagtgagaaacttgcagtagacatggagctgggctcttttaaatttgttttgtgaagtttcagcctcttaatgcttttgtataggaatactcactgtgtggtttaatcatgatttattaaaaaaaaaaaaaaaagaacaaatgaacgaaaattggcaatctttgctgatcttctaaaaatactttttttttcctgaagaaaaaaaaagccacacgaagtgcaatagggttgtgcggcgactcattgatatttctctgatgtgagatagagctgtgtgtgtgtgactggctagcagctatcagtattagcgaggtgtcttgccgatatcagagtcagtgtgtcatttcagtttaactggatgaactgtcaaataaagaaatgcagaatgaaaacaaactgtctcttacttgtccgtgaagcgtgcggcttgggtgttgtaacctgctctgccttcatctgagtaccacaaataacccagttgtaacatctcctgttggtacctgtcccttagcaaatactatatctctgctttgggttgctgctcttctaccctcttgaactacacaagagccggacccctctctccacaaccaactcagagacgcccaaaggggacccgaacagtcctctgaagagtagggttttgtccagtatatgcatattagcggtaataatatcattgataacttagacacaggtgtaacagtgataactgacaataaggagacatgagctataacaatgctctgttatttaaaacacagggattgtttatttctggacttttccgtgtaatctttttttaatcatgtggataatgaggaaaaacaaatgtacaaagagcctgctgtacgct

SEQ ID NO: 21990 - DNA, 1409 bp, Mus musculus
gtgaagctgtttggacttcccaatgactcctgagagggccgacagcgagaggagagaggaggcaggaggccgggcggactatttgggctacctaatgactgtacctttcagggagaggaggcctgggcttcctaatgactcctgagaggacctgatgggagaggaggctgggtgcagaccttccttttgtatagttcaatgtagtcttttggacttgtaggcaccataaatgtttataaatgtcataaatgaccaaaaaaaaaaaaaaaaaccaaaccaaaaaaccaaaaccaaaacggcccaaaaatctttggtcaggctgagtgtaccttaaccctctctgtgatactggagaactgagctagctttactgtggtgagcaagtgccccacattagctccagccccagccccagccccacctcctgggttttgtgttggtgtatttgtgttagcagttcccatccctccccgctgctgacagctagctaatgaggattttgcaagtgcaggtcatggtctgttttgttttagggttctctagaggaacaaaactggtagactatctgcctaagaacagaactgatgtggaacatctgtttgtctgtgtatatatctgtgtctccgtatgggattttatcagagtggcttagaggctgtggtctggatagtcagtccagctgtctcctgatgggaaggccaaggatccagtagttgttcagttgttcagactggatgtctcagcagtgttactctggtgctggagtcccgagggatccctggagagctgctgatcgtggtctgtgttggaatcctgaagaagtaggttctgtggttagcagcagaggaggccccggcagcagggtagatgaaccaggcggtgagagtgagggcaagcaggggaaaagccatagcttgctttttccctgtccttttatataggctgccaccagcgtgtgtgtcccagatttagggtgggtcttcccacctcaaaggatcaaggaaaatctctcacaggtgtgccctgctggttgggtttcagtgtttccagatgccacagtcaaagttgacagccaagatagcccatcacttgagtagcatagcatgccctctcctgctgggagggccctgttttctggatttgaccatggcagagtttgttggacatctgcttaggcggtactggtttaaagggagggtagcagcatagggatgggatttttgaaaagcaattttgagaacagagcattcaataaaactggctttcattatgaggtgtctaaagttactatctttattccaggaagatactgcagttttaaattctgttttgatcttaaatttgagagcttatggtccagtctaacattcaaagcaagattcctgaactgcactgctggctgctgcggt

SEQ ID NO: 21991 - DNA, 1184 bp, Mus musculus
gttcttccgaaggtccagagttcaaatcccagcaaccacatggtggctcacagccatctgtaacaagatctgacgccctcttctggagggtctgaagacagctacagtgtacttacatataataaataaataaatctaaaaaaaaaaaaaagtacactgaggctctccacctccggcgccgtagccatcatgaatgaaccatccagaccaggaagttcatgaccaaccgactgcttcagaggaaacagatggtcattgatgtccttcatcctgggaaggcaacagtaccaaagaccgaaattcggtaaaagctggccaaaatgtacaaaaccacaccagatgtcatctttgtatttgaattcagaacccacttcggtggtggcaagaccactggctttggcatgatctatgatcctttagattatgcaaagaagaatgagcctaaatgcagactcgcaagacatggtctttatgagaagaaaaagacctcctgaaaacagcgaaaggaacgcaagcaagaacagaatgaagaaggtcaggggcacggcgaaggccaatgttggtgctggcaaaaagaaatgaaatacctagcagtgagtggagattggatacagccaaaggagtagatctgcggtgacttgatgttttgctgtgatgtgcagatttctgagaggacaaataaactaaaaagcttctacaaaaaaaaaaagtacactgagaaagccagggagagcaagcctcttccgtgctcagccttcagtccctgcctccaggttgcttccttgaatccctgtcatgaacttcctcagtgatgcactgttgcctgggtgttttaagatagaataaacccttccccccaccctccaggttggtttgggtcgtggtatttaccaaagcagcagaaagtaaactaggatacatatctcccagggactccatttccaaagaccagcacattgaaggttaaggattctgtgtatgggtttgagggaaatgcagactttccgtccccaagcacattgtgaactaaacataaagacagacatatcttactatgtgatttttggatcatctagatatttagatacgtctatatctagatatagagtaaatatatttactcactgaaaggctatgccagtctaggtcattgcctaagtcctggtctctctgtgcttatactt

SEQ ID NO: 21992 - DNA, 1344 bp, Mus musculus
gccccaacaaggagatgacatcacggtgctggatgtggagaagcagatcgaggccttccgcagccgcctggtccacatattgggagaacctttagtcccccagctccaagacaaagtgcatttgttgaagctgctgctcttctatgctgcggacttgaaccccgacacagagcctgcttcagagcactgaggcagccagacttctaagcactgcgcaccaagaatacctcctgactaccgccagctacttagaagccctgaagtatgaacagtagttaggaacatcataggaccaaacctatcttatttatcagtaggttgtaataactttgtaactcttcagtatatattttttttataatctttatcctagcctattcaaatttggcttaaatatacaaggtgtatatattttttattaaattatttatctatgcttttgaaacaggcagtgatatgcactatatgtccaacatttccatgcaagatgtgaaagaacccttctgcacaatccatcagtgttacactggtcaagatactgacggcccgctcggcccagctctgaaaaaaacattagtttttcctgaatagaccatgttctatactagactttttatattgcccataaatatgactctgtggccagtttattaagtctaacaaagcaggcaaagaaacaagagcctgtcaaacctgtggtgttaataagatagaataagatgtttacagtgcttgggctccactatggggcaggcagaatggacaagacagacctgggcttgagaaagtagtaaagatttttatttgtcaatacaagataacacaaataaattaatttttacaacaatcttagactccagggcttctctctgaggttagctcattatgtaaatagcctacttactatctaaagtgatcgagcaatcatatgttgagtgttcgagaccaacaggctgtgaacaatgaggagacacaaaagggcacttccttgcctcctttcctcggtaagatgtgttactgaacaaatgaggctaacttggtggaaaacggtctcaatgttatcagaatacagccaagttcatgtgaacctgaagactatataatccagccatacctatcgtcttctttaacaaaaccttaagctggtgtggctgtgcacaccttcaatcccagcattggacggcagaggcaggcacatcatctctgggcatctactgattgagttccaggatagccacagctacaaagtgagacactgtctcaaaacaaaacacacaactaaaaaagcctactatccaggaagtaggggtgactcccgctcagtggtagagcacttgcctagaa

SEQ ID NO: 21993 - DNA, 2160 bp, Mus musculus
gcagacaaatggagcctctttggaccacgacccctgcagaaatctgattctggtaaggtagcttcagaaagaccatcaaggcatcaggctactgtgtgggctggggctataatctgttgttttccttggcaggttttgctattcaggcttacaaaggtgccccaagaccctctcctatggaggtgatgcgtgcccaggccacacgagtaggtgaagatccagcaactttcaaaccaccaaagatggatgtcccaatggtagaaggaaagaagcaaccacttcgaacccataatctcaaaccccgtgacctgaatgtgctcacacccactggcttctagaatgctctgtccagggtctgcaacttccctgggctctgacttaggagtgatgtggctaactgaggcctgagtgagtgtgtagattgtccttgggtgagtgagaaaaaacactttgcattgctttcaggttggtggaaaatgtcagtggtgtagtgttgaggacctcactatttttttttttaaatcatttatcctagagaaggactctgatccttgctttcctaggtaaattatgctggagtgcttccagtactaaggcctcttgattctttccccttgaacactatgagcactgacaaatcatggtagaggtgcccaccaaccagtttgcacagtggaggccacctgacatgcattagcctggacttctctgagagctgggcacagcttgcaggaccctggctttctaagctgaaccacagattgttcttccacccaccctctctttttctttttctttcaagacagggattctacgtgtagccctggctgacctagaattagctctgaagaccaggctgaccttgaacttacagagatccacctccctgcctcccgagtgctggagctaatggggatcaccaccacagcccagctcaagttctttctcttggttagtccagcacaccactttgttctcttgggccgtatctgctgtgtcacaggacaaacactaggtcttatacagcccccttttttccccctgaattttaacatgacattaatttaacttctaattcagtatgatgctggtttcatactggcaaatggttccccactctaattccattactgaagattaagcccaggcagggacttgctcattctaggcaagtgctctaccactgagcgggagtcacccctacttcctggatagtaggcttttttagttgtgtgttttgttttgagacagtgtctcactttgtagctgtggctatcctggaactcaatcagtagatgcccagagatgatgtgcctgcctctgccgtccaatgctgggattgaaggtgtgcacagccacaccagcttaaggttttgttaaagaagacgataggtatggctggattatatagtcttcaggttcacatgaacttggctgtattctgataacattgagaccgttttccaccaagttagcctcatttgttcagtaacacatcttaccgaggaaaggaggcaaggaagtgcccttttgtgtctcctcattgttcacagcctgttggtctcgaacactcaacatatgattgctcgatcactttagatagtaagtaggctatttacataatgagctaacctcagagagaagccctggagtctaagattgttgtaaaaattaatttatttgtgttatcttgtattgacaaataaaaatctttactactttctcaagcccaggtctgtcttgtccattctgcctgccccatagtggagcccaagcactgtaaacatcttattctatcttattaacaccacaggtttgacaggctcttgtttctttgcctgctttgttagacttaataaactggccacagagtcatatttatgggcaatataaaaagtctagtatagaacatggtctattcaggaaaaactaatgtttttttcagagctgggccgagcgggccgtcagtatcttgaccagtgtaacactgatggattgtgcagaagggttctttcacatcttgcatggaaatgttggacatatagtgcatatcactgcctgtttcaaaagcatagataaataatttaataaaaaatatatacaccttgtatatttaagccaaatttgaataggctaggataaagattataaaaaaaatat

SEQ ID NO: 21994 - DNA, 2057 bp, Mus musculus
gtggaaaggttctgggtacagcacagcaagtcctcgctcctagtccttcattatcctccagcccctgctcgctctgtctgtggccttgtgttcctgcctttctagccccggggccattatttttaaagggagatgatttccatgtttttttttttcctaaatgccatccctggcagtgccaaacctgaaaaccttagcacagaatcttctcgacacctccccactgttactacagcctggccttgccagtctttactgaccacaaagtgcagttcactgaacagggtgaagggtggttttgcccaggtctggagacaacctgctgcttttgtactaactgtgccaacacccatgtttacacaagtctagagaaggaaggagccggagtcctggaacaagactggagctagggggttgggggggggggggtcagcctcagaatggcattttatttatttatttatgtatttatcaaaggaatgggccaaagttctaggttctgtttctaggtgctgtaatgaaaaccctaggagactgtcagaaaagctgaagcttagaactgtttggaattatgattgagattaggtaacctatagctgtcaatggagacacagaactgtagctttcccctcccctcccctcccctcccccaaactggccttgagaccataactggaagcaagtacctcaaggagacctagtactcatggtccaggacttaggataggactagacgagccatcagaatgactcttcctgtgcccacggcgggcacatcaccaagccttctgggaccatttatttgccagccaaaaacagactgaaattctgtattctctgaagtgaacattccacgactgtgaccgatgcaaagctggaccccatgttgaccctggtgcaggcaaaagagcctcggtctgccagggacactgaatgacaacagcactgttgtttgagacagtgtcactctgtagctcaggctggccttgaattgatggcacttgtccttcctcagcctcccgtgctgggattataggaagcactgtgccatcacgcctggcgcattcagtctgctgtttgagaatcactgtgctgtttgccaattgtccaacatacagcccaggaagtggaaagcgtcgttaacgtgagcacaatcatcagaaggggggcgggctgtgcccttggactccagcccatgagaacagaattactacaggacaaagcactctcattacaagggattgtcctgcttttgtactaaatatttaaagaatgactaggattttaaagtagttgaaattttgttggacattgtatgtctgttctgaggattccgcctctccccagtgctaaagcttaccttacaaccagacttattgagagaatttctttttcctaactgaaagacctttgtctaatgcgttttatcatgtacaattgtcatattgtccaaggggtgggggagtgttaagaataaacaatttcactgtgtctcctgaagtgactttacttgaggctagacctggtggtttatgatcccagctgctctggagaacgcacagtcaatcaggctggatcagtaggtaaagcctgatgaccagagtttgacccatataaacatgggtagagaggactgacccctcaaggcaggcttcccagtgctagaaaacaaacactctctgggcactctgcacctacactagtttaggaggaactatcaacacaagccggctgcaggacgatgacatccaccccctgccacagggccagacctcagactttgattcgggtcttggcagatactttactccacaacctcagaggccaaagtcctttctggcaatcaactttctcctgcccttatacctggaagatgatgctctccagcccatgagctagcagcacggggccaacaaggacaacttgtaaagtggagtgtcaccagctctctacggtgaaagtaacaataaatgccagaatggcattattcagggcatcgtcctcatcgtgaggacggctgatacttacagttcctcagacagtgagctccagtcact

SEQ ID NO: 21995 - DNA, 1164 bp, Mus musculus
cctcaggactggagttatagatggctatgaactgttttgggtcctctctaagagcagccgctgaaccagctttccagccctctaatggcttctgagatgagagagccggaccccagggatagattggaagtggcacactctatttaggcagcgctaggatttggatttgagcgtctgcctgtgtatccctccacatgtctgtccttcctttataggccatggcccgggatgagaagaattactaccaagacaccccaaaacagatccggaataagatcaatgtctataagcgcttttacccaacggagtggcaagccttcatcgattctctgcagagtaagaagatggaggtagactgagtggggcacacccccagacctaggtctgctggaacaacgaaaccaaagccaggctgtaaggcaaggggcgtggagcatcagtgatgctggctaagtcctgtggaatcgggtcttacgtgccccctcccccttccttctggagaaggaactcttcattttgttttgttgttttttgagaaagagcatctctctaatagccttagctgtcctagaactctctctgtagaccaggttggtcttgaactcacagagatccacctgcctctgcctctcaagtgctgggattaaaggcgtgcaccaccaccacctggagaaggaactctttcaaggccatggtttgtgttctgttgggagcttacagaaagccggggcctgctgtttcttttcagagggatgctctgtttcagcttgttctgtacatgataaaggaatattttacccatgtaacatgactaggtgggtttttgtttgtttgtttgtttgtgactgggcttctcagtgtagccctaggtgggattaaaggcacacttgtgtaatatttttgtgtttactgtgcccagctaagctctggagttgtcccaggaaaagctaatcttactagcgagcggagatggattatcagctcaacagcaagtactgcagtcctgggcttttgtaggcgctgccttgccttcttcctcgtcagtgctcctagtctcggtttcctccagacactctccgggaggcctgggctgacatagaagggtaaggagccaggtctctgctcactgtggattgctttttgttggccatggcttaaatcaaa

SEQ ID NO: 21996 - DNA, 3107 bp, Mus musculus
attctccttgaaggaaagccctgaaaagtttcagattgaagccaattttccaagacgggtacttccctgtgttccttcagaggaatggcccaaccccccaacactgcaggaggcgggactcagccacacagaagttctctttgtccaggacctgacagacgaatgacactttactgcctccttctcccaccccaatccctaaaagaaacggaaaaacaaaaacagagaacaagagataaattcatattattattataatacaatattttttttaaaaacactgctgcatcctatggaaggatcagaaaccatgctgcctgcaagagtcacaacctgcgtgcatccgtgtgcagaaggtcagcagtgagcattgcctgctcggcagacagcagactcgccttcccacagtgaagagacggcggccctcgtggggaaggagacattcccactgttcgcagtcattcttgcttttgtagaaagtacaaatgaaaccctccagcagcagctcctgaggacctgttcctcccacttgtggaggaagggaggagagcccggaacagactgcccacagtttatgaataactttgtttctgtttgctttgtaatgataatgaccaaaggaatgaggctgacttaggtgtatttttttcccttagatttgataagagccaatgccctgggctccgaggcgaggccggggccgcgtaataaaggtgccctgggctcatttgcgcatcctttgccactgttcctctccaggtggtcccagagtggtcatttggtttggtacagttctgccacttgtgtatcccatttggagcaatgagaggaagtctcggattgtgacccacaaaaggctgtgtgtgggtgtgtgctcacctttacacacaagtacagcttttccttggcatctgtaccaggtggtggtaaaggggtctgaaccaaaggctagcagctcctggttcccctctggctgtactgctgctcttcccagctcccctcactcaccaagcttggtgccttccagaggactagcggccccttcccgggcccaccgctccacctgtggatgcttggcctgcttcagtgcaagtgtgataacagtgtctaaggatagacccattgcagacatggaggtgcactgagaggcagaggcagcagatctctgaattccaggccagcctggtctacagagtgagaccctgtctcaagttttgagccaggaactttgaaagagaagttggcctcccagcccatgtgtgttggaaagcacattccgtggtaccagagacagtttgcagccttgctcttgccgtggtgaagcagcaggagccccccccccctcgaaatgtctcatctgtgactgaatgttgggtagtggatatgtggttgatccacgtgctcccacatgccagcgcgcactgataagtattccagtgtggactagctcggctggtacaggcttggcacactgcagctctctgaagttactgtagtcactaggagacagtgggcattccagtcgagagaaagcatagcttgtgttggtcacctccaagagccctctaaagccactgctctctaatagtcctgtgcttctgtcctctgctgctttccattgttagagggaacatggtgaggacggaaggctcgtgaagccattcagaaaacccatgactatccccgaggccctagcgcagggccctgaattctaccttgggaaatgttagcgctgctaggcctgctggcactacagtgaggttgagaggaccctcagatgaagtctgtcttgctgacagtgatgcagagggacttccccactcccagagcctccctcccagattgtagtccctgcctgtctgtctgcctggcacatgggcatgtggactgtgaacgtatcttgttcacagctgcttggagaaattctgatttctccctcttaatctctttctgtaatgtgtaccttttaattttatgccctttgccttttgataactgcaaaaggatactagatgccaggctaataaaaatagggtcccctgttgctacaactctgagggcagcctgttgatgtcctggaggcttgtgctgaaatacctacccagctctcctcatctgcccctcccttagttttgagagaggttctgatggcccaaagtggcctcaaactctccacacccaagactggccttgaactcccctcctgctcctggttcctgtagtgggcatgtgggtatgcaccactgcataggcttgccagtagctgtgaaacacttcagttttcttgctgtacctaggtctgctgtctgggtgccatttctctccctgggtgaactgtggacttcacattttgtccctgaggccagttcagtctgtgactcccaaagacctgtgagcttgaagacacctgtgaccatttgctattgcttaaattgcttccaaaatattctgccagttgttccaaagtcaagtcatggacaatggaaggatttatttccagttctgcccctcattcccctctgaagtggcctcagctgaatgaccatgggggtgaccaagcaaccatacctgagtaagttttacagcctcagtctggtcttttcttcctctgcagaatcgtctgtggcagataggttttgtggggggttttgtttttgttctgtttttctccttgcttgcttccactatgacagaagagaaggcaagattcctgtttcttttaaaacttaaaatagaaaaaaattaactagaatttccaactgatgagttattatgaaaattgctaatggtgccaaggccaaggaaagaatgtcgggaggtgactgagaaggagcagtagcccccagagcacataatcagaggggtcgcctggcgctgagcagggactgccaccttacagctggttggcttctctgtttgtctcggggagaacgcagcaacaaaacatgcatccacaagagatgcagtgcccctcctgtactgcacctgagtagttaataatttcctgaagaaatctagtgtactttaaattttttcataaaggtttacattgtattgtaggttaacattaaacgttttataacaaaaaaattataaaaccagctgtg

SEQ ID NO: 21997 - DNA, 2848 bp, Mus musculus
tggcctgagccggctcctgggtgtctctaggggcaggagtggagattttctccaagtcagataggtgggggaggggaggtcacgcaatggggtctgatgtgtgggtgttctcccaggccaaccggacctgtcccatttgccgggcggatgcctccgaggtgcccagggaggccgagtgaggctccacagccacccacgagatccctgcccaaagctccggaattgggtgggggggagcagggcgtggcccggggaggactgtgagggcggggccaggcctgtcagcgttcccacctgccactccagagctggtgccagggtcagtctggagaagcccctgcaataagcccctgcattgccaagctccaaagactccttccccagtctgcctgcctgcctgcctgcccgccacggagctgcctgagtttccccaactcagtctgcttcttatctgcccctgggtccttcttcctgctggctctgggaggcaggagtccattccccaagtgtggtggctggtgtgatttccccagaccccagacggacaaaggaatagccaccctgggtcaactggtctcctgtactgaaatgacgtgtccttccctgccctagtggggttgccaggtgtgtgggcagggagtagccagagaccatttcctgagttctcctgtttggttccagacagacataggcagtcagctctgcctccactgctgtgtggtgtgggtctgactccccaggacccttaccccaggcacagcgttccagcccacccccaggctggagagtatcccagccaggctccatgagcaaatgggccagggctccaagctggatacattgtgttctgcagtagcctcgagcgatctgggcatgttcttgtgttcctggtggctgcccctccaccagtgacagtgtcagacccatgctcgatcctccccctctgtctttttgcatgaatgtgaggaacagcagtttttgtttattcatttggcccaaaattgcgtgtagggggtgtggatatttaagaggtgtttagttttttattatcttgttttctctttggtttaataggagtgggggcatagggaccaaccgggaccaaatgcccagggggcagagtagggtccggttctgccacaccaggcctccacatgagtgtgtgcggctggaactttatctgggtggctggaagtcacagggcggagtttgggggggtctgtgctcagctgataactgccatgcactgtactgcacatgtccctagagcctaccgggaccgtctgcttttcagggcatctcctctccagccagggcctgtgtcccacctgcctgggtgagtctcctagcaatcctgtgaggacaggggtcagggaggacatgaacctccacctcagggggcccctcccggcctgattcctgccctccaaggtctggaggaggctgtgttccttaccctcctttcaggtcccactcctttcctttcctaccgccaactggggttgctgcgctgcctggagtgaacgaaccgcgtgtggggccggcacatcctagcaggcagccattggcgcctgctgcctcagggatgctccaaccaccctcgttctcaccgcagccctgcccccaccccagcctgccaggccccattggcctggtcccaccccacaagaacccaaagtcttactgtatataactccaggtgatgtttctatatttatagcagtgttgaaaatccacgtgttttacacagagaaccaccttctccaacccccatcccttcctcaccccaaaaaaggttttcaaacccttgtggttcctggggcagcagaattggctcatggactgtgtcggctgcagtgatgattccagcaagcagctactagggggaaatacaccttttttgtttgtttgtttttaatcatttaaaaaagatttatgaaacaattacttaggatgtttgtgatttgccgaccttgctgtagatgccatgttaccaatgatttcctgtggtgggggcttggcattgtttactctttatttaccaacttctggcctaggcatgacagtgggcaccttcccccagcactgctgggcccagcgcctgtgttctgtgttagaaaagttttatatatatatatctaactaaacacacacacacatatatatatatatataaacacatgtgatttgggggccctgttccttgcacatcttacagttacctcatttttcccatgtatgtatttgagaaaatgctaatatatagagacaaatggttcttaaagcttaaatgtgtggttttttccatcccattggactcacattggtttgtagcatttaacataactagtatgttgtattatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtatacgagtgctgcccaagctgcctctggctgctctctgtgttctttccatgagaagtggggaatggggacgtggagactggtcatgctcagtggggtggcaagccatgaactgaccagaaacacctgccttgagtggaaatgggttgtgttggcaagttacaagattccatcgaacaaatgtgaggaggacacctggtcatccgaacttctaggttgttcttggcattttgaggtgatctcatgtagcccaggcctcagattcaaatctgtagttgaggatgaaccgtcttctgtctccaaagtgctggagttagaggcacgtcccctcacacagg

SEQ ID NO: 21998 - DNA, 1103 bp, Mus musculus
agcctcacggccagcttttcagcagctggcatagttcactcggggctctgccctgtcccaggctcttgtgccacagactcgggcttgccatggccacatctggcaagactagcaagtgcattctgggaggcgaactggggctccaccaggatgccagcaagcatttgtggagtggactgggatggaaaggggggtagggagggaaatctgtctgggcttcttctcctgtccacacagtgagtctgaaatgcctcgatcctcgcagggcttggccttgctcctgaccctcaggggagtccatgaggaagccacaacctgcaactcagtgcctcacctctcgaggtctccttacccactcagattcttaggagctcaggcctgtttactggggggagtggaagctggctctcccagccagccagccagccagccagccttctcctttgggtgagactctagggttgggcctggtttccagctgttccctctggactcttctctccccctagtggtcttgctgtggtgcccgagggcccaatgactggaacctcaatatctacttcaactgcactgacttgaacccaagccgtgagcgctgtggggtgcccttttcctgctgtgttagggacccagcggtgagtgggccctgggaggagggaggatctcttagcagtagggaggtgcatatcagtgtgctcccgtgtccgtgagagaacgaagaagtctggagtttcactgcagttgagcagacatggtaaacccaagcttccgtttgcttttctgtgaaggaggggcactagagttgaggacccgggtgagcccgctggtattcccttagcgtattgctaatagcctgtctcccctcaggaagatgtcctcaatacccagtgtggctatgacatccgactcaaactggtgagaagggtggggacagggttgagggtagcctggagtacagggggtgacatggggacctctcctaaggtcttgtggaaaggtctaagggcttcttcagggtggaactggccctgggtaggtttgaggtattgggttgctcattccacttctgtggagcgcctgctgtggttggcaccgctctagac

SEQ ID NO: 21999 - DNA, 1431 bp, Mus musculus
tgtcagggagggcactggagcaggggtgggctgatcaaggtggaagaggggcgggggatctgagctgaggtgggcaggccgagcttggtctcgtgtctcctcaggagctcgagcagcagggctccatctacaccaaaggctgtgtgggccagtttgagaagtggctacaagacaacctgatcgtggtggccggggtcttggtggggatcgccctcctccaggtacagccttggcttgcccaccctcctcctgcctgaagctctttcttcttcctcacctgctctctgtcttgcagatatttggcctctgcttggcccagaacctcgtgagtgacatcaaggcggtgaaggccaactggtgaggctgccaggggtgatggccatgtgcctggcccgtggggctctagtgggggcctcccaggacactctgcctcgctcacaatggcaaggcctgtgggacgtctgttacgacctgagccggaggttttgtgaccttggtgctcattacccactgaggaaaccattggggactagactggggctgtttgccacagagctctgtgtcgggggtgtgtacctgtgtgtgtgcatgcacactcgtaagtgcacctggagtctctaccctgctgctgtgaggtggtggcccttccagagctcgtggggggggggcagatggagggtagggcaggcacctgtgtcccctggtctactgtgggatgtatctgtgtgtggcttaggagcctgctgtctcagacctctccatactcaccatgactttgagcctgcctggagcttgtcttggcctcagtgtcacagcctctgaaatgggtccaagaattctctctctcgcttgcctctcaggatcacacttggcgatggctacaaacgactcaataaacaacactttgaaaaacagtggtggtttatgttcaccgtcttcgaaggttctgttggcagcgtggcctctacagagctctccagtgaggaggaccctggcctgaatccaaccaaggcctcttaggtctgggtagactatgcatttgagacagcctttcaaacaggtatattgccttaaaggtcacatctcctgttccccctgggcaatggctgtgtcatctacagtgggacacagaggcagctcccctggtctgttctatgtacctgaccgctagtatctgagagttgacctttccaacctctgtaggttactcctggcatacacctcaatgctgttatgtctcagcctcaagaaaggcataaaggagccgggcgttagtggcgctcgcctttaatcccagcactggggaggcagaggcagaggcagaggcaggcggatttctgagttcgaggccagcctggtctacaaagtgagttccaggacagccaggattacacagagaaaccctgtctcgaaaaaccaaaaaaaaaaaaa

SEQ ID NO: 22000 - DNA, 1166 bp, Mus musculus
tagaacctatgtcaaataggctgggtgtggtggtggctggagagttggagacaggtggatggataccttggggctaagcatccagcttagtcagtgaggtccatgagggaagctgttttaaaaaaaaggtgcttgtcaccaccaagaaagaggacctgaatttgatcctcagaaaccacatggtggaaagtgagaactgacccttgcaacttgtcctttggcttccacatgtaccccagtgacatgtgcatccttccccaaagaaagataaatgtgaaacaaaacaaaatacagcgacgcccaaggtagcaatggcttagtgtggtggtgtgtgtctttaatcccagaggaggagcactgtgaactgggcgccagcctggtcttcacagagcgagactctgttataaacaaacaaaaaccagaggcggctagagcttctgaggaagggcatccagggttgacctctggcttccatgtaaacatgcacaaaataagtaacaaagggaaacagacgttctcctgtgtagtcagatgtttcctgtgtctttccagtcttcccaaggtctgtttgttgaagaaacctctgaagaaggtctgaagagttctgaaggagacaactctgtgcccaccacgcaaaggtgaggctgtatgctgctgtgggtctcaggtctctttctacagtatgaggttaaggaagaggaacctcttgaaagattatataaatggaaaactggccagggaactcttctctcctttatgtgctgagattggaaatcatttttagctgtaagtttgcaaacgtgtatctcttagaagcctgggagaggttttcttacccactctagtcatcttagcataaatctcacagtttattacttgctgttccctaatccatctcagcttcctagactgcttctttatggctcgccctcttttctttcttttttgttttttctagttatatttcttttttcactcagattagcatacagaacaataagtttcacgtcatcttcatatatttgttccgttgcgctcattcacttgcctccctcatggctcactgtcctctcagtgtcccctctcctgaccagatatttccacttttgtttgttttctgagacagggtttctctgtgtagccctggctatcctggaactcactct

SEQ ID NO: 22001 - DNA, 1149 bp, Mus musculus
ttttgtttttgttactcaaatttggacacagtagttataatggctaggttggcttctaccttgtgatctttctgcctctgtttcctgatgtgctgggatccactgtaccttactaagagtattagtatttttttaaaaaaagatcttttaggtaaactgttactgaatacttgaggaaactacttgtgcaaattaatatgtaaggagccaagataaattgtttttaatgctattgaaatttcactagcattttctgtgtgtatatatgtacatttacatatgtccaacacttatatagaaatgtatatacatacatgtatatattcctttatagaaaaaagtaaaaattttaatgaataatagaaaagttctaaagtctagatttatttcccttaaatggctgtcatttgctcttatatgaccaaattgaataatctctagattagaaacttactttttgagtaaatattgaacttgcattttaggtaaaaggatgccacgaaggaagaaaaaaattaaagaggcctctgaaagccagaacttggagaagaaggatctggaaacaagcagttgtgtcagtataaagaagaagcgtagacttgaggacttactcatagtgatatccgatagcgatggagaggtcagtatttgacatggaattgtgagtctcaagctaggcctctttacgcatacacacaaggctttgttttgactgtaccttcctactagcttgctgaattcatttggatcttacttgattttcttttgatttctaaagggaattgtggattatttaaaagcgcgtgtggtcatattatttggctggggatgaatgataagtttttggttttgtaatatgttaacccaatgtgatttcagaactgttagagtaaaatcaaaagaaagtgtaatttgtgtttgaaaagtaagagaaaatgtgacagcttcctgggatggattccaggcttcctacatgcgagggactatgctgcctgcttggccaagaacataatgttactgtggaaaggcttcgaggagagagagtctagataaacctcccctttatttaccatttctctctctttcttttttacctgtgtgttagatcagatacagtacattatgaaccaactcagagtgtcttacatc

SEQ ID NO: 22002 - DNA, 1817 bp, Mus musculus
tgctgtggtgctatccctcccttgacctcctcaagaagattctgggggaactaaaaaggaatttagaactggtgcaggttctacagagagcaatagggtccccagaccctaacctgagaaattccttctgggtttgtgtcctgggatccactgcagtgggtttatacataactgtggatggagcaggtcttccaggaagtattcctaaagcttgtagagataaaacagcttccttgttagtgtcattgggtaccaagtagagatggggcagggcttaaactcttgttctttggtcactcaaccaagaaaaaaaatttcttctgtgagtcatgctgtaaccccagggctgaggttgatactgctatgacatccccacacagttggcccccagtgtccttaataacaatcttacccaggaaaggtctccctgctgccctaagcccaacccagttcatcccccagctaagggattgattcttgagatagtcactctggctactgagtgggggactgcgaagaggccagtgtgaaaactgtgtccatactgctgctggtctccagggcactcccttcagggtagatgtccaggatgttgtcttaagtgcaggatgtgtgagtgactgggtggtagtgctgaagacaggtgtcctttcccactccacttaaagagctgtcggagttttccttgaagtcctcctaggccgactggtccttgggagagccttttatttgactcataagtaacaaggcaaagagcgttatagcttagaaactcatgcagatgggccagaccaagcaccaccagccccaggtccttgtagcacactgctctgggcaccagcggcccctagctcctgacttaagctcttgactcctggcattggttctctgctttcagcttcccaactgtaggcctcctcagcagtcttcctagaagtctgtgccagaactggtgtcagaattagtaaagagcatgaagtagggaaccaaagggtaaggccctgaatgggctgactgaccattagcccttgtcttggaagacctctgtgtttaaatggattcaggagtccctaccagcttcatgtccagcactgcgagtatggaaaccctagaagtagctcgctgttgccctttggaagctcacacacttaaaaatcatgatttggagagtctcatggggcaagtgggagtgtccaggacacaagcaataacagcgtggagtagaaggctgagagaaatggctggtctctgtggctttgtttcatgtagcccaggctagtctcagatttgtcatctgggaggctagccttgagctgcttgctgaccctcccacctctgccttcctggttctgggatggtgggcacgtgcccccatgtcccacatcagctttcatccatgttattgtgggttgcttggtttgctttggtttttcaggatggggcctcattgtgtagctctgactgtcctggaactcactctgtaggccttgaactcagctccacctgcctccctcccaagtgctgccattaaaggcgtgtgccaccatgcctgaatgagaggttttttaatactatctagtagtcctttatttggatcagtcacaacctagctttgtactgttgaaatcgtattgtttccctttgaggttatcttgaataaagctgctgtaaaaactgtgtcatccgatgtgtgcgctcttccactcagagaaggggatggacaatggacacttcttaccttgttttttttttttttagccagtggttctggtgttgttcagttcgtaagggccccagttcctactaagtatttccag

SEQ ID NO: 22003 - DNA, 3094 bp, Mus musculus
aaactcagatgctaatattgggcagtttcatagaaagtcattgaagaactaggcacggtagtgtgtgtgtatgtatgtatatatataaaactgcaattcaacaacagaaataggattttgttttttatctttttgggggttggcgataggggtaggctgcctggcttcagaaaggggactttgaatgagaacagcaaggttttcaaggagtagtagtggacatcccaatatgtgggaggaggcagatgcaggaggatttttgtgaatgtgagaccagcttgttctacctacataatgagttccaggacagtgagatgtacatagtgagaccctgtcttgaaaaacaaaagcaaaacagaacaataagattttaggtagattctggtttgagatgtgttgtttgtttgtttttttaaatctccctctttttctttttttttccctaataaatggtattcttattttccttttaatttaaggttcctcagaagattttgagtaaatgggaagccagcgttggtcttgccgagcaatatgatgttcccaaaggctctaagaaccaaaagtgtgtcagtagctcagtcaagttggacagtgaggaagatatgccatttgaggactgtacaaacgatcctgattcagaacacctgttgcttaatggctgcttgaagtctctggcttttgattctgagcattctgcagatgaaaaggaaaagccctgtgccaagtctcgagttagaaaaagctctgataatataaaaaggactagtgtgaaaaaggatctggtgccatttgaatcacgtaaagaagaacggagggggaaaattccagacaaccttggcctagactttatctctgggggtgtatctgataaacaggcttctaatgaactttccaggatagcaaacagcctcacagggtctagcactgcaccaggaagtttcctcttttcttccagtgtacagaacactgctaagacagactttgagactccagattgcgattccttatcaggtttgtctgagagtgctttaatctctaaacattctggagagaaaaagaaactccaaccaggccaggtctgcagctcaaaagtacagctctgctacgttggagctggtgatgaggaaaagcgaagcaattctgtcagtgtgagtaccacttctgatgatggctgcagtgacctggatcctacagagcacaactcaggattccagaacagtgtccttggaattacagatgcttttgataaaacagagaatgctttatcggtgcacaaaaatgaaacacagtattctagatatcctgtcacaaacaggataaaagagaaacagaaatccctcattactaattcccatgcagaccatttaatgggttctaccaagacaatggagcctgaaactgctgagttgtctcaggtcaatctttctgatcttaaaattagtagtcctattcccaaaccccaaccagaatttaggaatgatggtctcactacaaaattcagcgcgccaccaggcattcgtaatgaaaatccactgacaaagggtgggcttgcaaatcaaactctattacctctgaaatgcagacagcccaagtttcgtagtataaaatgcaagcataaagaaagcccagctgttgcagaaacctcagctacaagtgaggacctcagtttgaaatgctgttcttctgataccaatggctctcctttggccaatatatccaaaagtgggaaaggagaggggctaaaactactgaacaatatgcatgagaaaaccagagattctagtgacatagaaacagcagtggtgaagcacgttctttcggaactgaaggagctctcgtacagatcattaagtgaagacgtaagtgattctggaacggcaaaggcatcaaagccattactgttttcttctgcttctagtcagaatcatataccaattgaaccagattacaagtttagcacattgctgatgatgctgaaggatatgcatgacagtaagacaaaggagcagcggttaatgactgctcaaaatctggcttcctacaggactccagatcgtggggactgttcttctggtagccctgtagggacatcaaaagttttggtgttaggaagctccacacccaattctgaaaagcctggagatagcactcaggactcagttcaccagagtcctggtgggggtgactctgccttgtctggagagttgtcttcttccctgtccagcttagcttctgacaaaagagagctccctgcttgtggtaaaattcgctctaactgtatcccaaggcgcaactgtggccgagcaaagccatcatccaagttgagagaaaccatttcagcccagatggtaaaaccttcagtaaacccaaaagccttaaagactgagcggaagagaaagttcagccgacttccagctgtgacacttgctgctaacagactgggaaacaaagaaagtggatcagtgaatggcccatccaggggtggggctgaagatcctggtaaagaagagcctctgcaacaaatggaccttttaagaaatgaagacacacatttttcagatgtacattttgatagcaaggctaaacaatcggaccctgataaaaatcttgaaaaagaaccttcttttgagaacagaaaaggcccagagttgggctctgaaatgaacactgagaatgatgaactccatggtgttaatcaggtggtgcctaaaaagcggtggcagcgattaaaccaaaggcgccctaagcccggaaagcgtgctaacagatttagggagaaagaaaactcggagggtgcttttggagtcttacttcctgctgacgctgtgcagaaggcccgggaagactacttagaacaaagagctcctcctacaagtaaacctgaggactcagcagcagatcccaatcatggcagccactctgaatcggttgcgcctcggctgaatgtttgtgagaagtccagtgttggcatgggtgatgtagaaaaggagacaggaattcccagtttgatgccacagaccaagctccctgagccaggtaaaaacttttatctggtaaaaagtgaagagaatttgttgatgttttttttttt

SEQ ID NO: 22004 - DNA, 1123 bp, Mus musculus
gattaattccgtcatttctatttggtgtagtatttatttaaacagtacatatagtaaaactagaacctacagggaggactggagccctgtgtaatgacgaagtggatattgatctctcacttgttttttcatttgtatccaagtgtatctatgtatattacatgaaaacagaattgagacaggctctcttgtaggaagggtgatttcaaattcctatgcagctgaggatgaccttgaactcctgatgcatcagcccagtcagtgtagtccttggtttttgtttatttggttcttgtgttttaaggcaaggtcttgttatccagtctccaacagtggtcttcctgcttcagcgtcctgagtctgtaaattgtactgatatgccaagataacctaggagttgttgctgtggcggtagctattaccaatttgggcacaaaaggtgttaaagaactggtttcaagtaccttagtaattcctgttgcttttcacttacagtgctttgaagccagtcgctcgggaaatggtattgttgaatcacgggctacatctcatttgaaagagttcagtggaggtgagtattgatgctaagaaaatgaaattaatttcatgtataaagttatgtaccagtacaattatactttgagattctgaacacaatatctaaaacccataggaatctatagctatttttaagtcttatgatgttattagttaaatagagtaaaattatatttttagtaaagaactatttgggccagttgtaaaatcagttcctctttaattttttttaagtattctgtcttcagattctaccattaatttcataccattgatcccattttgatttctttattagaaagtgtgcagtgtagtttgagagggaaatcccaaactgtctgactttttcttcacaatttgttttgagttttttttttatcatatctaaattatccttagtttctttaggtacatctgtgaccatcagccagctaccatatgcttgaataagagagcatattgatcctgttccatttattatagttttctctctttaagaaaaattatttccctctttcattctttttctgttcccatcttaatacttcttaaaatccccaacaac

SEQ ID NO: 22005 - DNA, 1102 bp, Mus musculus
actgaggactagcgcagagcttctctctctctctctctctctctctctctctctctctctctctctctctctctctggttttttcgagacagggtttctctgtgtatccctggttgtcctggaactcactctgtagaccaggctggcctcgaactcagaaatccccctgcctcagtgtcccaagtgctgggattaaaggcatgagccaccactgcctgactcccctcttactcttaatagtggttacatgtttaagagccatattttttattttatttgctgacaatttctccttgctggcaaatagacttgcataatgcaccttgttttcatatgtaatttttttacacttgctcttcccccatttccctgctttccgtaaatataggtcgtctgatgcgctgtgtccgctgtcctgtggcataccatgctaatgacttttgtcttgctgctggttcaaaaatccttgcatctaatagtatcatctgccctaatcacttcacccctaggcggggctgccgaaatcatgagcatgttaatgtcagctggtgttttgtgtgttcagaaggtaagttatgacttctgatttgagtggtttcaaagggattgtgcggtgtttatatctgatgtgtattgaagtgactatatgcacaccttagaggagctggttctccttctcccatgtgggtcctggatatcaagctcaggccatcagacttccctcatttctctgaccctcaaataaggtctctcattcaacctgttttggctagcctgctgcactattaaatcctgggttctgcttgtctcagctagccagtgctaggattacagggtaggcctttttcttgggtactagagatcctgactttaattatcaggcttatgtaggaagcccattacaacccactgaactacttctccagtttctcgtgtatccttggtgatttatttatttatttatttatttatttatttatttttagttttttaagacagggtttctctgtatatccctggctgtcctggaactcactttgtagaccaggctggcctcgaactcagaaatccgcctgcctctgcctcccaagtgctgggatta

SEQ ID NO: 22006 - DNA, 1685 bp, Mus musculus
gacagggtttctctgtatagccctggctgtcctggaactcactttgtagaccaggctagcctcgaactcagacacccacctgcctctgcctcccaagtgctgggattaaaggcgtgagccaccaccgcccggctgaaactattaattcttactgccagacattctgatgattgtctggggtagggagttagtataattatttaaacttgaatagataatttttaatgtgtccctgatctggaaactttttatctagaaaatggaataagcttttgcttctctggggccatggttcataaacttcaatatgcattaagagtacccaggtcagcttgtcacagcatattgttagacctgcatagtttagtattctcttgagtgtgtctgaaacatgaccttccaaatggaattggtgctgatatttactgctccatgggtgaacatttttttattttaaaatcaccctcttcatcttatgagggtgaatagtctaattttcgatatagcatacgtctcaggaaatctgatcagtagcttttcttgtgaattctaggatcgaatcattgatgctggtcctaaagggaactacgcacgcttcatgaatcactgctgccagcctaattgtgagacacagaagtggtcggtgaatggagatacccgtgttggtctttttgctttgagtgacattaaagcaggtaagagtcatttaaagattcttctgtgcctgagaccttgacttccaagttcttcatttaccatcaaaatatcttctgtcattcactcagaaagatctcctagttcccaaggatacataaacatgtaaagactttccaggtggtgttggtgtattggtgcacacctttaatcccagcactcaggaggaagaagcaggcagatctctgtgagttaaaggccagcctggtctgcagagtgagttccaggacagccagagctacacagagaagccctgtcttgaaaaagagagagaaagaaacggcatgtggtagttggacatgttttttttaattttgtgaacattggtgttttgcctgtgtatatgtctgtgttagggtgtcagatctcctggaattggaattacaggcagttgtgagctgccttgtggatgctgggatttaaaccccagtcctgtagaagcagaatcagtgctgttaacaacaccactgagcgatctctcaacccacagtttcagtttttgtttttctcattgtataaaccagactagctgtgaacccacctgcctctgctggaattaatgcatgagccactgtgcctggctttgaaggaacttcatataaataaaatcatatagttagttcttttgtaacaagtttcttttatttaacataatgactgtcaggataaaaattttctagtccttaaacttttttcttctgctctcctctgtataacagccctggctgtcttagactcactttgtagactaggctggccttaaactcacagagatctgctttcctcttcctccttcctgtgtgccaccatacctggtaatctttcttttattttaatttgagacagagtctcactatgtaaccatggctggactagaattcactatgtagaccaggctggccttgaattcatagcttctgctttctgagtgctgagattagcattaatattaagtaccccaaaattggcct

SEQ ID NO: 22007 - DNA, 1197 bp, Mus musculus
cactcctgtcatagtttttaaatgtacagaaagtacatgatttttcaaagagaattttgcaagggccatgattgcagactagatttggcagtttgttgttgtattgttgtttttaagatttttttttttttaatctatgcctatgtgtgtataagtgtgttaagtgtgcgtggttgccgatggagtgcagaaggggataccagagctagaactcctagttaaaggtatgtgatctgctagatattggtgctgggatctgaactcaggtcctcttaaagagcagcaaatactcttaaccacgttctctccagctctctattattctttgggtggttggtggtgttttgattaagacaagatctcgctgtgtagcactggctgggctgaaacttactatatagaccagctacctttgaactcacaggtctgcaatgcctggcttcctgtgctgggattcaagatgtggacacacaatgttttaaatttttaaataaaaaaataagagtgtcggtctgcatttttttttcctagttttggagaggctagggataaacccagggtttctcccatattaggcaagtcttctgtagtgatctttaaattttacttacttctgtgggtattgtgttgtattctttcagtcaatttatattatttctccatttataaagtggaatatttggcctcagacagttcctcagctggtttgaggcatacctgatctacacatgacactgtgaatgcatgaagccaccacaagttcagatcacctaatcagattatgtcataatgggcaggtgtcaccaatatgtattcttactctcttgatagtactactttgtagtaaaatgcctctttccttggatgcttccagataaggtacattcccaggcacacataactggcaggtgttctttaaatttacttgtgtgccctctgatagagggcagtggggtgtacccttgccacactgagcatgtggagatcagaggacatcagctggtgccttaccttgttctgagataggatttctttgttcacttttctgttgacactaagcttcctgcccaaggattcttagtctccactcctcagttttcatagtggatttttaggattcagacacagggccttgggcctaaacggcacctgctttaagaggcagctcttcagacatgttttgtttgttgtcttttt

SEQ ID NO: 22008 - DNA, 1055 bp, Mus musculus
atcacaggtgtgcaccagcatcctaccatcaagttgtgactttgtttttgttagtgagttagcgtattttgaatttaaatatttgaaaattgaaagaagtcatactttaatggcaagggttattttaaatattaagctgctgaaatttctgttaagttagctaactaataacagacttaaatttttgttctcttaaaaatacttttaaccggctatgatgttgtacacctttaatcccaacgtgctccagaggaagaagcaggaagatctctgagttcaaggtcagccttctatccagagtgagtttcaggatagccaggactatatagagagaccctttttcaaacaaaagcaaaaaagcaaataaaattattctattagtagctaatgtcacatataaataattaagaaatagtataaccatatatgttaatatttctgtggtctcttatgcaggcactgaacttaccttcaattacaacctagagtgtcttgggaatggaaaaaccgtctgtaaatgtggagcacccaactgcagtggcttcttgggtgtgaggccaaaggtaccacttttctaaacttttatattaggagcaatggtatgtcttccctgtacaatggtaggtacagtactagggatgacttcactgtaagaagctatttctttgcaataatgtaactggttatcagcagtgccactgacagtttaatgagtatgctcatgatctagttggtgttgctgcagtgtgtatgcagtttgactcaataggactcttaaagcatcctggaatgagggaggtcagactataaaataaaaaacctacaaagcaggttaattcctggtctcagctcacccattcataccttctggtaagctatttatatccccgaactgtgtgtgtgtgtcctttttttctttttcttttcttgaacatgtgcctgtcctcttttccttgtccctttacatgctggaattacaggtatgcattcccatacctgcctgagttttctttgttttgtttctttggttggttggtttggggcttttttgaaac

SEQ ID NO: 22009 - DNA, 2624 bp, Mus musculus
tgcatgcatgtatgtgcatgtgtgtgcccacaaagctcttctgtaaatggaagggtactacatcaaggccaaggtgagcttttggctggggcaactgctgcagtctctgtgttcttgtttgaagatttgtccttggaggagcatctggttagagggagatgttctctgagaatgtagtgtcccagaagtgaacaagggcgattggcaagcttacctttcttttctaccaataatcctctcacaagaacccccatcctcatttcctcaaacactcaggtgctttcagatttcagtctcgggcagtggacatagggaatttatggcaagctctgagcaagacataccaccttcaaggtgagtgtcagattccaaggaaattctttcctggtcttgtgccctcctacctgaggggaggagagaattcctacctgaaaagagagggccctctccacttccctgcaaatgactgctctctgtaatagagaccacatgcctggtaacttagctcagtggcaagccaaaacccttccccaagactggagagacgtgatgtttggagcaatgtccaatctaagcaatgactcctcataactgctgattatctgttactgctgcctgagctggggcccaagggctgggaatctgttggtgctaccttgccctaccatttccccagctcacaaactgccaacaggaagtgctgtttggctagttgtaccacactcacctgccctttgttctcagatcatgtgtttgtttacctgtcagctttgccaactcagcatctttagcaaacagacagcatcttttggcctttctgactcagttacagcttttacaccctcaacaggagtctgtatattccccagtttccttctccctaagttcctgttgaggttagcttccatctcttcttgaggaaagaacagtggttatattagcatttgcgctttatataaaaattgaaagtaggatctgcttttatttcccaaagcctgtctgtggaattgagacccttgaactcaggcagagggatgaggctggggcagggctgccccaagtttgggggcctaatccctgcacttccctgaaacctcagaatctcccctctgaatacacctgcctagttctctcccctttcatcctctcttcccacatcgtcagagtgaaaaaaagctctttgttttaaaggaagagaaaaagcgtcttattttctttttaaaaaattttaaaccatgaagaaaatatttttaaagaaattcacccaggacattaaagttcactatattacctatttatcatgtgtgagaatgtaagtatatacctgcagctagtagacgcctccctcctttctttcctccctccctcctttccttccctcatttcttaggctgtgtgaataggtttgcttggtgccagtcctgtgccctttgctctcctgtcatctgtagttgtgatcagaaagatacctgcactgcactgtcagagtctcctttcactatgttgtgtgttcgattaccgtagctgtttcatgaaataaactgtgaagtggggggtggggggtgcagactatgtaaaaattttaagtgaagaagtttggccttgacctagcttctctacaataggttgagtaggtaattggctttgaccattgtctagaagtgtctcacaggacaggagggagtgagttgggggcacaattggccacttgtcttttgttttgatacttccattcaccgacattcttttggagccttccttccagacctgctgggagaacgtcatctgcgccctgtacttggtctggaggggagggattgggggatgcaggggaagatcagtccttctgtcctttgttaccactgagagactcggtggaacctcattgacagcatcataaggatagtgttagaactgggcactggttactataccttagtaacacaagtattggggtggagaaccttgcagttccttctggactgcttttggatcctgtaataaccttttcttcaagggtgtgaattgccagcagagaaataggtggtaattttggctttggctaagtgcttaaattttggatgaccagagagtctgcacatgagacagctcccaggaagtagtttccagggacaagccaaaggcagaaatgttcacaggtcataactaatacttctctcgtttagttgtaggggagggaatataaggaaattgttgcaatttgcattcaagacttaatttttcttcctgctggagccaacccattttaatagatggtaagccatcatttaccaccaccacaccctcaaagtattgttaaatgtctgcttccctaaaattactgagtttgagattatttaagtcactatgtcaggcttttttttttcttttttctttttttttaccagtaatgcatctttggtacttattctctaccccacactacagtctgggcttgaagtacagtggtgagcctttgtggccctgcactgagttcacgaacgctggacactggtcgtgtcccagtgttgttctagaactgacgggaaggatgtctacgttgtccattcagggcactcaggagagcattcaatttgatatacacacacgccctccaagctgag

SEQ ID NO: 22010 - DNA, 1118 bp, Mus musculus
ctggagtgattcagtccagtccagaggaggaagagaccctgtgtccagatgatggcactgaatttcttatggctagtatcgccttgaccatagcttttatctgtctatcctgcccaggaaaggtcagaagagaactgtgggcgtggagtagccattaccttctgcttctctacctcctcccctctcatggcagcatctcaattgcttatgaagaataagggcaatgtttaagaattttggaagagctttgttagacaacaaacaacctcaaaagagatgtttcctgaccattataagcaaaatgcattaaactcttttgtggttcttcccctataacagccttcctgtgactttaagaacataagtctacgagaggccctaggagttgctcctgggagcttagtgcaccttggcagaagcagacagggagcagagcagaaactgaggtgttggcattgtttctaggttgggcagagcaggtggtctccaggttgtggtggtgccgccgtgtgtgtatgtaggagagtgtggaggctgggtgagtacagcatctaggagctcgtgggaaagcagctttctaggtctagcaaagaaaactgactagaaagctatattttttaaatggggaaaagggttcaacgaaggtccgtcactgtgttctctcgcccccaacccgttgccagctggaagtgaacctagtgaaaaagaggggagccctgtgctaggagtccccataaacatgtactgtaattctttgtatatagaaaaaaattactgtaaagtaaagtttaactttactcttatggcccttgccctgtgtttttattgtctctggggaaacatagcttaacaagacagggggctgactggtttaggataagggcaggagacagcctgggtcctccaagcactgggattcctcccaggtgcacgggttgtgcttaagtatccatcctttccctctctactgagcgtggttggtgttagtttcagtggcttcacagcaatcctctaccactcggtattttgaggaattattttagagaaatgaaaccagcactttgagttctatttttgaattaaagtttcactgtacagttcaggctaacttcaaacaa

SEQ ID NO: 22011 - DNA, 1198 bp, Mus musculus
ctgttagctacatttaggtgtgctccccaagtgtgaagacagtcacttctctttgcagatatcaaagcccaactctttgaaacatccagcaagacaggccaaagtgtgggtgagtgttgtcttgggtcctgtcagcaggaacaggcaggacagtagagcagaaaggttcagagggctgggccactgggatacccagggctgctggtctcaggccctcactgattctttgcttgccagatgaactcttccagaaagtggctgaggattacgtcagtgtggctgctttccaggtgatgacaggtgtgtacttcctcatggtccccagccttcttggtgacctacttgatgccccgacataatagtagtgctgagcagtcacctctcctctctttgacagaggacaaaggtgtggatttgagccagaaggcaaacccttacttctacagctgttgtcatcactgagtcaccactcatctggcccagtggaattagatgaattcccagaggggctggacctgactcttgtctgggctggaatggtcaagcgtctgagctattccaggtgcctctcacagcagaggtggcacctgcctgtgctggcccatggaacggaggaagtattgggctgactgtgggcatgaggaggagtaagggctgacttgaatcccaggcttctgtccagactatttaagtagcttctgaactgtaaataaaattgatgcatttccttgctgtgtgcactgggtgtcaaaacacctagttgttcctggggccacgtgggcctcacttatatgaagacttccatctggaaccaagtaacagtttcctaagactatcactgaaaccatggataaacaatgggctctttttcttatggcctttttattagtgcttacatgtctgagtgtagagcaaataccagggcttctaacatactaggcaagaactatatcactttttttcttttgtgggggtgaagataggttgaggctgggatggaaaagtacaaagttcaggagaagacgaaggaaagcacctcagctgtgcccagagacaaaaggcttgggtacatcaacctcaagacgagttggttaggccagctctacctgttgtgttatgtctgaacctgtgctcaggggtgtgactcagtcctaagcttcccagtgaaaccctataatgtacgcaacaagaggcaact

SEQ ID NO: 22012 - DNA, 1213 bp, Mus musculus
tatttagcgcctccaggtcatggctgcctgcaatctgtgatctgtgcccgggttcagaattagagtacactgaacctatccccgggcaaattccaactccctcctccacccgacatggattctgtggctctccaaagcgagcaaaatctcaagaattataccactagagagcgccagcagcaggtaagcaaaccatcctcaggatttctggccccgaaataccgctcaactcccgtgctgccgcctcttcctgtccaaccacctttggactgcaaaatagaaatctagagcccaatataaatcacaaactagacaatcttcttcgaggactttggaggcttggactgattctaatcctataaggattttgtgctataactgtggccacagttccgcagatagcccacatcggactctgtccagtctttcaaactccactattgaaggacagcctacggtgcgatctccagaagaagagaggaaggcgactcgctctacccaacgccacgtacctatagggattcgggtaccgttgccagaaggcggcgaacacttggtcccaggaacttcggagcacgctctggcccaggaaatacttcaccatcgtcccgacccggacgggctcagcacccgtgcagcatcagggtgaagagcccgggggtgggggggacgtggctaggcgcacgcccgccaggctcgcagctcaatctccgcaggaccgcgcccaggtccctaccgccgccatcaggggttataggactgcacgacgcttccggcgccggatgcataggatcggccacttccggcgcccgcgtcacgtgaccgggcgtcccgcctcttggcttccagtcccagaggtgctgtttggagttagctacgaggaccccagattcagtcggtaaccccggcgcagcggagcttcgggcgcagcggcggtcgcgcgggtgagcaccgcagggctctgcggcgcggtggagggcgctgtccgcgtccccgcgccgcggctctgcaaaggacggagcgccccgggccgaggcgccaggggcctgcgaggtgcgaggcccttggggttggggtctgaggcttgggctctgcctgggccgcgcggaccctgaagtgggtgaggcggcccagggagcatgagcgggcagcgcgtggacgttaaggtggttatgctgggcaaggaatacgtgggcaagacgagcctggtgga

SEQ ID NO: 22013 - DNA, 1184 bp, Mus musculus
gcaccgtaggctgtccttcaatagtggagtttgaaagactggacagagtccgatgtgggctatctgcggaactgtggccacagttatagcacaaaatccttataggattagaatcagtccaagcctccaaagtcctcgaagaagattgtctagtttgtgatttatattgggctctagatttctattttgcagtccaaaggtggttggacaggaagaggcggcagcacgggagttgagcggtatttcggggccagaaatcctgaggatggtttgcttacctgctgctggcgctctctagtggtataattcttgagattttgctcgctttggagagccacagaatccatgtcgggtggaggagggagttggaatttgcccggggataggttcagtgtactctaattctgaacccgggcacagatcacagattgcaggcagccatgacctggaggcgctaaataggaaccagtagacatgctgtcaagagcaggctcctgagaatcatctttaactcttgcagcaaacatgtcttaaccgaagacatagtgcaccgggaggtgacccccgaccagaagctactgtcccggagactcctgaccaagaccaacaggatgccacgttgggcagagcgactgtttcctgccaacgttgctcactccgtgtacatcctggaggactctattgtggacccccagaatcagaccatgaccaccttcacctggaacatcaaccatgcccggctgatggtgagacttcctttgctccctcaaaatagttgcccttcagatttcaggcaagagagttgtgggaacttctgtggccagaggcaggcctaaaataccaatgagctgcatctctagagttctgcccttagattggtctaccctttcgattggtcagattctctgggactgtcccttggctctcagatggtggggaaagacacccctgttctttttttctttttttttttccccgagacagggtttctctgtgaaactctggctctcctggaactcattttgtagaccaggctgtcctcgagcttagaaatctacctgcctctgcctcccaagtgctaggattaaaggcgtgcaccaccaaccactgcccggctgacaccccttttcaaagcttgttacaagtactgtgcgcagagcagtcagttggtgacatgcatgcat

SEQ ID NO: 22014 - DNA, 2805 bp, Mus musculus
ttttgcttcttgcccagctgagacagcgggcagggctggggtcagggtttagcatccccacagctggaggtttttgctccatcccaaggctagctctcaggagcaagcaagtctgtatttggggcccaggtgaggccctgtgtatgggatggctacttagggttccaggcagtggttttgttctgaggcctgcggcagcaaatgggatttgtggttctggacctcccagtagctttttacaaagacagacctcagccaaggctggaggaccgttcagtagggccaaggtgtgacagtttactaaaagtagcccgtctcagcctcatgcctgtcctaagggcttttttccacatctggtgattcccggtcccttctctgacctagagcagagagatggtggctgtcacattgccatttggggaagcatgactctcaggtcaagcaggactcaccccattctgcctggtatgcaatgttttgggaatagggtattgtacacaggatgtgacctcagcccagggcacaggcactggggacagaggggcaatgacagaaatcttgagattgaggtgatctggaaggagctgctgagccaggaatggaagacagctggatggcagtgctgctccctttgggcggcttgaggggacaaggctggggggccgagtggaaagcaggcaataccacagccagcttccggtctctggcaccctccccagtccagctctagggactcaccaagtctgcctccttcctcgccatcccctccccacagtcaatgcttggtctcttacctcacaagcaaaggctgccatccatgcagtgcggcgtcctcagttcgctttgttgctgcaggaaaggagtggtggaagcccatggagtgaacacggctgttttgttagtaccaccgtctttaccttctctcagcagagctgttcgctgagctgctaggagccatctgtccttgtcggaaactgttcatggtcatgtgtccagaggtagtcacagcagctgccagctgcagcttgctcccaggcttatgagcctgtcatggagcctcaggaaccccgtctttttgacacattgctctctaagcatgcattgcctatttgctgtgacaccatgtgggccgtgtccaagcagttacgttctgcgtgacagcaggcctgggacctgaagcatcaggcttctgccgtcgggaaggacctcagttcctattctaacttggccttcctgatgtccagagttattagctacattataatcaagatttacctttgtgtattagagcctccttagcagctgctgtagcattgggagataactcaataaaacacttgtctgacagtactggcggctgatggtctctggggctcactagtctagttggggacttccatgccaaaggaggcacatggcattcccaaagatcacacccaaagctgtcctctggtctccacacacatggcataaaacaaaacaaaacaaacccctgctttctccatatttggcctagtaaatcttgtggtgtaggaccaggcagggtctgcaatgaaccttagatgccagcacttagtgagtttgtttaaccttccaggtgggctctccatccctcatcacatagcctcactgtacttgtgaagaactgtttctaagttcaccccagagttgtctgtctgcacacaggaatgattccacaattagtttttttgtcatatgttcctaaaaatggccttcctaatcaacactgaagcacaaatgtgtacccctccttgtatcttctctgcagtgttggagatgcaaacctgccgactcacgtggcctcctttgtcccctccccacagagatgatggttgttaaagtgttccttaaattgtgtattttaaaactttgttttgctttaaaaagcttttaaatggtgtttggatgtattcctcagctcttcgagcagcatggccgtgtcctggacatgtaacccaagatgtcgctcaagatgtcttctgtgcacactggtgaccgctcttagcaccgtaccagactgtcagatggcctctggcggtgcttatacctggtgcagcctccaatgttcttgaattgtgttctcacacgtcatgagaagtttgggtctgcagcttgtatccagttccagttttgctagccagagctacgatgcattctgaagagaatttttctccccttcccacccccactccctcagcagctctgctgtgtgcttttctgcaccaggctggcagtctctgctcaccggtcacgtgcgtcctctgacgctttagttccaactcctgttactgatgttgtggaattgttattttcagcctcctggttataagctttgcagaggttccttcccacatgcttagcttcctgatttgctaatgacgtcatttgatgtgccatctgcatttaaatggcacttattaatcttttccaaagatgattttcctgaaggtttctaactttggcctttaaaaatttgcactttgttgaggtgggtcttatggagtgctgatgtcatcgcccctgctgtctccacccagttgtggccaagttttcctgactctgtcatcttccagcacccactcctgaccttgtccctttctcttctcatcagctgggatgcttctcctcccagctgcttccatgtggacctgtggctcaggagacccagaggacatgaggtgcggaaggtcttcccttcctgcctggaatatggtaggaccctgggggtacagaagcaagcgcctgtgacagggctggagagagcacatacctgttagatagggg

SEQ ID NO: 22015 - DNA, 1091 bp, Mus musculus
tccaaaacaagttctgtttctgggagactccacttcctgccttgcaggcgggctcagtagtagcgagccctacttatgattatggatggagcgtctattagagcctcccagtggccctctgaggggatggaaggctagcctcatgtgacagagaaggtagagttggcccctgggggaagggagcacaggtgaacaagtccaaggatgacttccagggacccctctccccaggtgctcccccactgggttgcagtcctcagttcttactactctagaaagttcctgaggtcctggttgctgcccggggagagcagggctcgttcaccttgctccatgcctgaacccagtaggcacttgaactgccaggggcaggctctgtctggcttcctggaaaacaggcctctgaccctgtgtttctctccccatagggatctaaagccagagaatatccttctggatgaccatggtgggtgagaaggcccaagtgggagatggggtgaggttggaagctaggcctatcagtgaacccacctgcttccatacccctacccaggccacattcggatctcggacctgggactggccgtgcatgtgcctgagggccagaccatcaaaggccgtgtgggcactgtgggctacatgggtaagtcctgttgacctagtacgccagtctcctcagcccccttgctgtcccaggcctggcctacttactcactgttgtactaggggagggagggtgctaacttcagagagtaggtgtaggtgtgtgtgtgtgtgtgtgtgtgtgtgtgtgtgtgtgtgtgtgatgttgggaaaccaagacttagccagatcccaccattgtgaaccctgctattcatttgccggatgcttattgaacacctaggactgggtgggcctgtgagggtgaagggaaacagaaacagagtacacatccatgccccatgcttggatagcatgccattcacaggggacacaggcagtggagacctagcttgtggacagtgtgacacagtacagtctaggctctccagagtccatcttgggctaggcattccacttcctgccttctttctcctactgtaaaacct

SEQ ID NO: 22016 - DNA, 1126 bp, Mus musculus
aactccagcactaggaatcccactcctgcccccaggaaaacaagcaatcagacacggagttccttggtgtgaccctcccctcagggccacaccagccaccattgatgagatgtggcttctcatactggctcagtccacagcaggccagtggcatacctgcctatccagaggatgtttgatcaaactctggtttttgtttctggggcccgagggctccctgctcctcacgacctgcccggtcctgactcctggtccctgtccagctccagaggtggtgaggaatgagcgctacacgttcagtcctgactggtgggcgctaggctgcctcctgtacgagatgatcgcaggtcagtcgcccttccagcagaggaagaagaagataaagcgcgaagaggtggagcggctggtcaaggaagtggccgaggagtacacagaccgcttttcctcacaggcgcgctcactctgttctcaggtacaagccagagtcttagctgggggcagctggggtacctcacccactcaggtaccctcaccaccactgcccttctatagcttcttagcaaggaccctgctgagcgcctggggtgtcgtggaggtggcgcccgtgaggtaaaggagcacccccttttcaagaaactgaatttcaagcggctgggagctggcatgctagagccaccttttaagcctgatgtaagtcctgccctcccttgctagtggccagccgagccagggggtggggcggggcagggctggggtgggtgactgggagcaagggccaagtcactttcagtgcagatgttggaaaaaccccatctaatggcttgggctgcccctcacccccagtttgtgtgtgtgtgtgtgtgtgtgtgtgtgtgtgtgtgtgtgtgtgtgtgtgtaggcttgtgaaaatggaatgcccaacatactgtgggttttagtgtaccaggttagaatgctgggcagacatggagatgctctgggagcattgcaagaactcatgtcctctctgtactgtgattggttagccttcgatggcaggcatcttttcccagggagtggcaatggtgacctagtggctcaggctcatgtcttcttagatagccacccagtgggcacagagcaaggt

SEQ ID NO: 22017 - DNA, 1594 bp, Mus musculus
gccgaggcccccaccggcggttggcggtagcagctactctcagtgacgtttacagttttgcacagtggtgttccccattttccacgcaagccgtggattgtggaacacagccggaactgtccccagtgtcctccgttcctcagccactggcctagctgagtttgacaaggcctgggccatcttgggacaaaggtgcgtcccttcagctctctgtggagctcggggctttatgtatttatgtatttgtatgaatgtatatagctactagagcgttcttaattccaccctggacctggacaccccagggcaattagccctggccaggaaagccaggagctggcaagaggagccagtgccaaactccaggcttctagggcccagtggagatgagcaagcagagagtgggccaggtcagacctctgcccacagcactgcactggccaccaccaacctccaagtgagacttgtgcctgcctgttgtggactgaggccaccaccttctggttgcctaatgctttccctctttctcagcatttgtcagggttggagctggggtctttgtatcctctaggactgggacatagtttaaccccagacttagctgagtgggacccatcaaaccactgcccgagatgggtcgctttctgccttccagctcccagagcacagtagtccttattctgggtcatatcctgaagacacctttttcagaaatgccccagtccaggccataggaggagttagaattagccctccaacattccagaatccctcataaaagtagacacatgcccagcaataatccacccttccctgtgtgtgcctggtgggggtgggggtgagtgtatatcattgtgtgaaaagagtagggtaaggctgtgcctaagcccccggaccctagccctggcctgtcccagactgtgatggctgtcctgatgctagttaggacagcatgggaccataaggccctggcttttccatatttaaagccaatgtaagctgccatgtgtctctatgtgaccaatgtgagctgccacgtgtctgtgcgaatacattctgagcacacggctggccagccaccactgcctgcctccttttatttctggtgtttcaatgattcttcctgatttcttggcccagctggaaagcattgaaggtggatctgtaatgggactgggggttgcccttcagaagcccaggagtccgcaggactttgcaggcaaccaaacctgtttttcattgctaggtgggacacagccttagatactggcttgggtgtatacatgactgctacagagacagatatatctcaacagtctttaagctctctgaggtcaaagaggccttgtaaactagggagtggcctggagaagcaggtgggagctgttgttagaaatacctgcccctagttagtgaacactgccctcctgtgtgtgtccattctgatctggcacacatgcataagttccaggactctattctcttaaacatgtgggtggggctgggtggtggtagcacacgcctttaatccgagcacttgggaggcagaggcaggcggatttctgaattcgaggccagcctggtctataaagtg

SEQ ID NO: 22018 - DNA, 1203 bp, Mus musculus
acaagcctccaggtagtatccccgggtgaatgatgggaattctggaattctgggatgggactggagggctaggggtgtcactagagtcggttggcacagctcttagaggttggggggcgggtggcaccactgatggatctacccagccttctctcttctctcaatatatcctagaaatcgacatcacctgctgggatgcagacccagttcctgaagaggaagagggcttcgagggtggtgattagtagcggcgactgccccctggctgccctcgccaaggctgcctacctgcagtggcctctggccagccggcttgcagtgccagcattagcagcagccccgcctggctcccactctggattccggcactggccggggacctgtctgcttccttacccacagggcctgacttttacagcttttctcttttttttaaaagttgatagacttgtacaattgactggttttcctcccgttggtagttgaaacaatgttgcagattccacccccttcctgcccagaccagattgtagcttagttctttctgctcagctgaccagggtggaggcctcaccttgtttgggacctggtgggggtcgggggttctggtgggaaaatgttccccccatcacttttcctagttttatgtttcttggaaaaaaaatcactttgtattctctatccagggcttcagatattttgcacgaaatttaaaacatggcaataaatggctcgtgggctctggctccctgggacccttccccttctctttaccctcgctgcttggtcagaaggaattatcagacccacctggggccccttggcttcccgccctctcctgccgggcaggtcccaggctggaggtcctaggcatgactcaagtcagggcttattgatgggacccagtggtttgggtggcccctccccaattctttcctctctgcttgggttctttttcacattaactttttttttttttctaagcacaaacttatgtaatgggtcgtgctcatgtctgttaataaagaaatccagatcccttcgggcctgctgctctgggcctccaggggttgatctggcgtgggcgccggccctcacgaccagcttcccaactcctgtcacctccgaggctacagggggcgcacaaaaacaggttaggaggagacggaacattaagcccttgagaaacaacctttggtttcc

SEQ ID NO: 22019 - DNA, 1141 bp, Mus musculus
tggggaaggcactagggagggagagtgaaaccagaggggacaggcagggcagaacaggacgaggagggggaaagctgtggttgtcggttggtcatgacaataaagctaggcatggcatcgttccgctgagccgggagtcctgggtcagatggcaatcagggaacggtgggggagaaatcgctgcctagtcagctcagcgtccggccctagccctggcagcccacaactcagtggagcgggtgtgcgatggagactccaaggcaacggttccttggttaccgttccctggcgaccatgattctcatccctcattggccagagccaggaatctacctggtgcgtgccttggtacccgctgcccctcccccttttgggagggagaagaatctggtgctcaatgctgggcatcccctggtaaccatggcaacccagcaattggcacagaaatcagcccaccagagctgcattctcctcgaacacaaaggaccctggggacatcctcagactcaatctctccctctctgagatggggatgaggttgctgtgaccactccccgactctgaccctaagatctggtcttctagccctgaggcagcctctgccctccctgaagcctcctaggactaccatatagactgaagccgaccagaaagctaaactaatgacttccttcctccctagccttttctgctctgtatttattcttggcaggcatactaacgcatccatttcatggaaggtaatgtagttattcttcccttgagccacccctcaacccatcctgatgcaggcaccacgctggacacacatgaagaagagactcttggtccctgagattcagaagggctcagaaccttgctcatctcccatttcccatctaagtcaggaggctggggtgtgcgagaagatgaaaaagcagagatggaggaaaggggggagcagggaggaggaagaaaagaagagggggaagagaacagacaagagacaggagggaagtggaaaaaataaaaaatggaggaggagggaagaaaagaaaaggagcaaaaaaggagaaggaggaggaggagaaggaggagaggaaggaacgagggagggctaaccccatgccccaggggttattgacccctgttaaggcgacca

SEQ ID NO: 22020 - DNA, 1213 bp, Mus musculus
caggacagggcagactctcctgacctcagcctgggcctgactttgccaggactcatggctggggtggcccttgtttctcttggtcaatgcctgcctctgtcctctcagtgcaagacccggatgaggaattcatgaagaagtcaaggtaaaagcttgggcgctaacccctctccctaacctcccacttcttcctttccagccaccagccctcggctgctcctggccatcccctgccagagctctcttctgtcccttcctcctttccttccctccatcctccctgcctcccttccatctctccttccttccacttcctcctcctcctcctctctctctttctctgcccctcagggaaaagtatgtcctggagctacagagcccacgctatacacgtctccgggactggcaccaccagcgctctgcccacgtgctcaacgtgcagtcatagcctggccttcccagcctgctgccctctgcttcctttctctgttactcactccagggcaccccacgggtgcctccagctcttgcctaccactttcatgtccctggcctgaacctcctaccggcccggtcctggcagccctcctggcacagggcctggcttcatctgacactgccttccttcttggccctgtggtactactgtctgccaggtctgcactgcctttgagcatggaaataaacattctcggccctgcttcctttgcctctgtctcccatcttttgggtctggttatgttttgggtttgggatgctaaatggtttagacatggtataggtcccgcagcttgtttctcagtgggagggagaagctaaccaagatggctctgccttacccatggttctcttggataagaggagacccaaagtctgccctaggagccggagcacactctgctactacactctacagcagcccagatagctgtaccctacttaggggaagcaccccttcctacccctaccccagagggacctggaatccatcccagcagctcccagtgcactcacgcatcacccatggggacagtacagctgaagttacggggtgggaccatgcccaaagcctcagccaggcagggccttgaatggcagatcttacagccaggtgcccaggacagaagccccagccccagcctcaactataccccaggaatcctggcctggtaagatttggggctgaagaagggtgggtagcctccatggtcat

SEQ ID NO: 22021 - DNA, 1190 bp, Mus musculus
agggcccgggagcagctctagttatcggtgatgttccctgtatatgtgtctgtcatttttaccttcctgccggactctgaaaatccctatccatgatatctacccacagcatctatgtttaaagccttcagttggtaatattgggtgcctcaggctcaaacccagacctctgcacagcctacaggccgtaggagccagctgtagcttggcttcctagcttcatctcagtcttacttcctaacctaccttcctggcttccaaggtccctccacaccacaccttcccaggcaaaaccaaaagcagaacaaagctctaggctccaactgtatttctgcatggggtgcttattcttcccagggtaataacactcacccgtcagtgcccgccaggagcactcagatggcccaggctggcttaaacatgccttggactttctgccctgtagcacttgacacggccgctcgaattaagctgtccatttagatgtctctcttccctggctgactgaagctgggaaacagaccatgtcttgtgcccagttgtcctcccaaagcttagtccactgtctcacagtcaatgagcaaaaggaactaagtctggaactcatgaactatgccttgctgatttactagccgcttgatcttgaaccagttttgtattcttaccaaagctgaagttccccatctgtgtgaactgtgttatggtacagcaagggcagtggtgagggctaaaggacgacttgctgcagggctaggtctgtgcatgtagctgctctcctctccaggtagtgttagtaataaggaggcgctctccacaccaggacttctcagaccttcctgaggagacacttccttatctagaacaaccagcaggcaggctgtgcatgccctgtgatgtctgcagacactgctccaggccacaccgctcactgctttcctgagtacgtagagttctggcacatggggaaggagactcggacccctacagccatcctgagcaaccttttcttgtaaattacaaacttcgatattaaggttcagagaaagtgattagtccaaggggctctaaagaattgagctcaggtgtgtagtcagtgttcagaagagacagaggtcacatggctgcccactggggaaaagagcattctctctaaggtgattcagaggtggaggcaagtcttctctccccag

SEQ ID NO: 22022 - DNA, 1217 bp, Mus musculus
tccctacaaatttcaggccggggggagtttgcattgtaaattccagtgaggcaaagcaacatagcaagaccctgtgtcaaatcaaataaaagtaaagagggatggggagaggatgggcaagagggagagttgtattactattgggtgaaacaggttcgaaccttgcctccgcttatatgttgcgcaggctgacaactattatcagtcatctcgctatttggctaaaccgaagaaaatccttccattttggagaccccagtcctcagcttgcagaaaccagccccaatcaggtactgccgcgcggaggcgtggtgtatctagggacttgtagtccatgcggcggaactcgcagtcccggcaggcactgcggtggcctccgctgggctacgtggctcggcagtctgcgcctgcgcaggcaggtggggcaagatggctgcggtgcgaggcgtgcgggttgtcggaagctcaccgggtctcttgctggggagagggatgcgggccttcctgctactgctgtggcttgcagcccgcggaagcgcgctgtatttccacatcggagaaacagaaaagaagtgcttcattgaggagattccggacgagaccatggtcatcggtgcgggggcgcagggaagcgtttgggacaagtcagtggtcctggggcggagggggatgcgacctgttccgggtagctagcctggccgcgaaccccgcacctcttcgagcttatttcatcttcctttttccgcctgtctccaggaaattaccggacgcagctgtatgacaaacagcgggaggagtaccagccagccacccctgggcttggcatgttcgtagaggtaaaagaccccgaggacaaggtaagctggcccttacccgctccggtacttctttgttagtttccttatctgttcgatcgagaattttagttggtgttgtgggaagataccggatcttctctaggaacttgggccgcggtttctggacaggttcagttcacaacttctcagtgacctctgagtgactcccccaattcggctgctttccctagcctgtgaaatggaagctcacttactctagcgataagtgtattaattgcagtcagtgatggataccaaaaagttgctaatgctaaagttgttgtttaggccttaatttcacaaaacagaacacctttcagttttgacaaataatgttttaaagacaaaaggcaaaatagt

SEQ ID NO: 22023 - DNA, 1633 bp, Mus musculus
tgaactaaccatgtccagcccaccagtttgcattctgaatgtatgacacatgtgatctttaaggagcagattgaaagacccgaacagaagtccacactaagtgctccaggacacctctgtcgcttgccaccacctttcctctcctctctaggtatcaggaagggttaagtgaggactgtatctgacaaatggacagacagacttaggagaaatgccttagtctgccagcagtcattcgactgctactgatgaagatagtccccacaggcatctggccacactttgggcagagtgggtggccctggggatctttgcaagctgggaacacagcggttccagcagtcttagactactaagccttgccgcttatttcccaacagtggcgagaagagcgcttcagacaaaccagcgaaagcaccaaccagcgagtgctatggtggtccatcctgcagactctcatcctcgtggccattggcgtctggcagatgcggcacctcaagagcttttttgaagccaagaagttggtgtagcagctgtcccaagcctcacaggcgatctttcttccaggctgtgggaagtaggaggaggactggttttcagccgcagatgttctggaggagagagggactgtaagcgtgtccccgttcctcaggctcaggtggaggacagcagcctggctggctaatgctgagccagtagtgggacaagccctcccacctccactcctggaccttttgcagtaatcactcaggggctggcgatgcccttggtgtctcagaatctcagtgttactgatcagggatatgaggttgctgtctggggtaggttttgggagggaagtgggtggggcagcaagctgattttccttctgtcttcctttgttaatgtgggattttgagcaggtcagggtgtatcagtgactccttgctattccagaaactttgcttttcttgcctttggcttagaaccagcctgcttatatagggtgtgtttgctgcgtgtcagtttaagggtgtggaggggttgcagtgcacaaaaggggcccagaggttgattttagtttgttacaattgtcctttctggggcttgaacaactggtatcaaaccaagcagagactttggtgctggttggaaacagagcctacagagtcttagttactgagtttattttcaatgaatgtgggtttgttacattggtttcccaataaaaaagaaaaaagaaaaaaaggaagaaaaactgttcgtggttactcttttttttttttaaagatttatttatttattatatataagtatactgtagctgtcctcaggcacaccagaaaagggcatcagatatcattacagatggttgtgagccaccatgcggctgctgggatttgaactcaggaccttcagaatagcagtcagtgctcctaactgctgagccatctctccagccctgtagttactcttggtgggtgtgatgatacttggacttaagagaatggaacaaggccagacgtgatggtgcacaactttaatagcagcactcaggaggcagaggcaggtagatctctgtgagttcaaggccagcctggtctatgtagtgaatccaggacagccaaggctattacacagagaagccatgtct

SEQ ID NO: 22024 - DNA, 1099 bp, Mus musculus
gatcctgagcaaacctattgaagtgcaggttggaggcaggagtgtggtttgctccgatgtggaacagcaggtggtaggtaccatgttcaggaaggcgccattttttggtggttaggcagtatatcatttggttttgtgtgaggtaggcgggacacttctgaagttaagtcacttacaaccttcatgttgccagaacatggagctgacctcaggaagctctttttagtgcttcctaccagaattgaaagctggcggaaacattgtacatctttcttgtctttgattaataagatttgagggacagagaaaaccagtgaccagttgccacggttacaaacctgccagttaaaagtctgctgcttttacttaatcactttaaggcgcaggaagctcgagattaaacaacgattttgttctaggacgtgtttgtgtttcttacattaacttgctacattgtggtattttcagattgtgattgaagaagaaaagaaattcttgaaattgctggagcttttaggccattatcaggagtcaggatctgtcattatatttgtggataagcaggaacacgcagatggtcttctgaaggacttgatgagagcatcgtacccttgcatgtctcttcacggaggtgacgattacttacctactagcatgtcattgccttgagcttgctcagaataataataatgctttgttgtctgtaatggaggtagaaggaatcaggtagtcagcccctggcccagcaacatccagttgtagctaatggaggctgctctcggtggcttctcacagctgccagtaggtcttgtctctcactgcaccagctaggctttttggccattgagctgtctgaattgacctgtcttcacatctagtactagggttacaggatcaaagaggcatgcctgactgttgacatgggcattagagacttgagtttgggtctttgttttatggagcaagaagtttccactgaagcatatccctgcttccttgctttctcatcatccaaagagaaactgtacctcttaagccgcagttactctgcatttctccccttcacctgtcattgtaacatcatgaattccttatcctg

SEQ ID NO: 22025 - DNA, 1127 bp, Mus musculus
agccctcaaaactcacataaatacaatgtacaaaaaaaatttgttttgttttccgagacagggtttctctgtgtagcccagcccttgctgtcctggaactcactctgtagaccaggctggcctcaaactcagaaatttgcctgcctctgcctcccaagtgctgggattaaaggcgtgcgccaccaccgcccagctcagttagtatttctttttttttaaatattattatttatatatttattataaattattatatgtaagtacactgtagccgtcctcagacaccacagaagagggtgtcagatcttgttacgggtggttgtaagccaccatgtggttgctgggatttgaactcaggacctctggaagagtagttgggtgctcttacccactgagccatctcgccagccctcggttagtatttctaatgcggtgtttactaatccttgatttgtttttctctcctgtcctagattgatgaacagattgaaagcatgtttaattcaaagaagagagtaaaggacatggctgcacccggcacatccagcgtgcccgcgcccactgcaggcaatgctgagaagctagaaatcgccaagagattggctctcagaatcaacgctcagaagaacctgggcatcgagtctcaggtattaagtaatttgttccgagccattgctgctgttgccgtgaagatccagaaatggaaagagtctttttcttttttaaaaagcagggtttctcacagcctaggctggccttgcattctctgggtagccacgggggactgtgaactgcttatcctcctgtctacttcctacacaccaagtttacaagtgtcctgtgtgaaagtgtgcttcagacactgctttcttttttgtttggttgttttttttgtttttgttttttggtttttttttttgagacagggtttctctgtgtagccctggctatcctggaactcactttgtagaccaggctggcctcaaactcagaaatctgtctctctctaactcccaagtgctgggattaaaggcgtgcgccaccacacccggccagacactatttcaatgtagatcctttccaggagttaaattgagcacaaaaaaaaagaatccaatacaggattc

SEQ ID NO: 22026 - DNA, 1731 bp, Mus musculus
tacactggctaacagtagcctatttatttacttacttatttttggttttccaagacagggcagttttacagattgttaaagggatcttaaacattgacttctttgtgtgtttttttctaaccttctgccttttattttccatcatagcaaaattcataccaaccaaccaacaaaggacgatacaaagtattataaacatcggagccactttgtacctttgctgtctgtgacgtttacagtgtattgtaaagtaaggcttttaaaattctgtcttgcttattttttaaatacaagaaaccagtgtttgttcaagaggtcgtctgtaagtactaccccatacccatccaaaaccatctacattagacctgttttcagaatgtgatgttcttcaatgtaaaccttagataccaacactttaaatatctggaagacattggaattttgtactgaatgctgtaataaagtctgtcaggcactaagggccactgacctgtcctttcagtggaattgtggtgtgctcatcacctaagaaaggtaaaaagctctggtcatagcctgctgagcttacacctcgcagactggagcatgtgagcaggaccctagagtgctgtgatggaagtttacaaaacaggctcagagtttttattttaattttatctgaaacgagtaatagtcaagccctggcttataaaattaaacataagtagtataatgggatttctgcatttcttttttatttcttcctacttttgagaaagtcactgtggggcatgggctggccttgaacttgtgatcctcctccagctgtctctccagtgcttggttttagcacacttggctctccacgtctttctactgtgctagtgttactatttaaggttttctctcgcccctggttttgcctaagtgctgacttctttattgactcctttagagaaagttattatgaccaatacatactccatgttaatcctgtccctcaagtgtttctttaggcattgatattatggtacattctctaccataatacttctaatctgactttccttcaggatgatggagttatgaattttcccctttattaaaacgaggcaaggtggtgcatgcctgtaatcatagcacctagtaggcaagggtagaaagatgatgaatttgaagccagtttggccttatataataaagcctcatgtggaaaaaccgtgcaggcaaggctgaggatatagttcagtggtaacgcacttgcttaagtgtgccccaggtctaatacgagaaaacaaagcatttttgttactactggttgttgggcaggcgaggtgacttggtggatgtgagtcttgctttcaaacctgatcactcagttcaatatcttggatccatatagcagaaagtgcaagttgttctatgattcgcattactgtgcgtgtgtgctctctcatgcacacacaggtgtaaataaatgtagtaaatcgaaataaagaaattacatcaaatactggtatttacatttcagaccacagcatttcttagtaaaatttggtgcacaaagaatcaaaaattcctctttagagcatttgaggtctaattctgaataattggattacctaaaaagacagaacagttttttagtctcgatttaaaccaggtgtggtggcacccacctgtaatccagcctttgggaggcagaggcaggatggtcccttagttcaagaccagcctgttgtcctctgcatc

SEQ ID NO: 22027 - DNA, 1133 bp, Mus musculus
ttttgaagacccaggttcaggtctcaacacccacatggcagcttacagttgtctgtaattccagtgaataagtctaaagaacaataaataataaataaaccagtgtaacatatttaaaagccatagtgacagccacctatcctacttgttaagtgtaaggttacttgtactagaaaagtaagaactacttgggaaatatttttagatcttcacatacccagttacttcacttcaagaaaagagcaattacagcaggaggaactagaacatcacactggaatccctgtcaccagcacttcttccggccttggtttatttattgcgtctcatcgcccaggtgtagcttgttaatttcagagtacacagcagccacaccggtgcagtggtgctcccggaaactccacaccggtgcggtggtgctcccggaaactccatactggtgcagtagtgctccctcaactccctggctccctggagattcagaagttacatcgtatcacgttttctgtttgtgtatctaagaagccctgagagcattttgtcctaaaatggaatattgcccagtatatctgttagtgtcaacactgactgatttttaaagttttaatgatgtacagagtttaatttgttttttaatgcaatatcaatatttcctcaggctctctataaattccttacagaataaagttgattcagtcggcattgtctcagattatctttccttgaatgctttgtcttttgtttttttctctaacctttttatttgtggacctctaaggggaatattagtgttggtatatctttctgcatttcttaacagtctcactgtgcagccccagctggccttgaacgtgctttgtagaccaggttggcactgaactcacagagatctacatgtttgtttctgtctcccaagtgcaggagagcatacatggcgtgcatttttttttttttttagcaaaaaattctcaccgggtgtggtggcacacacctttagtcccagcacttgggaggcagaggcagtcgaggccagcctggtctacagagtgagtttcaggacagccaggactgcacagagacacactgtctcgaaaaaccaaaaaaaaaaaagaaaaagaaaaggaaaaaaaaaa

SEQ ID NO: 22028 - DNA, 1121 bp, Mus musculus
atgctatcatacagataggtattcatacgcatttgtctctgtttttggtagaaaatgatgcaccccgttgccggcagtaatccagcgttctgtgggcctggcaagccttcctgcctcaatgaagatgccatgagagctgctgatcagttcgatctgtattcctcccagcaaaacaagtacagccacacagtcagccacaaaccaatggtttgtcagaggcaagacccattaaatgaaacacacttgcagcctaccagtggcagaaacatagagataaaagatgaactaaagaaaaagaaaaacctcaatcgatctggtaagcgaggccggccttcgggaactaccaagtcagcaggataccggaccagcacaggcagacccctgggaactaccaaagcagctggatttaaaacaagtccaggcagacctttgggtacaaccaaagctgcaggatacaaagtcagcccagggagacctccaggtagcattaaagctctgtcccgccttgcagatcttggctatggctgtggcactgctgcctttccttaccctatgatgcatagtagagtggtgcacgggcttcaggaaacgagtggtgaagtcaagccgcccagcgagtgagcgaggcaggagagcaggcgttaggagcaggttgttagttaccccaaagcgtcttgttttaatttgacatgctcttaccacgtggactccccagtgctgtttctgttggctctccctcaccctgcacttctttttctttctttttggcttagaagttgccacaattgagagatgcactttgggcaggagtagtacattgtgtctgtattgtacacagttcactcacaaccctcagcagctaagtcatttttgttttccctttgtgctgttctaagtggactcctcccatgctaagcagctgcccaagttaacttttatttgtgagtaatccattgtgaggcattgtaactgaaggggcagaacagcaactagtgagcagatcagagggatggctgtgtgagtttagaactctgaaataagacgcagctgtctggatgctttggaacttaaaacacagcttcttatttattgattcgcatgacattagttgatcattaata

SEQ ID NO: 22029 - DNA, 1470 bp, Mus musculus
gtgggttcagtaacctcagtggtagagcttcacacaaaccatagaagacagtgagcagtgctgggtgaccatttaaccactaaagtgcttcaaagagtttcttcttgcagaagcctagaatataaaaataatttacttaggacagtgtaacttctgacacaggcaaatgcttgcatcttcattgatgtgttcatctggtcacagtatctgtcacttagctgtttctgaagttgttcagcagctggctgttttaaaatccttgcacagctagttcctgaatacagttgaaatagtctagtgtggtatcatctcaccaccaaatgttaaggacttgggtgcatgttgtgtttcatggtgagtccacacggcatccttttgagtttgatttcattcctggctttgtaccttgtcatttcttcttgcccttcccacacgcatccccttccctccgcttgccgcacatgtactcagtggtgctgtgctgcgctgcgtcagcagacagagtgggctactgcataatgcgtttactgtataatgcgtcagaagatagagtgggctactgcataatgcgtttccgatacgtgttcatgagatgggacattggtgtaaggcgatatgtttataacagtgtttatcaggagctctatcccaggaaagggggatggatggatggctacagttgtgactggagcctgaattcactgttcctgtgagcagtcacctggaatattagacgtgtgcactggtgaacacctgatcctacttttctccttgtggacagtttactagtgtcagctggagaggcacggtgaggacgggagtgaagtcttcacatacaaatatttctacttctacatgatctaaagactgcattctgcatcttttgtaacatggtcttttgtcatgacagacactgaaatagcatgtgaaacagttgcctagatgccagtatattcagttggggaaaactgtcgtctcccctgccccacccccactgtataattgttccttaaaaggtaaattgctaattttatactgtgtgattctattcttcataaataggtttcactattctatattaaaactttgtcagaaaatgatgtgctattcaagtaagtttgttttacttttttcttaaaaggatattttaacatgccttatttattattgttatcaaaacaaataaggagtcaatacagatgaaaacgtcattttccacaggtatcaccttgcctaactaatctttagtatggggtgattttgatactatctttggagttttgcactggatatttaaaaatatatatattggcacaatatattgaaaaattaaatagtatttggtttaatttttagtatttgaaacattttttaattagtgtttaaatcagattaacaattctttgtatttttaattacttttttaaaaggaacatctgaaaaatggtatttagtcattccaaactggta

SEQ ID NO: 22030 - DNA, 1443 bp, Mus musculus
gaacttctgagagtagctttattttgttgaactttggtcttaagagaacagaaggtgactcttaagagtacattgaccagaaaagctccaaggagtcagaaattctagagttttagctttgaaaggctggaaggattcccgatcctttgatgtggtgggaggaaagaaaatcacactgacacacaagtgaaatccttccaagatatgcttgagatggtgtttattttagggtcgcttgtcattttgcatgccgtgcatcatacttcagacaagcctcagatgtgttttctttctgatttgaaacaattaatttctctttcaggtatagaagccaagaaaaatgtggtggtaacgcaggctgaccagatgggccctctccccagcactttgataaagactgtggattggttgctggtgttttccttgttctttttaattagtttcattatgtatgctaccatccgcactgagagtattcggtggctgattccaggacaagaacaggaacacgcagagtaaagacagaactgaactggaacaagaggggtctcagcccctcctttgtggacttagcattacagtcgctaaatgtgtggacttgcaacggaaatcagattcaagaatcatgttcttgttggactactgaaaagctgaaaagatttcatataaatgtgtttttcctatgacaactagcaggtacaaaaatgtccactagaattgactgttgttgctttttaatacttgaacataatgaatttcttttctagtgtcgtcaaacaggaaagtgttgtctcagaagaggagctaagatgggaagtatgggctaggacgggaagtgcaggtctactacaggaccaggtgaaaaataaagtcactgaaacaattcaaagtggtttcgcttgtttctgggaatggcagactttaggagaaactcctaattctaattaaaacatgttaattctgtgctagagcacagacattgcccagtcatatactagcacacagctagattgagatccaaaggaagttaagaaccctgtccttgcctggaggttgagtctggtctagtttaggacacagcaaagagatgacatgggccgctgagatggcttagcagataaaggtgcttgtcaccaagtgtgaagatctgagttcgatccctgtgttccacacggtgggaggagagaactggcaaattggtaatattaatgtgctaatttagaaaaactaacaggatagtgcatggtgacacgtccaaaatccccagcttctgggaggtggagatggatgttccaggccagcctctgcaactctacctggcttcatgaaactgtctcaggaaaggaatacaacaaagttacctagtaaaaaaaccaaaatgagggggctggagagatgattcagtggttaagagcactgactgctgagttcaagtcccagcaa

SEQ ID NO: 22031 - DNA, 1192 bp, Mus musculus
tctgtgtgtcaccggaccagccagagcatccacggtacctgcctgcactgtcccctcattcctcactcatttctggtagtcaccactcagacctttggccatttgaccagtgtctttcatagctaacttaaaacactgaacaccatagacacactactataaactgtgaacacagcttctcattccagcttaagagcctcagctccttacagggcagctaccaagctccagttagacattcttttttttttgggggggggcgagtgagggggtgggaggttggttggttttttgggttttcgagacagggtttctctgtgtagccctggctgtcctggaactcactttgtagaccaggctggcctcgaactcagaaatctacctgcctctgcctcccgagtgctgggattaaaggtgtgcatcaccactgcccagcccagttagacattctcatctagactctctctgaaaagactgagctaatgccgaaggccctgggggtggaagacagagctgcatgctccagattccatatatgaagctgcaactcacttctgcttctggactcctcaaacttctgatcacagacattaaaaccgtcaaggcacaaaaacttgtcctgtgccaacgcccgttttctagtttgttctccctgattcagcagctattgcctcccactacaaagggaagaatgacaatggatcgtaagcaaaaacattcaaaggcctggaatccaaaataagcacttaatgttcagaattaagagccaggcgtggtggcacacgcctttaatcccagctttcagaagaaagaggcaggtggctctctgagtttgaggccagcctggtctacatatcaagttctagtacagccagggctacacaaagaaatcttgtctcaaaaaaaaaaaaaagaaaagaaagaaagaaaaagaaaagttctgagttctctctctctctctctctctctctctctctctctctgtgtgtgtgtgtgtgtgtgtgtgtgtgtgtgtgtgtgtgtgtgcgtgtgtctttggctgggtagccgtggtaagttctcactagcccaggtttcaccctgcctcagcctcctcagtactagaatcatagataaacaccaccaaacccacggagttcggatattttccacacaggggtcgactatagaaaacactcccacctgtctatca

SEQ ID NO: 22032 - DNA, 1118 bp, Mus musculus
acggcgcaggatatgtattacaattccgaacaggagcacagtgaagaaatactaaacttaaagcaagatcaaaacccagcagggcaaactccagactccgcctctccatgtctgatgccaaagtgtttttaagatcttaaactcctctttgcggtgttggctttgttgactgcagcacacttctctctccacacagttagcagctatccttggcaggtgtcccaaggctctggcatcaccaacattttggcgtttccaaggcaacccaggcttcaccttcacagcttcacaatggcttctctaggcctccgtgaagggacacccctgccccaggcctggcctcagtgactttccttagccctggagattccacaatccctttcttgtgtccttgattctaaagccagaaccatgtggtcagagctgccgagttctgctgctgctggggctggaccatgctcctttgttcaagtatatttccaccagctttctgtttttttttttgatggtctccttcactatctaagcttggctgtcctagaactcactctgtagaccaggctggcctcgaactcagagatccgccatcctctgccatcagagtgctgagattaaaggtgtgtgccaccatgcccggccctaagcttttctttcattccttttcacaagttggcagcttagctggacggggtccttgctctgacgtcaccgctccctctattccacttagcatcaggcttgtctttaatctgtttacacttcctggtgcccctttctcctcaaagtggatattttgtatctccccttgctcagcttgctccttttcgttacagagttacaaaactgtcaatccataactcttcaatttagccctaggcagattttttggacaagggcagaaaccagcctcactcttcaccaaaatatcacaagaacagtctctaagctacatactaacattgttctcctctgaaacttctcgagccaggcccccacagttcttccatattcttactagatggcccgttaagcccctcttaaagcattcagctgcttctctcatcccgagcccccattctgccaacgagaagccctgcagtcaggccaatcacagaagt

SEQ ID NO: 22033 - DNA, 1174 bp, Mus musculus
ctattgccctagggcccccctcacccgcacccctgagcatcttgcttctgggtcctgtcactatgaagttcctctaaaggagaaccaccatctttctattccaggccagggtggcttgtgccctttcaccctaagcagcatctgcgggttccgagcgcccacctagctcgcttcccctcagcgccccatggcacgggagtcttctgtttgaagtagacccacactagccggcggctcccggtttctctcttccttctctcctctgtgccctgtgcactgcgagtgcccgccgcctcgcccttgcccacaccccgcccacgccctgccctctgcaccttgccggctctcctgttatttcccacctcatgcttctcttttcagctgaaccttattcacagtgaaatcagtaatttagccggctttgaggtggaggccataatcaatcctaccaatgctgacattgaccttaaagatgacctaggtaattggggatggggtttggcaccaccagctgtcagatgagaatttgtggaacccagaatttaggctctctgtctgcctagactcaggcgtggtcaaggcagacctccagtcctcggttgacatttgattgtagaccctgagcattgactcactctagaccactccaaatggagacggtcgcttacatctcatcaatgtgattgaccccttcccctgcattgcagacacgtcaccatctaaattctcttccataatgatcagactgactgctggtttcttggggggggggattttaaaatgtgtatgtgtggttttttttttttcttttccttttcctttatttctttttaagctgaaaaagtcaggtaacaacaaaacaacagtttctccattcaccctttggttagaacggcactccatgtgtatggagggaggcgagctaggtttcagagcacggagctggacatcattgatcatggaccagctcctgtccatcagccttccctaaccatgtggtgggacacagccttgccagagcacacaggcttgccgtatgcctctgggggcagggtcttaaacccagaccacggtatattctgcatgccttctgccctggactgcagccgctcttgtcctaactacgacggggctcccctccaggagcccactcccacccacacagacaggccac

SEQ ID NO: 22034 - DNA, 1149 bp, Mus musculus
tcctgcagcagccaacaggactcacagctgcactaaagttcccatgctgtggtataaaactgaaggttttaatcttcccacaagatgacaaagatgtaatcactttactcaaacattgaaaccactaaagatctttctccttcccagaaaatcagactattgggaattttcacaatttctggccgtctgatttgtgattcacgtccctttcctctgccatacactgtgtgtggttgaatgctctttggctaagaggtgaccgacaccaaccgacttctgttttggcccagaacctcgcggttcacttgtggattactagattggtcctttcgaaggctgtgcccatgtagcccgtgtgccctgtagtcaggggttttcttctcttgcccatggtctttttctacctcactactgacctttgccattggttcagcgtgccctagccaagttagctatccattcttctttacaaagactggcccagtcctctccccactagtcgctgtcacacactctgtagaccagaggattctcaatcttttcatacttgtgtatattctataagagcagcacagacttatagccaacccagtgccatgttctcaacattggtgtacaagcatgatggacaatccaatattagcctcatgcttacatggtggtgagagagactgacagccctccattggctgaactagtaccagtgctaagcagcaggcctcctgagatgctgtggtccttgcatctaagaatgctcgccactggtggccagaaggaatgacgggaaggccaggaaggactaagagttctccaagtagccgagctctgtctgcagctgcttcctgcctctgtccagcaaaggcagggcattccagtttccctagagcccactcccctggaccgaggtgtcgcaggccaccgagggtcggaggatgcctcctggctggtggaatcagctggagaatacatttcccagacgtgcccgtacagtgagaaagagtttgaagggttgaccctgcatgacttttcagcatctcatcctgtagacacttagatgagtgctcgcccatgttgcaccaccagaggctctcttttccacttcctcctctgcctccctccctccctccctcaccaacctcttgccttttc

SEQ ID NO: 22035 - DNA, 1126 bp, Mus musculus
gttccaggaatgggagtgtacatgaagcagacacgaagctcccactgggggccaggaccctggagctcagcctagggaaggaggtgcttctaaggagtgggctgctcatcaggtagtgtgggctgtgcagggagaaggatccagctggtcctggtgggcaccgatccaatccagggagccgggttgttcttagaccaactaacaggtgtaccaggggcttcgtcactgaaccaccaggcgactcctcgagccagttgtttgttttaaccacgggcaataaatatattttcagccaccccagtgatgcagctttgccaggacgccatggttttgtaaaagttgattcactcttattgagaataaaaatgatgcaaaggcttttaagacctggaaatgagaattgattaaaagaggggtggggactgtctcggttttttgagtcctctgtaatataatctcgaaggactgaatctggccctgccgatccgttggcttaaaggtgctctgcgttgggttagaagctgcatcatttttacctcctcactgtccgtgtccttttgcatcccgatgacaccgttttctcgctcactcatgcccgttgtcccctaccctcccttttgtgtcactgattgcactcaggctctcacgatgcaattcctgcggtgacgttccggaatctaaccattgctgtttacatcctgtagccgttacctgtattctgtgtgcatctgtctaaagcagcagttctagttgtcatcttaaggtctgggctctgaaagtttaactgcctctcagtgctgaaggcagatgccccgagtcttcatgcctttcacaggtcccctcaggttgcctcagtagccactgatgtgtgagaccctctgctgtttagggctagtctccatgctccctccccaaagaagtgagtagccagggtggtgagagctagtgctgatcagcccctagggaccccctcttgcccaccctgctcctagtcacttccaccctggcctctcctgattctgctcccttctgccccacctcccccaaagccagcctcagttagaactcacattcacctcactgcaaacatgaaagcaccgagctgtgtaggtggccgtatgccagc

SEQ ID NO: 22036 - DNA, 1181 bp, Mus musculus
agaagcaatgagcctcagatgacaattagatcaggcgagtaaaagttgcttttacacctatcacatatttactttatgatcacaactagcaaaattacagttatgaaatagcaacaaaataattttatggctggggaggtcacaacatgaggaactgttaaaaaaaaaaaaagtcttagcattaggaaggttgagagccactgtataaagtgatgtccaagaaaggcatttcttaatgaggaattgccacacccaacagtctgctggccttttagtgatggctaggagctgaggcataggtgaacttgcttggtgggtctacctccatcatttttgacactgaattccacagaatcttaaatgtgcacagattggctttgaccttctaggcttcttcaaaacagccctgcacatggccaatgcacaacacttttgcatctatatacaatgtaagatcctaaaaatcttacagtcatttgagttaagtgtgattgcttagatctttctccagagcttagatcagaaaagcctactgcctgtgtcaccacaccatgaaagaaaaggcatctttcttccaagacagtaggaagggatgcgaatacaggctgtaggcttcacttgaacacagttgtgatcagaaagcagttgctgcttgtgtgcagggcagtgggcactgaccagaagttctgctgctttgaaagggctcaagttctctgcagagaagaaggttggttctctgtgcagcacctgactggtctctcttcttcattcaggagtgttctagcctcaggtctgttttcccggaggtgaggtatctaagggaaggcaagcaggtttctctttgcctggtcacacagctggaggagccaggatttaaatgtggagctagcaagttcaaatactattgctcatgcattctatgatcactggtcgcttcctggccagagtcctactgctctgatggtagaggactgcaaagccttcccccgtaggggaagtgaggccacggtcttcactagtcactgctgaaagtcaccagcatcctcatagcttaaggcttagttaaaccgttgactgctgaattggtggggcattgggaactagaatgcctctttacagaaacaagttgtgacatctgaagtctgacacctgttctctaggccttgtacctctaactccct

SEQ ID NO: 22037 - DNA, 1158 bp, Mus musculus
aaaggacacaggttggattcccagcaccaataatcagctggctcatgagtgcctgtacctacagctccaggggatccgatgcccttcttctagcctctgtgggcacttaacacgcatggtgcacatgtaaacaagcaggcacacataaacagataaataaaaactaatttaaaagatatagatacaacaaagatgcttaggaagcaataacttttgatggtttgttttgaattaaatatggattatttaagtaagttcatataactttaataattcaactaaaactttagtgattcttgtaaatggctaaatgtagtttactattaaacttgtattagtcagggttctctagagtcacagaacttatggtagtctctatacagtaagagaatttgttatgatgacttacagtctatagtccaactccccaacaatggtcagctgtgaatggaagtccaaggatctagcagttgctcagtcccacaaggcaagcaggtaaaggaacaagagcaaatcttccttcttccaatgtccttatgtaggtctccagcagaaggtgtggcccagattaaagatgtgtgccaccacgcctggatctggaacttgttttgtcccaggctgaccttgaattcagagatctccttgccttagtctcctgggattcatagccactatgtcccaagatctccatgccaagatccagatcagaaacttgtatctcccagcctccagattaggatcacaggtgaaccctccaattctggattgtagttcatcccagatacagtcaagttgacaaccaggaatagtcactacatggcttaattctgtttagacttctatgatcttttaaaaacgtagtttgttttatatatatgagtgtgtggctcatgtgtgagtctgtgcacaagtgcacacctagtggtcctctggaactcaagtttggatgcttgggagtgtgggtgctaggaattgaacgtgggtcctcagtgagaacagcaagtgccgagccatctctgcagcctgacatctcatcatctttaacaaccaacacttaatagagagcctcagcaccctactacatgggaccaagcattctagtcccttgtcctcaggtactggggagcaagaaagcatagtgaaaatgccttcaagtga

SEQ ID NO: 22038 - DNA, 1163 bp, Mus musculus
cccagagcttctggaataggtaggtgtcagttaagagctaaacacagagagcctgaaggggtcaggtgccaccccagagcttccctggctctaggagcctccttcagcccacacaactagcaaggctccatgggtcttcgcgctctctcccaccacagcctcaagggaaggagaaagtcagaataacactacagagaatggtgcagcccagggttttcatggatccccaagctgccccatgcgtcagcactgcccagttgccctgaggtcagtgctcttaaccgctgagccatctctccagccaacagaattcatttaaaatttttttacgtgcactggtgttcagcctgcaggtatatctgattaagggtgtcagatcttggattacagacagttgtgagctgtcaggtgggtgctgggaattgaacctgcgttttctggaggagctgtcagtggtcttaaccactgagccatctctccatcccttgacttttgttctctagaaagtaaaacccagtacctgattgtctgggtttccatgtggacagacacgtggtgagggtggggcggtgattttcactcaggacaactgtcagggaccagtgctctccctagcaaaccaagatggatgggcgccgcactcaggagagtgccagatctttaacattgctgaagagctcttggttactgtgtcactttggccaggggccttagtctcttctaagatgggacccatactggggtttggtggggaagccacgctgtccctgaaagctataaagaaactgcttttttttttttttttttttttttggtggcggaaccaatgtgagtgctgaggccctggctgtctttaagggccaccgtggcaggggaacagcctttctgatgtagaaatgactgttgggtcatgcctttgaggaaacagttgagaggacacctcttgttctgcctctcccttggtgctggggcaattctgaatattggtatcttatcagacaagcgtgccacctatatccattctggcctctggcaagacgaaactcatgattttaaatctgcctgtgaactgatttgggaagccagcagctgggatggtttccaccagctgctcactaaagtcctgagccgaatccgacagcatcgtggccgctttgccagcg

SEQ ID NO: 22039 - DNA, 1193 bp, Mus musculus
ctttcccccataaaatgcccatcgttatggagtgggagtaagagttacaggcctaccttggcaaggccaggcaatgtattaactggaattccactcaacattaatttgaggctctagaagtattccttgtttgctagagtctgactctgtttgtaaaattaagttttatttgccagattcaacttttgtctccaaggcttactacctccatctgctaacctaggcctcgttctggaagcttctagcctttgtacagtctaatctaggccaagaacctacttatttttgaataagctcaccttctcttgttctttctaaactcttgctggctgattcaactctgctttttggttcagactcctgcttctgactggttcaatcccgcttctctcagtttctcactgaatgactctctgtggcctcaaactaacgctagcaatctgttctaatagtctggctccgtctcatcctctggcttgttctgtcttcgcctgtgtctagcttgccctctcttcaacctgtctctgtataactcttctggtaaaactatccctgaactccacaaactgaactgccatgaactcagctccactgcctgcctctcaactcacccactcaactgaactgactggaactcagagatctgcttgcctctgtctcctgggtgctggggttaaaggcgtgtctgggtctagttggatcacacagacctagaagatctttgtatgtgatctcttgccagagcagccgtattctaaattaaaattcttttccatctttaaaaaaattattttaaatatctgagaagcatttatcctcagaaaaaacatcagatgtttaatcctgtaagagggtggctctggtgtacgggtggaccatgctttgaggtcagatgtggctctctgggtttcatgatggtttcaccacgacctcagcagccatgtcaagtttaacatggaagaaacccaggctggaagaagttaagtggcttgccagggtccctggctaatgaatggcagagcctgaaccagagcccagctttctcaatgccccaacgtctaggatctacgatcttccctggcacacaggacttgttcccttccagggaaagtttccggagcctgtgcgctatgaaagaccagcaaaggggggttcttggaaaaatactgcctttaccttaggtgcctctgttt

SEQ ID NO: 22040 - DNA, 5023 bp, Mus musculus
ccttactcagatgggctctccgctgaaccccatttcttctgtttcatagtgcagaagtattctttcaactatatttttagtggacttgttttaattttagaggaatttccagtacagatgctgtgagctgacatggaaaacagatattattttttctacgtaattgtgaccaacacatttgtattttatgatgatattacatttgtttgtattcgtgttcattgtgattaactttcaaaagtattgtaaacgatgtagagtattttgcccctgttgaaatgtttagcattgatcttaaactggaacgtactttttcttattgtcccaacgttttttaatttgttaaattttttttacaaagtagttcatcacataatgaaattttatcctataagagaacatatattgtggaaagcagtagatgatatttctctgggaatttctttgccttaccacctttgaaaaagcatacattgtttgcaaaacctcaaagtagggcttgcttaaaggaaactgttgaatcttgtttgaaggacactgcagtcctaacgtgttcagtgaaagcaaggtggtagatttctggacgtcatacatttacatttaatataggtaatattcatcagtgtaatgtgacttcatgccatatatattttgtaaaacaattcctttttaaaaacttcaagtatttctcatttactcaaatttgttgtaagtcctacttaacagttagttactatgtgctctgtggccttgttcagcattgtttgctgctttgggccaacaattcaagaactctaattttcctgtgcattaatcttttcattttgcacttttatgggtgactgtcttagtgtagcctctggtaaaatactattaggtggcctggttttagagctcctcctcgctgccttggcactcctttgtgcaacacgaccacttagagatgacagctgtgagctgtgctgctttttctagcctttaatttccaatgtagtttataatgttgttcttctatagctccagctaaggtgcctgttagtcccctacaatgttatgagcattattgacattgaaaggttatgtatgtatgaatacctttgctccttaccagacttgtcatacaaggactcgtgcagtgtagccagtagaggctctttggttggcccaagaatgaggctgttggtgtaagtgaatcacaatagggattgggatagttcatgtcatatgtcatatagcaagacaatgtagagtgtaggcttgtctctctgcatcaacgctctgcctctttctttttatccttttagaacctacatggacgctaatctccacaacactgttggatgtgaacactcttaagacactcatctagttcactgtgccttgtccttaggactcttaaccactttctagggagcagttatggcctgagatggacagtcatggcctgagaatgaagacactactttgataaagaaaaaggcctcatttgcctatcagagtgagaaaggtttttttctggtgccttttgaaaatatacagagccacttggttcttctgctgaaaatgtaattttggtttgactttttagagtgcccttcctgcctttatgaggaaaacagctatttttttttttggggggggggattccttttgttttctgtgccattatttattgcctttcagagtgcaaccattgggtggctttgctccttcagagagggctccttgatagccttcagtagcttgagctgtagacataagtattccatagcaagagtgtgtcagctccatgagagagatgtctgctttatagccgaggcagaaaccgttcatgttcctttacttggcagccttcaggaacaggtttgtaagaacgtgtcttgagttgagtgagtgtatgtctgtgagctctgctgaagtctggacacaagggccttgcctgctccttttttcagcagtgggttacatgttgtctctccacagtcttcatgtcataggtctcggacttgcagagtcctatgtggcctgccatctgtacagtggcaggactgaagctctgagctgttctgaggttcatggagaaatcccaacctattctgtggtcagtaaatggagactgtgtagtctacctgctcctgtactgtccttactgtatgtaaggatatacagacgcctgtgggtaggcagtactcacagtgagatgaagacagcaagtgtgcactgaaccacagagggcagggagtagggcctctgaagaagccaccagaccagaccagtgccggtacagtctttgtcagagatggctctgatggggcccagactgaccctgaccatgctgagttgctgagggtagccttcagttctctaccctctgaagtgctaggatgacagacatccgccatcatacccagcttccgtggtgctaaggatcagcctcagtcttcaggcgtgctaggcatgtactttgccaagtatttagtatacaaaatacattagtatctgccagggaaaaaagatttgcaaataataaagattgccatcagtttgataaatgttgtaaatggaagaatcaaaatctcagcgatggattacagcaacaagatgctgcctaggaaaagcaggaccaagaggtacatttgactagtataccttcagcgtagcgtgatgacctcactgatgtcacccaactgaacttaagggctgtaagtaggcgtgctgtgggccttccagaactagagaaaattataggaggaagtcagttctaaagtatcaaaagctgggtaatggtggcacatgcctttgattctagcactcgggaagcaggggctagcctagtctacagagcaacttctacacagagaaactgtcttggaggaaaataaaaaaagaaaagtcaaagagcaaacaaatagaacagagtaggaatccgtgtccccttttttctatgtttcacggttgcaggtgtaagaaaagtagtcatagatgtggctgagtttctaagatgaaaccagtagtaagattgctaaatataacacttcaaccaagttaaacaccctttgggggtatgaatgaaagtaacactgcaatatgaaatgaaccgtgcaagtaacacttggggttacctcacagtctccctatgcctgagaggactgtgggaaacatttccatcccctgccagtatcgccattgggaggacagagtagatgaagaagtgaagtcttactggtccagggcacgcctgtcagcaatgccatttgtgcttctgccacagagagcaccgagaggcttggctcagtatcctcgaaccttctctggtcacttccctggcagcacttgggtccctgtcactcactggtctcttaaaagtcccgtctctttgcttcctaaagattctctaaaaaaattactattttttatttcttttttaaaagtctttgttattttgttttgggatacagtctctttgtacagtcctggctggcctggaaattactatgtaggccagcctcaaacttgaagtaattctcttgcctctgcctctggagttctgggattacaggcatgcactgcagagtacagtgagctctgatggcttttaaaattcagcccctttgagggtttggttttagatccattagctttgtctgaacccatctttgtccggccgagtaaatcctctgctatccggggtctcggtagaaatgtgttctcagtatacatacgactaaacattggttgtttataggtagcctcagatatttggtagagcatcttttttgaaagtaatctccagctaggtgggtatttccctcacagcagtaggattttccctttaggagataccagttcttcatctttcttgtgaaaataatgcctttatggggagtgaagattaaggagttgtttctacactaacagaattctatttgatggacaacttggacagttctgtggacttgggtgggttctagtgtgctaagaaggataacagtatttaatagtgtctgtcatcaggccttgctcatctccctgtctagggctgtaggtcagtgctcgagcacttagcaggcatcgagtctagtgttcagtgcccagcattgcacagaactcagaatatatctgtactgaaactgaagtgaccacctacaaccaggtggtatgccagaaccacagaaaggagattcacggtgatgtgtttaaagcattgggctggtgacggttgctgtgtagtaatgacctcttcctcagcaaagagagtcctggagcaggctgtcctcagaagagggaagggactggtgtgctccttgtgcagataacttagtgtataaatcggcatgagtagctatcctttaaggatttgtttgaagttactctttgtaaaaagttgagaattttgtgtgcagttgggcacatgcttgcccttcccccacccgccatagtcctgcctctcttgctgtgaactggtgtcagctacaacactccagctaggtctgagctcttttgagagaaggtctcgtagagcaccattctcagagagaagctaaagcatggggagccttaggacggtcaggcaatgcactctttaccacggctggctaaggctgcagcttgaccgtccttacctaaatcaggtaagaatgtgattacagagcgagtgcttgtgttccccggcctgccttctccgaggaagatgcttcatccgaggatgatgcagagcagacgatggctgcactgtaggtctgcctccttctgtgtatgggttctgctgctgcttacggcataggaaagtacactagcagcgtgcttcaattctgccatcttttgatacttataaaaatgtattaggttttactgtattgtgctctcaaagccataactcttaagaaatttggtttttttgcatattgtttgctaatactttgttttaataaacctcaaaatctgcttacagtgtctttgtttattttcttatactttgcctgcccccgtggttcacatagtggtggtctgaggaggcgagact

SEQ ID NO: 22041 - DNA, 1176 bp, Mus musculus
ggatagtttttcatgtaccatgtggttatgttgtgtgtgctttccattggcatctgataaggtgcagtcatcagaatgggattctcacccccctaggctgtgtgtgccctgagagactggggcttctgtccttcatgtcctcttcttactgcctggcttcagaggtggctgctgcatatgtaaccagaccttccctgtattggattaaataccgtaaatattcctgggtgccatctgacaaatgctttgggggcaacaactcctttcctttccatgcacgttttgctggtgctgagtagactgagcaggatacaacagaatgtagtgagtggcaggcctggattctgttctccatggtctcttcctctctgtgtgcgggttgaccatcattgggagaatatgagtctcacttctatctcatcttcaaaattagggactacaaactattgataagccacccccttctctccctccttgtccctccttctccctccttccctccctctacacatccactcaccactcacccacccatctacccattcatatctgtgtctatcagtctgactgtctgtctatgtatgtatgtatgtatgtatgtatgtatgtatccatgtatgtatgtatgtatccatccacttatctgtcatctatctatatacccatctatctctttgaatggggtctcaccatgtagcccaggctagactcaagagttctcccacctcagccttctgtgtagatattctataggtggtatcaccttacccaacttgggctatttttaaaagcactttcacgtctatagcaaaatcgagacgttagagagacttttatagatactagatacctatatgcttgcccaatacctccccagcaacaccctcccatcagagtgctgcatttattaagtgaaggtcacacactcagacctttcgtatcacccgaggcccatagtttacaatttcttagaagcatgttttgtgagtttgggtaaatgatgatgtgtgtatcttcacaatgccgtgcaagtagctttatctacctcatgattttctattttccgtgtgttcatcccactacacatctgacaaatactaatcttctcactgttccttagttttgactttcagaacattataggctagaatcacacagtgtgggcttcttagactg

SEQ ID NO: 22042 - DNA, 1645 bp, Mus musculus
tctatgaaacctacttggatcccatgcctggaatttggaagcatatgtacaaaaatcatttttacgttttatttttaataaatcattgtgtttgaccgtacatgtctaacattttttttttcctaggatccactccttaccgttttaaaggatatttttgttaggttttgatgtgtacttcgagacgcttaaaggaggtcttgtgggctctttttttttttttttccccttcctgtttgcccagttagtgatgttgaatttaccttttacagacaaaatctttctgaagtggtggatgtggctgtttagtcctgtgcatccatctctttgtaataagcgatttgcttatcatcttgacatggttggttctttctatgagaatttacttcaaaacatgtactgtgtagtttaaaaaaaatagtttgtgtttaaagcatgtgttctcattcatataaactgtttaaaacttttttaggtgacctagtttcttccttattggtttgtctgtaatgaatggttacaaataagggttctattttaccctaacactaaatgagttttttttaaatgtattttcagagcaggtttaaaaaaagcgtttcttccctaagtctgaactttgtcctcttttaagtccaacggatgtagcaccatctgctggtagagtggcagtatagctgcaagacggttggttaagaaaaacccaacttacttgttcaggacaatttcatcagatttagcagtttgccatcagaattctgcagacttgaaaggtccacatttacttgtagctgagacgggcttcccgggagtgtagttaacagcccgcatcagtcactttttctacgtgagatttgaacatgtaaactgctatgcatagcttgggcagtagccccaaactgctccggtagctactgaagcagctgtgtgtactggggttttaggtgcaagttgtaaaacaaaatatctgtattctgcttggttaacgtgtatttgtagcccttcatgcaatagaattcaagttgttgtttataaaaaaaaaacaaaaactgataatagaagaaaatgccttcctggatagaaacatagaatagcaacgtttatggatatcacaaataaagaattcaattcttacatgattgagtgagagtatgtataacctggtgggtgggctcagagtacctgctatcttactgggtttgacgagatggtaaaaatttgactcggattttggaagcctaaagcctaatggcatcaagcttttcagaaaagatttttctttttaccttttaaaatattttaatgttggaaccccacattttaagttgtcactgaataattcctaagatctgattcttgccaaaatattgtaagtactaaggttcttaaagaggtaagaggatttatgtttggctagtttggtaagtgtagtgagtgatagctgatgtttgggtcatgtatttaacactgtataggggtgtgtttgctgtggaagaaaaaaagttggatgaagttctttgctcacaattgcttgcttcccttaaattcctgcttgaaactacacttgaagatctaatgcaggctttggtggggggggggggtccctctaggatacaggaaaagacctaaaactcattacatgtta

SEQ ID NO: 22043 - DNA, 2361 bp, Mus musculus
aataaccaaatacagtggctgtgtctcaaggcacagtagcaatttaaagaaagctcagcagcccagccagcattatttagaaagcagttgatgcttgcaaaggtgacctgggtatagcttagattggctctccttaaattgttttcaaggtgacctgggtatagtttagaccggctctccttagattgtgcttcattgttcttttcaacagctgcagagtccagaagtcagatttcagcaacaactggaacaactcagtgccatgggattcttgaaccgtgaagcaaacctgcaagctctgatagccacagggggcgacatcaatgcagcaatcgaaaggttgctgggctcccagccgtcatagcagcatctctctatcctgagaaaatgtaatttatttttgataacggctcttaaatctttaaaataacatgctttatttcattgggattctgtgctgttataaaggaaaccaataggaagtatctggaggcagagtgcagtacgacgggcgggtttctgtgtctttttggaacagtgggaatcaatgtttcttctggttaaggctgctgcatgcatcaaacacttggcatttattgtaatttttaaaaaaatatcaccttttctaattgggtgaacaaatttttgtcctgcatctgtccaactaacttgctttttaaacataaccctatggtagtaatttatgtagaataaaggcattaaaaagcagatcatttgcgcgccccatgatttctggtacaatagtgcttgttgtgactttggcatgcactttgcaaatgatgctgtaagatttatactcctgacaattttgtttatttgtatacaatacaaattattgcacatttctaggccatctaagcaaaatttctgtaactaaaaaagtacaataaggattcctaattgtgtagaatcttacagcatctttgataaacatctcagcagaagtgccatttagtctgtgtggaaaataaagaaaaactaactctggttatctctttagggacatttaattgtacagacaacataatgtaacaatatctcagcattatataatggctgtaaattacctttccttgtgccgactggaggagcactgtatcatgctctgatgtgtttgctggggcgtcctgctccccgtaggtgtcgtctacgcagcattgagtttattgaaatgtcgctttcactggaagtgcggatgtttcggttctaattgccatataaaagtagagctgtctcttgggtttatcagctttctcattcataggcaatacctcgattttaaatgattagtgagccacttgtttctcaagtgtttggctagttctattaagaaatagttgaatgtcgtgctgttcggagcctcagaagggggtgggggaggggtgaaacagaatctattctggattgggccagcctgaactaggtaatactggcaattaagattctgtgaagattctatgcatatagtagtgtcatttgggtgaaaaagagccgttttaacaattttgagtacgtttggctattctatagcctctttcttccttccccaaagacgttctacttgcctaactctcaaactgttggggtgatacattcctttgggaccagttaaaatacagcgttagggtcggtgacatatgtgactggctctggttcagtattctcttatcttaggtcactgtagtctctcttgtatggttgcccaaaattataatgttaaataatctaaagtgagttcagacaagtaaaatcaagggaaatagaaggtgaattctataacttctgtaagttgcttgatattaaaaggttgagaggcaggttggccccagactgtatacttttctgacactttacctgggaagaaaacatgtacaaaggtcagggtggaggcatgactgaggaggtcggcacagcctgcatgtgtgtgctctctctgccttacgcctcagtctgtggttggaagactttgtactggtgaatggcaatatgcaggtggggcagtgtcaaaagcagtttgatttattaatctccaaataacaataaatctccagcttttacacttggttgtctcgcctcttttgtagaaaatgtctttgttttttctcagtatgtcttaatgtaaaacatatttgctttacctagattctgtgaaaacttagagatttcttttgtctgggagctggggagtggtggtgcactcctttaatcccagcactcaggaggcaggggcaagcagatctttgagttccaggatagagaaacaatagctcaaacaacaacaacaacaaatttttttgtgggctctggggcttgtttgtccagcacggtcttactctgtag

SEQ ID NO: 22044 - DNA, 1175 bp, Mus musculus
tgtcttaagatatttttaaactttagagtgtggaaaagctaacttgaaacttcaaaatataggaacatcacaaacacgggactcacagcaaattagaaagatgaatggagacgcttaagtgataaaggggcactagttcagaatccagaatgaaatgaagaattaaatagttggttaacattacactggcatttcccccccagtactgtgtcagaactcttctctctttattgaagtaagccaacttgctctttttgggcctctgaagtgtcactgtcagaattcttgtgccttggagccataaccaagtacagtaaaggttgatctgaaaatagagcttagtaactagtactggttagcaactttatttagctatgaacactaagtgtggagaaggggatgtaaagtcacaatatatactgtgtcttaaaacataaatgtgtgtcttaatctgtttgtttgtttgttttttttgttttgtttttaaataaatttttagctagtatgttcaacacccccggaatgcagagcctgctgcagcagataactgagaacccacagctcatgcagaacatgctgtccgccccatacatgaggagcatgctgcagtccctgagccagaaccccgaccttgctgcgcaggtgagcttgtggctgtgctgagagtgttctgaactaaacaggcctgtggtatcctctccgcacgttggcttgtgctctctcagaacactagagatgtggacactgcacctccagctttgggggcagttttagttcagatatacttgaaacaatctcatgtctgccatttgttgatgagatgtacttttaaaaacaaaaccaggcatttttagggaacctgctctgatcactgctgctccccagtgtggtgtttggtgctagctctcggggtggtggttgtggatggagatggagcagcagcacccttcctgtgcctgaacagctggagggagtacagtgagcacccacgtggtcactgctggaggaatgtagcttacagtgtgctctgggtgcttacagcactctgttaagtttaaaagcttctcttctttcattatgaaatggtttttattttcaaaatcctgcagccacactgctacaagggtatagcagatgtcgttgaggtagggtcggtccttggtgatgacttatgt

SEQ ID NO: 22045 - DNA, 1164 bp, Mus musculus
cctctcaggggctagccttggctccctcccctcctcttttctcctctcctttcctctcctcttttctcttctctccccccgccccctctcaaaccttgatccagtttcatgccttcaaaccggtaccatgaggaggaaaatgccaaattctgctgacatgatatgtagcctggttttcttggacatggctacagtgagcttcatgtgagggtctgtgatgtagttagccttctgtttttaaatacatttggattttgctatggtgacctttagatgtgtggggtcttccctcagggccccacattacaaagccctaatctgatttctttaacaatggcaattgcttctttgtaactgtgaacttcactattttctggccaaggctgaatctcaagatatcaattcactcaattctccaggacaaggcagagtgcagccagatcctttgccatgaaggaaaggcctgcagcctggtttcccttgtgtccgtgttctcctgaaacctcatgcgcaagtctcctcctgtgtacatttcttggagcattattgacctgagcaccaagatgcccattaatcagctcacgtcagctcaaagcctccagggcttctccagcccctggctgtgacctctgctgccttcctctggctgacaaggacactttcacctctgggagtttctgatgcttcccccttttatcattctttagcataaaatctagcatttctttttaacacatgtctcactggttcatacagagcctggtagcatgtagtataccattctctctctctctctctctctctctctctctagtaagtctcagtgggcttcaaggtctgtgtatgtgaagcccctggggtttgtgttattactgggaacgttacccctgcccccctgacttcctgtccttggtttccatagaatgaattcagacagtggtatagaagatgaaacatccttaagagatgactgtaaacagtggctaagggaccatttttgttgaactatatgtttgtggagatggtgttatttctaaagcctctaggatataagtctttgctggtggtgggtattctgttgttcatgttactggcagaatcacttgattaacttttttttaaattatttttatttatttagatatatgagggctctatctgcat

SEQ ID NO: 22046 - DNA, 1580 bp, Mus musculus
agaggcaggagatctcttgggcttgattaaggtcagcctggtctacattgtgagttctagaacagcaaggactatgtaagagaaatcctgcctcaaaaattgtgaggggaggtggggatggggggtgggcagtgtaggtttaagtccatttttggagatggcctgtttgtgatagcctatgaatatattttgtgtttagagatgaaatacaccaggaatcttaagtactttactaatttaaatatagcagaataggtttaaaactcttaattagcctttttggctctagaattggatgatacctcaccctttaaaatagaactagtgtttcccagaactgagcagatgagatcaggccaaggcaggcagcactgcgcagtcggagtcctgattaaaaaaaacagctgtttaaagttcagtgtgtctgcctggaacttagcacacgtgcctcccacaggcattagctgaatgcagaaggagttccttgaatagttcagtgctttcttttaaactggagatttctttcttagacactggaacttgcgagaaatccagcgatgatgcaggaaatgatgagaaaccaggaccgagccttgagcaacctagaaagtattcctgggggctataatgccttacggcgcatgtacaccgatatccaggagcctatgctgaatgctgctcaagaacaggtgagcactcgtgcccaggctcagtctgtgactaagggtactgctatgtgcagaatgtggctgtactgaaaaaaatcattctgtaattgattttttttctttttattacagtttggtggtaatccatttgcgtccttagtgagcagttcgtcctcagcagaagggactcagccttctcgaacagaaaatagggatccgctccccaacccgtgggctccgcagacttcccagagctcaccagcctccggtaccactggcagcaccactaacaccatgagcacctctggtggcactgccaccagtacccctgctggacagagcacctcgggcccaagcttggtgcctggcgcaggaggtatgtgtgcctcgcattgattacaagactggtgctgaaactatttatgtatctgtgtgcatccctttaatgaagactctttgttgcagacttttaggattgtttgaggggtaggattaatatttatttatttatttaactctgtgtgtgtgtgtgtgtgtgtgtgtgtgtgtgcgcgcgcgcgcgccatatgtgtacaggagccccctggaaatcagaaagaggtgtcagatgccttagaactgaagttgtacatgttatgagccatcactcgggtgataggggttgaaccaggttctctgtgagagcagtaagcgctctctctctctctctctctctctctctctctctctctctctcaactgctactgtctctacacccacaacatgccttgatctgtgtattcattgtgacatgatcaaatgtagttgccatgctatacagaacatctccagagctcattcctgggaaaatgtgaaaaggggaaataacatattttaagatgacaaaatggttgctattcaaagaacatata

SEQ ID NO: 22047 - DNA, 1149 bp, Mus musculus
tggtttcaaacagttcttgaaacagaataattagtgtctgctggtatcagggttatattaacaagagctctggtcttctgtggttgaggttaactctgaacaaacaatcagtagtgtgtgctgtaggctattagtagggtgtacatgcagatttctttgtccagtatgagagtacaagtatgtcttcttaatacacatataaaagtcccctatcttagcatcaggaagtctcttcaaatgtactgcaccgaatagcccattgagctactggctcattagcaccatgataaccttcatcagtgtcaccagctgatgaaggcttttgggtacacttcatacctaagccgtagcataggaattaaagctgaatagtataataaataatgaataacttataatgaataagtataactttataaatgaataataggaattgttttgtttttaatggtttttaaaatatagagttaatgacttcatattttagcactgacttctgattttcattttttgttttttcctcttctaaggcggacttggaggacttgcaggtcttagcagcttgggtttaaacaccaccaacttctctgaactccagagccaaatgcagcggcaacttttgtctaaccctgaaatgatggtccagatcatggaaaatccctttgtccagagcatgctctcaaatcctgacctgatgcggcaattgattatggccaatccacagatgcaacagttgatacagagaaatccagagattagtcatatgcttaataatccagatataatgagacaagtatgtagaaaagtagttctttttttacttaaactaaagggtgtttatgtgtgtgtgtgtgtgtgtgtgtatgtatgtaaatataaaatgttattgccagagattgccttgtgtattttttataaagttagagagaatcccaaccattatttagggaaactcagcaaaacaatattaattttgtttgtttgagctctgagttttctgctatgcatgaaaattctttacaaactctccttagagacaggctttttgtgccggtttctcctttggtggtggaggtggtgggggtcctggaatgcagggtggagaggtgatgtcagcaccttgctccttacacgtttcaaataaaacag

SEQ ID NO: 22048 - DNA, 1147 bp, Mus musculus
agtccaaggccggtggctacacagaaagattgatccgggggtcggggccaagaggatggggcaagacaagataaaggaaggcaggaagaattttaaatgattgagaagtgatgtggaggtgcattctacaggatttgaacatctgattgggaagggagaaatgaggtcttgagacccggttgcttgtaagagggagcgtgaacacttggaagaggaggatgcagctacttaccggttttcataggactggggttgaaggcagctaaataggtggccataagcagttgaagcagttctaaaacagctgaaagaactgcacctggacagtacactgggtgctggggaatagttcagtcgatagcttgagttctagccccagaataaatgtaaaagctcccagcgtggtatatcaagctctggtcccaaagattagcgggcagaaacaggtggatccctcggtcttgttagctaccctcccactctccacaaaaagatagcacctgacaaatgataaccacaccccctcccagcatgtgcatgaacaacacacacaaggatcggaaactcctcagcttagtagcgtattgctataagagaagggggcagactcagtctagaaatacatcatcattagagtcttgctaccccaaagttgaccacatgtgtgtcaccagcaagtttgtcagaaacgtgtggatctcgggcctaacacacacctgcccattagaatctgcaacctcaaagaaattccaagaggtgaccccatcagattttgggaagctcagctctagatgaggaaagtcaacagaggaggggagggtgggcagggaggaagagagggacacttgggtaaggcaccacagcaggggacttcagtctcgtcaaagctgggccagggagtgtgggtcagaaccacacaccgtggagggtgcgggaaaaccacgtgtgtgggttgtgactggctgccacgatcacaacaaccgtgttttcactgaggagggctttagagactcttactttcgggctcggggttgcctagagacagtcctagccctgctcacacactcagggcatgttgaagtaagtgggtggattgatagatcaagaacaaagtgtccccagagcaaggtcagctaatcgtttatca

SEQ ID NO: 22049 - DNA, 1816 bp, Mus musculus
ttatcattgaaattgtcttaatgttgattaagatgttttgaacaaaaattctaattcgtactttttttttcttttcttttatagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttggggggagggcatgcaaaaactaacattgaaattttgaaacagcagcagagtgagtgacttttattttttgttcattgttggtggttttaaaaaaaattccccccatgtaattattgtgaacaccttactttgtggtcactgtaacattggggggtgggacagggaggaaagtaatagtccacatgtccctggcatttgttcagagcagtgtgcagaatgtaatgctcttttgtaagaaacgttttatgatttttaaaataaatttagtgaatctatttttggtggtcttttttttttttaagacaatttcaaatggtggttgaattttccagcccacccctaaactaaacactaagtttgattttcagcagctcctctgttggatataagtgcacctcttggacatagacaaaatacattggcaaactcagtttgggtgacttcttaatggttggaaagacttggcttgataaatttccatcacatattcatgcttataataagcttgggattttgtttgtttttgcaaatgtttgccactacttttcaacagttttctgttagttgtggagaactgcggtggggagcaatactacaagagttacgcatcttaagtatatgccagaagcctgatgggcaatgagctttattaaccagagtaaacttggttatggaagtggctgatgctgaataaatcctggttatttttgttagataatttctcacctatagacttaaagctgtcaacctgctagtgtcttgttagttgaactttgtaaaaatatatatatatacttgtttttccattgtatgcacaatgaaagaaaaaagatgtaccatttctctgttgtgtgttgaattatgtaggaaatgtttgtgaacgattcgaaaaaaatggaaaaagttcctgtggatgttttgtgtagtaacttggcatctgtattgatagttcaaaatccacatctaaataaaacttccatgatgttagttatgacgtgtgcccaatttgaaaaggggttgattaatacatgtaaagtttgttgaagtgttcctcttgtaaggaaatacagtaatcttaaattatggggttttgtgtgtgtgtgtgtgaagtgttttttgttttttggttttttttttagcacttagagacagtctggttaaagtgcatagaaaattcaggtaattatttagacaacctgttagtgctaaatcattttgagtcattatacaagcctcaagtgtaatctattttctgcattgtagtgcggtgagcaattagctggttcacatattctcagaattacctaccttcagctccaataaggtggagtcatgaataagactggtataagaatgagcaggtttttgtcaacccatgctaagtattgcatcccaagggctttagagggaatggtggcgtacttagtttgtgaaagagcacataatctgctaaagactaggaatgccacggggttaaagg

SEQ ID NO: 22050 - DNA, 1196 bp, Mus musculus
tccgttgtaatgaaatgaagcaagttgctgaggacggaattactggtcccccacaccccttgcggggggggggggcgcaaggctctggtggtggaggtggttagggtgtgcttcattgagacaatctagtctaaaagaagtccattatgcctgtctctcctcaattatagtttttaaaaacagttcacttttaggaatattttagtttcctcgaatcagaccttgtttttatatactactgtagcactaggatgtcacttgtgtgtgctggaagcagaatcctttttttttttttttttttttggaagattttaagcaaaagagtgtttgctttctgataagccaatgtactagctagcttctttatttttcaacagattggtggatccatttaattcaagaaaatggagaccgaacagccagaagaaaccttccccaacaccgaaaccaatggtgaatttggtgagaagatactttaattataaccaattagtattttctgttctgttactttaattaccataaatgtttttgatatgttctgtttacctcttatatagtttcatttttttgtagtcttgagtttgtctgttggtttttatgaaaagaagtaaccttttcttgcacaggttaaaaagcagtacagtttttccaaccaacattttaatcctttgaaatacttattaaaataaggcctttgatattagggatattagggagacaaaggcagggacttaaaaagtggcttcaattaccctttcttgggggatgtttctaattgaaaatttaaactttaatttctaggtaaacgccctgcagaagatatggaagaggagcaagcctttaaaagatctagaaatactgatgagatggttgaattgcgcattttgcttcagagcaaggtataagctctttaaaatttggaggttggttagtagttaaatataaatggatgctttttcactttgaactctgctttggctctggaaacctttcagaattttataacacgttgaataaaaggtttttaaagggttcatttgttttgagacccctcacaggtgaggcgggccttgagctcttgatcctctgtctttgattactgggattccgagtgtgcgctatcacatttagttgtggttcttaatgataagcagatttcagaactgccggtagtgctgaaattttaatggtga

SEQ ID NO: 22051 - DNA, 1188 bp, Mus musculus
tctaaagaaaatggccaccctttccaggcttgttcttcaagatcatttgagaataatacttatctatctattggcatggacttacattctccaccctttatctatttgtctgttctaatggccagaaagccaaaggaagttactactgtgacagtcaaagcgtttattgtcactttaactggaaatctctcaagttctggtggcttttggggtgtaactgcaaaagtttctgatggtactgcatatctagatgtagattttatagacgaaatacttaccagtatgatagggtattcagtaccagaaatgaaacaattaagaaaggaccctcttaaatataaaacattcctagaagggttacagaaatgtcagcgagatctgatcgatttgtgttgcctgatgactatttcatacgatccttcttcatgtaaaggggtggtgctggaattgcaagatgttggtatggaacacgtggagaacctaaagaaacggttgaataaataatttgccagaatgctattggagcacactttaaaacaggcaaatatttggaatcaaatttgtgtattctcagttttggaattctgtaagaaaaagcttcagagcttaaagctggggcagctccgcggttgacagacacagtgtctgccaagtgtggtaactggagtttaaccatctggtctctcgaggcaaaaggcgagaccctgcttccagaatccgttggtagtcctctacacaggtggcagaggacacacacacacacacacgtactaaataaatgacatttaaaaataaagatatttaatcaaaatatgtgaaagaatgtttatattttggtgatactggcccagagtcttgtaatgctagcaagtttctaccatagttacatctctagatccttgggatgtttgtttgttttgtttatttttttgttttccctccctggaaactggatctcatacacaggctgtcctcaaactctcttgtatagctgagagtgacctcgagtttctggtctcttgccttcaccacccaagtgctagatttagggttgtacatttttacctgtgcgtgctaggcaaatgctctaccaactgagccatatccccagtccttgttgaagggtttagctgacccactctggctgagaaacttgttttccacttgtcattggataaacctaaaatt

SEQ ID NO: 22052 - DNA, 1242 bp, Mus musculus
tgctgcgagatatgtactggtccaatgcctgtatcaacctacttgggagaaccaatcacctccatcgtggatttaaggcctgcttcgtggaaaggaatgcatacctagtactgtggaactagcctgtagctagtgtagtcacaggcccttgagaacccactattgatgttatactaactagatgtgtagttaatgtgttctcattatttgtgtttattcccatagactagcatagctctcagccttgatcaaagaagcctcttactggccaaagtactgagaataagtgaccaccgtgtgctctgtgctcagcggacatctgcgtggctctctctgagacccagagagtattgcagaagagggctggaaaggctgtgggagccaaaggatatggaggagtgcagtgggctctgtcacctgggtgtgaacacagcagctgtggctgctacacaagactgggctgggggaggggaagagggacaggagggtgggtagggaagaggggattgcaggaagggggaggggatgagatgtggcagaaagcaaaggtgattaagcctacccccaaccccatctgatctcagaagctaagcagggtcgggcctggttagtacttgcatgggagaccgcctgggaataccaggtgctgtaggcaaaaaaaaaaaaaaaaaaaaaaaacaaaccaaaaacccaaaaaacaaaaaacaaagtgtcttaaaaattcacttatgggttagagagatgactcagtggctaagaatatttgctgctcttgtggaaaatctgagttcaattcccagcaccgacatgatggtctcacaaccgtctataacttcagttccagaggatcccatgacctcttctgacttccaatggcaccaggcacacccatgatacacacacacacacacacacacacacacacacacaggaacaaagcactcatacacatgaaaataaataaatctaaaaaagtattttcaaatccagtttaaaagcctgcacttccagaggctctttcagagaattctcctgtcccaattttttaaaagtaagaaaggaaagctgggcttggcggtacgtatccatgatgccagccctctgaaggtcttcccggcctacacagggaattctaagatggtgggtgttacatagacagatccgatctgtgtctgtgtgtgtgtgtgtgtgtgtgtgtgtgtgtgtgtgtgtgtgagagagagagagagagagagagagaga

SEQ ID NO: 22053 - DNA, 1184 bp, Mus musculus
tatgtcctgtaccaggtaggtgacagtggctgtcagagcactacgtcctgtctcaggtaggtgacagtggctgtcagagcactacgtcctgtaccaggtaggtgacagattattgtcagtgcactgtgtcctccccgttctgcctccttgtctcacagtttctttgcattgtgggcaccacctgctggccccaggcccctggcacatataatcacataactcttggctggttactgtcacaccacctctagttggatctgtgtgacaagttccacagactgaagcgatcgacctcaaaagggggaggcctcctggaaccagttgtgggacgcttcgccagagaaaaaatattgagccgtagttctcatggcaatctatctgttttgttttctcttattccttttcttatttacatgttcctggtagcctagcctaagatcttaagcgagaatgatgggtaagacatggggctactaacatgaccttatccccagggaaaccaatgctttactttctaaatcatttacaaaactatgatgataaaaactttcccaacaataaaatttcttatggctacatgtgtcatcggaggtggattttggtatatggtgtaaaaaaaaaaaaaaaaagccttaattaggaagaattaaaatagtttcaatttatattgaagattataaaaattcaggtactagatgttaaataatataaccacgggactggaaagttagttcagtggttaagagcactgactcttaaagatttattaacctgcacctggaaatatgccacaagccttggacgacagcccccactgaatacatccttttacaattgttatattttgatgatttataatgatgttgcctgttctgtttgcgattcactgaatacatagtttcagagttgtaatgcttggatgatttttgtgttttactgtgttaaatgatttttttggtatttgtgattgttcctttggatatagtttctaagagatgtaatgtttgcttttttaatgtataaaatcccctgcttgagagctgcagaatacactcagattcaaactgcctctgtgcttgtttctgtttgtcaccgccggatccttacccacctagcttcaaggaccctcattccaggggcccccatgcccgactggggtggtccgtggcaggttactgatagta

SEQ ID NO: 22054 - DNA, 1212 bp, Mus musculus
tccacctagctcctgccacaccagctcctgtgtgtggcgtgaacgcaggcaccactgtctccagaaagtcccatgtctcactctgaagtgggggtacccagtggaataaaacggcctacaactctttttgtgtctagaaaatgacacagaaatgaattacattttctgccatgctcactactcaggttgcttagagcagagcctgtatacttcttgtctttgattcccaacactcactttcctggtgtcatctgatagcaactgtttttggaatgctagttgctcccaacttctcataaaaacaaagcaaaatacgtccccctcccaacccctacagcccagctttacagggcctgggagcttgcatttatattgactaaatactttggggtaattttagattcatcactaagatttaaatcactttgtgtctttttcttgtttctcagctgtgaactcagtatctttaggtaaaaatggagttgtggagttgatgtttaaaatcattgggccattcagtaagaagaattcgggtctcatgaagtaagtaaatgttgtgatgcgagtggaagtttatccttaggcattctgagcttcactgccctgacatgtacctgagcaggtgaggtcagctatagctagagtctctagttcttaaatagtcatttcttttaataaagatgttcttaattcaaagcttaatgtttaagttagagcatttcaatttgttaagtacactgttttaagggcgatgactgaagctggtggccctgtgcgaggggctgggctgtgtccagcaccatcccctgaagcctttgttgagtgcccactctaatgctcgcccattgtgcttagctctcgatgaccattcgtcctcttcaccattatggactgtctgaaagttacacacgcctgttttgtcctcaccattatggactgtctgaaagttacacacgcctgttttgtccagatcatgctattcttttatcatttcctgtcttgggatgcgtatgggtgtctgagtatgtgtaccttacggttacattgtgtgtggttttcattaatttataagtcctgtagtttcagaaatgaaggacattgtgttaggggttagatttagtgtagtgctgtggagggctctttatttgtttgtttgaggctcacacagcaaggctcatcctgtgtcctactccgcgggtgccagtgtgtcat

SEQ ID NO: 22055 - DNA, 1138 bp, Mus musculus
ctttccaggcacaggccactgtccttggctttggagctgttgattaaagtctgttggcaagagaagagccaggtgatgtgagagggtcacataagacaggtgtgtacatattggcatgaaggatggagcacagggcccgatggctttgggcatggctggtaaagtgcattactcgattttgcaagtgtgaaatgaatgatgatggggtggggcaggaagaaaggttttcagttttgagaagagcagagccagaccaaaggcttggaggagaaaaccttgtggggtgagagaggactccgggtgggtgaacgtgtgtttgttgcttgtggttttctgaaatagaatggatttcttcatcagaaatgaacagtgttataaaggcagtgagcggctgtgacatggaagtggttaatatttatgttaaacagcggtctgtgtgagcaacattctctttgaggttggcacagaatccacactaatggagagtaatgttctttttagccttaccaatagttctcgggttgtgggactcctggctcagctggagaagatcaatacggattccacagagtcagatactgccagatatgttacatccaaaattcttcatttggctcaaagtcaaggtaaactccaatcccttccttgttttatggaatactttttcagttctttaaaagtagataactaagagtgtcctggtttttgatatgaagactgttccaagttttgatgtctggatagaagtaggagactgaatgcctttggaggagtttgattctcagtgcgcttgttagacttgatccctgttcaaataggtgcctgagagaaagcttatacaggaaacatgtattttggttctgcctcagtggccacagtcgatagccaggtggctccattgtttttggccctttaggaggaagcatgctgtggtggaagagtgtggagcagccaagtcagtcacctcattacagccaggaacaagacaacctgcacacatggctgacccctcagtttttcttcagaaaccccagcgtatttattactactgctgctcacaatctccatgctagtccgtgtgtctggagtgcttacaggtgcgggcagctggccgtgggccctgctcacctgctaggca

SEQ ID NO: 22056 - DNA, 1187 bp, Mus musculus
ataaattcctaactccctcgtatatactttctcacctctagatcacttgattattacaatgtaaatgtcttctgaatgtttgctgtattatttagggaaggatcactccattattctgtgcatgttcaaaatatttttctggatgtttttcattccttagccagatccatggctgtggagtctctgtttatcctatgctgactgtatttatgtctctttcatagtaaaggtctctcaagtcctgactgctggctttcaaatggtagatggagccattgtgttccctgcagggacttgtcaaatgctgacaccactggattcatctgggctgtttgtcatgagctggtttagtttcagagaggtggcatctctaacccaaggccctcctggatgggctgtgcaaactggatactgcacagctttagtgtaggcatcaaaaggtccctggagctttgcaaccgagtcctgctctcagaatctgccagctgccagccgccagccgttgagtagcagaagaaatctgggacttgagggaggacaaatctcaaatcctttatgacattttgctggactcttttgcatggggtactttgttatccttttgttatccaagccgcaccctgctgacaactccccctgcttgcttcgcctttcacagtcttctcagtggattgatcgggggcagaagggaactccacacaaccgggaagaagtcagatcgtatgcttcttaagcatggagtcctgctttagcctcgccctgcccttcatctctagagatgcttctgtgagttctcgaatgtgcagtggtgcaggtgtgtcctgcaagtgaccccatccttttggagtagccattgtccagctcctctatctgcccatcttttcaactgtactgtctacttcttcccattccctctgcccttgtgtcttttacagagattaacattttcactcctccacattgaatagataaatagataacctggctttatgatggtgtctaaatatactccatccccagtgttcttacttgtaacgctttgtaattgggggtactgtgattgggcacagcctcacctgtgcagagcccaccactcactgcacctcccgtcgtctttttactttttactttcagacaagggttgactgtgtaggacggactagcctcaaacttgtgattctcctgcc

SEQ ID NO: 22057 - DNA, 1137 bp, Mus musculus
ctacctgcagttcaaggtgagcttgctgcctgaggtcatggtggtgccacccatcctgcgggctgtgggactgctgctaaagatgatgataaggggataattgagatttggggtacacgggttaagaactttgtgtcacatgggcacagattgagatgttttcagcatttgcttaagagtctggggagctggagagatggctcagtggttaagatcattgactgcttttctggaggtcccgagttcaaatcccagcaaccacatggtggctcacaaccatctgtaatgagatcggatgcccttttctggtgtgtctgaagacagtgacagtgcactcataaagtatacatgtaaagtaaataaataaatccttaataaaaaaaaaagagtctgtatggatgggtagtcagaaggtttatattaaacatattgtgataaatcattccttctttttaggaaatgtctgacctcaataaatacagccctcctcctcagtctccagagctgtatgtggcagctagtaagcactttcagcaggcaaaaatgatccttgaaaatatccccaatccagaccgtgaggtaagtaagagtgggttcactgtacgtccttggggaaagcatacatcctgccactgggggtgtcagctataatgagtcaaccagacaggctgtcaaattgcaagaattccaggttaaccattttaagtctcttccctccaccatagggcttcactcttttgtccaggctggcctctcagctcctggtaatccccttgccctctgcctccctagtgttaggattaggtcataatctataatacccagtttccattatacattttaaatatgaaaaactatccagttactatagaacattttatacttgaccattttgaagtaaaaggctattgcattaaaagactgatcaacaagagcaaactttgaaagcaaacatggtttaagcatttgatggtttgattatgtgcattatccccagtgtaactgagatacatctactctgttagtgaggagttactcttgacatgtctaagtcactgagggaactcttgatgcaactctcagtgccatgtgatttagcattgtctgtcagaaccaagcagtgctgggctcagatgg

SEQ ID NO: 22058 - DNA, 2390 bp, Mus musculus
caccctgcagtgtaagacagagtagactgagggcagctgctggccacagcggctccctccttgtgctgccgcttgccagtttctgtccacagatattaagtagctcatcactcctgcacacacttgattccaccatcaatggcctagagctcttaccgtcagcataaacaccactagtcagttctatacaaaagctgttctgtgcaaaaactgcattaattaaaagacagccaccatatctggcttacttcaggattcggaaggctgaggcaggagattgctgcaagttctgagccagcctaaagcaacatagtgagtgccaagctaagatgagcaagaatgaaagcccctgtctcaaatatcagtgagagttgttactttaaaaaagactggtttaaataaccttcattattcttttgatgtacagaacactatgaagttactgacaatgcgagcacctatggtctgtgtttgtttgattgggcagagtttctagtaagtcactcatctcactaagaaaggcagtgcctgcactgcgctctggacaaaggctgcatgggcagaggtgtccaagaggaagggttggctgctggaggatactcaggtttcaagctggattcctacgaaggcaagagcaacacgagctgtttttcccaagtttatatactgtttgaaaaacacacaaggtgaatgttagttttgaaagatttgtagttcattgatggtaatgcatcgtaagtcttgattccgatcagcagcttctgattgcagactgactgcagtcacactgacgactcgttccagaaacgatctctctgaagagtggctgatctgactctgaagtgctggctaaataggaagcagcagcactagaggcacaggggctgaagatccctgcagtgaagtggatgccgggtggtccagctgtctgtgcctctttaaagcacacatttaaacccctatggcagacgtgggttgtttctcactgcagaactacccagttctaccccatgtttagatgagtactgtttaatgtcacaagccattttcctttacactttaacttgccagagcctcagatggactgttcttacaccttttctgctcctaggtcccaaactcaaggggactttgtatttctagtgcttgttttctaccttaatctggtttgggtttaaagtgtagatattgctgacaggctgtgctgatttcctttttaacaagtacaataggtaagggccacattctaccctttgggttctaagattccagggtaccaatagccatgcatgacagctgagccataccacctccgtactgaccaggaagtaaccaacatcctgtcttcgctagcatcttgatcaagtccagtcaggcatgcttcagtgtttctaggaaatggaaggtgccacagggttgggctggcatagctccgtgagaacttctacctagccagtatgtgtgagtccctgggtcgcatcctcagcaccaacgaacactgtcacattagagttaggccactgaaatcttagagtcatttttgctgtaagccaaatgaactagcaatagtcaggccaaaccacaaagccagattgaatttcagggtggctcactctgctaaaagcactgccccttcagagtacaaatgggaaaccccacgggcttagacagttgtcacagcacaccagtgacaagaccagcagaggaatgagcagcaaatcaaggatggggtctcttgctggtggccaagaacaaaacctacacctcagggcacttgggacttcagctggaacaaagggatgcaccactttccaacaagacctgaaactcagcggcctacaaactcctacctgataccagcagcagacactgcagtgtgatgtggttttccttcaactgcatgactaaagacccttagaaatctgtgtcacaacacagtcacaatcctcatgtactttagcgatcctcttacctcaaaatcaatttgtaatttgaccagaatcttaaatccttaataaatcttgtgttttgaaacttcaagttttagggttgtttggtgtttaagacacaatctcgtgtagccaaggtgggcctcaaacatagtacatagctgagggtaactgaagcctgaccctgcaagcctcagagcttgggagtagaggcttacacctgcagactctgggtaacgctggcactgcctgttcggaaggtggcgctctagttctccacagggcagctttttttttttttttttttgtcaagaaatttattaacctttacaaacactatttcactcaatcattcattaaaaaaatgtttacaattaagtctgtaatcaaaccatgtagcgttcaccaatgcattccagcccagttaccccatggagtaca

SEQ ID NO: 22059 - DNA, 1133 bp, Mus musculus
tgctagaaccagcttcatggccattgctttgctgggaattgaggaatgggataacaggcgtgacctacatcacagcatggcttgagtgtgtctatccctttctcaatctttgccaacccccgatctcaggcaggacaactgtgggtcacggtgtagtgggacctcatttccctcacctttggcatggcccattacatttttaccaaaaatgtgatgatcacatgcctcgtttgccaacccttcaacagttcctgagttctgagttccagtatctgaacttgggcaccaccaggcctgggttagcacatctcggtgagcttcatgatggtttgctgtagacctttcagttagaaacgcttgtgctaagcagccagcttgcttgctcagttcctgcccagctctcccttcctcgaggtcacagcagtgctgtctgagacattcggtgaggagagtggcgatggcttcccgcctggccagcgctctcaccagagtttcttagtttatagagacttgttagttttcttttgactagactcttgtgtaaaccctttcgtgtgagttgccatcttgttcgtttagaactttgaaacagtagttacagacatctgcagcccgggattcctctcagcaccgggcctgtggagcggaacatgccattctgacacttgccagtatgcatatgctttctggttcctaaacgaaattgctaaatatttttaaatatttttatcaccagttttttgagccatggttttgctgtatactacaggccagccttgaacgcacaatcctcctgcttcaaccttctgaggcatgtgctaccatgcctggatcccaagtttttccttaagtggtcttgattgacttgggttggacatcttaagtaacctgtgaattcttttgtggaaggctgagtctcatgcagctgagtttaatatttgtgctatttactaaaatacctaccaccaaaatataccaactcgtagttttatatgaatgttgatgagtctgtatcataaatagaattgttgatacatccttaatttgtgcaatattgtatgaagagattgagttgtcgattaaaaacatgcatctttatgatcctagtggttccttttcttgttggggaagag

SEQ ID NO: 22060 - DNA, 1358 bp, Mus musculus
tgcctgtggctgcattgaacagcctcggggctgtaccttaccagcactgaggaagcagtgtctaagcactgcccagtgcctctgatggctgtgcacttgtttatacctagcctaactgctcgactcaggacgagtgccctttgtggtgggacacgtgtctgtcagtaactgacaataagtattgtgtgactttgctcaaacaccattcttttcgtttatgttggattttgttttccctcctaggtagcctttccagtaaatatatgactcaggggagagcctcagtgaagaggacccagcaggaatcatgagggaaggaactgcagcactggaaatgccactcaggtgtccgtggccacttgggaaattaggttcatggcacaggacacagtgacacagatcaggcttcaacgtaacagttgaggggcatcgtaattttttaaattttaatgaaattgttaataaggaaaagaaaaattttaatatagtctaactataccaccaatctccagagatttgaagattttaatagaaagtcaacttaaaagaaaaatatgagggccagaattcaatgactacagcgtcatggattttagttctttcaaagcactctaaaaatagtgtgctgctcaccagaggagttagccctctttccctacacatcccctttttgatttccaagaggggattctctctgttgttcctggatcgtggtatggacgcacatcaaggacatgtggactatactgctgtacatagggtctacaagcattcttcatggctcattgtagaaatgatagcatggaatgcaagcacctgtcagtgtgggcctcggtggacgaccacagcaccactggcacatctttgagggcttccttctctaagtaattgacagaactgttgtgctcataaaaatgaagtcataaaaataagtagtccttttttgctggtttaaaaaagaaaaattaaaggagaaaaggacagaataaaagtgctttttactttttatgatacacagaaattagggtggagagcttttacaaacctctgaagatcaaagaggctgctgtctctgccaatcacaagtttgattggcaaccttctggtctgactggagccctctctaaactgttaatgaacttcacaagcctttctgaaatagtacagagtcagaactatgccggtttatttatcattttgaaataaaatcgaactttgaacgtgtaattttatccacattattttcttatgagtcattagaaaagtcaaccaaagcgctgacagtacacatctccttaatagggtgcccatgctgttcccctttgatagctgtgcaccgggtctggggtgtgcaagca

SEQ ID NO: 22061 - DNA, 1207 bp, Mus musculus
agattcctttatctatttagcatctaaagagcctcatagttcagattgcttttacctaataagcattaacttatggcctggccacagggtgctgcctgtaaggcttatggagactgagggagaggcatccccgactgggattcctattgggaaccccaacagcaagaaccgtttttagtggaacttactgcttataataagttagagctatgtgtgcattctgacatcagaaagaaatgcttgtattagcttatggctatactgtaggttttaaacactctgtccttttcaggatacattatctgaattttaaaaattatgacagttttctacacaaaatatgagcttgatcacataggagtacttagtatgctccacagctcatggcaggagtggctggaggccagagaaaagcttaggaaatggctgtgcagtccttgtctgagtgcctgctctcagtgtgtcctgcttctgggtgggcacgcctttgacttttgagtatgccttcagtagcagtgtttacttcttatagctttggagagatttcactcctgtgactcccacctgcttacttctctccagactgttctcttaggctttatggatcctcctgtagccgactgggcttcagagactctgacgtgaacattgatgttcagtttccagctgtcgtaagtacaaaatgatctgctggacttcacactcacgaagaattctctcattgtttagcattcagacattttatatttatgtgcttgtgtgagctcatatgcccttgccccctgcccccgtgtgtatgtgtgtgtgcacgggcgtgccagatgtgtttaggtgcccgtaaaggccagcgagggtatcagatctcctggagcttgtgagccacctatgtgggtgctgagatctgaactctgggagagcaagtgctcttgactttttagcccatctttacttaagctgtttttattgagttcatgggcacatgtgtacagtttcagtcacctggcagactgcctgatcataggctatccaagcagttggtgatctggctccttatcagaaacacacagctcttagtgtccttatctattccgtccctctgaaaacggacctgatagccaccttcttagcagagtggcagaggccctcagggaggtcagggcaaggcttctagattggagaatgctcagaatttaatggctggtcagca

SEQ ID NO: 22062 - DNA, 1155 bp, Mus musculus
tgcagctacgcctacagccagtacgccgaggcttgtgcgccggtgctagcgcagcgcggcggggctgatgctccggggcccgccggcgccttccccgcctcggccgcgtcctcgccgcgctggcgctgcccgagccactgcatctcggcgcttatccagctcaaccacacgcgccgcgggcccgcgctggaggactgcgactgcgcgcaggacgaacactgcaggtccaccaagcgcgccatcgagccctgtctgccgcgcaccagcagcgtgggcccgggcgcgggagcgggctcggtcatgggctgcactgaggcccggcggcgctgcgaccgggacagccgctgcaacctggcgctcagccgctacctggcctactgcggcaagcttttcaacgggctgcgctgcacagacgagtgccgcgcggtcatcgaggacatgctggccgtgcccaaggcggcgctgctcaacgactgcgtgtgcgatgggctggagcggcccatctgcgaatcggtcaaagagaacatggcccgcctgtgcttcggcccagatgcgagcaacggtccgggcagcagcggctcggacgggggcctggacgactactacgacgaagaatatgacgacgagcagcgcgctggggccgcgggcggcgagcaacccctggacgacgacgacggccttgcgcgcccgggcggcggcgctgctgcggcgggcggccgcggagacttgccccacggtcccgggcgcaggagcagcagcagcggcagtggaggccactgggcgaatcgaagcgcctggaccccgtttgcctgtttgctgctgctgttgctcctgctgctcgggtcacacttgtagctcctgcgcccctgctgcaggctgctccaggccggtatgcacgacccagctggttcccgagcagggcacctgtggctcggagaccggagatggtcgggaacactgacccacactcttcctgggtggacagggcccagctcgtaccgcagccaacatgttcggccctcttctgtgcggttttccaggctgcagagataaccggctgatctatactgccagctctaatctgcagaattcgggacaccctgcaaaagcaaaggaggcctagactcagagtgctgaacggtgggggtctttcaa

SEQ ID NO: 22063 - DNA, 1169 bp, Mus musculus
gtacatgtgagtgaatggcatatgtatgtgcatctagaggccatctgatctcttggagtggagttacagacagttgccagctgacttgagagtgcttggagctgaattcagtccccttggaagagcagcaggtgattttaacttctgagccatctctccagcccaggatatgcactctcactggacttgaagcctccagtagccaaaagatatatcaacagttatgaagcaaatctgtttggcatggtgtatatgcaaagcagatgatgatggtatgtgtgtgtgtgatgtgtatactgtgtgtaatgtgcacagtgtgtctatgtgtttatgctctgttgtggtttctgtgtatggcatgtgtagtgtatgattttatatatgtgttgtttgtgtagcatgtgtcaataagtggtgtgtgtgtgtgtgtgcatgaatgagattgatgtggttatgtgaactttgtgcatttagttatggaatatgtgacaacatatgctgggttcatgtgtgtatatgaaactgccatgtacctatgtggagcatcttgtttgtgtatgctggtacgtgtgatagatcggaagatcggatgtgcatactcgtaggcttgtgtgcctttggaggagccaggaggaagtccagaaatgatgctcgtctaaacctgctttggatggagggggcttctgaagtggctataaaagcccagcatctgtaaagttagaggacagccagggtgaggaccagattggttccaggctgtggagttgtagcctggtgatatcgggctataaatataaacatctgagagcaaagccccaggcaaactgggggttggagagccctgttccatcctgcctgtgagagcagtgactgcagcctccaaccgccaccccatgggaatcccggctgcttcgctggttaaaatgctttgtagctgctgatggcttaaagacttcaccatcttcccagctttgctttaaggtcagaaggattctaattaaagccaaagctgcaatctccgtgtcagcattgaaatgagcaccgaggccatccttttgggatcttcacagaggaaatccaagatgataatttctcacagaagtattgtctaataattgagccaaatagcagctctagagagcgactcagggtctgctcttttgaagtgc

SEQ ID NO: 22064 - DNA, 1203 bp, Mus musculus
ctctccacagcggtgatcttactccagcctggcgtgcacatggtactgtcaaaacaagtagactatgagaggggccttttaaggaccggagaactggcgatagaagaggggagggggacagtcaacttgcctcatcttcaggataggaaacatgttactgggtttaataaggagcatggctctgattagccacactgtctcagccaggctgcttgtggagctttctgtgaacgttgtaagtcactgctagtgggtctggcctcagatttagatagactggatgaagtctgactttaagtttaatggtttctgtgtattcgtgtgtcgcatacgcatgtgtacatgattttcggtgaacttactttaagccatttctagggctagggattgccaggctcagcgtttatatgggtgctgagattatgagctcaagttctcacatctgcgtagcaagcactttacccacaaagccatctcctcagctgctgggtcatatacatataacttcatgctcatgtgtgattttcccatatgcgtgtctgtgtaccttgtgcatgcctgctttctgtggaaccagaggggggtgttggatgcttttgaactgaatccacatgtgggtgggtactcagaaccaaacacaggccctctggaagaacagcagtactctaaccactgagccacctctccagcctcttcactttcttttcaacttttacttttgagacagagtctcacgtaacccagacttgccttgaactcttgatccttctgcctctgctgccaagtgctgggaatcacaggagtgagccaccacacccagctcaggtgcctgatttacgcttcaccgtgagtcagacatacctaggcagcttattaacctgaagattactggccctgggagctgagtcagaacctacggccctggaaacagtattcttaaaagtccctcctccagcctgatccagctgctgattgacttatctgcagcagctcgggtacctaaatctacccgtacaggtgtgttattcacacttaataaatagaaacacttgggctggggagatagctccctgaataaagtgcttgcagggcaggttttccaacccactcatgtaagtgaacacaggtatgatggcaggcacttgtgagcagcgctggggtgtggtgacaggcagagctctggaggtctctctagccaagcag

SEQ ID NO: 22065 - DNA, 1149 bp, Mus musculus
gaggaagtaggcatctgacctctgacccccacagagcacattccaggctggcgtttgctgtattagctgccagtcgtctgccttgtggaaaatacaaaagtcatatctatacagccgcatgtctttttttccgatcagaaattatacagcgacggttttggtttggaagctggcgtcaggtcactctgtgtgggtctcttgtgatcagatcagcccttggccctgatcacaccattcttgtgaaaagatctcagtgcccctgcttagctccttaagatagattcctagaagctgattccctgagccagaagttacactttaaaggctctggaaggaaaagagtttatgttgtttccacaagtgtctgccagtgtgttctcacgcccagggtgagagaggccacagggtcgtgtcctttgccagacactgttgtcttaaaaaccaaagcccagacccaaactgtcaccttgtctaacagtccacaggtcagtttgagcccacaggctttgagccctcattcccccagctccttctctgaggatgtgactacagagctccgcaggcagcagcttaatcttcctgctactccttttgaggagccgcgttcagcttccagcatcagacagctgtggttcggtgttccattttattttgagatttgggaccatctggaattctcggcttgggctcctttcagctcagatccaccgtctctaggcttttcctttttatctttatgctgctgtgatttgttgtcgttttgttggttttgtttttcgttgctgttgttttctcagacggggtctatctatgtagcctaggctgtcttagagctcactgtgtagtctaggctggcctccagtgtgtgttttaatctacgcttgctcagtacatcaatgtagacccccgtggcatttaggacagtgccctcaaggggtacttgggaagttctctgggctcttgtagcaaacagcattgccttcagattatcctagcttaccaagacataggtaacctgttaatgaggaggccatgccgcacacctccctcatcccgactcagactcacgtgcattctccattgcaccctgaagggaagtctttagggtcccagactgaaacatcaggaaatctattttcttggctttct

SEQ ID NO: 22066 - DNA, 1767 bp, Mus musculus
atcagccccgggacttcttccgtgcgcagaccctgaaagagagttcccttaccaacaccatgggtgggtacaaggagagcttcagcagcatcacgtgctttgggtgtcatgacgtctactcacaggccagtcttggcatggatatccatgcgtcagacctgagtctcctgacccggaggaaactgagtcgcctgcttgacccacccgaccccatggggaaggactggtgccttctggccatgaacttgggcctcccagacatggtggccaaacacaacgtcaacaacagggcttctagggatttcctccctagcccagtgcatgccttgctacaggaatggacctcctaccctgagagcacggtgggcatccttatatccaaacttcgggagctggggcgccgggatgctgcggactttttactgaaggcctcctctgtgttcaagatcaaccttgatggcaatggccaggaggcctatgcctcaagctgtaacagtggcacgtcctacaattccattagctcagtggtgtcccggtgagggcagccttggcttgggtagggtctttatggactgagatgcaagggcggaggggaggggagggggcagtgcacccttctcagggcagattcccacacattctttatgctcctgaagacaccctccaccccgtcctctgcttcccaatctccatctccctccctgtcacacatcccccagtcaagagcagaccgtatccttcactttggtcatttgggatgctagagcccttcctgtcagtgttttggactccatctcttgtcctctaataccttgcttattactgataattttattgagattccaaacttttcgatgaaaacaatttaactcctttattgattatccttatcaaaaaagaaaaaaaaaaaagaaaaagaaaggaagaaataaggaaagaaagaaagacacacatttatccataatgtgtatttcttatccttttctctgctgtaccagcccctcagcttatctcttttatatttgtaggagagactcccatgcttggaccccactgtatgatttataaacagacaatatgtgagtgccttttgcagaagagggtgtgttgaatcatctgagtcagaccggagctgccaccaaggaaacgctacctctctgtcccttgctgtgtgctgatcatcgccagaggtgcttcactctgacttgttggttttggatttttttctttctttctttctttttctagggagggggctctgtgtttcatttggcaaggaaagaggagaaaggagtcctccccagagtgttcatggccagtgttgctgtaagaagacaattttggttgcttttgtcaaaagatccgtgtgaacacgcacatgagacctacagacggtcacgctccctcactccctcccttctcaggtagaaggttgacatagtgtagggctacagagacctgtgttaagaattccgaagacccccccccccccatgtgtaacccatgccagtccgttattgttggtgcatagcaggttggttctacgctgagatcctggtttggtcacttcccatacttgaagtcagagagaaaggaaatagagggaacgagtttttcttgggggtgaccaagattgtgattgaattctaaatcagtgtgagggaaagtgttttaattcttctgtcctgagaagcatgtcatgttaccatatcatctgtacatatatatatgcactatgtatatacatatatattgatactggtattt

SEQ ID NO: 22067 - DNA, 1203 bp, Mus musculus
cattctgactttgaaaaggagcattcatttccttgtagaatgaatagcatttttccaatactgtttgaccttgcctctatgtggatggttgcctgctgagaagtcccagcacattttggaagtactcaacacctatcccgagcttatccctgtcccgcaggaaataaacacaggacatgccaggttcttccgtagttaactttacttctatatcatattgaggtagacaaagaaggctcagaaagtgtgtggcttaaatacttttggtgacgtgtctaaactaggactggtagcaacacccatgatcctcatgcaccctggggataggttaaagcccccaggggttgggcaaaagccccggagacggactggtgactttggcaggctgtgctctcgcagctgcgcacaaagaggtttagcaccatctagtggcggcacatagattgcagccctttacaaacaccaacatcaatgggctgcggaaaatagcctttgccatcactgccattaagggcgtggggcagagatatgctcatctggtgttgaggaaagcagacatcgacctcaccaagagggctggagaactcacggaggatgaggtggagcgagtgatcaccatcatgcagaacccacgacagtacagcattccagactggttcctgaacagacagaagtatgtgaaggatgggaagtgcagccaggttctggccaaaggtctagacaacaagctgcctgaggacctggagcggctgaagaaaattcgagcccatagaaggctgcaccacttttggggccttcgtgtccgcggccagcacaccaagaccactggccgcaggggccgtactatgggtatatccaagaagaaatgagtctctgggtctttgctgttaataaatagcttatatacctatgggggggggcttgaaatgggcttgatgattatgtgttccagagaggagggatttgattagagcccaccaagtattacttaagcctattctatcaggaggattatcttaaattttgaaagagacaaaaaaatggcctttagttccagcactggggaggcagaggcaggcagatttctgagtttgaggccagcctggtctacaaagtgagttccaggacacacaagaaacccccgtctccaaaaaccaaaaaccaaaaaccaaccaaacaaacaaacaaaaagaaaaccgaagc

SEQ ID NO: 22068 - DNA, 1148 bp, Mus musculus
aggaagagtgctggccactgagtttgtaattttcattctgattatagtcttgcagttcttatttaaatgaccatgttagattcacaggcctgtttatgtttcctttttacagtgctgccatctatgttgtatgattcattaattataatctaattacacaattgtttatctaggaaataataagccttcacctcttttcttcttctgataatttactatcagttccttgagtttttgttggtttggggactttctgtggagaaacagtgttagctttctcttcttcacctgaaaaggttgcctctcctcctttcttggagaatctgtgttttccagtccttgcagtcatcagtgtttggatttttaatccttcagtgactgatttggtatgggggttcttaaattattttcatatattattgtctctgtctcctaagttacttaatttgtcagcatttcagagcctacaatcatttgagagaactacagttgaggcggtacacagtcagaatgattgtttgctaatttggtgagagattgtggcattgtgacccttgactagggaaggcttatccactgagtgtggaagaattgctaagtgagtagggctggcctggatgagcaagagagcaagccaggaaacaatatttgctcatggtttttgcttttatgcttgaagttggatttctatcataagattcccaaataatggaaggaggttttggaatttttttttaattggatattttgtgtatttcacatacataaaatatttcaaatgttatatctgttcaccatttcccctctggaaccgccttttctcatactgccttctcctgcttctatgaggatactgcccctcccaccctcccactcccatttcaccgctctggcattccagtacactggggcatggagccttcacagaaccaacggcttctcctcctattgatgccagacaattccatcctctgctccacatagggctggagccatgagttccaatatctgtactctttgtttggtgatttagttcctaggagttctgaggtatctggttggttgatattgtttttcttcctatggggttgcaaaccccttcagctgtttcagtcctttctctaactcctccattggggtccatgtgc

SEQ ID NO: 22069 - DNA, 1221 bp, Mus musculus
gtcttttcaaaacattttaatcttcaaaagaataaaagaatccacactggagaaaaaagctacgaaggaattggattgtgagcaaattttttacaattttttacaatttacatttctgaatgtataagtgaacgtactgaagagaaagactatggatgttatcatagtcttaatcgtcatgaacatattttaggggccagaatccttctgactataaggaatgtggaaaaatctatgccaggcagttatctcctaatgcagcaaggaacacatactgcagagagagagagagacagagagagaccgtataaatatacacaatgtggtaaacctttgcgtatcacagttatctttgaatacataaaagagcacacaatatatctcagaattcataaaagaagacactgaagagagaaagtgtgtgtgattaatgtggtaaggcctttgcagttgacattgacattgatctcatcatgtataaattaacacagacttgtaagaaatctcataaaaataagaaatgtggtaagcttgtgtgtggaccagtcatttttttcttgagaaaaatccatgctgcaggttaaccctgtaaatggagccactgtggaaacattttgtacgtcacagtatctgtatgcgagagtaaaacctttaacatggactggatcgcttaaagtttgcatgtcacaataatcttttaggactttaaagaactcaaaaataaggcaatctatgactctgatggacatggttccatcttgtgccaacccagttacattaatttacacattattcatttttgagaaaacctttagcaaatgtcaactatctgctcaagcatggtgtctctattttgttcatacatggaaactcatagggacaaaagccctgtgagattcattgataacgtactggtttaaaattcacagttcactttaagtccgtaaaataactcattcaggtgtgaaacactgttggtgagtattagtgccttttctgttgttgtgataaaatgtctaaggtattgtagaatactgaagtcccaaaccagggtttccaccccagctttggccaatttttttccaggtaaaacacacacaacttttatatttgtaataaaccttaatcaatacccaatattggctaatatctatcctctatgctatcttgtctatttgccagccagtaattttgtcatattattttgctttatttcttctg

SEQ ID NO: 22070 - DNA, 1134 bp, Mus musculus
gaaaattaagctgttgtatagcagaaaatataggaagatgtaaaaccctgacctggtttcagggaataaacttttcttaattgcttggccatgtgtctaggcatgtaaatattttacagtgttttacatcatcttgatgtcagaaaattgaaaacacttatacaagagaaaaaccctatgtatgttgatgatctcattatagactgtagacaccacagttgtttttgatattaaggaaaaaactctgtttcatttcttcttcatcatggccttgaaagaagtaaattatttcccatgttcagacaagtgttttagtagagatcaccaattgtggtggtggtttttattttcaaacttttgggatagatattgacgtttgttctatgactttcgaatccatttacaggtgtttattaggggatccttgagttcattctgagacttaagttcacctttatttcaacttgttgaaaggtatttttctgctgcaatgaatttagtgtgatactcctcttctaagtggcccattctttaaatataaggatctgtgtgattacacatttccagtaaggttgctgctaaaagcatggtgagctctgttttgtgtttcattttattcacaaacttctttgagatatggttgttatccagcctggagatgtggttgatccagtgaatattaaatttaccagtagagggcgctccttgcagatatatcttatctactttcataggtaattcatctcagaggggtgagaaacaggccattggttttaactgtgtgtttgtgatgtttcctatatgcttggcctggggcatgtcattgttggagctgtggccttgtaggtatgtgctttaatacccttgtcctagctgcctgggagccagtattctgctggcagtcttcagatgaagatggaaaaccctcaggtccctctgcaccatgcttccctggacagagctatgctcctaccttgacgataattgactgaacctttgaaactgaaagccagccccaattagatctttgctgtataagagttgctttgttagtggtgtctgttcagtaaaaccgtaactaaggagtaaaatcctaactaacacattgtatgttcacatatcttacactgcatt

SEQ ID NO: 22071 - DNA, 1177 bp, Mus musculus
tgtaatcaatgtgataaagcgttttctgagaaatgtcatctccaaaaacatataaggatacatactggagagaaaccctacaaatgtaatcagtgtgataaagccttttctcaatacagtactcttcaaactcatagaagaacacatacctgagagaaacccttcaaatgtaatgaatgtgataaaggcttttcccaatactgtcatcttcaaattcatagaaaacacatacctaagagaaacccttcaaatttaatgaatgtgataaagccttttcccagcattataatctacaaattcataagagaagacatactacagagaaaccttacaagtgtattcagtgtgtgtaagtcaagtcttttcaaaacattttcatcttcaaaagaataaaagaatccacactggagaaaaaaagctacgaaggaattggattgtgagcaaagttttttacaatgccatcatttctgaatgtataagtgaacgtactgaagagaaagactatggatgtgatcatagtcttaatcgtcatgaacatattttaggggtcagaatccttctgagtataaggaatgtggaaaaatctatgccaggcagttatctcctaatgcagcaaggagcacatactccagagagagagacagacagagagatacagagagagactgtataaatatacacaatgtgctaaacctttgcctatcacagttatctttgaatacataaaagagcacacgatatatctcagaattcataaaagaagacactgaagagagaaactgtgtgtgaataatgtggtaaggcctttgcagttgacattgacattgatctcatcatgtataaattaacacagacttgtaagaaacctcataaaaataaggaatgtggtaaaagcttgtgtttaaaaccagtcgttttttttttttttcttgagaaaaatccatgctgcaggttaaccctgtaaatggagccactgtggaaacattttgtatgtcacagtatctgtatgcgagagtaaaacatttagcatgtactggatcactttaagtttgcatgtcacaataatctttcaggactttaaagaactcaaaaataaggtagtctatgactctgatggacatggttccatcttgtgccaacctagttacattaatttacacattattcattcttgaga

SEQ ID NO: 22072 - DNA, 1102 bp, Mus musculus
ttcttctttcgcttcatatggtctattaattttaccttggttattctgagcttttcaactaatatctacttatcaatgagtgcatatcatgaccaattgtttcttggtcatgatgtttgtgcaggaataggaaccctgactaagacagagcataaaccattggtgttctgttcaggaaatttttccctgtgcccatgtgtttgaggctcttcccccactttctcttctattagtttcagtgtatccggttttatttggcggtccttgatccatgtggacttgagctttgtacaaggagatcagaatggatcaacttgcttccactatggactggtgccatgagtggacattgggtgtaaattctgtaacctgtcccacaacacccagaggaagcaccactctcaagtgctctaacacttcctggatcataggattagaggtgaggagcacaaaacatgtgccccaatacctgcagtactgggaccataggtaaccaggcacccaggaactctgccaatattttcttatatccaaatggaactgctaaaccatatattcccttttggtaatatcttattaatgttatattgtgaactggtgtacctcaggttctggaagatcaatacagaactctattgtatgtatcactctcaaaagagtttaagtaaagggctggagagatcccatagcaggtaagagcactgactgctcttccaaagatcaattcccagcaaccacatagtggttcacaaccatctgtattgggatctgatgccctcttctgatgtgtctgaagaaagctgcagtaacatatacataaaatatataaataaaatctttttttttttaaataagaacttaaataaaagcacataagttcattctatgtttctggtttggttggttaattgtggcaggagaacagggtcttcctatgtatctttggctgtcctagaactcattgtatacatcacactgacatcctactcaatgccttctgcctatgtctcctgactgcattggtttggtttggtttggtttagtttggtgtggtttggtttggttttgtgagacaggatttttctgtgtagccctggctgtc

SEQ ID NO: 22073 - DNA, 1195 bp, Mus musculus
tcatgtatgtaatcaagttttttattacagtaagaggaacaggatttgcatgaagggcatggcttctgcattcacatcagaagagaagggagtttattgcgatccctactggggaaacagggtaggcaatcagctgctggagttgccattatgaacaagacctgatcatggcagggaggtgatttttaattttggatcatgtattaatcatgttctgtgatgaagacagcctatattgatgggtgtttgagttgtgaatgtcagttaagccactgagcattcaattcgaacgtagggtactgttctacagatacatgtgcaatcttcactgacatcattaagtcagctcaagaattgaatcccaggccatcgggtgtagttgtgtgtgtgtcaagttgtgtgtcaagttacaggtgtcagcaactaagagtccacatagaggcaagttcaagtagtgtttgattaatgctattcctgatgtgaggatatgggctgctagttttgaatgtcagtatggcttgtggttttttagtaatatttaagttggaaaaaatcaattattggttcccctttcaatgtaatttctatgaattaagcactgctctgatctcttactatttgcaattctgttgtatttcccaggtataagaatttcttttcatattttacaaggtcagtttaggacaaggtctcttgatgcccaggctggctcatgctatgtaattgataactgctttgaacatctggtcctgtccctaagaccacatgattcaaagacagtgctgcatgtcttctagcctaggctttgaaggggaaagttttcctggtttggcactacttgacattagcaatgagagtgaggttgataatcaccttgactggccatgactctggctgcagaaaaggcagtcatgaatctggataaggaactgaacttattgtcaactgtaattgacactacttcaagtaattcaaattactgtattaaaacaagttgacttagctaaaactggaacaggtggtcattgtgaaagtgttttttattatttgcaacatttaataagggagaactcttctttattctggatcttttgaattgacaaaaatgtcattaatctaggccacagttactggtggcatcgtacatttataaaggacattgaagatgctcgctccctctctttttctgcttgcc

SEQ ID NO: 22074 - DNA, 1250 bp, Mus musculus
ctgtttgattgtgttttcctgtatttctttaagggatttattgtttcctttttaagggcttttaccgtttacctgtgttttcctgaatttctttcagtgagttatttttatcctccttaaagaaatcgattatcttcatgagataggattttaggtcagcttcatgattttcaggtgtgttggtgtattcagggcttgtcgtggtgggagaactgggttctgatgaagctcacctacattggcttctcttccttatggtcttgcacttgcctctccccatctgtttaatccctggtgtctgtctgtagtctgctcttttgttcctgggtcacttcaggtctcctggtaggtctagttctagcaaaccttatgtgatgccttccaactggggggtgggtgttgggttcagaaggtcagagaagctcctgatctgttgccctggctgcagtagatctccagggaggacatcagacttttgggtcttcagaggagcagtcaagctgttgtcctatgggaagctgttctccagtggggcctgtggactgtggtttcattttccctgtgtgcatcagaactccagggaggctttcaatctgttgggtcagttgccctgtgtgctacagagcccccaggaggtcttcagactgtgatgttggttgcccagttgccctgtgtacagaggaacccctgggatgccttcaaattgtgttgtcttcaggggagtacacaagctggtgatcagttgctcaattgtgctgtgtgcagcagatctcctgggaggtctctggctgtggtgtcagaggcttaagtgaagcagatctcctgggatgcctcaggatatggtttcttcaggagagcagactagctagccaggcagaaatcaccaggcaaaaggtagatttttttttttcttaattaatctttgaattgtgtgttgagtgtttccctccctgggaagacatactaattctagaacaaatggattttcagcctttctggcacatttttctgacaggaggtatattgctttacagggccctgaaccagtctgttgtttcccagggcaatggccttgctttcctcttgattaaagtttctgtattcttaagttaaagggtagtagcacaacagagttttaatgttacccatttggctccgtgaatgaactgtgcgttgcagtaacagggaaaggatttgcatgaagcattgcttctgccctcagaacagaacaggaggagcaatgttctgtg

SEQ ID NO: 22075 - DNA, 1150 bp, Mus musculus
actgaaaccacaacagcctatgaggagttataaagccatagcccacctttctgatcacttcattttcagagggagctctagagaatggggcctctctatatggaagaaagatcagaaggaggtggaggggcagaaatataacaacttaggggtcagtttgagctatttttcctgtgagttttgagtttgttttttttctaagcaattacaatcacagttaattaacatcgttgaaactctaatttttcctggctgagattcctcacagcttttgatgaagacttgaatatatttgggcattttattcttggctttttctctacacacagcaggtaagtataagggcagtagaagactcagcagtagggatagccatgattattgggtctcagataacagttactagagatggtccacgtgcctctaccctggccctataactcacatctaaacactgagcttcaggttctctgcactaatttattcacttctttattaatttaaatttttgttctcattaatctttgtacatcttttcctttatttcaagaaaagactctgtgacctggtcaggtcactcaggaagcattttgcttggggtgacctgagttcagataccaacacccatgtttactatctgtaactccagatccagggggtctgacaccctcttctctggtgtgccactcgcacatacatggaaaacattttctctcacataaaatcatacacatgaacatagggacagagatgtcttcaaaggtgctaatatcttataatgcaaggtaagcaaatcaagcaagtttatgtgtataatagaaatcatacagtgttttttaatctggtattttgtatttttttaaaatttccatttcataaatgtagtacacacttaatatctaatcatcaatcataggaaaaagcgtggattctatgtgatcctaatagatatccttttttcttaccataataaatgagatgtttcagtaagtaaccctacttcttccaaattgaaaatatcagaatgcttaatctcttcagtttttcggattagtctccattcccaatccatcccactttatagtcaaagcagacaataggaatgaacaggaagagtgccggccactgagtttgtaagaggggtggtttc

SEQ ID NO: 22076 - DNA, 2082 bp, Mus musculus
aacaatctctggatggaaggggtctggctctgaggtgaggaagagttcagtaactttattcttcagttccatcttgtgccaacccagttacattaattcacacaacattaatcattcttgagaaaacctttagcaaatgtcaactatctgctcaagcatgatgatgtctctattttgttcatacatggaaactcatagggacaaaagccctgtgagattcattgataacgtactggtttaaaattcacagttcactttaagtccgtaaaataactcattcaggtgtgaaacactgttggtgagtattagtgccttttctgttgttgtgataaaatgtctaaggtattgtagaatactgaagtcccaaaccagggtttccaccccagctttggccaatttttttccaggtaaaacacacacaacttttatatttgtaataaaccttaatcaacacccaatattggctaatatctatcctctatgctatcttgtctatttgccagccagtaattttgtcatactattttgctttatttcttctgggttaggcttaactccattattttattgttgacctaacttaaggctgtcttttctctgtctactttcttgtctttgtggttctcctctgaccccaagtccagtatccctaatccctgtctatgtctcttctgcccagctactgtccagctattgattgttgtcatctttaataaccagtcagaagaaacttgagagcaaggtcacacaccttctcttagttctgtgtgcagatcttgtcttctatggagcaatcattttttcagtttcctgcttttaacattacaggtcatagcaagaaatgaaaccccaacatgaaggcaatttttagaagcatttaaatttcattagagttctaaagggatataggatcaccatgatattgtcagggcaacaagtgtcatttgtggcagctaaaggaggagctcagagctcacgtcctcaacctatagcctcaaagagagggttagagccaggtgaggtatcactcacctttaatcccagcacttgggaggcagaggcaggcaaatttcttagttcgaggccagcctggtctacagagtgaattccagcacagccagggctacacagagaaaccctgtctcaataaaaccgagagagacagagagagagagagagagagagagagagagagagagagagagagagagagagagagagagagagagagagagagagagagaaagaatatgaatgtgttcgaatgtgttaggactagacatgatttgaggaagtaaactctgaaattcaacctagtgacatattttctccagcaggcagacatttcctatatctccccaaatgacactactaactgagaagtattgatttctctgccatcaatcctctatgcttgctttttgttatataagccaacacatgatgaagaaaaactctggataagcgttatttgccacaaaccctgggttatagtagtcaatgtttatacaagaataacatcatgaataaaattttctttgctgaccaatttcgtttaattttatttatggggtttatctgcatctttgggtgagtatgtgcatgtctatgaagatttccatgatcattaagttgttgttatcttcttctagcagaagatacaccaagatgtccaaacctgactttgtccctgggaatgaaattttcttaattacttgaccatgtctctagccatctaaataattaaagtgttttatatcatcatgatgtcaggaaatagaaaaaaatcttatacaagagaaacaccctatccatgttgatgaccttgttatagcctgtaacatcacagatgttttccatatcagggacagcatcctgtttcttctcttcttcatcatagccttgaaggaagtaaattatttcccatggtccctcgagtgttgcagtagagatcaccaattgtgctggtggttttattttcaaacatttggaatagatattaaagttttttctatatctttcaaatccatttacaaacgtatattatgcgatccttgacttccttctgtgatttctgttcag

SEQ ID NO: 22077 - DNA, 1114 bp, Mus musculus
agggggaacgtctgggataatcattctggggaatgtgggtgacagctacttctatattgaaggtatggtagccttgccatgaccagtagcaaaatgctcacaagtaaataaaataatccacttgcagcttttggattcaaggcaggtattttgtctacttctcagagaagagaccatatcttattgacctcttgatctgtgggtgattggtgctcctcaaatgctattgcttcttaaagagtgcaacactcaggttggagaattagccccaggcagtgagttccctatttagctaatcaattcaaggtgggcagcccttcaaccatttacacacaaccaataaaaatgcaatcagcaagttttatttatgtatttgagtcttcatagtcacatatttgtaacaagggtgaaattggcagggaagaatttagaatggagatgggagaagtaagggggtaaattgatgaaggatatttgaatatggttcatagaaaacctgatgcagctaggggtttccagaaaccttgtttgggtgtggctctgaaagccaaagcctcaatagaagaaatgctaaagaaaggagtgttcctgcctattgtaaggcaaattgcttgggaggagtcttgtggtctttgcttggcgacttgaggcaaagtcagctgactggcactgaggagctccacaataaagttgaaaagttttggcccttggtaacccctgtcccgcccaaacccccatcaagatataacctgttccagcttgtcaagggtgtagtgagggaggtagacccctcttttacagcaattagacatttgagagctctcttggtgagcactctctttggactcttatctctatctctggtttttgaaaagcatcctggaagcagaggggtaagaagtagcagtacacagatgaaacaggatttgagaaaagagcaacagggaccacctttgtttcaatgagatcaagtgaaaggtagactagctaggtaaaagggtatagatgataggagatttctcagcatctagcagcttcttcctacattcaagcttgtaaatagatattttgcatacagttggggaaatgaagttagctcacaagggcagcatgt

SEQ ID NO: 22078 - DNA, 1161 bp, Mus musculus
cactagttctaccaagaataatatctaggtaatgattgtgttcctactgaatgagacattttttcccatgttttaagatgatcctactgagagagtaggcctgagtaatacttggtgtgctctaatacacttccctcctctatggagcacataatcatcaagccttttccactttaaaaactgtattttccattatacttacagcattcccaccatctctcttctgtctctgaattccttcatagacaatttattctttttcatgacggccatttctccttaaacaacagttactgtttgaatgtgacctatgtttgcctgcaggacttcccagctatgaagctaattgatggctgaactgactgtaggtgtgtaagagaatgtagacatgatgtaccctgttccttgattgaatgaatcaagtagacatgctctggaagactgcaagatcttcttcatatctaaaatttcccagtctaggaccctgtctgcacccattgtggaatgtcagagctcaataggcctggcctctctcagtcatttgatctcttcccatccagtggcagtgctgctactttcctgaggtccagcagggtgaccctagatagtgatggactctggaaagagctaacactcagtagctacagtaggaggtaccttgtgggttcattttaagattctcctctgaagcagccctacaagaaatactattgcgttggcaagcaaacactctctgaggattgaagcaagatatggtgtttaaatgggaatgtcacccattgcttctatgttgaatacttattttccagtacctggaattctttgggaggaatagttaaaaagtctgagataatcattctggggaattggggtgacacctacctctgtatcaaaggttggggaggtttgctatcaccaatagcaaaatgctcactaagtaaataaaataacccccttgcagcttttggattcaaggcaggtattttatctgtttcacagagaacacaccctatcttattgtcctcttgatctgtggatgatttgtgctccacaagtgttattgcttactaagcagtggaacactccagtaggagaattggcctcaggcaatgagttccttgtttggctaatcagtgcaacatgggcagtccttcaagcata

SEQ ID NO: 22079 - DNA, 1201 bp, Mus musculus
ttatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaataagggaatctatgactctgattgacatggtccaaactttggccaacacagttatattaacttacacaacattattcattattattattatttttcaagacagggtttctctgtttagccctggatgtcctggaactcactttgtagaccaggctagccttgaactcagaaatctgcctgcctctgcctccctagtgctgggattaaaggtgtctgccaacaccagccggcaacattattcattctttttttttttcttgagtattttcttcatttacatttcaaatgctattccaaaagtataggggattttgggaacattattcatgcttgagaaaaattctagcaactgtcaactatctgctcaagtatgatgatgtctctgttttgttcctacctggaaactcatagggataaaagttttatgaggttcattgatgaggtaactggtttagaattcacagtttactttaagtccatgaaataactcattcaggtgtgaaacactgttggtgagtattagtgctttttctgttgttgtgataaaatgtctaatgtattatagaaaaatgcaatcccaaaccagggtttccaccccaactttggccatttcttttctaggtaaaacacacccaacttttctatttgtgataaaccttaatcagcaccaaacattggctgatatctatcctctatgctaccacgtctatttaccagccaggaattttgtcatataatttgccttatttcatctgggctatgcttaattccaagtagtcaccgcacatgaccattattttgttattgacctaacctaaggctgctttttctctgtctacttctcttctcttctcttctcttctcttctcttctcttctcttctcttctcttctcttctcttctcttctcttctcttctcttctcttctcttctcttctcttctcttc

SEQ ID NO: 22080 - DNA, 1203 bp, Mus musculus
cagaatgggccatctgcactgggcacccctatttcatcatgtggttagaagtccatgacagaggcatgcagacaactcacaacctgtgaccccctagtacccaccaatgaaatttttgataccctagattgtttccctggttctcgataaaaaaggtttcatgcctttgtctgaggtctctatttcaatgaatgattgacccctgtgtgatgattgtttctgcacagtaagccctctttgtttttgcatagtatctgagtctggggtcttccttcagtgattttcagacacatacattatgtagcagatgaatattacctacagttttcctgatggaagtgtgaaatcacagaatcaccgtatttttttaattttttaatttatttttggtttttcgagacagggtttctctgtgtagccctggctgtcctggaactcactctgtaaaccaggctggccttgaactcagaaatcctcctgcctctgcctcccgagtgctgggataaaggagtgcgccaccacacctggctcacatatcgtattttgtgtcctaaaatctctcttcaacttttaatgattctaaggagaatcattctgtgcatggatcataaaatgactaatggacttttgaagctctccatcttgattcaaggaggtttagcatgagaagaagggggggaggggcaggtagaaaagaagacgaaaaataagagaaagaacaagaaggagaccaagaagaagatgaaaagaagggagagcatgagaagaagaaatagaacagaaagaggaggtgcaaccgtatgaagagaaggtggaggagaagggaggaggaggagctggggtgggggaagaaatccttgcttagtgttggaagacagaaaggtaggctattgaaagatagggaaaagtgatactgaaaggcaaaacttgccattgtgataatgggtcagctcctgcacaggaaagctgggccaggaaacctaatgttgctgtgtgcccttcagcacagtctaaccctaaggaaggtgctagtgtcactcaagattccctggccaatgagaaacaccaggaagaccctccagtcagaagaggaggagggttcttccatatgctttgttccgttcacctccattgctgagcaggcttttgcagttggtgctatatgctttgacttctattgctgagtgccttaggcaagtggca

SEQ ID NO: 22081 - DNA, 1306 bp, Mus musculus
aagccttttctgagaaatgtagtctccaaagacatataaggatacatactggagagaaaccctacaaatgtaatcagtgtgataaagccttttctcaatacagtactcttcaaactcatagaagaacacatactggagagaaaccctacaaatgtaatcaatgcgataaagccttttctcaatacagtaatcttcaaactcatagaagaacacatactggagagaaaccctacaaatgtaatcagtgtgataaagccttttctatgaaatgtaatctccaaaaccatgtaaggatacatactggacaaaaacccttcaaatgtaatcaatgagataaagcctttttccaatactgtcatcctcaaattcatagaaaaacacatacctaagagaaacccttcaaatttaatgaatgtgataaagccttttcccagcattataatctacaaattcataagagaagacatactagagagaaaccttacaagtttattcagtgtgtgtaagtcttttcaaaatattttcatcttcaaaaaataaaagaatccacactggagaaaaaagctacgaaggaattggattgtgagcaaattttttacaatttacatttctgaatgtataagtgaacgtactgaagagaaagactatggatgtgatcatagtcttaatcgtcatgaacatattttaggggccagaatctttctgagtataaggaatgtggaaaaatctatgccaggcagttatctcctaatgcagcctggagcacatactgcagagacagagagagatagagagatacagagagagacagtataaatatacacaatgtggtaaacctttgcgtatcacagttatctttgaatacataaaagagcacaaatatatctcagaattcataaaagaagacactgaagagagaaactgtgtgaataatgtggtaaggcctttgcagttgacattgacattgatctcatcatgtataaattaacacagacttgtaagaaatctcataaaaataaaaataagaaatgtcgtaagcttgtgtgtggaccagtcattttttttttcttgagaaaaatccatgctgcaggttaaccctgtaaatggagccactgtggaaacattttgtatgtcacagtatctgtatgcgagagtaaaacctttagcatggactggatcccttaaagtttgcgtgtcacaataatcttttaggactttaaagaactcaaaaataaggcaatctatgactctgatggacatggttccatcttgtgccaacccagttacattaattcacacaacatta

SEQ ID NO: 22082 - DNA, 1146 bp, Mus musculus
ctgtagtggcatcccacactcttgaaagcattaccaacgctcctgtgacacatcagaactttttgttgactgaacgagtgacctttgcttcattccacctgctgtcccactgcatgagactgcacctactcatcactgcgctgacattctggcagaagagctggtacactgatgacagtagcctcgaggttaaaggtaagcagaaggtggggacagcagtatggtggtgaacagaaagcaagtgatctacttcctgagggacgtcggcccagaaagctgaacttgtgactttaagacaagctctataaatggcaaaaaaaaaaaaaaaggtctacactgacaacaggtatgcttttgccactgtacggggcaatatacaaagagggctgttgacatctgcagaaaaagacctaagatgctgtggctaaaaaaaatcagatggcagatctaaccgccaaacaaggagcaatgatcctggcagtcaaggagcctaaagattattataacatcagagagaccagctttagatacacccctgagcactatcaagttatagacagtatttgacttggcctgggggccaaaaaattcaaaggcatggttaggtcctttgactgctatgttacaggactctctgacttgacagaagaaagagtcaaaagctgcaaggactgtgctatgacgaggtaaaatttctaaaagaaaccttcccaaggtaatggacctgcctttgttgcccaggtaaatcagggactggccaagatattacagattggtttaaagttacattgtgcatgcaggccccaaaagctcaagacaggtaaaaaaaataaataaaaccattaagagacccttaccaaattgacagcggagactggcgctatgattagatagctctcctaccctttatgctcttcagggatagaaacacccctggacagtttagactgacccccctataaattactctacagggggcccccctccactggtaaaaatagcctttgtacatggtgctgacatgctgctttcccagcctttgttctctaggctcaaggtgctccagtgagtgagacagcgagtgaaaaagcagctccagaaggcctattcaagagaagaagacctgctacattagatgtctccacg

SEQ ID NO: 22083 - DNA, 1151 bp, Mus musculus
caagaaaagagcagttggaacagctcaagaaagaaaacagctagctcaccctcagcttaacggaacagaagcagcactggaagacgctggaacagacagtggaaatgttgaaggagaaggaagctgcagcatggaagaagcaacagggctaaagaacgaaaactgtatcctgtcggaacagctctgcaactgcaagattttgcagaaggagagactaaaagaccaaatctctgagctgctgagcagggagacctatcacctggaggagctgctgagcctgaactccggtcacctcaaggagctgctgagcccgaagaaccgtcaacttaaggagctgctgagcctgaagtctcttcatctcaaggagctcctaagtctgagagcctgccactcagagctgctagcccaagcactataagcacagtcttttataaaaacaaatgttgtggtattgaaagaagttttcattacaggatcccaccagactgggaacagcaggagcctcaagatttgtattgtctattttgtatgaagaccatcccagcaaccaagagatggatctccaggaacatggttcctgtccttgtccctgcctgagcactccagcctgcaagtctgtgctgggctagattcctactggagcgtggttcctacctgagaaggctgcctagccagaaatccttagaggttcacacaactgctgtctgtaggatgaaattgaatgcagtagctgtcactttgtcacaaccagactctcagccaatgcccaggatgaaggtacctgctgattcacagcagctgactgacacaaagtcattgtcttctgagatgcctatctcattcagtctttggtgcatttctgttcgggcctcattcctaatcttaagggcagcaagcaaggacagcacaaaagtgatgaatttctttatcttccttgtctgtacggaaaatctcagatttttttttgtgatcaaagatgtgtgtcataacacctggctttcttaggaaaaatgggagtgagcaggagaaacaagacttctttctatctggaacactttctgttcctttctatacatatagcatggattatgtcatatatggagatgttttattcttacactggctaatctggaattcactgtgtagcccag

SEQ ID NO: 22084 - DNA, 1155 bp, Mus musculus
acatattgattctagagcagctgctcccagtctagaatgagactgagaaaagctcctctggttgactctggtggccttgatcccactgttgctccttagggcaataacatgttgtcttcgtgactaacctagctaagcccttcaattagatgggtgtcccaccactcagtttttcagttacccatttgaatcatgttgtcatctttgcatcacagcaagaggaaaaggatttggatgtggactatggcttttaacttcacaccagaatgagagtagcctcttattgtacaattcacagggagaaatattgtaagcaatcagctgctagagtcacaattatgctaaagtaccgcattgtgacatgctgaaggattttgtaatttccctgcatgtattaattcatgccatgtgccaaccagctttgtatgcatacaatttgaggaggcgtgcttgatccagtgaatattgaatatacctgtaccaggtccaccctgcagatatgttttatcccctttcataggtaattcatctcagaggggtgagaaacaggccattggttttaactgtgtggatttgtgatgtttcctatatgcttggcccagggtgtgtcactgttggagctgtggccttgtaggtgtgtgctttaatacccttgtcctagctgcctgggagccagtatcctgctagcagtcttcagaagaagatggagaaccctcagctccccctgcaccatgcttgcctggacagagtatgctctacctggatgataattgactgaacctttgaaactgtaagccagccccaattagatctttgccgtataagagttgctttgttcgtggtttctgttcagtaaaaccccaactaaggagtaaaaccctaactaagacattgtatgtttacatatcttagaagtttacattgtatttaggggcaagattaaatagtaccttttttttttttttttttttttttggttttttggtttctctgtatagccctggctgtactggaactcactttgtagaccaggctggccttgaactcagaaatcctcctgcctctgcttcccaagtgctgggattaaaggcgtgggccactacccagctaaacagtaccttcttaatactgttctctctgcaggggattggccgt

SEQ ID NO: 22085 - DNA, 1179 bp, Mus musculus
tgccagagtccagcacggccttggtagggatagcgggacacggttcctgttcctaggacagggcaagacgtcatgggccacttggagtatcaagagatgctatgggtgtaaggcttctttgtattataatgtacatgttctcacatcctactccaaggagggtcctctctgttaatgactccaagataatcagtgacagaattaatctgggaagaaaagatgtggctaatgtgtcatcaaaatggtaaatcctaggaacttcaatacagaggtaaggctgtggagaagaactttaaaagcatgagtttgaaaatatataatttctgaactacataaaaatataaggatgcaatataaattctataaggggcttcacagatctaaaggaacagaggcagctatactatgaggcagcttatcagaaagattgaaagacaggcaaatgcaaatgcaggcagatccctgagtttaaagtcagcctgaaacagagagaatttaggtcctggtgtggtcagaatggaaatctcaggacaaggtctcacccagctaaatttatgctctgcagacagacctctgaattctgcaataaagaactaaatggatgtgtgaattaaaaccttggctttccggcttaactagccaaaagctgtaagccttactttttagatttttttttaattttttttttttttttccagcaagagctgagcagtctggacatctctggaaaacctaaaaagctcttgaattttttttttttttcagtgagaatttctgacattggttggtaaatccatggagagataacacagcttttacaaattttctagctcttttagaatttttttcaaaaaacaggtacctaaagaacatttcacatccagatgaaagaatatgcctgcttctcagcacctcacagaaaattctccaaaattaattggagacaaaattctcaacagaagaatctggaatgtctgagaaacacttaaagaaatgttgaaactccttactcatcaggaaaatgcaaatcaaaacaacgctgagattcctcctaaaaaatcaaagtggctaaggtcaaaaactcaagtaagagcacctgctcccaagggtgtggagaaagggacccctccactcctggtgggattataaaactttataaccactctgaaagtcaatcca

SEQ ID NO: 22086 - DNA, 1193 bp, Mus musculus
catttccatgatgactaaggatgttgactatttctttaggtgcttctcagccactgaatattcctcagttgagaattctttgtttaactctggatcctatttttaatagggttatttggttctctggcgtctaacttcttaagttatttatatatattgaatataagccctctagcagatgtagggttggtaaagatcttttcccaatctgttggttgccattttgtcctattggctctgtcctttgccttacagaagctttgcaattttctgaggttgcatttatcaattcttggtcttagagcataaaccatttgtgttctgttcaggaaattttcccctgtgcccatgtgtttgaggctcttcccccactttctcttctattagattcagtgtatctggttttatgtggcagtccctgatccaagtggacttgagctttgtacaaggagataagaatggatcaacttgcttccactctggactggtgccatgagtggacattgggtgtaaattccacagcctgtcccacaacacccagaggaagcaccactcccaagtgctctaacacttccaggatcataggattataggtgaggagcacaaaacatgtgccccaacacctgcagttactgggaccatcgttaaccagacacccaggaactcagccaatattttcttatgtccaagtggaactgctaaaccatatattcccttttggtaatatcttattaatgttatagtgtgaactggtgtacctcaggttctggaagatgaatacagaactgtattgtatgtatcactctcaaaagagtttaagtaaagggctggagagatggctcagcaggtaagagcattgactgctcttccaaagatcctgagttcaattcccagcaaccacatggtggttcacaaccatctgaaatgggatctgatgtccttttctgatgtttatgaagaaagctacagtgacatatacataaaataaataaataaataaataaaacctgtttttaaagtaagatgagagtggttagtggggtatggtaggagacccagagagccaagacagcctgtgagtgcttggttcaggccaatatggatagttttccccgcagctgcaaaacttcaggcccatggcatctgtaaatgttagcagaggtattccccatgccaagtgttctattcttgat

SEQ ID NO: 22087 - DNA, 1148 bp, Mus musculus
gatacacgccatttgccttcccctggcctcattttccacctcagcacaacattatctcaactgtactgccagtgctgagggggacttgatgaaatgagctttgctcttgggttttatatctgattttgttttccttggaaactatgtgctgtgtctgagcacgccattgtcagggcgtgctaacagatggcgccctcagttggagagccacactcttcaccagctcgccaggcccctcccttttggtgacttgggggaaggttcctaagccttgatttcctggggattaaaatgaatccataaatactttcttcacagaattgttaacaaggtaagatgaggaaccatgcaagactatgaagaacacgtgaacaacccacagttaagttcatccggttgtttctgggctgtctggccaggggtggaatctagggctttgcgcatgtcaggcacatgcttgaccactgatgtataacccagctgagcatgaccgttggttaatgtggtttttgttcatgggaaggctctttcttagctgatagagtatgctgtctcttcagctctgtttccctcccttccaccccaaactaaagcagaaagagggaaaacttagccactgggtatgtgttgtcttttgcttgggacagccctttttacttgtggttcatagaattcctggactttgggttcatggttggttggcatgtgttttaccccttggggtaggggtagagatgaggtggggatactccacatcaaggtttcttggccccccatgcttgacagtcccatgttgtgggtgttcggcatccatggctcctgtttatgagtatccctctctcctgttttaggactccaaatgtcctcagatattgccagatatttcctgaggggccgaatccctgtgaagaggctctgctctaaggcagcagtgggttcagaaaaggcagtttttaaaatctcatgatgaattgtttaacacttggtgacagcctaggaggtgatggctgacaacatttaggagccacccggagcccactctgccccaccagaagtgttagagaatacaactttggcagaggtgggttcctttgatagaagagaaggacagccctgcaagggaaggtggcagcaggctggtgctgaac

SEQ ID NO: 22088 - DNA, 1284 bp, Mus musculus
tgaagccttctgctgagtgtagtgggcagtatccccaccttccctttcttcccttcctgcagatggcccacacggatgctgtaatccatgagattattggttttcttgaccagaccttgtacagatcacaacatctttgtgttgaagcctcgagaaaactggccagagacctcctaaaggagctgcaagcccaggtctagcaggtagtacagaatgtgggcacctgcggtgaagctccctcagtggatgagatgctgtttctgaggcaagaacaagtgagagtggttgaacatattcgtgccttggcctgatggagtgatgtgtaccacctcccacgctgtactgcctggccccggcggtccatgagtattatgaagggaagggcccagactgcctgttaggttccagccattcataagagctagcactggctggtgtgctgactctctttatccttccctctctagtgaaggtgtgggggatgcccagtagcaggagacatgagccctgtagtggatgaggctgtaccgtacagatgagcacctgcctcaccggtgactgtcgctcagtgaggcctttgttcctcagtgcagaaatgctgcaaggcacccactatagtggaaggaatgagaggtggccagagaagggtcattccttcctcctcctctaaacccccaaaaggcaaaacacatctgcttccctatgtctagtaaacaggatttggaaactgagagtgagtccttgtcctcctgcacttgctgtgggtggggatgacgggcatggctgttgttttctagtgagaatatatacaagtgagcagtgtgtgggctgtgaccctcctgcacatctgctatgagaacccttgccccatgtgaaatcagcttcaattctcacagtaggacatttgatgactgcactcaggctgtctaggggggttgtggcataaagtcatgaaggcctgggttttctcttgcatctgcacatccaggctttgccgggcaaacactgactggcagtggattcgtcttttacccacctgctgatgggctcacagtggagtggagctggactttctactttttcattctgaataaaaagttgtacttaattttatattcagaccttcctactcctacctatggaagcttcaggtcacacaaaccttaggcctggcttggaaaagatcaattatgacttacctctggataaactgggatcctgtcaccaaacaagggagaatgtccagagggcagatagttgtgtgtacgtactcagagttgtttc

SEQ ID NO: 22089 - DNA, 1129 bp, Mus musculus
tgcctctcatagctcctggtgcactgtgcacttgggtggactgctgcccactaagagaagtaatatatgtgagaaagtaagaggaatgtcttcacatggggattgggtaacaggaaaactttcaagagtgagatgatcagaagactcccaccaaagagaagaagcccctcttctagcagaaggaaaatgaccaaaaaatgatacacccctcataagtataataatacatcatgcttccatgtccagctcagggtagtgagtgccattcctggatgcacatcaaaattgcgactggaagttagaaaggggggagatgtccacagtctgtcttcaatcatttgtcctgtgataacagtgcgaagccttaagtgagaagcaccagcctgtgggctgcaaacatgaagctcatggcagcagaaagaacaacagcaaatgatgttgtggctggaacagtgagcccaggggacaatcaaacaaatcaaccaaggaaacattctagggtggccgtgcagtgctaagcccctgagcatagaaatagaagccttcattcatggtgggatctggtgtgtgtgtgttaggtccaaaataggactccaatatgacagtgacaggtgatgacagtgtccaaaatgacagcctaggcttggctcaggctggattctgaccaggtaagcagaagaattgcttttagataaacaaaaaccttacttggcattcctcagaaatcctgtgaggcaaccccgtccaccctttacagtcaactaccttaggtacaggacatctagttcctgattcacccaaacattctgtaatggatcaaaacccctatgctaactcccaggctgttctggctcccatccctcctcctgttcatacctgtccccataaaactgtcgagggttttcccactgctctctgtgacctgccctccctgcgccttctcccccccccccccccgacagtttgattcgtcaaataaactgtgtttccacccatgtagtggtctagtttgagatgtctctgcaccttcatttacagtgtgatgtctaagtagtgccagctatgtgggcactggggaggagaggatccagagtggatttagaagaattggggctcacaagaccagtgc

SEQ ID NO: 22090 - DNA, 1204 bp, Mus musculus
tgaatgtagagatctccgtagttagtcctgtccagtgcctttcataacaaagccattggaagcactattagcttacaggaggctgaaaggtgaactctggatgtctttgagaatactgcaggggctgggtatgtctacctcccctctcttccaccacagggtctgcattgctgtggctatcctgtctgctaacagcttcagtttctaaagttaaggtttttttctaattgtgctctgagtctctacctggaacagatttggctaccagaaacatagacagatagtagttattttgctttaaagagcttgaaattactgatgtttaaaatgtgaaattagaaacatgttgaagagcccagcactttcagctctttccatccttcttgtttggctttaaaaactgctgctgttgcagaaagagagttgaccacacaagagctggagtgagctgagcccacaagtagaaaagcctccgctgagcttgtttcttgaggttttcctaagcatgttcttagggttttttttcccctatttgataaagtctattcattttagttttcttttctgcagatgaaagccaaaaaattgtaatatggtgcttatgttgtctgatgaacaaagaacctcggacttctgcagagtcaggacttaactcgtggatccgggtaagagagaaaatccctctgctggctctgctttgacttcaggtggtgatttaaagataccccactccccttctttccctttattggctcaattctgtctgtcatgttttaaggcagtggttctcaacttatgggttgtgaccccttgggggttgaacacaggagtcgtatatctgatatcatgaatattggatatttatattatgattcataacagtagcaagattattgttacaaagtagcgatgaaatcattaggcgtcggcataacttgaagaattgtattaaagggttgcagtgttaggatggttgagaacctctgggttaacaagtggccttttactgttaggttttccctgagtgttgaactgtttagatttcaggtttgcttggttcctgcagtactgctccttatgatgaacctcccagtgctgacaccactgcatgctgggtggtttcgaaaaatacttggtaatgattaaaagaatgtactgggttttctgccagctattgctggaagcactgtttcaccctctaagc

SEQ ID NO: 22091 - DNA, 2896 bp, Mus musculus
atgtaataggattatttgtaaaggtttctgtttaaaatattttaaatttgcatatcacaaccctgtggtaggatgaattgttactgttaacttttgaacacgctatgcgtggtaattgtttaacgagcagacatgaagaaaacaggttaatcccagtggcttctctaggggtagttgtatatggttcgcatgggtggatgtgtgtgtgcatgtgactttccaatgtactgtattgtggtttgttgttgttgttgctgttgttgttcatttttgtgttttttgttgctttgtatgatcttagctctggcctaggtgggctgggaaggtccaggtctttttctgtcgtgatgctggtggaaaggtgaccccaatcatctgtcctattctctgggactattcaagagaagccagatttgcttcatgcctgtgtgtggcagcttctgaggtcatgggtagccctccaagcacctctgcttgggtttcaaagagaagatgttctcacaaacattgtgctgcctattagggcctctatatagtcagcagtcagcactagtggtgaaagattggacaatgttgcctgatggtgagactcagccgggtcatgagattaccctctaggggtgtgtggttgttcctttctgatgatcacacatacacacagcctcccacccccatactccagatacaggcccaaaaaaacctatttcactgaaggtctatattcgagcctttacaaatgatagtccctcccttgctatgactgcctggttggagcaggctaggctaatcgtggttcagtcaactgtgtggggagagtttctaaggactcttttccacacggtcttttcctgtgtatactttcttctcttccccactgttagcatccatccagtgtgatgtctgtgaaagcaggaagatgccacctcgtaaaagcatatagggtaagctctttgaaccaggtgttgggctttagagtttgattgtgttctccttccccaaggtttgggtttctttgtctctggtcagcaactagtagatagggaaggaaatgcccttattccttgcaagtgaacattgaggacttgtctcagaggaaggaagcctagtgctcatggaagctgttgtgaggaatgtactctgtctgcatgcagcttccctgaatccctcctatccttcatggaaaaatttaaggagatgggtccctagtagtaccaataatctagtgccctcagatcctaaaatttatcccccaaattgtaaggtactaattggaagccacctgtgactaccgtgtgtgtgtgtgtctgtgtctgtctgtatatccgtgtgcgcgtgcgcgccagaagccctggccatccactgctactgtcttaatgcctgtcaagccactgtctgcctacccaacaccagctctgctcggatatcttgcaccctgagttgaggagggagatgtagagtgcggaagccaccttggctgtggttcttgattgtgtccctcatgcctgagccttgtgcatgtggcagaaggaagtttgtacagcctctcggcttctgtgcatcatcatgagtcccatcagccaaggcaggaaggacacagagctggcaggagactaaagtcagagagtgtgtgtctctgtctgtctctctcatagttttattttgtctgtattgtttgttcatttggatgttttaatttgtaaaagaaaagatctttgctgatatttataattttgtatcataagaatgtcctccagaatttgtcatgccagtttataacaagaagaaaaaattgcagggattttatttctattggaaacacttattgcagttatgttttacttttgaacagaagttttatttgtatagagtgcttactaatgttaaatagttcagagtatataacatttacattaaggactcatggtaggttttagtgtaaggagtttaaaggaaataaatattcaaactgggtctcgtctgccaatttgggtggaaatgagtttgtgtcacttcaattacaaagatgaaagtatgccatataatttatttatatgaaaatttatttttgtagtgtacatagtagtcatcaagtctttcgacagaagtatatttttaaagaatttatatgtgatgaaatccataatgtctggaactttgctgagacatgggtgtgaggacacgtttcgttataaatgacagcaagggagagaagagagtatgttttaacagtgttaggagagtacacgtgagcagtgatccatgtgattggaaagtatcggtgtgaacatggtgacctagtgcggttctcagatgaaaatgtacaaaactctctaaatattaatgttcaaacactgatagaaattctaacatgaataaagataatataacttgttggtttatgtgcttgtttctagaatgtttcttaaactacatatacacaagaagttccaggccgtctgttcgtttcttcttgctggccttacggaagctgttttatgtgtattttgtggacactggggaagtcacctaatgactcttctgagcgttcccttttcttacctttctatgtaggcacgcgggaagtgaatacagccaaattcagtgtaaacacaagtgacccctgcaaaggtcaatcagtggttggttaggagtgacagttactcttacagagagccactcagaactgttgcctcacgctccaggggatctgatgccctcttctggcctctactggcacctgcatacacgtgcacaccccacacacagacacacaaagagacactgacttaaagttgagaagttttttaaatacaatagcatcaccatagttgagaagtttttttaaatacaatagcatcaccatagctgatgacatagcactaactgacctggtaca

SEQ ID NO: 22092 - DNA, 1215 bp, Mus musculus
ctgtcctggaactcacagatctgcctgcctctgcttcctccgttttgcaattaaagtcatgaactgccgtgccctcctctccttttcttctttttgcttgttttctttaaaagatgtgtgtgtgtgtgtgtgtgtgtgtgtgtgtgtgtgtgtgtgatgtgcgtgtagaggccaaaagagacagttatctctagagttggagttgcaggcagttgtgtgccctccagagtggattctggggtctgaacttggatccactggaagaacagcagctctaagccatctgtcttgttcctgggctttcgttccttagtttaagtaaagtgtgtgtgttttattcttccctctgagcatcttttgattagcaccacagttcattcactagcagatcaggagtccttccttaagtgagagaaaactgcagacaagtcgcctaccctgcctcctgtcctcagcctaatccctctggaccaaagctctcaggccaggttttaatgtgttgcacatgtttctgtttctaggacttcaggatgcatttgacagtgactgggaaactgggaggatcatgccaaacaattataaaaatggatcagatgacggggtcctcgcttacaaactcctggtgcagactggcagccgagacaagcccatcgacattagtcaggtattcccgatgtttcaggacactgagcagttattacatctaggcagctgacccatggaatagggctggcagtgtataatcccaccttgtgtcccatgagaacctgaagtgataggagatggtaggaagaagcttgaactggctctgagctagccagaaaacttccctttccctgcctgtcaagcaagaggaggggacagacaggtgttgcctctaacacaatagcaatgggcaaaaatacagtatgttaacactgtgtgcttttcccagtggtgggaagcaccaacccatactgggctttcagagtttattgaacactgaaatatgtgttatatgaaaatacattagtatagtggtctcagttatattcagacatgggatggtgggtttattggagagcaatcatttgaacagaggttgggtaggtgggtggcttagaagatgagcaaagtcactagaggttgaggatggattagttatttaatgctttctggggtcagcttggcctcagcagtagatgttgagtgtaggtgtgggcagctacctgctct

SEQ ID NO: 22093 - DNA, 1216 bp, Mus musculus
gttttagatgggaaataaggggttttgtgttttctggttgggagactctgaataatgacttcagcctggttaagcagctacagtacggtttgaaccacataacaggcagccaaaagcctttctggtctgtcaacagcccagtttccaaagtgagtggggggttaggagtggctgtaatagtggtgatggtagagtcccgggggggggggggcgcttgcccaccccactggcaacctgtgagagggacctcgtaagaatgattgttaaagttagcagatcaaatacttggattggtcacatttaaaaagcagtttttaagcaggcaggtaatattgtaattcattctttcggtttttcactttggagctcagaagaacccatccctccccccaccagctaattttttttaaaggtatcaaatactatatcaggggattaagattgtctgttggttcccttaatttgcaaaccctgcttgccatcctcagccatggattcttttcctgacttaagtttgccagtggctttactgggaaagaacttttatattttctcctttcctttatactcaggccccagagttttgctttaataagcctgtgttgtgcaaatgcagccatgtgccctcctgcctgtctgagccacatttttcatggcctcacctctaatttctttcgcagaggtaagcctcctttacggtggacaaactttgaccccttggaattcctagaagagttaaagaaaataaactaccaagtggacagctgggaggaaatgctgaataaagccgaagttggccatgggtacatggaccggccttgcctcaacccagccgacccagattgccctgccacagcccctaacaaaaattcaaccaaagtgagtttcggggggggtgcttttctgttttcacttacagttctctctatgattttcatcctgaagatttcgtttggcagtgacttttgttcctttttaatttggtgtatggaactaaggttgttcacagagctgagttttgctgtaagatttagcataaccctcattagtcttgctattaatgttttctctgaaacaaacaagcccttaacgcactggatcttaacgaggcatgtgacctgcctactaattcccataattatgtgactgtcttttcattacagcctcttgatgtggcccttgttttgaatggtggatgtcaaggtttatccaggaa

SEQ ID NO: 22094 - DNA, 1137 bp, Mus musculus
ctagtctaaggaggaatgaagtatccacacattggtcttccttcttcttgattttcttgtgttttgcaaattgtatcttgggtaagtttctgggctgatatccacttatcagtgagtgcatatcaagtgacttattttgtgattgggttacctcactaaggatgatatccatttgccagatccatccatttgcccaagaatttcatgaattcattgtttttaatagctgagtagtactccattatgtaaatataccacattttctgtatccattcctctgttgagggacatctggattctttccagcttctggctattataaataatgcctcccttttattaagtaaacaccactacattatagtcactacatcatcaagagtgattccagggcagcgaatcatggatatccttctaagtacttggcttttactgtcttagataattagacagtgagtactaagtgatgcatcttacaattggtcatatagctgtgttattaatgcttttcttgtttgttttttctgaccattctgttacagaccaactcacggggtgacacagtgagaaccttgtgccttagttacctgactgtgcttcagaaagtagctaaccatgttgcactgctgcaggctgctagcacctccaaacatcaggtttgactttacatgtctttgtgatactatttatataaaacagatactatacagtattattgacacaaaaatcatagttctcatctaaaagagagtaagagatattttatcctggagccattttagtggccagagcctgggaacagagatttagattacaccaaatcactattttaacatggaagtggttttatgaagtttttagtttgctgaagaaagtcagaaatagaggagttttttaaaatatattggtgggtacatcagagagatgggtacaacaagatgggggaagcttttctgtatgtccaggatcctgtccgataacattcttagcttttggattgatagaaattttattccaaaggattattctgttagtcacaggacattagttctgacacagaggtgggcaaggaatggctgttagcgatgtggggttaaaactccacccaacataagataactaacttctgaacctgta

SEQ ID NO: 22095 - DNA, 1118 bp, Mus musculus
gtttctctgtgcagccctggctgtcctggaactcactctgtagaccaggctagccttgaactcagaaatctgcctgcctctgcctcccgagggctgggattaaaggtgtgtgtgtcaccaccgcccggcactatagctctttaatacagttcctcgtgttgtggtgacccccaaccataaaactattttcattgctactttataactgtaattttgctactgttatgagttataagtatctgttttccagtggtcttagttgacccctgtaaaagagtcatttgacaccccctaagggttgtcaacccacaagttgagaactgatgttttatagtttctattggcagattgcctccacttgatggtaatttggtaatttagggctcatggggtgtcttgccatctaattttgttttcatgtggtccataggtgtctacttgtattgtctagtcactatttgagttcacttgaagattctgagggaatgaacagcccctattcagactgcttagtgatcgttttggcattgctttacaagtgtcttacttaattcccataaatcatgtggagaactatgaaataaggtgctacaggactgagcagtggtggcgtgcgcctttaatcccagcacttggaaagcagaggcaggcagatttctgagttcgaggccagcctggtctgcagagtgagttctaggacagccagggctacacagagaaaccctgtctcaaaaaaaaaaaaaaaaaaaagtgctacaggcaccttaattgttaaattttatttatttacacattaggctttctattatagttaagactcgtttaaatttttcctatgatatatatatgtatatatgtatatatatatgtgtgtgtgtgtgtgtgtgtgtgtgtgtgtgtattggtaccagtattaatccaatacaggattatcaactggtttgtttactagagcgaaattagaagcttaaggaattattacagtgcttttaaaaataatcatttgagctttgtagctgcaggtgtcagcggttggaagtagtggaattttatgtagcaagtaggtgttttcctaactacatgatgtagaagtatcttgtgttttgtgctttgtgatt

SEQ ID NO: 22096 - DNA, 1148 bp, Mus musculus
attataagcctgcttcttagcaactatattttcagtgctttctgaactaaacctcagctatataccaagaaatatgatgctgtttcagaatggagcactgagccccatcccatctctggttctgttatctttttctacttgcttaactaaaaaggcactgctgggaactaactataactcaaggctgccttggatctgggcgatcctgggaggagaggcaggccagtagtcttgatgggaaaagagaactcaactttgaaagttacaaggttgcaggattcctggttacaattctgtccagggaaagagtctacagggctatgtgcctggcaaagagagaactgctaaaaggtttgtgatctaacaggtctgtggattttcctgtccactgatattttgtatcagtatatgcctgtggcaaatagtttgaatctcaggaccacttagtagcttcaccttagtcccttggctgatctcaggatgcctcatagtctgtctggagcagatgtcttcatcatcaagtcagcaactcctgctcctcccgtccttaactcctgactcagtgacagcagaaactgctggtctattcatttttctccccaaaggttcctctcaagaagccaatcaatccttggactttctctgcttaaggatcttttaatctgacccttgcttgttcaaagttctaccaccatcactgtccattgaagatcttccttttttaggcttcctagagaaacctattcttttgtttttgtttttctttttcttttaaattttttatctattctgtggtgatcccacacataaatacaatgtatttagatcacaacttccaccccaccccaactcttcctgtagcttcttctttgccattccaacagaaatctattatttctaaaatttgtccaaaaacatcacaagatagtcgctggtgttactgcttaaggtggggcttgataaagtagagaccatcaggcctgaggtctgcagcacttgcaagcagtgttgccccatttccaaaggctgacttaatttctctatgctaaaacatttgaagtcctcttttgtagttatgtggtttagataaggtctggcgaaccatatagattgaactctaaccctgtgtagctgaggatggcctcgaa

SEQ ID NO: 22097 - DNA, 1105 bp, Mus musculus
attcccagcagcctacacagcacctcccatactatgaaagctaccagacttcctttccagtttccgcggcagccgcagtcatgagcagcaaagtctcacgcgacaccctgtacaaggcggtgcgggaagtcctgcactggaaccagcgcaagcaccgcaagtttctggagacagtagagctgcagatcaacctgaagaactacgaccctcagaaggacaaacgtttctcgggcaccgtcaggcttaagtccacccctcaccccaagttctccgtgtgcattctgggggaccagcagcactgtgatgaagccaaggccgtggatatcccccacatggacatcgaggcgctcaagaagcttaacaagaacaagaagttggtcaagaagctggccaagaagtacgatgcctttttggcctccgaatctctgatcaagcagatccgggcccaggcttaaacaaggctggcaagttcccctccctgctgacacccaatgaaaacatggcggccaaagtggatgaggtgaaatcgacaatcaagttccagatgaagaaggtattgtgtctggccgtcgctgtcggccacgtgaagatgaccgatgatgagctggtccacaacattcatctggctgtcaatttcttggtgtccttgctcaagaaaaactggcaaaacgtctgggctttgtacattaagagcaccatgggcaagccccagcgtctgtattaggacgctccaataaacctcagtgctgccactcaaaaaaaaaaaaaaaaaaaaaaaaaaaccaaaccaaaacaaaacaaacaaaacaaaaaaaacaacctaccagaacggaggaagctttttagtcagtagtttgatctctccatgtcctgtgaccaatgtttgtggtgtcttcggcaataggctattatcatccagttctggtgggcaagcaagagcagtagtaatagtattgcgctacaggtccccagggcatcctgaccaacaactcaatgggggaaggtgtcgcatacctaccactgagatttgtatttggcaacccatgacttcttggagaagcattatcccccatataggataactccaattaaactcacatatata

SEQ ID NO: 22098 - DNA, 1193 bp, Mus musculus
ctgctattctgtagaaatttatgaagaatgttgttgcctcagatggggtgagagagaattgcactttttttttatatggaaatagatttgatgtaaagtttaaactattttgtaaatatggattgcagttacagggtagaagctacaagttgtgggaagctaggttttgcaagtttaatgcattcattggaagcagttctcacaggaagcactttgtgaataagacatttgtgtgaaaaaacagattggtacaaatagccaaagaaggttgaaatagattatttataagatcatttttaacagtgtatgttagtgtgtgtgacagtactgtaaacactgaagcagagcagtgtgagacatatgtataaaatacatatttttaaattgcagaatagcatggccaataagtccagagaaatgggaggccaactatttggaaagatgatataagttatggacttggaagaaaaaaggtatttgaggctcttggtaagatgggtactagtttttaaaattggtataaaatgagttttatcccatcttcctgggctttttaactcactgtaatgctgatgcttagaaagcgctcgtcacttggcttgttgactggagacttttgcacattgctcagctgctggacctgagtgattaatcttgcaaagtctatgtaacctggcaactggtgcatgtatgtgtacaccagtgagatctattatgggccctgtaatgagattggcacttgtgtttgtattaataaaagggacatctgcagggttgttttgtagtgaaatgttttaggtcttttgatagtaaacactaaattttaattgttctgcttgtttagcgttattagtggatggaagcctccatatttatattttcagtgcatattgccacctttctgcttcacttcagaataacatgccaagctattttgtgttcactaagtttagctgtcagttaaacacttgagtaaatattggctactcaaatatgcgggcttctgagatagttttagctgcaagtgtctttcttgtctggtggttcaaaaccattttctccaaatagatgaagttattgagcacgttgtgtactaaggcatgaatagaattctaggggccaagcagccacctcttttatggagtcaagaatctatcacttgagcttttgttaaaagttgaatgaaattatat

SEQ ID NO: 22099 - DNA, 1167 bp, Mus musculus
gtcgggtggcttctacctcttggcttgggccctgacaggtcacaggggcttccaagcgttctcctgaggctctttgagcacaatcaggtctgtcgacctttccagctttctgggtctggaattcctcaggcctttgttagcttgaatagctgtctgtgacaagtgagtatgtgttctagaaacatcagctgtttttcctcacatattttttttaaaagttcttacttgcattttggaaagcagttggtcagaaaccttaaaacctattttttttttttaagctgggcaattgtagcaggcagatctcttgtgagttcaagacctacctggtcttcaaagtgagttccagtatagttagagctacacagagaatccctgtctcaaacaaaacaaagcaaaacaaacaaacaaacaaacaaaacagataatacaaactatattttaagatttctctcccactgaagtgacctcttgagaatagccactgttcttgcatttcttcataaatctgagtgttccccatctcactgagtggaaatactacagatacatttaaaagatcgcctatactgtgtaagaaattacctcctgatgatccagtagaactcactgtggatagacacgtctgtcagattacggtactgcagttttacatccattgtttgaagactttattgtacactcatgtgcagatgaagttttaaaatgttactgacgagtcaccatttgatcagtcattgtcttgatattttattaaattgtatatttctaataatattttttaaagttgagagaactggttggatgtttattctcctgaaggtatttttaagataaagcttcaccatagcctgtaaacttggcacataagtagtttttgatactttttgttgcatttgaaaaatcttgtgtattgtaaaatggttttatacaaaatactaaatagtagaaattgtataatttacaatcgtataattaaaaatattaaacagtcttttggtttgttgtattcacttactgagcatgcctaatagatagcaatttaattatgaaatggatctaattcttagtttacagaaggcatcatgacaaagtactacagactgggtgggacaagtaaagaaaaatgtgttccttcttggtgccagaagcatgaggctctgacca

SEQ ID NO: 22100 - DNA, 5011 bp, Mus musculus
tgatccttatatctaggtttcttggctgtgcatggccctcctgtgacctccacttagcctccctggatagtggtttctgattttcagtgagctcctcctgaggtcctagattggatgctttgaggattctaaataagctgggttaaatgaactggaccaaagtgcctttccggaatttggggtagagataagccaaagagatttggaagttgaggtaggagtactgtggcctatattcatagtactttattatcacttctagcctacaaaagaaaggcgcacgactgtgcacggcattccaccacttctaggaaataaggagaatcagagatttccaggatatagcctgcatttaacctgctgaataatgttcagcttctgtttacagggtattaaaggaatgccctctatataccattaacattggtatataatctactccaggaaaaatatctcagctgagatgattgggtaattctaacatacttagttgaagtctcttctctttaaacaatagccccccctccccccaaaaaaagcacatcaaaacaaaaattacaatttctttcaatgtctgtctcccttcaggctcaccaggcctcctggttcttttgtgggaaagtccctctctgttccaggtccttgcactcacacatctcctgcgatggcaacattaatgtttaatcccccctcccacacacacacacagaggcttctaggatggagattctcgccaacctccctttgcactgagtggactcctgagttttgacattgtatcaagagagacttcaactttcagagactttcccagcaaaacctcttaaaagattggctacttgcgctgagaaaatgggtggattatgatagaggagatgggcggatttgctgttggaggagaaaaaccactgtgctcctcctatgagatggccttcttgtcttatgtcatttggatggaagccacatgcattcagaagtcctggggcttctgtgtcggagcacacagcttgtgtgggatggagtcgtttggttggtgctgtgtttctcattttcatttgtcaggctctgaaggaagttcgtgggtttctacacctctcactttctactaggaccataaatctattataacagctcataactgacataatgaattggcttttttccagcattcccatactaactctgaagcgctctctcagagcaagccttgaacactgtcacaccggtagagggcttgccggtgccttgtgtgggccattcaccccagttcacaactctttctgtagctctttactcctgtgtttctggaagcttgtaaagtttcttttgggccatcttttctttttccattatttcatcccatttcctgaaaaatctctcttgtcccaatgaccttctttatatttaagatgcatcactctgcttctgccacgataatgcctgtggctccgggaaacttgtacttacaggtgtgatgctcaaggcccttcattgctccaaactcatgccttgcgaccatctccgtggagtgcctgcctgtacttcctgggctttctctaagtccttgctgtggaattcatttccgtcttgcctgtcattgcatcatagctctctgggcctcagctcctggtttctgttccgttgcttccgggatttcatatttcatcggccattatctccaggaaccccaggatgttctccctctattcttcttaagctaacatcctgtggaatggcagatacatttccacttgactcgacccagagattgtctttgcactcaagactctctgctccagtgtgtaaaaactatgcacccagttcgggtcagtcttcgctttccaagtgagggtcgtctccggatcagaagtaatttcataggtgggtttgtcttttctcatttgtactttcttcttttcctttttctctgaaagttgctaatgagtttgaggtataacagcacattgtgggagaaagaaagagaggaagggtgagttaggttgattttgggtgagcccagaggggcccttggctgtccctgcccagatctctttacagacaggccaagtgctccaagaggatgggcctggctcgaaaccacccagtaattcctctttatctcttccttctctcctctttccccacagcctggctccgtggagggagcggaggagaaggagcgctttgcagcaaatgcccatgctggccttatggtacctgccttgctctgctgcccatgcctgcctgtctttgtttatttctattgctttttttttcccctcctttaaacaaaatttgaacttttctctgccctgcctttctctcctgtctgcctttttatggttgatgttgtattgtctcttctaaaggatgccattaaaaatcacacctagtgtgtgcttttagcatgccgatgttctccttgtgttgccctccttgtctttgaaattttcctaaggaatactttagagtcttcatggtaaatctctctctctctctttttttttttctcctcagtccagccatttcaaggactaagacagtcttacgttaaagtaaaaaaacggtgaccagcactccagggaagactaggaacagaaaacccaaaaaggatttagccaatcaatctgagaacaaagcagactctgcaatggccttagcttcttaccacataagaagttcattcaatgaagaaaatgtcactggcctctcatccactcactgactctggggtgtggttgaaccatttgagggcctgactctcccttttgttatctcaagttggacaaaagctgctgttgtgaacttagtctcaggtgtcaatatcctgtcctctgccaccagagagttgtctggtgagtgtggtacatgtgtgtgtgtccctgtgatggcaatcatgtttgctgctggcctccagaagagttgaggatctgatggagatatcttaggtatttattttttgttcaaccttgtgaccctgactcgcagtttataaagatgaaagagatgaacatcccaccagtggtaccctccatcttcaggtatgatttggtacaatcagcttcactttcctcttgttaatcctgttgtgatgttcactgtgtgaagtacccaagctgcttgtttttcaccaaagagtgctttattaacaacctgtgaacactgcatttaaacactgttgtatgttgttgtggttactgaaaacctgctaggaaatgttgagaatgttggaaccctttctcagttacctggttcctacaaatccttccttgtgtcattttaggatgaagatttcagagctgggatgttgttgggttgctcagccacgttataattgtgtttacttcattacatcaaaaccaaacatcaaccctagcattttcctttgggaaagcatcctaaataatggtggctttaacaacaaaattgtgagccttgctgtattggcgcacgccttgaatcccagcattgggaggcagaggcaggtggatctccaggtggagttccaggccagccaatgatacacaaggaaatcctgtctcaaaaataaaacaaagcaaaacaaaaaaaccaaacccaaaatcccaaaattgttaaccctttgtagagtctttctctgtaacgctgtggagttttttccttgtgatccacagtttgattttagtgacaatcacttgcttctggagttaggctgtttgtgtaagagatctcactgttgcctttggttagggaatatgactagaaactgtagtgtgccttttctcttcaccctgctggaagccagcagcacccgtgccatgaagcaattgcaaaaccagaatttatctgctgccacaaaaaaaaaaaaaaaaaaaaagacagagcccataattagaaaatactctatagttgtcttggttacttccacaattgaggctaatggttttttgactctcccagtttagaaactggagaaatgcaatattgaaagccattgacagccaatgccttcccaagacaggtgaatgtgtcaggtgagcaggcaatcccacttgaaaagctgccttccttgtagttgatattgacaggttaaagtctagttaatgtaaaaatattgaaagacaataggtcccccctttcagtgtttctatcctcaaactgcattggttggccttggattggaggcatgaggattcaatgtaaatccacacaaagagccccccttcctaggcagcacgtagctttcaaacaacgggaaaaaacagttaaggtaaagtttgttatctctggatatgaattggattggatctaggtaggagggcaaacgtttcatttaccaatcatgctcaatcaaactgcctaagtctaaaatagaaccttcctgggtggttcttccttccctgaacaagctaggccaggcaccaggagacagaaggagactccattccatctgaactaagctagatttgttcgcatggatcagaatgagttggtcagggcctgcccacactggctcgtggtctgcaagtttgggaggaaaccacctgggcttcagagatgaccacagtgctttttaaaaggcacttttttgtgtttgcagctccattcatctagaagtgctgccactgtggctcttccctgcatttaactcccttgctaaagttacttaggaaacgtgagttggtgaggacacattcatttctaggaaaagctacttgatgttgtctgggcaggactgcttagcaactgaccaccagtgacatcaggacccaggaagtctttgatcagactaatggaaagtccttcctgttgggaattagtggacaacctctccccaaactacaactacccagaaacttctgggatagaagaccctgtagctataaagcatgactcagtagatatgggatggaggggcccctttaacttaagaactttaaatgcctttgtaagtgcatcaaagcttcttccagcagaatgaaaattagaaaagtatatttataggtgcccttgacgcttttggggaacgcat

SEQ ID NO: 22101 - DNA, 1184 bp, Mus musculus
ctgctagtgacccatcttgccttcagacgcccgacaagggaaaaggggcacctagccttttaaaacctcttcagattgactcagagaacctctgtagagggaggcaataccctgagaaggctgtaactttttttttcttcctcctattcagaaatttctggaagatgtgcaaacagatttcattgatgtggtttgtttttctagctggccttggtcgaacaggcactctgataggctgctacctcatgaagcattacaggatgacagcagctgagagcattgcctggctcagaatctgtagacccggctcagtaattgggccccagcaacagtttctggtcatgtaagtgtacttgaagcttgtcttctgtaagaaccagtggctgtgggatgggggtggaggcgatgtccttacggaaagctgtatttttgatgttgtttaaacactgtaggaaacaatcaagcctctggctagaaggcgactatttccgtcaaaagttaagagggcaggagaatggccccctcagagaagccttctccaaacacctttcggatgctgatgacctgtccttaaatgggcttgagaatcaagacaatcaagagcctgagccggtaatggaaccacctcggtcacgctgttgtaattgctgtaaatgcttttgagatccttgtagggcatggcgaaactgtaggtaaagcttaaaataaagtggcttttaggggctgataccacacagtcatgtttacatatattcataaccttctctagaaatgtttgactgaaaagaaagttgtgtgcttatagaacattccgttgacttcctaaacacagatggcaattatcagtggggagtaagctcctaagacagagctgcttacactccaacctgagtgtgccatcttcatctcaactggattagtagttcaaatggagaactttcaaagaaccactgttgtagcaggcaacagtactatactaggttaagtagtaatgaatggatattcagactttaacaagttctaaaactaaaagcccattctattatgtatctttacccctttatagagggctttgtgactagtgtccctgaaagtcagctttgattgttttgaaatatggctggtagcttgatttttgaaaactgccgcttagcattcagaagaaagtgtgtgtgtgtgtgtgt

SEQ ID NO: 22102 - DNA, 1341 bp, Mus musculus
tggttttttgagacagggtttctctgtatagccctggctgtcctggaactcactttgtagaccaggctggcctcgaactcagaaatccacctgcctctgcctcccaagtgctgggattaaaggcgtgcgccaccaccgcccggcagttttggtatttctgcttgctttccaagctctttatttcccgtgctctctcataagcttggctgagttgggggtgagtcaggaaagaatctttaaacattaaagtgaaaatgcctgcctacatcaacttctttggaggtgcaggtaatttcttgcacaggggttatctcccaagtgaggattcatggaacctcttacagacagcagatgcctgctaccgattgccctaagcttgttttggtggaataagttgaaggaaatactacttggtttggtttgatttgatttggggactgtgctgggaataaaaaaccaaagtttttatgcatgtgagcacattctgttacactgagctacatccccagccctgatcatgttttaaatatctaggacaaaggggacctagaatatgtataactctagatacttctcctagcagttcacatggatgtgcacgcgcgcgcgcgcacacacacacacacacacatattctgctttttaaagggcaatattaagatttttttaaaaacctttgtaatgaaaaggtatgctgtgtgattgattgggtatgttagcccacactcatgatctcagcacaggcagagtcagtaagacaggggtagatactgagttccaggccagtctgggctatatatggtgaaattgtgtctcaaaaataacaaaaagaagtgtgcagccaaatatggtgattcacgaggaagcagaggcaggagggtctcggtgagttccaagacagccaagggctacatagagagacgctgtctcaaaaacagaacaattaaagacaaatgtgcattgggttaggttgtacagtagtaaacatctgcattttctcaccccagatctgtcttatttggaaaactattttcatattttacctctcaaaaatcttacttttgtcccagaaattctcatgaaatgtatcataaaatcaaaccactggtaatccttagtaactgtagtactactaggaccttatacttttatataaaacatattaaggcacaaaaatgtatttcaatgtacttttacacgagtatatacggacagtcacgtttttaaataaaaaaatgaatattttcagaatttaaaattaaaattttttgtttgggttattttgtttgttctgggttctttgggataagggagaagagtgtccatggagagggggctcag

SEQ ID NO: 22103 - DNA, 1099 bp, Mus musculus
ccccctccccccccctttattttggcagtgctagggatgacccagatcctcatgagtgaggtagcccctagcccaggagtaaatattttgaagcaagcaaattttttgaagtgagatttattagtacatgtgcttagaaaataaatgcaatttcccagctgatacatatgttagtcccagattccatctgtctggttagatgttttatttaattctacttgatgaagctgaatagaaggttaaatttaggatgctgtcccctcggaactctaacatattaaatagcactcttattcagacattgtcttgtcgtggttaattgccacgatgcagaattacggtggcattgtgtagggaacataagggactccaggtaattaattttccctctggactatttaggagttgaaatgcttccttgatccttatcagctgtaactctaaagactagtgtgacgtttgccctcagcggtctgtccttgttctcttccaggtaacaacatccactttgtgcaccgagacaggaataggttggatcacaaacccataaactctgttttacagcttgtgggggttcagcctgtgaacttcatgagcagacctacagtcatccacgtgtgactttacgtggcatcttccacttgtgaatgggcccttaaaacgtgaaccaaaatgccaggcaccatggcttcatagggctatgaaacacagaacttatgtgcctatagaactacatgctgagggacatcagttgtcagaaatggaacagacagtttaaattttataacttctataattttatacaaaatatataaaagtcaaacattataaaactatcattgttaatatcattttatgagtatccactcaataaaagatttttggcaactaaaatataagaagggggcgctagaaaaatcactcagtggttaagagcacttgcttctcttgcagaagacccaggacccaggtttggttcctaatacccacatggtagctttcaatcatctgtaactccagttccaatggatccaacaccttatagcctctggtacacatgcatacatataggcaaacactcatacacataaaacgacag

SEQ ID NO: 22104 - DNA, 1099 bp, Mus musculus
acagctttataatattgaaaacttagtgcttaattctgagtctggaatatttgttttatataaaggttgtataaaactttctttacctcttaaaaataaattttagctcagtgtgtgtgtatgtgggacttcagtgtgtaatgtgttgacaaatgttcgggactaaatactgattcagggtgacatggtacagcaagaaaaaggtggcaggtgctctggagccttcggatttcacctcagtgtcccatcagattaggtatgtgttagtgaatctagcttgggataattgttttctttttgtgtgtgtacatggtaaatgtgtggagttcagagaacaactcagttccacagtgttggtcctatcaggtcctagccatcaaaataaggttgtcaggctgggccacaggtgccttttactactgagctatcttgccagccccactagtttttaagtgacataattacgtatgtttatactataatgtgtttttgatatgatgtgtatactacaaaatgatctgatagggctaataagcttacctcaaatatttaattactttgttgaacttttctagctgtttttaaaatacacagtatattattgttggaaactgtcctgttatgtagaccaggctggccttaagcccatgatctcccttcctcagccttctaagggctaagataaacatgtaatgttatacccagtctcaagtctcatatctggcaaaacttgacagtccagaagaacatgagtaaatcgctcagcacaggagtctcaacttttctaattctgtgacctttcaatatagttcctcctgtgtgactcaaaccataaaattatttttgttactactttataactaatattgctacagttataaatcataatgtagatttttttttttttttttttggaaatagaggtttgtcaaaggagtcacagcgctgagaaccactgttctagaaacttgcaggttttacatattaggctgactggaagaaggttgaagtgctagtttcagtagtgcctgtccacattgccagtgaagaccacaatcctgctatgtagttctagaaagggccatacacaggtgggctg

SEQ ID NO: 22105 - DNA, 1141 bp, Mus musculus
ccagtgcgggtcttgttgggcgtttagcgcatcgggttgcctagaaggacagatgttccttaagaccggcaaactgatctcactgagtgaacagaaccttgtggactgttctcacgctcaaggcaatcagggctgtaacggaggcctgatggattttgctttccagtacattaaggaaaatggaggtctggactcggaggagtcttacccctatgaagcgaaggtaattggtttgttttatcctggctttgttttcagaaaaggaagcattaccagatgtggttttcagagttcatactttagtgggtaactcacagcattctagttcaagggatggtttctgagtattggcctcacacggcgtgagctgcaagtcactgttttgtttctagagctcatgttctaagaggtaaacagttgtgatcaagtctcccccttaactttcaaaggacggatcttgtaaatacagagccgagttcgctgtggctaatgacacagggttcgtggatatccctcagcaagagaaagccctcatgaaggctgtggcgactgtggggcctatttctgttgctatggacgcaagccatccgtctctccagttctatagttcaggtaatggtcagaattagcacctccctgactttggcgatttatgttgggggaggggtgcgtgcagatgcccttgggagtcctgaagcatcagaccccctggtgctggactgaggtagttgtatgccatctgtctaatatgggttctggaaccaaactcaggttccctgtaagagcagggaatgcacttaactgctgagaccgctctctccagcaccctctgcttttcagtgttttaatgcattgggggtggggggagatgattagaggacaacttgcaggagtcatttcttcccggtgtgtgtggcttccagaatcagaccctgagccttgttaacaagttcctttccctgttgagccatctcaccatctgaaatatttcttttactattgtgacttactctatagatagaacatagtttacataaatcttctccaacatatggatttttttccaagagattttttttttattgctataattagggccttaaagaacctgtggttcagctgtaaggctgaagggggaggg

SEQ ID NO: 22106 - DNA, 1099 bp, Mus musculus
acttgggaggcaggggcaggcagatttctgagtttgaggccagcctgagctatacagaaaagaaaccctgtctcaaaaaaagtaacatatgtgagtgctgagaattaaacctgagtcttccacaaatggtcttaaacacagccatctctccagcaccatctctgcctctggaattaaaagcctgtgccaacatctggctccccctgtctattaacaaaaaatgaaaactgccagttctgtgcttgctctagaatgaggaagagtggaggagagcgatatgggagaagaacatgagaatgatccagctacacaacggggaatacagcaacgggcagcacggcttttccatggagatgaacgccttcggtgacatggtgagtggggacatgatgcgaactcttgaactcttgagccctctcctccattttctttctacaaagttatctcaccttttctacttttttttttctcccttcccggaagaccaatgaggaattcaggcaggtggtgaatggctaccgccaccagaagcacaagaaggggaggctttttcaggaaccgctgatgcttaagatccccaagtctgtggactggagagaaaagggttgtgtgactcctgtgaagaaccaggtatgagggctgggagaagtcttgagtttgatccccagggtccacacttggaagagactcgaggtgggggaggggcgggagtgcagcatcactaaagataatgatttgattaccctcccccagcagccatcaactggtagtaactcctgagaggagccaggccccatgagactctgtcctctgtgctttagccttgaccacagtgttttgttttgtctgctcttttggatcctgaatgagacaggatctcacaatactagcccagcccagcccagcctggcctcaaacccaggatcctcttgccttaatctctctagtggattgcaggcatacattgccctacccagattcctgtcttactgtttttttgttttgttttgttttgtttttttcgagacagggtttctctgtatagccctggctgtcctggagctcactttgtagaccaggctagcctcgaactcagaaa

SEQ ID NO: 22107 - DNA, 1152 bp, Mus musculus
aactattccacaaaatagaaacagaaggaacactacccaactctttctaggaagccacagttacactgataccaaaaccacacaaagacccaacaaagaaagaaaacttcagaccagtttcctttatgaatattgatgcaaaaacactcaataaaacccctcgcttcctgacgcttcccccctctccccggccttctcccgcagccgccttctgcaggccggaatcgtactgtatgtccgctatccagaacctccactctttcgacctctttgcagatgcaagtaagggtgatgacccgtttcctgctggcactgaggattatatccatataagaactcaacagagaaacggcaggaagacccttaccactgtccaagggatcactgatgattacgataaaaagaaaccagtgaaggcgtttaagaagaaatttgcctgcaatggtactgtaattgagcatccagaatatggagaagtaattcagctacagggtgaccagcacaagaacatatgccagttcctgatagagattgggctggctaaggacgatcagctgaaggctcatgggttttaagtgcttgtggctctctgaagcgtaagcaagaatttccttgcactgagtagaatttcccttctgtcccttgtcacaagtttaaaaacctcgcagcttgtatgatgtaatcatttggggtccacttttaacttggactagtgtaactccttcatgcaataaactgaaaagagtcatgctgtgtagtcttgaagtccctcatttaaacaggttgagcagtaagccctggcagtgtccaccctggtacaaagcaataacaaggtttcagccaagccaagaaccccaagatcacaggaggctctgtctgaccaaaggttccttggggctccctggacagaggcccctgccctaggagagtgtcaccacttgaacagctcaattgactgacagaatgggtaacactgccccagctatgtcactagagggagtctctgaccctggtgtctgaccaggtagaattcagaaaggtctacctttccagagaagtcatgcacatttaattcaccaccagggtggtcttttgaagcacatctatcctagtgggggggtgggggtggggggctgggggggggttgcaaca

SEQ ID NO: 22108 - DNA, 1992 bp, Mus musculus
caaaaacataacaacagcaccagtggcagcctaagcacaccccctgaacggggcagtgatgaggacattgagccattactacaagacagcagcatctgggagctttcctttgaagagcctggaaatcagtgcactgagctataacccagtagtaatggagattctgcagacaccatctctgagagccatagaggaagctgcaccacgtggagacttcatggtgctggaggggcgatgctagcagcatcctttgggccacgtttaataagttattcttcccatacctctgcccttcactcttctgtctctctctgttcttttattcccattcttttttttttctttctttctttttttatatatatattctaggaaagattgaaaattcttcaagattatttagaatctagactttaaaactttaatagaaaaatcatgttggtggtaggaaaggtggtcggtctttcccttcagtaactagaataagagtgacagatatttttctgtcttttttggtagaagattgggacagtagtgttaactgcctcctttcattgtctttttgtgaatcattccctcttagtctataaatgttgatgagttgataagaatcacatggtatcagggatctactgaatttgtccagaggttagatgaaaaccagttttgctttccctttgttttctctacttcttaagcttctcaaaaatgaacattattaatattgatcagtgctcacatttatcagataaaggaaatctttcttagaaaatttaagttatgttgaacaagcagctcagattcttaaactttgtgtcctgattgaggttagccttggcaacatactaagagcctaagcatatctcaaggcaaaacaaccaaccatgaagctttctagtggcaacaaggaaatcagagaatacttcaggaaaagttttctgtttattattttgttttaaaattttaaatattcctaaaaggggagagagtaagatagcagtgtttatttttaagttcatactcacatgttactgtatgctcttccccgtgtctctttgtcctacttctgtttctgtaccatattcctgccttaactgttaatgtagaatgtgtttgtttttgactaatctgtatcttggtatgtttttccgaatcccataggaatgcgcacatcaaattcctttctaaaatatgagggttagtggagctcagtttcatgataagtgtcttgctaatttttgaggtgttttatggacaaagaaaactacagattttatattttgctgcatagtaaatggactattaatttgggtctatcttcaacaaagtactcctttgaaagttttataggtatgaaaacatgtagatatttgtaaggattttaattttttttgatggggtgctgtgtaaatcttgtatttataaataatgaaggtattgacagaaaatatatacaacttttataagggatcatatattgactgaatacatttaaaggaaaatatattttgaagcctgttctgccatgaacagatataacatatctttttactatgctgttggtttttaggttaagcttcctaatgcataataaattttcaatggatacttatatggcttaaaaacaatttctgtcattgctcttttgggttcttttggggggggtggctatccacacaactgagttagtaatctttcaactaattaaaaaatggttttaaaaaatgattttaagtttcttgaaaatcaccttttaaacataagtcatatttatagaaacttaaacaatgctgctatggatgtagaaatatctcttgttcctaatagctagatggtacaaaaaaacaaaacaaaaaccagaatctggaaaaattacttgctgctcttgatgaggaaagaattcaattcccagcatccagcattcacattggaaggatcacaactgctgcaactccagcttcaggaaatggataccatctggctgtgcttatt

SEQ ID NO: 22109 - DNA, 7593 bp, Mus musculus
tgccagggctggcctccggcaagaattcccggtgctgaaatgctctacctatgagaaaatacattgatatgtttatcaggaattcttgttaatatttgtaaatttgttggctaccatactaattttattttctaccacataagttttgcaaaatattaacacatcatacctttctagtgagagattttaaaaaacaaatcccatttgctagcctaaattgttctactcatgttactagtcttttgtctaggtgtattaatgtcatctgaaagtaattttacctcattccttctagttttatgtatgtattcactgctttttaaaactttattagctaataaattaaaacgattataggttgttgggtttcttttgtaaagacttgcagtttttcttcattagacctcaagctattttttcttttcttattctttcctttttatttaaaacttttatccttccttcattcttatgcaaaagatgcattttcctctttttttttttgctaacatgtatgcctttcagtattgtcaagttctagttaattttatatttgcctttaagtatatatacagatacctgcgtttattttcattaggatataatatttacatggttatcttttactttgattataaagctctcttggataattcaaatagtctttcagttggtagaagatgatatcattaatcatattctttctaaaacaatctttttataggtggtattttggcatgatttctgtatctggagtcttctcagtcactttctctgtaatttttgcctatgtagctgacttcactcaagagcatgaaagaagtactgcttatggctgggtaagatagtaagctttttgtttgttttgttttgaaacaaaaacttacataggccaagttgacctcaaacttagaatcttcctcttaagggctggtgttatgggtttttagtaatttacctgtcgtagaattttttgtttgaggcctgtctcaaattcaataaatatcgtgaacttcagctcctcctccctctactttcagagtgctaggattgccggccacgatgcccagcttgtagactttctaaaaactagagtgataattatcattttactaaaaactgactggaaattgaggtttaaaacaacatcagaaacagatttgagaagtgtgaggatctcagcagtgagtcccaggcgctcatctgaaacacagcattgtagtgaggaaaggctggtcattcagcagatagttgctgactatcgaaagttagaggagacttttttttgataattttacagtctcattctctcagttgatattagacaatctcattctctcaactataatgatattatagttacaaaagggaagaactattagaaaatgtaagcaggagcttatgtatgtatgtatgtatgtatgtatgtatgtatgtatgtatgtatgtatgtcagaagtgcagaagatcacattcaaggtgggctgtgttagccatcagagctgtgaaaatatgttttcttttctgaaaatagtgtagccaatttaagcttatccttgactaccttagaattaaatgagactcattttatttggctttgacaaatactgggggtgggggttaacccctaatctacaccatgaaaggcaccatgagaggaaggtggacattatggatttaggtaattttaaacaaaaacataaagtagcctacttgacagtatcatcaggtgctatgagatctttggcttcatgaaaacctaagcaatgttgttcccataacatttgaggatgctaccccatactcgcacaataatactcttaagagagtatagcactgctcccacaactacttgcatgtctttgcaatttgtggtgcatttatgtgcctgcctggatttttttcaaataaactgttaggatctctgtcatcatccgatacttgataaatactgagtttctggaattagtttcccaaacgaaagttctccacatctttattccccatcccaaactacagcctttaaacatttttagcacagaatacgtttatatgtgttatatttttgtattcacttgtggaataatagatgatataagaatgccattgatttatcaggaatcatggtcagatacagtgatttctgttgtttctttttaaataacactgttacttattctcttaaaattccatacatgtatttagtgtaccttatatccatcccataatccatgtcttacattttatttcctctttattattttcttttcttaactcactgggttcttatgtgacttattttattcaaacagactcttctagttttaataacctatcagtatgcttttgatactctaatgtgtatataatttagagaatgaattcacattatatttataaatggagaacatgggggtgcagtgtaataaggccatggcctctaaccagaaggcttcaaccttcccaaaaatcttttctattctcttttgtatgggttttggtatggggatgctaattaatgatcacacccaggatcctgagtatgctagtcagtctactacttagctatatatcctctcccctcccctcccctcccctcccctcccctcccctcccctcccctcccctcccctcccctcccctccttttccttctttcagttgcagctttttctcttaagaaaaccagcttatcccctacccctgcccccactgtggtaatgaaatagccataaagtcacaaatgggtgtgtgggaatgtatagtgtttttgaatgaaccaggtataggtgtttcttagaaatttgtagatttcatcatcagctcttcagtgattttgttttttgagatagtcttaactctctagccctagaactagccttgaactcagattataggaataaactactatcacatgctaggcaagtgctgtgttgtaggaattgttttcatactcttctttgcacatgtctgttttccaattaaacaaacaaaaacagtgaatgttctatgaggagagtttctacagtgttaatttatatcatattttgatcattgctccccagcatatcttcacttagttaacagtgtgtgaatacatttttaagcaaaattgcttttcttctttttaattcttaaaatttatatggaacatatttgttttgctgaaattaggagaggggactggagagatggcttagcagttaaaagcagttagttgttcttatagaggattcaggtttgatataaactgaagcgtaatttcagttcttcttctgacctctgtgggtaacgggcatgtacatggtgcttacatagacacttataaaataaatctttaaaataataataataagaagaaaacaaaaaaacgagagtatagctgcagctatgcagctgtgttacctgcagtgtgtgggactccggaaagagcatgctctctccactgatgtttttgtcaggatcctaaatgattgtacttttccccataggtctcagccacctttgcagctagtctggttagcagcccagccattgggacatacctctctgcaaactatggagacagtcttgttgtgctagtagccacactggtggctctcctagacatctgcttcattttgatagcagttccggaatctctatcggagaaaattagacctgcttcctggggagctcagatctcttggaaacaagcggacccttttgcggtaattgtcttcctggttgcaggcagcttgaatatcaacagtttatgaagactagagtgaatttatgtataatgaaaactgtggaagaggcagaaaggaaggtcagaatgtcaaggtcattctcagctgcatattgagtttgaggccagccttggctccatgagaccctgtgtcagaaaaagacagaaaaccttgtagttaaaattatttagaagaagttactttacaaatcagagaaaatcagtttttcttagagagttgtgtagaatttttttaatggtctgtttataggatgttcaggatctcttagagaagttacatgaaaatagtgagtcactatcaaaagagcactgacatgtgtttttgccctgtgtttattcccagtcattaaagaaagttggaaaagattctactgtcttactgatctgcatcacagtgtttctctcatatcttcctgaagctgggcaatattcaagcttttttctctatctcaggcaggtgagtagtaggtctctaaaagcctttcaacatgtagaatatccaagattggggtttgtctaagataaattgaggaaataattgtttctagagactttataagcagggactttgtatagtccagtgatttcagtgatggcctccctcataagtgactggaactacaggcgtgcatagcttcttgctgaggcaggggtgttctcagagcagtctacctatctttgccttccaaatgctgggattaaagtcatccaccatcaaatctagctccgagaccctattctaaaatagggtttagattgaaccaaattaagaaaatatacagagctgtcattatcttttcaccacaggtacacaattggtaccaaagtggttcatttggtacattttatgagcctgtatactttcatgcattagcactgttcaatctatagtttgtgataagttcactgttgcttttgcttccatgttttagtgagtaaagctgataataataggctgtctcctcttaagcactgaaattataggcatgaactaccccaccagttaagattttgtaatcgaatgtgatgagacagtaatggaaaagccagagttgtggctctagaatttgttgtccagttgtgattgggaggaagatacttagtgatgaagtaaagctgtataaggttatttttaatgtatgttcttatattttatagaattttagtagaagacaaagtaatattttttaaaagtattaattatttcatggttactgttctaattggaggtttagaagtcaattgccagtcagactcagctgcttacttagaagtgtatgggagatttttaaagcacaaccgtcttaggaccatccctcagagttggacgtaattggtcttcagtgtgttctggcgtcttattgtatctctccctttccttcccttctgttctttattctgttgcccacataaatttaaaacacacccagactcaagagccaccgacttgactggtagtccagttctgctttggcaacattaaaagttgaattgctttcttttatacttttttgtatgctttcattgtctccaaactgacatagactaattaagagaagaaatactaaaacatgagacataataacatttttttttaaaattcacaattcatgcctactaattacaactattttatgtcatatttaaatataaattatagggtttttttcagcttctgtctctgtcctaatttcagttgttgtgaactttcctcaattatttttcctaccatttcttactaattatatctctaacacctgtattacaaaagtatttttttgttgttgttgttttattttgcttttgtttttacaggttataggttttggatctgtgaaaattgtagcattcatagctatggtaggaattctgtccattgtggctcaggtgagtgtttctttatatgtgagttaaagtgacaaagatctgttgttttttttccccctcaatcctgatagcctcagatctctagtaagtcaagggtacaagtttctaagagttcctccaaactgttgcctcagctgtgatgtgtcttgctcgtgtagagaaccccagggaattcaggtagctggcagggacccagctccaaaaactgggtcattcacagactattcaggtccttgggattcagtagaccttcatacatacttacaaacttccagaacagctagtttaagggggtgctgaaatgattcagcaagacatgcttgtcaccaagcaatgacccgagttcagtctccagaatctacatggtagaaggagaaaattgtttcttgatgattgtcctctgatcttcatgtacttgctgggacatgtatacaaacatggaacaaataagtataaaaactattttaaaggaaaaataaccagatactgtaaaattaaccagaggaatgtgtttcagtgtttccttaatggcaaaaaattaggtagaaagaaaggttttacagatcctgctatctccaggactgaacagataagaatcaatacattacaacatatgcagtaaacactttccaacctattacagttgtcagtccagaaaggcaagggtatatgttgttgtctttcaggagcattcagtgcagcttttgtggattgcctagaggcttgttcccttgaaatggtatctaggccaagcttcatgttcttctgtgattaactctctgcagaggaaatgagcagtctgggaaactaacttgtcctaccaaatgaaagaatgacaaggctcttgggaatgcatgcgagcaaaggctgttccttgctgtttttgttttggctgtatcaacaaattcagattatgctaaacatccaagtttattgtgattttttttgttttttacattaaccttagctgtttgtccttgggtgtctttatctttattttcatactgtctctaccagttgtatttaacagaatatatatttattaaagctcatatcattggtaattttgtgaaattgttaactgctgaacaataagtgctgttgacattctccaaagaagactaagctgtagtcttcttggtcgtggtaactggagtgcagctgtgttaaccgtgggagaggtaccagcagagaaccagctagatggcttctctggaagatcgaaagctttaaaccctggccagcactggagctcccgaaactctgtttccacagagttatcactactgcctggccttagggatcatagactgtcagtgtcctcttaaaggtccagtgagtggactttactaaaagagcttatgctctgagtttgagtttgtgatcaaattcttgtgtgctcatgtggcgtctcagagttgtcttctttcctttgcagacagtcttccttagcaaattgatgagatcactagggaataagaacactgttctccttggtttgggttttcagatgctccagcttgcctggtatggttttggatctcaggcctggtaagcctctcctcattcacatattatcaaaacaaacaaaaagacccaattaacagatgtgatgagccttagaggatcaaaaaccatttaactatgtttaaagaggagttatttcattagtttggtgtattcaacattttacccctgggcaagagtggaactagatgatttaatatgacctgaagacttttactaagtctggagtcattgcttaattgaatgtgtgttgtcatctaccaaccctctaataaagttatcatgagctcatgagctctttctctcttctgtgtcctctccctctccccccgcccctctcttttggggtaaatgggtttgtgtttggtttttgaaacagtcgtgtattgtagctcaggctggtctcaaacctgtagcaattctgcctag

SEQ ID NO: 22110 - DNA, 1193 bp, Mus musculus
tttctcttgggctgtgctgtgtgatgtttatctccattccttattacagatccagacaggccagcccatccctgtacaaagagtgtttatttgcaataaacatactggagtctaggacagaaaagacctccttattctcagagttcaatttcagcaagcttaaacagcatatcacaatttactgagataatgtatgttacatctggtatcttaatggagtcacacgcatacacacaccaataaataaatgtaattttaaaactcagcaggaaagatggttgggtgggttaagggtccttgctcttcgtgcatagaaacattcacactctacaccacagcttacaatctagttctagggggatataatacccccttagtgtctgtctaggtatcagccatacattttgatgtatatataatcatgtaggcaaatactcatttcaccttaaaaataaatgtttttgttgtttaataaagaacattgtcacattctgagaggttcaaaaccttcttcatgtggataacaatagaaaattccatgaagtcagagaagaatatgatgttatccttttcctacaggatagcacactgtaaactttcacctgatgactgcaagatctttggctccatcctgatgagcagcaagtcgttgaaggttcttaatttggcatccaacaatttgaatcaaggaatatcctcactgtgcaaggctttgtgccacccacactgtactctggagtacttagtgtaagcagtcttgggaggcgtaccctggggagactatggaagtagtatgaaagttgcctttgtttactagaatgtgttgctgacacttctgagccaggctgagcttgtgggaggctgactagctagggaagggtgcagggtgggtgcctctggtggcatttttgggagagcagatctcttccctgagcggcactgttctagcacttattacagaagctctcagaggataagagtaattctcacacacctttattattcctggataggattcttatatatagttttggggtggatcagagtctgacagtaggtatcttcctattggcttggtctgagagtttgggtataccttatctacatgtaggagagctttgggtgctgtccctatttgactgatggccacaaacctctctattggggcctgtagggagctgtagctacaagac

SEQ ID NO: 22111 - DNA, 1152 bp, Mus musculus
tatggtaaagcctttgcatgtgataattctttacacatacacaagagaaatcacactggactgaacccttattaatgtaatcaatgcggtaatatgttggcaactcactgccatgtgcaagtacataatagaacacattcaagagagtaaccctatgagtgtaatcagtttattaatctgttgcttgtcacaatgatctgtatacataaaagaacatatactgtagagaaactgcatgaatgtaataaatgaggtaaagcctttcaggacacagtcatctctgaatacacaaaagaacatgtgcaggagagaaaccttaagaatgtaatcaatgtgatagggcctttgcatctaacactcatttctaaatacattaatgatcacatagtggagagaagccctatgattgtaatgaatgggtaaagcctctgcatgtcactgtacttgccaaatacttgaaagaacacacattttagagaaaccttatgagtgtagtgaatgtggaaaagcctttgcatattatagtcttcaaagacaatagaatacaaactggacagaaatcttgtgaatgtatgcatggtggaaaatcctttacatgccacagtagactctgaatatataaaaggacacatactagagcaaaaccttttgaatataatcaatgtggtaaagcctttgcctgtcctaatcatatttaaatgcatgaaagaattcatatagttataaactggttatttgaatatgcttggccctaagaagtggcactattaggacatgtgcattgtgggagtagatgttactgttttggagtaagtgaattactatggtggtgatctttggggtgccagccaggacaaacagccctacaactacttgactggaaagcagtcttttcttggctgccttctcatgaacatgcggaactctcagctccttctccagcattatgtctgcctgcatgctgccatgcttcctggtatgatggtgatggactaaacatttggaactgtaagccaggcccaattaaatatttgctatcataggagttgccttggtcacagtgtttcttagcaatggaaattctaaggcagaagttggtaccccagacttaaccattgctgtgacaggcctgatcatgtttttgtttggagc

SEQ ID NO: 22112 - DNA, 1110 bp, Mus musculus
gaactggaaggataggtgtgtgtcaggaatcccaacaggatagagaaagcttccactgaagcccttggaaggtttttgtttgggtgaacagggctggataccaaacacttccggttttccttaattctaacctggtaacatggagacgtttgtggtctggtatgggaagatgctcagtcatcccagaactcctcattccctcacaaagccctcatagagaggtttgtcacctcacccttccaggacactcaccatcgtccttagacactgaggtcatattctccaacaaagccaccactgctttgcagtcttctgggtgctgcgactctacccatacccgaagcttctcaggcaatgcattcaggaactgctcgagcaccagcaactctaggatctgcttctttgaacgtgtactgggctgcagccactggtgacacagcttacgaagctgggacacagacttctggggaccagctgactcttcatactggaaatgtcggaacttctgtcgcgaagcttcagtgtcagtcaaatgcttgcttggctgttgagctggcttgaggttacctgggttcaagtcttccccactttctggatagagggattgaatcagggcattccggggaccagccatatccttgttcaatgtaaggacctcaacaaccttaatcttcatcaggggactctcagcaggaaaggaattcatttcagggtccagagaatgcccagagcattctaaaagtcaaaatcagagcaaaagctaggcaatgtggcacattcctataatcactgttcttgggaaactggggccaagagggaatcactcttaaaagtctagccagatctacatattgaattataggccaattagagccacaaagacagactcatctaaaaaacatacataaaaccaggctgagtatgtagcacagtttgtagagaattacatagcatatccccagaaattcattaaaaccggtcactgtgctgcctgcttgtaaccccagcacatgggagacagaggcaagaggatcagagggtcaaggtcaagtctggctacatggtaaggaaggacaaggccagccttagatatgtgagatatagtttcac

SEQ ID NO: 22113 - DNA, 1158 bp, Mus musculus
atgagaaagctcctgcttttgctgcttcacagcttgtcactccctagactatatgacttttgagaagatgtaaccttatttcttaatactgtcactctggcacttataactgcaatatgtatatcttttggtttctttcagggtgggagcctacgttgggaaacagagagttaactccagactctcccatacctgtggtaaagccaattcatgacccaaacccaaaagatctctcgaggaatcgtacccagtctaccctctttgaaagtatctcaccagatgaggtccagggaaggcacaccatagaatcaaatccagtggggcttctacaggaaaaaggccaccctcagcagaagctctctgaaagctccaagtctcagaaccaaacttgtattgacaaaagccagtgctcactcaatgaagttcttcctagaaatcatgtaaaagttaagcagaagggcacgggaaaggggaaaggcaggacaaacaccatttccatgacaggaggtttacgcataagaaatcagcagaaggactccgtggagtggcgagacaggagtggcagcactcctgtgacacatggctcctctataaaaaaccaacaattgggttctgagcagggaaaaactcagaccagcagagatcccattacacttgctgtgcctgcagaattttaccaggaagccactggctctgaagagggtaggtttaggaacagtagcaatgccatggcagctgatgcacctccaaagattcaccagaaaggccctgaatggcataaagctgggaaaagtaacaattccatgttacaaggttcatctgcacaaaatcaccagatggggtctagggcaggaagagccagggacaacagcatcttaacacatgtaaaaattcaccagaaaggctataaagaaggcaaaatccaaggaaacaataattacttgaaacatgtaaaacctcaccagaagggttctaaagaggaaagactcagggaacttagcacttgtcaaaaacatgtcccctatgtaaaacaacacctaaagacctcaggaagaggaaaaggcaggaaaatcaatgcttccataaaatgtggtccctatataaaaacttactatagaggttctgatgtgggaaggctcaggagagccaacaattgta

SEQ ID NO: 22114 - DNA, 1113 bp, Mus musculus
tttccgtatattaaaccatccctgcatccctgggataaagcttacttggtcaggatggatgatcgttttgatgtgttcttggattcagttttcaaggattttattgagtatttttgcatcgatattcataagggaaattggtctgaagttctctttctttgttggatctttgtgtgatttaggtatcagagtaattgtggcttcaaagaatgaactgggtagagtaccttctgtttctattttgtggaatagtttgaggagagttggaattaggtcttctttgaaggtctgatagaactctgcactaaacccatctggtattgttttttttgctggtttttttttttttgttgttgttgttgttgttgttgtttggttgggacactgttaatgactgcttctacttctttaggggaaatggactgtttagatcattaatctgattctgacttaactttggtacctggtatctgtctaggaagttgtccatttcattgaggttttccatatttgttgagtatagccttttgtagtaggatctgatgaagtttttgatttcttcaagttctgtttttacgtctcctttttcatttctgattttgttatttaggactgcccttgtgccctctagtgagtctggctaagggtttatctatcttgttgattttctcaaagaaccaccttctggtggttgattctttgaatagttctttttgtttccacttggttgatttcagccctgagtttgattatttcctgcagtctactcctcttgggtgaatttgcttcctttcattctagagcttctaggtgtgctgtcaggctgctagtgtatgctctttgtagtttctttatggaggcactcagggctatgagttttcctctaatactgctttcattgtgtcccataagtttggctatgtttggcttcattttctttaaacactaaaaagcctttaatttctttctttatttcttccttgaccaaggtatcattgagtagagtgttgttcagtttccacgtgaatgtttgctttctattatttatgctattattgaagatcagccttagtccatggtgatctgataggatgcatgggataatttcagtat

SEQ ID NO: 22115 - DNA, 1327 bp, Mus musculus
tcaatgtggtaaagacttcacaactttgtaatctccattattctaaaagtacacatacaggagagaaaccttataaatgtaatcagtgttgtaaagcatttcaagtcacagtcatctgcaatgacataaaagatcacatacaagagagaaacctcatgaatgttgtcaatgcagcaaagcctttgcatgtcttaattcttcacatgtatacaaagtaaagcacactggggagaaccctcattattgtaatcactgtggtaaaaaccttggcaatttactgtcatctgcaactacttaaaagaacacattcaaaaaagtaaccctttccatttttccagagtactaatcccttgtgtgacacagtcatcaccccatacataaaagaacacatatggcagaaaacctgcatgaatataatgaataaggtaaaccctttccaggccacagtcatctccaaacatacaaaaaactgtgcaggagagaaaccttatgaatgtaattgatatgagaaaacctttgcatatcacagtcatctcaaattacattcatgagcacatagttgagagaagccctgtgattaaaatgaatgtgttaaagcctttgcatgtcattgtacactccaaacacttaaaggagcacacgttttagagagaacttataaatgcaatgaatgtggaaaagactatgcttatcactatagtttccaaagacataaaagaacacataatgtagagaaatattttgagtaggctctcccagcctgaagcaggctgatccagactttgaccttgctgccactgagaattagaccacctggggtggagccttactccctagatcactatattgttcagccactgccactgttctttttcaagaatttgcgacctgctgaaaggcccctgagatattacagagactacaccctgtcctgcaggtcatcacctgcagctggttccaggcaccaagaatggtttggtgggaatgggcctcatcccctttataagcatttgctattaaacatttgagctttgattaggaaccttgacttagctccattatttctcttgaccgtctagttctctctctttcagctccagtctgcctcccaggtgtactctgtttcttgtgagcctagggtcggctcccaacacttgtgaatgaagtcaagttggaaaaccctttacatgccacagtagtctctgaatacctaaaggaacacatacaagagagaaaccttatcaatataactaatgtggtaaagccttgcatgtcctaatcatatttaaatgtatgaaagtatttatagtagatgtaaactgtatta

SEQ ID NO: 22116 - DNA, 1205 bp, Mus musculus
acatacaccactgttgcacttaccacagttgcctggccgtcgcctttttttttctttgctattttctcttaattaccattatctgaccttcatgttctgttgtagtcatcagaaaaatattaatttgatataatgtagacatctttcctctttttattaatcattttatttgtttacaattcaaatgataacccctttccctcttccccctccacacaccacccattccatccccctctctgcctccacccactccagattcacactgctctagcatcgccctacactggggcatcaagcctccacaggaccaagggcctcccctcccactgatgccagatgaagccatcctttgctacatatagagctggagccatgcatctctccatgtatactctctgataggtggtttagtccctggatgctctttatggtccagtgggttgatattgttcttcctatggggttgcaatccccttcagttctgtcagtcctttcctcttctgatggggtctttcctgtctttagacagaaatgattctaggttaaaagttttgatatggatgggtggctcaatccctcaactggtgcccgtgcctgtctactggatgtggcctctatacgttctgtgtcccctctgttggatattttggctaatgtcattccccttgggtcctgggaacctctcaattccctggtttcttggactttctagagcctacccccagttccccatcctctagtgctacatatttatattttctgatcctctgtacttctctcttgtctcttcccatacctgatcctaccctccatttcattatgtccccttctacactcccttttaggtacccatgaagcaacttcattggaaactttgccccaaggaatggcttatagctttccattatgtaaaaaattttgttgctgcttcgatacaagaagtcaggacattgaatctttcagtgtctattgttcattatattgatattttatcagctgatccctctgaaggagttttactacaagccttggctctgatacaaggagctttaaaattttggagtggttgttgttcaaaggcagtatcttctggcctcctccaaggggctggcttcaagtctccagctctgccctctgcagcactctaggctcaggtggatccacttcactgatgctgctattcttggagatcataccatggt

SEQ ID NO: 22117 - DNA, 1177 bp, Mus musculus
gacagccagggctatacagataaaccctgcctcaaaaaagaaataaggaaagaaagaaaggaaggaaagaaagagagagtgaaagaaagactcaccaggatgttgaatgaatctaaatcttgtgataaaagatattatatggcattaagggaaaggtgatgttaaggcaagattccatccagctaaactcatggatgttcagttttaggaaggagaactgtatcacattaggagtgattattacctggttattcttttcatgtgggcataaggagatataaatatttttcaaattaacaagggatgaagtgtgattactgttctgagttttcaatttaacatctagatggaaattctttggtccaggcatggtggtacatgctgttaatcccaggagatgagagtcaaatagatatctggatcaagtcatcctggtgcagaattttaggtgaagaaaagcttagatccaggcatggttttccatgctttttatccaagcattcaataaacagggatacacagatctctgaattcaaggtaaatctactgagcaatttccaggacagccaagcttaggcagtgaagttgttgaaaatttgaaagctggtgatcatgtaatagaaaggccatggtccagccccagcaagtagctttgtctctgtggctctggctttacaggcaagcgtagaagggactacttagacaattgatgttggatagctgtagataaaaaattaggggtgatgaagaagaaaccagcatcactgaggtggaaccttctggtaagtgttttctggatggacaaagatgctgtgtaccttgtgatgcttctggacttggtcatgtgtgagaagtacccaggtggtgttagtttcgaaggcatgaaggtgtcatgtagagcagctaagacatggcacaatgaagagagtatttgagaggaaagcagtgcacccctgttccagcaggaaaacccagcatattgaaggtttaaatcccatgggatgagcagaaagaacagcaacagcagtagagtggaatcagccagaacctagggtgctatagagaaaagagctggagatgtgacccactttcttttgaggagtgcaaaagatcatgtgtagatcccagccagtggaacatgaagatgtaatattgtagttaccttggagaccccaag

SEQ ID NO: 22118 - DNA, 1193 bp, Mus musculus
gtctgtgctctctgagcccgagctgctctggttctgctgttctgaccctgcactggaggtcactgtggaagaggatgtggaggaggagcgagtcttttccttaaagtctgtgataatgacggtgacgttgcccacagttactgccaactgctgtgcggtgctcctgtccacattcttcagccggggccttgaggtgtggtttgtttccctggtctttgttgtagcattagcagactgtatgctgttagcttcactaggaggatctttcagaatatcagactttggttttgttttcttgttggtgtttttcttggtgacactggggctaatgtccttgtctttctccggcttttctttgtcaggcttttcgaccttctccttcttctccttcttagggggaggtggagtggcgtactgctgtgccacctgctgtgccaccaactgagaattgatgcgaggtttcctggtggaggtgcctttcagcacatcgcagatgctgcatttaaaggcttcggcgctgttcctaaaggtgcagacgctacaatcccaaaagccttcgtctgcggcaggtttcgcttgtctttttggcctggtcgggctcttcttgtcgcccatggtcatggacgggctggcccccggcgccccacagctgcgcgcgccgccgctcagaggagaagcgcggtccgcagcgtcgcggagcggcccccgccctcccgcgccgcacgcccgccctccgctgctgggctcgagctccagccgccgccgccgccgccgccgccgctggcgccgccagtctccggacgagactagtctcttttttttttttagacagcatttttctgtgtaacagagccctggctgtcctggaagctctgtagaccaggctagccttaaactcatagaaatctccctgcccctaccttatgagtgctgggattaaaggcatgtgcactactaccctgatatattttacatctttaagttacatattgggcatatggaggttatagaacaactctcttctgctaacttgtatgatctacagatcaaacttgggttattaggcttgccttttagctcctttatccactaaccatcttcccagaccactctatatttcataaaaacagtgataaaggcctaaaataaggtaattatgatggagaaaaaaccctaggggtcaagactctcag

SEQ ID NO: 22119 - DNA, 1300 bp, Mus musculus
tcttgacacttttatgtattccattgttttatatgattttcctaacaatcatttataattggatgtgctcctgaatctactttttatatatatataaaaaaaaatctgctgtgcacaattttccatgtacattacaactggttttgtttctgttttgttgaagagggttgggaggggggagggaacttttatttattgtgttcacagactccatcctgtcagcatatcctcttaaatttagttctttcttccagctatactctgtactatcagttttgatataactatatatataaatataaaattatatataaagggttatttgaaaccaatccatggcaacgctggtgcttgatacactgtgaagtgaatacaacattgaacagttgacacagatctgggacagtcccttctatgaaagtgctgaaatatcattaaaatcagtcttacatgaagtatgttccaacctgcgtgggaacttgactctctcatctgtctttagagtactggataatataaaaaatatattttttaaacaatgtgatctcaaatttaaagactgctccagatagcctgcatttgcaatgggctaattgacaaatgacaagtggttcagttggagggctttgaccattcggaagtaacaagactagctccagaatgccaagtattcgtgtaaattatggttacatgttaacattgctgtttttattaagcactcatgaaaatatggtgttctgtatctcgaattccggcctttttccagacctctgctcacgcctgaggtatatctagcagctgtcttagttctagggttgcggtagtgcatctttgaatccacaccacccagggaagcagtctacatcccctgtggtgttgcagtggtggattttgtgatcatggcctgttttactcctcctcccgtaccccgtcctccaaatcctcaccctaccaatgcagttgttagtctttcttcttaaaacctactatggctcattttattaaacaagggttgtcaacctcacatccagacctgacacggagatcttccagtctctggagtcagttcttagttccttgtgtgggaaaggatcgcaggggtgcatgggcgagttgcagggaaagctcacttcccaggagagtgaatgaatagtaggtgttctttgttgactgaactcttgaaagcttttcatttttaccattttaggggtaggagataatgaaagaccactgataatagtttatcatcccatcccaagtctcagtgactctgctttgctcttaggttcagggtatctct

SEQ ID NO: 22120 - DNA, 9516 bp, Mus musculus
tttgtttaataaaagaatttctatgtgtggaggcaacaagttaagaacatattaacttaacagcttgaattgagtagccaacaggaatggttccattcacatttacattaaaaccagtcatttgatgcgccggagtctctccacaaaggcagtgctatttgtcaatgggctcctgttctcgatgcatggacaatgctcccctctttttaaaacagtgcttgtgtctgggatgcaagctgtacttacctttttaaatacctttttaaagtatttattaatgaaccaaaggaaaccaggtgctttctgtaagcatcagaatatataatacatagtgatttgactatgaattttaaatccacattttaatattagtggggtattgcaaagacattccttctaaagttttaatattccttttattaagggtctcagggagggttaattagtcagccatatttattttccagaggtgtaaggaattgctaagttttttaattaacttttttaaaaaaaaattaaatgccaccaaattcatgtggattgcactgctctttgaaccaataagtgttggtatgcactttgttcagaaacactgtgtactttttcaaaacgagtttcatgtaaagtgattggaccccctagattagtggaaaaggctgatttaccagctcctcataggctactaattcattcatcgctggtgtcttgggttttcagttttgcctccatgataaattaaagaatgaggagaggtgaagggagggaaggaccacttcagaactagtgaacttgccttgaggtagaaactgcagtggtggagtctaagcagtcagatgttcctggccgccctgtctcggctgtcgtgggctgcgttgggatagagaggtgataggtgccacacaatgccatcctcaggcatgcattctggaaatggaattcctattagcttcctgcatttacagtttgccctgctatagtactccgtaggtaaaaacactagtgtagcttacaaagagacattaagaggaccagaaatacttggtattcagtggcacagaaagaaagcagattaaaacaaaaagcacagtgttaaggcttgcaagtttcccgtgcgtttagtacatgatctttcacactcgtgtgcacacacacagctgagctgacatgctctgcccgagtcatgcagttgggaagggggaaaagacatcttgacacccacgagaatattttaatcaaaacctttcagtttggatctggatacttcaaaacattggcagacgcttctgtgagtttagctccactaagatgtctcgcctgccttattaagaccattctcagtctacatttttaagctgccgtatcttaaattattgagaatttattaattgctgactatataataacctttgcttgtatgttacggaaaatggtttaagagccaacatttagagtgtgacaatggagctgaacagtttctaacgcgcaagcagttctgttcttgtgtatgacttgtaaccttaatttactgtgtaaagatggttacattatttccttagctttgtttgttggagacagatagcgaatgcttgttaagtatgtcaacataatctccccttgtgaacttttgttaatgtcttatacgagctctcttttccatttgcccagaaaggtggcttgtataacgctttggaagtttctgctccgtccgtcttagagctgacagtctgttaggtttgttttctcttcatgctaaagtgtcggtggttttgtgaactggtcagaaattcacaggtcttaaatgtttgggggaaatttatattggacactgctctttgtctagcaaataaaagatgttaatatattcctgttattggcatgtgcacgactgttattagaagccactttatcattttcctgctttaaatagaaatgtctatttatgaattctgcttgtagttttttcacaaataaaatagtaaaatttaaaaaaaaaaaaaagatggaaaatatatgtgtcttagagttactattgctgtgaagaaacaccatgacccaaagcaccttggagaagaaagggtttatttcattaaagttccttaaaagagttcaccatcaaaagcagtgagggcaggaactcaagtagggcaggaagctggaggcagcagctgatgcagaggttgtggaggagcctggctcactgcagcgatttctgtggctttttcagtctgctttcttatagaacccaggactgttgggagccgcgcccacattcgccgttacaagatggcgctgacagctgtgttctaagtggtaaacaaataatctgcgcatgtgccaagggtattttgtgactacttgtactctgccttccccgtgacgtcaactcggccgatgggctgcagccaatcagggagtgacacgtccgaggcgaaggataattctccttaagagggacagggtttcgttttctctctctcttgcttcttgcactcctgctcctaaagatgtaagcaataaagctttgccgcagaagattctggtctgttgcgtctttcctggccggtcgtgagaacgcgtctaataacaattggtgccgaattccgggacgagaaaaaactcgggactggcgcagggaagatccctcattccagaaccagaactgcgggtcgcggtgatagaggttcccgtaaagcagactgttaagaaggattcaactgtatgaattcagaacttttcagctggggaacgagagtaccagtgagtacagctttacgaggtaagtctggtcttgaactttctaaggaaattcaagacagtctatcagaagtaaagtggaatatgtttggccttgaattttttctggtgttaggagcccttttgttccttttcacatgttatcaagtgattaagatagggctgaaaattctagaggaaattcaggacaagctatcagaagtaaagtggggagagagagtaggaacaaagagaaaatatggtacacaaaataagtatacaggcctttccaagggtcttgaacccgaggaaaagttaaggttaggtaggaatacctggagagagattagaagaaaaagaggaaaaagggaaaagaagaaagatcaattagcggaggtctctaggaaaaggagcctgtgctcatcgctggatgggctcggggagccagctcttagtagctctgaagcaggtgaagaatcctcctctgaggaaacagactgggaggaagaagcagctcattatgagaaaaaagggtaccagccaggtaaagtgctagctaatcagttaaggaagccaaaagcggctggcgaaggccagtttgctgattggcctcagggcagtcggcttcaaggtccgccctatgcggagcccccgccctgcgtagtgcgtcagcaatgcgcagagaggcaatgcgcagagaggcagtgtgcagagaggcagtgcgcagactcattcattcccagagaggaacaaaggaaaatacaacaggcatttccggtctttgaaggagccgagggtgggcgtgtccacgctccggtagaatatttacaaattaaagaaattgccgagtcggttcgtaaatacggaaccaatgctaattttaccttggtgcagttagacaggctcgccggcatggcactaactcctgctgactggcaaacggttgtaaaagccgctctccctagtatgggcaaatatatggaatggagagcgctttggcacgaagctgcacaagcgcaggcccgagcaaacgcagctgctttgactccagagcagagagattggacttttgacttgttaacgggtcagggagcttattctgctgatcagacaaactaccattggggagcttatgcccagatttcttccacggctattagggcctggaaggcgctctctcgagcaggtgaaaccactgggcagttaacaaagataatccagggacctcaggaatccttctcagattttgtggccagaatgacagaggcagcagagcgtatttttggagagtcagagcaagctgcgcctctgatagaacagctaatctatgagcaagccacaaaggagtgccgagcggccatagccccaagaaagaacaaaggcttacaagactggctcagggtctgtcgagagcttgggggacctctcaccaatgcaggcttagcggccgccatcctccaatctcaaaaccgctccatgggcagaaataatcagaggacatgttttaattgcggaaagcctgggcattttaagaaagattgcagagctccagataaacagggagggactctcactctttgctctaagtgtggcaagggttatcatagagctgaccagtgtcgctctgtgagggatataaagggcagaattcttcccccacctgatagtcaatcaactgatgtgccaaaaaacgggtcatcgggccctcggtcccagggccctcaaagatatgggaaccggtttgtcaggacccaggaagcagtcagagaggcgacccaggaagacccacaagggtggacctgcgtgccgcctccgacttcctattaatgcctcaaatgagtattcagccggtgccggtggagcctataccatccttgcccccgggaaccatgggccttattctcggccggggttcactcaccttgcagggcttagtagtccaccctggagttatggattgtcaacattcccctgaaatacaggtcctgtgctcaagccctaagggcgttttttctattagtaaaggagataggatagctcagctgctgctcctccctgataataccagggagaaatttgcaggacctgagataaagaaaatgggctcctcaggaaatgattctgcctatttggttgtatctttaaatgatagacctaagctccgccttaagatcaacggaaaagagtttgaaggcatccttgataccggagcagataaaagtataatttctacacattggtggcccaaagcatggcccaccacagagtcatctcattcattacagggcctaggatatcaatcatgtcccactataagctccattgccttgacgtgggaatcctctgaagggcagcaagggaaattcataccttatgtgctcccactcccggttaacctctggggaagggatattatgcagcatttgggccttattttgtccaatgaaaacgccccatcgggagggtattcagctaaagcaaaaaatatcatggcaaagatgggttataaagaaggaaaagggttaggacatcaagaacagggaaggatagagcccatctcacctaatggaaaccaagacagacagggtctgggttttccttagcggccattggggcagcacgacccataccatggaaaacaggggacccagtgtgggttcctcaatggcacctatcctctgaaaaactagaagctgtgattcaactggtagaggaacaattaaaactaggccatattgagccatctacctcaccttggaatactccaatttttgtaattaagaaaaagtcaggaaagtggagactgctccatgacctcagagccattaatgagcaaatgaacttatttggcccagtacagaggggtctccctgtactttccgccttaccacgtggctggaatttaattattatagatattaaagattgtttcttttctatacctttgtgtccaagggataggcccagatttgcctttaccatcccctctattaatcacatggaacctgataagaggtatcaatggaaggtcttaccacagggaatgtccaatagtcctactatgtgtcaactttatgtacaagaagctcttttgccagtgagggaacaattcccctctttaattttgctcctttacatggatgacatcctcctgtgccataaagaccttaccatgctacaaaaagcatatccttttctacttaaaactttaagtcagtggggtttacagatagccacagaaaaggtccaaatttctgatacaggacaattcttgggctctgtggtgtccccagataagattgtgccccaaaaggtagagataagaagagatcacctccataccttaaatgattttcaaaagctgttgggagatattaattggctcagaccttttctaaagattccttccgctgagttaaggcctttgtttagtattttagaaggagatcctcatatctcctcccctaggactcttactctagctgctaaccaggccttacaaaaggtggaaaaagccttacagaatgcacaattacaacgtattgaggattcgcagcctttcagtttgtgtgtctttaagacagcacaattgccaaccgcagttttgtggcagaatgggccattgttgtggatccatccaaacgtatccccagctaaaataatagattggtatcctgatgcaattgcacagcttgcccttaaaggcctaaaagcagcaatcacccactttgggcaaagtccatatcttttaattgtaccttataccgctgcacaggttcaaaccttggcagccacatctaatgattgggcagttttagttacctccttttcaggaaaaatagataaccattatccaaaacatccaatcttacagtttgcccaaaatcaatctgttgtgtttccacaaataacagtaagaaacccacttaaaaatgggattgtggtatatactgatggatcaaaaactggcataggtgcctatgtggctaatggtaaagtggtatccaaacaatataatgaaaattcgcctcaagtggtagaatgtttagtggtcttagaagttttaaaaacctttttagaaccccttaatattgtgtcagattcctgttatgtggttaatgcagtaaatcttttagaagtggctggagtgattaagccttccagtagagttgccaatatttttcagcagatacaattagttttgttatctagaagatctcctgtttatattactcatgttagagcccattcaggcctacctggccccatggctctgggaaatgatttggcagataaggccactaaagtggtggctgctgccctatcatccccggtagaggctgcaagaaattttcataacaattttcatgtgacggctgaaacattacgcagtcgtttctccttgacaagaaaagaagcccgtgacattgttactcaatgtcaaagctgctgtgagttcttgccagttcctcatgtgggaattaacccacgtggcattcgacctctacaggtctggcaaatggatgttacacatgtttcttcctttggaaaacttcaatatctccatgtgtccattgacacatgttctggcatcatgtttgcttctccgttaaccggagaaaaagcctcacatgtgattcaacattgtcttgaggcatggagtgcttgggggaaacccagactccttaagactgataatggaccagcttatacgtctcaaaaattccagcagttctgccgtcagatggacgtgacccacctgactggacttccatacaaccctcaaggacagggtattgttgagcgtgcgcatcgcaccctcaaagcctatcttataaaacagaagaggggaattgaagagattttaccccgagcaccaagagtgtcggtgtctttggcactctttacactcaattttttaaatattgatgttcatggccatactgcggctgaacgtcattgtacagagccagataggcccaatgagatggttaaatggaaaaatgtccttgataataaatggtatggcccggatcctattttgataagatccaggggagcggtctgtgttttcccacagaatgaagacaacccattttggataccaaaaagactcacccgaaaaatccagactgaccaagggaatactaatgtccctcgtcttggtgatgtccagggcgtcaataataaagagagagcagcgttgggggataatgtcgatatttccactcccaatgacggtgatgtataatgctcaagtattctcctgcttttttacactaactaggaactgggtttagccttgattcagacagccttggctctgtctggacaggtccagacaactgacaccattaacactttgtcagcctcagtgactacagtcatagatgaacaggcctcagctaatgtcaagatacagagaggtctcatgctggttaatcaactcatagatcttgtccagatacaactagatgtattatgacaaataactcagcagggttgtgaacaaaagtttccgggattgtgtgttatttccattcagtatgttaaatttactagggcagctaaattgtcaaaaagtctttttcagtatatgttacagaattggatggctgaatttgaacagatccttcgggaattgagacttcaggtcaactccacgcgcttggacctgtccctgaccaaaggattacccaattggatctcctcagcattttccttctttaaaaaatgggtgggattaatattatttggagatacactttgctgtggattagtgttgcttctttgattggtctgtaagcttaaggcccaaactaggagagacaaggtggttattgcccaggcgcttgcaggactagaacatggagctccccctgatatatggttatctatgcttaggcaataggtcgctggccactcagctcttatatctcacgaggctagactcattgcacgggatagagtgagtgtgcttcagcagcccgagagagttgcaaggctaagcactgcaatggaaaggctctgcggcatatatgagcctattctagggagacatgtcatctttcatgaaggttcagtgtcctagttcccttcccccaggcaaaacgacacgggagcaggtcagggttgctctgggtaaaagcctgtgagcctaagagctaatactgtacatggctcctttacctacacactggggatttgacctctatctccactctcattaatatgggtggcctatttgctcttattaaaaggaaagggggagatgttgggagccgcgcccacattcgccgttacaagatggcgctgacagctgtgttctaagtggtaaacaaataatctgcgcatgtgccaagggtattttgtgactacttgtactctgccttccccgtgacgtcaactcggccgatgggctgcagccaatcagggagtgacacgtccgaggcgaaggataattctccttaagagggacagggtttcgttttctctctctcttgcttcttgcactcctgctcctaaagatgtaagcaataaagctttgccgcagaagattctggtctgttgcgtctttcctggccggtcgtgagaacgcgtctaataacacaggacctgatccttttatattaagattagatacaaatgttgagtcaaatattgatttttagtcaaataataacatcctcaaggcctttccatattggcatgtaaagccttcatagttttaaactatttcattgatgtagaattcatatatcatagaattcacctttaaaaaat

SEQ ID NO: 22121 - DNA, 1198 bp, Mus musculus
ccgagagtccccgtgctctgacttacttttacaagtataagattttaaatattctatacttgttcatccaggaaccactctcaaatgctgtgcaaaactcatttcataagttatttcctttaccggagtcccgatgtttgctctagttcattttctaatcattcctctcaaacgttctctgcaagtcaagcatgaatccggaattgccattgtgcagttattgcattgtttccaaaatgagagcacaagcatgcacctgggcctcagtttttaatcttttaagaattgtgacatcagggaacatctcgattcacagaactcactgtagtagatggagaaagaagaaagaaagtcgggtataaaagaattattatccacatcaggggcaactgaaaagcagtcacacacgaatgaaatctatacagacactgtccaggtctaaggttggaagacatgggaacaaacgatttttacacggagctgccacaggctcctgagatgtttctatcctggcctgttgcaggcagtctctgtcatggcatgctgaccccagcaggtcattttctggggagccgttccacccaactgtgcccccactcaagcccctgtgcccatagcatcctgtaggtgacctctctcctccgtgtctcagacatctcagctctctctgtctgagtcacgtcctcctctctgtccctccccagtgagaatgcatctctgctcaggcaggctctggctattttacacagactgtgagacgtcctgagccgagtagaggacagaggtccccacgagtcatcttcatcttctgagtcattgttcacactcacacggacacagcctgacaattcaccccatggctgagctcgggggacaccaacaacagagcaagcaggcttctgtgctgtcttttcacgtttttcagggggtcctgtggactggctcctgtttaaatgcccacagtaggccctttatgttcacaatgttttgtgaatttattttctgagtcagattcctcctctgaggtcggtttctcctcttgagtcaccacggccctgtcctgagccacttttctcaggcttttctgtggagaaataaacatgtttctcaaccctgagagaggtcctggcagcacatgggagtccccacagtcctgggcacctgtggcttttctgtcccctgcctgtgccttcctcag

SEQ ID NO: 22122 - DNA, 1133 bp, Mus musculus
tgtttggagctttccttctcgtattttctctagagtagaatttatgaatagatattgtttgattttggatttttattgaaatgtcttctttctgccatgtaagttgattgtgagtttttctgggcatagtagtgtatgtaggcacctatgttttttagaggttgcaggatatctgttcaggcccttctaactttgactgtctacgttgacaagtcagatgtaattctgatatatctgtctatgtatgttacttggtcttttacccatgctacttttaatattctttctttgatttttaggttttgtattttgataattatgtattaggatgggtttcttttctgtttcagtctaattggtattctagaggcttctcacacatttctaggaatctctttctttaggttgggtacttttcttctatgattattttgggaatatgttctggtccttggagcttggagtcttgtctcagttagggttcaattgctgtgatcagacaccatgaccaaggcaattcttagtttcagaggttcagttcagtattttcaaggcaggaacatgacagcatctaggcaggcatggtgcagaaggagctgagagatttacattttcctctgaaggctgctagcagaatactggcttctagacagtcagaataagggtcataaagcccacacccacagggacacacgtactccaactgggagacaccttctaatagtgccacacccttggcccagcctatacaaactatcacagagtcttaacattcttttatttctgttgctctttgatggcctttggtggaatcccagatttcctggatgttttatgctaggagttttttatatttaacatttttgactgatgtattaattacttgtattgtatatttatgcctgactgtctctcttccatctccattattctatacatgcttgttgcatctgttgatcttgttgtcttcccttagttttctgcctccagaatttcttcagtttgtgtcttctttattgcttctattttgacttccaggtcttgcccagttttatttgtttcctttacctgtttaattctattttcctgtatgtctttaagtaattatttgtttcttctttaaagacctttat

SEQ ID NO: 22123 - DNA, 1208 bp, Mus musculus
atatttcttactcaggattttctatgagatattgagtagggaaaagtttaaaaataattgcctgatttgtacatttttattctatttatatgtatttgttcacttttcccatttatatatgtattcaaaatacattccaattgcaaccccctcccctttccacattacacagtccctcatcttaactccttttcatctacccagggagagtggggaccacctgagtatcccccaaatatgacaagtcaggtctctgctactgaggtaagacaaggcagccaagttagactggagagactaacagtttggacagacagacaacaccttaagagacatccccccactctatttgttccaggacccatgtgaagactgaagcacatttactacatatatggtggggccttggcccaccctgtgtttgctcttttctggtgagtcactttctgagaatctcctagtgtacaggttagttgactcgctagatcttctaatagacttcctgttcttttgcaggccctcaatcctttcccccaactcttccaaacgactccctgagacctgtccaatgataggctgtgggtctctgcatctgtttcagtcaggggctggatggagactttcagaggacagttatgctaagctactgtctgcaagtataacaaaggatcttcactaatgtcaggattggtgcttgcccatgggatgggtttcaagttggtcagagtatcatttgtccattccctcagtctctgctccatctttgcacctgcatttcttgtagacaggaccaattttgggagcaaatgtatttcgttcatttactgtgcttaattctccactagaggtctttcctggtagcaagagggtccataactctctgccatgcatctcaactaagatcacccccatattatccttggtgacctctcattcctggtctctggcacaacctaaagattccccacccttccatacccctccccctcaagctgcagaattccattcatattcctgatcctctgaccaactcttgtctctcacaacacctgttcctggacactcgcctttccccttacttattcactctcccatccagttctctctttcttccatctgcctcctctgactgttttattccccttttgaatgagatttaacaatgctcattagggcttttcttcttgtttagcttctttggttctatg

SEQ ID NO: 22124 - DNA, 1196 bp, Mus musculus
gtggagccttcctgcctagatggctctgttgttaagccactgctgctgttctccttcaagaggttgctgcctgctgagaggcccctgagatattccagagactacaccctgtcctgcactatcctcacctgcagctgattccaggcaccaagaatggattggcaggaatgggtctcctcccctttagaagcacatttgctattaaacatttgagctttgatcaggaaccttgacttagctccattatttctcttgaccgtctagttctctttcagctccagtttgcctcccaggtgtactccttttcttgtgagctgcaggttggctcccaacatttgtgaatgttgtcaagttgaaatatcctttacatgccactgtagtctctgaatacataaaagaacacatactagagagaaaccttatcaatataaccaatgtggtaaagcctttgcatgtcctaatcatatttaaatgtatgaaagtatttatagtagatataaactatgttaatttgaatatgcttggccctaagcagtggcactattagtaggtgtgtcttgtaggaatagatgttacttttttgaaggaagtgaattactggggtggtggtgtttggagctttatccagtataaaacagccccacctattgtttgcctggaagatagtctcttcctgccagccttctcatgaagatggagaactctcagctccttctttagcatcatagctgcattcatgctgccatgcttcctgctataatggtaataaactaagtatttgaaactctaagccaggcccaattaaatatttacctttaaaacagttgccttggacacagtttgtcttctgagcaatggaaattctttctaagacagaagttagtacctctgtgtactggctagttttgtgtcaacttgacacagctggggttatcacagagaaaggagcttcagttgaggaaatgcctccatgagatcaaactgtaaggcattttctcaattagtgatcaagggggaaaggccccttgtgggtggaaccatctctgggctggtagtcttgggttctataagagagcaggctgagcaagccaggtgaggcaagccagtaaagaacatccctccatggcctctgcatcagctcctgctccctgacctgcttgagttccagtcctgacttcctttggtgatgaacagca

SEQ ID NO: 22125 - DNA, 1151 bp, Mus musculus
tttacatagaagcattcagaatgtcaacaaaacagctgcaatttttttattttgcaattacagagtggtattcacttaacagaacaacaattatcttcttataagctgcatcagaggcaactgaagatgaaaaaagaaaaacaaaaataaaaccaaaagaaaaaataacgctttttgccccatctactgcgaggatgaagaccattctcagcaatcagactgtggacattccagagaatgtcgaaatcactctgaaggggcgcacagtcattgtgaagggccccagggggactctgcggagggacttcaatcacatcaacgtggagctgagtcttcttgggaagaagaagaaaaggctccgggttgacaaatggtggggtaacagaaaggaactggccaccgtcaggaccatctgcagtcatgttcagaacatgatcaaaggtgtcacactgggcttccgatacaagatgcggtctgtgtacgctcacttccccatcaacgtcctcatccaggagaatggctctttggttgaaatccgaaatttcttgggtgaaaaatacatctgcagggttcggatgaggacaggtgtggcttgttctgtctctcaagcccagaaggatgagttaatccgtgaaggaaatgacattgaacttgtttcaaattcagctgccctgattcagcaagccacaacagttaaaaacaagtatatcaggaagtttttggatggcatctatgtgtctgagaagggaactgtgcagcaggctgacgagtgaggaggcctcagttcctggccccagaaacgagatcctgatcacaagaacaatttgggctcttttgggagaataaaagacttatatattgaaaaaaaaaaaaaaccaaaaaaaaccaaaaaaaaaagcaacctactgttcccatatataactaatttgtgctgtgctttaaattttcgtgccaatttacaaatcccagactatgccaggcaaggttagtggctattgaaaatatcaccaggacagggctatctaaagacacatttggtagtgtgttaactatacaaaaaaaaaaaaagacactgtacagtttaaaataaatcttacacagccttacatttcaattttttttctttaaaatgagtgagttgtgtacaggag

SEQ ID NO: 22126 - DNA, 1645 bp, Mus musculus
tcctcatgactgtgtcccagactaaaaattacttagaactccagttttatgggacagttacctggtacacacaaggcatagacaagactgtcagattcccctggccttaatttattaatggggccactagagggacatcaagtaagaattggattttagctgagaagcatggcagatcccaggagtcagccacaaagcccagaggcccctggtgataatgtgttggctttctttgggcaggttctgaagacagcccaccgaagcattcaagcaaccacgaaagccattcttccagaagaaggaaccggcattctaagtccaaagtcactaatggagttggaaagaaatgaaggaagctagttaatgtcagatgttccagagtgcctagacccgagaggaaaacagcatatttggaccttcctatgcagagatcataatgtacggaaagaaccgagggagcttaggggatcgtgacttgagagtgtaagtcttgtctcccatagacctggacacacactaggctgaccatggctcggggtcctttgccaactggaagagtctctaaacttcagcgtatggcctgcattctctggtagcaatacagtgtgctggaaggacaggatagctgtttattcccagctgccagcagtggctctctgctggtgtgtcttgtggatgttgtataaatgtcttcattcagatgttgacttaactaactggctaatgaactggtcgcttggttttatttttatgagtctgcctgtccatttgattgattgtttaagttcagagagtctgcttttacttcatgtttttgagttaaatagcttcaaagcttccagaatccactgctgaaattgggggagggttccttctagagaaacaaagggtggaaggagctttggtgtcccagctaagcatactcagtccccagccacatggcagatgaccccagccggagtgaagaggctggctgctggcactggagcctcggcttcagattagaactgttttgttcccttccagacactgtccagactgagtgcacaagaacgaccttgcgagcggatctgggacagtggggctccctgccagggtccttttccatgtgcttggtttttcctctgtgatgttttgcctactctgtctttctggctcatgtgaggtgctagtgggtattaattaactttcatctgtgccatgttctactaaaacattctccctgtctaccctggatccttgttttaaatatatcagttcacattaaacagctcatcaatgatctgtctttgttagaatgatgtttctttgtatcttattagtcttttaactacttggaggcaagttcatattttgcagttgaccttaggataatatgtatgtatgtgtgttctatatggtaaagaaagaaaaaagaaaaaatatattttaaaggggcttacacatatatgtcctatctgaaccttccagagtgatccacagggaatggaagtgtatgcaggggcattgtctgtcactatggtcttacttactaggttggattttctttctcagacaagtgggctgtaaaacaaacttgctacaaacaatcctgctgctcactcaccaaagcacgatgatttctgtttctttgcctccttaaagg

SEQ ID NO: 22127 - DNA, 1193 bp, Mus musculus
gaagagtgtaaaaaacccttcagcaatctttcagccctcagtagacacaaagtagttcacactggagagaaacgctacacctgtgagaaatgtggcaaagcctacagcaggagttatcacctcagtcgacacaagaaagctcatagtggacagaaatcctacaagtgcaaagaatgtggcaaaatgttttactattcttcagaccttaaaagacaccagagaattcattctgaggagaggccctatgaatgtgaagaatgtggcaaagcctttcctagtccttcagacgttactcagcatgcgagaacccataagagaatgaagcagtacacctgtgatgagtgtggagagtgctttactattcagacaacattttccaacctccgtaaaattcgtcttgagggaaaaccgtctgaatgtgagagatgtcgaaaggacttttaaaggttcttcataacttacaacacataaaagtcttcagacagcttgcctgcacgtggggaggacgtggcagatgctttatgtatcaatcagctcttgctcaaccacaaacaattcacacctgagagaacccctacacacgtgcagaaaaagaccagggcatatcaatccctcatgtctctataagcatcggggaatccattctgatgaaggagccttcagaaacaatcagcgtgacaagacctttacccgttcttcacacctcaagcatcccagagacttcatagctgcagagacactctccatgtacaaacgctgtgcctaagccttgaatgataattgaagtcttcatcaacgccaaagaaatgaccaaggtgagaacccctgcaggtgcagatgtccttgttagctgtagacatccacatcacgcagcccagcatttcctgagggactctcaactaggtatttgactcagtcagattagcctgtaggcatatttttctggagcattttcttgattgctaagtgatgtgcattagtctgttcaagggtagggagtgccattcaatggcaagtgtccttgggttatacagaaatctgggtgaaggagaatattcaagtatggagcaaacaggcatatttcctctatgactgtaggccatatctacttcccaactttcctagttaatgcgtttttcatcttgtggtgaccctcaaccataaagttattttcaatgctactgcaaaactgt

SEQ ID NO: 22128 - DNA, 1193 bp, Mus musculus; identical to SEQ ID NO: 22127

SEQ ID NO: 22129 - DNA, 1188 bp, Mus musculus
tggctggaagtgcttttctgctggttgctggggttgaaacatggcccacttgttgcctgtacactgattttgaactcagaaatctacatgcctctgttacctgatttttgggatttaaagcatatataccaccatgcctagacctaagcttttctctacttggaacttgctctgtaccagactggccttgaactcagagatctacttgcctctgtctcctaagaactatgtctcaagatctggttcaaaagtctgtcttccagcctcaagatctgtatcacaggggtgtcctctatctctggattgtagttcattccagattaaaagtccacatgaaaaaaaaaaacactggtcataataatgcctgacatgatataactatctcctgttctactgcaaaagcatacacaatatgttcagctgggtggaatcttgccctgaggtcaccactcccttagtttcatttaatattcttgccacaggatttagctccattccacttcctgatgtctctttaatacttgaaccatacattttgtatttttcctttctaagtttgcaatatttgatcaaaatgctcttcatgagaggacaaagtcactgctgggcttgcttgagactctgtttatccgtgcaaataatccaaatttcttcactttagccttaaacagactctctggacaagggaaaaaagcaggcatattcttcaccaaaatattacaagaacagtctttaggccacatactaaaattattttcctgtgaaacctcataaaccagatccccacagttcaaatatcctcagcaccatcgtcttccataatcctactaggatgacccattaaattccacttaaagcattccactggtttccaaagtccccaaatccacactgaaaaaaaaggtcaggcctttcacaccaatactcccctcctggtaccaacttcttaggttgggttttatcacctgaagaaataacatgactggcataaggttttactgctatgaacagacaccatgaccaaggcaagtcctataaaaacaacatttaattggggctggcttacaggttcagagattctgtccattatcatcaaggtcgagcatggcagtagccaggcaggcatggcacaggcaaagctgagagttctatgtcttcatccaaaggctgctagtggaagactgactt

SEQ ID NO: 22130 - DNA, 1106 bp, Mus musculus
ctgcagtatcagagaataccctgagaccagctattcatccatcttctgcttcctgactgtagaagaaacgtgaccagctgcttatgttcctgttgttttacctttctcaccatgtgctgtggttggaataagaattgccccaagggctcataggcttgaatgcttagtctgaaggtagtagcactgctggaaaaagattaaggagtgcggcgtcattagtgtaagtgtgtaactgggggtcatatttgaggtttcaaagtttcagacccagtatctccctcttttaaaaactttagtcaatacgtataattctcagctactcttcaagtaccatgtctatctgcattccaccatgctcccaagctagtttcccacaataataacttacaagcctctgaaactgtaaacacgctccaattaaatgctttttaaaatagggattgtcatggtttgatgtctcttcatagcaaccggacactgagtaagtctccatggtagacaatggaattgaactatgatccaaattaagcccttctacttgtgcttgtgtgcatatattattgccatgagaatacttactaaatcttcatgccaaatgcaagtttcaatgtgatgtttaatacgtatgaatcatgtgtgttttccctttccccattattgccctcccttttgctcccttctctgaaaagtgtttccactcttctttatttacatacctacacacatatctacattaacaaacacagatgtagagcaagcagtgtctaaaactagagaaatattagtgactgctggctgcctgccagtcacacgggtgcccctgcaacactggagcatttatctcttcaacctattggcccagaacatctgacagatttttctctgcagcagcaaatatgaaggagttatctcccttgacctggcagagtttggctgttgactttctatgttttctgcttctccacagcttgcaggtcagcatttgaggtaagggcagtttcctgtctagtggcagcttgtcacatttttaacaaacttcgtaaggaagttcttcaatgctcatcatcatctttgaaggacttgcagattctgccaagagctgggat

SEQ ID NO: 22131 - DNA, 1357 bp, Mus musculus
gaggtcaaataacttacattggtatagaattgattgatttattgatacaaatttaaggttctttacatttcaaaattctatattatgttttaaccatgttttaggtatcctacacaaacaattacagtctttaaaggctactatgtcaaactgttttggataattataataatacaagttggtagtcatttaatcaaagtcttgttagctacttctttagttatttatgaaaataagctttgtttgccctcctgtagctgttttcaaagttaaacagataaatggctagaaaaaacctacacactcagatctctttgacatataggtagtttttaaacacttcagagatctacaggctatggcatttaagatgctttaataataaacgtcttttcgtgacagcaagacacatcagcttctgacagcacccccaatctacttccaagaagatgatgggcaccaaagaacctcccactgtagtctacttcaaatatggcaaaggtagctactggttaaaaacctacctttgcctagactgcacaaagtatgtcatccaaagtgtggacaaataggacaccgggaagttgactgactaattttgcagggacaaagtatgactatccttctatatccctgcttaacaagaatcctgtcaggtattctagacttctaggctaaatatggatgcccaagtgttgcagaggaatgtgggtaactgtccaggcagctagtggtctctgttgtttctataattttggaagtttcttgctctgcatttcctgttttctcaggtaattttatccttgtcaggtctctgatgaggatgaagagagatcatgaaatttttcatctaaaatgtattgattttagagaaaaaaagacattcattagactaaaaaggaagtgatactgggatagaattttgtacagtgtataaaggttttctttgtattattcagacattgatttgtctaccaggagaatgtcgactgatgcctggactttggtgttgttatttttatggctcattccttgcatcagtgttttgtaaacatatacctctcttactttcggattgtctcaataaagaactgatggccaatagctgaggctggagaagaatgatgtcactttgggggcagagagaggctctgtgggaagaatcagttgccaggtttattctccaacatcacactgaggtggaaggaacaggtgccaggactgactgaatgaaaagtaacaggtcatgtagcagatatggactagaaaactcaggttaatttagacatgctagctgtgaggtagccagctaagccctaagataaaataaatattaatacgattctgtgtcattatt

SEQ ID NO: 22132 - DNA, 1191 bp, Mus musculus
tgaatctcatgtgacacatggactgtggtcttttatagtgttgtaattgttaaatcctttggggacctttcaagttgtagcctattttacttatgaggtgaaagttaggttggagaaagggaagggatgttacgacttaaagctttatgggtagagctagcatgttgactttgggaacatactgaatgccaagaagacccacacccatgttagcattcccagtatcctcacatagaaagaggtaattacctctaaagcttgtcctctgaccttcttgcatggacccccacacaaacataaatttctgtgcccagaaataatataaacctagatcacacttttgaaatgactttgtgttttacatggaaaagtgtaaactaatgatacaaactcagttgttagcagcatgagttctagaatcatttgaattgcaagcctcttgttggtttgttgaatttctcttgattaattaaattgatttcaggaggtctgttgattgcagttttaatcatctgtttgactgagatgctgcagtatcagataataccctgagaccaactatttatccatctcctgcttcctgactgtggaagaaacatgaccagctgcttatgttcctgatgttttaactttctcaccatgtgttgtggttggaataagaattgccccaagggctcatagaatagatttgaatgcttagtcatcaggtaataacactgctggaaaaggattaagaagtgtggcatcattggtgtaagagtgtcactgggggacatatatttgaggtttcaaaggttcagacccagtgtccccctcttttcctgactatgggtcagtatggataattctcagctacttctcaagctccatgtctacctacatgccaatgagctccctagcttgttcaccacaataataatggacaaacctcagaaactgtttacaagctccaattaagaaatataagagaaaacagtctcattcccaaaaggcagggtggatttttccatgtatgatgaaagtttgtaattgtttaaggggattttggtcaatagttgttaatggtgtttgagaggaaacaaagcaaaaatggcaagattcaagaatctcttctttttcctttctttgtctttctttcatccttctttcttttcttgcttgtcctaggggaaaagtagtggagaggggatg

SEQ ID NO: 22133 - DNA, 2184 bp, Mus musculus
tcttcggaaccatcaaagagttcatagtagagagagaccttgcaagtgttaagcatgtcaccaagccttttaaatatcgttcaaccctttcgaaacacaagaacactcatgcaagagagaaatcctaccagtgtgaagatgtggtatgatggtttgtatatgcttggctcagggagttgcagtattaggaggtgtggccttgttggagtaagtgtgtcaatgtgggtgtgggggtgggcgctaatacccttgtcctacaagccagtcttgtagcagccttcagatgaagatgtacaactcttagctcttcctgcaccatgtctgcctggatgctgccatgctcctgccttgatgataatagactaagtctttaatctgtaagcaagcctctattaagtgttgttcttacaagagttgctttggttatggtgtctgttcacagcaataaacccctaagacatatgggaagtgtgataaagcctagttaatcttgatagccttactcaacacaggatagttcataatggagtgaagtcctatgaatttttaaaatatttaatcttcttccactcttaaaacaaatctgtgctgcccagttttatgtcagcttgacaggcaaactagagctatctgaaaggacagaacttcaactgagtaaatgtttgcataagatccagctttaactgttttcttaattagtgattgatgggagggcccagcccattgtgagtgcggtcattcctgagctgggaggcctggattgtataagaaagcagattgagcagtccatagggagcaagcatccctccatgccctcctctatgtgagttctttttttttttttttttgaggcaggttttttctgtgtagccctggctgtcctggaactcactttgtagaccaggctggcctcaaactcagaaatccgcctgcctctgcctcccaagtgctgggattaaaagcgtgtgccaccacgcccggcccctatgtgagttcttgtcctggcttcctttaataatggactacaatgtgttggtgtaactcaaaccctttcctgcccaacttgcttcagtagtagtgtttcttagaagcaataggaaccccaattgactgactaaggcaacactcattctgactacaaactccatgagtgtgtggaatatggtgaaatgtttgctaacaattcagattttatccaattcaaaaggatctgcagtgaagactattaagtgaattattttggaatatcaacacaaacatcttacttctaatagcacaaatgctaagaaagtcaccagaagctgggtggtggtggtgcacacctttaatcccagcacttgggaggcagaggcaggtggatttctgagttcgaggccagcctggtctacaaagtgagttccaggacggccggggctatacagagaaaccctgtctcaaaaccctcctaccccccaaaaaaagtcaccagaggagtagagacttctctttgatgtaacctccccaccaatgtgttcaaccaatgtgcttgaatcttgcatggatggatgagtttcatccctctgtaactatatatatttcatgaaactgttgctctgttgtataacttggtcctttgggtgcctggaatctgatttgtgggctgtggtacagtttctgttgttttaaccagtggcggtgtcacccatactctttaaataacgcattccctgggtgtgtaagaagctccataaactcacattcctcaccaacttggactttatgaagatgatttacattggatctaatctaagctaactggccactagtgtttgtgtccccaggaaaagctaacagaaatcattgtcagttgtatttggcttcagaatgaagaatctcttcattttctttaaacctatagattgtttttcatatgactccaactgtcatgtcatagaacttggcagcatattgaaataataattgaaaagatgcatttgattagtatgtatatgatgtcaatcatgaaacattgtagatgcagttcttacataaataactattgatagggatcctaaaagtgatctcacagttgtgtttattcatttatgggaacacttatattagggccattaaaacctaaaagttatcagtcattaacttagaaatgatcaaatatctctaatgtgcccaaattttgtttttagt

SEQ ID NO: 22134 - DNA, 1184 bp, Mus musculus
ttgaactataggtacaataatttaacagaggctattttttttcatcaaagatttacaactagttatttatcagggccagaccattagacttaggaagagaaggatgacaggacccttcatgaatagaaccccatcaaactacacagcgagggtaatgtgatgaattaacatgacctgtgcacacatagggtcttgacagtttcaaggaaaagtttatagaaaacacaacatggtcattatgatttagatagcatgcagacttaccataatcactaagttcatggttatagcgtatgtcagaatttagctatgattttggagttatgattaagagactttagcaatgtgtctcttctatcctttttaagaatgtgcattccgttagttgttcttgttctacacagctttctaccatgaggtaaataacagcagcctctactggaaacagttcacctcttagctgttctccagtgcgtggtatctctccctggactgtcctgttgttttccgtctaaactgtcacagagttggggagacagtttaacccaggacagaggctgtgggagaaactgagtcagttacacttgagctggaggtgggtggggcatattctacctctggaactggggtttcagtgagctaaaacagcatatgacgatttataaaatcattctctgtattcagatggcattgtttctctgtaagactgaacccaggcatgtacctaagcatgacttgtttcagtgtcttcagatgtgggcaacagcctgagaaactcaatgtctattttccttttacacaggccccagtgttaaggatactatcctgattctatgagacacggatatattggctccgttatggatcagtgtctaagttttacatacaaagtatacctgtaaccttggaaagagacatttaaagagagaaacaatgaaaactagaccactgaggaactcagaaagttctagagaggaaagaagggtatcagggcttgttggagcagaaacaaagatcagcttcagccataagacagtggagtctcaaacatacacaaacttgcgtgcacacacacacacataaccctcaaaggaataaggttcgcaaaccttgtataaaggacccaacctcactttcatcttcaatctcccaaacaagcagggtagctagaggactctccccac

SEQ ID NO: 22135 - DNA, 1166 bp, Mus musculus
actctgcacaaattacttcataccggagagaaacctttcaaatgggaagaatgtggtgaggttttctatacctgctgaagacttactaaacatcaggaaattcacattggcgaaaaccctacaaaggtaaagaatgtgtcaaaactctttactgtacttcagactttaaataataccataaaaactcatactgaagagaaaccatactttaattagggcttcgttagatacaaggtacgtcctactgtagagaaactttacagatgtggagaatgtggacaaatattttaccgtacttcacaactttaacagccagcaaaagggctcattctcagaagaatcccttcaagtgtgaagtatgggacaaggtattatgtgctaccttgagctttctgtctaccagaacatgtatcctggagagaaactctgcaagtgtgaaaaatttggaaagttttttaactcattcctccctgattctgatcagacttggcaaagtttggggcgggcgttgtgtttttgttttaggataattgtgctcaggcctgttgattgtgggaggaaccaacccatctctgttgagcaaggatcctggattgtataaaaggagaaagggaactgagaagaagcgctcctctctcttcctctgccctctgactgtcgaggcaataggaacttctctttcagctcccgctgccctaaaatgtctcacgacgttcacagggtcgtgattcgaatgagaaatgttaaccctgtagtcttaagcatttgaacatttgtgccccgagttgttggctctatttggagagatttagaagtaggtcactagaggtgaactttgtgaataaagagctccctctacatccagttctctcactctgcttcctgagtaccattgaggatgtgaactctcagcttccggcttcggccaccatgcagcttattcccatgcccaccctctgtcgtgaacttcgatcccttctgtaccgcaaactgaagtaaagtcattcctccataaattgcctggtcatagtgtttaatcacaagagaaaagaaactagtaaaagcattgcccttgtaccaggaacagtactaaactgtttctactacattccgtgtgtaaggatagtttatcatagcaagagggaaagaaagtaaggctgcaagcc

SEQ ID NO: 22136 - DNA, 1163 bp, Mus musculus
ggcaaggatttccattgtccaacattactttctaaatacaggagaagtcactcaggaaaacaaaaaaacaaacctacaagtataaagtatgtatcctggccttctgtgctcaacaaaaacattagggatcatgaaagaatccattctgcagataaaccatacaactctaaagaatgtagcaaatacttcagaagttccatagcatatgctgagcacaggataattcctactgtacagaaatattacaattgtggagaatgtggcaaaaactattacttgtcttctggtcttaagcaacattcaggaattcatctgttagagaaaccacacaagtgtgaagaatgttccaaggtcttttgtacttactaagaactgtaaaacacctcagttcatacaagactgaaatgcctcatgtgaaaaatgttgcaaaccctttaatagactttcttgtatgtctcaacacaaggtactccaagctggagtgaaatagtacaaatgttaaaaatattcacagtacattaacacttcttcagacactaagttatcgaaagctttctgctgaatggaaactatgtaagattgagaaatgtggtaaataaagcctttggaatcattcacacaaccatgtcaaaaatacaaatgtcagactgtttattctctggatttgaggctgatctttccttgctgtcttttgtttcttctgtttgagaatcagaacacttctataccattgttgcaaaagtagtcacttgtttttatgttgtaatagatcacacataagagattgccttgagtctcacataacacatggactgtggtctcataatgttgtaattattaaatactatatggacctttcaagttgtaggctattttacttaggaggtgaaagtaaggttggggaaaagggaagaaatgttgtgattaaagctctgtggctaaggctagcatgagtttgggaacaaacttaaaagacaagacccatacccatgttagtattccaagtacccacaaaataggtaattacctctgcagatttttctctgacctccatgtgtgggctcccacatatacatacatacatacacccagacaaaataaacctaaattatgttttggaattatgcttgtgttttatgcagacaggggtcaagaattaatgc

SEQ ID NO: 22137 - DNA, 1162 bp, Mus musculus
taatcgcattaattcaagccttaaggctggcagaaggaagggctcttaatgtctataccgacagccggtacgcttttgccacggctcatgttcacggagcaatataccgacaccgtggactgctgacgtctgccggcaaagatatcaaaaataaagaagaaattctcagcttattagaagctgttcatttgccccgtagggtggcaattatccattgcccaggacaccagaagggaactgggcccgttgaaaagggaaatcaaatggcagaccaagaagctaaaaaagcagcccaagggccaatgactctggtggtgagaacccaacagcccgctgctgaggaaataaataaaagaaccctcacagaagaagaggggcgagattacttagctaacatacaccatctgactcatttaggaactaaaaaattactaaaattggttagtaagtccccctattacattcctggattaaaaggaattgtggaagagatagtaaaaaactgccgtgcttgtgcacttaccaacgctgggtctagcaggctccaggaaggaaaacgactgcgaggagacaggcctggagcctactgggaaactgacttcactgaggtgaaaccggctaggtatggaaataaatatctcctagtttttatagacaccttttcaggatgggtcgaagcgttccccaccaagaaagaaacggctaatgtagtggtcaagaagatacttgaagaaatccttccccgctttgggatacctaaggtaatggggtcagacaacggacctgccttcgtctcccaggtaagtcagggattggccagacaactggggacaaattggaaattacattgtgcatacagaccccagagttcaggacaggtagaaaggatgaacagaacgctaaaggagactctgactaaaatagccttagaatccggcagaagcgattggacagccgttctcccttatgccttgttcagggttcggaatacacctggaccccttggcctaactccatttgaattaatgtatggggcgcccccacccatttttatgaccgtaggggataagaatcgcccggatgtgtctttctctccttcttctagtcttttggctcgattaaaagctctcgaaatagtaagaaaagaggtctgggaacagct

SEQ ID NO: 22138 - DNA, 1291 bp, Mus musculus
ttaagatgttttcagatttccttactggtatcctatgggctcccatgtgtatttattgacctctccccctaattatccactctctcgccaggtgtcctcgttggagtgacatcgtctttaaaccccgcgtggcaatccctgacgcaccgccgtgatgcccagggaagacagggcgacctggaagtccaactacttcctcaagatcatccaacttttggatgattacccaaaatgcttcattgtgggagcagacaatgtgggctccaagcagatgcagcagatctgcatgtccctccgagggaaggccgtggtgctgatgggcaagaacaccatgatgcgcaaggccatcgggggccacctggagaacaacccagctctagagaaactgctgcctcacatccggaggaacatgggcttcgtgttcaccaaggaggacttcactgagattcgggatatactgttggccaataaggtgccagctgctgctcgggctggtgccatcgccccgtgtgaggtcactgtgccagctcagaacactggtctggggcccgagaagacctccttcttccaggctttgggcatcaccacgaaaatctccagaggcaccattgaaattctgagtgatgtgcagctgataaagactggagacaaggtgggagccagcgaggccacactgctgaacatgctgaacatctcccccttctccttcgggctgatcatccagcaggtgtttgacaacgacagcatttataacccggaagtgctcgacatcacagagcaggccctgcactctcgcttcctggagggtgtccgcaacgtggccagtgtgtgtctgcagatggggtacccgactgttgcctcggtgccacactccatcatcaatgggtacaagcgcgtcctggcattgtctgtggagactgagtacaccttcccacttgctgaaaaggtcaaggccttcctggctgatccatctgcatttgaggctgctgcccctgtggctgctgcctaccactgctgcccctgcggctgctgcagcccctgccaaagctgaagcaaaggaagagtcggaggaatcagatgaggatatgggatttggtctctttgactaatcccgccaaagcaaccaagtcagcctgcttaatttgagaaagatggaaataaaggcttacttctcttaaaaaaaaaaaaaaaaaagagtccacattccccatcagatcacttatatcctgctattctctctgttgcctcctgcccctcctgggccttggaaatggttccttttaactttcct

SEQ ID NO: 22139 - DNA, 1130 bp, Mus musculus
tgtatgaagaaagtatatacactcaacgttggggcttttcaaaaaaaattatgagatcatttgtttcataaacttagttttccacttaatcaaaatctaaatgttgatgctacaaatggaacatttcaataaaacagggaaggaatgctgtaaatgggtatttgaggtgtgtgtgtgtggggggggtggcgtagcaacagctttcttctcctccctcttgattaaaaaaaaaaaatccaatgtggtcaagtttactcactctcacggtttcctggactttagttatgtaatgttatagctgatagccttagattttttttttttttttttttttgtggatagcatgatgttggaatgaccaagtgtgacctttaccacaagtaagcttctatgggagaggatagtctatgacatgtctcctccccagctctggtagggaactttgttatctccaattctccatctcccagaggccctagtttgcctttcagctgacaaaacccaagtctgaccactgataaaccacagggctttcaaagctttgtttcttcaaatgtgtgtgttgcttcgaaggaaaaaatggaattaagaatctcaattctttgacaaatctttaaagttacttaatataaatgtgtactggtgtctatacgaagtaaataggctgcttacgttcatgctcagctaaaagatcagcaataagtacttatttctaaaataataccttactactcttcaaaaatatttagtcaattactatttgaaatactattttaaacatagatttccataatagagccagttctggaaatggctcagtcgtttctctggcatgactaagcagtcttgtgattgattacaagttggggcttatcccaaacaagagtctcctttttaaatgtgacagttttatctctgttaaggatgcttctgggtagaatcaaccagaacacttcagggttgggacacatataggaatctttctttcacatacagacaaatctcagggatttcattgggtgaagaaaattctaaccttccacgttgtgtgttcgtgtcctgacggagacagctgtagaggtgaaagaaaatttcctggccaaatcataagcatcatggacatagcagat

SEQ ID NO: 22140 - DNA, 1202 bp, Mus musculus
cttacctgtggccccacccagcacatcactacgtggaggggaaagaggcagctcccacctggcacccattgcacataggctccccaggaggacagatcatcatccacggctcacctgtgcctgggcacatcttggagagcttgtggacatactatctttcaatgaagtatattcaaaggatatttatattggtgatatttaaattaacacagacatgcaaagcattcttttgcatgtctttatttaattgtggttttattatcaaaattatatttctgataaaatattttaattttgaggtaatccttacaaaatgaaggttttcatgcaactagaaatatattttgaaatatatttgatatagtactctgccattttcatcatgttaactttcagtgtcaccatcttacagcttaggggcatttgcattcccctgacaaaggtatcatgtgtacagctcagtagtgtgccctgtccttctcatggactccattcatgtctgctcctcactaacagacttgggttttcccaatacctgactatacttttgtgattcagttcagcttaaagaacgccagttaggccgggcgtggtggcgcacgtctttaatcccagcacttgggaggcaggcagagataggcggatttctgagtttgaggccagcctggtctacagagtgagttcgaggacaaccagggctacacagagaaaccctgtctcgaaaaccaaaaacaaaaaaaaagaactccagttaagacttctaataccaaattctcttgcaagttatgaaaataaagtatataaaaggatcctgtgctattgtgtgcgtggttgctgagacaaaaactgggacaaagcaacttacagagggtattttagctcagttcaggtgtggggtccacagtgctgaggaaatcatagtggcagaaggaggaggtgactggttacatcccgtccagtcaggaaggaaaagaaaaggaaaagtgcctcgctggcttcctccttttcacacactccaatactttaatgcatggaacaggtctgcctatgtgtagtgtgggtgtccacttcagcctagtgtagaggacctctcgaagacatgcccaggggtttttttccagtgaggttgtagaccctgcaaacctaactgtaacatagccttcacaagcatgataaaccctccctgttgtgtatagtaacgg

SEQ ID NO: 22141 - DNA, 2233 bp, Mus musculus
cacctccaccgctgtctgccaagcgcagcccagcactggtcactctgcatgtttgtgtggtggccgcatccatcttacagaacagctccttgtgctcatctgtgaagccttactacatgtggatgtgcgtctgcctgcctagaagtcttcatctgtgcccagcagggcggcctaggagtgtcagggactggatgtgcggctgtgcagccgggtcagctaggtggccatttggggttctcatcgtgtctgtcacaggcagagacgccaagccctgctccgtgtcttctgacggagtgggcaggctgctgttttactgccctcatgtcttgtttgaaaatttgggactgtttttctatgtaaatattgaaaacttatgatttgtgcaataactcagatattttttatttaatttcatattttcacataagttatatttaagggaggagggaattttttttaaaacacgcttaaatcctttcccaatttgcattttctaagttgggttcctcgtgttggctggttatctgatagcatcctgacatgaacaccgtgaggagggaggggcctgtgggctttgtttttatgtcttttcttttggtcagatgcagtgaaggagccaagtcaacttgatagttctgtgaggccagtgtgtacctggcagcctggctgtcggccttgggcctttgtcctctctgaccacgagttctgacattttggtttgggtttttaaaaactagacaccaaatccagcatttaaagtgccagaagtaagaacctctaagaggagaagaggttgtcacgtcgtataaatcgtaaagaatcgtgactctgggcgtgcttcggtcattaagtgacgtggtctagagtcacgggcctggtgagtatcgttacagacaatggcacccagatttaggaatgtggagaaagggattttgttgattccattgaggaatctgcataggtatgcactcgttctgttaagagcaaatatctgaaaaggacctccgttgtccaggcacatgggggtattttaatgtatcacaggagagcacagccccagtgtgggcccaggagcggctggtgcctggcgtcagaagcatacaggtatactatgcaagtgtattctgccacaaccactgtctttgttactttttttgaacaagaatccatccattgcctgaccctgattctcaagcaccacggttgtcctggagtgcttgcagttgtaggccctctgacttctgcttctaaaacgggggtctggacctgctgcacaccacaggcaggttgcttcttgtccaccagtacagagtgtcaagccgagtgctgtgccacctgattgacatgcagcagtggaaattctgaatggatgtctgagtgacattggacacctcgccaaggacaagctctgtgtgtctgggtctgcctcctgctgccgtggtgaggctgttgactctgggaggcattccagagcagaggagcacatgggtctgcagctcatgaggattggagtcatccagaatatttaaaattatttaaattgtgaagcctgttgctaaagaatatttatgaacactggtccatagcctgtactaatttacacattagcaatattgactgtatctgcattaaggagccaccgtggggccgttcgagtgacccgcagatgtgcgttttaaagttctgtcatccacaggcacaggtatgtgtccgtctccgtcatggtgaaccagatgaattggcctggcgaccactgtggccatatgctacagtttacaaaatgataccatgtttaaattttctgtgcggacaacaatgtggacactaaaattaacatatttttatgtaaagtttttctattctttgatctttaataaactttagatgctagatacttttcctctgaagggtggggtagtttctgcattagctgcttgctggggttttatccaagcccaaggtcaaccctgtagccagggtggtgatgggtcattttgccacaacgtggggtagtgccactgtgagtatagcaggaggattgcacactgtattgtgctgtgttctgtacttaggtattccagtggctgtcacacgtaaagctcccaagtatgcggcactttcagcctgtaagtgacaggacatcggctgctaagtgacagcccagtcagtgtgtgtgtggtgggatatcgtgtcttatacgtgtcttgtgaatcaaacactatccatgccaaca

SEQ ID NO: 22142 - DNA, 1170 bp, Mus musculus
gaggtttcagagttttgatcaacagtctggaaagggaaatcagtgcctgaagtcaatgcaggtcctagcatcactttccagtagaagtgggaactgatgggatgaatgggcagctctgcgggtaaagggggtgagggtaacagttacagagccctaggtctgtgggcagcagagaagccacgtgctagcagctcacagttggtgaattacatgctgtggcaacacccagggagggccactggttcttcctgtgcgtgcgttctcacttgtgcgcgtcctccctctccccctctcccccctttttagtttatgtatatgagtgttttgcctgcttgtgtctgtgcaccagctgagatcctggtgctctggggaggttggaaaaatatgttgggtctcctggaattggagtacaaatggttaggagcctccatgtgggtgctaggagcagaacctgggtcctctgaactcctgaaccatgtctctagcaccagacctctttttctttggataaaggtgcgtcatgaagcctaatgtcacatttgggtgtttctctgcctgttgttgtgtggttcttgtgcctccgtcatgcttgctgcaggccaaggctctgtttctgctctgtttctgctctgtttccttgtgctgatgcagtgcagttgctggctgaggttgaaaacagcaccttccaacagtttacagcttgtgcttgtttcgagtggggatcccaagcctgaaggtctgcgatcttgggagtagagaaggagccagctttgcccaggtaggaactggaaggaataggaaccaggaacctaaggtcggggctgcactagccagcttggatttgcttggattacctgggacagcacttcggaagtgaaaaccattctcgcaggatgaccatctctttccttggtagctagatttggtatggagagagttggtttggcttaatagctgggatcctttattcttaagactagcccagagatccaagctccatgtccctgacttgggcattaaagacagaaactgatggaatatacaaaaaataggagaaaatctgtcgtattttcctctggtgttctgagatggtctcttgtggtccaggctggcaccaactccccattctcatgcctccacctcccaagtgctgggttatagacatggact

SEQ ID NO: 22143 - DNA, 1993 bp, Mus musculus
tttggctcgcgaaaagttctgccggagctccgccccctcagcgccacagcggagcaccagagcctcgcatcacccacaaagtcccgcctacacagcaaagaccccgcctcttcgctcgaaacagactctcgctccgccccgcctaacttgcaaccacgcccctccacagtctaacccggacagcgacagatcggacaacactccatgactctctgcgcacgcgctacgatcaggtcgtccatgcaggtgcctgagtctctgtgtaagacggggagattcacgctcagtggcgtttaaggttgatttgaggaaacacgttctctataggaataccacccttttttttgcgtgagttctcggcgggagcatgttgtgtctttcaggcatattttttgactgcctctgctaggacccagccgcggggtcctcgggatgcagccggaagtgcagcgtgcgtgcggtttggtgggtcgctgtgtgcgctccgcgtgtgcagccgcgtgggccatggggcggcgggcgcggggccggcggttccagcagccgccgcagcctgagggcgaggaagacgccagcgacggcggcagaaagcgaggccaggcggtaggcgcggggacgagaggggtgtctggtgggctcgcgcgtgcggagcttgctcgtgggccgggttcgcgggtgtcggtcggagcttgctcacctgtcgctttcctggcagggctgggaaggtggctatcccgagatcgtaaaggagaacaagctcttcgagcactactatcaggaactcaagatcgtgccagagggagaatgggaccaattcatggagtcactccgagaacctctcccagccacactgagaatcactgggtacaaaaggtacgtttgctgtgtcttttctgaggtgtggacttgggggctgtagtgcacaggaacgtcctcggtgggacattagaatatgaatagaaaacgcgacccgggaaagacttgggtcctatgggggaccatcagagcagcaggaatctttgcctctcttgcacgtcaaagtacgttgtccgcaagactcgtggcaattaaaaactgaagctgtgacaaaatgcagtattgcttttaccttatttgtaaggtgtgtccaacagaacagtgaactggagggagttagaaaattgatggtgttgctttcttagatgttaacagggcctaggtgttaaaaagtctgcacaccccggagcgcttatggaacgtcttctcagaactggttttacgtttaaaacacttggcaatcttaaagctattaaatcttaccaactcaccttcttagatgactgtgaaacttgcttttttttttttttccatagccatgccaaagagattctccattgcttgaagaacaagtactttaaggagttggaggacctggaagtagatggacagaaagttgaagttccacaaccactaagctggtgggtacagaatgcttcctcgtgctgggtgtttcttaggtccccaaccccctttaatgcacttctcagctctaaagtcactgtcggcttaaagagcttggttgtactttcctttttttttcttcttataaagatttacgtgtttattatatataagtacactgtattcagacacaccagaaggcattacaggactcattacagatggttgtgagccaccatgtggttgctgggaaggacctctgggagggagagagcagacagtactcttaactgctgagccgtgtacctagtccctggatgtatttttcaagcatctgtttgtctgttttccgagacaggatttctgggtgttctgaaacctgtagacaaggttagtctcaaactcagatccacctgcctctgctgggtggattaaatccatgtaccagcatcatctgccttattagatttatgtatgtatgtatacgagtgcagggaggctgtcttcaggcacatcagaagagggcactggatcccattaccatgtggttgct

SEQ ID NO: 22144 - DNA, 1109 bp, Mus musculus
tatcatgattgcctcagttcctgaggccctgggtgtgtgtgtgctcctcctaattacaccctggaacagttcccatagccgtcttttgttaagatgtctatcagttatgggcctgagcctaactctgtaggactcatgtgccttactcagagtggacacagggttaccaagagcaggcaggctctacaagcccctgggatgttctttgtgaagctattggagagtcagctctgaattgaacaatgcctgcagattccatttaaagagcaaatttcaaaggcaatgttttttaaaaagaatgtttatctttcaatgctttaaaaaaaataaaagtggttgacaggaacatagtagtcttaatttctttacagtggtgcgaagtgtgttgcttttgtgtgaaaatgaatttgttcccttcaacaggtccagaataaatctgcagaagccagagaacccagggtatccagccatgtggctgccacagagggaaatcccagtgaccagtctgagctggaaagtcagatgataactggagctggtgactcagaaacagctcacaacactgagaacacagagagcaatgagaagaaagatggcgtgtgtgggtgaggaagaaggtgccatctgagcagaactatctgtttgttgtcttcatagccctccttgttaagctaaatggggtcccagagccttagccatggtgactttcaggggaatgaggacacagcacaacttgtttgttatgttgtacaggttagaccgcactcacagatgcttccagctctacagaacagggttgagtgctgggcagggcaggatgagtgctgcaggtatagactgctcctgccacacttgctgaccaccttaccacctccctattctctcctcagccctcctccatcaaagaaaatgaagttgtttggatttaaagaagatccatttgtattcattcctgaagatgatcctttatttccacctattgagtaaggatcctgccatttgaatcccacttaagaaagttcattgtagcaaaacaaaagcattaccaatctcatacaattagtacttggtacttcgctctctttctcctgatcatgcgttagagctgg

SEQ ID NO: 22145 - DNA, 1287 bp, Mus musculus
gggacttcttttttggcaggaatccagacaccctccagtgccccatcgtgctgtgtgggtggcggggaaaggcctctattcgaacttttgtgcccaaaaatgagcggcttcattatctcaggatgatgggtctggaggtactgggagaaaagaagaaagagggagtcattcttaccaatgagaatgctgccagcccagagcagcctggagatgaggatgccaagcagacagcacaagacccctgcgtcccagactccgtccctggctgtgatgcagctgcagctgagccatcccggtgaaggagtcttcacacaatgaattggtaccatccgttgttggagatcaaacctagaatgtccttagccagggacctggaaatgagtggtggccacagtctgttaggagtcgcttttgcagagtggatacatgtttctgctgttaaaggctaacagcctttgcagaagttcagatcccttgttggccagtattgacctagtcttctaaaacgacagtaaaagtctacaagtctttgggaagcagctctatctatctatgctttaatactttctggactgcacaccagtgtgctgtgcagtcatgctgacactgaggtctcaggtgacttctgtgcctttgtgataaagggtgagataagccatctcagagggaaggctggtgaatcatgacagcagttttggggaccgtttgtgcttatcctggagttgttttaagtggggtggagattgcttgggtcatgaaataaagagctattatgatcatgtatcttggcatgagacttggatttgcttttagttggctaatgggagagaaaagccagccctctggtgtctcatacaggacttgaagctggactgtcagccgtgtttccctcgcccagattctcccggcagagtccttgcaggagctcttccttccctctgtctgtaatgcattttgtccgcacagttgagcatcagttacaccaatgctcttccggcctccctatatgtgctctgagctaaacaggctacctctgggaactcagctgtgccttgctcataaacgatcagtccagctggatttgatgactgtttatatgccctggggagggtcataggagcctcacctaaatgtccagctgtgccattcctcaagttgtatgtaactcttccttggggagggaccggaggatacaggccaaagaagaccagggtgggattccatctctgtggctatgggaaagctgtcatctgctggttaaagactttggcactgcctttgcagggt

SEQ ID NO: 22146 - DNA, 1097 bp, Mus musculus
ttttaaagcactccagacaaacaaaatatctgaactggtcattttgtgaatagcagcacttgtacctaactccttttactgtatcgtttcttcatctatgccagaaagtaggaaaagattatttcagcctatcttattgactgagttacagtccggggcatattatcttaaaactacattttgagagagttctaaatataaagggaggcttgaaatctgctactagttctggccagtcagatcttgtcagttatctgtttaccctgttccaatcatactgcttaagtttgcttaggggtaaatgccccaagaagattcctggagtcatggcctcatttagaaattcatagcttaatgctcatttatcacagtctccggggaatcaggatgagttacaagcagagccaggttagagtgagtgccgcacacagagaccaaaacctgaacgtgagagacaggaggacagcagtcacagcatccgactcagcactgctgcatctgtgttagacagctgtgctggcttcatgactcgttgcttccggtcgatatggccctgtgagaagggaagactttttcatttttgtaagcttgtttaagcctctatgtggtcacatacatgccatggcttaggtgtggaggctaaagaaacgtctggcttctccagcaccatgtctgcctgcgggctgccatactttccaacatgatgatttttgtttttaaaacagtgtccgattaaccacatgaagcctcaggacccaaacacaggtggacgtctgctagctcgcagaggcagaaagagaaagcccccagctgagccctcctactccactgacatcccaggaaggaaaagcccctccttgctctccactctgtcttaaacgcccttcaacccacaagccctcctctctccctcctggtttggttttgctttttaatgtttgctccgtgtcagctgattgttagctctgctcctgccctatcattgacttttttctagctcttgcgtacagaaggctcttgggttaaaggtgtgtgttagggaaaatcagtaccataacttgtttacagtacacaaagctcttggatagaagactgca

SEQ ID NO: 22147 - DNA, 1152 bp, Mus musculus
tgaggatgacgatgttgacaccaagaagcagaagactgaggaggatgcctagaccgcaaaaggaaaagtaaccttacgcaccgtgacctattcacactccacttcccgtctcagaaagtaaaagtggtcaccttcgagtagagaagcaggccccacctgcctacggccggcactgccacccacaggtggcatgagctctccaccaccccaccaaaactacaacatgaattggcaacatggcaggaaaaaagaaccagaacttcccagaccctgcttttttttttcttaaaaatatttcaaatggaaaatttgtttgtgttttttattgatattttatatttttgtacatattgttaggggtcagccacttttaatgatagcgggtgaccaaaccagccttcagagcattttttgacctacttcagactctacttgtggtgtaactatgttcattataattgcaaaggagaaaaagaaaataccttgttaaaaaaaaaaaacaaaaccaaaacaaaaccaatcttattccgagcattccagtaagtttttgtgtctgtacctagctatactataagtagttggtttgtatgagatggttaaaaaggccaaaaataaaaatattgttttcctttttttgtttatgaagttgctgtttattctattctattctattttattatattttatttggcctgtttgatgaaacaatgtccaacaataaaccggaattaaaaaaaataaaataaaataattaacgtgtgtgtgtgtgtgtgtgtgtgtgtgtgtgtgtttcactcacaactacagatagctcctgtgcaggtatgcatgtgcgacctgccaggagcgaaagcagtttagccaattacggctacagagacttacacacagaaggcagtgctatatgatgctccaagtgtagactctgctaaggtggagccatgtctgtattgattaaaatagaaccagcaggccgtgaaggaagaaggacattcatgcagattcatttgcactagaaactagtacaaggaccccctgataacacagaacatacaagatgagttgcctctatgacaaggcctcaacagtgatcagtgttatcaaggagtaatctcagtatatgggtatggtatacagggtgtagagtgggta

SEQ ID NO: 22148 - DNA, 1264 bp, Mus musculus
aggcttaccggaaggtcacgatcactgcagagagaagggctttagccagctctactgtaaagctcttgccttctttcagcagagaacggcatgatgcagatgacaggagcgcgcctcgtggtctgatgaggacagaggcaggcagctgcatttccccctataccacatgcatttcagttatgactgtatggtcacagacatatagattgtattattgtatcttggtcaaacaacaaaaacttgaacttagccctttttatttctttggctgcaaaagtgtcctttttagtggcttttaaaggttgagtggcattttttataatgatcttaaacatacaaaaacatggtttggtacctgagtcatttttagagtttatgctcaagtaaatggctaggcaaaagcaaattgtcttttaaaacaagaactaagcaagtctctcactgttgtagctggaaatggctccagaggtttaaccacagcatagtgcgcagctaccgtagtaccatagtaggacaaacttggtggaagtgtatgtgagtgtgtttcttcccatttgtaaatgtcctgaaccataaattactatcaggattaactgacagagcaagactcccatttggctgtgtagagatggccagtctgagggagcatcagagccctgtgggctgtgtgcatagggacagctctgtggggtgtgtgcatacagacagtgctatctatgatgtgtctcacattggatgatattccactttcggaatttttttatttgtatatagaaatgggtttaataactcactgtgattctgatttgtcttatattcatcatttcttaaaactcttgtatgtgtttttataataaaaaataaaagcaagccatacacactgttgtgattgttttatgtggtgcttgatgtcccatctgtagtgcggatgaagatgtgtcccagactgtggagtgtcaaatggttctgtgtagacttcgctattcagttataattgctgtctataaagtcacacctgacaatggttctggtgacttgcatctgtgtcttaagtagctttcacaaacatgagtgagtgggttgcccctttggaagttcttctttagtgcctccttctgcctatgctctgagctagtgctcaacgagcctgttaagagagagccatattctcaatgggtaagtctcttaagtcatcacccactggacctggcagtgatgggtctgtaatcacagagaaggggcacagacgtcagcatgagatcta

SEQ ID NO: 22149 - DNA, 1216 bp, Mus musculus
aaaagtatagttcagttacttaacaagtggtaatgtctctatagaaatgaattgaatcgtcttgtcataatgtatagcaaatggaaaattctgagcctgaagaaatttagaagcaagatgttttaacttcctgttctttgatggatggatccctttgataccacctgttccttctgtgttttctacctgtatacaaagtttaaaatctaacactgtgccaagccagacatggtagctcactcttacagtctcgggatttgggagattgaggcaggcgatcgagactacagaatgagacctgtctcaaacaaaagacaaattaaaaagggactaaagatggagggaaaacaggttgtgaaacattgaagatcagagccctgttggctgcctgtgccttgtaggcccctgtgaagtaaaatcactgcctcatcttagatcagttgcctcggtgagacagatgtaaaggcttttttcatccctctttcttacagattttccagaatctgagaagttgactctgttcattgccaacatgtggcgtgaagtatttctctcccagtcagccattagtgaagcgatgcagctggttgccaggcagcgtgccagaggagaagttctgaactgcttgagagctttcctgagctgggaaaaggtgcacttttgggttttggggggtttgtttctttgtttgtttcttttctgcagtacttgtaggatgagcataggtattgttatgcagcttagtatttattgtatttccttttgtcctagttcttcaacatttctaaaaaatgatatgtatttatttgcttgcttattatttattatgctgtgcctatacatgcatatgtgctcactgtacgtgtggacatcatagaacaaccattgggtctgttctgtcctcccacccatggttctggaaatcaaactgagttcatcagacttagtggcaagaacctttacctactgagccatctcaccagcttgttcttaggcactgtagagctatacttcacaacacgtgatttaaagtgtcatattatcttaagtttatgcattttatttattgagtactcatgacatcccaggaagtattgcagacctccaaaatgtatgatgttcatctgatacactaacttatgaccgatgaaatctgttggtctgtaatctacagagaaagggattgtaaattcattgatttttgcaaaaggtcctt

SEQ ID NO: 22150 - DNA, 1217 bp, Mus musculus
gagtgactgtcctagattgctgcctctcagcctaagagactgaagtgtctttgagagactatcttctgtgtgaatagcttgtcatattttcaatgatacaattctctttcagggaaagggaaataacacctaatttggacaatagaataaataaaaatggagatacaattagcctgagcttaacgtatgtacacaggtatttgcacacgtcaattcttagaacaatagagaatttatctgaatggtgaccatgtcctaataggcaagtaggtggatttacagacttgctgtggtatctatagtttgatctcaagaggttagtcatagggagttctctcacctctgctagcatgctaggcaagttgttatccgttattgtgacctaccttctggtgctatataagctttatttgtctgataaataccaatttaagattggctcttgtatcactaataattgttttatctttttcccaatctagcatttaggagaatacttacttcgctctattctctcagagctaaagattcagaagacgtctctggaccacagttacatccatgcactgtgcagagtgtatgtgggcatttgtcggcaacttggagacttggaaagagctcgcttgttctgttacagccttctgaaggaaggtgtgtgtgtgcccagggtgcagcactgctgtgtgagcacccactgctgcaggcccaccgtacacttgcttctctctcgttcagctggttgaatataaagtctcatgagtttgaagctagcatggtcttagagatcctgtcttacaaacaagttttgaactatcgtaaagattaagtaattctacatagccatactagttttcaacatactttacttagaattactgacatgggtgcatgtacttgggtttgtatagattgtttagacttaaattggcaccagcatttgtatagattgtttcctcttgcccactgtgtattttctctattcctgtgttgcacactgtggggatccttgtacaatggctgtccatattgctgtgcctttggctaaatggcagtgactgtgagatggacgttgtccctcactgatgaggaggaggtagaggagcagggctgtcaagtcatgagtattcataaacagggacagacaggaacgcggcacagtgctgcatcagggcatctgtatcagtcagccacactgctgctgcttactgatctgctca

SEQ ID NO: 22151 - DNA, 1247 bp, Mus musculus
gtaatattccactgcaggcacacgtggtgtgtgcctgtctgtgtttaggtgacacaattgtgttttcaagtatgtcattgctcatttgacttcatggatttgggtgagtgctgtacacataagttgagtgaaattacaaagattttgtgtttgtctgtttcttgtctttcctgattctaggtgaatgagaactttgccattgatttgatagcacaacagcctgtgaatgaggtggagcaccgcatcatagcctgcgatggaggcggtggtgccctgggccaccccaaggtgtacataaacttggtatgcagttaagcagcttactgtttctttgtgttcaccttccctcccagacatccgcactggctctctgggtgtcccagttaacagtcatagctcaaagttcagcctgcctggtgttttcatgggagtttctagttgacagtgtatttcaagttcaacctgattttcaatgtgctgtctaattgggattttaagctaaaaagtaagagatatttctttttgaattttttcaggacaaagaaacaaaaacggggacatgtggctactgcggcctgcagttcaagcagcaccatcactagtgtgggctgtgtcctggtcctctgactcctatggaacatctccacgctgggtgttctgtgtgaggccactgctctgtgaatggtgtcccttgttttgaataaaggatgctcccaccatggatagtgagttgtttcttcctttcataaagcaaacatgagcaggagccgcttcgctgctgaagtagcctcttctccagtgctggcgatgaagtgtgggcaccggcatcaccagcgaagggcccagcagctgccagtgagaaatcaacccactccaggtcccaacatctcatttaaaggaaaacaagccaaacgctgaaagggatacaacaaaggcttaacaatattaactgcgtctcagtacctaacagtgtgctctcgtcccagactgcaggctgatgtgggctcctccactcaaggaagcgggaaactcaaaggaggacatgccacaagactggatactcaggcacgagaaggggacaactaggctagttctgatttaaaacatgtaggatacagatgccctcttacgtctctgcaagtgagtggggatgagggtggggagaggagagatgtcagaaggcgtttgtatcccatttcccaggagagaaaacaggaaacagctaaagcgtagcaagtaaaagggaa

SEQ ID NO: 22152 - DNA, 1112 bp, Mus musculus
catttcacaatgtaagccctggggattgaactcagattgttaagcgtggccatctttacctactgagccatcctgttggctcagggccaggctattaagaattatctgactactgttggtctttgtcctgctgaccttcaggaactggtcctcctggtttccttttgctatccatcacttttttgtctgaggctttctaactgcccccaaataccactccagtgccctattgtctattgcttgtcttccttgatcctgcccctgtatctataggagactgcctgacaaacagtcttcataggaagggtgttgtagctctcagtgttcagcagtgaccagcttcatgtataaaagctggtttagaggtatttaccagggaccgtggagagagtaaagtgtatttatggatctgtggtagtttgaaaaggaatggcccccattgactcatgtgtatgaatgtgtgacccatagggagtggcactatgaggaagtgtggcctattggagtaggatgtcactgttaaggcaggctttgaggtctcttatatgcttaagttaggcctagtgtagcccgtggatcaagatgtagaactcttagctccttccccagcaccgtgtctgcctgcatgctgccatgcttcttgctatgacaataatgaactaaacctctgagactgtaagccagctcccatttaatgttttcctttataagagttgccatggttgtggtatatcttcacagcaataaaaccttaactaacatagtattcatgtgttcagtgtttgtgagaatgcatatccatggtgtgtattagtatgtgtacatgagtaactgtgtgttcagtgtgcccatgttatacatactgacttagatgtatactaatgtatacatgtttaactgtgcagtgtggtcattgtatgtgagtatgttcatatggcactgtatgtgttccatgtgtgtatgaattatgtatattggtgtgtgtgtgtgtgtgttcatgagtattgtatatatgtgtttgaatatttgtccatattgtatgtgttggtttctgtctataattgtgtagatgaacatctatgtgtatgtatatgtgttcaatatgaatgtgt

SEQ ID NO: 22153 - DNA, 1174 bp, Mus musculus
caccctgtgatttaaagttttaaattacatacattctttgctttgcatgtggactatagcctttgttttttgcttgcttgctttctttctttttctctttctcttcttcttttcctcttgcagtttcaatatctctttttcttgcttgtggcagaaagagtgtcaaaacccccaattcagccccagttcgctaagccctccacggtcaggccatactgggggtagtgctggcttcctgggacatccagatcaaccactctctctcaggtagatctgtctctgagacctagtctgtcccctgtcctgcctcctcttggtttttgttgaggactttctggagggtcaagttctcttcccagaaagaggatttgcaagagaaacttaggcctgattaaccactgacaagcaggtgctctcctctctacatggcattctagtgggacagagcgcagcatccttttcccttgcctcttccgtgcctgtgccgtggcaggaactcagtgttgcctaattctttcttacagggtcgtggacttcctgctcaaggccatcatgcgcaccatgtggtttgctggcggcttccaccgtgtagctgtgaaggggcggcaggccctgcctactgaggctgctatcctcaccttggctccacattcctcctactttgatgccatcccggtcaccatgaccatgtcctccattgtgatgaaggcagagagcagagacatcccaatctggggaagtgagtgagcacctgagagtgggtgagaccgtgggagtggatgaggctgcaggagtgggtgagacaccatctcactgacaggccctgactatgctggttttgtcactgtggttccctgtagcatgagctcctttatttatcagtactgacatgtcccccagtactgtcatgtgcagagatgcatctctgaagtcttgtcctgcaagcattcattttctgaatcttagcagttcagggtctcttgagcgtctgggcagctgctcctgagcaccagtgacccctacagatcaggaacagcggtgtcttgaggctgctggtcagatcacaaaacctgaatggcttgatgtagcacaaggcctttctgtcacatctaggaaccacaagcacagggtcaccgtgtgtgcaagggggaaaccctccagagtttccacaagg

SEQ ID NO: 22154 - DNA, 2521 bp, Mus musculus
tcccctgtggggaggacacccaccccagctccattgaagctgctttcccgaaggcttcagcaccataaccctggcaccctatacttgggccctggcttgaggaattgtcattcctgtaccagcattgggggtgacgacttttcctgaaatattcgcctttctagcagggatctctaaccagtgcctggtaatggggctctcttgggtcccaataatcagcttccttgtctttgcagatgacttctgcgggtttgcggaaatgtaccccgactacgcagaggactacttgtaccctgatcagacacatttcgacagctgtgcacagacacccccagcaccaactcccaatggcttctgcattgacttcagccctgagaactcagactttgggagaaagaattcttgtaagaaagcggactagaatggaagattccggagggatgaggcccctcccgcatcaccacctgcctccagtggcctggagcctgattgtgtgttgcgccttctacctttccctgtctctctatgtctgcaggcctgaggtccaagagacttgtgatgttatttgttttctgtaaagtctgtctcagggcccagctgggcatttgcagggaagctgtatgtgtgtcccatctgcccattgcaggcaggcaggcgggcgggcggctgctcggggcctccctgtggggcaggactccacaggctgagtgggcacaggtatggctgtgtgctcacctagaatacgctggtcttgagtttgtgtctgtctttcccctctttgtttgtgcggtgtgcacaatgcaggacctctgtgcgtgcgctgcacataccctccctggaacagtcagtcaccttgtcctaatttagtgcctctgccgtctctggctcacgtgacgggggcatcatcggattctaagtgtttctgtgtcggtgcaggaggtcgtgactcttttataaacctcacttaagtactttgaaaacattcaacctttttttaaaaaaaaaaaagaaaagaaaattggttttctacttcatttttcaccttaacgaaaggatatttatttccaggcttgcttttgatagactctgagacgtcctggtggccgcagcgtaaggggcctcactgccctgctcccattgaagtcatgggacatttagccacaaagaccggccccggggtccttttctgctttccttaagccttcttgaatctccatcttttttataaacattgccagtttggtatttcagtttcaatatgacaaagtctacttcatgtatctagtaaaagcattgaatgtgggttaaagagtcagccagagggaaagaactggaaagtgtccccttatctttgtgctgattttagccctctgagcagacatactgagaaggccaggaggtcctgcccaaagcccatcaccctctctttgcactggttgccatggtgacttagggaaagcagccaccatctgagcgtaggtggctttactctgtgggggtgacagctgaaggggacaggccacagagtttgctgtgcttggcccttcatgagatcaggaaggaacagggtccaggctgtcaccttcagcattacctggtttcctctttttttatgacaagacttatccgtaaagcacagtgactgtaggtttagtttgtttcctaagctttggaatcttgttttttactcctaagctagattttttttttttttctcatttggggcattgctataggaaatgaccaccaagccagtaaatgcaggaaagctgttttctgagtttctcagagggagtgtcagtatgtgctttccccaagagaggtcacataaacaaaacttgtcaacctcagtcacacagcgccacactgccgcgggatgggcagggagatggatttctgagctcttagctggttaggtatggatgaaatgtgaacacagcctttgtagctaacgggttggttttataactgtagagtacaaattttcagaagagaaaagccactaaaaggccaatgaaggagacagatgaactgagatgtcccgaggcttgggctctgccctgccatctgcaagtgatggattcctgaggaatggccactggtcatgttgaaggaatcctgagcagacctgggacggatgttcatcctcctgatgactctctctagtaacctcagtccgcgcatcagaactgtgaatgtacataccgggcaggggaaggggcagtgcccgccctgtctgcgggcgcctttggggtgcgggcttcaggttttcagtggaataaacatgacacgacgtaaagttttacaggctcgagtgtgttttgttaataaaagcttcacttagaaagtttgctgtcactcacgggacacgccatggtgccttgcatccggagggtcagctggttctgtagttttcctgtgtgatgcgtacgcaagtcgtaagcacatttgttagcagatccatcctttgaaacctgtgtaagaagaagtaaaacgacaggtaaatgatcacaccctccaa

SEQ ID NO: 22155 - DNA, 1132 bp, Mus musculus
ggatgttttcagaggagctgtgttctctcaaggacataaggacttgccttgctaacagtcatccatccctaccattgcaggctttaccctgtggataagagcagggtcaatgaatttggggagtcttatgaggagcagcccaagcggaagccccatccagactgagcatctcggcccaggctcccaggcggcactgtactgcacagcacagttgggccatgagtattcctgggggcttcgggaaaattcctagataccacatcttctgcgttgccaaatccctctgagcatttctcagtatccctgagcaccctctcttctcgtgtttcagaaggaaccatagcacttaaccatacaccccacatgaacttgggtcttggtgattgtgccagtgggcagtcacccaagggtagctctcagtgcatgagtgtcccatggcagccagtggacaccttagcacgcaagggtagggagcatggtggatttccacgtcagcttgtccaagtgctccttatgtggatttcacatacacaaaagtcgttctgtacggactctgggatcaaatggctctttttcccttttgtttaaaatttgattgtttaaagcctaatgtatgtatgtttctattttaaaataaatttctttggctgtaatatttttcttaacctctaataatataaaatatagaaaatattgcggatatcatacgttaaacctttctcaaggatcaatgcaaaagataggtttgtttctacattgaaagaagcaaatgggggctggagagatggctcagcggttaagagcactcagtgttctcccaaaggtcctgagttcaattccaacaaccacatggtggctcccaaccacgggcttctgtcatgagatccagcgccctcttctggtgtatctgaagacagctacagtgtgctcatacataaaataaatctttttttttttttttttttttttttctaaaaaacgaaaggagcagatgcccagtgtatttcccagctatggagccacaaatgtcctacaagctcatgttgtcatttaatggctggtcatagttgccagcattcaggctggtcatattttaggagaaatgctgtggagaggagtaggatgcaaagaa

SEQ ID NO: 22156 - DNA, 1095 bp, Mus musculus
aaaacgcgcctgttcaaatgctaggtcggtggatagaagcaatttcctcagaaagctgaaggcaccaaaggttatatttgttagcatttcagtgtttgccaaactcagctacagtagagatcacagattccctatttcccagagattcaaaattcagcagcccctctctaactatggctcagagtcgtgtcattacatatgccccaacaacaacccccacccctatcctacccccgcctcacacgtgcaagtactatcacagttgccaacctagcagagctgccatcctaaggtcgaggtcgccgctttggctgtgtgcacaggcaagcgccctcacccaatggccctggccttgctatgggtgcgtgagttgagatgatgctctggactctgaggtgaaggccactggaacagtgaaaaaagctaacgcagggcttttacctagtccccttcctttggtggtgggtgtttacggaacatatttgggatctgagtgtatggtcgcaccacaataaagccttaacctatatagtagaatttcagctgtaatcattaagaactgagattgccaccacccacctcactgtctgtgtcaaccacagcaggctggagcagtcagctcaggaacaggcaaaaccttaggtccctccgcctacctaaccttcaatacatcaaggataggcttctttgcttgcccaaacctcgccccagtctagaccacctggggattcccagctcagggcgaaaaggaagcccgagaagcattctgtagagggaaatcctgcatgagtgcgccccctttcgttactccaacacatccagcaaccactgaacttggccggggaacacacctggtcctcatgcaccagcattgtgaccatcaacggaaaagtactattgctgcgaccccgccccttccgctacaacgcttggtccgcctgaatcccgccccttcctccgttcccagcctcatctttttcgtcgtggactctcagtggcctgggtcctggctgttttctaagcacacccttgcatcttggttcccgcacgtgggaggcccatcccggccttgagcacaatgacccgcgctcctcg

SEQ ID NO: 22157 - DNA, 1124 bp, Mus musculus
actgcagcccctcagcatcctgtctcctcaggtagcagctctccttattctggacacaggctccttcctgcttagactggactttgcctgtccttgcagtttacatccagttttatgattgcctttccagacttgttggaacatgtctcttttctgctccaagaacccctttgaccttcagtttgtctgtaaaaacttaagcatgctctctgttagagttttccttggaattttattcctgtctcttcaggttcattctggctcaccaccaccaccaccccccccccaacattatacatcataggtatttggctacacgtttccttctggatactgccttagctacaccgagtgcttctgtacgtggccattttgatatcagtgattttttttgatttttgttttggagacatcgatatattccaaatgtgtgaaatattttgaattttccttggaaattgatcctcaattctgtgtagaagtctgcataataccagttattcaaaggtgctgcaaacttgtacctctgcacaggcagtttttctaaatgttcactgtatttctgaatcctgagatttttttttgtgtccactatgtcaaatatatacaggaaaagtccacgtcccttctggtcatgaaataagaagagggctactttggtttctcgctagtcggctgggcttatttcttcttactctggtggtatttacatgcaatgctgttaagtgtacgtactagttacagatttttattcattttatgtttatttgtttgagacaagattttagcgccaggcagtggtggcacacgcttttaatcccggcacttgggaggcagaggcaggcgaatttctgaattcaaggccagcctggtctacaaagtgagttccaggacagccagggctacacagagaaacctgtcttgaaaaaaagaaaaaaaaaagattttactaagcagtcctaactggccagtgacttgtttgtagatatgactgaccttgaactcgctgagagttgcttgcccatgcctcccaagtgctgagatttaagatatgagctaccacacccagctggagttttatctttctgattagagaatctttgattgccagggtattaattatg

SEQ ID NO: 22158 - DNA, 1131 bp, Mus musculus
tctggaccagacacccaggatgtactttgttaaggtggtcatttggactcctgtctatcacatttgctctcatggtctgggctctagggacctccttgaaataagcaatgctgggtgaccctgttgcagcctcttgttggtgattgggagtgttagcctgctaccctatacaggccaaaaatattatggcccccagttctctcaagatcagaaagaccccatggtgggggaggggttgataactagctcccaggacagtcttgagctctatatgggttcccttgacagtacattccaacctctctggtctccgctctgtgcgagaccctttggattctgggtcctcttcagagaagtaaagcctgactctaccaccagggcctggatgcttcagcatctgggttagccaggggcccttgtaggcctcgagggtcttcaaggctttccttgtcctagggtactcaatctggggcaatgggatagcgagaggactataggcccaccatgccccagggtcttttgtctggaacgtgggatgggaatgtgcggtagtggagtggagaagcgtggagtatcctcctgcatctctatctcctgcaggtttgctgtgggcaggttggaacccaggcaccaaggacagagccagcaggacccctgtccctggatccagccatgcttaatggtactcacatgtatcgtacaggcagatgtgaccggggcctatgatgccatcccccagggtaagctggtggaggttgttgccaatatgatcaggcactcggagagcacgtactgtatccgccagtatgcagtggtccggagagatagccaaggccaagtccacaagtcctttaggagacaggtaagaccatagtggactctcgtcgagactgtgagcatgttggtgacccgggcctgttcacgtcgtggatatctagtatctgtcagtgacactggtgtggctgtgataggtccacacttgtgtccatggtgccaatgatcatttgtctgacccagcctgcctccatctatgggaactcccaatggagagccgtccccttccaggagataacctgcaactattctcagtctctggggccacttcatgatttatgcatccagtgacctctt

SEQ ID NO: 22159 - DNA, 1207 bp, Mus musculus
cacaccatctccagtaggatctgtgtgacacgtttcacagactgaggcagttgacctcaaaaaaaggagaggcttcctagaaccggctgggttgtggaactcttcaccggagaaaaattattgagccgcagttctcatggcaatctatctgttttgttttctcttattccttttcttattctacatgttcctggtagcctaggccaagatcttgagcaagaataatgagtaagaaaccatcccttgagatgaggttactaacatgaccttatccccggggaaaccaacactttactttttaaatcatttacaaaactattatgatagataaaaacttccccaacaataaaatttcatatggctacacatgtgtcatcggaggtggattttggtatatggtaaagaaagccttaattagaattaaaatagtttaaatttatttatgcattgaagatttatcaaaaaatcaggcacttagatgttaaataataattgaccatatggggctggagagttagctcagcggttcagagcactgaccataatgatttattaaccttctcttggaactagccttggacaattgcccccactgaatacattcttttagaaatgttatatttggatgatttatattaataatgatgttacctgtactctttgtgattcactacatacatggtttcagagttgtaatgcttgggtgatttttgtgctttctgtgccaaatgatgtttgttggtatttgtgattgtttcactggatatagtttctaagagatgtaatgtttggtttttttaatgtataaaatctcctgcttgagaactgcaaaatacactcatattcaaactgcctctgtgtttgtttcttttttttttttaaagatttatttatttattatatgtaagtacactgtagctgtcttcagacactccagaagagggcgccagatctcgttacggatggttgtgagccaccatgtggttgctgggatttgaactccagaccttcggaagagcagtcaggtgctcttacccactgagccatctcaccagccccctctgtgtttgtttctgtttgtcaccaccgaatccttacccacctagcttcaaggaccttcattccaaggacccccatacccgactggggtggtccgtggcaatcttcatacattttaggaagtttctgctgcgctaggtttcgatat

SEQ ID NO: 22160 - DNA, 1198 bp, Mus musculus
gtgcctgtgggccctacagcctggatagtggcatgatgggagcaccccactgagacgtagggtcaagaatgtttgctggccagctacctttttctatgatatgatagctgtgacccctcagtaattcagctgggcctaccccactaggctgtgtatcccccattgtctctcggctacaattcccaaggcagtttcttctagcctgtccactggtctgtacaccaaagtattgtagcaggtctccatggcttgggtgggcctcaggtgcctgtgtgtgtctgtgctccagtcagttgatgcttagatggatggtctcagaagtggtcatgggggactctccagatggtgccacttggcttttgacgtcactgacatttcctggttacatttagtcttagcatccatccccctgccttagctctgtagtcagtggttctcctgagataacctaagtagaaaatgagcttagcaagtcagttgtaggtgctgagaatacatttagttactagtgtgcccttcttcttcttcttttttttgtttttgtttttgttttttcgagacagggtttctctgtgtagccctgtagtcctggaactcactttgtagatcaagctggcctcaaactcagaaatccgcctgcctctgcctcccaaatgccaccaccacccgtctgtgtgccctgctttttgacctgttagctgacagaggtaggaagctacacacgcgtatgtatgtgggtaacatgtacacacaccctgaaaagcccagagtttcccatcattcttcaggtgtgtcagggctcatctggccatccctttcctggaggggtagaaattggcctccactgtccacagtatagttgggtgtttgttaaatttgtatcttttactagaagacctgggatgctgttctagaatgttttacccatactctggagaaggaactgaacaatgaggattctgtgtttggttatagtgttctgggtggttagcataatatttatataggttaaaggttatgaaaggaaaagtattggcccaggattcccaagaccccttctcagcatgaaggagatttatctgccccacagggacaaatggtagggagtaagaaacaaaggtaggagataaaggatgatgggagaggagcaagggagaggggagggtagagggttatttgtccttgaggacaaaggact

SEQ ID NO: 22161 - DNA, 1149 bp, Mus musculus
catgggcccccacataccaagaactggaggtgagtatgccccatagccacagtgccaaggtagcagagtggagtggagaccctgatcctgccaactggttagcgctgtcttggaagcttttactcttggccttctgaggagagatctgacagggcatcactgccaaagaatgggagaatagccagaggtgggtcctggatatccaacaagccaccagcagtatggattggaggcatgctcctctacgggagtttcctctgttctaaggccaaccttagctgggacacctgaagcctcagacacaaggtcctaccggtcccatctgccccacctgtccttcttattccacctggtcttcctaggatgtctgtctacttgctctcccatctctatcccatctggctccatgagcacgggagccctgtgtgtggccattgtaactcctgtccctgcctatcctaccacaggccccaggtgttggtgatgctgaacctggactcggagcagtgtgtaaagcacccccgcctgctgtccttcacctctcagctgaaggctggcaagggcctgaccatcgtgggatctgtgctagagggcacctacttagacaagcatgtggaggcccagagggctgaagaggtaggcaggcaggtggagtgcagagtgagtgaggtccgggttgcaaccacctaagaagagctgagccacggcctgcatctcgaggcttaggggcacgatttttacacgtgccgttcctggtttctgtcagggtggctactgagtctgaaaggatcagaagtaagatttgaagagatgagatgtgtgatctcctgagacagaggggcagtgacaactgccatgggactggatccctgagggcccctgtgtctagccttggcactttgttcctggtgtctgttatagctccctgtgcaccccagcaccttctagtaggtagagattgttgggtcatgagtctgtgtgcgctgggctgtggtggcgcacacctttaatcccagtacttgggagacagagacaggcggatttctgagttggaggccagcctggtctatagagtgagttccaggacagccagggctacacagagaaaccctgtctcgaaaaaaaccaaaaccaaacaaacaaacatga

SEQ ID NO: 22162 - DNA, 1119 bp, Mus musculus
ttgtttttatctgtgatatttcttgggtacaaaaaaggccagcatctgctttaagcaatggtatgctcatgtcctttcctggtgtctcctctacactttagaggggatctctggagttaaggccaccctttggacagattcgaagggtgtgcatggactcttgtttgttatctgatgtcactggcagaacatggggaaaggtatttgtgttgaagtgagtgcctgctggggaccctctgactctggtttcaatctccattctgataagaaatgagaagagtatctgtggccgggcgtggtggtacatgcctttaatcccagcacttgggaggcagaggtaggtgaatttctgagttcgaggccagcctggtctacaaagtgagttccaggacagccagggctacacagagaaaccctgtctcaaaaatcaatcaatcaatcaatcaatcaatcaatcaatcaaacaaacaaacaaaaaccaaagagttcctgtggctatctcatgtatgtctgttagattaatttatattctgtagtgctggggtgggacccaggaccccatatgtgctagacaagtgctcactcagccactgagccacactcaaaccctggttggatgattttaatctctatttgcttttaggcagaaggttctaaagaatctgaatcaggaacatgtgttgagaaacagaagccaagtattcgcctctcctggtacccataggaaaggtttagcattggaattagtcatttttattgatcagcaaaagccagaaggagctgcccaagggtccacctgcccctcctgcctgatggagctctgccctttagtcggactatcagtagtaatattaaacgaagacagtttgggaaagccattcattttaagtgatcagagcttgtgtaagaagcttgttctgggcatttccttactatgtcagggttaatatcactttccctctactgcagcatttgcatgaaagggcttgagggtttgagtcaccctatccttccctaactaagggtcctgtcttcctcttctgtgaggtttccctgcccacagtggctttggcagatgtgccaacttcttatctggaccagattcctgcctggtcaggg

SEQ ID NO: 22163 - DNA, 2202 bp, Mus musculus
ggtatggccttaactatcaacccagacatggagttcctcgaggtcctgacggaagggctgaacagggtcctcctggtcaggggtggtggccgagaagtcatcaccatctactcctaacacctgcaacctggacacacctggatggggtcaggactgtgcaagctgcctgtggccaggctgggactcgccagcatgccactgtgatagccactgctctggcactcattgcctggcctaccaacatgttgcagtgattctggtcaccctgacacacacggcttcccacagacataacagctcctaggcttcctccaaacagaagatgctatatggcggggagtatctagagctgttctggtaggaacggctccttacattgttgtcggcaatggtaggtatacccaggagatctggggcagctcttcctattactggcagggcctcgcctcctgacactaggatcacctttctgcagatggctgtccagcattttgtggcagttatattttacttccaccagagaacagtacaaaggcgcctctgtacttttcatgaacctgacagataaaccagaactcgtgaacaagcacacagttccttgggtctagaatgtcactgagttgttccccattggcttctttgttcctttgagtatccttgctgtgctttctgtacagtaagcacactgaggactgtccaccctcacctcctcattctctcccccaccctcctcagacatggctcagggtaccactggaaagtgagatagtgtttacagggtaggagtgggtcaccattggaaccagtggtacctgacagctgtgttcccatctgagtcgatgccctaggagctcctgcagagagaacctttgttctgcagggctatctgcagctagcctgctttctcttctcatgggaactcagccactttatttcatacgcaccgagctgggaacttcaagcaggtgactacggagagccacagtgtaacaagcaaacggcaggaactctgagaattctgcacatagtccaccacagcaggcagcatccagagtgtgaaccatgatgtgtctcagcatacagctttgcacatgaaatgccgtcccatccctcaccctcctggagagaaaagccaggcccagcccaacaccctcagcctcagcagccacagccctgggtgtgtgtctttctggctgagtgtctcctgccatagatccttactcagccgggggccataggcgcctctgcacttttcaagaacctgacagatgatttgcactttacccttgggcattctgctctgtaggtcatggtttgttcacaggctgtaggcaacagcactgatccgttcctcacgttctgtatggcgtatttatttatttaaccctccccggggaagcttgatagaggtggcttctatgtggatggcccgtggtgccaggctctgggcatctccgacttcctccaagagaatcagccctgtccacattcacgacgttccagttagggtagaggccacgtttgcacctgcacaggttcttcaggctttgttaggcacccaggtaagctcgccagagtgactgctgcccagtgtgtgtccctgtcagcatagtgatttccacacctgcttttgcctcaattctgaacttggctcagactcctgagccctggatgtctagagcagagcaggtggctcgcctcgcctctcccagctgttaggaatgccctgggcagctggcctttgcaggttctgggtcgctgcttacaagagatgcctgtcaagagcgtccagcctcctttctgttgcaatctccatgttcctggtaactgtggccgttcagatcagtttcatgttttttcctttttatagacttttgtctttgtatgactttgttagtagcagagtaaagttctataaaatataaatgtttaaggaacttcgtgtgcctcatttccatagaattcagtggtggcagaagcagtacttacctattccttcccagagctgctcagaggcccacttcaagactgaccacccaagaggctagaccacccagggctctcagggtcaggggtgaccctcctgcattggagaagctctacaaaaatacaaggggaactctcgtgccaacttagatttgtcaactcagtactgccattgtagggaatcaactcagaattttctaaggatgggagccccag

SEQ ID NO: 22164 - DNA, 1105 bp, Mus musculus
tagtgtaggacaaggaccccaaatccctctggagttgtggtgagatgaaccccgtttcttgtgttgggggtgggacactttaacagcctcagatatctaggcaaacatgagagttcttgggttccgtaaggtgttgagtgtgctgtctcttagaggaaagctcagccgtcttgatctgttgatagctggccacagactcgtctgcttcttttccctcatgggcccttgtgaacttcccgcaacatttcttccagctcagttacaacaaccagtcccctcatctaaataagcacatgtatggccaatacatctcacccgctgtatcaggagaagttttaatactcgcctggtctcttcttggaccagagtaccacctctcagcagggacaatggtgagttcgtctcctttggcccaatagagtacttattagtggagttttgggcctctgatccctgctggaggctatggagttgtgaagtttctgattttagactagttgctagcagagaacacaagactctcaaatcaaatgaaggtcctcattgttcatggtacaacaaacccactgtggtggtttgaaataagaatcgtccccatcagaactatgaaagggttgtaaagattatgaagtgtggacttgttggaggaagtatgtcattgggggtgagttttgaggtttcagacgtccataccaccaggcctaggcacatgtgttctcgttctgtctgtctgtctctctttctctgtctttctttctctctctctctctcttcctatggatcaggatatagctctgagctactatttcagtacctgcctacatgggactaagcctctgaaaatataagcaagtctctccagttaagtggggtttttttgttttgttttgttttgttttttataagagtgccttggtcatggtgtctctacagcaatacaataattaagtgactaataagttgtctggatgataagaatatgaaaattcaaccaggccgtggtggcgcaagcctttaatcccagcacttgggaggcagaggcagtcggatttctgagtttgaagccagcggatttctgagttcgaggccagcctggtctacagag

SEQ ID NO: 22165 - DNA, 1282 bp, Mus musculus
tgtcctgcatagagctgagcctcttcctaattccacaaatgtatagatggtagctgtcatgtagccccactaaagcacaagtccattcagtaatggtcgtttcttttcaggcccccagcgtcaccatcgagggtttcctccaggccctatctctggcagtggacaaacagtttgaggagaaaaagaaactttcagcttatgtttgatcccagacatccatatctatggctttcaatggacaagtaggaggtgataccgtctacctcacagtgtgcatcagaaatgactctaagccatgtagatctgcaggccagacagatgggtgtacaatctttgtcaaaaggactatgtgttattttacagtgcatatctaaaggcaaaaaagactgcttgtctttttcactgtttttaaaagataattccagtctgtttgcatctatgtaaagccccatcctgactcaagcctgtcagacacaagatgttagaatttgtttaaaataaagggagatcaaaacagctgtcatagaacaagggggatgctaactaatgcagttacagcattgaaagatggattctttgctcaggctagaagggagcagttgctttctggcttgagtcggctttggttagcacaggatgctatgtgatgggtgagaaagacgtgttgctgtgatacggaaactgagaggggactgcaggtaagaagatgaagagttctttggtagtgcacaggagcagtgtgtgctttctatggtcacgtcaatcaggcaatgtgttttgtttctccagtcattttacttgtatttcaagtgaaaattcttgttacgaaatataaaataagtcaatatgtgttgcacctcacagaatatcatgttttatgtcatcttctgccaaacgtagtttggcactaatactttatacatgaatacacttttaaatggaatgctgcctttgtcacagaacgttttgtaatattaaacttgttttcagaattctcttatttttattctaacgtctgcttcaagtgctgtgagttttactaataatgactggcatactcacacagcattaagtctgctgtgctcccaggatctcatggtgcagttgcatcatggcaggaactcatccactctgccaatcaggtttgagggtggcacttctgagacactacaggccctggctcctgcctgactactaaactctacctcctgttccgagcagggcactgaaagcagaaccctgctctctgactccttggcccccgagggtacttgacttcact

SEQ ID NO: 22166 - DNA, 1238 bp, Mus musculus
aaatctaaagttaatatcataatagactaggacatcttttaattaaaacaggtatttcttgacctagaagaactcttgtaagcctccctctggagttgtgatgcttgggcagtaaaaaggtttactctggctcaggacttggagctgggaaatggggcctccattttgcactctatttcccttctgataaagtgagagtactcttagtgtttctgtttttcagaacatgttctatcataactgtctaccttctacacagtggtgagtgtgtgttctggtggtcattacttaggggctagtattagatgactgtcctctacactccctccaccctaggcagggataagtaggcttttaggaatctagtaatttgttcaacaaactaacctttactagatggctggctccatgctagcacctgaaagtcttcgaggtggcatgaaactattagtagtgcactgtggttggttggattttgccgttgaacatgcaaacttaatgtgtgcctgctattttatttctcttcatctcagctatgtttgaccgagaaaacaaggctggtgtgaacttcagtgaattcacgggtgtgtggaagtatatcacagactggcagaatgtcttccggacctacgacagggacaactctgggatgattgacaagaacgagctcaaacaagcactctcaggttttggtaattcacttgtcttgattgtatagcatatttcattttggaatataggagtccctcaagctttgttttgccatgttccatttattgatatttttaactcagtctatgtgaaatttctttttatgtcatacaggttcatattttgattctatttttgtcatgaagatgtatatgtgacatggagtctttcacacagtgtttcatccaaaatgagataagggctatgcaaatcatctactttttgtgaaatgagatggtgtcataagcaaaattgagaatgtggcttctggaacaacttaaagtagaaaaatgaaaacataattgtgtggggtagttggcagcatatatgtagtggtttgtcaaactacatgaacacagtgataaaataacagtaagacataattctataaataataaaatgatcagtccattcaaattttgcttcagtgggaaattagaaagtgtgtgtgcccattctcaaatggcatttagtatgtgtgtgtttggtgtgggcttaggcatgcaaagtgtgctgtgtttctcaca

SEQ ID NO: 22167 - DNA, 1673 bp, Mus musculus
aattacttaaaagaattaaagattttgtctcgtggtttcagaaagttaagtccattgctgtgagaactcattcaattgagcagaatgtcatgacagagacagctcttcacctggtagcaggaggctaaggcaggagaagcttgagttggtggccagcataagctgtagagagagatggggtgggaggaattaccataatttacatagccaacttgtgactcctttgtcttaaagttctcatgcctgtaaatgtacttgatggcctaattttacagaagcacagaagaaatggctgtttgtaaatattcatgccttgattcaccccgactcttttctccaaggttactttggagtacagacctgttatcgacaagaccttgaatgaggctgactgtgccaccgtacctcctgctatccgctcctactgatgaaacctgacagctacaggaccagcttatgtgattatatagcatagcttacctgcgtttcccctcatacttgtcttggtaaaattctgctctcatgaacaaggagtcacttcatagattgtgatcaacagcttggtagtacttgctgtaagggattgagttgcgccagactttgtctctttattcttgtgcagtgataaaactggcataattcttaagtgaagtacaaatgagcaatcttttatttccaaataaaaccatgtagtagtggattttagttctatctattggtctgaaacagcaaatataattttcttccgctgtctagctgcagcacaagtattgttttgttcattctctgtgtgaagtagggcaggtccttcataatttgaaggaaagtttggatatggtaagtatcgagccagtgccttgtttaggttcctggtgggtagaggtatatgcatatgtccatgtttatttgagggcgtatgtgctggctagctttgtcaacttgacaaaaatctagcatcacctaagaagagagtctcaatgaaggattgcttctgtttgcttggtccatgggcatgtctctgagggattggcttgattaatttaattgttaaggaagacagcccactgtgggcaccatcattctctggtcaaatcagtctggactgtataagagcaagctgagccttccccatgcatgcagttattcattgtctacttctcactgtgaatgtaactagtttcttcaagttcatgccctgacttccttgaaatgaaggactttaaccagcaattgtaagccaaataaaccctttctcaaagttgcttttggtcaaggtgttctatcacagcaaaagaaatgaaattcgcataggacatgcttatatggagactggagcttgacattagggttgtagggccagaaataaaagaggaaaggtgagaggaatctagccactgaaaatgacccacaagttttgtgtctgttatagaaagtagccacagaaaagttgctttttgcatgcagggaaaaaaaaagatcgtattttgtccatacagtgctcatcactactagaaaaggacgggctttggtatacacagcagcatggatgaatctcaatgctattgacaagggtaagaagtcaagaaggtacacactgattgcacttgaagtctagaaactgctaactgacatgtaataacagaagatcagtagctctatgcagatttggaaaa

SEQ ID NO: 22168 - DNA, 1167 bp, Mus musculus
taatccttactctggttttatgagctaagtacttgtaaatggtaatttctcaagatacccaggttctgtgacttgccatagtttctaatactcaacctatggttgccctcaggactaagatttgtgttagcaagaaagataaaatcagcagagaacaggcatgtagaagaatctagagggagccagatggagccaccaggggttacactgtggaatcccagggagcattgtttagtttaggggtataactagaaacacaacaaattcccaggaaagctcactggagactatcaagattttgatagagtgagatctattcatgtgacctttcacagcagttccattcccacaggaaggcaagtggtagaagtcactcatagtctgtaagcagtttaggtatggtgaatcactcttgctagttaccagcactgggaactcccagcatctagacacctattagggactagccttgtgtgaggatgcactatgaagtctgttaagtgagctttcccacatagccttattttacagaggatggggatagagagccttaatatggagaaagcaatctgtctaggtcataggtagtattttgtggagtggatctgagttgggtgtttgatttacagacattggaacctgtgtgtggttatttgtcagtagccatgcaggaagtgaacaaagtagtcagtttgtgttcagatcctatattctaccctgtgcatatctttctgtgtagagagatggcaaacttgaaaatacttacccagaaaacagttcagttatagaatggttaaggagcacttggcccgcttcctattccacatttagttttcagaactaccttgacagagctgatagcaggcactctgagcagaagccaggtaattccaccttcagataaagctcttgtccgtagctatttaccatgtctttctgctgtattaccagtcttttgagaagttatttttttctagtacatctaagaaacagttttttaagattgtgtttcctaattcattagaccattgaaggaagccacataggctctagttttctgttactccactggtttgcccatgtgatcttggacagaccacctcatggctttctctaagatttatcttttaaaatgacacattttccaggggaatcacatcactgttt

SEQ ID NO: 22169 - DNA, 1308 bp, Mus musculus
tattctcacagatccatgtacctcaatgtcatttacctgatttgtgtttacaaggcgttcctctaggaaagagggcaaggtaacaatcaataccttaagagataactttaggagcagcgccttggaggtcccgtggatctgtgtcttgcttcaacagtgtttgaacggaacagacccggggattcccactgtactcgcttccagccgcctttacaagtctctccagtcgcagcctccgggaccatctcctcgctgccttcggctcctaggaccagtctgcaccgtctcttcgcggttagctcctactccggatcagccatgacctctcagattcgtcagaattattccaccgaggtggaagctgccgtgaaccgcctggtcaacttgcacctgcgggcctcctacacctacctctctctgggcttcttttttgatcgggatgacgtggctctggagggcgtaggccacttcttccgcgaattggccgaggagaagcgcgagggcgcggagcgtctcctcgagtttcagaacgatcgcgggggccgtgcactcttccaggatgtgcagaagccatctcaagatgaatggggtaaaacccaggaggccatggaagctgccttggccatggagaagaacctgaatcaggccctcttggatctgcatgccctgggttctgcccgcgcggaccctcatctctgtgacttcctggaaagccactatctggataaggaggtgaaactcatcaagaagatgggcaaccatctgaccaacctccgcagggtggcagggccacaaccagcgcagactggcgcgccccagggatctctgggcgagtatctctttgagcgcctcactctcaagcacgactaggaggcctctgtgccttccaaggggctcccccctctgctctgcaccagcccgccctgggacctccacctgaatgaacctctcaagccactaggcagctttgtaaccgccctggagcctctgtcaagtcttggaccaagtaaaaataaagctttttgagacagcaaaaaaaacaaaaaaacaaaaaaaaaaaaaaaaaaaaaaaaagagataactttatttatttgtagctccattagagctatgctgtggaactaccaatctgtatagtctcatgatatttagaagttgcacattgaatagtgataagtatatatccaaaaccttttaataaacaaatagtccatggtaaagttggtaatactcatattcttgcagactcattgctaaatttattgagaggtcagtttatgagagtcaagattgttgttgtggaaaaac

SEQ ID NO: 22170 - DNA, 1195 bp, Mus musculus
aacagcagtaaagtggagtcaaccagagcttagagcaatacagaggtcagagctggagaagtgaccttatctctttggaggatagcagaagatcatgtgtggatccaagacattggaacaagaaactgtaacactgaggttaccttggagaccccaagatctttgagatgccagagctgtggggtacctgctcatgaaaaccagccaaagagaaagaattatgctgcagtgaacaaagcagaaaagagttggagatctgaagaatgctttaacatcagacatggagatgtagtttggagatttccaagctggcttttggttttgttttggtccagtatttcctcatgacacttaggaatggtgaaatatatcttgtgaagttggaagtatatgatctgtttttattttcttttttaggggattacagttacatgattggatgactctcagaagagactgtgacctttggacttttaacatatttgagactggtatagatgatggggacttttgaagtttgaccacatgtattttccattatgccatgtttaagaatggttcccatacattcctgtactccaacaagcttatggggccagtaagtggaatgtgggagtttgaatttgcttgtcacaaggagtggctctattaagaggtgtgaccttgttggaggaagtggatatctctgggggtggactttcaagctccaccaagtgcaaaacagaccctccaattccctccctggaagacagtttcttcctggctgcctttggatcaaaatgcagaacttacagctctttctccagcatcatgacttcttgcatgctgccatgcttcctgctatgatgaaaaatggactaaacctctgaaactgtaagccagccccaattaaaggtttgctttaatgagagttgccttggtcatgatgtctattcctagcaatggcaacactaagacagaaaccttgggagtgtatttaatatggtgaagcctttgcacaattctataggcttcatcatcatgaaagaatatgtactagagccagacagtggtggtgcatgcctttaatcccagcacttgggaggaagatgcaggtggacttctgagttctcggccagcctggtctactgagtgagttccaggacagcctgggctatatagagaaaccctgtctcaaacaaccaaaaacaaaaac

SEQ ID NO: 22171 - DNA, 1193 bp, Mus musculus
cttatgagtgtgatcaatgtggtaaagcctttgcatggcagtctagtctcaatatacataaaagaacacattctggagagaaaccttatgagtgtaatgaatgtggtaaagcctttacacatcatgctagtctccaaagtcataaaagaatacatactggagagaaaccgtatcagtgtgatcagtgtggtaaagcatttgcacatcaaacgagtctccaatgccataaaagaacacatactggagagaaaccttatgaatgcaattaatgtggtaaagcctttgcaagtcacactcatctccaagtacatgaaagaacacattttagaaaaaaaccttagaatgcaatcaatgttgtaaagactttggatgtaagaataatctccaaagacataaaggaacatatactggacagaaaccttatgaatgtaatcaaagtgataaagcctttgcaactcacagtcatctacaatgacataaaaacacagaggagagaaacctgggtattgtttactctgaagctccaccaagtgcaaaacagaccctcccattccctccctggaagacagtttcttcctgactgcctttggatcaaaatgcagaactctcagctccttctccagcatcatgtctgcctgcatgctgctgctgtgcttcctgctatgatgaaaatggactaaacctctgaaactgtaagccagccccaattaaaggtttgcttttatgagagtcgccttggtcatgatgtctattcctagcaatggaaacactaagacagaaaccttgggagtgtatttaatatggtgaagcctttgcacaattctataggcttcatcatcatgaaagaatatatactggagccagacagtggtggtgcatgcctttaatcccagcacttgggaggaagatgcaggcagacttctgagttctcggccagcctggtctacaaaatgatttccaggacagcctgggctatagagagaaaccctgtcttgaaaaaccaaaacaaaccaaaagagtatgtactggagagaaaccttttgaatgtacttactatggttaagcttcttcctacggttaagaaggaatgactttgacagaaatagttctcattctctgtctttagaacgtgagcatcacacaggagttcatgacaagctcattcttggaccctgtctacatgtgttaaatca

SEQ ID NO: 22172 - DNA, 1216 bp, Mus musculus
ctcagaatgaagaggaagtctttaagaagaccatcagagtcaactaatctgggctgtaggagaggctcagaactaagcccccatccaacgagcatacacaggatggactgaggcccccaccaaatatgtagtccatgtgctactcagtcttctctcccaacaactggattgggggatgtcccttaaggtgtcgcctgtctgtgcaaactgttcccctaacttggctgccttgtctgacctcagtaggaggggatgtgcctaaccctgcagaaacttttaaattttgccctactcaatatctcagggcataagcagaaaagaaagaattttgcccaaaatatctcacaaatgacctctaggtaaagttttcacagagtctattttccactgaaatagtgtgacctcagcttcctctggctgcatttactgtcaacactccagtcttccagatcctatgagagcaaccgttaagctccatgtacttttgccatcttttattctggtattttccatagcccttcaaaagggaacatagattctgtcgagctgcaaaatcatcttttgataccattgttgttgttgttgttctaccttattactctgttgctctgatcgaatcctctgatcaaaaccatctcaggtaataaatggtgtgttgtacatggttctgtccaatcacagaccatcatttggggagcttagaatagaacctgaagctacaaactgaaggcaaaaaacacggacaaacattgtctcatggctggctttcttgcttggtcactgtctcctgctcagctagctctcacatccagccaaggctcacttgcttaggaacattgccaccctcagtgcaagagccttcccacatcagccatcaacactatctctcatagatgtagaaaccagtcatctggtaaaggcacagcctcaattgaggctccttcagatgaccgtagctctgaagtgttgagaactgaagacaattatgatacagagataatattgaatgaggaagttgtacaaaccccaaaccaacaggctaaccatataaattactggagttcctaccaccgcatgaggaagttggagttgtggctgagccaggacaaaacagtaagtgaccctggctcagagcagggaaagatacactggactgggagttcagaggctgtgcttccctgcagtgagctgtctttaaccctgggttcccaaggca

SEQ ID NO: 22173 - DNA, 1185 bp, Mus musculus
aaacagaccctcctattccctctctggaagacagtttcttcctggctgcctttggatcaaaatgcagaactctcagctccttctccagcatcatgtctgcctgcatgctgctgtgcttcctctgaaactgtaagccagccccaattaaaggtttgcttttatgagagttgccatggtcatgatgtctattcctagcaatggaaacactaagacagaaaccttgggagtgtatttaatatagtgaaaccttttcacaattctgtaggcttcatcatcatgaaagaatatatactggagccagacagtggtggtgcatgcctttaatcccatcacttgggaggaagatgcaggcagacttctgagttctcggccagcctggtctacaaagtgatttccaggacagcctgggctatagagagaaaccctgtcttgaaaaaccaaaacaaacaaaagagtatgtcctggagagaaaccttttgaatgtacttcctatggttaggcttcttcctacggttaagaaggaatcactttgacagatacagttctcattctctgtctttagaacctgagcatcacccaggagttcatgacaagctccttcttggaccctgtctacatgtgttaaatcagaagttttgctctcagtatatgactcctagaaaaataattaaaggtggcccctgaactctatatttctgactctccagttactactaatctatctttcaagcagaggccccatatccttgagctctctgggagcagaggtgatcagaaaggtagtcaagggctctgaagcccctcaggcacacgcgaggtttcaggcaacaccagccccactctgaagcacacacacaaaatcctgttgaggattaatctaatgcctgctctctgacacagcgtttgcaacacagcaggtagaacttgccatatccacccaacaaaccccatacacatctaggaaacttctacagctcagaaactcctgttgtacctgaaattggatttcccagaatcatgccaggttcaatggtggcagtggaaaagtgaaaatattctgatcaagtattgctaaacaatgatccccatcactgcctttatacgactttcaaatacttcataacatatgtcacacaacagtgaatgtgtttgagcctatccctaacccctaaccctaaccactaa

SEQ ID NO: 22174 - DNA, 1192 bp, Mus musculus
tgcaagtatgtatcaacttgacaagggatggattgtgattgctactcttggttttcaatataagatctaaagtggaaagcataggtccaggcatggtggtacatgcccttgaaccctaggagatgagcatcaagcagatctctgagttcaagtccatcctgatacagaacaagtttcaggtgaagaaaagctaaggtctaggccggtggatacagagccttgcagatctctgagttcaaggtcagtatatagagcaagttccaggacagccaagctgaggcagtaaaggagttggagaacagaaaactggtgataatgtaatagaagaggccatgtcccaggcccagaaagcagcagagctcagcaactttgtccatgtggctctgactttagaggtaagaatagaagggactactgggaaaattgaagcttgttagctgtggatgagaaattagaagtgatgaagaagagaccagcatcattgaggtgaaattttctaggaagtgttttctgagaggacaaagaaactgtgttccagagatagccaggattgtaccttgtgttgcagctgaacttggtcacatgtaagaatcatccaggtggtactggttttgaaggcatgacggtgtcatgaggagcagctgaggcttggaccaatgaagggagcataagtgagactatcagtgaagcctagttgcaggagaagaacccaacatattgaagatgccagtccaatgggatgagcagaaagaacagcccagtagagtggagtcaaccagagcttagagtgatacagaggtcagagctagagaagtgaccttatctctttggaggactgcagaagatcatgtgtggatccaagacattggagcaagaagctgtaacactgaggttaccttccagaccccaagatctttgagatgtcagagctgtggggtacctgctcaggaaaaccagccaaagagaaagaattgtgctgcagttaacaaagcataaaaggagttggagatctaaagaatgctttaacatgacacatggagatgcagtttcaagatttccaagttgacttttggttttgttttcgtccagtaattcctcatgatgacattttggaatggtgaagtctatgttgtgaagttggaattatatgatctgcatttagatttttcttttttaggggattacagttaca

SEQ ID NO: 22175 - DNA, 1119 bp, Mus musculus
caaatctggctgataacaagggagcacatttcattctgaatgacaagactcgggtaggtgattctcattgtgtaatgaggaaaatcagtcccaagcaggctgacactgagccagctgttagccattgttaacaagtggaagctccagacagcaaacatgtgcctccttccctaagcccggccaggcctcaaggcaaagaccctgccttcattcccttctgtcagcttcagttgccttctctaccttcattattcatgaatcaaaattcaagttagatcttgtaaggttttcaatcttggtataaaaattaaacactcacaatgtttattataataaattaaattgctttaatttttaattcttaacatttcaaaaccttcattctaatcaaattgatagctcaagctattaaacataacagagacttgaaataagtgtgtgcctttctaaattgataagggtgagtaactgctttggctagtctacctgtgttcttgcagaagggcgtggtaccagaagatgctgttgaaaccttggctggaagcctggggacaagggaagcagatccagaacatgaaaaaactgtggaggataaagtcaaggtaatggcagctcaaatacttttacaaaatgacttattaatcatttacttcagccctccaatgaattagtgctttgtttttaaaaatatatctataaagcaccatcagctttctttctttaatactgcacataataagctaacccctaggaagttccaatattgatctaccatagtagagaggttacatgcctgtgtccaagttccatgaatcacattttcgtctacctgtatccatccttttctgagagattacaggaaatgtagaatgtacctaatacacctcccaacctgcccttaggccagcaagatgaaagctggcatctgagccagctaatgtttaacactgttaaacaatgttgaagtttaagctgtagagaaactcataccagtgaccatatgtttgtttgaagttaacaataggttaccttaaatttagtctctgagaaatacactgtagagaaggagacaacaaccctgagaatgatgccacttttatttaggagaaagctaaagaa

SEQ ID NO: 22176 - DNA, 1257 bp, Mus musculus
gggtggtggttgtggaggtggttttggtggccatgacaattttggtcgaggagggaacttcagtggtcgtggtggctttggtggcagccgtggtggtggtggatatggtggcagtggggatggctataatggatttggcaatgatggaagcaattttggaggtggtggaagctacaatgattttggcaattacaacaatcagtcttcaaattttggaccaaagaagggaggaaactttggaggcaggagctctgacacttatggtggtggaggccagtactttgctaaaccatggaaccaaggtggctatggaggttccagcagcagcagtagctatggcagtggcaggaggttctaattatgtacagccaggaaacaaagcttagcaggagaggagagccagagaagttacagggaagctacaggttacaagagatttgtgaactcagccaagcacagtggtggcagggtctagctgctacaaagaagacatgttttagacaatactcatgtgtgtgggcaaaaactccaggactgtatttgtgactaattgtataacaggttattttagtttctgttctgtggagggtgtaaagcgttccaacaaaaggttttactgtagacctttttcaaccatgctgttgattgctaaatgtaatagtctgatcatgacactgaataaatgtgtcttttaaaaaaaagttggtattttgctcgtgggaatgaatttgacttttgtgcaatgattttccagttactctggaaatgaaaatgagtattaaatttcactgggatgtggtaagcagtgccacttgggttctaagaggcataaagtgctgaaatcaagtggcaaaggctagcaaattcacttcaaactagaaaactggaattaaagactgacggagaaggaagtaagatggccattagggtgagaggctaaagaaggaaactctgtgtgtgtgtgtgtgtgtgtgtgtgtgtgtaccaagcacagcaaggtgtaaaaaaaggagagggaagctcatggatagctagaatcaattgcccaggaatctcatgcatttcctacctctaatgatgcatttgtttcagtttagtttctgagtttttagtatttagaattgataatagttatgttttattgccaatccctttgaaatactcttttaagatttagattttttaaattgtgtgtctgtctgtctgtctgtctctctctctctctctctctctctctctctgtgtgtgtgtgtgtgt

SEQ ID NO: 22177 - DNA, 1278 bp, Mus musculus
ttctcttttgtgaaaaaatagacagaacctcgcccccatattaaaacagagtcaggaccattccatgtattagttagggggtcctgccatttaaccatggcatatgagctggaagtgactggatgccaatgacgatccactgcagcctgacctttagcatcagtttgcaaaaaaattaaaacaaataagacagaggcaagatgtgcttttggtgaccttgaagattataagaccccctttttatttttaaagaagatattgttttaaagttcaccaataccttgtccttgagaattataaggaatcccagtaatatgggtaacgttaaattgttgacaaaacatctcaaatgcttgactgtaatagccagttccattatctgttttaatctgatttggaacatcaagcataaaaaatattgcaggagctcttcggacttgggcttgggttccggcgacatggctaaacgcaccaagaaggtcggcatcgtcggcaagtacgggacccgctatggtgcctccctccggaaaatggtgaagaaaattgaaatcagccagcacgccaagtacacttgctccttctgtggcaagaccaagatgaagagacgagccgtcggcatctggcactgtggttcctgcatgaaaacagtggccggcggggcctggacctacaacaccacctctgcagtcacagtgaagtctgccatcagaagactgaaggaactgaaagaccagtagaagccctgctgtctgagacttgcctagcctgcaataaacgggttatttacgtaaaaaaaaaaaaaaaaaaaaaaatattgcaggaaatgactaattgcagttgcaactagaaagcctggaaaggtgtcaataatcatatgtacatattttatttttctaaaatcagaaatatgagtgtccatttgcaataattgattaaatataagtcatcaagaattaacatcattatgtggaacatgtagaaattgaggacactgagaataagtttacaatttgacatgcacattctctaaaaataccaaattattatctcaagccattactatcttgatgatgtaaagagtgagattatatgtacaattattcctatgtaagacctatactctgtgtgggataaaaatatgctgtggtattgccttaagtggtctggtccaggcagtcattgataagctcttaaatgtctaaaggcagtcttttaaaggaacagtactttctcttgagttgtatatgcataaagaattgcaatttttgaaaattagca

SEQ ID NO: 22178 - DNA, 1222 bp, Mus musculus
gtctgcaccacagagcatatcaagacccaaagcttgtgcagctgtcaggaaacaaaatccgtacttggtcatctgtcctgccttcacccctaccgaatggggatcttcacttcgtaccgcaagaacaggttgacctatgtgttcggtccactattacctctcaaggggcggggctccgacttaggctcacttggtaaccttgacacccaattagcagggttctgccccaaatcggtccagccaatcgccgcaggagagccaagacgagacatgacgtcagataagattaactcgacgcgtcaccccgacgtcaacctctcctctgtcggacgtcccgtcctgagagcaaaactcctgcgactttgggccccgcccccttgaggtgaagagcagccaatgagggaggctctgtggggattcagaccaatgaacagagtccagggcggggtgcgggctcgagggtggggcggcccgcagctgtggaagcccgaggtctagctgcgcgcagtatatgacagtacgtcagcagcgggatggccgtagctgtggcggcggctgcaggagcccgagcagccgcggccgcagtggaggctggagcccgagcggcgtccgcggtggcaccccggggagtttaagatggcggcggggggggctgcgggactgcgggaggagcagcggtacgggctggcgtgcgggcggctggggcaggacaacatcaccgtgctgcatgtgaagctcaccgagacggcgatccgggcgctggagacttaccagagccacaaggtgagcggccggccgggcagcgctcggggaggcggcggccactgatctttctgccgggcgcctggcgccgcgccggtggggcgctggctcccgctgctgcctccgcacccgccgaagggaacgaggccagccgcgggcgccgacgccgcggtccggggcctctggatcgagggcgcgggcgggcggccccttgtggcggggtcggcctggccggggctgcgcggccgctgcgggactttccgacagccgcccgcggggtttctggcttgtttggtccggaggaggaaccgggtcctttgggagagaagtgtggcgatcgccttaccctcggagggggcgcacggagctaccagtaaagaagcgagggtcggaggccgcgagcggtcagagttttctgggaaacgcggagggatggctgagtcgctgagcgaggggcagc

SEQ ID NO: 22179 - DNA, 1149 bp, Mus musculus
tgttattgctgagcccataaatttggtcttttttttttttttttaaattctgagctgcacactgaatgtagggcctcacatatgctaggcacgcactctttctaccactgaactagagccccagccccttttggaaaaggaatcttgtgtattccaggctggcctacaaactactgtatctatgaggatagccttgagcttctgaccctcttgcttccacctaccaagtgctaggattgcaggccctgcagccctgccaactgtttgaagtagtgttgggtgtttaacacaaggcttcctatgttagttaggcagatgctatgccaccagtggagctgtattccagcagctcacctgcctcttctgctgtttgtccttttgtgacagaaccttactgagttactaggactggccttgaactccctatgttgttcaagcaggtcttaattgttactcttttccttcaaccttttataaaaaaaatgtttgccaaaatgatcaaaggtagccaggcagttgtggcacacacctttaatcccagcacttgggaggcagaggcagatggatctctgagtgcaaggccagcctggtttatagatcaagttccaggtcagctagggctacacagagaaaccctgactctcaaaacaaaacaaaaaagctcaaaaaacaaacttcaaaagtggttgactccaatattgtgctttcccaagtataacatgaaagttgagcatgcagccgggcgtggtggcacacgcctttaatcccagcactcgggaggcagaggcaggcagatttttgagtttgaggccagcctggtctacaaagtgagctccaggacagccagggctacacagagaaaccctgtctcgaaaaaccaaaaaaaaaaaaaaaaaaaaaaaaaaaaaaaagaaagttgagcatggttatgtctgggagcacagttgttcattttccatccctgaggatcaggcagccactgccttttttttttttttaaagatttatttatttatttattatatgtaagtacactgtagctgtcttcagacactccagaagagggcatcagatcttgttatggatggttgtgagccaccatgtggttgctgggatttgaactccggacctttggaagagcagtcgggt

SEQ ID NO: 22180 - DNA, 1148 bp, Mus musculus
atatttaagtactgtaagtaatgcaggacagaattaaaattatttttacctttcatcaaagaatcaccaatgaaaaattttctattctcttgtttgtatcactaattattgtccatgtgtagctaaatgccaaaagcacatctatttattttaagaaatgatcctattaaaaattcctactccatattgtaggcaacttcattagaatacttctgtatgtttctaaagaaactctaaagagtaaaaattgaaacaaaatgacctatttttttctagaaaaaaaagttacataaattgggttatagaagcttcaatgctcattatcttacagcacatagatttgtaatcatgtcttttccactggactttagggaaaagagtgcaaattcgtaaagctcctcaagccatctcggacacagtgcctgagaggaaaaggtcaacgcccatgaaccctgcaaatacaattcgaaagatgcatagtggcaacagtgtctctcagaggccatacagggacagggtcatccatttactggcactaaaagcctacaagaaacctgagctgcttgctcgactgcagaaagatggtgtcaatcaaaaagacaagaactccttgggagcaattctgcaacaggtgaggacaactcagagaatgtctgagtaccttctgatgaggttcagttgagcacttgttgatgggctgtggacataggttagctgatacagtacttccctggtgtgcttgaaaaccctgggtttgatccctagtacctcataaatagaacatgcctgcaatagcactcccgagatggagaaatgcgaatccccacaagttcaggattctccttagctacagagtaagttatagcctctgtgggctcctttcttaaaaacaacaaatcctctgcctgttcttgttaatattgtcactactttttagataggcaatcttcatgtagaaatataatttttgaatattattaaattaaaacatcttggttgttttgtttttaagatggggcttggtgatcctcttgccttagactcctgagtgctgatagtgttgctatgtgccactatgccatctaacagtttcattaaaaactggttgaaatgtgagcatttttctcatttggctaaaaccatttttc

SEQ ID NO: 22181 - DNA, 1151 bp, Mus musculus
ttataccaaccagtacagctattttctaaaactaagaagaacatttccaaaactcagaacttaacttacctcataagaaaaccgaaaggagactccatgttgagtctttgaataattctcatttaaccacaaaaatttttgtatgctaaaatatttctgttacttgtggttgggagttatctcatttttgtgcgtctttattctgttacctcattaaaaaccaactgcaaagtcctaaaaatctgttaaaaatagttttttcttaaaataccagtatcaaactgcaacacaattgttggcttcgttgtagttttccttaacaaagttattaaataaaataccaagtgtcagagtcttagaaagtgtgataagtatattacacaatggattaaaccagagtttcaaggttgccttagtctttacctttttttttccaaaaaaaaaaaaatgtatattgattttattcatttgataatgaactgtcttaaaattttttaaacattcatagtgtcccatgctagagcaacccgtggccctgaaccattgcctggcctctgtctgtaggctgctggcactgaagtgggtcgcacagtaagaaaaaaaagtagaagaaaaagaaaaattttaaacaaactgacaataacttatatacacttattcccaggaacctgagtcaccctcagggctccctctgatgtgcagtaagatagcatgtctgcagaggactgctccctgtggctggcaggggtcctcttgcagctgagaccagctgggtaacttaaatcagcgcagtgctactgtctccgtcacgcttagaaaacccaacctcgatactgtggaactcagcagaaatgagaatactactgaggacgctcagtttgcacactagtcacttttcccacttgcccactttcccagcaaggcatttgtggtaaagcaacttatataaaactggtatgattatataaagccatccggagaggcccaagttccaagatgttggcaccgtaaggatcaagtgtgcaccttagaatgcattctacagctccccccagctgcctgatgtcagttttaacccaaaataatcaagaaaatagatcttcaatggcaggaaaacaaaacaaaaaggaaagctgactgtgaactaatga

SEQ ID NO: 22182 - DNA, 1698 bp, Mus musculus
tcattagcgatgattttttttttttttagatatcggggatgcaaagtccatacagatgcaaagaattgcgtgtgtttaaaacaagacaaaacagtaatgtgcaaggtgaaaagcttttggataaacaaaagcctattttctgacctttcttaatgtaaactctttgccttaaatggtagaatatttagacatttgcacaaagtacaaaaaatcaaaacattgtttttggagggttgaaaaatagaaagtgaatgtgtatagttttctatacacatacatacatacatacatacatacatacatacatacatacatacatgcatacatacatacatacatacatacatacatacatacatacgggctgtctggctctagagtgttaaatctgccctaaaagttaaacccccattgcaatggctgccttaaggtgtttgctagttgtgtacatcatgtggttaaccagtagctacactgcttcccagtgataacagccccagcccgggaagcacactgtggcctaccagcatcagaacctgtgtgttctgcttgtctgtctgcagagctgctgtggatgtgagctgtgtgaaggttaaaaagctgctactctcagtaggccggacactcaggttaaagagctgacgagtgttgcagtagcttgttggtgtgtgtttgcttggtttttgtttgtttctgtcaaattgctacttctattgtggaagacaaaagcatttccatttcaacagtttgtcagctttattaatgttgggcaaaaaatgatatgttatgaaaatgaaacagatcttatagttttggggcaaaatgacaaaaataaatgtgtaggtaacctatttatatactgctataaagtattttttgaagaaagatatgcaaagaagctattacctacatcagatgtatatttaaattttttttcatcctggatcccaggaatataaaaagagtagatatatttaaccataacatactgtgactcatcaaatagcacaaactttcatttcatggagtttatctgttaacgttgatttaaactatcacttgtcttatcatgtgggaacataagttatgtggtcaaaatataaagattttgaactaaagttgattcaggttgtcttgtattgtctcaaagtgctgccagttgaaaagggaagcattatgtttacaaatctgttttgaaatgtttgccaaaattttggtagtatctttaataaagatgtttgtcttcagcatccaaaaataagtgaataattttgacgtgtatcactgtaaagtagaaaatgttagtactgaggccttgtggcagtatatgttgattaactttcttgtggagttttcctgaaatgtcaactggaaagactgggtaatggatccaaagcacagaggcagccaagcactgaagccaagattcctctgacgctacaactctggtatcactgcacacattccatctctgcatggccttctggagacttccatttcagttttgagatccctggtgctcttttaccttgatagtgctacagtcattattaagtagaagtttatctcaatcttttgagtttaaaaagaagaaaagaagcttagttatggctaaattggggcctcacattatcatcgtagatctcttgacataatgacttcaggagtacactctgaagtgttggcctttcactgaga

SEQ ID NO: 22183 - DNA, 1201 bp, Mus musculus
gattatccattcttcatgtgccaacatgtctctacctctaagcccaggttttccaaatccagttgctctaaatctccagtggatctgttgctggttttctgctactgttcgtcagctgaagtcattttgcagaagtccactttctaaagaattattgaatcaatggatatcgaaaatttgtttcctgagtcatgcatcggctcctctctccctcgtgcacgcacccttcccactcctgcattcactgcccttacttagccagtgttctcagcctcaacctcctacaacccgcagacgtccacactggtgtgaggatgctgtttgaaaaatcagatgaactttagcatagttggtcctcacggaggccacgttaacttaggcggcagagcagatggtgcatgcagctccctctgtaaaggtgattaattgtccagaaaatcccaagcagctgtgtgttgatccgagttagagggccagaaaaatcaaatgtgaaatacaaaattgcaaaattctccttccaagaatttttgtgaaagacgttgtttctgaaacattgtcctaaacagtttcttccatccaaactttgacattttgctttgatgtcttgctatgctgtttaattctcatggatctgtagatcacttctctggtctccagtgaggaggattcattactattaaagatgtatctatagataactaatgacttttgtccggttctgtgctgtgctctcaaggcaataagggacagtagtcttggtgcttttgggcagtcaacgcagggtaaaggcacttgcccctcagctttccgatctgagttcaatccctggggcccatgtagtgtatgtaaggtgagaaccaatacatgcatatgtacacacatataaataactgttattttttttaatttgttttgaaattatgtgtagttatgtgtttctgtgtgtggttatatgcatgttagtacagctctcttgtaagccagaggagtcaagacttcccagagctggaaatagaggcagttattagctgtcggacaagggtgctgggaactgaaactgggtcctctgtaggcactcttaacatggagcatttctctagcccgtggccaacatgtctctacctctaagcccaggttttccaaatccagttgctctaaatctccagtggatctgttgctggttttctgctactgttcgtca

SEQ ID NO: 22184 - DNA, 1107 bp, Mus musculus
tcattgctacttcatagcttaatttttctactgttatgactttcatatgcaaagtatttgatatatgactaccaatgggtagcaacccacaggttggtaaaacactgctcaagagtaactgactgctgcttcttcttcttcgggaaaacaccaaatggcggatgacgccggtgcagcgggagggcccggaggacccgggggcccaggattaggaggccgcggcggcttccgcacaggattcggcagcggtcttaggggccgtggtcgtggccgaggccatggccgtggtcgaggccgcggggctcgtggaggtaaagctgaagacaaggagtggatccccgtcaccaagctgggccgcctggttaaggacatgaagatcaagtccttggaggagatctacctgttctccctgcccattaaggagtctgagatcattgatttcttcctgggtgcgtccctaaaggatgaggttctgaaaatcatgccagtgcagaagcagactcgggctggccagcggaccaggttcaaggcttttgtcgctattggggactacaatggtcacgttggtcttggtgttaagtgctccaaggaggttgctactgccatccgaggggccatcatcttggcaagctttccatagtccctgtgcggagaggctactgggggaacaagattggcaagccccacactgttccatgcaaggtgacaggccgctgtggctctgtgctggtgcgtctcatccctgcccccagaggcactggcattgtctctgctcctgtgcccaagaagctcctgatgatggccggtatagatgactgctacacttcagccagaggctgcactgccaccctgggcaactttgctaaggccacctttgatgccatctccaagacttacagctacctgacccccgacctctggaaagagactgtcttcaccaagtctccttatcaggaattcacggatcatcttgtgaaaacccacaccagagtctctgttcagaggacccaggctccagctgtggctaccacataagggtttttatatgagaaaaataaaagaattaagtctgctgaaaaaaaaaaaaaagagtaactgactgcatac

SEQ ID NO: 22185 - DNA, 1115 bp, Mus musculus
catttccaatgctataccaaaagtcccccatagccacccacccccactcccctacccacccactccccttttttggccctggcgttcccctgtactggggcatataaagtttgcgtgtccaatgggcctctctttccagtgatggccgcctaggccatcttttgatacatatgcagctagagacaagagctctggggtactggttacagcaagtgttcttaactgttgggccatctctccagccccaaaatgcataatgttttgttacgaaaatttcctttccagatgaacattcagaacacttcttaaataaaaatgtaaatgaagtatgagcacatccatattataaacacagtgtaagttctaacaacaaaatatgaattctcttattaaaataactatggttagggctgggaagatagctcagtagttaagagatgttctgctcttccagaggccttggttcaattgccagcatccctagagttctgacactctgttctggcctgtgcaggtacttgcatatatacatatgaaaagtaaaaattaaaaaatactggatagtgttggggtttggcgactgtatgtgcgatggatcagggaaatgcttgctggcaggagtctgatatggtctcctgagaggctctgccagagcctgacaaatacagaggtggatgctcccagccgaccattggactgagcgcaaggtcctcgatggaggagttaaagaagggactgaaggagctgaggggggttgcagccccagtcgggggagcaacagtgtcaaagggccagaccccacccccatcccagctcccggggactggatcaccaaccaaagagtacacatggagggatccatggctccagcagcataagtggcagaggatgactttgttggacatcagtggacgaagtggcccttgggcctgagggggttcaatgccaaactgtagggaactgccaaaacaggaaggcaggaactagtgggtgggtgggtaggagatatttgaaatgtaagtaaatatccaataaaggggaaaacaacaacaaaatactggatagtcatattgtacatcaagattcattttattttctatgccatatagaaaata

SEQ ID NO: 22186 - DNA, 1149 bp, Mus musculus
atactttttaatccctgtacgttaagaaagaaatacacagaaagaatataatttcttaatagttttcaacataatgcccagaacagtagctgatagctcaggattcatcaaacaaacacagtgcagccagcaagacggagcagtaaagtgcatgtcaccaagcacatggaggaaggaaagaacgacctcccagagttgtcctctgacctcagccctgatactatggctcatgtgtgcatatagatgagcatacatatagctaaccactagggttcataatatattgctgtagttgtgaacaaaccacagggagcttagagagcgagtgactgggtgtggaggagcagaaaatgtaaatgttgcttttgtttcctcagaggcaagatgtaaatgtagtttttatttgctagatgttgtctcaaaggcttattgctgaatatgcttaccctttctacctctttctgaattctggccggctggatcaactcagttgttctagatcaagttcctctccgagctggctgattcaatctggcttctctcagattctcactgaattgttcttgcttggcctcaagctaactctagaattctagaattctgttctaatcttatggctccttctcattccctggctcattctgtcttcaccagcaacctgtctgtataaaactgtcctggtaaaactgttctcgttctctctctctctctctctctctctctctctctctctctctctctctctctctctctctctgtgtgtgtgtgtgtgtgtgtgtgtgtgtgtgtgtgtgtgtgtgtgtttctcttttaagtcacctccctttcctgtggtatttttgtgaaagttgggtatatcctatctcctctcactgattctgtcaaatctttcatcactttgtctacctctgaattaaacattactttcaaacatgattgctttcttctagaaactaaccttacctacattattaggaattaaaggtgtgtaataagggcatgtctatatttcagccagaggtattaaaggtgtacattaagaacatagctgtattccacctggatcacatcaacctaggttttgtttatgaatactcactcaaggagccaaattgctgtatcaattttcctctgcaagaggtgtcacca

SEQ ID NO: 22187 - DNA, 1099 bp, Mus musculus
gcagtcagttgtctggtgtaatcagttgcagtcctgtgtcatcgggcagaatcttgacattgctgtacactatcttactagtttgctagtagaacgcttcttgcagtgcttgacgacagacaaacagacaaacagaaaacaactgagtgatcgggtggcattagcagaactaagacaagcctcctgacaaaacctgaaacctagagcccagatcttatgccatggcttcgaacaggcactgctgttgggatagctctgcagaaaccagcgtgtcgggtcagggttctgggtgacaaaggtataaacaatgtccttgattttgtgtacaactgatccttagagcagtcaagttattggcagttttactaatacacagtgcttccattgctgactttagctgagtggttcattacagtaaaagtgaacggttgcatcacggtagcttctccaacgtctgtatgatttcacacaggtgttggtgaggaatgcagagactcatggtgataaaagaattttggaactgaatcggaagctgtcagcccagtgatcgtggattgtgagacttaagtaaggaaccgatgaaaatacttacagatgaggcaatgaatcaagagttctcaccagaacagcgtattttaaagttatagttgtatcagctaggtgtggtggtgcaccagtttagccctggcacttgggaggcagaggtgggtggatctctgtgagttccaggccatcatgatccgcatggggttccaggccagccatctggacacaatgaaatcccatcttgaaaagaataaaaaataaaaacaaagaaatttaaagctacagttttgatcatttgatccattgcttcccctccttttaaatttttttctttatagacaccaaagttcttaagttaggggtgtaactttctagtaagcccttaatctgcttttaacctgaaacctcttacttggcccataaggaaagtcaataccctgattcttatttaacagttacttacaaactgtttgtttctctgtttccaagacagtttctttgtgtagccctggctgctctggatttccctctatagaccaggctggccttgaat

SEQ ID NO: 22188 - DNA, 1099 bp, Mus musculus
cttgtgttgaatggaaagaaccactcctcaaagttgtcctcccatgtggctctcgtctttctccctggggggctgttggccaccagcctgagaagataaaggcagccgagtgtcttagtcatggtttatattcctccaaatgtttgtaggtttaccatctggcccaaatcacacactagggcatctggctgcagccttcagctgtggtacaaagtccaattcctgatttctgtgttcttctgtctccaggctccagccctcttgctagggcattctgacatctctcccgattccatatcccaggactaggatgtttccagagcacatgtaacattctctgctccctgcctactgcttttttacctcattccttcaatgtatggtcatgctagctcctgcctctccctgatggaggtaacagccgtcatatcagtatcagagcctgggtgatcacactgtatcttcccagctccttgactgccttggacatggacctggccctgcccaaaatctctgtagcctgagtctgactcctcctaggtcattctccagatctttgttccaatagacagctctgcttgaagctctagtacctggtagctgggtcaccttgggcaagccactaaagttaagcccaactttcctcatcataaaggtagggaaaacactcctcatgtcacagggagcaatcctcaggatgacttgtatgaagcagtttacacagagccagggagctggaaatggcccagtttccaggtattattactgcctctgatggtggacaacttaccttgactgaagtgctggctagttttatgtcaacttggcacaagctagagtcatcaaagaggagggagcctcagttgagaaaatgcctctataagatctggctatagtgcattttcttaatgattgatggaggaggtcccagcccattgtgagtggtgccatccctgggctggaggttctggcttctacaagaaagcaggctgaacaagccatgaggaatatattagtcagggttctctagagccacagaacttatcagtagtctctacatagtaaaggaatttgttgatgatttacagtctgcaatcca

SEQ ID NO: 22189 - DNA, 1190 bp, Mus musculus
cttagtggaaggagagaactgagtatacaaagttatccactgatacctacttttgtacagtggaatgcacacatacacactattttgcacatacaataatggtaattaaaatttttagaaatacaaataagtctgtatttggtttgtcaaaataacaattctgtcctttttactataagtgtatatatatatatatatatatatatatattactgctaaataatattcacagaagcctgggattttctcatgattttaatataaatagtgcctgaataaaagacctgatagcttcagatcaaattttctattgttataagctatggttaaaagttagaaaccttggatttattaaacatttttttatatgaaggttgactgaacactaaatgcccacaaatccaaaagttattggccatcatgatttcacaattggagtctttcatagctgtcctcataaatgggtctcagaacaggtgaaattacctctacaatatttacagaatgtatatatgaacaaataagtcccatatttggatttgcataccattcctagagtgtcattttctatttataggtaacttgaaacttaaaaaaaaaatctggaacctgaaacacttaagagtcctagtcatttcagatgacagatttccagcattgtggtgtatgtaatgagagacatagggtagatggagaaagaggtaatttgttagtatttttccattgctaacgtaccctatatttttagtcattgaactctcaaaatggttgtaaaagtaagcattaataatagaaaaattttgtatttttaatgtttcaataatattttcccatcttgatgctaggtcttcaaacatgaactatcttacttactgactggaattcttggtgcagcagtagattactggatcttccttggtattcagatgggtagaaatgtgatccgacatatgtctgatgacttaggaagttatatttccctttcctgtgatggtaagtgtatctttgttatggttacatttttaatcactcattctgaaaattaatttcaagtacctttaagtggtctattcttcagtctatactcatatgaagttttctttgaaataatacgcagaagcaatatgaaaaggaatgggaaattctataatgctcccatacagagtactttaaaaaacttatgatgttta

SEQ ID NO: 22190 - DNA, 1101 bp, Mus musculus
ttttaaaactgcagtgggtaagaggttgctttttacctttgctaagtcatttaaccttggaatctttgaaaggattgcattaggtaatacctaagaatcctttgaagtctaaactttttctgattctacaatgagagtgagacctacagtttgattccaagaataatcaaacctgttctctctatggacaaagagacattcactggctcagtatatgtcttttcatgtcacagtagaagatataaaagacccctttaatatctccttctgggagagttgcctttccctaagaaaaccctaggaatagcaacatgcaaacagtcattctcttacccttgtagttgttataggagcaagggtagaaacaggggtgggcagcaagcaaaattaagaagtgaggtttctctgtgtggatcacaccttaaagtattactagttatttatgcttgtcttcccttttatctaaaaaccacatttgtttcatatttagtcttgaagggttttttttttttgtaggagggtttttaaacaatttaaaattagaaccacatacaagggttaagaatacaattattactctgtattattaattagaaagtatttggtatgcctaaatcgatataaggattcagtacgcctaagtgcatatgtctttttcctggcattattgaaatcagacaaggtaaggatgatgaatgacctgtattttgcccacagaagagccagtttttcttctgcaaggctacaaatagcaggcaaggacagtactgtcacacggagagtaactctgaactctattactttctctgcgagtaaaaaagcaattcctcaggactaggtcttatgaaaacaaacaaaaaagtgcccttacatggctgaagttgttcacttgtcgtgtatcagtgtgagtagtcttatgctaagactgtaatcatgggttttgcaaactcgatacagcacttgtatgagctgaagctttctaagtacttttagtcttttggtacataacaaaagtaagagttttggtaacaaaagtaagagttttggtaacaaaagtaagagtttgggtaacaaaagtaagagttcctactgtgtccttct

SEQ ID NO: 22191 - DNA, 2649 bp, Mus musculus
gtaccacattttctgtatctattcctctgttgagggacatctgggttctttccagcttctggctatgttctgtgaacatagtggaacttgtgtccttattacaagttggagcatcttctgtacatatgcccaagagtggtattgctggaacttcctgtagtactacgttcaattttctgaggaaccaccagattgatttccagagtggttgtaccagctttcaatcctaccattattggaggagttttcctccttctccccatcctcgacagcatctgctgtcacctgaatttttaatcttagccattctaacttttgtgagttggaatcttagggttgttttgatttacatttccctgatgactaaggatgttgaacatttcgttaggtgcttctcagccactaggtattcctcagtgaagaattcattgtttagctttatacctcatttttttaaaataagcttatttgtttttctggagtccaacttcatgagatatatatatatatatatgtatgtatgtatgtatgtattggatattagtcccccatcagatttaggattggtaaagatcttttcccaatctattgattgcccttttatcttattgacagtgatctttgcaattttatgaggtcccgtttgttaattattgatctttcagcacacgacatttgtgttctgctcagaaattttttcccctgtgcccatatctttgaggctcttactcactttttcctctataagtttcagtgtctctggttttatgtgaagttctttgatcctcttagaattgagctttgtaaaaggagttaagaatgaatcaattcacattcttctacatgctaaccaccagttgagcaaacacaatttgttgaaaatgcagtctttttccactggatgattttagctcctttgtcaaagatcaactgaccataggtgtgtaggttcattcttgggtcttcatgtctattacattgatctacatgtctgtggctgtaccagaaccttgcagattttattcacaattgctctgtagtacagtttaaggtcaggcatggtgattccaccagaggttcttttattgttgagagtaatttttgctatcctatgttttttgttgttccagatgaatttgcaagttgccctttctaactctgtgaagaatagagttggaattttgatggggattgcatttaatctgtagattgctttcaccatgatagccatttttactatattaatcctgccaatccatgagcatgggagatctttccatcttctgagattttcttcgatttctttcttcagagacttgaagtttttatcatacagatctttcacttccttagagtcacaccaagatattttatattatttgtgactgctgtgaagggtgttgtttccctaatttctttcttagattgtttatcctttgtgtagagaaaggccactgatttatttgtgttaattttatatctagctatttcagtgaagttgtttattaggttttagagttctctggtgggatttttggggtcacttatatatactatcatatcatcagcaaatagtgataagttgacttcttcctttccaatttgtattcctttgatcttcttttgttgtcgaattgctctggctaggacttcaagtagtatgtggaataagtagggagagagtggacagccttatctactccctgattttaattagattccttcaagtttctcttcttttagtttgatgttggctactggtttgctgtatattgcttttattatgtttaggtaggggtcttgaattcctgatctttccaagacttttatcatgaatgggtgttggattttgtcaaatgctttctcagcatctaatgagatgatcatgtggtttttgtctttgaacttgtttatatagtgaattatgttgatggatttccgtatattaaaccatccttacatctctgggatgaagcccactacatcatgatgaatgatcgttttaatgtgttcttggattcgggtttgcgaggattttattgaatatttttgcattgatattcataagggaaattggtctgaagttctcttccttttttggatctttgtgtggtttagataccacagtaattgtggcttcatagaatgagttgggtagagtaaatttgcttccctttgttctagagcttttagttgtgctgtcaagctgctagtgtatgctctctccagtttatttttggaggcactcagagctatgagttttcctctcaggattgctttcattgtgtcccataagttttggtatgttgtgacttcattttcattaaactctaaagtatttaaattctttctttctttctctcttttctttgttttctttctttccttccttcctttcttccttctttccttccttcaccaagttattattgagtagagtgttgttcagcttccacgtgcgtgtgagctttctattatttatattgttattgaagatcagcttcctgttattttgttgttacatttggcattctgttcttgtgactatcttgttttaggtttgttgaaggatttctttgttggtctatctagtgtgtcatttccctccttgtgttggagttttccctttattatcctttgaagggctgg

SEQ ID NO: 22192 - DNA, 1108 bp, Mus musculus
cttattcttaggagataatgtgtaaactgtttagggataaagtcatgatacatgaaagctattttaaatgcttctttaaaaagagagaaaaatacaaaaataaaaagaagcctaactgtatttggaacagcacttggaaggctgagaccacagtcttgagactttaagggcagcctaaactacatttggaaaccttgttcaaaaaatataagtcagtggttggtggttctgagctttgtctctgaactgagtgttcggagctgttgttaggcttttccaaccttgactttatgaacttccattattgttactgtccctttgagtggtgttcctctttgagagaaaggagatctgaggttcttgtttgatattttatgcatgaggtttgtaaggaaggagataactgtcaatattctcatgacctctctgacagtccatgtgctgtagtgtgcaagtattttcaaagagggtactgtgtttgtggagaccactgcagagatgaacacagcaagccactgaaacaggaagaagtgactgctactgatctgagtgcaaaaccatcccatgctacttcctcaagtctctcttctggtgttggatcacttgctgaaatgaatccaggcgaagttgagtcatgaaactcaaactttccagttgtaggagtagctgtagaggattgggtgaatgccattgagtttgtaccagggcagccctactgtggctgtagtaagtattgtgaggaccctctaaactgcaatcaaagggctaaatgacaggccacagtgaactcagagtcatcttttctgtttccagtatttgagattaacctagtgtcaacacgttagattgggttaactaagatttaaagatgaagtaaaagaaattttttgaactacaataaaatgaattcctatttaagaacttcacataaaaccagagacactgaaacttatagaggagaaagtggggaaaagccttgaagatatgggcacaggggaaaaattcctgaacagaacagcaatggcatgtgctgtaagatcgagaattgacaaatgggacctaatgaaactccaaagtttctgcaaggcaaaagacaccgtcaataaga

SEQ ID NO: 22193 - DNA, 1147 bp, Mus musculus
aaatataagcagactcaaattctgttcctctattcacccaagtaagtatgcaaaaggtatgccaatattgctatcttctttccaccactggtgggagataaagaagtaatactttcattttctcagtgatttttttactcactaacacattaaaataagaaaggagctaacccaggcagcaacctttaatgtgccattcacacatttgcagcatatttgttatttgttccttggggctcatctttgcagtgagacataataaattaacacatcagtaaatcaaggacaatagagtttatatgtaagagctggaataataaatcagctggtagttgtaaacctcagacctcctgacaccaaccagaacagaacactggtgggtctacaaggctgcttgtaatcataacttgtagaagactgcgtaccttgcctccacgctgctgaaatgcttacaatatatgggtgtaggggcttggaaagaaaacagtatttataaggagtccagaatttcctgaacgtttgcacgatgttccttagtgaaagaactgcataccagtgagtaggctagaaaaagaattagctgaattttatttaaatactgttctttatttcaatgaaatattgttaagtaaaatgaaataataaatttgtaacaattatgttttagaaaatagagcaaacaaatagagtctaaacaaagttttaatatcttgaataataaaacttttaaacttgaaaataattatgaactttgaccaaaaaaatacacagcagatatatacccaaattccctttgacacttagttttgagaactcagggaaataataagagaatattagaaggaacccttgaaagtttgaagaatttctctctccaacataacagagccaaacttctctgttactgggtccatcctacaatcatcaattaagtgtgtgtgtgtgtgtgtgtgtgtgtgtgtgtgtgtgtgtgtgtagccttcttctaattcagacaatattgtagatattgtgcatttcataacatgaaacataaaacacctatagtatagagctttaattttagaagaacaattataaatatgtaaatgttgttgatcagtgtgttcaaaattgagtaagggttaaaaaaaaagctttagaaatg

SEQ ID NO: 22194 - DNA, 1176 bp, Mus musculus
gcaagtttctcaaaggtatcaggtcaacagcttccttcccgttgatagagatgaaagttgttcttgtatttaactggtaacaaaaacaaaagaagaaagaaaagaaaagaaaagaaaagaaaagaaaagaaaagaaaagaaaagaaaagaaaagaaaagatcaatttttgtctcactgtttcagtgtttaaataataattcccatatttgcataataagactctcttcagagagcttggagagctagctccctgttcactctctccagctgattgtgctggcgccatgcttcctcttcaggagggggaaagactattggaagatggctaacactctcaagtacacaagtgtaatagcatgaagtatttattttaaggcttggtatgttgtttaaattattaagtagtgcatttcttatggtcttttgggtagacacagtcagtaaacacttcagatgtaatgtgtaaatccttgctagtgcatgtctacacggtggactgctattgaagaaggctattcttccaactattgaacactgttgacagatatggattatgcaatggcttgttgggaggtggattagcggtgctgcttaattggtttgcttccaatgtggcttcgtatcaagaagccctgactagtggagatgagaaagatttcaaaatctgtctgcttatacctaccagcaacctaggcttgtgagcagaacgaatgatcccaagaaactacttgatcaagtttgtttttgttgtcctggattcaagatgtgcattcttccttgatctaagactgttaatgtatgaggctatagaaagagtccccagattttcactgtaactttccatttgcacacactgtagagcttcagactgttcactgatagtgcatctttagtggggatgtgttcaacaacacagtttactgcttctgtccattggttaggtacaaatatctgcctctgactctttcagctgcttgttgggtcttctggagtgcggtcatgctaggtctctttttgtgagcactccacagcctcagtatagtgtcaggccttgggacctccccttcagctggaccccactttgggcctgtcactggaccttcttttcctcaggctcctttccatttccatccctgtaatttattcagacaggaacaattatgggtcagagttgt

SEQ ID NO: 22195 - DNA, 2417 bp, Mus musculus
tctgcgcggtcctaccgcccgctgcagcgcggtcgccgctgcccagcctcaattgtgcccatttttaatcccctttaaacccagcaagcttttattctaaacctcaaacttgattttaaccaggttttttcctcaggtcatctaatgagcctctgtcttttacacaaagccacacactcgagtcctaaaaatgccaactttaaattcagaacatgatggactatgtagtttggggagtacaagttctttctccctataacgacttattttcacttcaacccccccccccaaaaaaaaaaaaactgtacatgaagtaccgaatccgaatcctcatttgtgcccagttgaactccagtctttatgtctctgatttcaggagggaatgtcgaaaggaaaatataaacagatcttttagatgtaggtataagtctccatgttcagtgaattttccagttacttataagaactgaccttactattaaaatatataacacgatgtgtgcgccaatgcagggtgatggtggtggctgttgatccttacaacctgtactttcacctttcttgtagcgtgccctgtcagatgcaggacttttttactatcatcaagaaaataaaactacataacctctttcttccaaaagtccaagtagggttaatgtgcttcagttttcatctgcagtaggaaaagagaggcgtagtgtgaatgggttgctcttttgaggccaaaatgtttactgttctcttcctgtgatagggcgctgccctgtaattccaacagtaaggccaacgcggaagataaaataagttgacattttactggcttttgaattaaagcattagacattaattacttgaaatttttaattagtgaaggttatatccagtgcatggtgagattgtgatttaatacatccatcctttttaaaatgaatgcaataagtaatttgtctaccttgtttgagaccttgagacagtataagcaaaatgagtctgagttgctaatgacagggaagaaaacctgagctcagccacctcatgaggaatactctcatcccatgaactgattttagcaaggtttaaactggtaacatgtcatgctctttgcacatgcatacattcagtaattctgtaaggacagtaaagtcctcagtgccatggctgggcatctcctgacattacttaggcagaagtaccttaggaaaaaccaaaatggggctttctccagcttttgggcagtttaaatatgttactccaacagtgtcaagcacattgaactgtcatagtggccctttacatttctgcttttagaaggattggtgaactctgtgaaaataatatctttccagttactgggcttgaaacactggtgtgcattgattatattttaccaaatgttataaattgtctggtgttttcagtatgtgaaaatgttcacaagaaagtgagtttgcaacatgtagaggttggaaaaacctatgcagggctaaatttgctagacttctgcagctaaattaaagcagagttaaagtgctcagcttatgaaccaaacaaaagtatcctgctcctgccctccgggttcctctctgcaactcttaaaccttattcagagaaagtctctgtttccttgggatgagtactttactgtcactggattgtaaccttgtcttctgtctagcagagagctatttacaaagttacattttgtaaatgtctgttactacttttgaatctgtgctatagcaacccagagggagccaggcgcagcaccccagatcaccagctgatgagtgacaaatgattctttacaatgtaggatttcttgacctgttgattgggttgctgttggtatatgtgtaaggatgttattcacctcagctttcttgggataacaacaagcacttggcagtaccctgcctacagggaggccagggttaatatttctcatctggccttctccctatttttattctaggcacacagtggtagaaaggtaaggtgtgagcttttttaaaaataaatcttatacttagttcttaaagtaaatagatggaaagagacataaattggaaattcaaaatagtctgattcaagctttggagctttttcgggtacctaacacacagtccttggaagtcatcatggatgtttgctagaccatctacgtgtaataattgttcttttctcacaattctgccttgtgcttcctgaaatgcatttttgtttgtttatatgtcaaaaataataaagtgtggacctcctataatcttgtttaccattttaaaataaaattttccaacaaagcaactgtgtcttctgtcttcctcctcagttcgtttttcaccaactgcacagaggctgttaagactgaaagctagccgggtgactgggccagggccaccagtattataagacataat

SEQ ID NO: 22196 - DNA, 1168 bp, Mus musculus
tttgatttgtatcattctgaaaggatttcatttatatctgtgttgcttcttagtagctgggaggttgggtggtactttcttagccatcctgagctaggggccttgcagtcaggcctagttcttcttctctagctaaaatagccagggatgcagactatggatggacacacggagccggtgaaggtagatgacttcaccctagatctcctagcagtgtgatctgtgagtaagacccagcaagcaggagaagatgcttcgggagcgagtgactgcaggaaagaaccacagtgcgttgggtgcgcgctgcggctcggcgatgttcacaagcccccctggatgcacattgcctcttttctctctttctttttatcagcggttcagcgaggaagaatgcctccaacccagcccaatccaggccagtatgcactcacaaacggggatcctctcaatggccactgctacctgtctggctacatttctctgctgctgcgcgcagagccctaccccacgtcgcgttatggcagccagtgcatgcagcccaacaacatcatgggcatcgagaacatctgcgagctggcagcccgcctcctcttcagcgccgtcgagtgggcccgcaacatcccgttcttcccggatctgcagatcacggaccaggtgtctctgctgcgcctcacctggagcgagctgttcgtgctcaacgcggcccagtgctccatgcccctgcacgtggcgccgctgctggccgcagccggcctgcacgcctcgcccatgtccgcggaccgcgtcgtggccttcatggaccacatccgcatctttcaggaacaggtggagaagctcaaggcgctgcacgtcgactctgccgagtacagctgcctcaaagccatcgtgctattcacgtcaggtgaggatgcggtcgcgaggagggcagactgtgcggggagctggtgggcatggcgaggcgagtccctggcatcctgcagctcccgcaccgccgctgtcgctgtgaggccgggcgctcaagccaccttgggcctgcccagggtctgcagcccgggtatgtggttgtcgccgaccgcgccgctgccatcttgggagcgtagtggtgcttggagcggaggaagctcagtgaggccagcggcctggcctgatggatggcctggacccagcg

SEQ ID NO: 22197 - DNA, 1344 bp, Mus musculus
gctgacattctggcagaagaaatgatctgaaggatcagatcagccttggcctgaggacagtagcctcgaggttaaaggtaagcagaaggcggggacagcagtatggtggtgaacagaaagcaagtgatctaggccagcagccttcctgagggacgtcggcccagaaagctgaacttgtgactttaagacaagctctatgaatggcaaagaaaagtctacactgacaacaggtatgcttttgccactgtacggggcaatatacaaagagggctgttgacatctgcagaaaaagacctaagatgctgtggctaaaaaaaatcaggtggcagatctaaccgccaatcaggtggcccaaggagcaatgatcctggcagtcaaggagcctaaagattattatgacatcagagagaccagctttagatacaccgctgagcactatcaagctatggacagtatttgacttggcctgggggccaagaaattcaaaggtgtggttaggtcctttgactactatgttacaggactctctgacttggcagaagaaatagtcaaaagctgcaaggactgtgctatgacgaggtagaatttctaaaagaaaccttcccaaggtaattggatccaataaaggacctgtctttgttgcccaggtaaatcagggactggccaagatattagagatcggttagaagttacattgtacacgcaggccccaaagctcaggacaggtagagagaacgaatagaaccattaagagacccttaccaaattgacagcggagactggcgctaatgattggatagctctcctaccctttgtgctctttagggatagaaacacccctggacagtttagactgacccctctccactggtaaaaatagcctctgtacatagtgctgacatgctgctttcccagcctttgttctctaggctcaaggtgctccagtgagtgagacagcgagcaaaaagcagctccagaaggcctactcaagagaagaagacctgctacattagacatctccatgcaaaaaaccttgagactctggtggaaaggcccttatcttgtactcttaaccaccctactttctacctttatgggaccccttttgattttggttctgcttttaattataggtccatgtgtgttaaataggcaagtcacccttattagaacaaaaattagtgcagtgcggcctttagttttgagacaacagtaccatgccataaaggatcaagtatgtcaggaaaaagatagtatctagttctaagattagaactactaacaagaagaaggggggaatgaaagagtagtaaactcagtgctccaaggtatgctaatcataaa

SEQ ID NO: 22198 - DNA, 1219 bp, Mus musculus
atggagtcctgtggtatccatgagaccactttcaactccatcatgaagtgtgatgtggatatctgcaaagacctgtatgccaatacagtgctgtctggtggtaccaccatgtacccaggcattgctgacaggatgcagaaggagatcacagccctagcacctagcacgatgaagattaagatcattgctccccctgagcgcaagtactcagtctggatcggtggctccattctggcctcactgtccaccttccagcagatgtggatcagcaagcaggagtatgatgagtcgggcccctccatcgtccaccgcaaatgcttctagatggactgagcaggtgccaggcatctgctgcatgagctgatattgaagtatcaatttgccctggcaaatgtacacacctcatgctagcctcatgaaactggaataagcctttgaaaagaaatttgtccttgaagcttgtatctgatatcagcactggatcgtagaacttgttgctgatttttgaccttgtattcaagttaactgctcccttggtatatgtttaataccctgtgcatatcttgatttagtccttagttcatgtggctcggtcacttgggggctggggagagcacgctgcagatgagaaagccccagcctggtggatctctgtgagcaccactgagtgatctgtgcagggtattaaccaacagcagacttccaggatttcctgaggctggcaagggttcctgaaccagttaccactccttcttgccagtctaacagggtgggaaagtccgagccttaggacccagtttcagttctggtttcttccctcctgaccaccatcggttgttagttgccttgagttgggaacatttgcatcgacacctgtaaatgtattcattctttaatttatgtaaggttttttgtactcaattctttaagaaatgacaaattttggttttctactgttcaatgagaacattaggccccagcaacacgtcattgtgtaaagaaataaaagtgctgcagtaactgaaaaaaaaaaaaaaaaaagaaaaaagaaaaggagatctcgcaggtgtcagatattacccagacagagcttgaagaatctcaggaagagtgcctgtcagagaggactttctcagaaaggggccctctcaaccctaaattagaaagatatagagacactgatgatgaggtaactttagacaaggaagatcattcagaa

SEQ ID NO: 22199 - DNA, 1212 bp, Mus musculus
atacagaaactgccccacctggggatccatcccataaacaatcaccaaatccagacactattgcagatgccagcaagaacttgctgacaagagcccgatatagctgtctcctgagaggctctgccagtgcctgaccaatacagaagtggatgctctcacagtcatccattagacaaagcacagggtcctcaatgaaggagctagagaaagtacccatgtagctgaaggggtttgcagccctacaggaggaacaacaatatgaactaagcagtaaccccagagcttcctggaactaaaccactaatcaaagaaaacacagtgagagactcgtggctctagctgcatatgtagcagaggatggcctagtcggtcatcaatgggagaagaggcccttggtcctgtgaaggttctatgccccagtataggggaatgccagggccaggatgcggaagtgggtggattggggagcagggggaagggggagagaataggggattttcggaggggaaatgaggaaaggggataacatttgaaatgcaaataaagaaaatatctaatttttaaaaaagagaagggtagatgtggtggagcttgtgtgcgtgcatgggggaatgttagcggcacttccctcattttgaattagttgtgactgacaaggcaaacttcactggcatgtaagtctaaatatacggtaatatacacaaatatcaaaattttcaaaatgctacagatttttatcactataaattgtaaaaaaaaatctctaaataagattatttaaataattggacatggccaatattagttactatttatgttttctaaaactagaaagatttagtaattttatacatgatattacatatcatcattcaagatgatctattgtctatggaagaatatgcatcaccgagtgactatgactgccttttcttctttacttgctatgttttaagtgatcttaactgtctcactgtgttgctgtgtgttgtgtgggctgtctctgtgtgtcgcttgtgaagtgtctgacctctttagggttgatggcagtgggagtggagaagcggacacggatttcttccttccacctgtcctcccgcatggtaagcagcggtcctgtgatcacttactactgtctttacatcagcttctcattctagagacaacaatgctgatcacttcctgtcatctcctgtaactagatgatccgtt

SEQ ID NO: 22200 - DNA, 2288 bp, Mus musculus
tattttgattaacagagaaaatgacatctgtggcatttctgggtgtatctttgtactttcttccttccatgttcgtgttttatagagatttttttcagagtctgaaccatacatgatagcatattttacaaagtctgaaaataacttcacttatttaatgttcacactgaatttgcatactctacttctcatccagttttcatgtctctggtttatgtggacaccagggattttaagcaatgaggatatttatagaaatgaaatagagtcattgaccacacaacaaataattgctctggtgttcggattacgccctctgtggtcactagcgtgtgccatgttgtctgttattttcttaaaacagaagcatattagttcatgttcctcgccacacagaaaccacaggcctgtgtccaggtctctggattgcttgtggtttcactgtgacttgggagtcagattaagaccatattttttgttccctaggaagtcacacttgaagaatttcaatccagtttgcatgactaagacttcctaaaacctggctctagtctcacagcctgcagtctctttgatcatcctaattatacttaggcacaaatacctgaaattataaaatattttatctattcatttctctatttgtcaacagacacaattatacactcccacacacatgcacatgtgtgtgcatgcacacacacacacacacacacacacacacacacactttttgttattgcatatcagcatctcagattcactttatttctttcattctattttacatttttttcatgaaaaaacagttgaggctacaactgagacatatagaaagcacttgaaagcaaaaggtatttacaaaagtcagatcataattgtgtttacttatttagctttgcctatttgtggcttgtatttacccacttaatatattacttaattaatataactgtatttaaggagacttaaatataacattgaaaacacatgtatcagagaagcacaacacccagcagctatcaagttgtttcaatgttttctactaattacaaactacaattttctaaaatactaataaaatgtgacaggatttgatacttcatatgagtgatttctctattatttatgtacgtatgaaatctagtcaaataaaaaaggagataatgaattcagaaatctttcagtaagtgctatcaatgaaaaacagttttagtatgaagtgattttaatacatgtaaatttgttttaaggtataaaccttatttgctttatttgctttttaaattatttggcagaattgtcaatactgctggtgttctttaaaaaaaaaaaacctgaaaaaaatcttgaaatttcagactaacagagtgtgttttccctctcactttccagggtgagcgtggacagtgacgtcctaaaatcaggctatactagccgagacttgattattttggaaaatgatgaccctggaggcatttttgaattttcttatgattctagaggaccctatgttataaaagtaggtccaaaatttcactctggattcataacttcagaaaaatgttgtagaagaatttgaactcttgtgggctttgtttttaaaggaaggagatgccgtggagctccggattactcggtccagggggtcgcttgttaaacagttcctccgctttcacgtggaacccagagagagcaatgaattctatggaaacatgggggtgctagaattcaccccaggagaacgggaagtagtgatcaccctcctcaccagactggatggcacaccagaggtaccttgttccacgtccttgtgaaaggttgacagtatcaggatattgagaatagaaatattttgaacattgataaaaagacataagaaagatttaggtactcctgtttagaaaaatttaaaacgaagcttgaaaagcagaatacaattcattcaaattatgagtgtatttctgtcctaaagcaagaacttgaaaaccctgagcagcttggcttttgtggtcagggcttctgtggtcagggcttctgccccagcccagctttctccacttacgatacatttcattctgcatgctctatactcactgaactcttaaagctctgctgcgaaattatttttcagaaagaaactaatttgctttataatagaagaatcacatgtacttccaatatatttatactgcaattcatatgcaactttcaaattaattttatttttttattcttgctaatttaaatgaatattcaatcaccaatgaaaaggccttgaattttta

SEQ ID NO: 22201 - DNA, 1137 bp, Mus musculus
atcttaagaccccccaaatagtgtcattgggttggaaacttcccatttgatcacacggacactgtaattcgtcaagatctattccttaaaaaaaggaatcctttatgactagctctgcaacctcacctccacttcttcatttttaaaaatacttgtgtctgatatttgaaggcacttttgtagttctttgatgaagtgttacacagaaaagtatattcagcaaatccctctttatatactcaacatacttattgctgttataaatagtaacttatgccttaattaacacctaacgccttacaaagttacttaacgtaagttcatgtacacttcacaatcaaagtttgtgtcagattttattgaataggctatcatttcacaggctatatacatttgtctgtcttcacttttgagcataaatgaatgaaggaaaaacaaatttgtacaacctgcctctgaagtcttgcagaagaaaatgattcattaagcaaaaatgagtaagcaagacttttacactagcagtagacgggttgctttattcggcactctgttgacctctgcttttccaaaaagaacctgtccaatttagattatcctcctaatgtgcatcatccaatggagaaacatatgccaaggtgtgtggcgtggtcaaaagggcttaatagtggcattttctacatctaatgtgggacaagcaatttggctaattagtatgtattctaaaaatacacttttagggagtggggtctgatttgcgtgggttttgtgaaataaagtgcagaccgtaaaatatgtcacattacctcattttttagactctatttcctaaatcaatgtttcagctttttaaacattttgtataacaaattccaatcctgatacaaggaattattaatatctatttgttatatttgggattttatatgctttcagaagaaaaagcattacaaaaagactgacatggaagtcagtcattttaaggcccctacatcagagcagttttagaaatttttccttatttagtaataggtacattttgataaattgatccttgagtaaatcttattaaaaataattttttcacataccatgtgcattttgaaatcagagtgatctttaattatgttcagtgttaac

SEQ ID NO: 22202 - DNA, 2734 bp, Mus musculus
aacttggtatctgtaaacgacagagatgttcttttttgtattgtcttcaatggtgccttctcatcacctgactgactgaggaatccatcccttctcttaggagaatgactacattaactcctacttcgacaacggcgatgattttggtgtagacagcgacgacaacatggatgaagccacctactagctgtggaatcctcaaatgtttgggggattcagcttcgagcgtttggacccactttattttggataaggattaagtccgtattttctgttgttcagtgttctgtatccaactcttgagaacgactttgtgtttacagcccatgaccttactcccttacctctgccacacctgtgactatgcaatgcggttgtgggttctctggcttttgtttgatctggatttgaatgtttctagagagttttcgtggcactcttgtgtgttcacagtttaaaaagctcactctggctcacctgctgaccttcggtagcaagggttactcgtcatagtggatttctcttaatactgcacgtggggcactttaaaagcaaactggacgatgatttctcttccctggaacattgttttatcacgctgtgacctcataaactgacctcagaaacgtccctgagttcctaacagtagagttatgctgataggaaacaggttctcggcaagcaccagtgacctgggtgagacccacttcagtttccacctcagccacaacaaagactttcacgtgggtggaaggttctcaacgcttggccttggggataactccaagccttacagtgtacagtgtgtaaactaatgattccattgtagtaagtctgacactttcaacttgttgggctgggacttgtgggaggggaagctgagacacactgctcaattctggacttaaactggaaacaagtcctggttgtgtaaacctcatgataaaatggtgtgtgagtggatatggtgaagggcactcccctcctttgtgtttcacaagactcataaactgcaagtcaattatataatcactgtaaaatctcaggtcattttggaattatgagcgattcttcttgttttaacttacagggtgactctcccctgcagttttctattttgcaggagaaaatatccagatcccttcacctctgaggactttaaaacatgccaaagattttcaagggaattcatagtatgcatttcgaaactaacgtattaacaggatctgcctacgggaggaaaatcggtttttcccagtgggagacttgttactcagtatcctctgaccggaaactggaggcctgcttcttctctcaggatcgagataaccttaatattaagcttaagtttgggtgccttagtttctccacttgtaaatggtttcctatcaaaatttataggaaaatttatagtgtttagacactaaccagaattgaccaaatatgctttcttttacgctacagaaacaaccatgtcgtaaattgtttgctctgtacgtagtactgtggacgtgagatagctgtgaggaaccgtttcctgttgagttataattcgatttccagtcttgtacctgtgttagaaacggtagtttctttgtatgatccgagagattccaaaagtcttttctcaggtgaaggatcactttcaatggcagtgcttctttaaatacttcctgatgggttcgagagcccatcttgacagtatactgctgaacgcttacatccagttcccaggagctgataaagatgctgtgagattcctagtggaaaccaagtctttaaagctgcagtgtgttagggaacttattaagttttagtaataatggcaaatgctgttatttgggaataaaaagtacttcattctcttatgtttgataccggggccaaacaagattccattcgtagacactctttggttgtttccttccagtattacaaagccacagataacttttccagttgggagccgcactggcagtgagttctttcccagcatccactgtcttcaagggtgtgcgccttccacccagagggaagcgctttcccacaggattgactcggaaacccttggcatctctcctaaggatgcgcatcttcatttgaaagatcagcttacaactctaaacgtactaattttgaggagagatgagattttccaggctgcttgactaccataaatcttgtttactttagctctgagtctatgaaattaccttgtagagagataaataagagtactagttagagaagagtacttactgggactggtgataaaatatctttaacaatctcgtaacaaaactagttgcccacatgctgatttttctgtatttgtttacacatacaaaatttaaaaaaataaaattttggccttaataccaagatgatttgcagtgaacatttatttggtacgaaaaaaaagttaattctgattttttttttcctgctaaaataactattcattgatcggtggttgtggaataacccccagcccacccccgttataacaaaagaaacctcttaccttaatgtggcagggagtatgtgctcacagttttcttgaacagttactggaagatgccaaagtgtcagaggattgctgtccctctttccatccacaccttcaagtgacaagtgtcagaggaattgtaagtacaataatgtcaactataatgtcaacccgctttaaaatggaaaagagaagtttcccctgaagacctttctcacttatggt

SEQ ID NO: 22203 - DNA, 1169 bp, Mus musculus
tgctcactcaagttagcaaaatattccaaaacaaaagcaattatggatggctaatatagttctaccaaatagtggcctgcctattattcattgtcttaagactttcaaaactatgcttctaaaaatacttaatttcttaactttttaagagaaggacaatcagtttgtgtaaattaatcctcttatatagaaattaaaattatccaactctcatatgttacatttgattatataaattcaatttcatataaatattttcactgagacaatatccccaaatacagaaaaattagtaaaattctaaaattgacttgctacattcaaagaacttcagtgattcatggtgaaactgctaaagaatagcagacgacgggattactattcattttaagtgcagatacaaagtaattaacaagctgttaactatcaatcctcctttaagttgtatttttttcagttttggaaataatcattaaaatttaaaaataaaagataaggagctcttggtgactatgaaatatataatatataattatcccaatgaatttaccaaacttgtcctaataggataacttcccagggatggggctttaagtaacagtaacaagatcataacaaaatatccttcatatcaaatatagactatactcatgaataatacataaataatcaaggtagattccttttaagtctttggggttactattgtgcatgattgttctggaagctaagcaagtgctattctgtggtgttcagcagcatgccacagcaacacgatcatcacagctaggtttgctgtttacatcgtcttgtggaggaattgggatggttccatgccccttgtctgggtatccagggatgtatagcatatgttatattcaactgttgaataaagtcttaacaagtataaccacttagggcaagaacattcacaatcttactaagcagccactcacctgttgtctggacgtaagcccaacaaactcactgcttcacagattaaaattcagtgacatcagacctcagttcatcattggaacctgagaaagaggggcagataatttttgtgactcctccaagacaagcattctagcagtagctgtcttctcctttaaaataacttgtaattactattttgctatacttatagatcctgagcattgacatcc

SEQ ID NO: 22204 - DNA, 1196 bp, Mus musculus
tgctcgcccgttgccccccatcgtgcactagcggtctcaaaagattcaaagtccaagatggcaaccctcaaggaccagctgattgtgaatcttcttaaggaagaacagactcccccagaacaagattacagttgttgagggttggtactatttgcatggcttgtgccatcagtatcttaaagaaggacttggcagatgagcttgcccttgttgtcttcatggaaaacaaactcaagggcgagatgatggatctccagcatggcagccttttccttaaaacaccaaaaattgtctccagcaaagactattgtgtaactgcgaactccaagctggtcatcatcaccacgggggcccgtcagcaagagggagagagccgactcaacctggtccagcgaaacatgaacatcttcaagttcatccttcccaacattgtcaagtacagtccacactgcaagctgctgattgtctcaaatccagtgggtatcttgacctacgtggcttggaaaatcagtggctttcccaaaagccgagttattggaagtggttgcagtctggattcagctcggttccgttacctgatgggagaaaggctgggggttcacgcgctgagctgtcacggctgggtcctgggagaacatggcgactccagtgtgcctgtgtggagtggtgtgaatgttgccggcgtctccctgaagtctctgaccccagaactggtcactgacacagacaaggaacagtggaaggaggttcacaagcaggtggtggacagtgcctccgaggtgatcaagctgaaaggttacacatcctgggccattggcctctctgtggcagacttggccgagagcatcatgaagaaccttaggcgggtgcatcccatttccaccatgattaagggtctctatggaatcaatgatgatgtcttcctcagtgtcccatgtatcctgggacaaaatggaatctcggatgttgtgaaggtgactctgactcccgaggaagagacccgcctgaagaagagtgcagacaccctctggggaatccagaaggagctgcagttctagtcttcccaatgtcctcgcacttcaatgtccaggctgcagcagggattctagggagaccacacccttctcttctgagctgtggttagtacagtggtgttgaggtggtgtggggaaacatctcactccccacagctctgc

SEQ ID NO: 22205 - DNA, 1196 bp, Mus musculus
cctggattgtttggggatgtctctggtaccccgctggccaacagttcattgtaatgccacctactcccagtactggaagactcctttagtgataagatggccaattggcactcgtttgttgcaggaatactaacaaaagaaccggcacgttccagcgcttgtgcggcaactctgctctggcggcctggctggccatgcactggtggggaatggcagacctgtttttctctcatgcagactctgactcagaactccaaaatctctccacctagctcgctaggctcccactggcgggtcgttaacgcgtcagcccatgcttcagtacttccacagcctctgtggtgcacctcaggcaacccagactttgacgctggaccttttctctttacccagtcaagttgccgcgagaagaaaaacaccacccaaacttagttcagaaacaacgataactcaatatctgggcgcaacaactagaatcctaatcttgtaagctatattaaatctaatttctccggtgatataagctgggagacactggtagctccatcttgtcctcacaatatccctgtccaaaaggtgtgtctgtctgtctgtctgtctctctctctctctccctctcctcccctccaccccccaagtccttcctactctccaagtgattggctccttttcattaggggattggttcacaagaagtcacctgaggacttgactcactccttgtttggagagcggaattagtatcaaaatacaaacagcaaattctagctgtctctctctacattcccatcctcaaccctgtctccttgccccttcctccctgatgctgccatttgcattctgccccaccctcagtctacccataaaatctgtttcttcctcctagggagatgcatatgccctctcttgtcccatatatgtgtgatatgattgatatagatttttatcttagatattgatttaatggctaataaccacatataagtgaatgcataccatatttacatttctgggtctgggctgccttaactcaggatgatttctttttctacttccaccaatttgtctgtaaatttgatgatgtcaatattttttgtattttactttatttttattgttttagcagctgagtaatactccattcttctttaggggacatctcggttgtttccaatttctgtctgttattagcagaa

SEQ ID NO: 22206 - DNA, 1235 bp, Mus musculus
gcatgatttaagtgaagtgaatgcacacccacccacagagagagtgtgtgtgtgtgtatgtgtgtctttagttttgaagcaaatgtaaaatgatatggttcctcgaggctttatcaaaaaacctggtattgagtctctgtagtctttgtcataattggcaaaacctctttatgtataaaagttgagaagaataatattgatttatatgtaagggtttcatggaagagaagttttaaaaatcatctttcttaaaataacatggaaatgatgcttttgacaaacctctgaatcatttgaattgaaattaacatcaaataaatttgataatttgcttaagcttgacagcagagcatcatgccaagttcaacagtgccacagtttactcatagctacttacatatgattgagtaggtgttattaaaaaataggaaaaagactgactagtaggttcaggtaagatttacatagcagtagtagggattttaggagtggagcatagaagcacaacaaagtcctgcgctgcaagatgcaagcgtcagtatggtttcttaagttctttctgtgctttgaagaggttgccagctttccatattcagacgacgggaagatttagtctttgctatagagattattgagcagggtgtacatatgtctcatggtttagcacttgcctagaaagcttaaggccctaggctggggacctaacaccatttattcattatttgatggattaaataaaataaatttttaaaaaatgtagctttagcatagagcatgctccttttgaaaaaatgtaacaaaaatgtttaactagtttgaaaagatccatcttttcctctgctctgcgattgactatttagtgtcattggtggaggcagacaagtgagtgctgagtgtccaggctctggattatgctagggttaaaactcaagtctcctcgaatctaactgcataacttccaggtttttgcctaacttctggcacaggtctctttagccatggtctgttttgtacgtgactaatgctaaaacacagctggtttttccagtgcttaacatgacattctatcaaagtttctttttttctttttttttttttaaagtttatttacttagaagcattcagaatgtcaacaaaacagccgcaactttttttttttttttttttttttgcaattacagagtggtattcagttaacagaacaactactatcttcgtataagcagcatcagaga

SEQ ID NO: 22207 - DNA, 1167 bp, Mus musculus
gacttgatcctaactaaaggagtaaatatgtgttatgtggagttcaggtaacatgttgccttttgttttattttcaaggtgggcatgttgaaactttgatcagtttggaatattcagttggaattgtctttgtttagccctcatatgaatgatggatagttctaaatagttttcatataacaccagcaggtataagcaatttttaaatttataatttagtggttacaaaagacttccgtgatattataatatgtattttattataagtgaaagtaatgaatataaatgcttaataagtatgcctgataagagtagcagcctaaaatctctttaaaaccactccttttcaagctgctgttgtcctgaacctattggtttctcaaattttgttgttactcccattgaatttgagtcttattcataagaaatacattatgtaattacaatttaatttttacatacttttccttaatttaaaaatatagactcattagattttctctttgtgttctgtttccattaagattttcattagttttcacttcccaaggacatctgacagacactggatagaatcaaagcaaatactgggtgttcttttggcatttgcctgatgtaaagatggctgtgcatagctcccacaagttatttgtggtttttcctgaacttttccttttgcagcaaagttctattttcattaactacacactattttaaagtagaagatggaggtgaaaggtcagtttgtgtcacctttggattttttttcttcgttaaagcaatggcagttttgatcgtaacagagaactacctggagtttggccttgaaacaggtaaaacttttatacaactttaaaaatcagttttagttatatattttttattttagtatttaagttttgtcagataaatatttaaatgttgagttggcttatgttctaattaacctttactaatcttcaatgagatctttattgttactgttttattagattttattaaccttgttcccaaaatgttgcacccttagttttttcttaaggtttaattaatttctgtaatgctaaggaattaatttcaaattttctgcactcatgaaatgtacaagtaccaaagggatgttttagagactgttcttgcaaataactgatttttattgcatcatag

SEQ ID NO: 22208 - DNA, 1143 bp, Mus musculus
tgaatatcctaggtaatcattcctggggaatttatccagaagccgcctttcccttgccagtggataataatctccccgccaactcggcttaccctgaactaccatcacctgatgggaagatgaaggtaactgttacacaaatcacagtggccctgagcagcttaaaaaacatcttcacgcctctcctttttcgaggacttctgtcatttttgacatggtggattgcagcttgcctcttttctacaagcctttttgggcttttctatcatcagtatttgacagtggcatgaatttcagtcaaaaacggatatccaagtcacactttaaattcaaatatctgtgcccttgaaggattgacaaaagaagaatgcaaatagaacggagaaaaaaattattggagtgttttgttttgaatgcttcctctgtactctcagggtgaattaatgttgtaatatttaaaactcatgagataggttgttacactgttacacactgtggcattggaattgtaactcattgagagaactaatgtgagagggctctctgcaggggtaatccttctgattatcttggtttacagttgcaaacctccaacagtctgttagacttcttctaggactccagttactgactgcttttcatggtgttgtggtactgttactactcatagttgctgcctacagaacaatcttcaaactgagccatgctcgagggaagggaaaggaacgaaaattacttctgttggtaatgtattagtcttaaaaaaaaatccaacagaaaggaagagaaagctactgtatattacagtaagaaaagctgcatagtcattttaaattgaatggagatataaattacctattgtctacaagtactgttacttgagagtagcaggaatattcttttaaagtgaatgccacccagcttgaaagttctttttaaatgattggccatatgaacatcagcggtctcactgttagttttgggccttgctgtattttattttttctttgattttaaatagttatgtttaatctaaaaatatttatcaatactgatcaaatttgagaattactttgcaatcctgctgactacgtgtatgtattgtgtatatattatatattaaatatataatatattgaggtt

SEQ ID NO: 22209 - DNA, 1105 bp, Mus musculus
tgaggcttctgctgatgaccatctgcagtattacttaccattatctgtcttctatggtcataaggtatatgtacatgatcaattctgttaaatcaaatcttccatttatagttcttgatgcacactacttagttatttcttcaagtttctggttggactatataaagctattaatgatggttaaatactgtagcagtagtagatgttgggccaatctaactttatactttcccctaagtctaacgaataaaagtttaaaaaggaacacttaagttctttttttttttttttttttttaatttcctgcagtgtctagcattgtcacatttcagtattatgcagtttacaaagtactttaagggatatttaggtatttctgctgtcctttatttttttatgtaggcttacttgtgcatttttggcctgcaaagtagatgaattcaatgtgtctagtccccagtttgttggaaatcttcgagagagtcctcttggacaggagagggcactggaacagattttggaatatgaactactacttatacaacaacttaattttcaccttattgtccacaatccatacagaccatttgaaggcttcctcatcgatataaaggtaaacctgctgataggaaattagctagtagagctaattctttgttattgtttgctaaaacgaattgaaaacttcataatcagtaatagactaactcgtacaacacaggtgcaacctgagagtctagggtaatagttttcaaacctcagtgtgcattagagtacacctggagagtttgtttcttaagattattggataagagttccctggtttctggtttagtaactttctataatagattatgagattatagtaatgtcattaaagaattattgtaactcttgtaaccgatatatatggtcatagatctaggcctagtgacttatagaacctcaaaaaagtcttaatattaaactaaaatataaattgatcttattttaaatgttttatgtactcagttcacaaataaaagcaccaaaattataagtacatagatgagacctgtattttcagagcctcaggaagtttaggtgggaggaccactttgaatct

SEQ ID NO: 22210 - DNA, 1200 bp, Mus musculus
tgacagttttccataattcctgaacatagtctaaaagtatttctgtagatatttgtgaaggctaattggttcaacattcgtttacatttactccccccacccccatggtatacattaaaaaaaactttgctttgacagtgatttggtacaatttctaatgtggccttccagtctttacctgagcgtctgtatcatacatatcttgtctttgccttgaatcccatagaatctcgaagagtttccctttctaagttagaaaagtactaaattgagaataatgttaagcattattgtgctaaagcgtatgattctgtttttttcttataagcatatattgctaatcatggttgtattccaaaaagtttgaaagtcatatcagtgaaaacactcagaatttggtgacaataacttagctatgtacataccaaacaatctagcattgaaagattcagttttggaatagaggaaaggaattataaaaatcattctttattaagtacctcctagttactgtagtttttaatggtggctagccaataaactcagaaatggtaacatctataaactttctttctagactcggtaccccatgttggagaatccggagattctgaggaaaacagctgatgattttcttagtagaattgcattgacagatgcttatcttttatacacaccttcacagattgccctgaccgccattttatcaagtgcctctagagctggaattactatggaaaggtattaatttgtttttacttcttagtagagttttacttcttagtagagtctgagcttttaagtaagcttcattagacaatatttctgtatatataatgccttatatctggtaagtttgtgattgaagaaagaaatcgcctttaaagaaagcatttaatcgagtattgttgagctaagagaatacatttctgactaaagtagaagtgtgacaggtagttttggaagacagttatagctaccagtgtatgatagatttacaaggcagtgttaatgcagcaaatctgatttattttatcatatgttgtaaagcatgtgtaacactttcagtaaggatttgtagaagtatgctttagggtatatccatatgaaaattatagttgagccataaataataatagcgagtacataaacacacatagatagacattacaatgagtacttaatgtgagttaattcact

SEQ ID NO: 22211 - DNA, 1149 bp, Mus musculus
actaaaaatactcagtttatgtcttgagtagaatctcagtcctttgatatagtttttatcaaaagtaataaatcctataattgaaattttaagctctttatttgcttagtgatttttttcctcactatttctcctgtgtctagcacgtactgaaaaagcttctggcgataacagaactgcttcaacaaaaacaaaaccagtatacaaaaaccaatgacatcaggtagcagcctgtgttctgcgtggattcagtatgcccaccgtggtaattcacaccatcatgtctcctttgctcttgccaaaaagaaaaaaatagagaaagaaaaaaaatagcacactttcccacattccagtgatgtgtgagctatgcaagcaaaaacccaagattctgctgaagagcaactgccagcacctttgtaagctatctgtgcagaatattgcgcactttttccacatggaatctctaccaaactctgagccttggtgtacccttaacaacaacaaaaatgctatgactgactgtgtcttgaactttgaaaatatattttcagtatatccaattgccaaagttttgctgtctcttggaaaaggaactatgaaatcaactgacaaggaaacgcattctatagacaacagaatttaactggatcgcagacagttattactgtaatttcttctttatgaacatgaccatttgactgttcactgactttctttgtatttacagtttccagagtttgacattataataggaacaatcttgctgtatactttttaaaaatactgtgctattctttctggaactgttgaaagacaatatataaaatcgatgaatctattgctcatcagctttattttttaaacataccacttattttgttggaattgtcaaagactgtatttagatctcatgcttttgttaaaatgtttacaacagtaaatagtttaaattcaataaatattattggtcattgtaccaattattgcatgttacccatttgaccattttatagattgctgatgtcttttatgtttaaacgaagtgctagaatacttttgtcacttctaagatggtttttgttatctttgattatgcagataacctaatcagccacttaacaacttacacatcttttaatttgtacttgt

SEQ ID NO: 22212 - DNA, 1227 bp, Mus musculus
atgattaggaagaggagggagtgggccaactacatgtcttctaactgcttttgagacctacttcataagagaaaatgcatgccttgtgctataaactacttagaagtccagggttgaggcaatcttaggctcaaagagggaacttacaattgttatttaacacggtgccaatctgccttctaaatattaatgtttatatccacagacaagtgctactcttagtcttaatcagagaaacctttctttctttctttctttctttctttctttctttctttctttctttctttctttctttctttctttctttctttctttcttccttccttccttccttcctttctctctctttctttctttctttcttcctttctttctttctttctttctttctttctttctttctttctttctgtcccccccctctctcttttaaggcgcatggaggaacttcacagtcaagaaatggagaaacgtaaagaaatgcagttgaggcaagaggaggatgttcgccatcgtgagatggaagaacaaatgagacaccaatgagaagaaagttgcagcaggatgggctacatggatccaagagaaagagacatgagaacgggtggtgaggaacaatgaacatgggagatccctatggttcaggaggccagaaatttccaccactaggtagtggtggtggcataggttatgaagctaatcctggagtaccagagaaacttttccttacgatgaaaagcaacaggtacagagaggtattgctactcaagaaaatgaaactcaaatacttagccttcagtaagattcctattgcccacatttaaggctcagaaaatcatatggaataggggttaagaacaatggaaaaacatgagcaaagagctgtggaatactatgctatgctctgggcataataaaatacagacaatgcagtctggatcttagaaaaagcaaccagtacatgattggcaacagtcatgaggatgggctcacatggccttccaattcctctctgaatttatgagttattggtcagttctgtaggatgacagacgttgtcttccattgtgtatccattcataaaccaactacacctcaataaatagtaacaagcctataaacatacaaagcaccctggttaaacacaatgggtatcagaacaatggataaatgaaggaaaggaactctgagagagattgtacgtgagagagggataacagagtg

SEQ ID NO: 22213 - DNA, 2084 bp, Mus musculus
gagctgggcggcgtcggagattgaaggtcattggaaacaaaagaagagggcctgtggctggttattagcgctttaaaccagcaagccacgtttgaagcggcgatcctcggttaggcccggtttagcccccagtgtaagtaaacggagtacttagtggtgactgccccggaattgttaggtgaagcctggtaaagggaagagagaggatgtggaataggaaaaagagaaaattgtactgtgattgatactgaaaattcgaataacaacggacgagaatgatgtgtttgtttctaaaagttactacttcggagagtaatttttttttcaaatattaaaaccaaaaagacccttacacttaatagggcctaccaactggtattcagaaaacctgcgtgttaaattaaaatgaaaatgttctgtcgaatgcagctgattataaaatacgtggttgctcccgacccttttattagagcaagttcagatgctttgaacgaatgttttttgccgtgttctctctttctcaacagaatttgccattttcagtggaaaacaagtggcggttgctggctatgatgaccgtgtactttggatctgggtttgccgcacctttctttatagtaagacaccagctacttaaaaaataaggatatttaattcatccctttaacaggtaattagtaagcttctaattttcctaaaacagtaatttctgttctataccctatacactcttccacaacatgcaagtagatagttgtctccagattccttaaggttaagtgtaaatgtcatattggtagaggcaatttggaaaacctattaaaaaaataaagtattgatcagtaaaggtcagtattttacaagtactccttgaccccaataatctgaatatatattatgcaacacacctctaagataagtagtattaaaaccccattgaagacacagagataattgattgagtttcaatagctagtagcactagtgtagggttcctacagaggataatcttgttctatgaatcacacttcataaatcagtgttgtgtcttctacagaaataattgaatcttcagcgacaaaagtgcactaaggatagccaacctttgacattaccaaatggtattgacatctacaaagttgatgggaaagaaaccctgaaatgttccagtgttcttttcatttctaccactcctagttatctattttatggtattaaagttggtatatcagttggtctgctgaggttgaaaaacttaataagtttctccatagacatgttgcatagtggtagcctagatcccttcatatacatatgtgtttatttagcataattcatgaaaattttggtacatgtgatgaagcaaatcagtatgaataaaatgatactgtaaacgctttctgatgtatcatcaaattgatagatgatatgaaattgctgtaacttgtaaagtcgggcttctaatgccattttgtttttattttgcagaatgaagaaagtttaagagatgatctgaaaattggattaaactcttgaactcttatactagaaaaaattgtaaataaactaatgacataaagattcaatgcctcgtctctgcaataaggaatgtgatagttattacttttgtttgatgagaactatatatgagagttggggtgacgggtcagtgcatgacatgctttcaggacctgcttataaggcctgctttgatatccttgagtaccctgatcaagagctggcaagcaaaatagcctgcttttgatcccaacacccaagaggcataaaatctctggtcaagctggtttgctaagctaactaggattaacactgaactctgggttcaacaaaagactttgctttagaaggcagtagaggaagatacctgaggtaacgttggatttctatttgcaagctcacacatgtcccaaatgagaatgcatatgcataaaacacagttgcatatgatttagactttattataatcttaaattactgggtgtcattaacttgttttttaaattgggaacatgtagtaacaatttgaatatacatactcatcctaacttaaatttaaaagtagc

SEQ ID NO: 22214 - DNA, 1062 bp, Mus musculus
gaaagaggaactgcttttctatgtttgtgagagtaaggaaagatatatgtttaagatgtctatatagttaagtctcactttagatgtctttcctgcattatattcacttgctctagctctacagacagtaattttttcttctttatgaactatactctattctttatgaactatattatgtttaccataacacaggagaatgccagggccaagaagtgggagtgggtgggtaggggagtggaggggaaggtatgggggacttttgggatagcagtggaaatgtaaatgaggaaaatacctaattaaaattaaaaataataaaaataaaataattaaataaaaaaatatataaaatatatgattattgagaaaaaggataatattctcactctatgcattataggaatatatttaagtacactaagtattcaggttaagcttacacaacttgttcatgtttcttgtaaaatgaaggccaggaactaagcaacttctaatttcagcgctgagaaggaagaggcaggttgagtagtgtaggacagaggtcatggaagttgaaatagtgagactttgaccctaaaaaaaggaaacaaaaaatcaaatgcaaatatggatggtctatattgttgttaagactcttcactgagtttcaatattcacttggctctatttttaatgtgaccctaatatcacacatgtaatcaagctcttatagattaacaccagatggctgtcatgggcctaatgatatttataatagcatcaaatatgaacaccttgatttactgtaacactgattcttcaatttcaattcaaacaatatacctgtcactacatagtttcactatctgaattttaggtttgagtcatttactaattttttactgttttttttttttgttcataaaatggaaatcatgaaagaactaaatttatattgctaataaaacaatcagatggatagatgcaaataaagcattcgtaatatgtggcatgtggtgaattctcaccaataattaaaagttatttaaaaacactgcccagatggttcaatgataccaa

SEQ ID NO: 22215 - DNA, 1198 bp, Mus musculus
tgagaaatgcattagtttggcaagtgttttttttttttttttttaactctcccataacaatgctgttttgtacatttccccctagaataatcaaatgaagctaatataatataatagtataaaacagtttagttttacaggcaaagagttggtctccaaattcagataaggtgtcctgtaatgaccagaccacattttacaggaaaatatactggtgcgtcctgtttaaatatgcgctaatgcagtgatagtgatggtcgggtttgtccaacagagacttctggtgcgtcagtgagcagagaggatttaaccgcaaggataccagtgaagcttcttacgcactaaagcacttcagaatgaaatggttactgcactgcaagacggacttcctcttactgttcctcttttctcaaacagatctgtatcaagacgactgattacatactcactcataagcaggaagagcactgcttaatctccggttacatgatggcacgcttacgttggaagcaatctgtaaatggggttaggctactctgcagtccttaaggtttctgctttgtgtttgacaaagtggtttatttttagaatgaaaaataatcctttaagtctcttcctggtctgagctcacagtgactgctcagatttcgctcatagtggagattacgaggtcagctgtagtaaaatgggctcctgacatgtgagcaagaaaatccagaacagtcaagtggaaatattggattgtagaatatttttttaaacgaaagggaccaatcccttttgtaattgatcatcagttttgtagtttgtgtatgtctgccagtcaaaattatgagataatcttttccaaaacaagatgttctagttttaataacaatattttcttgtgtatatatgctacatttatttatttatttatttatttatttatttatttatttatttatttatctctgtagcttaactcatatgttataaacaccaaattcttggaatgttttatggcagctcactatttacatgctttaatatttattttccaaattcttgtttaacattgatgctactattacctccatgaattagcacagtacagatgacacaacaagacaaaacagcagtaacaaaaacaccaaaatgggttcataatagtcttttaattagatagagatattatcataaatgaacccacatcact

SEQ ID NO: 22216 - DNA, 1171 bp, Mus musculus
tttgctgaaagtggaaacaaagtccaacatattttcagacgccacacttgccattgtgaaaggagagactgttccacttgatgtcttgcagatcaagggtgaaaaagaacaacctgtgtatgcaatgactggcctccggtgggggatccttcagagatgctggcgtcaaagttagcaagtactggtatcttggtccactaaaaaccaaagcagcccactttttcagcactcttcaggaatggcctcagactcatcaagcctccatctcttacacgggacctagagagagacctcccattgagcctgaagagactcctcccaggccgtctctgtataggagaatattacgcaggcttgcctcattctgggcacagccacaggatgcctcctcccgagaggtaagccctgaggtctggaaagatgtacaactgtccaccattgaactgtccatcacaacccgaaacacccagcttgacctgatgagcaaagaggattttatgaacatttgcattgaacctgacactgtcagcaaaggagatttcataatcataggaagtaagaaggtgagagaccctggcctgcgtgcagctggcaccgagtgcctccaagccagccactgtactctggttcttcctgagggaactgagggctccttcagcattgacagcgaggagtacgaagccatgccggtggaggtcaaactactgcccagaaagctgcggttcttctgtgatccgaggaagagagagcaaatgctgccgagcacatcccagtgagcgacagcatggcgggcactcccaggctgcactgcaagccaccagtgggaccacacggggatgtgtgtgcttctgtccccagagggtcacaggatcccaagggaattttcatggcaagtacccccagccctcctgtttgcttcctagagcacataccatgtcatgcacttgtttgtggtcagtaccctgttaacccctgctttccttatgttgaggtagttgatccctcttacacagtggttgtctcaggctgggtctagaacgttcttgtactccctgagttgggaagggctggagttttgtgattgtcccacagtggagagtggaatctgtagaccaagttcctgtttcggttctctgaccgtcctggggcaccccggggaggcagctgctgt

SEQ ID NO: 22217 - DNA, 1055 bp, Mus musculus
atataggtacttccttctaagtgtttattacggagaatggaaatgtgtttagctatccataagtggtatttgcccatcccaagcaagtgtgaaaatgtagaatagtgtggccattgcttactgttagatggagtgtatgtgctgacgttttcacttcacccttcaccccttgcatttgaatagtggttgctgaagatgacatgggaatcattatctagataatttaaggctcaaagttaaaactgctctcagaaagaaggcatttaaggctcatccattcccttcatttacaactaacagaaaaggcaaataaaacctgaacagaaaccagctttgaaatgacacaatgaaagcaagcattgaagcatcgtgcggtgtcccataagtatggtcagactttatgttttatacatcaggtcaaaatatatattcagcaaagaagagtagaggaagagcagactggagttggtcctatgttgactgtttcccatgaatgctactttagcttagagggaatgactgtgctcacaagcatacatagtgtcttagacatggtcctgggtctcagcagtaaatgtaattcatcctaatgtgtactagagcacagaaaatcactgtgttgacttactagggctttttttctttttcattacaatgcacataatacttccctgtatttatattataacatgtatagtgtaaaatgtgaatggctttttttgtgaatgaaaatctaaaatctttgtaactttttatatctgcttttgtttcaccaaagaaacctaaaaattcttcttttactacattgtgacttgtctgtttatttccacctttaggccctaatacccaccaaatattttatgttctggtttcatctcagggaacaagctccttgcctggatgaattaattttatggttagtagggaggaacaacaatgtgaaccaaccattacacccagagctcccagggactaaaccaccaaccaaagagtacacatggagggactcaaggcttcagccgcatatgcagcagagaatggtcctataggacatt

SEQ ID NO: 22218 - DNA, 1135 bp, Mus musculus
attcagcgacaccttccaactatccggtgcctaggaaacgggagatgggcaatgcctaaaataacctgcatgaaccgtaagtggtcctttagaaagaacggacagcgttgctttaacagatactagacacctacattttaccgctgtggtatccgtagtttagggtatggagcaagtaatactgttgtgttttcttctttctttgttttcttccatgtagcatctgcataccaaaggacttattctaagaaatacttaaaaaattcctcatccgcaaaggacaattctataaatacatcaaaacatgagcatcgctggagccggaggcggcaggaaaccaggcgctgatccttaaaatggcgaacatgtgcttcactcatcatttcagccaaagtcctgcctttccgtgcctttcctatcacctcaagaagaattagaagttggtttggattatgggactgccgtctggtcatttggggtggctgtactcttaaaatattttcaatgaaacatggaattttgaaaaagcgaataaaatgaaagaaaatgaacgaagaagataaccattttcagcctatctaatttctttagttctctcaatgcctccagtgcagactgtttcctgtacaccagcctactgtactattttaaaaaaacgcaatttcagcaccgatggccatgtaaataagatgatttaatgttgattttaatcctgtatataaaataaaacatcacactcagttcaggcatatttaatgatgattatgcagctttcaaggtctttaatcgttggtttggctgctttgctatagcttgcttaggctggaaatggttttgtctaccctttgactgtcagcaagtttgaggacggcttttctggacagccagcaaacagcatcttgcaggtctctgcacgtgtgtcagccgcgggagccacactgatgcctggctgattcctggctgatgaaactctcgctcggagctccagggtgtaactccgctttgtcatgttcccttttcttcacttacacgaagcgcctgaatggaggacttttctatgacctggaacatttttttaggggtcaaattgctaactattaactcaaccaggtttcatttacaatggctttcttaa

SEQ ID NO: 22219 - DNA, 1170 bp, Mus musculus
attatggtatatagttttattatatggtaataatagttttctcaaaataaatatgtgactgtttgctctaccgcataagcagctgcctcctcactgtaagaagtatcacgtcttccctcagcatttatcaaatctgggagagaatgaggtgtcgacctaagcccttttcctcctcctcttgcaggcgatgtgttccacatcactgctcccagtaagttcaccttcgaggaggccgaagcagagtgtacaagcagggatgcgaggctggcgactgttggagaacttcaggcagcttggagaaatggctttgaccaatgcgattacggctggctgtcggatgccagcgtgcggcaccctgtgactgtggccagggcccagtgtggaggaggtctacttggggtgagaaccctgtatcgttttgagaaccagacatgcttccctctccctgatagcagatttgatgcctactgctttaaacgtaagtgtttgatatctcttttaaaaatacagattaaaaagctgcagcaaatatatacccactgaggttccagtggatgtcgggatggattctgtattctgtactaagtgcatggaggacctacagtgcagtgacacaaacagacttaataccaccattatggttaacacagtagggagtttggcaagtgggattttttttgggaggtggggagataacaacgtcagagtggggtcttaactgcaccccagaattccaaaaatcacagaacacaccctgaattgaaatttcttattaattgaagcctttcaatgcaatttcactcttaatataacaatgttaagacaacagcagctgagttaaacctttgaatcctgttttattttttgatatgattcttattataaaaaggagacaatttaagcttaagtcattgcaggtgagtatttgtgctgaaattaataatgattgtgttcaattcctacctaaaaatgcatcatactatcaaataatacgattcacatatctcattttgtttcaagtaatagaataggcgccttttggcgattaatcttgctttgaattaattaaagtacaatacagcctccttgcatgaattggctatgctcagttagatttgccttgtaaaattaattttaggtagcattcattacatatatatatatgtatat

SEQ ID NO: 22220 - DNA, 1209 bp, Mus musculus
acttaaagaaatcttgtctaagatcacgtgaattgacttcttggagcttcctccatctcttgtctctaggacttcctaaagattcccttccccaaaccttggcagctgcttatttccattcaatctcctggccctcttggttactctcctgtctctccccacatctgtccctattcccctccccctttcctctcctctgcacttccctccttctgccttttctgtctattttgttcccctttctaagtgtgattcagtagcctcgcttgggccttcattcttgcttaatttctttggatctttggggtgtaccctgagtattctgtgcttaatggcttcagtgagtacgtaccatgcatgtccttttaagtcttttttacgtgactgaagatgatattttctagttccatccatttgcatgcaaaattcatggtatccttgattttatagctgaatagtattccatggtgtaaatgaaccacatattctgtatcgattcttcagttgagggacatctggactgtgtccattttctggttattacgaataaagctgctatgagcatagtggagcccgtgtacttgtgttatggtgaggcatcttttgggtgtatgcccaagaatggtatagctgggtcttcaggtagaactatttccaatttcctgagaaactgccagattgatttccagaattgttacacagttgcattcccccccagcagtggaggagtgttcccctctttctacgtccttgccagcatgtgctgtcacttaactttttcatgttagtcattctgattggtgtaaggaggaatctcagggctaatttgcatttccctaatgactaaggatattgaacatttctttaagtgtttctctgccatttgggatttctctgctgagcattctctgtttggctctgtaccccattttttaattgggttatttggtttttggagtccaagcacatacacactaggagcatcatacatactgaacagttagctccaaatatgttcctatatatttacacccaaatgtatattgccaaatatacaaacatacatacatgtaaaaaaaaacaattaataaagaggggctatgaatttgaatgaatgcaaagtggcatagatggcagggtttagatggaagaaagggaaagggaaaattgtagttataatctcaaaaatgttttaaaaacaaatgttat

SEQ ID NO: 22221 - DNA, 1112 bp, Mus musculus
atctgaaaatcagagcgaaaccttactttattatatagcagaatatctaggatatattttttccacaatttaagagcttttaatattcttcccaaatcatattctctctctctctctctctctctctctctctctctcacacacacacacacacacacacacacacacaaacacacacacacatacacacaaacacacacacacacacaaacacaccacagttttatttaaatattaaattagaattacatattaacaaaggttttgctccttatccttaaagacttataaatgaaatttttttttctctcaggttttctgagaaaaatgtggcagagactaaggatagagacatatcatattattactctggcaactaagatgggatatcaaatatggaaatatgtaaattccataaacgtatcaaaaatgtagtttaaagtctggtgtccaagaaaagtcagagattgataggaacaaagtgcctgcatgttagacatgcatggaaggtgtcacacatttactggaattccgtggtgacttcagtacctactcctctgacaccattcattctataggcatgtatgagatgtgatagcaggaagggctggctctacctccaaactatgtggaaattgatgtgaatcatcaggtgtcctttgtagtcctaccttcataactcagacatttatacaacagagtttctgagaatccccacggaaataatttatttgactgagtttccagatgttcttaagcaccatcaaacaattcacctccattatgcgctctccaagattgacaagtgcagggatgctaacagcccatgcagcagtacttctccatagaacgggtctggatacagactaaaattctttaatagtcagtgattttataataatacaaggagatttcgaacacaattataatgttaggcactaaagtacgttctcagaaaaccctctagtgtgcctgtgggatcgccttatggtcctctcacaatcctgtttagaaagttgtttgcttcccacattgatggcccttgctgtgagtaacgaggtcatgttctgagtgataggacacatgtgaaaacgttcagcaccacctcactt

SEQ ID NO: 22222 - DNA, 1212 bp, Mus musculus
aactttttttttctagaaatgtttttctatattttcttactggtaaatgagcttgtcagcaagaatgaatcgaggatttcctggtccacctttctctatttccagggaaaatccgtgttctgacaaaacacctgaggagcatgggctttatgatggaagcaccgatgaagaaagtggagcccctgtgcaggctgcaggtgagaggctggacctactctgggttcatgtgtcacatgggcttatcactgtcataagaaaccaaattgaaaacacgtatgaaaaaaattttccatgaaattgataaaaaattttgccctaaagaatttttaccctaaaacttttaaaatattacattaatattaaaatttatagtagactgtagcagttagtaataacaaggcacacaagcaaatacacacacacacacacacacacacacacacacacacacacacacacgcaagttaactagatggaccttgactgttaaatgagaatgcatgaataagaaggcagatgcatcttatgttaaatatcaccagctcagaatcagaacttcaactcagtgagctcatggagctggggctatagctgaagcagggggaggctgaacctgttcttacgctttagagaagagcttgctatggagtgaaagggcgcagagagaaaagatgtctagttgcactgttttcaagcagtttttatcttactggctttttgctagtgcgttacggtttcagatcttgtgtttttattggttttatttgagtttgtgtgtgtctttgtgtgcctgtgtattttctttgttttcatgtggttgttgttgttttactttctttgttttcctttgcttgcttgtttcggaagtggggatgaaagctacatttgaatgcatagagtgaaagggatgagatagaggaagggaacccctgattagaatatattgtattaaaaattatattcaaaaaacaaataactttgaaaaagggataaaaccccgaagggaaaagcatcttggtttataatttgttagacacctgcaggcctgtgaaccatgtcctagcaggtatttaaccctatgagttattttctagggttatgtagaggcagtataagtgcatagtaatatatgggagcagtagaagtaggcaagccctgaactcctataacactgagaaagttttgcctaaaccccatataaaaccagtttta

SEQ ID NO: 22223 - DNA, 1409 bp, Mus musculus
ctgggccattgacagggcaggatatgtcttgcttccaggtagtcttgcaagatagtcaaaaggacacatgtcaaattggtcttaatagttttaaaaagttaaaattccaatatggtgtcctattgataccttttctacttaggctggaaactaccatatatgtttcaattcaaggtgtttcctgctggggttagtaagaatataaatttataataaatttgttcatcttcttaataaaattagtcttgtaccatagggtgacacagagttccataaattaactcttccaagtttacaaagacaaacaaatccttgcctccatttgtgaaaattatttaacacttgtaaataatatttttttcaggaaacatttacacaattggtatggcatgtgaccattgaaaatagatgagttgtttctctgtattcataatgtacatgaaagatgaaattaatgtctatgaagtataatgtgctaattcttgttattgacataatcccaggattctagaaaaaaaaatgaagagtgatgattcattgagggtagaacttctcagagatcatgagttaaactgatcttgacagtgtttttttttttttaaaaaaaaaacaaaaaacaattctatgttagggattgtatgtcccttagtttgtgaggtatggtgtggccataaaggtcaacggatgttatattctggaaagtcatgtattttacctacctcaaaattgaagttgagattgtcccctcctgcctcacaaatccttcaggaagataataaagtctcccttggtttatgagtgagcaaagttgactaaggaatacactagtagattctcctgagacttttgtaaacattgtagaggcaactggccagtcaaggctgtgttttcagaaacttgtaaaatctcgtattctatctgctaaaagcagccccagctgttaaaacaggcacccatcccaaaagtgcacagtttacatttcctggacatacagaaaatatttctacttatcaagaacttaagctccacaaaagcctttgagaagctactctgtcattactatctgaaaacatgaatggaaaattcttagggctgctcttctcttcctttgttaccttctagtaataataaatgttctcaaacggtgctagcaatcgcccttgttacagggggtcctgactaacttctgagaaataacttcatatcatttccactttgccctgaactaattcctaaataatctgacaggccatttcagtaccttttgtagaaagaattcctgtttaaaagaggtagtcgtcctagtctctggttagttcatacatctgctgtgtaataaaaaatgaactgtcagaagccgtctagttttgatatatcacattgaaagagagcagtacatggagcttaga

SEQ ID NO: 22224 - DNA, 1223 bp, Mus musculus
atgatggtgtctctcttacccttagctacacctcgggtctggggtcagtttgcatcgtctttattaggctgggccctaccttgttcacttgtgttccaacagcgacctatccagttatctgggaagggttttgttttgttacagagagcatccccacacctgctggagtgggtggttttattttatggccactattcttgaaataataatactgctttatttatttatttatttatttattattattattattattattattattattattattgcttttgttttctccttattctcagatccgctgatcttagaaactgcagcatgaagaatgccaagagctgtacatggaaatgggactgcaatatctcacatcaccaagatttgatacagatttctttcctcagaaagaagacatctgcagaagcctgtttggaatagaacatgtgtggaagaaacatgtcacagattccgatcactataaataacaagaatgaacctagtttggtgatgatgtcatttctgacgtcatcagggcgtgcacaggtcgtttttgcctaggcacagttctcctgctgtggagattgatggggaagtgtatttgtgtgctcgctttagtgaacgatgaatgaaaattaaaatgtagaacttgcctgtttctgaaaattaatgtaataaatatgacacatcttaaattattctcccacagtcaaattcaggagcaatggattatttctctatcactcaccaaaaaaaaaaaaaagtgtgtgtgtgtgtgtgtgtgtgtgtgtgtgtgtgtgtgcgcgtgtctgtggtgtgtatgttaacacacacataaaaaattagatgcagaataaagaatagctgatcattttaatataataatttgttttacaagctaagtatggaatggtaactacaggttttttaaatagctatagaaaacatttaagcattgcaaatgccttttttttttttataaaaataacacaatcattttccttcttcctgggagacccacgactgctctgttgaattactgcaggcctctcttcatagccctacaatgttctgtgtaatatgagaataacaaactgtctcataacgttgctgtgagaactatatgaaatcattaacacacaattattgaaaagtgtatacaaatactaattaaatactcacctgctgcataattgactactgttactttgtcccatatgttt

SEQ ID NO: 22225 - DNA, 1245 bp, Mus musculus
tgtgatgtctgcctgcctctcagatagtgcagagtagttccatcatcaaacgtgtctcccaggcaaaggcatcctcacaggtctaccctgccaagtcagctgcgtcccaagccagagctcagctcccactggcctttacctcctgctccctaacctttctgttagttggcagcagggctctgtcttctcctctattgtaaagaatcctaactgaggaagaaggacattgcggtgatcactagttgctaattcatgttacagttttgcttgcatcaggtgttttcgtgttactgtttttgtccccctgtcctcatcttgtccagtcagtataacagctgcagatggagtcccagagcttccgagtgtggcagtttggcacacgtgcttcttcctggtgacacggagcccctgtggcttagcattgcgcttgcatgtctagtagctccagtgtctgtttaattggattcttttgcctaaatttaggattttatttttactggtgctaagtaaaaattttgcctgttatgacttgtttttgttaatccttgatctgctcagttgacaaacccttgttgttataatataaggatttgataagaccgtttgtggcagtgggggctcaacaggtcacgtcagatctccttttgaagaatgctctctgagcaggctgtcttacaggagtgagtttactccttggccaagcagtttagaatgctttcagaagtgggtaatcctgagtattgggtctgcaaatcaccaaagctgtgaaatgtatagagaatggagtctgttgcaggtatgcaaagcagtggattgagggtgcagtgttgatgagaagaatttactatatggaaggaagttatcaaggttagttaggaaaaacagtgtgtgttagtaaattcaggagaacacacatggcttacaaataccacatagccaaacaaaggggggcaactgtagggtatttccattcttgtgaccacaaaagtgagtgagccagaacatactgggaattaaacaaagtagggttaagttttcattaaaggctgtgctatgcattcaccattcctggttgccctggcaacggggctccttcgaatgctaatgacattataatgagaaaaaagcccacatatgcaaatgcagtaaatagtaattagaggcagagccatacgtggaatggcgagccccaccttgtgaaggtctgggaggagttggtgaggggtttgtattggagacaaagag

SEQ ID NO: 22226 - DNA, 1193 bp, Mus musculus
actgtgcctaaaagatccattaaacaaaagagcctctagcatgtaagccccttgcccaaggacaaatattccctaagatgctggaggctattgttcatataagataacaagcacaggtttccacttcccaaaacaagtttggttgatacaactgcattggatgtatttgatcccatatacacatgcaggaaatacatcaggatgtatgcttgtcccaagtaggacaaaggtgggaaacatagccttatatgtatgctttataagcacctggacaacttaacttagttcatggccattttctggaagcacctggaatggacctgaccagagtccatcatcctggccagtatttaaattaaagcttgcctttccgcgctacccgggaacgggtccatacatcgttgttcttgattcccatcgtaacttaaagggaaacttacacaatgtccggagcccttgacgtcctgcagatgaaggaggaggatgtcctcaaattccttgctgcgggaacccacttaggtggcacggaccttgactttcagatggagcagtacatctacaaaaggaaaggtgacggtatctacatcataaacctgaagaggacctgggagaagctgttgctcgcagctcgagctattgttgccatcgagaatcctgctgacgtcagcgtcatctcctccaggaacactggccagtaccaacattataaaggaagtgactttgattgcgagttgagactgttgattcatcagagtctggcaggaggaataattggtgttaaaggtgctaaaatcaaagaacttcgagaaaacactcagacaacaatcaagcttttccaggagtgctgccctcactctactgacagagttgttcttattggaggaaaacctgatagggttgtagaatgcattaagatcatccttcaccttatatctgagtctcctatcaaaggacgtgcacaaccgtatgatcccaacttttatgatgagacctatgattatggtggttttacaatgatgtttgatgaccgctgaggatgacctgtgggattccccatgaggggaagaggtggttttgacagaatgcctcctggtcagggtgggcgtcctatgcctccttctagaagagattatgatgatatgagcccttgtcgaggacctccaccacctcctcctggtcgaggtggccggggt

SEQ ID NO: 22227 - DNA, 1196 bp, Mus musculus
ccactcactgggctgtatatagcaaaagctaggcctcacactcttcactgtaagccacccttgaactaaagttgtccagattgtttcaactgtcctcaaaactttcatctggcttggaaggagagtctgaggactgcataattatctaggtcctgggaaagaatcaggctttgtagaggaaataatttcaaattttaaactaagtaaagccatataagctggcttgttacagttccttattttcctgaagttaaaggtgtgtgcttaattgctcatagagcctagcatccatcccttgcctctgtgtcaggagaaccctgctgacgtccctgctaacactggactctctgtccctgtagtactcccccagcatgaccatgagcgtgtgatccgttgccgcgtctctcatgaaaaccatcgtgagtcagcccatcacagaactactacagaagaaaactactcgtcgtgtacagttagacaaaggaatctcagacaaccagaccaccttttagttcctgctctctcccctattttgagaagaaagcgggtccaaatgtgattcaagcaactgtacggagcggcacattagcattgcccccaactgaactgcgatgattatctgtgtgtatgtgtgggaagagaatgcatcgtatatgcagatctgtatgcacatatacgcatacgtgcattgacccacaggacattgtaagatagtatcacatgacatcttaagtagaagtaagtaggacttttatgccatcctttttttcacgtttacactttaattattaaaggttgctcctgcccttccccaactattttgtgctgtgtacatcactgctttatataagttattttttaaggtgaactcagatgttatggttttgtaaatgtctgcaatcatggataggaataaaattgcttatttgagagctttcattcactgtgtctgaagcaagttgcccgtgagccccaggttgtaccaagtagagacagtgacttcatcctcatgtccaaccaggcacccagttaccttctgtgcaaagtagtgtggtgctttgtatataaggaaacccctcaacagtagctcagccagggcttcatacagtacacttctgcaataactgctttaaattgagttctttcttgatttgtgtgtcttagatgatgcagaactcattagctaactcaaatga

SEQ ID NO: 22228 - DNA, 1198 bp, Mus musculus
ttgtcaaagagttcatctataatcatgccttcagctctattgtgtacctggaattgaactgatcagactgattgttcccttgaaactttgtcccaaattgttctgggttttaaatatgctggcaaagaccattctagcattagactccctaaagtctgatccagattgacaaagtcgatctgcactgggttttcagtcttatctctttgcagggtttagtgctctgtctgacacctgcacaccggaccccctcagagacagggaaatgtgctctgtatatttgcctcatgagctgttcttcatcctaatttgtttgtgacttccttgtatggaacctgtgtgttattaagccacatgataggaggaggcagggaagaataggatgaaagcatcttcctaggcctctttaactgactgtggcatagtccttgacattaaagttggcaatgtctatagtctgaattcctaacatcgcacattgctgttattctgttctcacagggaaataaatgcccgacttgatgcagtatctgatgttctccactcagaatccagtgtgtttgagcagatagaaaaccttcttcgtaagttaccggatgtcgagagaggactatgtagcatttatcacaagaaggtaagtggtgaaaatcaagcctcctgagactcagtgtcccttagataacaactggaggtcctgatggaaaaccacgtgcatctcactagagcttataagtagcacaagaaaacaactgtagctgcagacattttaattgtacaatttaagttgtttgtattccagtatttatagtcacaaaaagttttctcacttcttgagactacagcaacacagaagtacttctattaaaatgcaagatgctgtgttatgtcatccaagttcagaccattgtcaaaatgagaaacttactttgatctgcaactttgaaaaagagaagccttaattttttaattttttaaaataatctttgccctaaacaaagggaaaatccttttccatcctttaccctaagatggtgtccatccttgatgctaacatgtgtttcttggatacagcagcaggataaatcctgtgtttgaatcctttctgttagtttatttattttttgttgccagaattgagaccatccatgttgagagttatcagtgagcagtgttggcgcctgttgctgagttgtgtgtg

SEQ ID NO: 22229 - DNA, 1122 bp, Mus musculus
gccatttacgggaccccatgtccattgttctttggcatctgcaatgaaatggttccggcaccttctttccttggtttcgggtgtataatattgaacgaccaatggagcactaatgtggatcatcttgggataatatctgttgtggttagttttagttgccaacctgacataattaatctgggaaaaggtgatctcagtgaaggagtctatgtatgtagggtagtatcttggagagtgggaggacccagccactgtgggtgagccattccctaggtttgggtctgaatgttaaaggattggagaaagagagctgggcagaagtatattctctatcagtgcttgactacagatgtgaccagctgcttcaagttcctgccacctgatttccctacactgctggactgtcacctggaattgtgtgcctaataagttttccccctgcattgctttgccagggtattttatcacagcgacagtgcagaaagctcagacatcattatcatttctcatccttttgacagtgctgcttcctgttgtttgtcaggcttacccaacctttcactgactgagctaatcggatgattctcatggctcccctactgctttattttaatttcttagaaggccttttaactccttcaattaaaaaaaaaaaaaccctccaaattacgtgaattgttttatttttaaatccttgaagtcattctttggtcattggcattttaatctgtatacagaagttaaaaatggaactattgctacttagtattaacagatttgtgctaagcaacaccacacacccctttactgtctccctgcccacataggcatctgtaattagtcctaacatgttttctcaatgcgactcctcactagtctcagtataacacttcaaattactgctacctgcttcttggtgctgaagattccaggtgcggctcttcttgttcacttactttaccagaaataaccatctttgtaggtatttcttaaggtctgtttatagttatttccatttctttcataatctataccctactccctacccaaatgcatcccagcttggttttcaagacagggtttctctgtatagccctggctatcctagaactaagtttgtag

SEQ ID NO: 22230 - DNA, 1102 bp, Mus musculus
tttcaaaggacttgagttcaaatcccaacatccacatcaggtggctcacaaccacctccaacttcagctcctccggcctccacaaatatcagtactcacaaaaacatataacatataggcatcatttttaaaaatataagcaaatctttttttcaaaatattttatacgtagtaagactgaacagctgtaaacacgcatttaatgcctagtacaaacttaactaaaacaagtaccttccagtctctgcctttcagcacaggttgaggagagtgataccttgtgttttgttttaaaggaagccatgaatcaaccaggccacctcagactctttgtgacaaggatcatgcaggaatttgaaagtgacacgtttttcccagaaattgatttggggaaatataaacttctcccagagtaagtatacaattattaattagtgagaagcactttaaggactaactacagaaagaaggggaagcaagtaagaacaaagcacaatgacatatggatgaaaatttacaaggctcagcagaagccataactgacatacaataaattagtaataaaaagaggaaagagaattataaagaagagtaacttttcagatttgatttgacatagcaatgtgttatgtagaaagatactttttaaataatatttttatttatttgaaattttcatacaatgtatttggatcatattcatcctctcctccaccttcttccagatcatgttctctctctaagaacaaaaacataaaaaccatggagtccagtttgtactggctgaactcccaaacatggggccagcttggaggatggctggtagacacagttagttttgaagaaaacaagcttctcctcacagcactgtccgctggctaagggtgggctttgtccccactcctgtgcagctcttgtgctgtcacagtcactgagctctctgtgcatctgtgtcctatctgcaaaactctgcttcctggaagccacccaccacctctggctctacagtctttttctcccttttctgtgtagatcattgaaccttgaggaaaggagcatgtgtgctacagacatcacattagggctgagaattccaaagtct

SEQ ID NO: 22231 - DNA, 1161 bp, Mus musculus
ctcacattgtgtgaatatagatctcagctctcccttctcatttcttcatttttgtccctattctcaataagaacagacttctgtgtgatcagcttcatttaaatacctctctaatgcttaccagcttttttaaaaattggatattttatttatttacatttcaaatgttatgacctttcccagtttctctgcaaattccctatctcgtccccgccccctccttaccctgcttctgggagggtgctccccacccacccacccactcctgcctcactgccctagcattcctctacactgggcatcaagccatcacaggaccattgatgccagataaggccccttcgactccttgagtcattcccctaactcctccattggggaccctgtgctcagtctgatgtttgtctgcaagcatctgcatctgtcatggtcaggatctggcagagcctctcaggagacagctgtatcaggctcttatcagcaagtacttcttggtatcaccaatagtgtctaggtttggtgtctgcatgtgggatggatctccaagtggggcagtctctggatggcctcccttcagtctctgttccactctctgtccctgtatttcctttagacgagaacaattttgggttaaattttggagatgggtgggtggccccatcccccaactggaaggccatgcctaacctctggctatggtctccacaggttctccctcccctttgtttcacctaatgtcatctctgtggggtcctgggaggctcttgctttcctggaatctggaactttctggttgctaccctcagttccccatcctccattactacacgcctctgttcaatttcctgaccctctgtatacctcctccatctcctcccatacctgattctgcccctcttttccccctcccccttctctcttcctcccaagttcctgccaccctccatttcccttgattattttgttcccccttctaagtagaactgaagcatccactctttggtcttccttcctcttgagcttcatgtggtctgtgaggtctatagagggtattccacactctttggttaatatctatttatcagtgagtgcatactatgtgtgttcttctgtgacttgagttacctcactcaggatattttctagatccagccatttgcc

SEQ ID NO: 22232 - DNA, 1115 bp, Mus musculus
ggcaagggcagaactggaatgcatttgcccaattgacttcaagaagtttaactacattcatgtgaggaaaatgatagaagtctttaaggtaattctttaggatcctgggaaattctctcaggtaaagaaagattacagcagatgagtaatatatgtcttgagagctatttataaaaattgtaagaggatcattttgtttccatttattaaaaagttaaacttttttactttgcaaagaaaatactacaaacatttttatagtcataactgttaatttttttaaaaagacttttttttttggaaacaattagctgtagccaaattttgtggttacatttttgctatagtggagtttgaatgcaatctgtgtggtaagtctactgtttgtttataaaggtctctgacatggttagattttgctaccttttaaaatagttatttttccccattagccacaaagccaattatggatttgtatttgtgtttttcaatgctaatttttctatgaagcacctgaaattgactagccttttcctatgtagaaaactcaaacatgttaactctgtactttaataaaatgtaaacttgaaatcatgttgtttgttttctattagacacctgactaaagtctccagttagcctttgccagagctagtgccttcttatgtcaaccagagttcaaacattttggcagctatactgatgatggcttgtgattgacaaataaaaatgggtgatttgtggtatctaatttaaggccttgaagtacaaatagaatggctaaatcaagctagttaacatgtataacttttttatggtgagagcacgtagtccacctgtgtaacaatttaaaatgctgttagatacaatcatgtttcagagcacttcccttgaacatagttcttcgaagcttagctgaaattctgattcttcaacatgactcaaaagtccttggtaaccagttttacaatccacttctgtgttgacctcatttgttgtttgtgttttaggagctacaagttgaatacagagcttcatgtatggtaggcaggaacaatatcactgaactacagcctagacaccaagtctaaccttggctttcttaagacaaattt

SEQ ID NO: 22233 - DNA, 1150 bp, Mus musculus
cataaacactcataagaagcttcttattgtatttttggtagtaaaataactttattaaagaatctacatacagtggcattccctaacttatctaacataaattcacatacattttaacagtttgtatatttgtaaacctacaaacacaaggtttaaaaggttctctgttctataagggtctctgtgctcgttatagttagccccttttctgtaatttcattttgcaaatctgatatacaatactcatcaaaacataacttcatacccctcttccctccttcgacagcatttttgcgttctctgtcatgactgcgtacctccagtatgagtggagacatacagcatttgccttttgcgggctgatgtcctcatgtggcatgatgtcctcgaggttcatctgtgttacagtcaattacagaatttccttccactacatgtacctgtatacttcattttgttggtccagccacccactgaaagacactgagtttccctctaccttttgacctctgtgactaacgctgttatgagtctttatgtcttaaaatatttatctcttcaaccctgttttactagtccagtagcatattttgctgggcagtttgatattaatatacatgttttgggctctctttttttcctccttgtgtttcactttgatttctaataattttgtgcaattatattaatttccctggacctgtcaaatccattcttatttccattatttttaacactgtcacttgattcttgcttgcagtttccatttctctgccaaaattcccaatctgatagagcttggcgtctcctcttctagtaagagcccatggatgcttccccttttgatatttagtgctctttggtacacattgcaacctattgaatgttaaatattgcataaaaagcaacagtggcttagagcagttgtcccttttatccatgggggattggttccaagaccctttgtcagtaccgaaatctgtgggtcctcaagtctcttacttatgtcaggttgaatggtatttgtgtatttatccctctgtacacttaatcttagatgaagttgactcatataataaatatgctatgtaaatacttaacactttattatttagaaaataataagaaggctgtttatgtttagtacaca

SEQ ID NO: 22234 - DNA, 2187 bp, Mus musculus
gtttagtctagcaatgttaagtatatttacagaaaatatgcagttacatttatttatatatttggcaagaaatcttttctgagtgatcaatgcatttcaatttatgaaaaataatggttagggggcactgtttattatagataattttaaggtatataactgttttcaaggacggccacttccacctagcggtcaagccgagaggactgcatctaaattgtgactgtggcagatgggtcttcacagaaaccatgtctttattcaaacttcacaaggctatattttgaactgttaactaggcatttcaaaacaggagataccttcaacagactcttctccaagagcaggttttactgtttttttgatgtaattttaagacatttagcaaacatgcatttctttatatgatacatttctttcacaaaacaatttaaaagtaagccaagtgctgcctgctctgcgagtaggaactgcatcagaatcgtgtatcttgctgtacaatgcctgtgatagtgaagagggttcttcttagtgtatgcttgggtacctaactctggagtcaatgaatgcacccaattttttttgtttgtaccccaaatgattgaattgttaaatacaaattaagcagattaacccatctttctcactcaaacagattctttagtatgttttatatttatgtgtatgtatgtcaatacatacatactaatttatattagaatgaaaataaatcgtttgtttctaaaggtagtttctacagtaaggtgtctctgacacatgtgtatcagacactggaccaccatgtattctctgtgctattccatcctgcctgtcacctccatcaaccttagggtatttccctcacctgtctattatagaaggaatcttttgggtacacatgctcagagatgagatacttctctgagaaatcaggtaataaaatttatttgatggatagaattttgaaaacatatgattttatctatgagtttctgaatatcaaagaataccacgttttcatttaaatagaggactaacactagggatcagggaatttagttatgaagagtttcaaaaaaaatccaaaaaaaaaaaaaaaaaaaaaaacagtgtaagctgttgatatggtaagcgaattattttaatgatgtaataaaatatttttaaattttggcatagtgatcatttaatgggaaaataactcaccaaaatgtctccacttgaattgtactgataatgtgaggcatatgtgtaattcaatatatacatatacctatatgtatatacagaaattatttttaatattttcctactgctgtgaaatttaaaattggaaaattttgtgagtgttttccatgtccaatagagcctaattgtttctttttttagtaacttaacaatctcttgagggctgcacctataaattcccagcttgtcagtagacatgtacagtgtttgggataaggtggacacaagtgcacatataaataaaaccttcttcttgactattttaaaccttcactcacatgaggagagcctctagaaatcatagcctctgagctataggtacgtcactcacacaaggagagcctccagaactcatcgcctctgagctataggttgtgtgcctactgtagcttttccaccgctgtattatatagacatttgcatattaaaatttgatttttcccagagataaatattatatagtgtatctatatttagatcaaactgtggtaatatattgatcagaacatagtgttggggactatagcctgaacatgtggacttgcagtgacccaggaggagagcaggggtcagtcccatctgtgtataagttattataactatgaaatcttgtacaaaagcaaaaactggaaaaaaaacaaaaatacagtttttattttgaaatacatttgttctctggagaatgtacttgatcgtctcctcagtcttctaaggctacttaagcgtttaagggacggcagcgtttacttcaaccctacaggtgctactggattctgcattagtatgtgatgttttaaaatcctaactttgacataaaaggttttataagtatttccctgcctggaaaattagtttttattcttctttcttcatccccttctctcgctctgcctctctagacttaaaaatgaacattcatgacattgcattgctccttgt

SEQ ID NO: 22235 - DNA, 1163 bp, Mus musculus
ttttagagtgggccagtgcagaggactgggacatggggaagggcatgacaaagaggggcagaggcacattagaacattgttgtttatatacaaggtttgaacgaggcattgctcactctgcggtactggagagatggtgaggggattttgttgtaaagaagtaatgcaaaatagcatttataaaaccaggaagttatgggaatgacagtaatcctgctgagagtctggccctggagatggtataaaatatgcagtgatgggtctgaagagtgtctagggggtgaaatgagtaggctgtcctaacttgtccaggtgctgtgggagaatacaaggtgactgctgggcatcttaaaccatggggtgagttgaacaagaaggaaaagcttgaaggcagagaccagaagcatggattcatgtctgttgctctttcgtgcaagattgggcgtgactggagtaaatgagtttcagtgtgaatgaatttagtgtgtatgaaaaatacccaagtgaaactgagtctaggtgtgaaacttaggggggagatgggagctgaaattagctacttaggagtcgacactgtggcagcacttgggagcctcatgacagggagaacccaaagtgaaggtgagaattaaggccaggtgcagcttgaagaagagtagacagaggggtggcttggcctgcatggtgggcctctagaagccatgagtggagttccagaaagccatatttcacatgaaaataaagccacaactcaactcaggtctcagggtgatgctttaaaatgtgttccattgagatcctttatttgttttaaatatattttaggtttaaaggaattaaaaaccaacaaactgaaatgtactatcttagaatactgagatccactacatataacatggaaaaatattgaaatctgggttaactaatttttaaggcaaattggtaggattgctgctgatttctgtaggaatcaggactttctcagtgtagcacagaaatggcacctgaggtgatatgtgtctccttgagattcattttaacatttataacaacagccttattgtctttaatggtgagctgatcagattctccataccattgtttgtcactgtattggacttcatgttgttatgtcaggctgggggggggggggggggaggggg

SEQ ID NO: 22236 - DNA, 1177 bp, Mus musculus
aaggggtgtaatgcggcattttaggtttctccatgcaaattcctttgtctttcctatgaagtctttgcagttaccggtggcatttccctttcctgtggtttccccttattttgtgtgatgtaacaagggttgcatcctatagcagtttcttacaatgttttcgacacagtccccactgccttgttgaatctctctctgtactgtatgcactgccaagtgtgagaccataatatgtagtttaatgagaaacggaaggatgcaggtcagtttgcatgagtaaagcccactggggctacataaactgacacttttgtcattttacccagttgtgggtaaatgaagactacaatggcagactgactcaccattacttgctttgtgcaatgttataaaggcaaaacactatgcactatgcttggctttacagatggcattcccaccatgacattaagtggattgtccacagcatactataaatgccatctcttgcaaatttatatacgtaaatatgctcaattaacacttaagtattacaagtataaggaaactactaagcaggcatttatagcaatactatgaaatctccaatcactgttttgactgtcgccttctccttagtgcagcctttctgcatcgtagttgctgcttttttacatttcacactcctgacttcagagttaagtacttgctcatccagtgttgcactcacctttcttattgtacatgcaatgtaacaacacacagttttggtgcttaacaatattcctttttttctttaataaaggatatttatttgaattaacttgattttgtttgtttatatattatcaccagtaacttttcatttcaaaatggagcatagcaatatggtacaagtttagtaagtttattagttacttccttgacaaggggcaaccttgggagagagcttatttggcttagagtttaggggaacaagtccatgacggcctggtcacgaaacagaccccttgtgttcagcttgctttctcctttccgttcagtccaggtaaccacgggatggtgtccacacattcactgaaagtctttcttcgtcagttacacctttgcaaaaacattcataggtatttccaatgctgcattcccataatgattcacaattaaccagattcctggactgtccacccctgaactgttt

SEQ ID NO: 22237 - DNA, 1293 bp, Mus musculus
cggtgcccagtatccacagacactgcttgtctttgctgttcccaagtgttttatactgaagatgggaaagcaggagttaactagatgcttaatctagtgttattattcatacttgaatgtcaaatttcaaatatgtccccgatacaaccaaaataatgtatagtagccgatgtgctatgtatagaaaagatatctctaggttaaaggtcctagttggtttttagtagtaagaaattgctggcgaatgaggattttagggtctaagcaatgaccctagttaaagagtgctttatatagggatatgaagttcatgagacagcataaaaacaatcattccttagttgctcatcatgcacttaaaactttcttccccctccccattcctgagacagggtttctccatgtggccctagctgctctggaactccctctatagatcaggctggcctcaaactcagggatttgcctgcctctgcctcccgagtgctgggactaaggcatgtgcgactacacctgttgcaaaatccattttttaaaagatactggtgtagtatagtgaacactttgtggactctacagtgtgtgtgaacgttcagagggttctcatttgtataaatatgaatgtcgaacaatccttggtgccacagtaagtcctagaatgtggtaagttgcacggtgtactgcagacaccacacactaagaattagaattcagtaggatatagaatgacagcatccacatggcatgggggcacgcacattgatacagttgcattctctagactccctgagacttctttatggaatccactcacagaatatgtttgtatttatttaaaccaatattttgagtccagccttgtaatacactcatcaacagacatcaatctgcacagtgactttgggtctttagtgggcctgtcagggagttttgagctttcttacattttaccagtaaaataagtatagatcctgaccaactgcaggacatttcagactattgcttaagatgcaagcacttgacagggaaagcggagacctttaatttttcctcatctttgcactgaatataaatgattatataaagctaaatgtgcatattgaacattttatttgtgcttggtgttgccagtgaccatcaagactttagatggaagagggtgagaaagcagaagcaccttactgctgagcacactgtgttcaggcctcacgactgcagtcgtgaggcctgaactttatgttagagcatgttaaaatcctgcctaattgcttggaaataggaggcgatggtatt

SEQ ID NO: 22238 - DNA, 1149 bp, Mus musculus
gctctttttgcttcacaagtcagctgttagaactccctctgctaataaccagctttattggcaagacacatttcttgtaacaaaggcagggagcagatgttgctagtggttctgttggctgtgagtgctccctgtctgtgagctcttactcgggctttccgcacccatgaccctaaccctaaccctaaccctaaccctaaccctaaccctaaccctaaccctagccctagccctagccctagccctagccctaacccatccgctcactcatcttcctgtggagcgcacagcccattgcagtaagccagcatggagacatgcctgtgccgtggttttggtttccatgataactaaatgtgtttttatctccacccccacccccacccactattgctcattctgtctagacttctgctacccagcttgtgtggctctgttcctgtcatgcctttggacttcactgtcctgtgcctgaggtctctctcccctctgcttcacccattctgagctttaggatagtcctaagccctgcccagaggaggtggactggtcattctgtgtccatgctaatgggagttgtgggtctgtggcatctgctaaggaggattattcacagttgcatggaatctgtcaagattgtggctatatctcccactatgccatggtctatgctgttttctcaagcagtggcaagaaaggccaggatagcacttcttcgccctgagcagtctcagaaaggaagtggccatggaatgttggcctcagtaaggcagaggagacaccatccatgtccctttcattctctgtttcactgccctgttctggggctctggattctgggcttggagaatgaggatacactatttgactgtcagccctttctcagaccctcatacatcttaccgatgtgagtccaccagattcgcagcagggtgtgtcaaacccagtggtacttctcattaacacctctgtctcattcacagtttatcaccaacatcagcaaccatgtctgcgacataatagatagccagtactttttaaaaatgaattaataaacaaagtaaacgagaaagagttacctggcatttactagtccagtgagctgactgtaagggcagaataaatatcctccagcccttccgattctgt

SEQ ID NO: 22239 - DNA, 2083 bp, Mus musculus
aaactttgatatattcttctgtcttatctttttaattgaactaggatttgtgtttggcagctgtgtgtgtgtgtgtgtgtgtgtgtgtttgtttttgtgtgtgtgtgtgagagagagagagagagagagattgattttgacacaggtattaaggctagcctaacccttgaataaaaagaacacacagtatttaagggatttttcttttagcctctcacttttagttacattaaaaataaaagacccttgtgattctaatatgcttgatttcttaatgtacctgtcttttacttttaagacagactaaatccatgtgaaacattgcaccaagcaatggagagaaagctcaagtaatatattcattattggtaacatccaatttacattgttatggtgcagcacaaactgatgtgggttgagacttttaatcatttttaatgctgattagctgtctcaagaacatttgtaaggcagactgttgtagtttggaagtctcactagtttagattgcaaaatgatagataggctgcaacttacccaagttgactttaaacaaagatgggctgtcaaagacaggatatcctttaaaaatgagctgaagtgagtggctgagccactgtaccctgtccccaaggctgcagtcggggactctgtgcagagctggggtgcagttccttgaggtctgtggtattggattatacatctgcccatgcagggccatgctagatttgcttgggaatttactaagtacaatagtccaaaaatgtttctttgattgaggaaaaggtagaattcagagtatgactttggagttgtgttttgagtccccatgagtaggattccccttcgttctcacctgctcatgtgtggctgctgagcgactgtgcttcatccagtgtggtttgatggacactgaggtcactaagggtgtaagagttcacagaaacaccagtacttatattctaaatccaggcttattcttctctgatgtacaaataagagacacatcagagattcacaaaatgctaatagttttttattttcaaaattgggaatgttccctgtccattatgtggaggtccccagaggtggtattattaaatggaaaagaatagttataactcacattatgtttttgcgtatgaacaaggaaaatgctgttttcaatccaattgtttggattcatacacgtttgaaagagattatgttgtttgaaaacacaaaggagctttacagccatggtggtgtctgtggctgggtcaggtgggagcggctcgaagcccttacctgctgtcctctcagcagcagtctgtcagcagtgcactgtgatttggtgaaagcctgttgacgtcttctattcaatcccaatgttactgcagccatgagacgagctgcacgaggacaggcatccatgtcacgtcttagttggcgatgttaaatggtgactgttttatttaaaactcgggtctgatcactggaaacgattgcttggtgatttgtgatttggggctcggttcattgctctagggatgtttgtgtattgtgtaggtgcgtgtactactgcgctgcccctgtggtatgtcacggttctgtgtaaacgccctccatgtggccctctcatgttgcatgttttcagtggtttggaagttttgtatatttattgtattaatgcagagtgtcataaaataaaataatgtttactggatgtttgtttgtataattttaaatactgtattagcagttgaggcacaaattatacttgtagctttaatacagatacttatttgacttttattaaaaccaatctttgtactgttttatcacatgctaaatatagtataaaagagttagtgtaaaaccctcagcaatacaatccaacagctttcccattgcattagaccttgataggtgcttgacagtgagccctacacatcaaatgctgggactcttgtgaggtaggcaagattacctacaagttcattacatttttggcttaggattttcttcatgccagcatcgtactggtaactaaacccatgcgatttcctgcgccagcttccgctgctgctgtacacacagaggg

SEQ ID NO: 22240 - DNA, 1163 bp, Mus musculus
tacactttaaagcagagatactaacgctttgttttttctgggccacatgtgcatgttatttcaagtactcccttttatgagtttctaagaattaatataataagtaagattttctagaaaaattttaaatagctgtatgtgatctttgatttttgtgggggaaaatagtaatgaaagaaaattccttccttgaatcatctgtctaaaattctaccacaatccaaaacatctttcgagtaaaaattatattaaaaatatattctccattaaaataatgtaatcaaattctaataaaataattcataacaaagaagaaacagaacaaataattgcttattaaaatcagcatttatgggcattttagctttatttgctagctgtacttttgtgttttgttttttaaaaagacattttttgtatctattattttcaggtagactttgaacatgtttaattaatttcaactcaaggttttaagtaagggcttatcttgcagccactgtaattggaccaaataatcacgtgcttcccacttggttattatgtagcgccttttgggttcctgtgcatctgatagaacggctttggactggagctcaggcaaggagcagctagcactaaccttgctatatgaacgtgcttctcacttacagttctctgtaaacaccaagggaaaacactttgtctccgggctgctctggagctctcgaccctcatctgtgcttcagagctgggattaaacgcatgtaccatgataaccagataatttccagtttagttttgaagatggctattttattatttttaaaaacttttgttatcaacaagtgtaaattaggtgacttttctctggttaagttattttggatgcttgtttctttatgaaacatggtttcgtgtaacctaggctggcctcaaactccctgagtaggtgagggtgactttgaacttcagtcctcctacctctgtctcctgagtactgagtatccagtggtataccaaatacagtttatgtgggggtggggtacagcacaggggtttgtggttgctatcaagccctctaccagctgagctatgtctccaactgctgtgtgttttccctccctccctctctccccctctccttccctccccctcctctttctctttctctctctctctcc

SEQ ID NO: 22241 - DNA, 1181 bp, Mus musculus
taacgtcacttaggttgcagaggtgagaggtattctagaagctaagagacagctgcagaggacagagagtaaggtgaatttttcataagacacattcactacaaacactgaagaatatgctcatgatttaggttttcattgtatttaagcatcgaggatgttttgctcattgaaatttgcattctcccagacagattgcaattgaattgattatacgtatttaatatggtaatctctttctttgtctttcagaaatagttgttgctgagagtgtggttgttataaagaaattgttgcaaatgcagcctgcacagcatggtgaaattatcagacatatggccaagctcttggacagtatcactgtgagtgtccctgcgctctgctgactttgttcagtacagtactttccttcagtggtcatcccagagcagaatggttaagagagatgggatgcctggattaagttctggcttagattttgttagggctgaattacagacctgaaaaagggaagggagcatgagcccagcactgggctgtggggaagtggccccatcttggtgggatttaggagcagatagggagagattaaattagtacatgcatgtgcttgagttacgtgtcatgtgtgagatgtgcagaacaacatgctttcccagtgctttcctttgagagaccctagaaacaataacgcccttctcagtaagcacaccagacacctgagatcttctgctattattgagatgtactttaatgccaacaagttttcattttaaaatgcattattcagtaggatttgtgtgctctgaagctgtgcagatattctcattactcttagatggtgatcccatactttaagcctcagcctcccctcagcacctctaacttacttcttgtttctatggctttgttttattcttgatgttttatgtaaacagactcatagtatgtgaccttgctttggaattctttcacttgcatgctttcaagcttttttttttttttttttatgaaaataacttactccatcgactatatttttgcatgtgggaaagtgtgccatagccctgtatagaggtcagagggcaggttacgggagtctgttccagatgggggcagtttgggactacacacagagaaaagtccgtgtacttcccatacataactatgtgtaaacagtg

SEQ ID NO: 22242 - DNA, 1097 bp, Mus musculus
aatatttttgcaagtcataaaacttatttaaaaattgaattcttacttatataatgaatttaaagacttccatttttcaaaagtcatataaacttgtagagattttgagttattaatgtgaactcaaaaacacttggagagttttacatatcctcattttctacttaaaaaaaaagcttaaatatcttcttaaataaagagccttgactagtgacaggaagtacaacaggggtggggtggagggaccagtgttttataaatgacatgtaattagggtaagttattcttatatggttttgtaaaattgaaaaattatagactccactgcctatgaagtgttagcatccacagaggcactggaagtcagtcaggacattttgttccctcctcactggggactccagtgaggagttcacatcttgatgaccaagaatgcgaagagcagggtcctatcctgagaagtcaatgctgtgcattgtttgtgcccacgttttcctcagatcacgcacgcacttggttgatcttaggatgccatttcctgtgttaggcgagcgtttgtgtgtgtgtgtatatatatgtatgtgtgtgtgactgtgtgtgtctgtttatttaaataggtgactttatttaattcccccttctatcaaatgctgtggcttttgctcagattatgagtaatgaaggcagatggtagcctctttgccttcatttagctgacagagagttggcgctgaaaattcatgtcttgaatctacaacttgaatcttactagttttctttcatccggacagtgcatttggggcacattgagtgtcagcacaagacctttgaggtagctggagtatatgacttccaaaatcgttaattctgtggtggttcatgagtcaagtgtggcgttcctgtggggaggtagcgctttcatgcttcagcttccttgcctgcaaagcagaagctgatccctactttgttacagctcgtcctgagggagacaaaggtacaagcgcgccgtgcactgcagtttgcgctttttgtatgttgctgttgtctgttttggttggttggttgttggttttggttttttgaccgagggcttttct

SEQ ID NO: 22243 - DNA, 1241 bp, Mus musculus
ttacaaaggttactttaaattctgatacgagttgagcttttatagaatattgttttaatgacaaatagtggacagtttatcctttcatatttatgatgtttttgttgaatttaaagttattaaaagttattcactatcagttatctgtagcaggcctgatgtgctgcagtccttagattttgaaaggaaagatggatagcccatgggttgttaatgggcagcttctctctgttctctcctttcccctttctccctctttctcccttttactgcttgttaaaatacaattaattgatctcaaaataggtgtattggctatttctcttggttctgtgaccaaagaccagacagaggtacttttaaagaatgcttttaaagaaatacttttaaatcttggggctggagagagctcagtggttaagagcactgactgctcttccagaggtcctgagttcaattcccagcaaccacatggtggctcacaaccatctgtaaaaagatctgttgccttcttctggtgtgtctgaagacagctacagtatagttacatacattaaataaataaaatctttaaataaaaaagaagaagagtgatctctttggctcatggcgtaagagcagacaatggaaatgtcatggtggagagcatggtagcagagttgggtaggacctgtcctctgggtctgtgggcgggaagcagacagaaatgcttgcctgggctcccctagtcagggtaggtgtccttcctcagttagcccaggtgtgtctcccaggcgaccgtggacatttatcatcgtggtaggtagggaagttcattttaatcagtaagccaaggacgaagctggcttaagctggagctcacagtggaagaagctcaaggggaaaatgtgtgtggctgaccacacacggtgaacgcggtgattccagcactcaggaggttgaggtagaagactctcgggttccaggcaaacctgtgctaccagtgagaggctgttgtttagtagtcaggattgaagaggaaggcacatgatggttgttgttggtcggaatttcatatagttgaaacattcaagaaaactaactagaaaaccataaatctagacataaagtcactaagaaggttgtagatgggatgtttatgttaaagagtaaaaacacaactcatatactctttgtaaaaggaaagtatttacatatgcagggcatgaggcctatctccatgtcatcaagttctcaacagt

SEQ ID NO: 22244 - DNA, 1237 bp, Mus musculus
gtgtttttgcaggtttgcagctagaactgtgcacagtgggtcgctgatgctagtcacagtggaactgaaggaaggctccacagcccagcttatcatcaacaccgagaaaaccgtgattggttctgttctgctgcgggagctgaagcctgtcctgtcccaggggtaacctgcttacatctggacttcagaatctggcacacaacaaaagtgcctggcacccactgctgctgcctttcatttataataatagcccttccatctggcagcaggaagagcgcactctcgacattcttgtctctgctttagaatgctgctgtgtctgtcatgtgtgcactcctcgcccctcctcgctttgctaaccaaagaacatatattttactgtccatttcctcagctccccagtccgagtagcattttctctgccctccgacttcttttgacctcatcttccttctgggttttgagaacagtgggtgtgaatcagtgcttggcaatcgtccttcttacagcagtaagcaaaaattagcaaggaacgtgtccgcatggcctctcagcttggtatgtgaaaaggaaatagcatactttttcaaaaataaataaataaaaatggcatctctgaaaatcccattctttgattttcctggtattgtaattggttattgacaattgtcatcatgaaattacccctgaataatcaggtaaataaaggagtatatgaatagcatttgcctctcctaatccttactggctgaactttctttgttccaaaatatttctggtcacactgtggagaaacttctcccaacaaggtgagctgtttgcttcttggagatgggttcactgagcagcctgctcgccttaaacctgagatcctcctgcctctgctcccctgtgctgggaggacaggaatgcacggcatagctctctaaactaggcagacattctaaccgtgctgcagaatggctaatgagcactttcataacatcaggagcctctgtggaaagtaaaacagctctttctgtacagacttaattgtagagctctgattaccaggctgctaaataagcctggttcctttttcctttaaaaatcttggttttggacttttatcaaaactgactagtacacaattgatttatatgctatttaaaactgtatgaaaattagcatatatctataagttgtttatttgctaatttaggcaagaaaccatctttattaaaattattctttataa

SEQ ID NO: 22245 - DNA, 1174 bp, Mus musculus
gagaaaatcacacacagagagagagagagagagagagagagagagagaggagggggagagagagaaagagagagagagagagagagagagagagagagagagagagagagcacttatgtgcacaagtagagagcaaggtcagtctggggtattgttccttgagagacacccacattgtgtctccagcactgggattataagtgtggaccatcgtgcctggcttttgttttgtccaaaatccaaggttcctcctgaaagccaacatcatattttgtagcatgaccaagtcttcttagttctaaatggcttgggttgctatccctggaaaggtctgcaatgacatcagcattccaggataccctgtgccctggtcagctgctcctcaagaatacaactcaggggctgcagagatggctcagcggttaagagcactgactgctcttctgaaggttctgagttcaaatcccagtaaccacatggtggctcacaaccatccataatgagatctgatgtcctcttctggtgtgtctctgaacacagctacagtgtacttatatttaataataaataagtctttttttttttaaagaagaatacaactcagagagatggagttcccaaatgttttcttctaactgccggatggtatgcttagtcctgctgtccacaccaaagagaagattgatcacaaaccccagaacgtttcaattcctgatgacttactaccatggcaaaagaaatactactacagaccacagtaccacttattatgcaattacatatctttcattaagatggcacacagagccgtagaaataggcagagctagcctgtcttttgttctctgctcagttttcctatctgctctggcagaggcttggataggatgatgtcagacctctgaccccaaccgtctcctatagcatagttggtcctggggaaataagggaatgtaaaaggacagacagacacatgtacagaaaagctggggtcagtggcatgtgctcaccgatggacctgcagcaactatgtaagcaactgagaacctttgagcttttattacttcccgtgtgagaagtcacgtctctgtgggaggtgtctctctgggaggagggagctacagttgcaagtttttgcaccacttggccaatcctttgtactcccacccagacta

SEQ ID NO: 22246 - DNA, 1175 bp, Mus musculus
tacatgaaataaattaataaaaaaatctaaaagaaaattaaagatgttagttaatatttttagtgtcaatatgaatactcaaaaataagcagacagtccgtttttctaatttgattgtatttaacttgggtgacattagtgacatcctgtagcatgggagtaattggagtaccattttacgatggatgattagcaagtccttgtttttactttgtacattgtaaataatctcttgtatgatgatgttggacaaataatgatttttttaatttgtgattttatttaattatttaatgctaataattgtagacaactgtgttcttaattataacatgaaaatatagtatgaaaatatataataaaaataagctaacctctcatttcttcctttcctaggaacaaagggacagaactgttttatacttagaaatcttagaatccttttctctaattctcaagttacttactggtctgtattatatgcagcaaagtattgaaattcctaaacgacaaacttaattttgttatttttcatttcaggaaagtgaaaaagacttggaagaagccgaggagtataaagaagcccgtgtagtgctggattccgtaaagctagaagcctgacatttttctgtatgggatgtttttttgcattaaatcctggggtccattctacaattcattgttttcagccactgctgtgtttaataatatgaaaacgtggttctttttatgcagttgcatttatttttctttgcataacttaatgtgtcaaataaatgagttcatctaataaaattgtttgttttatactttaccaaattttcagttggccacttagttaagtgtcattaaatcaggtgtttttgaaggttatctgaagtgtaaatagttcgtagtcgcaggttgggtttaaaactagagtgtgtcagctgggagcactagggggtctctgcctgtgcagtgtcagctgggagcactagaggaggctctgcctgtgcagtgtcagctgggagcactagaggagctctgcctgtgcagtgtcagctgggagcactaggggaggctctgcctgtgcagtgtcagctgggagcactaggggaggctctgcctgtgcagtgtcagctgggagcactaggggaggctctgcctgtgcagtgtcagctgggagcactagg

SEQ ID NO: 22247 - DNA, 1866 bp, Mus musculus
tcatctcattattttgtggaaaaatggagagcgagaatctggagtacgcagcttaaagttatttcagaagttagaagagaacggtgacttatacccagagtccccttgaaggagccagacaggcgtgcagacccgaaccccgcacagccaacacagcgcgcccggtaccctgaaaaccatcagcacactgaccccttactgtactcttttcttgcctgtgaaggtctgtctgtctgtctgtctgtctgtctgtaacacctgtccactcaagaacatagcacaacatggccttgttgctgtgcaagtggtgggtgctgtgttctgtcccttaaaacggtagaaaaaatgataactgtaaggttgccacacactatttacaagtgttcttttgggttcccttagagactgtctgagacttgtcatgggagatgtatcctctctgctgctcctcagaagccatctgtgtccaacagaaccagacttgaatattagccccccaaaaggaattctactctttaagtacaatgattttgtttggtaccaactaatttaagtcattgaaaaaataatatttactcttgcccactaaaatccctgtgtcctccggtccccaggcgtcatctgagcatttctttctcagtgtgaactggcctgacccctcactgacagaatagtcttcaggtgtttctgggatgcgtcctgggttaggaaggaggcacagctttttctcaggtcaggaactgtagctgagttgtcctgtttgccttaaatggttgagagcagcttcactgttcagctctctgaacatccactaagactggaccatgttcctcgccctaccagcctgatgacagtactcactttgggcactaaaatgtaaaatatactccacacagtaagaatgggggaggggagggttgattaagaaatcttattaaagacaggcaagatgaatgtacgtctacagatgtgtgtgtgtacacacgtactctgctccctagatggacacgcgaaattcttgcttccgctagttctaacattcacagctgtctacagccaaagcttggtagcattaaaatcatagggcgatgagtggcaaaatgttagacgtgaggaagccaagaccggggtaggaaagccctctctccagtgcccatcaccatcactgaacagccttaaaagcagaggccagaggaggagagtgaggagggctgagcgggtgacctggtgaccaagttaggaaaaccagagtgttcccagtccttgctgctggcacagttcacaatgaaaatagctttatataaaaagatagcattacagcatgagctgccttagttaggacgtagcaggatgcaaatgggaaaatctagtgtcttttagccagaaaaccattgttctttgaggagtcagcacaggaggcaggtttgtcatcacccaccctgcagatgtcatgggggaagcacccaccagccaggcagacgcgccgtccgctcaaagtgacaggagtgcatccccttgccgtttactttggctaaattgttttaggctattggtttgtaaagatgttttcttaaataatataagacaaagaactcatagtttgtgggtttgttttttttaagtgcttcctaacctgttttggaattgtgatttgtggtagtaatctattcaaatcgactggcagaagccatgcttgagtctcagtagcagacaagaccctagtcaagcatccagttgttccactccagctgactagtttcccaccaggagaacaaggctgctcagagggcagcctccagcccagtgagagacctggtgtgagtgacagaggtcagagagagggagggggatgggcgactgtggcaa

SEQ ID NO: 22248 - DNA, 1143 bp, Mus musculus
ttgaaataggactctacttcaaaagatacctgacagtttactgtcttctacagttttatctttttatcctgttttttacatttttaaatccttcaaaaatagaattctaatatcattctgtaaagcccctttctcctttgtctagggaaaaaaaaatctgaattcccatagcatctaacacagatatatccttaggggtactttttttttttttttactagtttttgtatgtgtatgtatatgtgcatgcatgcatgtatatatgtgagtgttgcgtgtggcctatgtgcacatgtgcctttgggtgcttgtgtgcaaagggtgaaggatgtcaggtgtcctgcctatgattatttgcctcgttcctttgagacaaggtccttctggacctagagtggggctggaccctgttgaaccccaacagcccagtctctgaccctgcacagtgctgaggtcaaaggtgctcacatggccacgccctgattcttaacaggggtgctaagatttgaacttaagtgctcatgtttatatagcaagtgtccttacccatagaaccatctctctagatatccacctctttgaaccaaggtatgggcttacctgtgtctataactatctctgagtaaagcgggtgacccatgagcaggatgtgcctcccataatgcaccagagagacagtcatgtcgtagtaaatacacagtttcctaattattagggaagtccaggatccatcagttacagaattcccgctagcccaggagggttttgctcagtgactagcatactggcctgtctcttgagagaaccacacatctccagtgatggctaagggtggccttccagagaagttccctacctgtgagacccacagagttctgtggcctaaggcctgttcctagaaggggaggggcacttcccacatggtaacacacctgagcaaagtactcctcggagatccttccagcccattcaatgcacaggtccaagggccggcacgggttggccacgtcggcacacttaatcatcatgcgtttgatgaggatttggttctcaggaaagttcttcccggtagggttgcattcacaatcactgccctcactctgggaaaaaaaaccaaaaaacaacaaacaaaaccgatcagat

SEQ ID NO: 22249 - DNA, 1226 bp, Mus musculus
tgatgaggcagatggtcctcagttcagctctgccagcgtcacagctcacgttcagccttttcccatgttggcaagagcttggatgtttacagtaatctctcaggttgttgtaagttctctgaagttcctgtgtctttacagctgttctagtgctgagtgcatcgagtctcccgggacttggaagcaaatactgtttgcactgaaccagatgtgcacatttgcaaatcatcatgtaaccttcgtaacccacgttagttatcctggcagtcattttgctctttccctcgcctaaaaaaaggcctaactgaagaaaaacctccaaccacagccagcaacacccaccccttactagaatgactgagcacctacctgtattccactctctgtcctcccagctacatcccagccaggccaggaagttggcatcgtttctttggagatcccaggaattattggaggagctagatttgaaatgaacccagacagctttcatcaagagccatgtttagccagtgtagccagtggtttcaatgtggttctgagggtgtgggtttcggttcaagtgctctactctctatttcaggttctgctaatcttcgcaaaggaagatagccagagtgatggcttctggtgggcctgtgacagagctggctacagatgcaacatcgctcgcactccagagtcggccctcgagtgctttctggacaagcatcatgaaattattgtgatcgatcacaggcagagccggaactttgatgcagaagccgtgtgcaggtaccttcctccacctaaggtgcttggtaaatccccccaccccatctgctctaaattaatttctttagacagctttggctcctagcactgaccctggactgtagcttcttcctaaagatgcatcccgcctttctatttctgcatgtttaaatttcattgagtttaaagatgtcagctggactcatcctaaaacttaaagatggcccccccgcccctccagagtattgctcataaaagagtcattaaaattcacacagattttattacatgtagtttagatttaaagtagatattttaaacttcattattctgtcccaaaatgagcatcagaaatgtgtgaaacagaaaattttccatacgtgacacagatggatagatacagcaggctacagcagacttgccagagggaagaaggcagccacctcagcaccagagtgttcctgggggcctgt

SEQ ID NO: 22250 - DNA, 1162 bp, Mus musculus
gcacacacacacacacacacacacaccccgatgggtataactaccttaatttaggttcccaccagccttagaaaaggatccctgtttctccatgtgaagacaaatggccaccaacaaactatcatttactggccatttgcatctccagcttattaattggacgctttttgtcactgtttggagttcgttatggatcccaggtcttcatctcccgttggatgtgtaacggacagaggctttctctcatcctgtaggtggtctctcctcactgatgtgggtttgcctggccatgctgaagccttttagcttccagcatcagctctgacatcccttcctgtgcaattgacctttctgcagtcccagcttagacgtctcttaatgttttctctggcagcttcagggttcccaggattctactaagatcttggctgtgctgtgaattgagcttgtgtgcactgtgagagactgtccagtttcattcttctgtatgtggatatgcagttttcctagcaccacttgtgaaagaggctctctttcagtgtaacatgtctggagcgtgtgggtttgctcggtcagtcctctattctgtccactgctctacagacctgtctgcggtactactgcgctgtcttgtttctatggctttgtggtataggccagtgcttccagtattgctcttgtttgctttgcgttgaattgactgtgaaagggtctcttgtggcacccaacccaagaactgccgctgcctgtagcagctgtttaaatagtggtgcacacagcaaaggggctttatcgcctttgggggggctgtgcagtgccccccagagtgaatcagtaggttctacagtcctggggaaaaacaaaacaaagagtcttttgtgtccatatgcaagttgggtgtgttctctagttcttggaattggttgcattgactctgtagatgacttttggtggcatagccattctcactgcctaagccatgaccacaggctctacttatcctccagtgtctacttcaaattttttcaatattttagtttttatattaataggtcattcaccttaggctttgggggttttgctttgtgtttatttttgttttgctattgagaatgggattttttttttcccttgacttttttcttggcaattttgttattag

SEQ ID NO: 22251 - DNA, 1319 bp, Mus musculus
gcagagtaaaggcctgtctgtcacacgggaacttggagcttcaaaagagaaagagtttgaaaacttcagtgtagaagctgtgttcctagaaagtcagtcactggaggaactcttaagatggctacctgatcgacacatgtgtggggacatgtggtttgtagcttgtagaaagcagttcttaagtgggctcaaggtgacaggcacaggagagctgccagacctttgttgttgtggcctgtcactcaccctgtggagagcagctgaccatgtgagcagcgcacataaccactaatgacttcagcgcgcgtgtcctgtctctgtcatcattaccatgacacacagatatcagacatttataaaacaattctatgtgtatacttgtttacaccttttagagcttaggttttttttttaaaaagtcgagaaaccatgggtagtggagcctaattttactatccttgaaataactgcagtaataatagtgaagaattgatgacaggtgacagattgtaggaaattagtctcacactattttcttctgtgaagaatgttgtttgtactacagagtcagctttgcctttggtttgtcctagctgatggagtatttcatatagacgactgagtgcagtgctggcatattcagtatgctagcatttttagttttgataaataccattgcaggcaatgggactgtgctcgagaaatctgatgactagggcagatgggttactaggccaaggcttcaaacatttactggaaatgtcttcaaatgcaataaaaaaaaacatttttaaagacttgatttcttgaataaatgatataaacatattggtcttctttgtatttgcacccaaccagaattgtcccctttgaatggagtagtgcagggtgagtgtggctggggctgaaagggcagctatgtccaaaggtgggaaaggaccagtgaacaaatctagagggccagggtgggagacgttcgttagccctgtgattcttcacttggattgtgttctggtgcccttacatgcacgcacacacacatcccacttacacacatgcacttggaggcagcagaagtgctctgcactgttttctctacaatagaaatcaacattattctctgagtaggtaacaataggccttcagagcagctctgctgggtctcatgtgagctctcctctaccttcagtcttccctggtggaggtgttttgcatggatctttttgctaagaaaatggaaaactagaaaatgtggtctaagactgaaatatatgtgtgtacaaagtctatgctttttttttttttttttttttttttgg

SEQ ID NO: 22252 - DNA, 2776 bp, Mus musculus
gtattgctccatcctcttcatgacctgcctcagcgtgcagaggtactgggtgatcgtgaaccccatgggacaccccaggaagaaggcaaacatcgccgttggcgtctccttggcaatctggctcctgatttttctggtcaccatccctttgtatgtcatgaagcagaccatctacattccagcattgaacatcaccacctgtcacgatgtgctgcctgaggaggtattggtgggggacatgttcaattacttcctctcactggccattggagtcttcctgttcccggccctccttactgcatctgcctacgtgctcatgatcaagacgctccgctcttctgctatggatgaacactcagagaagaaaaggcagagggctatccgactcatcatcaccgtgctggccatgtacttcatctgctttgctcctagcaaccttctgctcgtagtgcattatttcctaatcaaaacccagaggcagagccacgtctacgccctctaccttgtcgccctctgcctgtcgaccctcaacagctgcatagacccctttgtctattactttgtctcaaaagatttcagggatcacgccagaaacgcgctcctctgccgaagtgtccgcactgtgaatcgcatgcaaatctcgctcagctccaacaagttctccaggaagtccggctcctactcttcaagctcaaccagtgttaaaacctcctactgagctgtacctgaggatgtcaagcctgcttgatgatgatgatgatgatggtgtgtgtgtgtgtgtgtgtgtgtgtgtgtgtgtgtgtgtgcacccgtgtgtgagtgcgtggtagggatgcaccaacatgcatggggctgtcatttcctatccaagctgcctgtctctgcaccaatcacaagcatgcagctctccccaggattgccagaagcctcctcctttgcatgagaacagtcttccactctgatgaaaagcatcagtatcagaaactgaaacgaactgagaggagcttgttttgtgaaagtgaagagaagatggagggtcagtgacttgcaaaaaaaaccaaccaaacaaaaactacacctggcaagaaggctaagactctctgaaatgcttccttttccatctggagttcgtctcggccttgttcaggacctgaggccctggtagagcttcagtccagttgattgactttacagacttgagagaggagtgaatgaggagtgaatgaggctcctggcggcatcctaaccggctaacagtggccttgctggacaataggattcagatggctggagttacattctcacaccatttcatcagaactattggggatcttgatcaatgtgcaggtcccttagcgtcagtaaccctgggagctcagacacgatgggggtgagggtgggggtgggggtgggggtgaggctctacaaaccttagtgatgactgcagacacagaaccatggagctgagcctgcttctgcttgccagggcaccactgtaatgttggcaaagaaaaaccaacagcagtgttttgagcctctttttttggtcagtttatgatgaatttgcctattggtttattgggattttcagttcctttattactttgttgtaattttgtgtgtttattagtcaagaaaaagaagatgaggctcttaaaaatgtaaataaaatttttggttttttggttttttaacttgggccaactacaaatactgcttaggtttttttctaacttaattgttaactacatcatgtgaacttaagacattttcatgataaagcattactgtagtgtcagttttccctcatcctcgatcatagtccttcccgtgaagcagggcccttcccctcccccccctttgccgtttccctccccaccagatagtcccctgtctgctttaacctaccagttagtattttataaaaacagatcattggaatatttattatcagttttgttcactgttatcagttttgttcactaatttgtccaataatggaattaacgtcttctcatctgtttgaggaagatctgaaacaaggggccattgcaggagtacatggctccaggcttactttatatactgcctgtatttgtggctttaaaaaaatgaccttgttatatgaatgctttataaataaataatgcatgaactttaaaaaaaaaaaaaacaagttctttcaggctgtgtgtttgtatgaaggggggaggggaggaagagaggggaatcctgctgttctagacattgtgatctgacgcccaccccaccctgtctgttcttttctttctttctttcaattttaaacagtgtgatgctcactccaccccttccttccttccttccttccttccttctttccttccttccttccttccttcagcccctcccaccccccactcacacacacacacacacacacacacacacacacacacacacacacacacaacactaggaatctacacctggccttgtgaatttacactttttctcacactagtttttcaaataaagtgtagttcctgttgttctgccacaactacctttcgttaattgttatgtctaaaattgttttctgtgtatttctacaacgtggtcatccatttttaaaggttatagaccctttaatagtctggatatattacaatgaatatattccctcctggatggcaccttgacttaggctaactcacgtgatttttttttctttttgactatttcagcattattgctttgtacatctgtgtgtaggcatcattggcatttactttac

SEQ ID NO: 22253 - DNA, 1316 bp, Mus musculus
ttggataattaccagcaaggtgacgggaacggaaataaaggtgtccagtgttgctagtgctatgatagtaactggatgtcacttcttatatatctaggtgactttaatatatagatggtatgcacacactcatttgtcatgcaggagggaatctgcactttgacacatttttgtttattccctggccgttactatggaaataatctgattctctgacttaataaacaaagtctgagttggtgggtgttagcactgggcagctggagatcctaatgataggggaggagtccgtagtttagacttaacacagcttttgcctatattttttttcaaattatttgataataatggttagtgatggaaggatgagacagtattacctgtgtaggggaagctctaatacttttcatcttgaacataccgtagttttaagaattatcaaggctgttggaaaacccgttttgatatgggtagcattttttttttaacttgcaatttacttactgaatacatggaccaagactgagcataagactcaccaggactgtaataaaccttacaaagcagccaagcctagacacagccatctgcatggaggcctctgagcaccaggtacatcacaccccttcggctatgcctcccagagagcagagatggatgggaagcaccaggcccaccccatcctgctaggattctcattagctgtgagctgactgtgtcttttagaaattggcaaggtaaggtatgccatcttgggaggcagtaactatgaaagactgacgagaggagaaaggtgtgtttacatccagtagctgtcctgcaaggctggcccttgcacagacagacacacccacatgccctggtcacactgttggatagtgggccatagactgactataggagaataaccgagtcctgtccttactcaggcaacgcagagagctggcatgtggtcagctatgatgcacatagaacttgtcttcagctggatgtgaccaagtgtatttcacataagcaaggcctatcagctaaactgctttgcatatctgagtttctgcttccagtagctatagattaggataaaaacacagtataagatgtatatttttaatacatatgcccttcagcctacaaaattacacactatttatttacaaatgttttttcaaaaattactcaaatcagccaggcattatggtatacacctttaatcccagaacttgggaggcagaggcaggcagatcttaaacaattttttttttaagaaacaagcaaacacaaaaagttttacttaagtccaattttaagaaatatat

SEQ ID NO: 22254 - DNA, 1197 bp, Mus musculus
cctcaaaatataaatcagggtgccatagtgtgggttatattgctgtgaagagacaccgtggccatgacaactcttataaaggaaaccatttccctgcaaatacagaaatagtagattcaagaatttccaggggctagaaaaagtctctttcattttacagttgtcagttcttctaggcctcttcaaattttttattttggttttatctgcatatatatgaaggtatgtgggcacacgcgtcccatctactaccatatgggatcgtaggattgaactcttgtagtcaggcctgatggtaagtgcttttactttgctagaccattctaggactattagagagtcataaaatgaccctagtgaaagtagaaagagataagaaggcttaatagtaaccatcaattccactaatgacaatacatttttaaagtaatatatttaataacattctacaacatagttacaaagtgtatcttgagaaccagtgaaaacacagaagatggataagtgcttatgcttggttgaatgtaagaataaaccaattcttattgtaatgtctttaaatatttttatttagtcgtagaagatgatgaagatgacttccctacaactcgttctgatggagactttttgcacaataccaatggtaataaagaaaaatgtaagtaataacttttctccctctattgaatgaagtatactttgtaaagttgctatatgtcaaaaaataatttctaactaattttcaaaagcaatggaactcctgaaattttaagttaaaatatctttgaagaaaagttacaaaggtaaaatacatatgctgatatcatgttaataatggtttgctctctacttaaggctggttctaaatgccaaatattaatctcatttcattagtattgtcaaagttagttgttagtactaaaagaattttattcttagctagaaagtactgttggggatttgatttcagtgtttcatttgagagtaatttctctgtgtttagtatactcttctacacttgataaattggtgttgaaagtatttgatgagttattaggaaacttcttgaagaatcacaaattttttattaatatgaactataaattgtatactcttcttgacatctacctaaaaaatctaaagtagatttctacttttttaagatgaatgaaagttttgtgaaattttaagtattta

SEQ ID NO: 22255 - DNA, 1183 bp, Mus musculus
agaccttggcttagtctactaagctctgtcttttattaaaactgtaattttagagatgatgagacagcacagttgcttaagtgcttcttacacaaatatgaactcttcacattccacatgcaaaggcagctctggtggcttgctcttaggagtccccagatccatagggctcactggccagcccctctagtctacatggcaagctctgagacagtgagagacacaggaagtaaagcataatgtgtaaagtttgctctctggcttttacagcacataggcacatgtatactcgtgcagacaagtaatagcgtaactgaaatccattgttattcaaatgttaggactcataggctttaaatgagagcaaggagaaatgaggatacacaagaattctgtcttcagaactcaaacctgagccttaactatagagccaaacaatcgctgaaagcctttaagtgaataactattttttgtaagattttacagaattttagcttacttgtgtagataacatttttataactagtgtatataaattaagagaaattaattttgctggtagaatttttttgctaacatatggtgctatatgattaatcaggtcctgtttcaacttttgagcacatacttctttatatagcagaagaagtaaaagaagaaaatagtattgaaattttaaagtatttcttgtctttgtgtttgttgtcattagcaaatatgggttctagaaattaaactgtaacttatgttctccagcatctttagaacaaagaattccaagttcataagaatactgactttgaataatgttatttatataccttttctcttacagtaaggagtctgccaaagatctaggcctttgttaatattagctgagaatttgtctggaaaactctatgttcaattacaccagtggttaaattggatttggtacattttacagtcaggcatacagaatagacttaggtctattcaggatacgctcttgggttaattactaacatttgaaacacgttttgttatattaccttatataacacatttccatgtacactaaggaaatctatgaatttccttaaattattaggtaatgttaaccttaaaaaaataaaaattatttttaaaataccttaaaatattatgtagccaaagtcttcattttgtaattaattgaaaaaaa

SEQ ID NO: 22256 - DNA, 1090 bp, Mus musculus
atatacagtttgcatattaccacctggagagggtgtattaactgatatctccagcaataaatgttttattttcacataggttcttataaatatataaagtaaaactttcagatcttctctatcttggcaatcaaaagtttttaatgtagtttaattctcttggaccacaggtttgcaccatgaacatatttatttcttaaataagacacacacgcacacactgcccccacataacttgggtagaattatcaagttcttggacatagtattagatggcataactcctacctaagactgcgaagaagacaaggctagtttataagctaatatttgagaaccctctttatttacagcacgatgctctccatatgtttttccaaacttccaaaagacccctttatattttctgttgcttgcttacagaggatatattttcaaacgtataaggtcaatgattttgcatttgcaagggtgagatcctttaaaggtaaatggcagagactctgtgcactccatgcatgagcaaggcgtgcgacgtctgttctggggtctccatgctttcactgcacacacacgcgtggctggtgcttaggttcttacttgccttttgttttctccttcagtgactgaagcaaggctgcgtgacgttccatgttggagaaaggagggaaaaaataaaaagaatcctctaagctggaacgtaggatctacagccttgtctgtggcccaagaagaaacattgcaatcgtaaagctgggtatccagcactagccatctcctgctaggcctcctcgctgagcgtgtaactataaatacatgtagaatcacatggatatggctatatttttatttgcttgctccttggagtgaaaacaaataactttgaattacaactagaattaaccgatgctttaattttgaggaacttttttcagaattttttatttaccatggtccagcctaagatcctcagttgtatcaggttttgtgcacaaaagaaaagcacaaaagttgaacgcacctgaggcatgtgctctctgtgcaccaaatactcagatgggcttctttttacaggcctacagtctgtgtc

SEQ ID NO: 22257 - DNA, 1902 bp, Mus musculus
cagatagaatatttattactctgtatagagagaaaagtgcgtataaaacatagagcttacattacatgcacgcagtttcatgtcccataaatcttttatattttttaatttacctttctctaaatgatgtgcatggaatatgccttattacagaaatgctattcataatttgactctgtggaaaagtgcctatgtggtggtagtgctaggaaggcaaggaacagattatcataccagtttacatcaccagttaacattttatattgtgatgtttaaaaaaagaaaagtttatacctcaaatgtgtattttattttgcaatcagctatggggttgggatgggagaacggggagggttgggagggaaagtttatttgctataggcactggtgggaatcttggggggggggacaaaaaacaacaaaaacaaaactctctacacccactataaatgttcttctgtttgcatttctggtaactatgatgaaccagacaaataactctcaaaacgaaattggatagctttattttacaaacgtgcaaagtttatgaagcagggtctgcatctaattattaccagtggcatttgcactaaatgtggtgataatcttttacaatttattctgtaaataaaatgttacactaaaaatacttgtagtaaaaagataagcaatgatcattttagtaatgatcttcagtaaaagactggtactttattggagataaccctgcccagtcagatttagaattgagttcagaaatactgaaagtattcaaacagtcaaagttaggaggagcactggcgacgttataatattcagaccgtcaagaattactttcatttggctaatccctacatagtgaatatttattgtttcttcataacctgggtatctatcttagcctaagcccccatcccacacacccccaaaacaagcccctttactcaattctgctggattattctgtgatgttagacacctgaaaaatactggtgatgtggggatttgtccctgcgtgtgagtgagcataaggagggagcagagtgctcctcctggggttgaggactccatattggaggtagagaaacttgacttggtgttgctacaggaggagcgagggaggaacctgactaagagagatgtgtggaggccaagtgaggtacaggaggcatggctctcaactgtccgtttccatgactacctatacacctatccaatatcagtgtcagtcgctacagaattttaactgggctgagctggctctcttgtgaaattgtgccggttatcttcagacgtctcagttgtttgtccgatcagacgcgtgaccagtatgtggtccaggctgtacaggtgatgtatttggattgtcgtcgttgttcatctacagactcaaaacataatcattttaaagtaccttgggagtgtgtagagtgtaactataatagctttatgattctgatgatgtttttttaaaaatataaaagatggatcttccatgttacaatcacaaaattaaaaccagtatttaaaagtggagaagtattaaaatattacaaatatgctcacttgcttgatttgttttccttaacctcgaggtactgttttaggtgatcttctgggtaattttaaaagtttccttgaattattccaattcaggaatcctatttgtaacattagggatcaagtaactctgcgggagcaacctaatgtttgctaacagatgagagcgggcaaggactaaggtaagcgcctgtcagccttctgtctgtcctgtgtggtatgcatatgtgtatagtgcagtgcaagctaaatgaacttattatgaagtacacctaaaagtcttagagccagagagtgaagcaacataactttttctgagtttctaaactagcaatgctgccc

SEQ ID NO: 22258 - DNA, 2296 bp, Mus musculus
ttttcccaaatgaaagttttataatcctggtctgggaattaccactaaaatgtttggacaacttcagtccaagccctggaatccagatttaaagaaaacaaaacaaaacaaaacaaaacaggtgtagtgtcatgatctttaaagtccaagctctgggcagatagagacaggcagggcctgggggcttactgaccaggcagcctagcctacttggcaagttccaggctactgagagagacccgagtgtgtggccttgtggtcttctgacatctacacattcacatgcaccccaactccccagttttgcattgctgatattctttgtgttactactttgtctttttctgacgtagatcaaagataaatttacaagatcttcaaggaacgtgcaccaagaaggcagcttgaggatcctgacactgaactgaagcgcgggcattgggttctcaaggactaacatgcaatctgtgaattaaaaatctcaatgcactgtctagtggaagatgaatggacatgatcagtgacacccctgcttggtttctggcgctttcagagacgtctgaggttctttgcacagagactcctcagatgtgggaactctggttctttccgtgctgtgttctggagagatctcacgtggatggtaccggtgctctgagcaccacagatgtgagctacagttcgtttctgaaagctaccacaagctggaaactggtgatcagtgtggggctcacctctccgtgggttaaaaatggttttaaatgacactgtagctgacagaacttctgatctttatttattcagtctgggttgtagaactttgcaatctaagtttattttttgtaaactaataattcatttggtgctggtctattgattgggggcctacttcttcatggaagaattacttttattctcaaactacagaataatgtgctaagtagtgctaaatagttcttgacgaagaaaacagtcactgcatttatctctgtgagtctttgttcagagaggcctttagtctagattctgccagctgtgccacactctgcactaaagatatcagagctcttagtgttacttagaggagagtacaagcaagtcggacctctcagaacttagagtgtgggaacagttttttttttttttttaaaaaaaacaaaaaacaaacgaccatttctctaagccaagtttcttttagagacattttaacttatttagctgaactctagattttttggtaaactatcaatctgtatatgttgtaattaagtgtctaatgctaggagtttattggaagtgtttaagaaataaaagaactcaacttttacactgataaaatactctagcttgggccagagaagacagtgctcgttagcactggtccaggaaaccctggcttgctttccaagcccaatgaagggaaagtcagcttacagagccaatgatggagccacatgaatggccctggagctgtgtgccttgttcctgtggccaggagtttggtgactgaatcatttatgggctcctttaatgggcccataaaagctcttagcttcctcagggggtcagcagagttgttgaatcttaattttttttttttaatgtaccagttttgtataaataataataaagagctccttattttgtattctatctaatgcttcaagtttggtcttgggaagctgacatttgtgtagaagatggactctgaaagacattccaagagtgccgcggcagcatgggagcctcttagtgattgtgtcagtattattgtggaagattgcctttgctgttgtatgtaaagtttcaaattgctcctcttgtgacttttcagccagtaccattttatttacctgagcttgtcatggaagtggcagtaaaaagtattgagtgttttatgctggtgactgtaaccaatgtcatcttgctaaattcatgttttgtacaattactaaattgtatacattttgttatagaatactttttccagttgagtaaattatgaaaggaagttaacattgaaaagtgtaagcagtggcttttttaaaattgaggattaaccccaagcctgaggtccagaagttagcaaagtctggccaagtggtagcctgacctctccactgagggtcataaggtcctccctccattatccgttatactatcagcaacatcagcagctggccagtgttgtttgtctcagtgatctttcttacactaagggttttaaaattcagatccataatctcaaccagattctctttggtgatcagatggggcaagttaagaggaagggaag

SEQ ID NO: 22259 - DNA, 1142 bp, Mus musculus
tgtactttgcacatataaaggtacagggtgcagttcccagcacacatacaagccacagctgctcagacgtctttggactagagctgtggcctgtgtgacatcaaagtggcagagcagctgcttttggaacagtcaggaagaatgatggcaacagggagtttaaccaaaaaaaaaaaaaagttggtgattgatttgtgaaaagcattggttaagtattgattatgaaaatctattcatttagtgtttaagttgaatgtatagatttgctttatttattatatgtataacttgcagtttctcagatgcccttggttgtgagaataaataatgtaatgtagttttttactttaatttgagccaaagagtaggagttggtgatcttaattttttttctggtctgtacaattttggcaccttctatttgagattaccgactgatccttgaaataattttgtggtgaaatgtttgttaattttcactcttgagttattaacatttttgcattgtatcattttcagattaggtcaatgaagtaaaatgcttagaacatcagtaggcactgtggggttatagagagctgcacttagtgctctgtaaggactgtgtactgagatgccgtgtcagaaaggcataactgcctactgatctgtgcattatattataaatcaacgtggacacatgggctaattaattgcttttatgataagtgagtctaggggagtagtgtagtttggaggataaagtaattcctgtagagtagctggtcttatagctgcttgtctcagccaaagtgatagcatttatagaagaattggaagcatttgtctgccagctgtgtgaaacagccccattacatacagctttgtgctgatgcttgggtctgtgtcctggcaggactgctgttcctcaggccatagatcatctttgtgttgctaattttgttgtactaaatgacaaaggatgtaatgtagtgagacttggctgtgcataatgaagcgcctgtaagttaagtggcatgttagagacccacactgagcagctgtgtctcactctctccccaggcgtccgccagctggagatcatgtgctgcttcggctgcatgtcagtgttggccaactactttgtgttcatgacattcttc

SEQ ID NO: 22260 - DNA, 1198 bp, Mus musculus
ccacctacaaactcagaggtgggccttacccaactgtaagcaaatcttttacagggactagaaagggcttgctgagcactgccgaggaccacgtagttttgggtagtagtagcttttcagttatttcattattggcacactcaacttcttggctctcagaggaaggtgagtgtttgggtacgtctagggcatctaggacttagggcctgtggaggacatggggagaagaaaaagttaaggcaaagatgggttgaggtggcgtagagcagagcttgtgttggttagggaacgaaatcagggagacaagggaggaaacactcatggctagaaactggcgttgtgtgtgaggttgagagagcattactgagcgctgcctagaaacctcaggtgaccttgaggaagaaaccatgtgagtcagggcagggtcatgacttggatgggttgagataattgtttctctgagaattctttcacctcagatatgtttgtaccttgatttgggcttctcagaagcccccaatcagtagcagaagcctgtggaaatcctgtaataattctggaacgaatatgagatacacttctcagtttttatggtacggttgactggcagtcagcaacagtaagtagagggaaaattacactgatagatctttttcctgctctactttttcatattgcctaagaaccttcattctgtcgtgtagttttataaatctaggggatggccggccatggtggcacacacctttaatcccagtactcgagaggcagaggcaggtgggtctctgagtttgaggagagcctggactacagaatcgaatccagaacagccagggctccacagagaaaaaccctgtttcagaaaaaaaataaataaaaagaaaaaaaaatccaagagaagggtgaagttactgccaggcagagatagagcatcttgggctggccttgggattcttttgtgagaggtctgcttatgtttctgtacagcttggccaagattctccagcttaacatttaatttatgaattaatttggacaatttttacacttcattgcccattctatgtccggcttttgatgagctagttggcttacggccccattaagctttctcagtcatgtagaatctgttaaggccttacatgggcagagcccaaagtacttgacaggatttgacctgacagctttagagttacat

SEQ ID NO: 22261 - DNA, 1378 bp, Mus musculus
tctcttgtgtgtcttttatccctgtcctccgaccctctgctctgcaccctctgctctgcggcaactacgtctcctttgttctgagaacttggtcttgggggggaacgaggattttttttttttaaacaaaagcaacaagtgttcttaactgctgagccatctctagccccacccgtattttatagtgacttttatgttgagggctatgtaaagggtatatttatacatacaatttgatgtatgtgagcatttgtgtatgtcttacaactatataaacgtttatgaagtacccatgaatgtttcattgcctattttttgttgttgctttgagacaaggtatcttatgttataggcttggctggcctggaactctgtggttcaggatactcataaactccaaccagttcccagcctcagtctcaagtgcttggattacacatgagccaccatatctggctttattgcctgttttgaatgtagatgacttaatactagaaagtttttggcataagtgcctaaatcaacagactataaagctatctatcttgacaaagtgaaatagaaggcgaatagtaaaatacagtaggttcctttgttttgggggtttgttatctaggaagaaaagaaggcatccgttctaagcatgttgttccgtgtctgttagagaatggcattccctgtggatttgctggataactgcacgcatgaggaattggaaaactcttctgaggattacctctccagcctaaggtgtggggaccctgaacatccagagtgcttttctagtctcaacattacggtaagcattccatacgtaagacttttaccatctgtccagttccacatgaaattagtaattaccagaaatctacaagtaaaatgtgttaatatcaactaagcaatattaacaaattgaatggcaaatcagggttttggggtatgtgtgtgtgtccatgcgtatgaacgtatgcattgttgcgtgtggggtgtgtatgtgcgtgtgcgcatgcgtatgaacgaatgcattgttgcgtgtggggggtgtgtgtgtgtgtccatgcgtatgagcgcatgcattgttgcatgtgggggtgtgtccatgcatatgaacgtatgcattgttgaatgtggggtgtgtgtgtgcatgcgtatgagcacatgcgttgttgcatgtgcacacagaggccagaggaggacagtagatgcttctgttgctttattctctggagaccgggtctttgatcagacctgaagctttgtcactgagtcaggtgtgccagagagtgagcctttagatccatgctgggagacagagaagctgaccagttttgctaagacaaggtacacgttgaagctgtgccacttaaatttactttga

SEQ ID NO: 22262 - DNA, 1137 bp, Mus musculus
aacttcccactaatcttgaatcgtcttatgtttcagattcccgttagtctgtcaaatgtgggctttgtccctctctatggcggcaatcagacacagaaaattcttgctctctttgcgcctgaagattctcttacaggtcctgcctttgctttgtttttttgtaaattgaggcacttgaattcacattgcgaggaatttgagaaacttacacaaacttcttttacattttagttttagaaacatgtaattctcacttgcatataattaaacctttagtgaatgcagtgggtttgaaaacgggtgggaagtgtgggttagggtctggggagggagggaggatagctgagggtagagattgtctggatgtgattctcagcatgactggacaggaaagcaagcaggaatgggtgtattttattgtgtatttatattccttattgagaagcagtagtgcctctttcaaccctttagacttaaaaatgttaatggccattttttctattttagctgtggcactttaccttgttggtcagtggtgggccattgatgatattgtgaaaacctctgaaccttctagagaggggctgaagcaggtaatacaatcacatccttccatgattcctgtacacagtgatggttgtggtgaaagcagggccgtgtgagcttcctcgggttctatggtcctgcctttcccgaggattaggtgagaaggagcgcgggctatgtgggctagcccacggaagctgcctctctctacttaagcttctgggcttctgtggtggaggagatgctggttgtgggcgcagctgaaccacatgaattgggaggaaccagaggcgtgccggattctgacacctcggataggctgtgttgcccgttcttggttttgttcttttgagggtaaaactcttaagagacatcagattcaaagggaaggaattttagggagtaatatatgagtattatttcttctggatattgtatttattctcataaggaagaaagaagtcttagaataatataccaaccatcattttttcttaatattgtatttattcttaagtatgcctttagaatctacagtaagaggcccatcttacagaagctgggagagcgcatatttggatatttgccagc

SEQ ID NO: 22263 - DNA, 1577 bp, Mus musculus
ggagacagagcttaaatgacaaggcaattagaaagaaggaggttgggtgtgtgtgtgtgtgtgtgtgtgtgtgtgtgcgtgcgtgcgtgcgtgctgaaattcgcaggagctggccgggctgagatgaagcagagctgaccaccagatcagtaagagtagagcccaggtcccagaagagaagggaggcccacgagacacatcaaatgaagaatggcatactcagaatcagcctgagcaacagagtaaagaataagataatatttattttaaggatgctaagtagaaatggcaatacatgtaggtcatgtgtgttttaataagaaacagtaacgggcttcccggccagacggcgggacagacggctgggtgtgcagcgacctcgaacccgtgagccagaaagcagagcttctgcgtcccagggactccagcacaccaccatggcggattctgagcgtctctcggcccccggctgctggttagcttgcaccagcttctcgcgcaccaaaaagggaattctcctgtttgctgagattatactgtgcctggtgattttgatttgcttcagtgcatctacaacatcggcctactcctccctgtcggtgattgagatgatctgtgctgctgtcttacttgtcttctacacgtgtgacctgcactccaagatatcattcatcaactggccttggactgacttcttcagatccctcatagcaaccatcctgtacctgatcacctccattgttgtccttgtagaaggaagaggcagctccagagttgtcgctgggatactgggcttacttgctacgttgctctttggctacgatgcatacatcaccttccctctaaagcagcaaagacatacagcagcccccactgaccccactgatggcccatgatcgtctttcagctgtctctgctacctgtcaatagctcctccatcaaaaactttcctcctgtcgggcggtggtggtgctcgcctttcctccaagctctcaggaggcagaggcaggtggatccctgtgagtttgaggccagggctacacagtgagatcctgtctctaaaacaattccttctccggtttccacaacactccagccaattctctgaccccattgaaagtgcttatggtacaagagattgaacctagagccgtgtgcatactaggcaagtattctccactgagctacatccctgtaaaagtgcctttattgggagttttgtcttccagcctgccaatcaacccatctgggtgtagccacctttatgggtgtgcctagattcccctttgctctgcagtaccagcagccgacatcagttctgcttgaaccatatccccacataagctacaaaatgagtgacccactacaaataacctttttctctgtgtggggtgagctgtgaagggctaaataaacaataaaaataatgtttaagtctaaaaaaaaaaaaaaaaaaaaaaaaagaaacagtaacggccgggcatggtggtgcacgtctttaatcccagcactcgggaggcagaagcaggaggatttctgaattcaaggccagcctagtctacaaggtgagtttcagg

SEQ ID NO: 22264 - DNA, 1194 bp, Mus musculus
cccaacctgtgtgtgtgtgtgtgtgtgtgtgtgtgtgtgtgtgtgtgcgcgcgcgtgcatgtgtgcgtgtgttcatgtgtgtgcgtgtgagtgtgtggagacatgaggtatatgctggtctcctcagtcactcttcacctttcttggaacagaattgctcagtgaacctggagctcactgattggctagactggctgctacctcctcagcctttttacctttttctgtagaagttagggattgaatcacagatgtgcactgacacccctggctcttttactcgagtattgtgattgaattcaggtcctcatgcctgcgtggcgcacagtgtactgactgagctgcttccccagctgctggacaatctgtaataattttataatcgttatgctgaatattatacagtgcttttacatcaggtgttcagaaagttcacttaaagtttttgttcaaatttgagtcatgactggtgattgagttacatatctgtcagtcccttttctgatgccagtggcgaccaataggaaaggtcacaaagaatgcatgcttactcttctggtgatgctttctgttggtggagctccaagtagtacaggcatcatggtggaagatggaacacagaggagaactggatcaaactggctgttgtcagtgtagacctgttgagaaccttttatttttttggttttttttttttttttttttttttcgagacagggtttttctgtatagccctgactgtcctggaactctctctatagaccaggctggcctcgaactcagaaatccaaaaacttgtgattctaatggggagtgtgtttcagcatgggttttagagataaactgtactcataccatatcatccttcttgtacaacatttctcagcatcttagaaaaggatggatgtaagcttgtgggactgaaacactggaaagaataaagtacagtacagagtgcagtgaattcattgcctgagatgggctctgagcttcagctatctgaagatgaattgtaattattttattttaaattaataaaatttagtctgtctaaaatttacagtgttgggtaacttgaaacatcttctgagccgggcagtggtggtgcacacctttaatcccagcacttggaaggcagaggcaggcggatttctgagttcaaggccagcctggtctacagagtgagttctagga

SEQ ID NO: 22265 - DNA, 1186 bp, Mus musculus
atctgacacctgacctccttggccaccaggtacacgttatacctacatatatactggcaaaatattcatacattaaatacgcctgaaaggtaaaagtacaacacaaaagacaatgccaggcatggtgcacacctttcatcccagcactcgagaggcagaggcaggtgggtctctttgttctaggccagtctggcttacagagtaagttccagaatagctaggatgacacagaaatcctgtctgaaaaaacaaaaacaaaaacaaaacaaagcaaacaaaaactccaaaataacaatgacaaaaacaatacctgacctagactagcccaaccaatgaaataacccagtaaggattgggagttaaaataatatattcataaagaagcatggattaggctttgtggatcaatggattagtgacaaggtattataagggagacatatctaaaactcaaatagtattaatataaaagacatgattggttcataatttaaaattttttcttcatgtagatgtttctcaatatgaagccacaagacctgtgtctggagaatatggtcttgctgctgtaccagaacatgaacctggactggacgacactcagtctagtgagctgcaggtacacctttgaccctcataggaaactgtcgtgtttttgtgtcatttgtgtttgttgcttgttttggggatagtgagcactgaacgtggtatcttatgtgttctgggcaattgttttaccactaaagctcattcccagccctgcctggtgctctttattttgcggtgggtctcagcatgttgctcaggtaggcctgtattctagcctagtttgaacttgaaaacatcctgccttggcctcatgaatagctcagactggaagcttttgtacccaaagtttcagacatttattacataagcttaggtaatttcaactgcattcattttcttggtggctctgacagttgattattaaagatttaatgttttttgaaaaatatttgtaatgatgtttacagtattacaagctaattaaaactaatttaaggttacatacatatgtattgtttattattgagacagtgtctcattaagttgctgtggctgacctgaaattcacaaagtctcacctgcctcttcctcctgagttctcagactcagtgtggcaccatgcctggcaagcccctgt

SEQ ID NO: 22266 - DNA, 1135 bp, Mus musculus
cctctcctccaactcctcctgtgtccttctccaactctatctctaatttataacctacggggatcatcttcattcaaaacaccaggttctactccctgatcgccattgtcttgtggccagatcaaaatgccaagtgcatttaatccaacttcagaagtcacagtaagggctggaaagatgcctctgaggttaagagcactgactgctcttccagaggtcctgagttcaattcccagcacccacatggtggctcacaaccatctgtaatgggatctgatgccatcttctggggtgtctgaaaacagcaacagcatactcacatgtataaagttaataaatcttaaaaaaaaaaaaaagtctcgccgggcgtggtggcgcacacctttgatcccagcactcgggaggcagatttctgagttcgaggccagcctggtctacaaagtgagttccaggacagccagggctatacagagaaaccctgtctcgaaaaaccaaaaaaaaaagtcactgtaaatttttagtctcaatactttttatagtccaaagttcaaatacactctgagatgcaaggcacttgtaacatataaaattaaaaatcaaaaaacaaattacatagttcaacatacagacccagaacatgtgttgagggaggaaatgggttatagtgaggaaatactgggctaaagctagacgaaaccatccgagaaaacgcaagtcctgtagctctttctgtcgcatggtgttcttttctctctacactgtatactttgtgtttctttatcctcacttgcactttttcattgtcaacctgcatgtgagtgattgttagcaatgacactgcagagtggttggttatccgtgatttgcagacagtttaggctgccttgaagtctcctctgctgaagaaattgttccgttacttctcagttttgtcttgggcaagttcttcggactggagcaggaatatcaccgggatggtatctagccagattgctgctactcccttccccccaggtttctccatctgggtctccacagcccacattgttttctgtactactgtcttctaagctccgactaggatggctggttaggctctgcttacagcattcaacctttttcctaatctaaagtc

SEQ ID NO: 22267 - DNA, 1854 bp, Mus musculus
cttgttgttattgttgttgttttaaactgcagtaattaataaacagcatggggcacaggacagattctaaaccttccactggaacttatttacacatgcaggttttctctttcctttagaacaaggattcgctgttctttttcatttttcaggctattttctctaagtaactttcgtttatgaaccatgtgtcaattttggaattccaggtcatattcttcttcagcaggtggagcatctaatcattaatattttaaaaatacaacttaaaaagaactattagactttgatcataggaatcttttatactaagggttttaatggtaaaatttggtaaggattctcaaagttttatcttagtatcaaaacaatctccatcttttaggtgtaagcatacctaaacaaaaggagtcagttaattaaatatagtatcaagttagagaacaaaaaatagaaatttatgatcagtggtttatgaagatggtttttgtttttatttcttaatgttagttgtagatggagttcaagtctgtgagaagtactttaggctgcatatctggtgttagtactgttaaagatataactgtggtgtgtgggtacataatttaaattttaaatttaatacttccacatgaagtattagtttgctataatttttttctctatatattttcagatgctgaaaaccttgagtacacttttatcttttaaacacctcaagtaattgaagttaatatatagttgaatttggactgtcgtcctgatcacagatagtgcagaagtgtaggcccctccccaagcctccttaattcttcactgctgtctcactgtgactcttctatcaacagacctccacccagcttgcctgttatgccctgtatccatatttggataggtctagaactcaatccaaacacctttagtcctagatggaaggaataaagctgcccagtgagatgtacaaatgcctagattctgactctgcggtccctttgggtcttgtatactttaagacagggtttctctgtgtagcattgactatcctgtaaaccaggcagacctccagctcagatctgcctcttcctgctgagtgttgagattaaagacatgcagcactaccacctggctatttgatattttagaaatatttaaaaaaaatgacaattggtttttaaatggttattagaattcatagaaaattggtcagtggcacttggggaataccacatactttgatttgtatttcagttagagactattttgagaccaattagaattgtttttgaaacagcttgaaccttgtgagagaaatgttgagaaattgagtcatgaagtacttgtgagtttatgctcagtcatttcagtctttggtcagctgattggtgatttcatgtcttacattttaatttagggatgttggtattttagaaaagtctgattaattagttaagaccttaaagcagcaaaccaaatagcaaacccttgaagttagaacacttgcacttacctgttgttttaattttggctagatgttagataatttcattctaagtgaaaattatactttgaccatttttttttttttttttggtaaaagctgttataaaatagatttgactaattagtaaatttgccaaatgctgatgctgttttacacgtttagagaaatttgttaatatctcaaccagggatagcatttgaaaggcatgttaagattcagaaattgatttttaacacacatttaaagttttctggatatgttgttttggtattttgttttggctcctgttccccttccattacttttttaaatgagtgttttagtagattgcactcactggcagctcaatgtat

SEQ ID NO: 22268 - DNA, 1120 bp, Mus musculus
ctgggcgtgccgcactccaggaacctcctgtatccaggaatgcagcaaccctgaacttgtcctttgaggtatgtgagtctccactgcatagacatggtgcaacaggaaatgtgactagacaggaagggtctgagcaaagcccagacatcctgcagcttcaagatcctctctctgtgcagcatccctcccttggggtacaggacaggtcccctctggaataagtagggtcataggacctactatcaggtgagataggtcagagaatttcgttaaggccagctccaagacagtttattccttcctggtatacattacatttaatacatcaagatgcctaggttttctgcaggcatttgcttggcctgtattgagcctagaatgaacttcacctcccagggttattacctttcatatacatgggaactgtaagctttctattcccataagtgccttgtttctcctgtgctcttcttcctaagacaatctcggcctcttcaacctctattcctggctccctgacataatgatcaagtcataagcttgctctccgatacagcaatacctcagcttcctgtatacaatgtatatgctttggggagggctctaatagagatgtatcatgttgctctctgatacagcaatacctcagcttcctgtatacaatgtatatgctctggggagggctctaatagagatgtatcatgttgctctctgatacagcaatacctcagcttcctgtatacaatgtatatgctctggggagggctctaatagagatgtatcatgttgagtacatatgaagaagcacttatactttctcttcattctttctttgcttaaaaaaaaaaaaaaaaaaaaaaaaaaaaaaaaagcactgattggaagcaatcccaatgtagacagaagtaatacgtactgttttcttctgtggtacagaattttccccatgtttgtttgcaggatgccatggcttttaataagtttaatgttcttcactggcacatagtggacgaccagtctttcccttatcagagtaccacttttcctgagctaagcaataaggtgagtaattcatgccattgttatctgtacacaaacatcttcagcatagcttcaccag

SEQ ID NO: 22269 - DNA, 1142 bp, Mus musculus
cagtggtaggtattagtacactgggcacttccccagggatctggggaagaccagagcttgcagctctgcctgctttgatccatatttctcacagtgctgtattaaaaaatagaacctaaggcagatagccacctttacattgtgagtgtgtttaccttgtctaatgacggataattccttaacatttctctccaccttagtactttaggctaattatacacgtctgtctgtgccatgagtaagtggactgtagttggaccaaaaaaacaaatgagccgttggaccatttgagcagtcagtttctggtccttagatgtattctaagcagtgtaagtgtctgattgtaccctggtggcatgatcagttgtcttgtagctgtcccccgctccatagtttacaatgcaaatctgtctcaagatcttcacttcgctgctgctgagagcaggagaattttctgcagctgtttcaaagttgtggcctggccttgaatcctctattaattactgtgtgagccagagggaactgccctgcaagggtgggcccccagccggcaggggaactttctagactcccgctcattcaattgatctaggcatttgggcttgctacttgaccattctcgccctgtgaaatgtcccacactttgaagcaaatacaattcacagcacagtacacacaaaaaccctggcataagacggggaggttcttcttattttgtgagccggttgccctggaaacggataacaaagggcagccttccacttctggtataatgggggagcctcttttctcaggcttgacacctgtctgaataagagtgattagagccgcataatatccctctcttggctattgaataagtggttcacatacccaaccctgtagaagttagaagatggtcggtcatgtctgtatgttcttgtttgcatctactacatttttaaggttttgtaaaactgttatttttttttcacgatgtgaaactgaaggtcaataaattattagagattttctcttcattgtattgtgagtttttatttgacagcaatgaaaattttggaaatgtgttttctcgtataatcaacgtgaagattagttcacgtgttttctgaacgtttcatttaaccatttagcaccatttt

SEQ ID NO: 22270 - DNA, 1050 bp, Mus musculus
agaaagaggtacattcagtgttctacctagggctgcccccctcttgactcagaggagcaggaggtaagaatgtgggggtatgcagagaccagctcctctaggctgctgatcacagtgtggatgttgtttgccttagggagcaacaaggatttattaaccccccaacagggagcatgacacaggattaagaactcggattatgtttaggccccaactgtggaattcaacattatactctcgctctaagttataaaacacacacagtaacaaccttctctttagatccacgcacggtcttttctgcttcctcattccctgaagctctgatgatgtctaaggatgattcattccggtgagctaatattagacattctaacttccagagagatgaattacagaagaatgattgcaatatagagagatacatcagtttgaaattcagaagcctgagaccagatggacataaacagaatcccagagtgtgacactcaggctagttcagtggtaactttgacttgggaagccacttcccaacttgaacatgggctggtatccctagaagggcttggttgccaaaacctagaccccttcacttagagtgataataattcagtctgggcctcgcccaggagctaacaactgaattggactgagaccaagagttggcactgccaacatgttcccaggtgatgctgatgatactggtgtgggtaccatatcctgagatctgctgacttaaatactcactctgatcctttacaagtaaggaaagcagaatgcagaaatgggagtgttgcctaaggcagcagtgagaaaaatggaagccctgtgattgaatttaaagccaatattctttccattcaaactgtgactctattattactcctaacaaaagactgagtgcacccacgctaattcatttacttgagaacaaagagacgccaacccctccacccaccaaactttgacttcttgcttggaggctattgacattgaggagtcatgtgacttttcttgcttcagcttcagcaaaatgatgatgatgatggt

SEQ ID NO: 22271 - DNA, 2712 bp, Mus musculus
tatgaatggaccccccacacccaccagtttaaaacttctcccccaaactatttcttgtcatgacatgagtcaaagtcattggaggcaaattacggttcactttgtaagtagggactcatttaaagaatctaaattccaatttggacagcaaaaggttaatggtgcatagaaaaaatatcccagcagcctacaaatctaagcataattatgtatgaacatgaggcttttattgctgtcaaaattaatcacttttcaacttccagctgttaaaacccttctggaggctctccaagaaattcccctacagttactcttccttcaattaaactctgtgcagttcacaggctcctgttacataagcggcaatttaaatatggacttattgggtcttccagtttttctccctcccttcctccttccctccctcactccttctctgtctttcctgtctttgcttaacactataaaatgacaaagcatgacgttttcttctgacccctttagcacagctcttaatcgtatagtttaagaagcaggctgtgtgaggttaacgaatctgtgctccttccaatgcgctctaggtgtgttaagtgactagcgatcagtattgttagccatttccttaggctgtccctctgaggtgtgtaaatgttatatggcttactctctttctcaccccactattcttctgccccctcaccccataaactttataggaagtgcagtttacaaatcttccctaatgggcttagtctaaatttcctacatcgctttctctggagtgacggtcactcccctcctttcgtaggactgcgtgtccctatgttgcttaggctgctcttgacctggtgggctcgaggagatcctccccctcagcttcacttccttagctacacacgcagtttgtcatggtgagggtgatcgcagccatctgaggtgtctgaagccttccagtcaccctggaagagcttgtggtccctttcttccatcctgaaaaaaaatctgctcagaaatgagttgagtctgggagcgcagatgcccagggggcatgagtataaatcctcaatgagattcataaattgctgcagcatgttattattggggcttatgagtggagatcagcccacatctctgcacttgcctggtacagactgagtgcttgcatgtggatagcatgctgggtgtgtgctggcttttttttttccgtagaattctgagagaacagtctttatattctttctcagtgctctgtggggatggataaggataacagctttacttcacaaagacacttatattatttattttattattattattattattattgagacaggtttttctctatgtagccctggcagtcttggaacttgcgttgtagaccaggctggctttgaattcaaagacagccctgcttctgcctgtgctgggattaaaagggtgagccatcacaccagcttggggatggggaattttaatccttctcttcctctcccatgacatcagggcacaggtgctaaactaccccagagtcagcaaggtcagcttcattttactgagctgtcactcatactgaaggggcctgccctcctgtgtccggtatgcaaagcatctttcctggccactccggtaatctttgcagcctcagcctcatcaactctgcttcatgctgttcagtaagtatgtgtgcaagtgctatagggaacagacgcctgtcgtttgaagaagtctctgccatatctgctgtcatcctctgctttcccgcaaaattaatgttcttccagatgcaaattccttcccgagcctctctacctgttagtggcatatggcagaagatctgaacccgggccgggggcatgaagacatctttgaggaagagagaagggatattttgtctgaaaaacataaggatccagcaaacacctgtgttatgcgttgttctaaatatgcagtcttgtgctgatgtgtgtttatgtggtcaggaggagagacagcatccagagggggaatctatatcccattatccccacccagactctaaccggcatatcccagaagccccaagctagggctaatttgggacactgaatggattccttgtgcaatcaaagtctatctgtcccagaggacagggagtaagctgtgtgagttgagtatggtatgtccctgagggtggtttccaggctatgtagccaccaacagcctgctgaccctaccacactcacactcaaactcacattcagcatttgcacagagaaggggcagattcacaagtcaccgtcagattctgtctctcagagctgaaaagaagtgtgctagcctcctgtcctccttcctaagctggctgcttagtttctcatgtggctgagttgattttctcgatcaggctaatttagacaaattttcccgaagccgagggtagacagggttaagattaaaaatggttctgacttttgacaactgaaggccaagaacctgccagcctcttacagcatgggaagctttaaaaagctgaggaacaggcctgaggtcatgtttgggtcaaagacaggaaggactgagggtaaagtattttacctttctatctggtacttaatatgcctcctaattgcaggacattccttaggcatcgccacacacgtaatttctgctaattggcttatgtaacacatgcatgattattgcttttcaatggaagcaactctgtgcatt

SEQ ID NO: 22272 - DNA, 1096 bp, Mus musculus
tgtgatcctcctgggacagtaaagccacacagggcagcaagagcagcctttctgttgccggagatattctgtgggtattgattcggctccctctgacttacttacaatgagctcccaacacaatcgaagtgatgtataaaaccgtgaggctggagcttcggccaagcagaggcagtatgcaatacataaaagctggaagccccccttccccccccccccccccgccgcgcttctgtgacacttccagctggaagatgaatcggagccacacattccagctctgcttgggtagcacggaaatatgcaagctgcaatcatctaggtatgctcactacagctaaagtggtgctgtggtgccagtgccacgtgccgcgaaggctgccagcgagcattttttccaaggaccgattattgggaaattcagcctttcctcctctcgctccccaaccattcatggaaaggttgccatgtgccaggaagcccgactatttcagtcagtcatgaagccatctaagcacaggtgttggaagaggtcagcctttgagccgtgatttaatacttaaaggtttgtggatagtaccttttacattagttgcctaagtgttagaagggtccctagtgtggggtgaacacgtcctcatagttaaatcgggaggctttctcttaaaagtgctcagtgtggaccaaaagttacataagcgctttgccttaaaggctatccagttggtctttcactttagttcaggcttaaagaacaaaaatagctttctggttttgtctccttctggacgagtggccatctgtttaccgtttaatatcaccagctcatgacttttcaaggaactgcgcaggatttcatggttgtgcatcagggacttccttcccctagttcactcttccactgtggtcccttccaccgggataacacaaaagcacttccctgtctcttttggtttatctgtgacctgcccccaaaaacacatatatgttattttaactcggcagttcataacctgtgggtcacgacccttgatgtgtcagatatcttgtatatcagatattttcattataattaaaaaactgtagcaacattagt

SEQ ID NO: 22273 - DNA, 3820 bp, Mus musculus
tcgtcggtataggtaaatgacatgaagaacatctttataggcaggggatgagaatctgagatgaagaaaagaggctcccctgatggaccattctaagctactgtcagaagcaggatccatagaacttaaggacatgattgcaacaattatcagacattggcctcttaggtcatggtgatcttttagtattttggctttctgctgtcctttcataaaggaacctcatttttagcttctattgaagatataaaatcatctcatagtattttctcattactaggagctgtaaatcacttcaaagctgtctttctccttgatcatttgcatatcaaagtatttctcttgagtacggtgatctctccccctgtggtttgctgtgtaccagttctctctggatcctagggcctagggaagtgtggattccaagtgactggtgtttttctacagtagagcttttttgttggctcttacctgggaggacaatggggaagggccagggccatcctgttctttgctgggtgtgacctttcctgctctgcttcagggttccatgctgaaaccacctttagccatcatcgagtgggactcctttttacattttggtgatttcaatattgtttttgtatgggttttgagtttcagtcctaaatctgtgtggtgtgacagagggaacctctacacaaaggcctgccaatctgcaacctcttcatgctgccactggttagatcaacagttcactctagacactgaaccttgcctgcatgcgtgctagtgtcaccaccaacatcagtatcactgtgcaccagcatcagcatcactgtgcaccagcatcagcatcactgtgtatcagcatcagcatcactgtgcaccagcatcagcatcactgtgcaccagcatcagcatcactgtgtatcagcatcagcatcactgtgcaccagcatcagcatcactgtgtaccagcatcagcatcactgtgcaccagcatcagcatcactgtgtaccagcatcagcatcactgtgtaccagcatcagcatcactgtgtatcagcatcagcatcactgtgcaccagcatcagcatcactgtgcaccagcatcagcatcactgtgtatcagcatcagcatcactgtgcaccagcatcagcatcactgtgcaccagcatcagcatgactgtgtaccagcatcagcatcactgtgcaccagcatcagtatcactgtgtaccagcatcagcatcactgtgcaccagcatcagtatcactgtgcacagctcaatctccatacgtcaatcgccagatcggtccaaaagtgtcttgtctgtgtgtattttctcccactttaccactccactctggcttaagccttcccacctgctactgtgtactgtgtggttgctggctttgggaactcccaaactttccctctgtatttcatgtttctgttggcctgacaagtatctctttctaaaaaagtactagtttattttatgtgaatgaatgttttgtctgtgtagctggtatgtgcttggtgcccatgaatcccagaagagggtattggatcctctggaagtggagttagttacagatgcttgtgagccttcatgtgggttctgggaattgaacccaggtcttttggatcccagtgattttaatggtcgagctatctttccagctccttcagggcctgagagaggtcctagaacccctaaattccccagtgactcccctttgttattctgagaagtttcagcttcaacttgccattctgggaaacacaggaccctataatccacctgccttccgggatgaacacatggcttcacccctgaaggcagtgcttaaggcactgcatgattctccacttccaaacgtgatctgtattttctgcccacctacctctttgcttagtcattcactgtattattccctattctgtgctgagcacgagtgtgctctctctctctgtctcctttctttttgctttttttttctcatctttcttttttttttgtcagttttatgtatctttgaaaattttattgaatgtaacctttttaagagtcttggatgcaatgtcctttctttgagccttgaaatctgaatcatctctttagtgtattgtggcaaatgacggtgtttctctgtgtattcctagctgtcctggaactctttttgtagatcaggctggcctcgaactcacagagatttgcctgcctctgcctctcaagtgctgggatcaacagcatgtgctaccactgtccaggtcttgatttcttgatttcttgatttaaaagaatgagtctctgcataaggcttgcctaggccatcagctacaagcttcactggacagtgtacagacagcatagagttggcttcatactagggattgagcatctattggtggaataaatacatcaatatgtggaatattgcgaactcaagacctcttcctatactaaacttctctaaatgtgcaagactctcagtatagtcatttcattctagatagtctctgagtgttgccagaaagtttaggggcaaagagggagctatcaactataatggccgtgagtggaaaccacaggcactgagcagcttaatggaaaaagacaagttctgtagactcttcagaaaggcatcaatcacaggatgacggcagctttgggagacagtgaagagatgcttgagtaggagccagagtgtgaaggagaaagtctcttagaattggttttccaaagccagagcctgagtcacagttagcacacctaggaaaggcacatgtgtgtgtgtgtgtgtgtgtgtgtgtgtgtgttgtgagggtgtggcagtgggttggtattatagatttaccttgtttggactggtgacctggaggattgtgcctgctattgctctcctgatgggattctgttcttctccctctgggtgttatgcgactgcttgtggctcccagagagaatattacaaacaccactgattatgttccttctcaggtaacattcttctgctgtaaaatatcctggctgagtcatgtttaaatacaccaaagtgtaatgtggtcactgtgataattctgaaacacaatactagcgtcttaacttctctcttggcttttgcagcatcagagatccaaaatgattcagtatgacaaatgcttattgaaggcaatgtcgaaccactgtgttgagtctctaattgtcctcaggagagaaagcacgcagacatgtacagaatgctgggcaggtctcaggcttccgttctaatgacgcaggaaaggagagccaatagagttgggtccattatgtaaccaccttgggcttaatctctttgtcaaaagagtcctaggatccctcaggctgcagacttatcaattgtagaatgtctcccttctggagggaaatatgtcacatgagctccatcacctgtaattctgtcttcacatttgctgtttcatcttacaagagagccgtgatccctcactagtaggcctccacctactgatagccagaagcatgaggggcggaggagggaactgcagggttggaggaggaaggcctgtctgtgttccagggcaactgacgcatctcctcagaaaataaaaatgtttttccaagagctctctgatggcactggccagaatgaggttatagacctcggctacgaggaggttgacatttttcagctcctgtgataaagtgtaagaaagaaggggcaaagactgagttggggtcagccagccaacaggcttccttattggccatggcctcgcaggatgtaaccaaggaagggtggttaatgagttaactcctgggtcagcgccagac

SEQ ID NO: 22274 - DNA, 1070 bp, Mus musculus
aaagggaaaatttttagggttttgttgttgttgttgtttgtttgtttgttttgttttggttgttttgtccaagggatactgtccattacacatcctggtagggagagaatgagggtaagaagaggaagtggctgatatcctacctctgcaggcgggaagcagagagcgatgaacagcagtgcttgcccaactctttacattttctccatctatgacatcagctcacagtctacataatccagcagactcacggccagatgcttgtcccctaggtgtttacaggttctgtctcaatgacgatcagcactaaccatcacagtgaggaaggaaagcagagattgtcctggacaaggtgcttagcttgctcccccctctccttcacatcataatgacaggctcttccttttatgtgggttcccctgcctttgaggtatctcagcctctctttgcactttgtgtcagagtggggtgcaagactctacagaggctaccacgggacttctggcctatcagagaacgccagaccttagtgtcactgttggaacggtagattctgaagatatccagaagctaagaggaacacagagaggggacaaggagtcagataccatgaagtaaacaggtaagtttatggaggaggcagtagaacctgaacattggtggaatgagcatcctggatggagctgccatacttaggtagtggttatttttctcctgtgtcttgggcatcctcccaatgccctgctgggctaccatcttctttcctcctcccgtatctctgtaagtgccccattctgggagggaatggcatacaaatacttctctctggtcctcagtaactatggagcttgactcaaagaaaagaagagcatttcagcctaacagtgagctcttctgttcctaattagagtaagagagggaggctgacaaagaacagtccccgcagctctcgcccacccgagctgtgcctcaggaatggccaccctcatggctagctgaagaaactgctcttttaagacaagatattattctgtcctgtgcacaataccccagtacctggtgccaggact

SEQ ID NO: 22275 - DNA, 1109 bp, Mus musculus
agaaatgattccagacgaggcacaaggacactcttttgcacctgagtaaagcctgcagcacagcctctgtgctatggtccctttgctggtggctcccaccctgtgttcgtagctctccttgatgaaagtgagtcctgcctctttggtcatctctccagtgaaacgttctgctcacatttgtctgttggagagagccaaggtttctggctcagcctgttcctcttatgtccaggaccaatgacctcaccatgtttggtcaattaacacgctgtttccaaatcagcatctatggatgatggatacattgtttgttctagcatgacgattgtgtggccaaagatcacctctggcaccagctttgcttttgttctgaacacattatttctcatcgcaagtttgagaacaatcggcttattgatcaaatgtaagaatcaggggcggactttgccagactaaggctcgctgggtgccaacctgaaagctggtgaatctcctttttggagttgcatctttgggcatgagcatggtgatgagagaatgtgcctctaagttcttggctttttgttgctgtgccttgaaaataccgttctcatctctgactgagggacaacacatggtaaacagctcaccaactagttagagcacaccaggttggattacttatgtcttctttggttttctgttgtgtgtactttttgctaccctgctttaaactcctggtggactatgctatgagcccccacccagattcccttagatttccagataaaatgcatgcacacacacacacacacacacacacacacacacacacacacacacacacacacaaacgctggttaatcttaaatgtctttgctaactcaatgagttccccagttctcctgattctccttggttcctccttctcaactcttaagtatcccacccccatcctcagtcattggtcactggtatttttattgattgatcaagaaccaattgggaacaagaccttagcatcagaaccactccctacagttctctctccttgtgtagacttccccaccccagttcctccctgctgacttggcaggtaaggaagcatcccacttaggtgagacaccaaa

SEQ ID NO: 22276 - DNA, 2934 bp, Mus musculus
attctaccatgccactcacatatagccaaatagctcagtcttacttattatgtgtgtatatgtgtttgtgtgcacatgtgccagtagaaatgcatgtatgcatataggccagaatttgatgttagatatcttcttctcttaccttattttttggaaacagggtttctcactgaacttggagcttgccagttcagctaaattggttagccaacaagcctcagggatcctcctatctctgcctctgccccagcttgttttcttaaaacataggttccctgggattgaacttgtgtcctcaggcttgtgcagcaagccctttactgactgagccatcccctctccttaagaggttcaggattttgttgaacttgccctgtgatgggagagctgccatcagtgtttgatgatcaactttgtgacgtattttctcagtagtccctacctaaaggaaatgatctatcaggtactcattttggtgacgagaggacagtaagatgctggtgtgtgacatgagattcattgttctctctcaattcaggaaaggtggctgcaggaaatggactctgtgtttattctgctctctctccctctctctgggtgtctgttggccttggctcagcttcgagctttctgggaacccaaagccctggctgatggcgttgttggacctgggttcctctgaggaagatctgtctgagagagaagaggagataaagctgagacgttaaatgtttccaacaaaagctattagggcagaatttcctgattcagcacttcccggcattttttgaggtttctccacagacaacgtacagttacttttttttgtatgtgtgcatgtggttttctttatttagtttttttctccccctaagcttatgggttttctttgatgagatggttgtgcaatcctggcattgccaggaaacgctggtaagttgctggtggctgcttacgctcagtgccaggggagacccaagcatggctcctgactctcagtggtgggcagaactgctatcacctgtgtacccctgagctgggctcctggcagctacagctcttgagctctgtcccttgctagcactgtggagcttgagtttattgacttatgagtcacatggtccttggcttttgtgctgggttgagctgtatcttcccacagtggtatgctgaagtccctgttccctgtacgacaggatgtgaccagattattgtgagacattgtttctgttcagccgttccactcctgggagctaataatctactcggaggcagaaagccttcataggaaacaggtcacaaggcacggcattacagaatttcaggaccgcagaatctgtgccctggagcagccaagcagtccttgacagtggcatctccttagacacacagctgggttcccagaaagccatcgtctggcctctctccctagactggtgagtttctctgtgcctaagctttcttctttgcaaagctaggtttacttgtacggattttacgcttgataagagaatggtcaggcagagggagacaaactgtagcttcaagaggacagagtgcctcctcactgaccagggaagatgtggctggtttatggaagaagaatctcatgggcggacaaatgctcgaagctcaccgacaggacccaccaccaagggattagaaaggactgcacatggcccctgacataaagaggcttatttgtctagaggacctcatctgtcaaagtgagctgggagaggccatccgagaatcacagtgttttgccaggtgttaaggaagcactaggtcctgatcctaggttgcagtcctgtttgtggggctcccctgcttccggcgctcccctgctttggagatttctttctttctcgtttcatcctctgtaaggacaaagacaaagacctggcttcagggtcctgccacacacgagctgtgcagccgtttgtgagatttcaagtttgcttgtgctcagccttttcattttcataaacgagaaaaataagacctgcttttaaatgcttctggcctcaggtctaaatggaagccagcatagcatgcctatcatagcagagagtgattggtcaatgtccaccatgttcacataggtgatttgactctggtatggcatctggggcgagtggtgactcttagtagctggtcttgaaattcatttcaggataggtactgtccactttgttcaagagttggggtagcactgatctctgagaagctgaatctgaagaagagtctagccaagggatcttggctttctccaaagttcatggacttaggctagcagaccctgaacactcatgctgtggccaggggcagcaataatgactgcctgggcccatattacttcttctcttctgccactggcctgaaccaatacaaccaattgttccactcttccatttggtaacctggaaacttctgaagatctatgacaaccgcattgccatttctgaggagaaaatgaacaaaaagacagctatgtggcagaggcaaggatcaggcaagtctccaaaatttggcagaaagggttggggtttgaaagacaaatgtaactagaaaaagaacttgttcttcctccttctacccccatccccacaaccaccccatctctgggattctatttccaagatatttaattttgaaaacttaaacaagaaagtggttttaatcttcaagggctctcattaatcaccgtgcctggcccagtggagagagagagagatgactcacttttacagttgatttcgtggtaatggagggtcaaggcctgcccctacactgcccctttgtcgagctaatggagaaagctctcactgaggaagcacccattctggagcaatttttcaatggaaaattgctgacaggaatagccaccgacaagaaaagatttctcttagggaaacaaagtaagtggctcgg

SEQ ID NO: 22277 - DNA, 1207 bp, Mus musculus
ggttgccagtgtctcagcttctgtgatgcgtaaaaacagatgaaagatgaatggctgtcttccaacagataatacacaatttgcatatcagaatctgaacacacagaaatgacataactctacgtgtttaataaccaatacacaaaaggacagcaaaaggacagccgatagcctgtaggtctatcctgatagtgtttgaacttccatttatcctgtgagatgggcaagtgtaccgaacacagcaaagtcatcacaagccaacagctcttgttaaatataaaagaaaacaaagcgaaaactgaatcttagcctctgcccttgataggaaagaacctgatgtggatcatcaaaccgaggacaattaaaaacaaaacaaaacaaaacaaaaaacaaaaaccagacctatacagaactggagctaatgagtgataaagaaataaaccgctcttccacaggaggcctacacgccgccgtctgtgccgccgccatgtctctagtgatccctgagaagttccagcacattttgcgagtactcaacaccaacatcgatgggcggcggaaaatagccttcgccatcactgccattaagggcgtggggcggagatatgctcatgtggtgttgaggaaagcagacatcgacctcaccaagagggctggagaactcacggaggacgaggtggagcgagtgatcaccatcatgcagaacccacgacagtacaagatcccagactggttcctgaacagacagaaggatgtgaaggatgggaagtacagccaggttctggccaacggtctagacaacaagctgcgtgaggacctggagcggctgaagaaaattcgagcccatagagggctgcaccacttttggggccttcgtgtccgcggtcagcacaccaagaccactggccgcaggggccaaactgtgggtgtatccaagaagaaatgagtctctgggcctttgctcttaataaatagtttatatacctatggaaaaaaaaaagaaataaaccaatcagattcgagaatgacataactcctgcaaagccctcacccctttaggaaggtcatgaggaccctagagcactggcctctgaagatctattggagagaaactgggagcatttctgcagcaagacatttgagaagaaggaagaagctcatgtccctggggacggcagaaaccatacatagaagtgagaggcagagg

SEQ ID NO: 22278 - DNA, 1195 bp, Mus musculus
taagctgcacacccagactgggcagattacactactctgttccccagctatgagatctctcgctacttgtggcttctccaagccgtgtggttctgctctgctccatcttcctcacacttcctcttcttctgtcttctcctctctctttcactctctttcccccattctctaaaacctccagccccacgcttcccttccactgcccagttacagcctttatttgaccagttaaaatggggaggaggttcacatgaaaccacctgagtgagtgatcctctcctcttgaggaagcagaattaacatcagaatacaaaacagcaccagggcaacccacaacagtgtggtacagccaagcttgtgcaatgaaatctaaaatagagctcccagacaggttcctgtcagcccactgatcagcaaagacattgattgattgatctcagtagaacaaatctcaatagatgctacagatagatagaaggaccgcctacctcccgagattttttttttttgagcatgccattctgtacccaaagaaactttccctagaaatttgactttggagacgcagctccatcagatcacgcgatgaatatgtaaggatgggacgttgggcttctgaggtggaaatattatatccttgcataactctttaccctccctggtgatgttgcagaaaggggcagaaccagaggcacacagtgagaggtgtcttcatttgaagggggaaggttaatgaccaggctttaaggccctttggggggtaacgtctttaagaggggttgccttgctgcagacacactggtgtatgtcacatggacaagtagacacatcttcaagaaaacttcacaaacgcagccgaaaacaaaccaggtctgtaaaaacgtgttccttacattagctcatcacccccttgtcaagaagaatcgaatctccaggtaaaaaggcaaagcagttgatcctttccagaaggcgaagagaatttaacttctttcctttccagaactgataagatctcaaataaccacatgggtctggctcacaggaggggccagacctggctcctctgcagagctggtagttgttagagggagccggggactacagagaagagggatttcaaaccaccaggctgtacttacgcttggttttacatcaggctttctcagtgggtgcttacctcaccagcttgttatgc

SEQ ID NO: 22279 - DNA, 1165 bp, Mus musculus
atgctcaccccctggaggggtctcattttgatttggcaaggactagtgagagtccaacagaactgaagatagacatttctcagcctcctgatgtcaactctgaactctggacaacggggccgggccatcagagacctgctctccaagaaaacagcaaggagtcttataaaaatggtaattgattctttacacatcttctgtgtgatgtcaatgtgaaattggtcctctgagtggttggctcctccgtagagtgaatgaaccctagtgaagttagcttagggatggtgggagcaatgggttggaggtttctttgggaagcctgagtcccctgtactcctaaatatctaaataaacgaggccttgtggtagggcttagagcagtggttctcaacctgtgggctgtgaccctttgggggttcaaatgaccctttcgcaggggtcaccttagtccatcaggaaacacaaatatttgcattgcaattcataacagtaacaacgttacagttataaagtagcaacaggaataatcttatggttgggggcgtcaccatgccataaggagctctgttaaagggtggaaggatctggaaggctgagagggagtggcttagtgtagtcaatgggcatggtcaacagcggtttctttttaggccagtggactaagtgacctccacttaaaagtgatacactttggtatttatcctccgctgtagttagaccctgccacgtcttgatgtgtgtctcggttgctgggactttactgtctatccaggtgatttcctgtaacatcagtgaagttttctgttgtactattaagcactaaggaaggaactgttaacatcatttgtcattgtaaaaaaaggtgttgtctccccataagtacctcgtaagaacacaatttgctaaccccattaaagcatttgccaactataaaggaagggcagctagggtttccaactccgtgtgaatcccaatgattgaaatctctgtccattttgaactgttttccctgggatgggaggtagggaattagaagaacttgaaacctcccttcagaaaaacagatggtatgcaatcgcataaacaaatggctggccacaaggataggaaataaatctccccccactgcaacgtttcagaaacataaaacaatcaggagttacag

SEQ ID NO: 22280 - DNA, 2245 bp, Mus musculus
ccatgacacggaatgacagcgaccctgtgccggagcatgtgcccgctgaactcccagaggagaagacagagtcaccaacgcagcccagcgacacggacaagaactcctaactgggtgttgtttgactctattatggagaagaaggcagcttcagtacactcaaaggataattaagagaagttttatggaagagactggattaattaaaattgggacataagtacctgtttcaagatgtggttttccatgtattgatttattttatgttgccttcagctagaagatcttagttggcttggtcacagtgtctgtttaccctggatgtgttaattctgaccttaatggagccaaaatctctgttgccgtggggcctcgtggccctctggagaggtttccaagcggacagagtcctgccaagtgaacagagccccggttttgtttcctgcttctagcctgggaaataggaagagcaaacagcaacaacaaagcatccatcgctgtccccagtgtcctggggagcttcctgtcctctcgctggtcacttcagagtcttgagtcatatgccttcctcagctgtttgtgggactgtcttccaagtgtggcggatcactgaatattgcccctggaagtgcgtttagggtgtgatgagtctgttttgtcacctaaaaattgtgccctccaccagtgtgttctttagccttgtgtgtccagagagctctgactgaaccaattcccgcccctcagcctgcttccttccttccgtcttcaccgtgctttggttgtcctctcctctatagtaaaggcctttcagcctgcccatgtgctttggcaaagtgtatcatgaatatgtaaccctccataacgattctcttatctgtccttcacatttctttttctctgtccttcactttctgggtcagactcaaacggcagcagtttgctttgagaatttatgtttctgaaagttcattgtaaattatatttttttataaagagattcttttcttcttggctttctgaggtgttcctgatgggcagtcagtggctttgaccagcatactgactgcacggctgtgacttccgtgccttccttcagtgaccccacttaggttaataaatgtctggtgatggaatcccgagccgaggatgtccttgggggaaagattgtaatgattctgcctcataatctcacttgtgtaaatttagggttttttttttttttctttttcccaagacagggtttttctgtgtagcttttgctgtcttggaaatcactgtgaccagactggcttcgaactcagagacccacctgcctttgcgtttcaagcgcaggaattaaaggtgtgttccaccatccaactaactgtaggttttctgaaagcacaagggggtacagtaagactgttctgatgtgtacccatgttcaacagtaggtacagcgtcctttcatgagctgaagcagttctgcagtacagcggcttgtgaggtgcctggcttgctttgagtaaggaattatttaaataactcttgttaggtatgcagagagcttacaggagcagttgcgagtctgctggaagctgtagctgccatctcctgtgcacctctgcagcgtttcttggatcatttcattcttgtcatagctatccaagggttgaatcattctcttatagaaccctgaattaattaaagtcactcacctctccacgctgctgtccttatcattcctgcactgggctggtctgtgagggccttaactactcgttccctttgacagacgagagtgctgcagctcctgtaaggaatgtgtagtaattacaaacccttaaaaggaccagggacctcagagtcctcaatgtagttgtgttcaggagtgggcttttgttttgttttttagtgacaggcttctccaggtaaccctggctgtcctggaattcactatgtagactgggctggcctcgaactcacagagatccacatgcctcccagccttccaagcgctgggagttaaaggtgtgcaccaccacagctcaggagttgtttttatattccctgaaactattacctgctatgtgaagtgttttaacacaataacatgtttcaatatataatgttggctttaagagtcaaatgcctaatcatttttagatttgtgattttaagttgggaagtattttatactttactattgatgtaaaaataatgaattgttgctgggaactagtcatttttgtttaatttattatgt

SEQ ID NO: 22281 - DNA, 2317 bp, Mus musculus
ttatgtgccataaggaaatcagaccagagtccaagttgtatgcaaacaaaaaccatccctataattttattctcataagcatattaataaagtgtaaatggtgttttatatgatctttgagattctcaagtgcaatgtgtttaaaataagcttacaaaggactgcagaacaacttacttctgcgttaattaactttatagaagttgtgattgttttgatgaattaatgctgtagatttaatttatttttatatggactacataatgtgtgccttttaaaacaataacaaaaaccagaaatgtgcctctctagtttgtgttaattaatgtgcctcactttctcctcactctggatcttgtattcagattcatacagtgctcaagcatatttaaaagatatttgcaatttttaaaatacttttggcttgtaattgagaagaaaattcaaaataactaaaagataatttatacttaaaaatcctgtctcatttctttagtgatgtaccgtagccactagaaaaacaaatcagcctaatggaatatgtttactgggaataaaattacctttagatattcaacattgacctcattataaatgcgtgaagcagacaagctctgaaactgtggtgataaattggtaactggtattttaactgtaatttagcatttcccttgaccctacttatcaaagagaatttacacattattgtgttgtaaacacaagtttcctagcattttataaataattttttgaaaagattcattttagcagtgagagaagtactgtcacttgttttattttaacaattagaaagttgtcagattcccatatggtaaaaataggtcaagtatgtgaagtggtgaaggattggattaagagattctgaaaatgaactgttcatacagagtagtagctttctagcaaattccgattaacaaaagaaatatatgttttagacaaagtttcataatttacaaatgggaatttatgataaataccaacgtctttttcatttttcatggaaatgatagcttgtgttatatctggtaaaccattatataaaacactaattttgttaattttgttaagctttacagaaaataatatccctattactagacattaatataacgtcttgctatactaaacacagcagaaatctattccttttcacagtatgtaatacaaaatgagcattttatagtcagtgttactccaattctaaatttaggtttgacttaggtagacataagacaatttgatctttactaactagcaaaattagaatttctaactcttatgttctttaaaatgccagttacaattacacttactaaaatctgactaaatctgcttttattgggcagttgatgctttagtatttgaagtttgacactgctgcaatgtctgtttttaatcaggtgttaccttgagatgttaaactgcttggaatggttaaccttgtgcactttcttaatccccatagcctttatactgagtgtcaacatgcaagtttatattgggtacaggttacaattttaaagccatatgagtttatagtgattcttttttccatttaaaaattcactaatgttaaaaaaaatttaaaaaaagaggcccagtagattcagtgggagactatcttatctagcaagctggttcttgcttgtgtacagtgataactttgtagctgcttctttaactaagaatttgtaaacacagaactcttaacacatgtgagcttttaaggatcgttatttactactttgggttgtaattagagcacatctatcttccaaaattttgtaaatatttttgatttttttcataacatgtaaatattacataaaagttgtattcctaataaacatgtaatatataatttagcaattgactttgtgcctttgtgtcccttttaatagatgatagatgttaggacagtcaagcagaggaaggagattgacttttcacaagttggaagtttagctggctggggtcttgccttgaggtcaacactccctttatcccagttagtatcaggttctccttaaacttttcatctcctagataaacactgggcctggccaagctcctgatgcttctcacattgaaggcttggtcggcttccttgctcagctcgtttgttttcattatagatatgcagatgatctcttcgatcattaatagccacacaatagagtcaatattctaggctgtcctgaaatctgtgccaatgcaattaatccaaaagttttcaatttagtctcaagcagacttttaggacagggcaaaaaacagccaccatttttgccaaact

SEQ ID NO: 22282 - DNA, 1304 bp, Mus musculus
tagtactatgggattgtaatataagataaacacctgcaatttagaaattgaaagtctgaaatccaaaagtctgtatgatgataattctcaaaacagtttggttgggggggacacattttcgatttgaagcttttaggatagggatgatggaggttgatgaagataatgcaaatactataagataggaaacactccaaaatctgacagaggtctgacaccaagcggtccaaacacagacaatatttaagttagggtatataagcatcaaagagggatttagaaagcattgtagtaacaagtagggtatgaactgttattatttggaggaacataacagcaaaaatctaacatgatggcctgaagtgtctgattggtaaacctattaaaaaatgatatttgggctggagagatgactcagtggttaagagcactgactgttcttccagaggtgctgagttcaaatcccagcaaccacatggtggctcataaccatctgtaatgggatctgatgacctcttctggtgtgtctgaagacagtgcactcacacattttatatatatatataaaagaaattggtatttgaaggtttttggaggctgcagtaattacgttagcttttcaaatcaatggcctttaccttttgatatttcttaaccatcctgtgtcttaaaagtcagttttatagccttctggacttatgtgtgtgtgtttcacattatgttctaatttgtttcttggtgtctttcttaacctctaggtttatacttgtagaattactgaaaccagtaataagttcttttgtgaaaacctaacatgaatctgtccggtatttatggtatgactcttagtatttgtatgttagaatgatttaacaaatgaattatatctgttctaggtgtatcacggggtcccagcccggtcagccttggaaaccaggacactttacctgtggcaatcgcccttacagaatctgtcaacgcctactttaaaggagcagatcctaccaagttagttttaaatatacatcagcacttgtgttaggtgtggggcaggaattggggcttagtggtaaattttaaattattctttgatatttttttttgtgtagttggctatatgtgtgtgtgtgcgtatgtgtgtgtgtgtgtgtgtgtgtgtgtgtgtgtgtgtgtgtatacacacatacatatacatatatatatatatatatatatatatatacacatatatatatatatacacacacacacacatatacatacagacatttcctacacacatgttttagcatcttgcttttgag

SEQ ID NO: 22283 - DNA, 1164 bp, Mus musculus
tacgtagctacaataaatagtaggctttattgtacaaggtgggacatatttgctttggtgcatgttgagatattagatagctgattctaggtcattgtaataattttgacagaatagacctacattctattcagaatttcttacagatttcacttgttttgatctcagactgtttagaatctattagctctgtctatcaggtagctcatccacattgctgcttttcttcagttgtaaatccagaatcattgttctccacactcaatttgagtttagcaaggtttgatcaaagaagattaatccttatcactttccctgccaacaagatgttatattgtaaactctgcttcatgctgttggctaagtctattgactatatttctcagtgtgtcttactatttaatcacattgattgaactgttagaattttgtagaacaaaaataaatggttttatgctaacaataatctttctaatcattgttcttaaaatgttactctaggaaagggaccaatgatttacttgcttgggatcccctgttcggatcgtcgcttgagtcatcttcagctccactaacttcgtcatcatcgggtaaaaaaaagaaccctgataaaataaaatatatgtatataagcgatgtcttatttttgggaatatagtagcagcattttcccccgaatgatactatttattatgtttaatcatctgtagcttttcttcttaagtttgtcatccagtaatagtgagttccatcactactaccactgtaaaagatggagccccagaacacttaagaatggaaatcatcagaaccatctctcttctgtcagcggcttctaaagcactgtctatggagctatgtgcagatgcaatattcatttataaacactagtactaataaagattcttactagttttttaaataaaggaattctgattattggaaagaattgaatttcatactttacatgacttggcttaagtccatttgaaatgccacttggacaggcttcctggtgagtaactcatgtgtaaaggcctctgctgtggcaagcccattaacaagcttgatgtgttgagtctagttcagtgctagttccacagatatgaccatatctttaaaatactacttaatagcacaggcaagtgttgtagccattcaggg

SEQ ID NO: 22284 - DNA, 1207 bp, Mus musculus
cttctggggtgtctgaagacagctacagtgtacttatatataataaataaataaatcttaaaaaaaaaaaaagaattagtcttcagaggctggagagatggctcagcggtaagagcactgactgctgttccgaaggtccggagttcaaatcccagcaaccacatggtggctcacaaccatctgtatcgagatctgactctgtcttctggggtgtctgaagacagctacagtgtacttatatataataaataaataaatcttaaaaaaaaaaaaagaattagtcttcagaggctggagagatggctcagcggtaagagcactgactgctgttccgaaggtcccgagttcaaatcccagcaaccacatggtggctcacaaccatccgtaatgagatctgatgccctcttctggggtgtctgaagacagctacaatgtactcacatataataaataaatacatctttaaaaaattagtcttcattaatattttagcacaattgaaaagcccccccattgaattaataataaagaacaaaatgagggtttaccattaaaaggaaatgtctgatgacagaagttgtagagaaaatgtggctaagtggagttgctgtaagatggaagacagtgcagcaagcactttgagacagaacaaacatccagaagaaaccaggggaaaccagtgcaagcaggtatagcatacagtgtggtacttactcctgatgagctgcagagcccattggggatcactgtagtcatcagttgttgtttgatgtagcaaaagatgctcactgataagacctcactcagtgcagttcacactggtcagatgctttcctcagagctgcagaatgcagcagaataggctaggacctccttcagtagctcatcactattaatgattgcatagtagtcagtagtatattctgagaatgtgaaactactgtaggactcatcatttaaaattcttacgtagaatacacacaagtatttacacatctcttctaatttttcttattacttatttatttttgagataaggtttctctgtatagtcctggaactcgctatgtagaccaggctggccttgaagtcatggagatttcacctgtctctgccctctggagtattagaattaaagacatgaaccaccatgcccagctcttataatttttaaagttacagtccatgttttcttttataaagctaa

SEQ ID NO: 22285 - DNA, 1169 bp, Mus musculus
ggggataacatttgagatgtaaataaagaaaatatccaataaaaaatataatgtccttgagcctgttccatgtagttgtaattgataggattcatttttttgttgttgtatgagtttgaatgtatattgtatcttatttacttagccatctgatgatggacaccatggctgattccatgtcttggctactggaaatagtactaccataaacttaggagtatgaatatcttttcaaaaacaattttttaaaaaagtttggatgaatcattttttttagagctttttagtggttgtcagatagttttaaaatatatatgtttttcactacacccatagttattatctgcaaatagatctggaagcagcctcttagaaaactgcttttcagcctttgtctagttttatcactatcttctagtgctttgttacaatttgtttggatttgttgtcatgtctagtctgtcttgatcctcagtcccatttcttctcccccatctctatttagctttctagttgtttgctgtagagactctggttggtttgtagcttcttataacctggattttgctgactgtatgtattcctatacatgtattccttcacttctctgtgctatttaagttggtacttagatctgtaagcttgatcagacttagattcaagagattttgtttattccctctgaatgcacatgatgttttcctttttatcctttaaaaaatactgatgtgggctggagagatggctcagcagttaagagctcttctgaaggttctgagttcaaatcccagcaaaaacatggtcgctcacaaccatctgtaatgggatctgatgctctcttctggtgtgtctgaagacagctacagtgtactcacatataataaataaattaattaaaaaatattgatcttagatcattggatagccaaactttactcttctttaaagaggcactatatcttaatatctccttgcggctttttatgatattgagagaatatggccatagttctttttttaaattcatttattcctgttttaaaaaattgttttatttacattccaaatgttgcccaccttcccagctccccctccaagagttcttctccccataccccttcccctttgcctctgagcgagtgcttcccccccttcagacccatggggca

SEQ ID NO: 22286 - DNA, 1194 bp, Mus musculus
aacactgaatggatcttctagcccaaagttccaaagtctttccccaaacatggtcaggttgtcataggaataccccactcctggtaccaatttgtcatttttgttgtgctttttttttttaactattttaaaaatgatttaatgtttatgggtgttttgtctgcatgtacatctgtatcacatgcatactggtgcctgaggaggctctagaagggtgcattgcatcccctggcattgtaattacagatagctgtaaactgtaagctatctgggtgttgggaatcaaacctgggccctagaagggcagcaagttattactttttaaaatttatttattcctttctcatatattacatccaaacctgttttccctccctttatacctcctattccctctgcccacaaactcccctctcccccagatccactcctcctctgtttcccttcaaaaaagaacaatccttctaggatatcagctgaaaaaggcagaacaagttacagtaagactagacacagaccctcatatcaaggctggatgagacaacccagcaggaagaaaggatcccaagagtcgatacaacagtcagaggcaatcccccactcccactgtcaggagtcccacaagaactaagctgtacaaccatacaacatatgcagaggatccagctcagacctacacatgctctgtgattgtcatttcagtgtctgtgagccctgcttagtggattctgtgggtttaacacagcccacagggtcctcaacccttcttctctgactcctacaatcctttctcccctcttccacgaagttccccaattctgcctaatatctgcagtcagtactcttaacctgtgaagtgcctctctggttcctttaccttttctggttggttggtttttggattttttttcagacatgctctcactatctggccctagctgttctggagctcagtatgtagaccaggttggcctctgccgcaaatatctggctgcctctgcattcccaggctggaattaaagatggtttgcctccatacctggctctttcatttaactttttttttttttttttaatggattttcaagacagggtttctctgagtagcagagctctgtgaccacatgacttccaaattacagagatcctcctgcctctacatcctgagtgccaggattaaaggcttgtgctgcc

SEQ ID NO: 22287 - DNA, 2393 bp, Mus musculus
ttgctgacatgtttataaagaaagaccatcatacttaatagtctttggaggtttgtaaggtgtttttttgttttgttttaatgtattttattgattatcttcccggttagtcgattatttttcctcctccaattgttttaccagaccagagagagaaataaaaacctctcctcacacttggtatggagactcgactgaaaatgagttgagtttggtcctctccttttccaaacactcagaacacaaaagtggaatcttctccctacataaaattttgcaaagttggggtgccagaattaaattatgtattaaactcttgtctccatttaacacctttgcagtgaaaaactttttgcttcatatagttaattatattcatattgaatgtattaacagatagcagtgcaaaagcattcttcccaagagaagagtgtaccatgcacgtctgcaccccaggcccttcctgagtcttcaggtgcacacagccttcttgtggagctacttttgcaaatattacaaggtggggggacactaattgttgctgctagtgctgtctaataacgtggtcattggaatctaaggaaactagggtctgtggttaacaccctgggataattgtgatgggcagatgcgcagtaatggcctgtgttggtaacaatattatctagttcaatgccatgcagtagcattgtatagcaactagtgcatttcatactgtattaaatatggcactgcttctaagcctcgttccagttaagtttcacatgacagttagctcctctgacctgtctttctaggtaactggaaatgaacttcaggcttgatacagatcttctccctgttggtattacatatatagagataattctcaatgcctaattaatatacttatacatttgttaaggtatgcgcataattacagcaactgtttttatagtttgtatcccagagtatactgtgttgaaataagaagatgcatagcagctgaatgcatgcatgactttgagggaagttaagactggttttcttttcccatctctgcacattgaaaaaccaagccaagtctatttgccaatgatagatcactaattacaaagctagtagttctcctttgggtaagagtctgtttgccatacatcactcttccactgtggcttggtattgtgcagattacctctttgataggtctagtcaccttgttcagtgcctgtctaacatggctagctacaaggcaatgttgtctcctcctaatgtccacctcagtgacgaggttccacactgtctcctcacctcttgtcacggcttccctatgtggatatataaagaaccaaactgattcgctgttgttttttttttttttatggagataataattagataatactatgtaattaattttactcagtagattatcatcttaagagatgcttaaacatggtaaatcacttcatattatgaaagttttacacttagtattcatgttaacattgggtgcaataacttagtagtacttgcttagttataaataactggatctttctgctgacaacttaggttgtatgagttatgcttaaaagctttaaatcggatgtttcctgtacctgccacactatgttagaatgtgtccttcaaccatatcctgcaacttctcaaactgtactaaattgatatttcttgaagtctaactctgtgctaacagatcttcattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactatagacgttgcactcttgatttttaatggaaagaaattaccttatctttgtctccttccattttgtgtcctaataggtttggtgggggctttgggggacgggcattaaagtattgtgtgctatgtttttatttgttttgatttgccttagcttacacattagtgacccgttgttatccaaacaactttttttttcttatttatatacaacagtaaaaaagttttgcatacattttaggtaactactattgatgcttttctatttgagctgaggtgattaactgcttatgggtgattaactgctctaccaagggaaatggctgaaggtgaagctggagccacagagttgatggaggagccgtactgggtgtgaggagttccagttggagctgctgtcctgcagaaaattaaggcttagaattttttgagttaacacttccaagtcatttcctcttcaggttgtaatcacctcacgtaattgcatgttaccaa

SEQ ID NO: 22288 - DNA, 2459 bp, Mus musculus
agagtgggaggctgcagcagtaaggtggctttttatcaaaggtttttatataaatttcccacgttacggggccttgttttgcatgctgatgaagaactacttaaaactaacagttaaaatcagcttgcctcccctagtagaagcaggttcttggaagttacaatttaaggtacccccaaaaagttggaaataaaaggaaacaaatttgaacaacgaagcaccctgtgacatgccgacgcgccactcctttatctttgcgggctgggcagggagggaggaataactggggtcggggatcaaacgaaaggtgacatctaatttcacattaaaatgttagtggatataatttcatggttgtacttcttagatttaatttctaggccaacacgttatcttaaggtgcagttttaaggttcaggcatgcgctctggctcatagtgtttgaaagtgatgtccattagtgggaccgtagcatgcttgcctcgcatagagtgcagttggtattcatttacctatgtgcgccagtttgggttgccgttaccagttcaatatagccctgcatttaaaattccttttaagattcgtggattttatttttattaagtatatagatatataaagtactgtagtttacagctaggccttgagatatctttttaggatctgttaggaataagattgatattgtattgtgtgtaacctgcacaatgtggaaagctgatgaacctgtgcctccgtgctgtcagtgtggtgtgctttctgcatggttatatactactagtaactttatcaaatttcaaattacatggtaaaagatctgtaaaggctgcatccatgttagttggcacataaaggcaattaattgtagaagttgaaacatgatcgctatatttcaatgtttattcccgttcaacgtactgcctctaagctttcctttaatttctttatttttatttttgttcgaagcatgatcttaaagctatgtttaagttaatggatgtaatgcagggttcctacactgtattggcgcatgttggtggccctctgtgccctaagcatatgcacatggggcacatacacagctacagagtgagagttggtttggatcctcttcatttcatttgtttgcctttctgttatttttccctctgcttctatgtatctctgtgaataaatccttgttaagttaaccctttgctcttcctcccatgtgtattttcttacatactgtgaatgtgaagaccctaactggtacacttgatcttatgtccatatgaaagtgcaaatctttattaatttggattgcctgagcagtgtgtatcccatgatgatgaagggaaatggagagatttttccttttagctctgctggtcagagattaagccacacctttccatttttcaatgctgcatatttaatctgcaaaaaaaagttaagccataacagcctttttatattttaatttgtcacctttgcattgcagaataaatacccaataaccgtttttataggagttgctcctctttgcatggttctgttctatagaagtgactgataacagccattgcactgaagtgtgagctgtccgtgtgtgactttataaatacagttttaaaacatttcacatgcatggtagcacgcagagggttttgttgtggatgtgtttgtttgtttgtttgtttgttttaacatgttcttttactttcttttcttctgttttggctttgcaaatttcagtctgtggggcctgaaataaaaccatgtatagtgcccagtctctctctcctattttttatttttttaagctagactcaagggtgtgtggtatttcgctttttagtacattactttactggaagcttaaaatttgcttctcagttggcctttagagcaagagtggaatagctgttttattcttaggttgtagaatgccttgtagtgcttcatatactttggggacgtaatataggagatagtcttacataagtaatatagaaacagccacatttgtccattaatgcataagaagcaaagtaaagttttctggatctgtgataaacaattctttgttaattaaaggcaattttattacctgtctaattaagaatatatttccaagttagcagttatgcagctcaaaagcagtatttggctttatagtaaatttgtttctaaatctaataactttaaaatagaaacttaagtaaatatggcttacaccctaacactggggtggttttcttttctaatgtagctttccctgttgaggctattgtttcttcttaatttatattatattttaaacaacatagtatatagcacaggaatttgcagaagccatttaagttttttgaggtcagcgctgagttagcatttattgttttgatgaaacgtgacacatcatgggatatatatatatatataaagaacttaattcttgtggtgcagtcttgatagtt

SEQ ID NO: 22289 - DNA, 1221 bp, Mus musculus
agctggggctagctgagtattcagaagtcactcttagcttttgaatgctttccaatgcaaaacaagaagtgtctctgtccaaggttaagggtgttaatctatgactccttagccatgaacttttgactacgttcacagtaccaacgatgagttctttcctgtggagcaggcagcctttgattatataggagttggttatggttactctgttaaccgtcatgtggcgactgtacataggaacatgccggcagactcacttccttaaactcagaaatctgctcttatgctcaggttacatgtcacgcttattacacacaaactctacatgtcctctcaccttctgtacagtttaaatcacgtctagactacttatcatacctgatacagtgtgaggttacatttttctgatgaattgacaaattgactgtgaatgaggtttgaaagaaccggttcatagtgagacatttttgcttgctttaaagcacttatattctctactgtaatctaaaccttaatgtgtgtgcttgattctttttagtgtctctcgtctgttgccacagccttgcagtctggcttccttccatattgtgaacctgtatatcagcgttgcgtaaacctagttcagaagactctggcacaagccatgctaaacaatgctcaaccagaacagtatgaagctccagataaagattttatgattgtggctcttgacttactcagcggcctggctgagggcctgggaggcaacattgagcagctggtggcccgcagtaacatcctgacgctgatgtaccagtgcatgcaggtgagaccacaggcgtctgtgggtgactggggcctgcgtcttcgttgttacaagaagctaatttttcctgatttcttacaggataaaatgcccgaggttcggcagagttcttttgcattgctaggtgacctgactaaagcgtgcttccagcatgttaagccttgtataggtaggaatgttttctgctttgggtgtggggtgttctacctgttttaactgtttattttatatgaaaaaaagtgcacgttgtacaggattggggcaactatgtcatttttttttaacatctactgagttaccactgtatctggggatgtttgaatagtatcagtttatagagaatgttcggttctaattgtttaatttatgtagcattcacttataacaatatgaatttgcttttttgttttgctttt

SEQ ID NO: 22290 - DNA, 1251 bp, Mus musculus
tagaatgcttatttaggttagaccctatgtagactccctgtcacatgtaataggctacaaacattcagaggtgatggacaagcatgatgaatcctcatggcaataagtcatgccttaattgacagagatttgggggtttcctttattttctttgagttttgggggttgttgtttttagtttgttttctttaagtccatcttcttctctctgtggtttattttaaatacactgattcaggttactcttattgcagtaagtaacagttggcagggcctgctaactcagcatgtgtcatagactccattgtccctttcacagggacctggtgactgcagaaggggactaggtctcatccaggaaatacaccccagaatcccgtgcgggactcaacccatatcatgttccggctccttaacttacattggcattaatagcttaaaggagaatagccactgacagtgtctgtctaaaataacaacagggtgatgttgaggaagatgagaccatcccggatagtgagcaggatatacggccgcggtttcatcgctcgaggacagtggctcagcagcatgaggaggatgggattgaggaggaagacgatgatgatgacgaaattgatgatgatgacacgatttctgactggaacctgagtaagtgaggcttcactgcttggctgtgcctgaccagcttttaatttagtgtgattttttaaggcttatccgttttgtagcttgtgtccatagttcttttctatatcagttggtacatatttgcattatgtttcccattttggtgtggggagtaatgatccatgaagattgaggtgcgggtttctttgtggtctgttggcaaatgtatccagtacaaggctgctgggtgatggcactgaccacagcgtgtgctccatggggcagcatcagtgtttctcatgttcatgtctcctgtcctgttgtcactaatgaatatgacttggaatccttggtttttatttcccttatagcatgttgttgtaataatcatcacgtttgccttgtttgttggattattccagtttactgtgtagccctggatggtctggagctcactatagaccaggctgacctctgaattgtgtcagtccatttgcctttagcttgttgagtacatatattactgctgtgcactgttactgtaccctgcacatcattgccttcctaaaaaggctttttcctgttttcccagcagtttttgtgtgcttgatataattacca

SEQ ID NO: 22291 - DNA, 1177 bp, Mus musculus
tttggtttggtttggtttgggtttggttttttgagccatggttcttctgtgtagccctggctgtcctggccctcgctctttagaccaggctggcctcaaactcaaaagatcttcctttctctgttgggatcaaaggtatgtgccaaccaccacctgtcttatccttagtctttcgatgggtcttttattacagattcttaagcttgtcattcagtggtagagcggctgaaggcattttggtgtctttctttaggtgattttcatgaatttttgttaattttaattagtggatgtatcgtaggtattatagaaaagcaaattgtagggtttttgtacagatgtttggtgaagttttaaaaattggaaacggtgtgcaatgagatgaaaagtgtctgctgtgtgctgcctgtgatgcacaccccacactgaggcgatggtgactgaggtagcagcctgggtctcttggtgggtttgaagtgtgtgttatgcatgtgccccacacagtgcattatgctctaaatgtgtgttgtctttctaggtattttaattacaaccatagcctccaagggagagctgcagaattggcctgatctcttaccaaaactctgtagcctgctggattccgaagactacaacacttgtgaggtactgctgtttatctgctcatagcatgggttaactctgggaaagtgcttctgaaatggacaacttcaaagtgcagagcctaaagctccctttgtattttatacttgttaaccttttactggttttctgggaataatatgacaaaaatctgttttctctaaggaaagattttgtctttctaaagttattcttaaatgttacactcatgtgattaacagctgtttatactacatttaatcaatttttaattgtatatgtggaaatgttttgccttcgtgtatatgtgtgtgcccatgtatgtgtttggtgctttcaagatcagaaaaggtcatcagattttcctaaactggctatggaatggttttgaattactgtgtaggtcctgggaagcaaacttgtgtcctctgcaagagtgatgagcactcttcccttccagcagctgtctccccgcccctccctgatggcttacatacataaaaaaaataagctgaaatttcccaaagcaccagaccataaactgtttttgtttctc

SEQ ID NO: 22292 - DNA, 1170 bp, Mus musculus
cttgatttgcagcaaaccaagatggagtatgagtggaaacctgacgagcaagggcttcagcagatcctgcagctgctcaaggagtcccagtccccagacaccaccatccagaggaccgtgcaacaagtatccttgccgtgcggggccgggcctcacgcagccgccgcccgccgcccctccgggccgcggcccccaccccgccggcctcgtgcacgcggccgcagcccgccaggcccgccaccgccgcgtggggctcggctgccgcttccgggccgccgccggggaggccacacgtgccgccccgccacgtccccgctgctgagcgggagcggccgggcccacacaatgaccggcggggcgggggcgccgggcctgcgagcgggctgaggcgggcggcacggcgcggctgggggtggagctggcgcggggtttgaactgtcgggagagagagaaggcccgcccggagctttctgcagaggcgcctgaatggccggcgactctggttggtgctcgtgggaacacctgttgcagcctccctggcgctccagtgaggtttgcatgggcgacagctacccaaggggttgctgtgggctgagtgctggtgtagaggtcctgttgtcacagttggagaaacgaacatttgcagggtgcacggatggagagctgcaggctccagaggcaaacagacccgcagatggcagcctcttacccctgttaagtccaagcaagttaattctttaagaacttagatttgtgtgttcacaccagattcccttgtaatgctttccagtaaggagcaaaatcatctaatagggaattaggtaaattaagtgagatcctgctgtttgagcttatttcattttttttttaaaatccacagaggtgacgttacaagagggtttgaagcagtactgtattgctgtaacctcagtcctctagtagacgactgagtatgacactgcccgtttaaaaatggatagaacagtgacgtaaatctacttgaattgtttaaaaagccattttgttggaatacctttgatactagggaaaaaagtagttttaggtatagtggagcttttatctgaacatgctataaacaccttaattttgtgttgtcatagatttatgggtagtaaaagttgaaaaaaaatgttaagtatcttacgaaac

SEQ ID NO: 22293 - DNA, 1194 bp, Mus musculus
tctaagatgtcttttgggttttctggttctagggtactagtatcacctaccatgtctgtctgtgccactgtagtaagtgctttagactgggtggcatccctcctggtctatagatggtgcctttctgctgtatcttcatgtggttataccatatggcggagtaagagaggaagtgccaacagtctgcctcagccttcttctgagggcaccctttcactccagagacccacatgttgctgtggtactgtgtcctcgtctgaccttctcatcagctccgtttcacatagggagaccgttgctcagcaagtttcctgagaaggtgaaacagacagatgagccagcacacagggctctgactgtggtcagcccaggaacccaagcctaacaaacaggtcaaaggcatttctgctcttacagaggaccgtggttcaatccccacgcccacatggggcctcacaactgtatctccaggttcagggcttttcataccctggtgccttgggcaccaggcacacatgtggcatatgtacatacatgcagacaaaaacatgatacacaaaatggaaaagaaaacattttgaaataatttcctttgctgtgtttgtctgctctgtccatcctcctgtagccgaatggttactgagctgtgtgcgccccgttaattgtttgagctgctttcagcaaacaactgcacggttaggtcagcacactgctaattgcatttctaactgcttacctttgttttgttttggttttttttttttttgggtttttcgaggcagggtttctctgtgtagccctggctgtcctggaacgtactctgtagaccaggctgaactcagaaatccgcccgcctctgcctcctgagtgctgggattaaagtcgtgtgccaccacacctggcaccttaaaaaaaaaaaacaaacaaacaattaatttactcttgaaactgtgctttctcatctggcccttgagagtggctctctcgctgtgcttgctcctcctcctgcttcccttagcacatcagtaccctgtctgtgagggtaggttgggatataagtgagaagtaacagagctgtttcagttagaacaatctaacagtcagatggcatgcttgttatcaaagtgacgtgtagtggttatccccatatgctagcaattgttttcttagaaatcagcttggtttcatattgac

SEQ ID NO: 22294 - DNA, 1111 bp, Mus musculus
gcttagatcatgggtgggacagaggaagggacatgacacagaaaaggactgtcagatgaccacacaacttctattgccagctcatctgatatgtggatcccaggtgagggacagaagggatggaagacagaggaaagagaaagcaagcctgtgcctcttctcatatctggcaatgtgtctggaagagatatatgtcttcttcattgttctgtccctatggccatcttctcctcagggtctaaactactgccacatgctgtccccttcctgtggcacccactttacaagtgaagtcaacttgctcatggaagacaccatctgcctcagggctttggtccctggtgcatgaacagtctgtgatccaaggcagctggaaagctgaggctcccagaagcacctgtaactccaaaggtctagctctcttactcctcggggtatgatgacccaagctatgttccccagtggctcttgggtacccgaccaggccatggctgagcttggcaatacatcttcccatagacttcctggccacacctggctcgctgccctccatttgtgtccctggcttcactttcctcagagctgctgtgctccaaccttgtctcttgagcttctggaaagccatgtaatctactctctgtattaactgctctccaggactccatctccactcggctcaggcccacctatctaccttctcagagaggaagaagatgcctgcggagtcactgctcctcaaagcatccttcatgtttctctgcagcccattctgaagtgtgggctgtggaggctggcccctcttgcctcagacgtaagactcttggtgctgctcccctactgcgaaaccttctgtaagggctgacatgacacctacctctgtaccctcactgacttgtgctgatttgctttagccaaacttcctggccagaggcagagagaaggtcattgccttcatacctcatggtcctctgttctctgcccatgggcaatggtgacgtgagctgaagatcccagaaaagaaaggcatgtttaagttaaagtgtctacaaggctcattgattagaactttgtgattgtggggaactggaatgttacagatccagagccaaat

SEQ ID NO: 22295 - DNA, 1153 bp, Mus musculus
tcaaactatacaaggacaaaccctgtacttggaagtcatctctgattggggaatgtaaagagatacctcccaaagtacatcattgtcaattgcgttttccccctactgacatcaaaagtcagggtaggtaaagacatgcaaatacaagtttcatttcaagagaaacagcaggagaagctctggcaaactggataatttcgattactgaatggtacatgttcattactcattatttataaggcgatagagaaccccccccccacacacacacccgtgcctgctgggttaatgggaaaatttccagtaaagcctagcgatgccaatgctctgtgtgtgctgtgtaaagcccacagtgaactagaaggtcaggccttcttaattcattagtcggtaacctattagttctgaaagctactgagtctgctttgtcatcgttttcccagagcattccccagagtagcactctctctgtaaaatattgagcttattaagagtttttggacctctgattaacgttcacagcaaaaagctgtgttaagtaaattaggcactagataaatctaaagtgattgtgagccgtcgtcagctaaattaggacgctgatggctcgcataacaagatgcaaagcaatagtaattaagaaaaataatcaccttggctgctgagagctcaggcttggcctcaggtgaagcaaatctccagctatgtcttgtaaacagtgaggcaaatcttactgttttgtccttttatgaaggagtgggcttagatcctagccctcttggacagtctagtggaatggtatgtgtaaagagtaaccttgattgcaggagaacaacagtatcgtcgttactgttctgttgctgtgaagacacgcatgaccaaggtaacatagaaaagaaagcatttaaccgggggcttgcttatagtttcagaggataaaatccctgaccacaatgacagggtgcatagtagcagacaggcacggtgctggagcagtagctgagagctcacactttattagcaagttagaggcagagagagtctgggactaatgtaggcttttgaaacctccaagtccagccttagtaccacacctgcccccaacaaaacgatgcctcctaatcctttcccaaatagccccaccaacttagga

SEQ ID NO: 22296 - DNA, 1221 bp, Mus musculus
ccttagtagttttaactgttgaccacactgtattgtttctcttctagcatctacaaggcttcttcctagattcaacgtcattcaatattttgatggatatgttatttaccaaaggcaaatatgaacgtaagtattacatacagtctgaggttatggaaaaactcccccggaatagcagctcgggtgggaagcgccttagaggtgaccttagattcctgttgaggagccccagtgtgacctcactcctgaagtttgaaaacatctctctgtgtgtggtggctgacgagaaccaccccagattatctgaaaccttagcaagtttctgtgcgttcttcctacctgatctggctccgtgctatttgactttgaggaagggctttcatcatgttaaaatctgctctctggtaggtggtgctgaactgattagaattttggccactgccaggaggtgcttttaactgctggccgctctttccttcattgcaggtgcacttcaagtgttgatcgaaatgaaaaaccaagatgtgaggttcagcaaagaaacctacatcctcgcttttgcaatctgctacaaactggtaagagcgtttccctaaccctctgggcgctgggcattgaggaggatctgagagtgaatttattctccccctcccccctttctttctctggttcctttaaaatctactttccatctggcacaaatacttcaattttaaattagatcttgaaaacaagagacaagtccctgctgggctccagaatctctgctcggttagactattctagatcaggccctgctcccctctggaaatcatcccatccttctggggtgagctctacatgtgattgccgtcatgtgttctttctatgtatgggcgtttcacacaagtgcctatctgtgcactgcatgcatgcctggtgcctgtggaagtcagaagagggtatctgaccttccgaaactaaacttgcaggtggttatgaaccatgatgtgagtgctgggagttaacccctatcctctaccagtcagtgctcttaaccacttagccatctcctaagccctgctaccacgtagtctcgatttgttctgctaagcctttgtaaatctttaagccattcttagctataggtctgaaggctagtttactgccctcaggatgaggtcatccttcccagtcatacagcactaccatgggtcattccaaacggtgactcccaggtag

SEQ ID NO: 22297 - DNA, 1615 bp, Mus musculus
ggtgcagctgcactgtgtgtgccaaggtggggtgatgtcgtgtgcggggctgcactgctccctggggtgatgtcgtgtgcctggctgcactgctcacaccttggtttaacagctgagcaggagagcccagcgagaggcagctgcccctgcaggacagatgcagggcaccttcctgcaagcagatggagcggctgttagcggaggactcagttgcttctcactgtcctcctttctcctgcctgtcccttacctttcgatttccctttgcttccaacaggcctctcggtctaaactgcaggagctgaacagagttgagtctgaaagtcttttgactctgaccacccagcttgtaaaagaaaaactccccgcctgtgaggccgaggacctggccacctacgagcagaaactccgtgagtggcacctggagcgggtgcagttgatccagagggagcaggaacagagggagaaggccaagcaagagtaccaggcgctgagtgcggcagagaaagcagcctgaagttctgtgagccacctcagtgttcagccaggacagcatggggctccgccgctactgtccagttcttttcttacaggaagctgtgcatagcctgaaaacaaggatggctctatgccaagacactgtctgcccatctagatgtcaagggccctgaactaagtgacaaacggttgggctgaagcccccacacagtggagtcctgggtgcagactgggaatatcgggtgagcgtgacgggaagctatagctgaagggtcggctctgcagcacgggtgtttgaatgatttcctgcccttggccatgtgcatggagcaccgagcttcatgaccaggtgctggtagactcagaaccacccacgttccagaaccgggtgcttgctcctttcacccgcttccaggactcagcaccagtggccacatgacctgctgtcagtgtgacacatttccactgttaacactggtctcatattctccctgtgcatatgtgccatatatagctggcaccttcatggtctgtccccttcccatcactgctcagaagcagccttttgtatacctgcctccccaataaatcctacccatgtgggctgttgtgtggtgtgattttgtggcattccttggccagtcacctcaagaacccttacacctgagaccctgtgaccatagtccccctcactagtgcaaaacaaataccctggtgatctggccttgtgtattcacacagccccactacctctttcccatcatgccctgccctccccttctccctttgggagaagtccagcacagaaggtctccagaccacaagctccctagatttctgattacagggatccacagtgacacataatgtaaaagcttttggggagaaacttggccctaggagtgaaacccttatgctctgacttcagcatatcagggtaactttccacacattgtcagatttgtaaatgagcctttggtatgcgtgtgcacacacagggcaactttagagcagacatttctatgaagggagaaaacgaagagggggatggtgttaaacctgagaactgcgagagaaataccaagtccacaatttttgagccaaatctgaagtaatt

SEQ ID NO: 22298 - DNA, 3268 bp, Mus musculus
ttttttttttttttttagctactcgagaacttttcatagatgaactttttaacaaatgttttcatttacaggaaaacgcaaagaaaattttgaaacgatggtctttctttttaattattattttaagtgttttttgtaagacaaaaattgaagtttttttaaggttctggcaagatttgaagtctgatattgaagtcatgatatttatttttaaaaacctgtcactaccagaaacggtggtacctcctgccctttgactctcataccgtgaaagttgagtccgtgctgtttgagagtgggtaggtggcggggtaggctactgtccggggcatcacccagtgctatcccctcctcctttcaagattattcaccatgaggtaaaagagccaagttcagaagtaccctagcacccagtttgcttgggttggttttttgtttttgtttttcctggaaaacattcagtgagagaagtaatagattgaaaacaaatgaattctcaacttctatgttgaccatgtagagagttcagacataatgtctgtcgatgtcatcactgaaccacagacttgcgccgccagatcgcgaggaaaactgtcgccaagtttcaagtggcagattcacgtcccagggttcagaggtggcaaacttctcagtggcagctgtgctcggtcatgctacgtttcctgcagactcttaagatctacggggtagtgaacaatgacctcattttattttctatgttagttatttatttcaaaatttacattttagtttattttcgtctgtaaagcgtatgtttcgcactgctcttttactctgagggtttaaacaatatttctccaggggtttcctcactgagaacccatgcagtctacttaatgctgtgaatcacattttccaaatgtttaattttttaaagaaaattaatattctatttttgttaggtgtctctaggaatgcagcttttttatttattatcctgtttctttcaaaacccgtaacagtgacacgttaaaggtacaaaactgtcctatctgatggaaaagtcatcctgatgaaaacagagttcgttgcctgtaagcccacttgcttctcacttcatcagacaagctcaatacacacaagatagtaatttaatgggagctgttaggctggtccacacgtgaagagaaacaatttctagccttcttgccaaatccagacctctggttgacttttctttcatagaagatggagttatcttccagttttccaacttaaatttatttagcctttatattattttgttttaatatatatatataaataccttagaagagccatagccagccttcagttataaccactcgacccccatacctcttattgtttctacagaatctaatggggaaaaatgcttcacaaaactgtcactgatccattggctctgattcctacacaatctggcaggcaccctcctgcacccctgtcctcagtgatggccacggagccgagccgaggacaccagggtgaagtacatttgctttacaaggggctcctgacctcccaggcacctctcctacctgtgtggctaatctgatcttgctagttccatacatacacaattagtttagaggtagccaccacaatgggaccgtgtacatttgtggtgaaagctaaaaaccgacacagacttctagaagatttgtgcatacgattcttaatccaattgtatagattgaatatttgagtggaaggcatttccaccctgtttaaatgatggaattctattgagctagcactcctgatcatgacctttttagtagtatttgtaaacaaaattctacagagactaaatcttagcgataatcctccatttcaattttaaccaattctgtcctctttttccaaaccccgaaccccatgcatgctttctcagtcttgtgatgggactggacacagtgaccgacccctcgcccaaacaccattttccatggaattcaaaagaaaatttttttcccttaacgttacatatcatagtgaatggtttccccagtgtatatgaatgttttaagtgtttccaatagcttatgaaatttaggagctttctaatactcgttttataaatttaatcatttgctaatggaaattttaccacctcccacttctgttacaaatcttagctcccggagcggcgctacaattccagagttgttctgctcacccccctctgtcatttgtcacaggaggtccctgcttggcaatgacatttgtgagttaggataatgactttccttctcttctttttttcctttcgtacttaagatttaggagaaaaagattctgtttccacctgagaggaactgtaagcttttatcatttaaccagctgaacaccacaccaaaagcagcctacggatgagcaccgctttggtagcaattaggttttattcacctggtattaaaactattcactatttcaaaacaaaaacaaaaaccgagactttatgaattcatttcaaggcagcatcaaaaaactgaaaaggaaggaaaacaacaacagctaataatcggcttctccgcacgtgtggagctccggagaaacaggcgccccggagaagtggctctgctcagccgcccgcccacgccgcgccgccggtccttgctttcccgcatgcgcccgcccgcggcaacgtgcagtcctacgtccggctgcggagaagtccactctctctcttgttatgaatggtgtttgtgtcggtctgcagctgtgtatggtattatgtcttataatcctgcatcacttccatcctatccagtcatatctaatgtagaaaaattagtttccagtgaaagtaatatgtagtgcttttatgatatttgtgtgcaatatcccctcttctatcaaggatatttgatgtaaaggaaaaacaaacaaacaaacaacagaaactcagttccacaataaaatacaaagtggcaaaagttcactcatgtgttgagacatctttggcttccttgtcatttggactttgcctccaggatcaggcgtttcattggtgggctccctggctttatttgggtgatcagtcaagagggccccagctgatttttgcaacttattttcggtgtcttttaatagtcaagccaatagctcctcaggggaaggacttggtgcccacaagaaggagacttctgaacacaatttttgtaattaagtgggcatttgatggctggtggaccacaccctgggaggcacccatcccagcagtgacccaggtcactgccag

SEQ ID NO: 22299 - DNA, 1150 bp, Mus musculus
ccctccgtaggtgactctgattccgacacatgactccgaggtgatgagggagtggtaccaggagacccacgagaagcagcaggacctcaacatcatggtcttagcaagcagcagtacagtggtcatgcaagacgagtccttccccgcatgcaagatagaactgtagagaccgcagccggccacaccacaggatttgaactgtgtttccagaaattcttgaatttgaaactaccttttctaaaacgtccattcatccaattaagtcactgaacagttattacctgccagatgctatactatgtcatggtgatgcaagtcactgatagttctcaatttttgctgactgctaagggaagtaaccatattcccacaatagatttcgagttactgcaaaattgcctacccccgttcatctctgctgaacattcggaagccatgcactcacgcacccaactgacttctgctaggtattggcatttatcatagagagagaaagagagggaaagagagtcagcgggaggggagggagagaggcgggagagagggacaaagagactgcaggagagagagagagagtgagaggggaagaatcagaaagaaaaagaatgcaagagacaaaggtagagagttctgatgagatgcccagggagagagagtgggcaagatggggtatagagaagacaccagcaaccaggtctgcattttctcagaccacagctattctgtggtctacacaggtggagtttcccattttcatcagagtcatcagaaagagtcttattctcctaaagcgtgtttctaaagaacaaaaagaatgaagcctgttacgagggcatgagctttttcacgccttaattcaatgcctttgctattataaaggctgcacacggcataatgtagcaagtgtagactggatgagtgagtggtttgcgccccattcagaactctcagacttttcgaacacgtgagtaggttgatctaaggcatgctcccagcatttgtctacccaagtccacaccaagtcaagctgcatgcagcaacacccaagtccaccccggttaactgaagcaaataccaaagcaggtgggagtacacatgggagacattttgccttaggaagtgacttgaatgtacaaagacacctgatgca

SEQ ID NO: 22300 - DNA, 1134 bp, Mus musculus
gtggttaagaaggaagacaaaacacccctcaagaaagacgagaagccaagaaaggaagaggtgaagaaggagatcaagaaagaaatcaaaaaagaagagagaaaggagctgaagaaagaggtgaagaaggaaacacccctgaaggatgccaagaaggaggtgaagaaagaggagaagaaagaagttaaaaaggaagagaaggaacccaaaaaggaaatcaagaagatctccaaggacataaagaaatcaactcctctgtcagacacaaagaagccatctgcgttaaaaccaaaagtagcgaagaaagaagagtccactaagaaggagcctcttgctgctgggaaactcaaggacaaggggaaagtcaaagtcattaaaaaggaaggcaagaccacagaagcagctgccacagctgttggcactgctgccaccacagctgccgtggtggctgcagctggaatagcggccagtggtcctgtcaaagaactggaagctgagaggtcccttatgtcctcccctgaggatctaaccaaggactttgaggagctaaaggctgaggagattgatgtggccaaggacatcaagcctcagctggagctcattgaagatgaagagaaactgaaggaaacccagccgggagaagcctacgtcatccagaaagagacggaagtcagcaaaggttccgctgagtcacccgatgagggaatcaccaccaccgagggggagggcgagtgtgagcaaacccctgaggagctggagccagttgagaagcagggcgtggatgacattgagaagtttgaagatgaaggagctggttttgaagaatcctcagagaccggagactacgaagagaaggcggaaactgaggaggctgaggaaccggaagaggacggggaagacaatgcgagcgggagtgcctctaagcacagccccacagaagatgacgaaagcgcaaaggctgaggcggacgtgcacctcaaggagaagagggagtctgtggtcagtggtgacgaccgggcggaagaagacatggatgatgtgcttgagaaaggagaagctgaacagtctgaggaagagggcgaagaggaggacaaagcagaggatgccagagaggaaggctatgagcccgacaaa

SEQ ID NO: 22301 - DNA, 2310 bp, Mus musculus
atatcaagttgcaataagaccaggcacctcccctcacattaaggctggccgaggcagatgtcctagagagctaggatcaaaccaaacatgcctggaaaaaagaaaacagaaaagtaaagaaatgattcctaatgatattctgctatcctcatagacaggagcctggcataatcgccatcagagaggctccatccagcaactgaaggaaactgatgcgagccacacagccagacattaggcagagctcagtgagtactgcagaagacggggaggaaggattgtaggagccagagggatcaagaacaccatcagaaaacccacagaatcagcaaaccttgacgtaggagtccacagtatagtctgatcagattccggcatgctagaggttttaatggctgtagcccatgtcttataaaaagtcttataaaaagcttaatccccttccattttgcagaagtctccgtctctttcaatggactttctgcctttcagggtagaatgcatgattgtggctaacgatgccaccgtcaaaggaggcacctactacccagtgactgtgaaaaagcacgtgcgggcacaagagattgcgctgcagaaccgactcccatgcatctatctgggcaagtcacaagtgcgccgtgaactgttttagctggtaaaatggaaggctgagtggaagtctgtgccattgttactgggtgtttgaaaatactgctggttcgttcctcctgcagttagaaagcaatatagtgtttactaagagctgctgtgaagggttgctaagaactgtccattgtaccacagtgtacacagtggtacattcctctggatattttatttttctgtttactttaattaattcaagccattaaaaatagccaatatctgtggatctcttgagagtcaaacattatgttaaatacttgagtgttacatagtttgaatatttgtaatttaaggtacagtgaatttccagagagagtcagtcttcatttgaaagttaagtacatttgcattaaaggctgttttgaacagaatctaaaagcagagcactttagaactggcacgttctgggtactggcttagtttgccaaaactcttgcacatgctactcatgtacaaatgtgtaaatatttgaataggtcataatgtagattgtttttttcttttttctgggaaagtaaatttacctggttgacatataaggtgaatttctttgagcacatagaaagtagaaaatgaaactgcttgcaggcgccgggcgtgcatactgaagagcattaacattgtttctgtcttcaaggaagtcatatttaatggaagacagatgcaaaatattaaataataaaagaaaatgattataggcaagaataataataggtatagggctagttaacttctatttcattcattcattcattctctctctctctctctctctctctctctttctctctttctcctctttttgacacatggtctaggtagccttggctagcttggaactgaccgagatccacaggcctctgccttccgagtgctaggattaaagacaccaccacaccctgctctaagttttccttttaacatttgttctgtacactcatagagtagatgctggactcaaagctttttacatacgtgatttcacgtcctcctgaaagctctatgaaatggctactgttgtttacctcatggctgaagaagttggaggtgcacaggatgtcctgtaagcacacctttgatctcacaaccacacagccttgctgttggacctcactgcgatctgtaggaaaactactctgaatacttaggaagctggtgcagaaggatcatatagctaaaccactcagacaaacaaacaaacaaactcaaagcccaaacaacaacagaaacactgaaagaaaggaacatacaaattatccataagtcctttaacggttttcgtatcgatctaggaagatgtgttttcagttctactggcaaattcatgcatttgtaggtcttttgctgctcttttaagggacaaagtttcctgagctgttcgtatgaagctgtgaaaaaaggctagaaaggaaactgtctgagaggaaactttttggttgtgttgggggacccgagattctagcatacattgaagatagggggcaggcattggtgaggagcactgtggctgtttgtcgtcttctgtgctcacttctctcattttccttattcagttgactcaggaggggccaacttacctcggcaagcagacacctttccagaccgggaccactttggccgcatattctataatcaggcaattat

SEQ ID NO: 22302 - DNA, 2400 bp, Mus musculus
agtatccaaactgtcagcttcctgcttgggcagcaagcgttgtaatcactgagcggtctctccaggtgctctctcccctagactgtgttacagaagccgtcttattagtaagtattgaagctcttcttgcctagggattgggtcacttggttttcctttttgctaattgagccccaggccttatgtcagctaggaaggcactgtaccatccccagtagcaagatctaaacagtatattacatttcagctttcttaccttcctaggtttcttctgatcagcccttgctaaaagaagagtgtaaaaatgggcccaaaggagcacctgaggaagaggtgaccccagtctcagagtttgtcttcagtgacatcttcattgaagtggatgagacactataaagctctctcctggggccccttctttttactttctacttttgtaatgagtttgagatttccagcgaccctgactttcaccaagcagaaaagcaccactgtctgttttgatttaggtcaattttgaatatttattgagcttcatttgaagcttttataatcagtgggaaacatttctttctgattgaccctgcatttggaaatatcaagcaattaagactggtctcactgacaggcattgtagcttgtttacatttgatgtcctctgtgctgagcgcacctggacttgagaactgtgtgcacgcacatctgtataaatcgtagtgctggcacactgggagcttgattgtgcttaacatttgctgcccttcttttctaaaggtggctgtgttttgtttctgtattttgttttgttttttattttgtttttttctttctttcatttttctttttcttgagggtgatcagttgcctgtaacaatatgaaagcaaagtgtgaaactccactttggtatggtaaagttaaaacttttctatcatcatctatttgactgaaaaaaaaaatgtatatttttctaattcatggtgatgtaacattagtcctgattgaagatctagtatttaaacttgctatttataaagtcggcacatcaaagagatttatttttaaattttttatttaaaatatatcccaatttaattattttcactcatcaaatttgggtaaagaaagcattaacaaataatttgtctccttttcctctttactttaaaagctattttaaaatgtcataattaaaaatgtttagtgttcatattttgaatacttttctcacactttaatatactgaatttgtactgtgaatattttttgcttttcttattctaatctcaggattttcattggaagaaaaaaattaacataaaggacaaattgtcttgtataattgatcttttttacacacacacacacccttaaaaaaaggtttagtgatagctattttccctactaaattctgttcacaggacatgtgggctttcagccacagaacatgaatctgatgttaaagcagaaaataaggcagccagtgaggtcctcattatgaacttgggtgtttttaattttgagtctttatgatttatgtgtcttgttttccctaacagtttttcccctggttcaaattaaatgcttccaagagcaaatgtattcaactttattataaaaccttatagattgatacatagaagtttttccataaaagattctttttgaactgtgtagcccaagtggtcctggtagcagctgcttaggcaggatgtgcctaagattcaaaaactgttcagtgtattaggaaatgagcaatacttcagttggaaaatatttttacatctaggtaatttttgtttttcatattgataaaatggtgaccacttttcaagtttctaagcaaacaagggtcgaactcaatgagtctagagtgctgattcattgaacttactgtgagcctgtttcctgttctgtggcttagagtcaaatgtatagtttaatgtctgctataaagggagatctataagttagatggaaattctcaaaagtatgcatctatttcatgtgactaatgtcacaaaatcatggaggtaattcacattgctatataaatgcctttttgttagtttttaaaatgtcatgttctgtaaagtttgtttgtttgtttttgtaaatgttacttgggttagatcaccgagactaaactattatttatccctgtataatatttatttttttaacctctgtctcatttatctgtaataaactgattttatggaagatgtaatttattgtataaagactacaggggcatttgttgtatagagaatcatgtcggtcaacaaattgtcctgctgccactggacaaaccggtgctaggaagagaaatacaatcagtgtgcttagctttaaggtgggaagatttgtgatggtggaaagatgttgcaaggaatttgtta

SEQ ID NO: 22303 - DNA, 1189 bp, Mus musculus
tgattattttatctcagtcatcatatcatggttattagactaggattaaaaatttattatgtagaaaaatcccccttactctgcaatatttctagatatataagtaagaattcactctgaataagatgctaagttgtagtcagttccttttttattttcatgtcttatattttaaaagaatgggtggggctggcatacagttcatgagcacatttgtgtatgacttttgaggccttaggttcaattctaatgccataaaatgaaatggtatagcatcatcctcattgtcattgttgggcgttgaattaagactttccatgctgggtaagcgccctaccactgagctacagccttagctcgggctctttattcagtggctggaactgaggttttactgtgaacagtaaggctttcactgagatcatcctggtgcttacatgatgatatctgtcactctggttacagatccagctgtccacaactatggaaagaatcaagctatcccaagactgtttcgagtcgaagaacccctctctcttctgcctctgagtgtgaaatagagcacagttggaaaagaacacagaggaagacgaaaccaaatctgaccaaagggcgtggatcaaaacgaattcgaggtaagactgctaagaaggaacctagagcttccaagtccgtgttggtgactcttcgggcttctcagaaagaggatgaagatgatgctgaggattttgattctgactatgaggaagaaacctatcatcttgccccagaagaattaagcaaagcaccagtgtttgtacctgttggtctcagatcccctgaaccagtttctgctcagatcgaggaaacaatggaagaggtagtttgtgttttgttttgttttttcaatttctggcactttcacccctttaatggatggttgtttcttctcttagatttattagagtctgaagagttctttctctaaacatcaatgtcaaaagtaattatttgggacttagtgaacaccgtaaggaacacagcgggagtggcctgtatggcccgcactcagttgtcagccccttactccacagggctacgataggaagctgcttatccttgtgtctgtaagctacttaatctggcttttgactaatttgaagaaagtcttggcaggtgttttctatgtttggttgctaaagaagataga

SEQ ID NO: 22304 - DNA, 1124 bp, Mus musculus
cttttatagtatcatgtctgcatggcactgtagtgagtcattgcacttcttgctcagaatggggtgaccttgttttggctgtaaatcatgaatactggatgcccagttcaggtcataatttttaaaacctaagtggcttaggcatatggcacaatgacagtgcatgcagatctttcaggttcagtcccagcatcccagagaggagaaatagaaatgggaatattcgttctttgattaaaatgttttaagacattttatagttaaatattaaatctcatgccaggggttggtggctaacacctttaatttcaagctctctaggggcagaggcaggtggctctctgagtttgaggccagcctggtctacagagtgagttccagtgggctacagagaaaccctcactcaaaaaaaacaaaacaaaataaaacaatctcactcactcggcttcgtcttttcaggcaaactcttctcacattgaaagtggagttgcagttgacatgtcctccagagtgtcagagtgccaagtgagtgaaagtcaaggccacgcagatcctgtagaaaacttaagtgttaataaagccagtgttgttcatgaacagatgaggtgagtctagttttcatgagaaaaacatgaaccatgtcaaacacagtttcttattgttacatacttggttttattcaaagacattctgcgttgctgttgtgttttctggtgccttttcatgccaggcaagtgttgtaccattcttatgttctctgaaacagaactttgctaagttgtccagtttggcttttaaacttgcttataggccaggtaaaccataatttgtgatgctgctgtttcagccttagtagctgagatgaagcttgtgccagcagtcctggtttaaaattatctcattctgtatagggtgtggtggcttgtgcctttaattttagcacttgggaggcagaggcaggagctctctgagttcaagtgtagccaggactatgtctagaaactctgtctcaaaaacaaaaacaacaacaacaacaaaaaaaacccaacttacccaaacccaacttgttccttatctttaggctcataagtttgttgtctcctttgaacttagtaatattttac

SEQ ID NO: 22305 - DNA, 1136 bp, Mus musculus
agctagacagcaagttccaggcgagcctggacaacacaaagcctggtctgaaagacagacagacaaaaaggacaatagagcagtttatttacctttagtccaaaggtattttgaaaatgctgtaaccggaaaacaggttggcatttatttctgtaccttaaaatcacatttggaaaaatatatatttcaaatttattatcctttttcaaatatattttatattttctgtactaagtgctgtgtaaatcttagaatgcagtaattaaatctcatctactgtttttcatacttgggtttttagtgtgactgtattgagaatgtcttctttcagtttaactgtagaagttttgagaacaaaaggcccctgcgtcgttgaagagaatgatcctatatttgagcgcggctccactactacttactccagcttcaggaagaactactactcaaagccatggtccaataaaggtaactaatgttcatcaaaggtcttttggaataaaatgaacttttatttaagcttctgacttcttgtaaataaaatggaacctgccacgttggtttccactcagatttattggttcccctccccttcccctactatatctttgacttttgatcattttgcctggaatctgtttcagactgtacagagaacctccatttaagtgaatagttggcagtgtttctgtgtgagcactaacctttgtgccggtgggtcattgtttttgtaggatttaatcatagcagtactcgccttgcagatgctgttcccgcagcagtcacggtgcctgcctgtaacacagactgaggggcttaggcagggcggccagggagtgtgagtccagcaacagacagcacaacacgacagcaacagagcacacaggcacatttcatggttttccttactgctttttactttaagaatggtttttaagtatggtagcatatagggcaaaaggaaattttttgtactttctccctcctctgactattaacaacttgtttttttttttttaaggtaaattctgtcgggcttgttacattttccctcacttcctccttccctttcccagtgttataaataccagggcccctttagtccagtaaacatttttccaagtgcttgtctgtatgtc

SEQ ID NO: 22306 - DNA, 1193 bp, Mus musculus
gttttaggacatgaacacacacacacacacacacagagacacgatgttaaaattaagtcacactaaatatgtattgtaaatatctgacaaagtactgacatatttaaaatataagaaaattattgtaactcaataataaaactaattttaaagcgagtaagctgggtctggtagtcctggctgtggcacatttctggcagtcggatggctgtgtaggtgtgtcagctacagcaatggagggaccccttccctaatgcaggagctcttaccccttctctgcttccctttagcgcatcatgactgatcagctagctgaaaacaaactgctgaactaaagaagttttctccttagtggatgaagatggagatggcaatgggaacatgaacttggccctcccatatggtcactgaaaaaccccaacaagccaattcaggatatcccagaatctttactctgatggaaaaaaagaagaaagaagaaagaaaaaaagaaggatgcaaatcctgtacctcgcttggcctgtgcttcattcagttcttgcctccaggcacctgctttgagtccttgccttggcgcccccagcgatggactgttagctgtgaaccaaaagagctcttccttttctgagctggctatggttaagttttatcacaggaacagaaaacaaactagggcagtgtgcatttgaaaatgatctttttcatgtgtacacatcttgcttaggaaagtggtgttaaaaaacattacttcagggctggagagatggctcattggttaagagcactgactgctcttcccaaggtcctgagttcaattcccagcaaccacatggtggctcacaaccatccgtaatgagatctggcgtcctcttctggggtgtctgaagacagctacagtgtactcacatataataaataaataaatctttaaaaaaaaaaaaacaactgtcttcttaaaacaaaacaaaacaaaacaaaaaaaacaaaacaaaaaaaacattacttcaaaactcgaggcgggacagggtctctggctgtagaaatcatacaattcaggatggaactagggccttcgctccattggcttatttaaggacttagtctttgactttagtgatcccagagtttacctcagaccctcgtctgtggctccagtggtcccagagatcaccttgggacctggcctttgatct

SEQ ID NO: 22307 - DNA, 1213 bp, Mus musculus
attactgcaagcagttgaagagcaaattatcgcacatcaagaggatggtgggagattatgacagacggaaaccttagagagatgccagttgcgggagaagggagaggtgcatctgcctgcacgatgtctctgcaattctctccagaggcaaactgactttggactctaatctgggaagttaaaactttgtgatcattacaaagtttccgtggctttaattccatcagtttcctatctccagtattgaagcattttataaatggcttttgataattgactgggctgaacactccaattaaggattttacagtttcaacattgattcttgtattaagaattaaaatgttgcttgatattttaaatgtcaagaaaggtcctggtgtgagctgtgatgtgtgttgagctttgatgtgaaggttcacacgccaggcagtgtgttcctccaggtagaccgtctaatcaatctttgcagcagccctcaggtgactgttatttagaatcaggttgtttttggttttccagacagggtttctctgtgtagccctggctgacctagaacttacgctgtagaccaggctggccttgaactcacacagcttctctgagtgctggttcaggagttaacgtcgtggaccggtatcatcacttttcctgcggtgacttctccaaactgaaactgctaaggcagttttggctaagtctgttttatgactgcaaatgacagcattcctgcctttgtatttcaggggaaatacgatacattatatcggccacgttccccaccactgtttttcttatattgacttttaacaaatgaataggattatttttggctttacattttttcctaacacttaagatcatataaaattaacaagtatgtgaaatttaagaattgtaaatatatatttacgtttgaaagatgattttaaatccagggttaaagtgctttttatcttgtatagtttacatgctttttttttttttttttgataacccactagacctttccattgtatcagagtatccaattacatttacaattatgacttgaattgtatttcacaggaatgctcaagttttgtacatattttataaggtattaaacctgatgttctctttctataatgtgctcatttgatgtcattagtactgttctattcagttgtgcaaagctatactaaagtttcagtgtgtgaactaccttgggtgc

SEQ ID NO: 22308 - DNA, 1253 bp, Mus musculus
tattcacagttggtcatttgccttgtattttttgtgtgtgagtggaaagaccacttagttcataatttcaaggagttttctgtttggttcccactgatgtcttcgctgtgactctgacaggttgaaaatggaagccctgactgaccgagagctggggctgatagaccctgacagtggggatgagtccccgcacagcggagggcagccggctcaggaagctcccggtgaacccgcgcaggctgctcagaatgccgacccagagacctggtcccttccgctgagtcagaacagcgggagcgatctgcctgccagccagcctcagcccttttcctccaaagtggacatggaagaagaggaggaggaagaggaagacataataatagaggactatgacagcgaggagacatagagaacagcctgccaatcaggttgctccttgagagataaattttagtctattcagtggtacttgaacacgtctctgaaggacaagcaatttgttaattgctcagttccttatcgtattcgtcacagcaactgacgactgtcatcttgaagtaaagcaggtctcaagtactcagtgcttagtatttatttagtcttgtgaatggtttgaggagaagtcacggtgtgaagtgtatgaatgttgtactaaatatcaaaatgtgaaggagtaatccagaatatacggactttatggggtgttggaaatttgatttataaaacagtttaggatgcaattatgagtataaataaaccttgtgccttacttacagtttgcatctagcttttcggataccatttttggtatgttgtacagtggaatattttagatacttctggaaagtatttacataatttatatcaaaattaaaaacgttggatttcatcttgttcttcttatcctttaacattacctaccgcgcactgtctgccttgggtccaggcaaggcaagtagagcaaatgttctaaaatgggaaggagctggtagcacctatgctatgcctgcttcctggcctcagctaggtggccaggcgggcggggcactgcggctcggccacgccccgggagctcggtcccagtttcggtgcccgcggcagagcgtgctgttccggcggccgcgcaggtgagtggggccgcgatgcggcgacgggacgccgagcccgcggggtgggcctttcgccctgggcacacatccccggagccgcctccctcccgcggccaggctgaagcgggagcacgcgggcgcgcc

SEQ ID NO: 22309 - DNA, 1253 bp, Mus musculus; identical to SEQ ID NO: 22308

SEQ ID NO: 22310 - DNA, 1144 bp, Mus musculus
cccaactcatagtgtatattttatcagagactgaaaatagcaaaaactggagttggtctaggctggctataaaatagctgagctggttgagagcaacaacaaagatgtaaacatccccttagtggtgagtgagcagttgatggcattccgcactgctacaagccgagatgacgacggtgccaaaagaacccgtgacacttaaatgtggctaaggggtttccccgtgtttgtgtgatttcaggcatggttgccctatgttgcctaggctgtgctagaatttgcaatcccccaggtgcgcaccaccatgcctcgcttcttcctagctgttttcgggattacaatatacagtacatagcctgttgtatggttatactaaaccgctatttttaattttgtatatgtttatatgtacacacatgtatgcatgtgtgcacacctactatagaatgtgagggtcagaggacagcttgtagacattggttctcgttcattatgtggagtaggaccaaactcaggtagtcagtcctgcttgacagcaagcaccttcaccagctgagccgactcactgcacacgtagttcttaatacattctggtgtggaaacagggtctctacagtatatagcccacagtggcctcaaactctgcctccccagtgggattacaggcatgcgctaccacgccaggctactaacgggttttatattgctcagagccttgagaacacttgagatacatgtactagccttaatacactggtatgcagttcctgcctgcgtgcagggtaagaagatcctagctggatcagactcgagctttgcagattttttaaaccatttttaaaaacaaaaaaaacaaaaaaaaaaacccctaaactataaaacacatataccttttgtgtttataattgcttttctttaatctgtagcatttttcaatagagaaatgttgatgtttgacagtgacccactgttcccttcatgccgtacctgtgttacgttccctaccccagaaggtgggtgggttgtcttagtgactttcctgttgtacacatgtgtgtgcttgatatgttaatacatcaatgtcttccctgaataaacatggcgtttctcactcgtggaccctatccttggaagatggtccagt

SEQ ID NO: 22311 - DNA, 2642 bp, Mus musculus
agatttaaggccagcccagttacaaacagctctatgccagtctgtcctcaaagcaagccccacccatctcaaaaagcaaaacaagaatagtttttggcatgggagcctcacaaaggcatagagaacctgttaagaatcaactactgagctgggtgagctaggcaggggcagagaggtatctatgagtttgaggatatcctggtctaaaaagtaaattctcaggcagccagggatataccataaaaccccgtctcatgaataaagacaactacttgttatattaggaatgactagtaagtaaagaaaaagtgctaaggcagaatggcttggtccagaaagttagctctaaagggaaacagctggggaaataaggatcaacagggttggttatgcagacttcagcatcgtgctcgtccttggggctgaataggcatctttttccccacagggaaaaaaattattttggtttttgtttgtttgtttgttttttgagacagggtttctctgtgtagccctgactgtcccggaactcactctgtagaccaggctggcctcgaactcggaaatctgcctgcctctgcctcccaagtgctgggattaaaggcgtgcgccaccacgcctggcccccacaggaaaattttaatctctctctttattaactttttatgtggatgagtgctttgcctgcttgtcacatgtgtgctggtacttcgagttcagaaggtggcagtctcctacagttatgtgattgtgttctaggtaaacctgggtcatctgcgagagctacaatgacccatcttttagccatcatctcatgctttaagaactgcacagtgattattttatcttttgtgtgtttgataagcatgcatgtgtgcactcactccacagcacatgtatgtcagtggacaaccttgtgtcaattttttctgccagtgtttttgggggaaatatgtcaagccactctgcttgcccatgagtttccagagaccctttgaccttactgtagagccccgggagtgcagatacatgctcctctttatactcactggttttggggtgtctttggcagagtagtgtatctttttttttcttttgggggaggaaagggtttattcggcttacacttccatactgctgttcatcaccaaggaagtcaggactggaactcaagcaggtcaggaagcaggagctaatgcagaggccatggaaggatgttccttactggcttgcttcccctggagtagtgtatctttaacttctgagcggctcagttgttgctctgttgctatgatacagttctctgacaaaagcgccttaaaggagaaaggcctcattttgccttaggatttcccttgaaattcagtccaccatggtggaggaggctggttggtcgcacggtccttgtactcagatacagagaatgaacaggagtagggtggagctagacagccttaaagcctaccccagtgacccagacagagtgacacttaagcctgcggggaacagttcacattcaaaccacaacagaggttttaggcagaatctgctaccaagctcacacagtgtttgtagttttggacagggctgtactggaactcactatggtcttgaactcagagctcacctccctcacctctcaagtgatgagactaaaggtgtgcaccaccaaatggccttcttatagttcttagaaattgtttggtgctgggatcaagcctagggctgtgcacataactgatgcacactgagccacagcctgagtcccagctcttagtcctaatagagtgccctgttgcccaggcttttggtgctgttacctctaggcttaacttttttctttctttcctacatgcctaagcaggttatctcaggctagccttgaacttatcctcctaaggaccccatttaggatgatgggcatgctccatcacgctaatgcttgttcttcgttgttgtttgttttagtctttttaagacagggtttctctgtgtagctttggctatcctagaacttactctgtagatgaggctagcctcaaactcagagatctgagtgctgggattaaaggcgaatgccaccaccggctggcttaactcttgggtttttaacatagctcacatttcttttactgtgtgctcactttccacaaattagcaataagtatgattttcaagtctgatttttctcatgggccactgttttaaaatgcctttggttgggggtggggtagaaacaatgtctacccacctgttcaaaggacaaacaagagtgggattccagagttcatactgggaagcccagtgagcctattaataaggcttctttacaaagcactgggtgagagtttacatgcaggagcatgggtaaccctcaagtagccacagcagaaagtctgcaccccacatggatgtgatgccctcggagctgtgtagatggagttctcttctagtaccctactcaaaaataatccgcccctcccacaagccctaaggccatgagcaattagggttaaaatcgggcccatctacacagctatgggggaatcatgtccatgttgggttcctatggttagatttcacatttgactttcttgaatgtattgattgcatcaaggaaaccctatctcaaaaaaataaaa

SEQ ID NO: 22312 - DNA, 1185 bp, Mus musculus
tgctcttaactgccaagccagctctcctgccctctgcccagcggttcttactctgtgttaatggttagcaatgcctgtaagttagataatgctctggagtacagtgagtgaacaacctttctgttttactttcaggaatattgcccaagaagctcattttttagttgcagcgaacaatggacagtttcactgctgaaataaatgatccaaaggcaaataatggaaaaaatagtgaatattaaatgctataagagagaacttgtaaatattctacagatgtaaaatatgtaaaactacgggttatttttattaaatgtattttacaataaatatttgtgatttatgattagagtacaaggataactgcagtctctaaaatgtaattgacagtgcattgggagaggcttggcatgcgattcctggttattctgcagctctgggtgatctgccactttaagatcattaggtatagtattgaaaacagaaaacaatactgttagcagttttgcaagagctttagcctacttactacccagagtaagccctgaaaagatggccctgacgcctccctgatgtcctgtcatctcgaactcactacgctcctcctgcacgcacagccaggaccttggcactgctcatcccattcctttgaccctcccccaaggaagaggcctcggggagatttgtgtttgtcttccatggttttgtactgctatcttcaaagagttccatctcaccttatggcagcctatgcctttgatcctagcatgtatggaagtggatctctaagtttgaggacagcctggtctacatagtgagctccaggccagccagagctacgcagtaaggtcctctctcaaaaagcataaataaacaaaataatcctactatagctcatactattgctttctgttttttacttagaaactttctttccatattaatagatctaaattgagttgatttaattaccatatgataatatagtacataaatagtgtaatttacctgtgctttgtttatggactattatttttttattgctgtataaattttatcatgaacatggcacgaatcgccaggcatagtggtggtttgtccctgtccaaactcgggaggtagaggcagttggatctctctgaattcagcctggattcagagtgagctccagagctacgtagtgag

SEQ ID NO: 22313 - DNA, 1180 bp, Mus musculus
catggtattcttggaaaagaacatcagctttacaaagaagtggtttttctcaggcacggtgactcctgcctttaattccagcatttgagaagtgaagtccaatctccattaagtttgaggtcaacctgatttccatattgagtttcaagctatcaggaactacacagtgagaccccttcagttgtttgtgtgcattttgtgtagtaaaaaaggtaaacagggaggtgtgcaagataattatgaggtgtgatagggcagcaacaagactgttcagtcggttcggatgagtgccggcgagcctgatgccctgggttcagggcctaacgcccactgactctagaggagagaactagcctgacaagttgtcctgtgactgccacatgagcttcgtggtgtacacacacacactgaatatttatttaataaaagtgttactgattaaaaaaaactttttacttgtagatgaagaaaaaactccagaacagattatgcaagaaaaacagatcgaagtgtatgtcatattttaatcttttatttgtggcttttactaagatgtaatcatatgatctgtgttccagggctgtctttctttcctttaggattctagataaataagtcaggtctaagttgggagcttggtgatttgcagtggagtatttggcactacggggtgatcgcttctctgctgtctggtatgccctacatggtctatgtgcttagcaaagcaactcggctcagcctgccagctctgcagacaggcttctgggcggtgggcagtgggctgtggttttcttctgttcagataaaggtgttcaactttctccccaaggagaagctttaacacagttcagtaaccaccttgacattgctgaaattcgttcctgtttcttttatagtaaaattgaagagctggagaatgaaattgaagatgtaaaaagtaatattgaaatgaaaagtcttgcactgagcaggtaatccttcctttactactaaagataagactcgggctagaggtaaacctgagcatcgagggaaggctgcggccggagggccaaactaagctgaactaaatgatgattagcagccaagcaaaatgacacaggcctatgaccccagcactcaggagactgaagctggagggccagagttcaaagccagccttagctactacacagggata

SEQ ID NO: 22314 - DNA, 1484 bp, Mus musculus
tgtacactagttcagaatttgtctaaggccgtgacaaaggcataactccaatagactgctacatctgcagatgcagttggcaccatgtgccgcctgtacataggatacctaccgtgtttacttgctcttcaataaaggttgtgacttctcattttacatagcttaactcatttgaatgttgttgcttctgagtttaggctaacggaagttgtcgaatttaggagtatattaaaaactgcatctagttttaacagtggatccaactaatgtatatatctgtagcctatatgtctatatacatccttcactgtgtgtccttatatcatcatgtcttctgcctcactctagtttaaactctaaatctaccagctagtcctttgttccattttccagtggttgccacctttaaccactgtctcttggtttgtcaactttcagatctgaaaccaagtatctttttttatgtaattatttatttgttcttaattggaaaataggatgttcaaaattaaaggtgtgttttaaaaagaatttgcccccaagtctcactatcaacagataagggtgtattcttgtatatcctgtatagatataatcatgcatatactcccaaggagatatttttatatgggttcattttatcaacagtattcctatcagcattcctttcaatgcctatattgcatttcctagtgtgaacaaactgtgtgtaacatagtcattccctcggtgggattcaagtgcattctctcagtgccctccacagtgttcttaaatgatgtttaatgtcttgcttggcttcattcatagtagctcttccaggggtgtgctttgaattctgacagccagatgggtgtggctgccaccataccaaggcgccactcctgtcttgtaatgccacctggaaaagaatcctgtctcatttgctgttttaatttatacatctgatatcaagttgaataaaatttattggtggaaagctttcacaattctcatttgcccttttgactgtttatgttgtctttgcaatatggagactttatgttgctaataaacatagttttcgattttcagccaaggtcggccaactcccaagtgtgcacaccttgtaatccagcccaggtttttaagtgtacatatctgatctaaatggtgttattcccctgtaataataggactttttttttcttttctttttttctctctcttttttaatatatttttcaaaaaaggatgtccaatcccctggaactggagttacagttataaactgacatttgcctactgggaattgaacccaggttttctggaagaacagccagtgctcttaaccactgggccaattgtccagcccatgataggaatttttaaaactgagttctaagagtttctgtggctacatacggcttaacgagtgcatctgcgtgtatcttgttacttggaaactttttttttttttggtttttcgagacagggtttctctg

SEQ ID NO: 22315 - DNA, 1140 bp, Mus musculus
tcagagttgaggctcacaagtgaactataaattttcaatgtaaatagaatattttcaaatgtagaaaagggtggcaaattttaaagggatgtattttatctttcttgcctcagttttgctcacttgtaaagtggaggtaataatattgttctctatctgtattacatagctatatcatgtatctgtgaggaataaattaatttatacatgtaagggtttttaattatatctcatgtgagtatgcagtaccctttaggtggcttcatgccagaaaggttcctcattattatcagagtggcaagttaaggacttctgttttcgacaccaagaacatctttaaaatataattatctttctaactccattgaaggtcttttttctctattttcaaatgattatagcataaaaattgctcatagaaaacatggtggtatacacatgtactcacatagtgcgtctagtcagaaacagaaagatcaatatgagttctaggctggcctgagctccatggtgaaacctggcatcaaaaataaagtcctcatgaacaagatttttaaaagactaaatcattaattacggctagaaaactagtgaaaaaaatggaaaattatactgcattggaaaaagatttgagcaaacagccaggcatggtggtgtatgtctttaattccagcactcagaaagtagagactgaggggtctctgagtatacaaagctacatagtcagactgtctcaaaaaaacctagcaacaaatgatacatagtggaatgtggttaggcagatagtcttggcgtttctatttaatgttaaatatgtgattatttaacctttaaaatgttacatagttatcatatttccttctgggcattgtttggtttcttttaagacatgtcttgatgtgttaggcctgagcaacctgaaactcactgtagaccaggtaggcctgaaatcccagaggtctgcctgcctctgtctcctggtgtggggctcagcggcacgtgctccactgtgctgcctccttgtaggttttacttattaggaaatacttactagtaaatggatatgactgaagttctttgttgttgtttctatttatagtggatcaaaatatttaaacatgcagttgctggatgtatcat

SEQ ID NO: 22316 - DNA, 1132 bp, Mus musculus
tgcatttagaaaatgtgttcttttctctttgtagcattggactagtcacagcagtcagccagtcaccattcattttggctaaatcatggtctgaaaaaacagcatctagttggatgcttgatatttttccagctctctgttcagagttcagtttagaatggaaggcaagtagacccaagtgggtggtcactgtgctttgtggagattgttaagtgcaaacatttaacagttcggacaggtcttctcattagcgtgattgtgcatgttgcatacatcacggtgtgcaaagggagcagttggtgacatctttaattcaggacaaaagttcgagtttcccaccctagtgtatatgtgtcaaagctggtgagttcatggggaattgccatgtgctgtgatgggtagaggttgatggtagtccctgtcgcagcccaggtagattcatgagccatcatcagtttctctttctcaatatcagacacacctgcagctttatagctcttcccttatttgggggggggaaggggtcttgtaatgttgctcttgttttgatcttggaatttgcagtccagtgtctgggttaatggtctgtagaatgtgtttttcttcctatgaagccactgctcattttcaagagcaaaagtcagtcaaccagactgtcagcccacaaacttgacccgaccacctcctgactgccaggaaattgattccccgggttgactctgggctttgcaacctccagcggtagcattccgccacaccacatacaactgaagagttaatacttatttgtaagctaggtttgtggttggcttctgctctcttcttcctttctctctttcctttttctttttgtagcacatcatgtatgctatcagatacaaataactttaatttttaaaaaggatctgagattgcttcgtgacaagttctgttaagtggtttttttttgttttgttttgttttgttttgttttgttttgtttttttccttcaacactctctgcaagataacttgcaacttaggcagttgcctgaatttctcatctcactgacgtgagtacaatagagctttcatgtgtcagaaggcaggagtcattgagttatagcacacctgtcctactgaatgccctttt

SEQ ID NO: 22317 - DNA, 1258 bp, Mus musculus
aggcaaaagacactgtcaataagacaaaaaggccaccaacagatgtggaaatgatttttaccaatcctaaatctgataggggactaaaatccaatatatataaagagctcaagaagctggattccagaaattcaaataactccattaaaaaatggggttcagagctaaacaaagaattctcaactgaggaatactgaatggctgagaagcacctgaaaaaaatgttcaacatctttaatcatcagggaaatgcaaatcaaaacaaccttgagattccacctcacaccactcagaatggctaagatggaaaattcaggtgacagcagatgctggcaaggatgtggagaaagaggaacactcctccactgctggtgggattgcaagcttgtaaacccactctgtatgtcagtctggtggtttctcagaaaattggacatggtactctagaagatccagcaatacctctcctgggcatatacccagaagaagttccaactggtaataagaacacatgctcctagacttgaccatttctatcgtaagttaaatagtgaaaagtcttgaccagagataaaccctattcatgatcttctctacataggactctttggctgttaaagaattaggcttgcctttgtcgctggcttttgtgtgtgtgtgtgtgtgtgcgtgcttgtgcttgtgcttttgcgtgagtgcgtgtttaagttctcagaatttcctgagaggatggagtgccattgttatttgtctgccttgtgcctgacacagcggaatttatgtcaagagatgacccaggatggtagctagccactaccagcttggtgattgattacaggattgaggggttgaggacagcccaagacttctgtgaatcctgcctacagatgatggttcaattccagctccagttgagacctagtgcaatttccctacagatgtgctttaggctgatgtactcctgtcctttgatggcaggacagggaggctgtgtgcttgagacccatctagaccttgccctgtttgtgtctttatttgactgcttctcattctttttcttttgaataaagttcaaaccataaaaaaaaaagaacacatgctccactatgttcatagcagccttatttataatagccagaagctggaaagaacccagatgtccctcaacagaagaatggatacagaaaatgtggtacatttacacaatggagtactactcagctattaaaaacaatgaatttatgaaattcttggacaa

SEQ ID NO: 22318 - DNA, 1192 bp, Mus musculus
taaaactaagggccattagtacccattttttcccttctggaaatgaaatgctttttatacaaccaatattcaaaattgtgtgcccgactccccagcagtaagcaggccttaaattctcccatgctttttcttctagttcaactgagatagtgggatatagttcctacagaggaggcttaaaataactgtccaacagcctccttccagaggggaccaagcatttaattgtgaatttagggtcctttttgtgctaagaaccaaacccagttttccaagtatggctggctagtctctcctcctctcaggagaaagttacaaatgggctgtggaatttgtacatttgctctcttaaagcgatggaaggactcgtgttgaaattgctttaactaggttgcggtgggccttccctctagctgagctctttggtggtaattaagaggaaagtgaagcgcagatacttttttctgaacgatgaatacaggtttaccaaatgaattgtaatgataggtgcgagcccggcggggaggctgaatatcccctgtgtactgagaaacctataatcagataggtactgttgctgatggctgagatgccaccatctatgccttttagacccttgctttgagatgtaaggacacttgatggcgcacatttagtgactgctgctttttaaagtttcttgttggcttgggcgtgaacgagaagctcatagaagagctccgtaacctttgttacaccgaagcttcatggatatttaggctttcgctccggccccattgtatgggcgggtgactccgaagcattactcatgggtctcaggcggtcaaaataatttgaattttcgcagctagctctgtttcgtatggtccaaatagctgcttacaaacccagaaaatgagggctcagttggagtgggattttgggcacgtggctcattttaactcaaactcaatggtggcagcccctctatggtgctcagtgccaggatggtgagtcgactggagccggctattgcttgagcttaatattaactcttgctttgggaattccttctcttctctttgcctgttaactttcactttcacttactaatagtttgggtttttttcctcctgtgcataggtttgtgtgtgtgtgtgtatgtgtgtgtgtgtttgtgtgtatgccatgtgtgtgcaggtggatgcctgag

SEQ ID NO: 22319 - DNA, 1154 bp, Mus musculus
atttcgccgccagctttctgaaccctgtaattcttttcctcctttgccgacaatgccaagggaagggcgtcctatgtaccaacgccagatgtctgagccaaacatccccttcccaccacaaggctttaagcaggagtaccacgacccagtctatgaacataccaccatggttggcggtgcagccagccaaagcttcccccctcctttgatgatcaaacaggaacccagagattttgcatatgactcagaagtgcctagctgccactccatttatatgaggcaagaaggcttcctggctcatccaagcagaacagaaggctgcatgtttgagaagggtcccaggcagttctatgatgacacctgtgtggtcccggagaagttcgatggggacattaagcaagagcctggaatgtaccgggaaggacccatgtaccagtggcgaggatccctccagctctggcagtttttggtagctcttctggatgacccttcaaattctcatttcattgcctggactggacgaggcatggaatttaaactgattgagcccgaagaggtggcccggcgttggggcattcagaagaacaggccggcgatgaactatgacaaacttagtcgttctctccgctattattatgagaagggaatcatgcaaaaggtggctggagaaagatacgtgtacaaatttgtgtgtgacccggaagcccttttctctatggcctttccggataaccagcgcccactgctgaagacggacatggaacgtcacatcaacgaagaggacacagttcctctgtctcactttgatgagagcatgacctacatgcctgaagggggctgctgcaaccctcacccctacaacgaaggatacgtgtactaagatgagtaacccgtcaagcaaggcaccccgtgctttgcctcttttttttcaagatgcagagaatcaccgaattctcttcaatgtttgttttatttctgttgtttgtactttattttttaaatgataatacaaaagggggattttcctgttgcattattctatggtctgccatggactgcgcactttatttgctggtgggcaggagtaatctagacattcattctttgtaacaggaagatggcggatgagtgggcagaaggagctgagggattcc

SEQ ID NO: 22320 - DNA, 1181 bp, Mus musculus
atggccgctatcacccaacctcccactcctcaggtacctctaactattacccccgtgattccttcaagacagaggatgtttaacctagtgagaggagccttttatgcccttaacagaactgatccaagcgctactgaggactgctggctatacctgtccttgggtccgccttattatgaaggaatcgccttcaatggagatttcaacagaaccagcagccatacttcctgctcttggggtacaggacaaaaactgaccctgactgaagtatccgcgaggaatccaggtctctgtataggtaccccaccttccactcacaaacacctatgcggacaaattcagtccgtgtctagaaaggaagctaattactatcttgtaccttccccggttggatggtgggcttgcaatacaggacttactccctgtgtatcaactaaggtttttaattcatctcatgatttttgtgtcatgatccagctgttaccccgcgtatattatcaccctgcatccagtttagaaaaaagctatgctggccggcggttaaaaagagaaccaattactttaaccctggctgcattcatgggaataggtatggcagtaggagtggggacgggagtgttagctttgatagaaggaagacagggaattcagtctttgagggatgctgtcaatgaagacctagcggcaatagagaagtccattgacgctttagaaaaatctttgacctccctgtctgaggtagttttacagaacaggagaggtcttgatttgttgttcctaaaggaaggaggactgtgtgctgcccttaaagaagagtgctgcttctatgcagatcatacaggaatagttagagactctatgcagaaactgagagaaagattagagcgaaggaaacgggaacgggatgctcaacgggggtggtttgagtcgtggtttgaatcacgaccatcttggataacttctttaatttccgctgtagccggaccaatccttatgatatgcttagctttagttttcggcccttgtataataaatagaggaatggctttcatccagagtaaaattgatacagtaaaactcatggttcttcaaaggcaatatcaacctatagttcaggtagatgaagagttaggggacaccaatctctaaaattctatgattagaattagtctaaacagaag

SEQ ID NO: 22321 - DNA, 2201 bp, Mus musculus
actgtccaggagatgagcagtggaggctcttaaaaaatgctagttactgagttttgtattgttttactttttttaaaaaaaaaaaaatttcaatatatacagtttgatgatgtgcttgaaatttgtgcaaatatacatacactcttgtaaagtgcaaatgatgtaagacgttttcacgttgacttcacagggattgcagtgattgtggtaaatcctcactactgggttttcttttgctcactgttttggacatgagtttttctttaaaacagttttacagattaacattgcttaaataagtgattaaaaaccaactgacaatgcatgctactgttcttccgaagaagagcagctgtgtggaatactaataacgtattcagtgttcagaatcattgggtctgccagaaaatgagcatttcttcttaaccttccttaacatttccaagctcatgaataatactgcagtgtgtcttgtcagctgtaggtggcaaagaggcccttagaaaacggaaattgagttttcacaaacaggctattggagcacaagctgaagctgtagtgccttctacaatgtgtggtatactgttcctgggatttgtatgtgctagtcagtttcaattcatttggaacctagatggctgtgtgctattcacccattgggaagtgttcagttgctgtgtcataagcacttctccattcagatgagaaaaggaagtcctgtttacaagctctgtggaggttcaaacaacagtgtcgtttggggaccaccagttttatactgtgatgattaaacaggagacatgctcttacatggtcagaggatgcctatgagttgacttcattggatggccttaatattgccttgcagtcattttctcccaatgatgcagaaattaaacttatggaaggactaggagcatatggtaaatttgtgtttaatgataggcttactggaatccatcttaggtccaccttcctgcagaaggagggcaggagtaaagcagcatctgcgttcatgttttctccagagctgtgcactccgcactaaccgtccactcatcactgtcacacttccaaagcaaacagaaccccacttccaatttgcaaaggttatttgaaaatcaagtgtgattattttagcagaacctaatacaatcaaattactcagttgccttacctcatgaagagttatgttcacagactgaaaaagccaagtagcactttagttccttggtttcaatttgagtctttttttcatattaatcagaagactagaaagaccctttctgcaaatcacaaagcctggttcgattatgaagctgcttaatcatcttcaggtgtttagagttatggtgtgtgtgtgtgtgtgtgtgtgtgtgtgtgtgtgtgtgtgtgtgtgtgtgtttccttttttgtcactgtgtacattaaactttggaaaatgctttactatgtaaagtatagatggccattttaatcatttagccacatatggttggctaataaacagcttattctgatagagaaacatttggacctgtggagagattgttaaggagtgtctcacttcaaccgctgtcttatttatgaaatgtaagtagactagagcaaatgttggaatcgttgttattttttagtaccatttctctaataaagttgagtattttagcggaaagagtcttcagtttctattccgctctggtttggcgtgccgtgtggagggtgtctgcatggcctgtgcaaacctttgcagtgtttccagagcggccctttaaagttagggcatttcctctctggaagactggtaaaatgttttcatggtggagattaacacttcattcctatcgctatttacctttcattcgggtatttattttgctcaaataattattaatgtagaaaatggttttgtaactcagaatgagtaggaggaatacaagagaaaatgaagtcagatgctgtgggatgtggtctggcagttatgtgggagggaggcacttggggaggcgggcactcctggtctttgtttttgtttttgtttttggttttttttgtttttgtttttaattcctctactgtttttcaaatactgttttttacctaagatagatgctgtcagaaagtgggggcggggaccataaccgtctcctactaacagccagtgtggttgtctctttttctttctagacaggctgatactg

SEQ ID NO: 22322 - DNA, 1135 bp, Mus musculus
aatgttttaaaatggctacgtaaaagttcttgtgtgatagttgacctttgagactttgttgtgtctctagagtggcatgttacatgatttccacatagtgtgattcctgtctgtcgactaagttaacttccaaaatgctttacgtatgatgtttaagtattattctcttttgttagtattaaacgttagatcttttcctcctaggactattttttccacttattaatagatatactgccaccaggtggcagcatgttgctatggtaacagctacaaaatgagacacttcctcaaggttgtttatacccttatcccagatgattctagaatgatcagttaagcctagtcttttaaaaacattttaaaataaatgtcttaatacattttaaagttggtttttcattgcatatacattgataaatgaatatatttcctagtttgaaaaatgttattttacagcttatttttcacactagcctattaaaagataataaaaagctaattgtagtgttcattggatgctggtataacaggccaaatttagttcttagttgacttgaatttctcaccttatttacttcttccagtaaggttgtgagactgttagactgtggtacttaaaactggctcagaaccatgaagttgaaaagagtaacaccggtcacaacatgctcaacatagaagcactgaagcaggtttaaacagccttttccctgggtatcagcctaacctgtgactgcaccctgggtgcaagtgattttgttggtcatgtgggtgccttcatgttattgtaccatccagatactctgcttcacagcatcaaatgatttgaatcctttttaattagtaatataagtttatttttccagagactctgaaatgcttgttggctttcttccattgcgtgttcatgctcactagcttaataccctttctctctctctctctggcttgcttgctcgctcgcttgctctcttactctctattgctcctgctctcgctctttttagacggtctatgtagctctcaatatatagaactagctggcctcaaactcagaaagatcatgtgactctccaaaatgcttggattaaaggtgtgtaccacaatgcctggctccttttatgttgaaggg

SEQ ID NO: 22323 - DNA, 1193 bp, Mus musculus
ccggtggctaactgcttctgggctgtgtactgcctgggaatgtggttgacagaaccagtgtcactccactggagaagactctttttttctcttcgacagcagaaacactgtagtttgaaaggaaattccatcatatcattaaagtccttcttgtaacctaaacataaattttggggtgcagctaagtggtagagtcttaagacatgagaggctcagagttctaagctcccaggtatttgtgtgtgtggagggggctcccagtattcttaattcatggaaattttatggtggtttttgttgttgtttttttgtggggttttttttttccctctcctttgccgtttgaataaacacaatgtacctatcttataaactaggcattagggaatgaccctagacacagaacttggggcatgcctgtggaggactcccttggttaagttaactgacatgggaagaccagcctactgtgggtggctgcattccgcattccctgggcttggaccctgaactgtataagaagagaaagtgaactgaacacagagctcacctctctctgctcctggactgaagatgtaagaagaccacctgctctgatgcctgctgctgtgacttccccacgactgtgtaacctggaacagtgagccaaaataggaccaaaataagtcgtccttcaagtttatttgtcaagagtatttcatcacgggcaataagaaaaacaagatgctacatcatctgggttatgttttttattttgaaacattttttccctttttgttgttgttgttgttgttgttgttgttgtgctgggaactgaatgcaactctggcttctggaaaccaggcctgtgtatggtagatccatacattcacagaaagaaacaaatacaacagctgggcgtggtggctcatgcctttaattccagcacttgggaggcagaggcaggtggatttctgagttcaaggccagcctggtctacaaagtgagttccaggacagccagggctgtcttgaaaaacaacaacaacaacaacaaaaaaaaacaaaaaaacaaaaaaaaaccccaaatgcaacaaatctttttgaaaagtctgtacccttgggacagacttgaaaactgcttaaattttcagtgtctcatacagccgtggcgatgattgatttgcatacctgaccggcttgagctgtgtttgt

SEQ ID NO: 22324 - DNA, 1169 bp, Mus musculus
tgtcaaggcccgcaggatacacttcaatgctgtttgtcttttgtagtgagctttgtgattctcggcttctgtcacacttacttacatagctccacttagatttggggttctttcccttctaaaatttaatttctaaagttaatattattatttagataatatttttaaattttgtttcaactggcctagtatataagttttgtgtcttgcactagaagctcaaatgtcaagtcttcggttgcagtcacagtgagagaagcagagaacttaggcatcttttgggttctcgacttttagtatttgctatgtatttgtttctgcttgttttgcttatatatatatattttttttattttgtttgcttgaggcaccatctcaccatggagccagattcgcctggaactcatggtaattcccctgcttcggcctcccaagccttaggggcgcaggtgtgagctgcctcactcagctcagttctcacgtttctaataagactctgaccttgcctccctgaaagtggtaggtcggccctgtagtcacagtgtgttgaagtgccagggggagagatgacatccactggaacttagctttgaaaactccagaaaagagtgcgttggagcagagcgtttgcgaacagctgctcccaagtgttccgtgggcaaccgagctgtgggaaaaggctgtccagcaggctgtttcatatggcgactgttaagtgaacctccagatctccaactccttttattgggacctaagtttccagctcagagtagtgagctcacagcattattttagccttgggagtctactccaaacggaagccaagtaggatagagaggagaaaatgtaaatgagctgtgatcggactttccacagggctttgagttgtttctccacacatacctgaggaatgactttcctggcaggaaacgaaattagagcctgtctgttctttagacccggtggactttgtgttcaataaaatattatgtcgtgtaataaagttatacagagtaccaagagctggtacacagcagggaagccctttgtttatgtagtttgatttgatttttacaaggctgggcatcaaacctccggcttcttcacccatgctagcaagtgctatgctctcccagctgcttttatggtggtggtagaaacctctggaa

SEQ ID NO: 22325 - DNA, 2271 bp, Mus musculus
aacttttatcatcatatttgtatattagacttagtacagagtatatttattgaatagtagggctatttattggaaagttcgttagctgcaggtttccctaggcagtggtcttgagcggggcgatgctggtttagaagacacgtgcttggcagcacgtcagagagaagcgctggcacgcgctaccatcagtgacgcgtgtctatcgagagtggcacttggaagatactgtgaatgcccagaaagcgaaggcagtgtgctcaggttttctgcatagattttttaaactaagcttgtctgtagcttcgtgtttatagcattcgcatggccagttaagtacataatgaaacatacttagaaatccttaatgatgctggtcaggtcagtgacattactgccccatttaattatcacagcttaaatgtcacaatttcattgctggaaaacttacctagggcagtatctcgttacatttaaagaagccactgacgtgtccccagattccgggtttcctaagtgggatttaattatgtgcccatcaaagacgacgacgacgatgactatttttcttgaccattatttgatggctaacagaagcatccatctctaacattgctcacttgtgtaatcctttggtgcagtttggcttggcatgtcggttcttatgcttaactttaatttattgcaatttaaacgtaacaggagacttcaactgtcttattttaaattggatgccacactgtgcatctggcgtgtgcttagtaggaagaaatgacacgagctatcgatgggaggactcttagtgcactgatggataagaaggctcatttcaaatggaactggcttattaaccaaaaacttggttcgtatcccatcactgcattagagaggaaataagtaggaacagagagtagatgccccatggaacagatcctggagctgttaaaggacaaccagagcgcctgggaacacagatcagtgcatagtgcttgcccagcatgtgtgaggccctgggttaccccttccctagtactgcatgcaaagggaatggcggtgagtcccagcacgtgggaggtaagggtcaggaccaggaattcagcatcactcttggctacacagtgagtacaatgctagcctgggctacaggacccctgtctcgaaaacaaaaacccccaaacaccccagtagaaaaaaaacccgacccaaacaacaacaaaacagacaattagaaaacctcatgacttgctctagatttctgtatttaacaactttgggaaacaaatctttgtgaagaagataagctgaataggcctgtcttgttaaaaaaaaaaaaataaggctcagatgatttcagtggtcttgggagagaaggatatcccttctctttaactctttcgggaagcagacaaggaagaaacagcccccaactcatgtgagcagtaggactcggataagaattcccagcttgggaactctatcttcatgtgctgatgccccttgctgaaggcagctcttcttaggtgggacacaggaaccagtgcatctttcactgcacgtttctagttttgtttctttgggaaggaaggaccagacagccagatgttgtctcccatttccacagattttctttccagtcaggacacccttcactcttcgggtctgtccagcacatcggaatcatcacactgcaagccatttcaataatttttttggtatggtctgattgtgctagctgtcttaaaagtttaagacacttccccagtattcttccccttcttgttgagaaacagggcactgagtacttccatgtgttctgattagggatgcctgacttccacgtgttctgattaggatgcctgacttccatgtgtcctaattaggatgcctgacttccatgaacccatttcaatggtgtagctgacgctgtgaccgtgctatgcaaaatccactgtgtcctttctatggaaatggaattttcatttactatatcaaattgtcaatctagtttttataatagttgactcagatcctttataagatggcattatctgtcctttatttaaagtatgaatagtacacagctatgttgtgtatacacagaagagactttgtaacctaaagaatatagcagaataagttgtacattcctactgactgaaacagtggttcagtcataagaagatgctgataaatacgacttgaccagtctgtcagcccaaaggaacggacctcagttctcactgcttatattttgttttgcacagacattcatca

SEQ ID NO: 22326 - DNA, 1241 bp, Mus musculus
cagtacaggggctccaagtacgtgctgttcagtgatttcaaccgggtgggctaagtcatcatttctgatagctgtattttccatggtaattatcaatgagtgaacactgaggtgcatctcatattttctctctctctctctctctctctctctctctctctctctctctctctagagtgtctctggcttaagactcactgacacatttctaaagagaacatacgaatatgatgacatcgcgcaagtctgcgtagtctcagcagccgtggaagtggaagcctaaagaaaattcctaatgttagacttcttgtttaatcacagaaatgctctctgtatttcgtcagctttgtgcagtgatcagtagtgaaaacaagtatatgttatttaaatgtttcttgtaaaacagttcaattttaaacgtttgttgtaaaaacactacttttatctttcaaattatattctagaggaacaaaacatttctttattttctgtatatattttgtgtcctttaagatacctgtcattttttttgttttcaacaagctcatctttgaggctttttgtctaacaagtatataaaaagcagtcagcgaacctttttgtaaagggctgggtatcagatgtcttatgctcggtgaacagatgaattctgccatctgagtaggcaggcaggtgtatccgtggttgatggacctgcttgccaaggcccctaggctacacactaactctgctggaagacaccatttgctttaggattatcgaatttccatgatacttaatatagaaagttagttgaactaatcatggtcaactgcattctctttcctaggtgcttagtcaacaaagagaggcctgtgtaaaacaattcagccagagaaacatttcagttgttttcaaaattgttgtatggttgcatgtctgtcttagtgtacacataccaacacacgttaacagacactcgagagcaggccaggattgactgatttaattagctttcaacaatgttagcaattatttcactttaatctaaagactcctggggtcttccctactgaagaataaagagcttattttcataatatacatttaaatgattccaacttcacatctgatttttttctttctttttttttttttttttggtttttcgagacagagtttctctgtgtatccctggctgtcctggactcactttgtagaccaggctggcctcgaactcagaaatccgcctgcctctgcct

SEQ ID NO: 22327 - DNA, 1204 bp, Mus musculus
ccctcttctctttctttctccagggtctcttgtaacccaggtggcctggaatttaccatgcatctgaggatgaccttgaactccggatcctcctgcctctgcctcccaaagtaatgggatttcaggcattcattgccattgtcatgataatttcttgaaaagttgaaagttaaattaaaaagtttaatttcttaaaaagttaaagaagatcagtttcttctaggaatttatccaggaggaataaaaatacatgttcgcgtcttcttcctcggcgctgcctacgaggtggctgccatctgttttgcagcatcatggctgccctccggcctctggtgaagtccaagatcctcaaaaagaggaccaagaagttcatcagacaccagtcagaccgatatgtgaaaataaagcgaaactggcagaaacccagaggcatcgacaacaggtgcggagaaggttcaagggccagatcctgatgcccaacatcggttatgggagcaacaagaaaaccaagcacatgctgcccagcggcttccgcaagctcctggtccacaatgtcaaggagctggaggtgctgctgatgtgcaacaaatcttactgtgctgagattgctcacaatgtgtcctctaagaaccgaaaagccaactagaaagagcagcacatctggccatcagagtcaccaatctaccatgcctggctacgcagcgaagaaaatgaatagatagcttgtgtgcatgttttgtgattaaaataaaatcacaaaaactgcaaaaaaaaaaaaaaaaaaaaaacaacccacacacaaacaaaaaacaaccaaaatccaaaaaccaaccaaccaaacaaacaaaaaacctacatgttcacaaaaagtttgcttatgaatgttcaactttaaccaggggtgggaaatactttagttgggaaagtgtttgcattgtaagcataaagacccgaggttgatccttagaacactcatttaaaaaagtcagggccagtggtgtgtgcctgtaaacccagttgggggaggaagaaatagatgggtttcttgggttcagtagccagccagtgtagactaacctgcaagccccaggtctcagttaaagttccgatctcaaaaacaaagtgaaaggctgccgaagcatgacacccagtgtttacctctggtcttcacatgaataaacaaaggtgcacatgttccggaaca

SEQ ID NO: 22328 - DNA, 1174 bp, Mus musculus
gtaaaatgatatcttgataagaaaaaagaataggctaaatattagaagtggttttaaaatttagtcttatttctaagtgttgaaataattagagccaaagccaagtgagtccttctttagtgacagaacaatttgaagtttcagtgcttgcatgaaattaaatatgtctaaaaggcttaaaaataattgtttcattattcacttgcttatcaggtttctgttttcaatgactcctcagtggtaatcattattccagaactagattgcaagttaataattgttaaggtctgaactgaggctttactgtatgtgggagaagaaacccgagtcccctctggtttgtggattatcagtgtgaggttacacacactctttgacctcactcctgtatgcctgacaaggtgtctctcccacgtggattagcttctcttcattgtttcagtatctgtgctctgcctgatgaaaacctctttgaaatcatagaattttatagctctaagggatctagtccaacttcctttctttatggctgcggaaactgagacccaggttaagtgacttgccagacttacctatttcctttcagattggattgcatgatagaccggtgctgtaataaccatatctcaggctcagaaaagccctctgttgacgttctcatgatattcttacggcgcaggaagaaatgcaatctaggagataacactgtcaggtggattcagagcaaattgaatacttttgcccaaagggtgctttcttgtcaatttgtgtctgatttttttttaaatttatttaactctaagtggaaacataataggaatacttgaaactctgtacattagtccaataagtcccaaatctgtaggacaagacagacagaatggtttgtgtatcttaaactgcactctggacaccgaggcatggtcttcatgttgcttcttggtctgggaattcttacacacatttgctcttaaggccttcacttgcttggatgaagtccattcacgttatggaagatcatcgcaaagactactgacctaagttaatcatctacaaacaatacaccatctagactagtgttgcctataacgctgggcaacacggcctggagaggtcaccacacgaatgaactgtcatacggttagaggctggaccagtgttatccctgtcagca

SEQ ID NO: 22329 - DNA, 1766 bp, Mus musculus
agacctgaggcagcgcagatcctacacagttgatgtctccagtcacagcagtgttcttgcccataggtcttactccagtgccactgaagaggactccgcaaaacaaaagaaacagaagtatcagaaaaaagaaaagaaaaaggaaaaaaagaacaagtcaaagaaaggaaagcatcacaaaaaggaaaaaaagaagagaaaaaaggaaaagcgttcttccccttaccattctgaactcaccaaaaagtaacagcgtcttgggcctaactcagaaaattcaagaattcagtgtttttaactgttgagccttccttggaagtgctatgtgattacactttgcaggaagtcccagcctcttccataaagacattctcacctattggggcccttctctctctgaccatctgtattaaacccatctctttacttagcagatgtgcctcaagtatagacatgcgtacttacaaagcacatcattcttttggtggcttaggccggtgctgtccctcggtaagtcaattagcacgtggctttactgcagtcacaggaatgatctacttagcagctctgagtcgtgtccgccttccagtggcacagctgcctcggcaggagtgatttgctcttgatactgaatagctttatgtactctgtaatgtataaagatagtgagggtcttcactgttgttttttaaatctctagactttctaaaataacattgaggataaaattgctttactgatcttaagtagtaagtttttaaatgaatgggatctacaggaagataataatgaaagtatttataacagtgccgttgttttatgaaatgcatgtttctggcacttgcctcccatgtttttataacaattaaaacatccccttttttaaacaatcatttaggttactaggaagtctggcagagagattctatgctagtcaagattattagggtagatcctgggttgatttacaaatgtgccatattggcatgtcttaggtgatacctcaaacacagagctttttgtgtggtagcagcaaaatcctcattaaaactgattttaattgtatccagtgtatatgatgcctacatatattcgtgttatgatagtttttatgaatgtgtgcatatatatattttttttctgaaatggttttagagtgagtttcacactgaacttctggctcatggataatcaatgttgatatttcctcttccacgtcggtcacagatcttagtagcactgtgaaaatttttaaattaagatttccattctgtactttttaaaattgacgacttggagatagcatcgtgaaagcctttgtgtaataatgaaatttgtatataaataagcattttcaatgacatgtcagtagatttaagtgtctctgaggtttttaatttcatggttatcagtatagagtagtttgacatctaatagtccctaataccaccaagttaatgcattatgccataaaaacattgatcaccaacctgctatcatcgaacagccccgaagcctccgagtaccttgctatggttcacttcatacatcttcagattggtaagtgcacgtgtggctgcgggcaaatttatggccataaaatgagatgcgtacacttggccttgcaggctggagggctttagcaattgttcccttacccaaactgacattccctgattgactgaggggtagtcctaggaagtcccttaatgtaccctcatctctgctcaggttacacagaagctacgcccacacccttccctaca

SEQ ID NO: 22330 - DNA, 1577 bp, Mus musculus
ctacaattttgaaaggatgtgttcccttgagaaactgggcacatcagagcaacacactcagggccccaaaacactgtctgcaggaggctcttagaagtgttgctgtggagagattacagagcccagtgaggcacgtgcaggaggattgtctgtctctctgaccctgtctgtcctctgtcctgcagctggccctgaaggacccggtgcacacagtgtctctgcagcagttcatctatgagaagctcaaggcgcagcaggagatcctgggggagcaaggcttccagtccctcatggaaacggtggacacagagattgtcacccagctgcaggagtttttgcaaggattctaagagcacgtgtcatgtggccaccatcccttctgaaagaagctgagtaacccagcctgccatccatttatgagcctgctgagataagatcatttgtgtatgaatataaagaaaccaagaccataaattttttactataaaatataaagaataagtataaatcccaaatattaaagtcagaaaactattcctcaaaagaatttaattttatatttatgaggggccctgtgctgactagaggtgcatttattgagagtagctgcattgtctcttgttaagaaactcgctgattatctttgaatcatgagctcttaacacttgagaagatgaaggttgatgttccagatgtttttctgcaacccaaaattaattaaatgtggttgccttatcctaattttttttaagctaatgaaacaagtttgagaaatgagaatgctgtgcaaatgatagaattccatttgtgcatagcaacatcccaacagctgccctctacctgggtatctcacaagggagctgtttgcattcgacagagaatcaaatgcttttattttcattctagtagtctgatagaggaatcagtaaaggcacttttaactttactctgagtgcatacattgcaaggcacactgaagtgaacctgcagtactgtagtgccaagcgggagagccctggtgagcctccagccctggctcctttgctacatgtgaaggccagtagccctgggagcaccaggaagaaccagataactccaagtccccttccactgtgacagtcgtgcttggctgtgacaggctacccagtatttacccatctcaggttcctcagtaccagggtgtgtcagcacctcagtgccatgggtgcacctcagaggacccagcagcagtccctgggtactagcactgacataactagtcttccttcctgtccctccattgcactaagcgtgcgagggagagaactgacgccttactctgcattacttgccattgtgaggaacctttagtgcatcatctcctaggaaatactgaaaagcaagattggaaatgtcgtatctttctatagagatttgggtacagtgtataactgtaggaaaaccactacccctttgtaagctatggaacccatagtgtctacggatatatgatgttttcagcaaagaaaatatggtccaattaaattttccaaagatacctcacctttgacttgttgtctgttttccttgccacccac

SEQ ID NO: 22331 - DNA, 1181 bp, Mus musculus
gttatagagttagagtcaagaatagcatgtacccactcctcagaatagtaagtaaaggctgtatactaagaattagaatgaccttcataattacactattttaatgaagagaaatggacttgggacaaatttgtgttaaaggaaaaacattgaggtccaaggataaagtcacagatgtgcactatgataagtcaaggccatcataaaactgttactttgaacttttaatgagtatattataatgaaacactgctttaaacttactatcaacatcctctgtaactcccattttatgtaacagtttatgtctgaggtaattttctaaataactttttgtctaaaaaggtataaaaagaccagaaaaaagaaataaagttgttggttgaatggtttggcttggggagctttaccccatccatccatccgtctgtccgtccatccacccacccatccacccacccatccacccacccattcatccacccacccatccacccacccacccacccacccacccacctgcccgtccgtccgtccatccatccatccatccatccatccatccatccatccatccgtccatccaaatgtgtctgtctgtctgtctatatgtttatgtgtagggtatgtgtgtaagtatgcttgaacactgtggaattgattgtgatagatggtcgggctggccagagtgtgggtgtatgaatgattgaatatatatgcgtctatgcgtatttgcctgtacaaagcatcttaatttttttctttccctttagtctagttcacaaagagttaaccagataaactagagaggcttctgactgattccagagaaaggaaccctagcagtaaatcctttaacttcattccctgctgctaaatatctgttgtttgccagatattagcgcttatcaaaacacaagtgacagagttaagaaagagttaagtttttttgtgcttaatgaagcacagaacagtaagaaagagttaagtaaaaataaaggggtggggggagggctgatgagatggctcagcgggtaagagcactgactgctcttccaaaggtcctgagttcaaatcccagcaaccacatggtggctcacaaccacctgtaatgagatctgactccctcttctggtgtgtctgaaaacagctacagtgtacttatgtataataatcaatat

SEQ ID NO: 22332 - DNA, 1179 bp, Mus musculus
atgtttttagttcagcaaatacttaatggaacatgttgttaggcattttcttgtattgtagttaatttttaaaaacaggttgctttgctctggtcatcaccaagagggtagtagaagttagatgaatgagataaatgtcaaggcagaatgaggggaaaggaattgacggacagctgtgttgaatatacaaaattaagtagatgagttttttagaaatttacaggtttattgtaaagtgacaaaactatgaagaacacattgtcctttgcctgctttgaactgaaaatgcttcagatacagctgatttagtttttaaaaatgccttataatttgttgctaaaattgttaccattttatttaaaatgttaagtttaaattttggaattagttttgttcattgtaattttgattacaattctgttttattaggaacaaatcttgctatttcaaccatgaatttcttatgtgaaatatcttatttttaataaaattttgatgtgttttgtgaatttacagactactaaaaacttaaattttattcttaataggcagaagtataggtacagataatgtgtgtcgagatagactggaaaagaccatcattctttttactaaagtggtaagctttctcttttagttatgtttgtttacccaagtataatacaccctcacaattagaaaggagatatatttgtaatattttttgctttaatgaaaggaaaattaggtttgtggaaaactgaaaatagcttttgtatctttaaactatgtatagtaattaaatttacatacccaatgtcatagtttacatcctagcactcacaagcgtttggttatgttatcagcactgggcaaaggaaatcacccaaaatgagtattagaaaaattgagtcttctaaagttcattattcttagatttatcagagaaaagcaggaaaaaggaaaatagcagttcagccagaagcggatgagacgcagctggcagcagctatactattacaacgtgtattcacagtgacttcagattatcatcacaactaccacaccttttgagtagaatttatggttttactgtactaggcaatgcatataaatgctagagctaagttttctataatattttgtgaaagttgatgtttggagaattagtaagaaataaaaagaactgtgtggtgccac

SEQ ID NO: 22333 - DNA, 1185 bp, Mus musculus
atcatgtatttaaaggagttttattgttagaattcatagcattcttgattctcttgctactgggtggcattctcttgtataataattttactttttttttttacagtgctctctcagaagaggaaaagtcaacattgcgtgcagggctcatcaccaactttaatgaaccaataaaccaggttagtgacaaaaaaaaaaaagaaagctgagtggagagtttgaggccatcctgagatacgcgtcaggtcccctgccctgcccctaccaagaaagaaagacaaaaaaaaaaaaaaaaaaccctgaagagtcaaacttgtaatttgtgattagaaagacattttgatagctcttagagtctatggaccactgcattaaatagtttagtgtagttttaataatatttgctcaacatagttaattcctgagagttaatttcaaaatgcgagtgtattatttatcccttgcccttgatttcctagttactccccatggtctctctctctctctctttctctctagattgcgacccagatcgcagtgctgattgccaaggttgctcggttagactgtcctaggcagtggccggagctcattcccactcttgtagagtctgtcaaagtccaggatgaccttcgccagcacagagctctgctgaccttctaccatgtcaccaagacgctggcatccaaacgcctggccgctgacagaaagctattctatgatgtaagtatttaacatgattacatgtgattatgacaatagtgacatgtgtataaaaatgactcatttttcttgtattaatatttttggaacgattttgaaatctttctaatctacactgcagtggtatgtatggaaagctcacgtaagtgtcagtgaggttgcttgtggtaggaaacactttgaaagcagagaaattggtttgagattgtcagtgtagctgagatgtgataacggatctcttcagcaaagccgttcaaaaggggatggttagcagtaagattggcgtgtatagatagttgatgggtgtaaaatagagctacaactgaaagattatgttagttacctgtgctctagtgatgatgctcaacagaaacaactcatgggaggggtttattttgcctcttggtttcagtccaacatgacagggaagacagagctgatgttggcagacattatgtggta

SEQ ID NO: 22334 - DNA, 2897 bp, Mus musculus
acaacggtggtccgactgtaaaggccacttgaacgtttttgaaatctttttttttttttttttaacgttttttgaaatcttaagtgtgtggaaaatatcttgtccttcatctgaatgacatttcaattttgtgaaacactcctttgtcgacaaaatgcttctagaccaagaggcacaactaataattcggactagtgaagtattttgtttcatttgcccaaataaatagtgattgcttttggatatccttgccaattttatttaaagattgtggaagtgatccagaagtggaagataggggaagccacagaatttcctttaacgcagatcaattttcatagcaagactgagcaattttgaaccctttgcgtgcatgcatacctcatgagtgattgtacatactttgcctactcctagagacactcgtgcttactcatccttctgtgccttggctaaggctattgaccctagatttctaaaacagccgagattaattacattccttgtttgtgactgtaaattacctttactgtgtgtacatttttactgtatttgagacatttttttgtgtgtgactagttaattttgcaggatgtgccatatcaattgaacggaactaaagtctgtgacagtggacatagctgctggaccattccatcttatgtgtaaagaaatctggaattatgtgattataattttcttagcattttctttgtaaaaaaaaacctaaaatatgaattagttggtgtatagtaaaaagtaaagaaattctgagaggagttttattttaggataatacatatatacatatgcagtgtgtgtgccagtggtgttaacaagactaatagtggaatttggtccttaacaatgccattatttaagttgaagtgtttattaactcaccaaaatttaatgtactgttaaaggaaactggcttctgatgcatgaacatttgtatgtacactgaaagtaatccctaatacaagttagataaaccaagcatagacagtatgtacccctgagaagtgttgatgacttatgaggcaggttattccaagctccatctaaacctagtatgtgatggtttttgagaatcatatttcgcctgtagattgatggcaaaataggctactctattaatggcagcactcatttttagctgctaatctaagaaagaaaactggccaattttcatgtaaatattgtttaaagatatatatatgtatatctctaggagttttcccttggttcccactatctagtccagtaggttaaccaaagaacctcccatggatctcttaactctagggagcctactgatgactcagtgtaccgaggggaaatccatgaagagtcatgagccaggttctttacttcactggtcataaatgatgagagtagctctgaggaatccgaacaccatggtgaaaactctgtaaacatgaaatctaaatcaaatgtagattttttcacaatatgcttattaataaatgaaatttatgaaacgaatttagaaataatgtacttcaatataattagctttgttttggaaggaactcaggttttcttggagttttatgctatattctatttgtgtttgtttcaaagacgggaggaagaatgaaggactatttctattgaccttgcagcagctgtttaaagaaggtaatttttgctgggtatagtggtgcatgcccttagttgcatccagcacatggaagcagaggcaggtagatagatttctgagttctggaccagcctggtatacatactaagttctaggacagccagagctatgtacaaagaccttgcctccagttctgagaatgtctcatatatagtgggcaataaagacacaaacttgctcataacttacctaacagttgagctttaatgttactggcattggacaggtattatctttgaaggtctttatagatacatgtttccttattggcttcgtcctgatctgtagtcagagtacatcaataaatatcttggtaggtaaaatatgattcagctttacggagggaaagctttagttggaagaaaataagctgagaaagcctagtctagcagaattgtttccctaaggtagagaatggtacaagtgaactgtgcaaagttgttctgacaataaacaaactttaagaacagttctgatcaatatgacaaaagctgcttttgcagctaagcaaatgtttttgttctagattaaatattctttagaaatgtctcaaacttaaaggctgctaactattcatagctactataataagtgtttactatatgacttagaaactggattttgaaggaaaaactgtaggcgagcaatttatattaagtttacttagcattctttttctcaagtaattggagatattccttttaagttttaagtataaatagagaagctagtttagtttccttatataaataaaacagctaatttattaaaatatataaacagcatttatcttttatctgacaatttttaaatagcttaaaaagaaacaccaggtagtagaattttaattatctagaagtcaggaataaccaggaacctgtagttttagtctgttcttttaaaaagctgaaaactaaaactggaaaacttactttgcacaagtataaccccagaatttatttaggaggctgaggcaagagtctgagattaaagtcaacctccaaaagaccctctcattcaagaaaggaaatgaatcataaattaatgagaccacctatttgattgacaaaaccctccagagtttttctaaatctgaaaattgtagatcttgtctcccttaaggaaatatgtgatttaacatgagtttttactttctaagcttctgcattttacaggtagtcttatgcagaacttgcctgtactgtcattg

SEQ ID NO: 22335 - DNA, 1161 bp, Mus musculus
cgcggtcgccagctgacgtcagcgccaccggttcagccccaggccagagcggtgctcagactctgcttgctggagtgggcggggaggggcggggcagggcgggatccgtaagtgattgacaacgagagggtcggatcgctttgggtgccggagagggttacagaaaccttggggtgagggagcaggttaggagtttttaatactaagattgtcgataatgatactttgtagtaaaagacaacaactttcttttttgtaagttcggtacggcttctgtttaattttaaacaaaaccaaatataacttacatattaacttggatatttcaaactctatttcccctcttttgagaaaggaagagactgtaaagtcttgcagatttttcggatgaaggaacagaaaggtggtttttgctggatactgagacctttgacttttgttactaaaatccatttttatttttgacttggcacaggaaagaaatctaagaagctctcatgcagtgtaaagcagagatcaaaaaatagggaaatataagtgaaaaagagtcaaattcgaaaatatctgcatgaaaaccatcctggacacgatagctctgggttattgaggctgacacattagcctttgaagaaaaatgttggctttaaccatgatggcatctttactaggcttagagctgtttttctcttaaatctgtcccttttctgtgcctgttaacagttaacttcaccgttcacatttgtttttcttgacttaattaaatcattttgcttagtcatagctgagagttttgttcgtcttctagctcttggttaatgtgagtgagaatcacaaatttattagctatttttgtgtgtagggtgtttaggcaacttgaggtgtgggtagtggacctgggacagtcctggatgaaggctctgaaaaggggtcactgaacttcctggaaaacttcagtgacttgactaggttaacaaagaaaggctgctttgattggctgctgaagttacctctgctgttcattttaattgactgttaagaaacatcttctggagctagagagagatggctcagcagttaagagcactgactgctcttccagaggtcctgagttcagctcccagcaaccacatggtggctcacaaccatcagtaatgggatctg

SEQ ID NO: 22336 - DNA, 1605 bp, Mus musculus
acggcaagaaaacatcgcaaaagctaaacgactaaagaaggattgaaggggcgcacagactgtagccagagaaaaccactctggaaaacctgcagctttggaaggactctcacgaaatttccaggctgttcctgatagtattatttagtgaattaatctgaccgtacagaagagtcatgttctgacctcaatactatagtaacttttaggcttggaaataaaagtttgttggtatctactggcaagtatttaagttagcatttatcatacaggtggagcatacctaatgtgaaaattcaaagctcagaagcactgtaaaacctaacacctgtgctcagacatgatgccaagagcggaaaagcccacagcccacttcgggatgggttgcagtcaaaatacaggtgcactaaaaatacatcaagttatcttcaagccatgagaaatataagcggaccttgtgttcagaattggatcccatcctcaaggtattatgaaatactttaaagtctgggaaaaaattaaaacactccaagccccaagcatttctgtctgttcaacctgtagtaaaaattctttaaactgacactcatttgccattttggagcttaaagtattcaagtgaaaaatgatgagaaaatggttttagaatatggtagtttaaatggggttcagttctagacagaggatattaggaatgtaaaagaattaaccggaagtgaggtttacgttggctgaaaagagatacagtatattaatcactttttcaaaattgttactgcttatttttttggaatggaagcattactttctcaaaggaaaattttattaatgagtatggctattttcattcttctgacgttagcttttaacacagctagtaattatcaagatactgcattgtaaaacataactttatataggattcttattgccttgaccatgttcaataccatgtactggatagaataggttttgtactttgaacactgccatttgcttcaatgtgttgcagagtaacatgctgtagagccagcagtgcagatgccttgtgctggtgacaccttgggttctgttttaaatgtaaacttgttaaatgtcaccggataattagctgattacatagacactacttttgtttttattgtttataaccaatatagtagtgatgtcctgttactctttacttaatataggttcaaagtaaaaatcagaatttcaaatttatgaagtcagacttcataatttaagccagtaagggtttaaatttgggaacatgatttcatgggtataacagtggttgcagggactgcaataaaatggcagtacaagctgggcaccttccagtgagtggtaatacacacatgagaaattaatcatggcttttctaaatgcattgtcgagcaacattcactgcagtattgaagtgcttattactgttttctgcatctctgataattttaagttagaataattgttaagtcttaataaaaatgaaactaaatattgaaataaatttgatacctttttataaagaggtcctgagtttttgtcttttggtgggaggagtattcgtttaaattacatatgtcatccaagttaatgttt

SEQ ID NO: 22337 - DNA, 1199 bp, Mus musculus
tgtcccttgtccctatattcccttgaggtagtgacccagattggtgacagaatccaagtctgagaggtaggagcacagaatccaaccccgtgtgctgtgggaacagagtggcagcaaggaattgggtctcctactagtaagggctgtggatatgggcagtcacagcagctgttggcactgataatatatacgctgtgagttttaggagtcacacatttcattattattttttattagttattagtgtcctacaggattaattggttactctctttaaatagaatctagatttgttctaagaaaattaattttgcttcaatgctagaaagtataaaatttgcagtagtttaaaaactacctttcccaccatataactctaagcaaaattcattattttttctaaaaatttaataattttgccatataatgtggtatgcaataatcaaaataaactagcccatcatagctatagtagtgcaggctcatgtcaaatgttcgtttgattttacagggcagactattcgagagaaaaggattgtagaagcagcgaacagaaaagaggtagactatgaagcaggagacatcccaaccgagtgggaaggtaagtgtctgcctccaggaggatgctgggaaaggcaagccacttaaggcgatctgggaacttagcaagagtgcacagaattactcctccatggagacatttttacagctttgtttccggaacattgcattgttttgaaatctgtaaaagttgtgaagctccagcaggacttgggttggggtgaaacaggcagatcaagctaaccctaaccctaaccctaaccctgtaaagtcaagggagtcacccatgccttgccctgcccctgccctcccacccgcacccacacccacccctacacccgcccctgcacagcctccaggctggacttctttttccaggattcactagtccctgaacttggggaaatattttattttaggtctccattttctgtcttataactagaggagaacacttagcccaggtgctgttttggagtatttctctgacttacaaagacaatgttaactgacttccttcttaaaacaagggtggctaacataggagaattggaacacacagtggatttcatgctagtctggcatgaggccctgcctcaaaaacagtatttttcatattaaagatcaggtagtcaaag

SEQ ID NO: 22338 - DNA, 1078 bp, Mus musculus
tttaaataaatctacattatctttacattgcttttgtttttaaattagcagcaataccgtttccaaacattctaattgatgttaatctagcatatttcataatgattatgaggctaaaattatgaaatacataaaatagattctcctttcttttataggctccagccaaatcccagttaaacccagcattcgcggacgcctggagcagcagtgacgaggatgggtgactgtcagccctggctccttgtccatcagacttccacgacagtgttgtgtgcacttcagcacgagcagggttgttcttcccgttattgttggttttgagacagtgtctcacgatgtaaccctggctagcctggactagcctggaactctgtatagagcagactcggctcacactggcagctattctgcctctgctcccaggtgctggggttagaggtgtataccacgtggcccctcctgtacatgtgtgtgattgtttgtttcattgtttgtaaactcttcagtcagtttttaacctgttaatcctgagtttgggatatttccctgtgtgctttaaaatgagatcgatgtgtatgataccctgaaatatacttttctgtcggttaattaatcagaacttgtctccttgagcgcattcaccagggtggtgggccagcccctacgggcacagcccaagaacagacttgttattcccagctgggaccttcatatgtgcatccaaggagctgaaagtatgacccaggaagctctcagctctgactcctgactgtgctgccagcctgcccttcccaccttcagggaggagtttagcaaggaggattagagaaacttgttgcaacagtggcatcataatgctagattttttactcaaactgaatggcttcatgtaatcgagcctcttctccctcatattgaatgttagccactcatgcatcttgcagtgtgaacatcgtatcacataggcaatccctgaccactttgtattgctctcagagggcagcttacactcagtcttaattccttcctgtgaaactcagcaaaatccatgcagggatgtagattaaacatgaaa

SEQ ID NO: 22339 - DNA, 1214 bp, Mus musculus
tatcgggttccagctaggtttggctcactgggctccgaggctgcagagctggtgttccgagtggactcgcggcagggacagtcccggtaggttttgggcagcgccatccactgtgtgccggcggtacgcggcgcgatcagtcatgtccgcaagcatccgagcgcccattggcgaggagaaagtgttctttcctcctaggtgctggaggcgcaaccccgggtagtgaaatccaggacacaaacagccccgcccaccacacagttcctgtcacgtgccctcgcaacgtccaatcagcgccccgaagctccgggcttgtgattcaaactgcggcgcggcgagctccgtctggagtccccgccggcgttgccccgcgactgctgcgcgttggcaatggagcaccgcgtagtgggacccgggccgtaccgggccaccaggctggtgagtgagagtggggccgagccgaccccgcgccgctgtcaccgccaagactcgggcagtgtgcagtcgctcgggggttgccggtgctggtggtcgtgtgcctgctccggtcgctgctgcacactctgtcccacagcgggcagacgaggcccggagtcagccctaccaaggtggcatgaactacttctgccgccggtagttggatgctcggctttggacggcgccttcagccttaacggggaaccgaacctcaggcgatcgcgttcccctttgtcctagggacctactctagcttccagggcaagatcgaccgtgggtggagccataggaccacctatgggggtagctcttgcggactgcggtgctccaggcagggcgtgactccttcctgagtgacactgttgacacttgacaagtgttctttgtaacggtgcactgcacggaggtggattgcccctctaaggttcctgcccccggagtttcagttgtcagcacctacttcaagtagcggatcagctctgataggtgatctaaaagctttgctgatgcaccagggtaagggtctttcttgtggaaacaagttttgccactcagaaacttatttctaggaggaagtacttttactgacttctccctcaaacggattaggacaatggaatagacagaaggttttagaggactttgagttttgtctgtgaagactcatagctgcattgccttgcaataaagtctcacctgctctctactctggaaaaggtggggatgaatatccaaac

SEQ ID NO: 22340 - DNA, 1200 bp, Mus musculus
tgtcctaggcatccttagctctccttgtagggcactcatttttctgcccctagcagttgcttcagactgggttgctttccattgttgtatgtatctgatattgctcataaaagaggattacttgaagttatatgactcttattttgaatgattcctcagttgggacaacgtgaattaagacaagcatttctgcacttgatctttcttgaatttataaaaattgatttcactggttagttggatcgcccccaggaaatagcagtgccttagtgactctgcatttgctcctctgctattcatcctggcacagcctggtcctgagagtcattccctacttctctgagcccatgcaaagttagcctagaattctaaccacgattaccagtcaaatttcaagtaggcaagtcaaaacattttttataaaccatagcattttatactgacagacatatgtattctctctcccactatcccaccccttttcgtcctttctccctccccaccccctcttgtcctcccccccccccccgcccccacttctgccaaattagaattctgagatgtggttcaagcgccacagtattgctattggagaggtgccggcatgccgcctcgtccaccgcagacagctgaccgaggccaatgtggaagagatctggaagtctacgacgttgtcatagtacgcacatttgacatctgagaagcctagagatcttctttccgttttatctctttcctactctctgcatatttagtgttctgaaatcattctcaaagaaatctcaactttgcgtaacctgtacttttgctgttttataaatataatttaactggattttaagaagtttctaatgttagatatgcagtagttagaacaggagtttaaattattttttaattgttatttaatatatttgcatatgctcttgctgtgtagtcgccaggttgaccttgacttttctgacatgctgctggaccctttgggtgctgggattacatgtgtatgcactgccgttcccagcctgacgtcgctaacctttgagtagcactgaaatcttaagtttattaaacatataatggaaaatttagccttcagtaattttactttaaaaaattgctttttggaattcagtttgttatatgattaattaatttaagaagtatgcaatgataaaaatataccatgtatacatttatcat

SEQ ID NO: 22341 - DNA, 1720 bp, Mus musculus
tgtaaaaaaggtaattggatttgattatagcatactatatatatatatatatatatatatatatatatagatatagatatagatagatagatagagatatagatatgtagctatcacttggaacttgtgtgtataatgatttattagtaagaaattgaaagtttttttccaaaagatattagtctaatgcacaatatacttttagaggtgtggtgacacccatggtgcccctccttggatttgtctcctaagtattgtcttctaagtctccaagtaccttgaatatattttcatattctatagtatttaaaaaatgcagttgtagcttttggctctccggtcggcaccatggcggtcggcaagaacaagcgcctgacgaaaggtggcaagaagggagctaagaagaaagtggtcgatccattttctaagaaagactggtacgatgtgaaagctccagccatgttcaatattaggaacatcgggaagacactagtcacgaggactcaaggaaccaaaattgcctctgatggcctcaagggtcgtgtgtttgaagtgagccttgccgatctacagaatgatgaagttgcgtttagaaaattcaagctaaccactgaggacgttcagggcaaaaactgtctgactaacttccatggtatggatcttacccgggacaaaatgtgctccatggtcaagaagtggcagaccatgattgaagctcacgttgatgtcaagacgaccgatgggtatttgctccgacttttctgtgttggcttctctaagaaacgcaacaaccagataagaaagacatcctatgcgcagcaccagcaagtccgccagatccggaagaagatgatggaaatcatgacccgagaggtgcagaccaatgacttgaaggaagtagttaataaactgattccagacagcattggtaaagacatagaaaaggcttgccagtccatttatcctctccatgacgtctttgttagaaaagtaaaaatgctgaagaagcccaagtttgaattgggcaagctcatggagctgcatggggaaggcggcagctctggcaaagcagctggagacgagacgggtgctaaggttgagcgagctgatggatatgaaccgccagtccaagaatcagtataaaatccagatttttaatagtgacaaataaaaagtcctatttgtgatcaaaaaaaaaaatgcagttgtagcatcttgatttctatattgtggcaaaaataaaattaaaacaagtgaaagtaaccacagtaagcagatagcttccagggactgatgggttttcctgatatgccacatggtgctctgccattctcatctgtgttgctatctcctgtcggcttagtgatcacaatctttagtactcgcccagtgctgcattctctgtacaatttactgcaaaggcagttacagagaagaatgggcagctgcactagccatcaactaaggcttccttcggttctctatggtgcactttgctcctttcatgaacttctgttctctttgcactactgctgtgttagctactttggaataaacatggccagtgctacttagatggcattctcggtagtcaaatgagagaaatcccttcaagtatggctgctttctttcatttccttcctaaatgatttatatctaaagtatttacaactaagttctagaggttggttttcaatattttatatctctctcaatttat

SEQ ID NO: 22342 - DNA, 1101 bp, Mus musculus
ttatcatggttaggtatgggccttgaattcctgatctttctaagacttttatcatgaatgggtggtggattttgtcaaatgctttctccacgtctaacgagatgatcatgtggtttttgtctttgagtttgtttatataatggattacgttgatggatttctgtatattaaaccatccctgcatccctgggatgaaacctacttggtcagcatggatgattgttttgatgtattcttggattctgttagtgagaactttattgagtatttttgcatagatattcataagggaaattggtctgaagttctctatctttgttgggtctttttgtggcttaagtatcagagtaattgtggcttcatagaatgagttgggtagagtaccttctgcttctattttgtggaatagtttgtgaagaactggaattagatcttctttgaaggtctgatagaactctgcactaaacccatctggtcctgggctttttttggttgggagactattaatgactgcttctatttctttaggggatataggactgtttagatcattaacctaatcttgatttaactttggtagctggtatctgtctagaaacttgtccacttcatccaggttctcctgttttgttgagtatagccttttttagaaggatctgatggtgctttggaattttcaggatctgttgttatgtctcctttttcatttctgatttttgttaattaggatgctttctctgtgccctctagtgagtctagctaagagtttatctatcttgttgattttctcaaagaaccagctcctcgtttggttgattctttgaatagttcttcttgtttccacttggttgattttgcccctgagtttgattatttcctgccgtctactcctcttgggtgagtttgcttccttttgttctagagcttttaggtgtgttgtcaagctgctaatgtgtgctctctctagtttctttttggaggcactcagagctatgagttttcctcttagaaatgctttcattgtgtcccataactttgggtatgttgtggcttcattttcattaaactgcaaaaagtccttaatttctttctttattcctt

SEQ ID NO: 22343 - DNA, 1179 bp, Mus musculus
atggatttatttttcaaagtcaggatgttcaatgaatcctataatctagacatacctcccaacaaactggagacctcccagttgatctttcattggacgaaaattctgttcaccaaacatttgatgtacctcctagatttgtgttagtatagcatggcaaacattggggtttggagcacaggagcaagttccaagtcaggttcttcttgggttgatccgctgagggcaggcgggacgagtgtctttcttccaaggtagcaggattcccaagcatcaaggcctatgtaccacttcagcttcaaattccccttttaatcataatgccttccatattgaacagctcacgtaattatcttactttaactcgagtatctctttaaataccttctctccaaataaacaaagctacaatgtaagttagcatctccgggtagtttggagtgactcatgaagtcgttagcatcggcctctcagccacagccgttgtttgtcctacactcacaaagacaagtccatccttctccatctttctcatgtgtggagactcgtgtgcccctgagaggctgatagctgtatggcctcagctgctccaggggctggagatgcttcccagcgactggtccatgagttaactattttacttcttccttggggatttccaccgagagcattcgttacatgaaaggtttaaaatggcatctcggtttgggctgtagtcctgtgactaatgtgtaccgttagtccaatgtcacacacaaagagggaaataataaaaattaaagggctgtctttaacatagtttatcataattaatgatcagtgctctattttgtgggcacatgcatgtctgtgtggatgtgtgcacatgtgtgtggagtggttatgtgtggatgagtgaatgtgtgctcacttgcgagtgtttggagggaagaggtcaatagcttccttttccaccttttatttttttggaggcaggagctctcatcaatcccgctagctaggctgcctggacagaaagctccaagaatccttgtctctgcctttgcctccagtactggaatgacagaagggcattgccatgttcaaattgtatgtgggccctgggaatccaaactcatgtctcatgctaacaaggctggcacatttccctccagttgactggttttaaaactgcacaat

SEQ ID NO: 22344 - DNA, 1144 bp, Mus musculus
agcaaagtttcttgacagtaaaagaaagccagctgctccccacaatccccagtgaccccagtgacaggagggtaaaggttaagatcagaggttctgacatggaccagctgggttgaaatccaccctctggtccttgcttcttggatcacctaggtaactcagatgtgtatgcagtgggctcctcttctgcaaactgctaacagccacaccgcatggttgatgacattactatgagacaatcctacgcggtgcagctaaactgattgggagtgtgctacaagcaaagcaaaactcaaactcaccagcttctttaaaataaccttccattattctaggtgctagtccaatcagaagacatgtttggtttgggggtttgagattatagcccacaaaacatccttacatgtagaaaacagataggtatgtagaaacatatataaacatataaacagataggcatgtagaaaacagataggtagccccttaatttttttttttcaaatgcaaggttgtatgaaagcaacttgttactcatcagcacctggaatttgaagtttgagatctgatggttgcccactgatgtctctgtgttttctgtggctacaagatgctttctccctaggcagcagcgtgagtcacagagatgcccagttggcagtacaatcagagaaacaagtagtgggtgcactgcagtgtgctcagctgtgatgttctgtgggccaacggaattaactgcagttttccttgatgatattttaccttctgatggttttgcttgggatcggcccccatcacaagtcaaagaacacccagtatgctgcctagcacacgggcagacatgttcagcgtcagcagctgttgggcttctgtgtgtgcgtgcctggcattggatgctcttcctgtcataaaaaagttgtgaccttgccactcacccgacagatggcattgcctgattaaagtcaggccatatttagaacatttctgtaaaggctttgtcgtccagagaatcattactgcctactggtgtggtttctcttcaacaattaaagaagaaaaattgttgggcatcttctcagaaggacttttctattcccctggttttaggacaattggtcttgtactttcataaggaaacttgtcacac

SEQ ID NO: 22345 - DNA, 1239 bp, Mus musculus
tctgtctcttcctcacttgcttctttttcctttgtccttccttcctttctcccctctcttctttcttcctctctcctaagttatagcgatattaagaagacatgtgatgcttatatgcatttaaaaagagagatgaatatcatatccattgctgctcacattacatcagctaaagtcaggtgactgtgcctgtcccttggggtgcaatgacgtgcagacttaccacttcccttaaaggagaattggaattctgaaaggtcatgttggtgacaattacacttcctttcttcaaatgttgcttgaatggccttctctttgcttcctccccaggtcttccccatcagcctgtgccatacctctacctgtgtagtcctcagccatgtaaatggctcaaggtttccctatagtgtgtgatggttcttgggctttgttcatcttgaggattactgttgtcctccatgagttactgacagtctcagagaggggagtactcgaaaacaaatgcacttagcatcttgtgtatctgacctcaagcattacacatcacttctgcctgatagacaaccctgcaacagagtaagaagcaactataatgatgtaaatgatggcgactatcagaagctgggtgtgattcctaactacaagctcggtaactctcacttaaacccatggtgacaaatatctgctttctgacccttaggctctgcaaggcagcagacctagcgtggggtaagcaaactttaaaacatgttctgggggaggggagttggtcttctgctttgcaatcaaagggctctcatataacattctatctgttcagtacctaaagaaacacatacactcttccttggcatatttgcttcatttataacactataaatgctatttttaagtgtcttgtgttcaggtggttgttacacttgaaatggtgacaagctatatatatatatatatatatatatatatatatatatatatatatatatatatatatatatcaaaggggagcaaggaagtacttgatggtttttctggtcctttccctataggagcatgagttgagtaagctaagtgtgactttaaataggacactgggaggaatcagaaatagtggcacagtggcagaaatcccacagcaaaatccatccttgtccgcactctgtggttatacaagccaggattctttctagactaatgaagaaatcgttgaaaaatattaggcgaacatgcagttctgga

SEQ ID NO: 22346 - DNA, 1107 bp, Mus musculus
acagagttctggtccagaaaaaacactggccattccacttagaactattttaacctggatgctcttgatcccatcaagaaaagaatgtttactctgaatagaattctgtcagtcaggaagcccgaggattaaaagtgaagtatccaaatgctagttagtcaaaacacagcgggaagaaactcggtcttcagctgtcattgttctgaaggataaagcaaaactgaaggtctacttgacaagttgttagcacaaccaacccaaggtatttaagagaacaatggtttctcttaggatgtgggccatttgcttaagcactttcaccttattaaagaaaaggagccaagttgtagggtttttttgtttttttgtgtgatagtaatgatactagtaattatttagatcttttttagtctctgtgtcccatgcatatacgtgataaaaagagtaggatatattatttattaaaatatactatattatatattcacatgtatttaaaataatatatggtggggcttccttcaagaaatgagatccctgtgtaagagcgtcttgggtgctgaggagacaatgaactgcaaagtgcataaggatcacagcagagcgagccatcttcagagaaaccccgccccctcatcactggctttctggtatcaccttttaaattgtcctgtagtaagagaaaatctagtgccaagggacctgtcactccagaggagtgctcagtgggctctttctgggtgtgcctgaaatgttgctgatgcttcatgcttaataactttaatgaaaatttaataaagattacacatgctcacgattatagacaggctgtttggtggcctttgcttatacatttgatatatatataatatacaattatatatatatatatatatatatatatatataatgaatgcctaggtattctgacttttttttaaagctaaaacagttaatttatgcaccctgcctccctaataaaaagactcctagtgaaaatgagatttgtctgacgacatgtatgcatggctcttttattagctgaagtatttaatagactagtaagaagccattttcttccttgcttgcttcatagcttgcattgct

SEQ ID NO: 22347 - DNA, 1428 bp, Mus musculus
cttccactcctccacctgccaggggagtctgctctcccacattgctcccctcactgtgtgcaaagtgagtatttattctgtaatacgttaatgtgcattacgtccagtgttgtcttaaacctcataggagctcagtcgtcagcctctgttgtctgaagtaaatgggagatatataaatacccagtagctaaaacagtcaggtcttttccaggcattttcctacccactgccttctggtaatttcctcccccccccccccccccgccctgtctcaggagacatgcattcacaaatgctgtccttgtagtcacccgaacatttcaccatcattttattgttgctcacagccagttacaggaagaaaaacattttcgcatcctgttgcttggtttaatgcctatgccagcctctgcacttgttcacttgatgggggtcttaccaagtctgtcactaccattctgaccgaggaaaaagaaacaggttgtcagggtagggctgaagttcaattcttctacatggttctgtcttctctagctttttcctctgaggttgcagaggaaaagcatgctaagtgttatataggcaggtcttaagactgtcagctgtctctatcgacaaataccaggacagctgttgtttgaactgcccagggaagcgagacctccgtgaggagcagccctgggaagtggttctgagtgtcgaagctgctctctcctaatggacagtctggtaacatgtggactttgctattgattcttcttgctccatcagcttgtcccataggaaggactgctgcagacacactaaaggagagtggatgataccgctggctccaggcggatcgttatgcgatgggatctaaaccagtggattgtgtgagtctgcctcagtagaacattaagagaggaatccagatttcagctccaggaactctgtgaatttatggcttagttcccagggttaacttgctgataccagtcagcctcgtgcagcatgtgtctagcctagaccttagttgtcttcttggtgtaaggtttggagcccatgctaattttcctttatggcacccaaatggggactaaaggagagggtggtatatgaccaaatggaaaaggaaacgtttaagaaaagtcctaagtctggaaaaaaaatatgaataaaacttctccaggaagttggaggctagtgactgagaaagtaagtcatcagccagggagatcacccaggctgcgcacaaaccttgtttcaagttcttgaatccaaacgatgcttagagcctttggtacagaagtgtttctgatctgtggcatagggcgggataaaaatcaaataagtgatcattggcgggctagccacctttccttgtgaagagtgcatggtgcacagtcagcctttgtgtgaccagagatttcacaaaacctggggcac

SEQ ID NO: 22348 - DNA, 1181 bp, Mus musculus
gaaaaaaaaaacttgaatgaaacagattttacagaaagctttatgataatttttaatgcattatttatttttttgtgccatgcatttttttcctcaccaaatgaccttacctgtaatacagtcttgtttgtctgtttacaaccgtgtatttattgcaatgtacatactgtaatgttaattgtaaattatcggttcttattaaaacatcatcccgcgctgggatggtgttgacatatttggaaactcttggtgagagaatgaatggtgtgtatacatgctccttgtacatttttctgtttcttctgtaatatagtctcgtcatcatagagctcgtttatggaaaaattcaagaaaaatataaaatacataaagatatataaatttaaataacatagctgcaggtctttggtcccagggctgtgccttaactataaccaatactttcttctgttttgctgcaattcaaagttaggtggtagtgaggctcgggctgggcgttttggagccgtgctcctcattgattggattgcaaaactatagatcacggctggagaaccttctgacccttgtgagacaaaacctctgacatacatgttgccacggagcacaatggcactggtggtgcgtatttaccagctgagtgccgggagctactacacctggatacacaggattggttttcttcttcccaaaccacacaccaagaaaacattcttctctagggactggagaatggccttctggcttctggtcctcacaggaagatgaatttgatttgaaatgggagccatagttcactgatctcgtcagtcctgtgttcaccggcttcctgccatgccaagacattacactattttaaatactctcctcgtctccaagactaaccaaatttagaaatatgtatgatacatagtccatatgtgtcatacatatgcatacagacacgtgcacagatatgtacacgtcagtcacctgcgtaaacacagttatatgatgatgccaattcatgtaaaataaagaatccatgtctctcgaaaattgtttttgtgtgtccacgtggaattgttaagcatagccttgtacagtggccagtcctgaaagccacaagagcttccttgtggaaaaggtggccacctcccaccatagcccagcccttagaatatgtgacgtagaaaaaagaa

SEQ ID NO: 22349 - DNA, 1688 bp, Mus musculus
caaggtcttgctatgcagccagacaggcctggaattcttctatgtagcttagagcttacctagaatttaagatctccagcctctcaagtgctaatagatttaggctaccatgttcaactaagaatagattaattctgttacagatactttgttagataagttggtcagttgcatgtgactattgaaatagcttatttgggggcatgatgtacttgtttcaggaattttcagggtaagataatgattgttaatttgcttgtttttgacattttagttacagaagaatggtctgagaaaaaatggtattttgaaaaatggcctgatctgtgacttcaagtttggaccctggaaaaacagcactttcaaacccacaattgagaatgatgacacagagacaagtagcagcgacacgtcggatgatgacgatgtgtgaaggagatcctcacagctttagaaatgttagtgtgatacatctctcatgcagtttggggtgaattgtaaaaatgaagaactataatttatgtagtgaacctaccccattagaagatgattttttgggggacttcgatatgaagaaaaccaagaatgttgtgttgggctgtgttgaacattatttctttgtaaatgaatgttgtagaaatgaggactttggttgatccaacattgactttcttcatcactgcagcatttctcttgactagcaatgtgacgatgtaacaaatgagattttctcatttaataataaaaaattgtgtgatgttttgcaaagcttctgtcttaaaatgttcaggtcttaaggtacaaggcagcttacagttttgcttgcagagtcctatctttttcaaactgtggaaatcttcaactctacgtgtgcacctccttatccactccccctaaaacaaaacaacagcaaaaaggaaaatgtagcatgttggctaaaaccggagcagagtgactaaaacattagcttcttgaactcaactcttgtactaagtcacctttccaaacaaattcctctttagtctttggtagcagtgaatgtgggagaggagacatgccaggcgctcttccaagcttcaggaggggcttgtcaggagctttgttcggtgtgctgtcagatcaggattctcagaggggattgcaagagttgtgggaaaacttattttgataaattattacacatgcagaaaacctgatcactgactggatctgtccacaacatggaaaataaactggattttcagaatattgttgttctttgtagtgttcaagatactggtctctacacatgctttatttcctacaggtttatacttttctttgttaaaatgcaattccttgagcttagaaaaagcttttaaagttttatcaatttcacaaagctatttgaagaatgttgacttctcacctgcacatcaaatttagaatcatttttgtttagatagcatgttagaccactaactataattgtagccaattttcaagcttggtttactctcaggtgcttttatattcctctctcccaacctcatttatattctgcataggaggaggtcagatcccctggagctggagttgctagtagttgtgagctgcctgataggggtgcagtataaagaccttgtctgttataaagaaagtagtcatagaccaggtgttttggcgttttatgccagactacaatattt

SEQ ID NO: 22350 - DNA, 2809 bp, Mus musculus
aggtttctttaaactgcacaaacatgcaaggattttttttaaaaacagaaacttctctcatgttattcaactagagcacttcagtttacaaaacagcaagaccatctgtctggaagccggcgcgaggagctgtgtgcaaatgaaggagacacttgcttggatcctgtttcaaaattccagaccagggctaccttacacagaattggtcattgtactgccgggggacttctgtgtaaacttttttttttctttctttctttttttttttttttttttacaaaaaaattggcatttgaagatgtggtattcatatggggttttgtccaccattgtcaagattgtaatattaaaaatcatactggtcactggtaatttagtttgttccgaggcaattgacttgcaaggcacagtctacaaagcccaggaagttgccacagtggtttacattttgggacaccttgtttggagcactgcagttcaaagtgttaatatacttagacttctagatggtatacataacgcagacccttgaagctactttgtttagctcaaatagttggaaagaaaactgtgagtttctgtctgaagtagaatggtacgttaccacttttaagttttaaaacgtgacagatgttcacgtgcatctcagacgtgatttcacttttattccaaacatgagtaagaagccattgtcatagctttgaccatttttgctttattagacatgctccttttaagttttcaggtgagtcaaactctacaacacagtgttaggatataagctttacttttacagttaaaacaattactttttgcaccgtcttaattaaatattttgatttttttttttattttcctagttgtgttgctgtttataagtgtgagtcgcttcaaggtcgtgctgaagagtaggtaggaggtagtggtcctagtgactggacgggagggtatttattgcacaaactgtgaactgcaatgacatccttgcttttggatggtgtgtattgttttcctttgcagcattttaatgaagattgctttgaagtgtttacgcagtagcacattaagtataaaatttagtttagcacagaggacaaagggtagttaaattaataacttaaaatcagtctttaacttatacatctaaaattgagtattcctgtatgcacacagtaaacaatgggtagcctgggctccatgttgctttctaatactctccaagtggttagctagctttttattgctgtgctgtgctaaactttgaaccttggttttttcgttcccttcagtagactttctttaatgtaggaggataccgggcatgttcttgcattgttaaaactatatttttcactctgggtttaccgtggctggtctgtataaatgatttatacaaagataactgaatgctaataccagttgcacttacatgaaaatgcccattctctttggctggcacagtttatctatgcatcgctggggtcttgatgtaagatggaaacagtgtttctcatctagagttttgattatcagcaagttgaatggacactttagttatttaaatagagttttgaccaaaatccagaaaaatgatatgagagaaataaattccagctagtttaacagatttttaaatgctaactggattttagcctcttagagagtgctacctagctggtaacgtttacttttaattccttgttaaaatgaggcaataatttgcaagatttttgtatatatgtgtacagtaaattcttcatatctttttagacctaattcaatattttctgactgctcctgtcatgtatgatacatttttgtgcatgcctgatgtgacattcataaattgtaccactatgactttatccatgtaaaatagctatttattgaatttcttccaacagctggacttatttttttgtctccatttgaacatcttaacagagaatttgttactgtttattaaaagaattgagtttgaaagcataaaaaatctgctttgcaatcgtatgaagaaaaacaatgcctttattatcacgtgttaataagcacaattcttatagcaaacggtgatgaattctttgtttctttcatttgccgcaatattttcatatgaacaaaccaaaaatccatggtgagcagtggcggtgtcggctggcccatcctgtgtgtccagggcactcggaggatgtggacgttgacgagtgtgacctggtgctgtgactggagcaatactttactttcgtcacgtgtgcttcgccgtgctatgccggccttttaatgtttagttttcctcttgtcatggtcaactgctgaatttacttgaaggatgtagaatactatttaaaaaaaaaaaaacacaaaaaacctaaagtctgtacaattaggtcaaagaattgtgcaatcgcttcctttttaatttttaaaattgaaggtcacaaatatttgcgatcagacctaatagagtagtagcgctatttaatttaaccaaagtctagtaaatacttcaacgttgaatgtaagctaacaacccgaccaccaaggagattgtctgcccagagtttcaaagcacattgtctacgaatggaaattgaaataatttataaaatattgacattactatgttttttaaaaagttcctaattttttcactaaaaggagggaaactattagttttattgttaaatatggtagatattaatattcctcttagatgaccagtgattgcaattgtcccagtttgaactaagtaccctgtgagtatgaggaactagtgacaatcagaacaagttttagtatccagtgttca

SEQ ID NO: 22351 - DNA, 2292 bp, Mus musculus
ctacagctcgtgcaggaactgcacaccgtgcctttcacaggactggctctgggggaccaggaaggcgatggagtttgcatgactaaagaacagaagcataaatttatttttggagcactttttcagcaatattagcagctgagggctcaggatctattttgatgtgtcacttcttccatttcacctagtggtcacagcaggggctctgcaattccctttgggttaggtttttgggtttttttttttttttttttttttttttttttggtttttttggtttttttgtcactggctgtaaaaaaaaaaaatcattgcctggtcagagtgtgtatgagaagcagtaaatacatgcgtttttaaagttaataacttctttataacccacagctgacccccccccccctttttttagctcctggtttattgtggttcactgtgcattttactgtcggcccgttcatttcggtttttttttttttggaaaatatggttctgtattttcacttcaccttcattcgtgttgaatattcagggaaaggtgatctcttcaaaccagaaaaaaagaaatagaaataggtgtgaagtagttcattaagtctgtgtctatcgcaagagctctgctttcttctctcggcatgctgtaaagaactcgctacatcgactcagtctctgccctcactgtgcgggttaagcagaaactcacttaggagtctgctgttctcggatgcagcttacaaggcagggcaagattgcctgaaggttgggtgaattatttcatattattttgctagcctataggcagttcacaccattgaaatctttctctctgtcacgacccatcactcaccccgctgatcattacataactactgttttccttctgccgtgcacgatatctttatacgagactgggctgataaactcactcatctaccgatcgatcagtagcgtttttaaacaaatactaaatttgctctgcatttagaaactgctcagaaagaaaagtgaggttgagtttcatttacacacgaattcctggcatttgcacagctatttgtcctggcctcaagttgaattcagatgcatggaatcaggaaggaaaaaaacggtagccctttgtatgtgtgtcttctaaatcaagtactggttagctattaaatgtaactttgagatgttaagttttaactcttcagaagccagtgtgaaatagaattggttattctcaaagactcaggataaactaaataagctatatatatatatatatatatatgaagtacatttggaatgtacaacacaaattggaagtaaaataagttccaagataagtttacagggatatattgcaaataattttcaaaggcagttttatgtgaatgtgcttcttagtgaaattttacattcctttgttttgaaagattggcaatatttgaagagttaaaaataatacagaaatgtgaagtttggtaatgctaaatgtattgtacttgacttttttctttttactttttactttttgactacttagaattttcacaattctaataagattgtttccaagtctctcatgtgcaagctttaaaggacgcactcttgccatttaccgtactggaagatcattcggtcagattagcactgtgtctgacagagatataaactgtagaaactgagggacctcagctaatcagtattaccatgtagatcaacatgcccgccacatttcaaactcagactgtccccagatgtcaagatccactgtgtttgagtttgtttgcagttccctcagcttgctggtaattgtggtgttttgttttcgatgcaaatgtgatgtaatattcttattttctttggatcaaagctggactgaaaattgtactgtgtaattatttttgtgtttttaatgttatttggtactcgaattgtaaataacgtctactgctgtttattccagtttctactacctcaggtgtcctatagatttttcttctaccaaagttcactctcagaatgaaattctacgtgctgtgtgactatgactcctaagacttccagggcttaagggctaactcctattagcaccttactatgtaagcaaatgctacaaaaaaaaaaaaaactctgggttaaaaaaatttggcttaaatgtatcctttgttattttaaatatatcaagatattttaattaaaatttttacccctttgaaccaattttatagtatttgtacctattttggtgttttgtctttatagtaaataaaagtttttgaacaaaagttaactggtattttggct

SEQ ID NO: 22352 - DNA, 1192 bp, Mus musculus
atgtgtgtagtgtgtatacaagcaagttgagaaacttaaaagataagggatgtgtaactgtaaagaaacactccaatttgcattggttatcttttactgagcacggagcccgcccttggagtgcaattgatataatatataatcagtgtaactccactgatggaaattgattttctcattcccaacatctaccttttgttttgctctaaaggagacaaatgacaggaagctggacggatggaggggtgtgtgggagaagttgagggaacagcaaaaaaaaaaaaaaaatctggtaaaaatatactgtatacaattcccaataaaaaacttttaaaagtgaagaaatgactcaaaaaaaaaaaaaaagagagaaggctagagacttttggaagaaaggctaacataatgatttgcagagcaaacaaatacccattaattagtcattgtaaagttctttgttatattgacaattcagatgagatcaaatggatcaaactgcagtcttgctctctgcccctccctcccccttttcttgcctctgttgcatctctatacccccagctctgaattatgaccccttagctgttggtcagctagtttgaaaaaacactgccaagggcctggctaaaagagtctcaaacacactagtggttgatgtgctgaagctaaagatgtgtttgtctcttgctcagggtgtgacaagatcgaatggagggaaaagacttgtaagggcctttgttcaattgaagaccttacaaaggtgcttagtaggtctgctgaacgactatttaaatgcaaatcctacggttgttacttcccattgctgtgaccttggaaaagtcttgagtttcttcatctgcaaaatgaggaggacggttctgacctgctaagttgcaagaatgaacttatttaaaacagcgagagggtttgacgcactgttcagtaaatatcaggtgtcctcgaatgactcctctgccatcgcacctcagtagacctttctgcattacagcatttatttaaaagtttgtttatctgaggtggttgtggatagaaggaggtgaatgttttataatggattcacctgccttggaccatgggtggggaatccgaaggcctatactgcctctctcgcatacatgacttatcactttgtctgtattggctcagctcaagccttgccacacagcaactc

SEQ ID NO: 22353 - DNA, 1130 bp, Mus musculus
ggggaggttggttgccagggcagagatgaaggttggggaggttggttgccagggcagagatgaaggttggggaggttggttgccagggcagagatgaaggttggggaggttggttgccagggcagagatgaagggctgggaagacaaatggtattgagctactacataatgtgaaatttacaaagaatcaataaaaagtttaaagaaaaaaaacccagcgtggtgtgggcatagtcaagagtggtaaaaagactagagtgcatagaagtaaactcattatatatagccaccaatctttgacaggggcactaagatattagaggaagcgcagtctcttcagatcgaggtgtgggataattggatatccggttcttcctctctccacattttgaaaaatcaactcaaaacagattaaagacatttatacattattggttgattgattgagtgattgattgattgattgagacacaatctcactgtgtagctctgccagcctgggaacctgcactatagataagcttgttcttgaattcacagagatctgcctgcctgtctctctagtgctggggtaaaggcatgtgcgccatactcgactagagtaaagactttaactataagccttgaacctctgaagtcctggaattaagtagggaaatgctttaagatactggagcaggtggggagtttctcagtgggatcccgaagcacagagaggaatgcatgcaacatgagcagacagacagacagactaaagcaccacagcacacttttaggttcagttgagaaagaaggtcgactgagtagtacaatttcaaatcttacacccgataaggaattaatactgattttgtgaggaattcaactcagtagaaaaatataaataatgtttaaaggctagcagacctaggtagacatttctgaagagaagacatgcaaatggctaatatcatataatctcactggtgaaatctaaaaaaaaaaaattattcatagaaagttgagagtagacgttctcagaggcttggggtcctgactgagggaacaaagaaagggtgtgcactgggaccccgttgtacagagacctgaataatatatctgctattcttttgcacagcaaagtaactaag

SEQ ID NO: 22354 - DNA, 1139 bp, Mus musculus
tttgaaatacaaaagtaaaataaagtatatgcaaaacatttttgctcctacaacgaccttttaatactagttattattaattttagaacacttaaaagagacattactgataatttttctggttataaataaaaatgtatttttatatagaaaactaaaatgaaagcaattaaagacagttacacacacacacacacacacatatatatatatatatatatatatatatatatatagaaagagagagagagagagagagagagaggaagagagagagagacacctaaaaagtatttaggagttggaagaaaaattaacatgtttctcattttgctcatatattatcttgggttcatttatctaattgaggtgggtcttagacattatataaattagataatacttatctatataagacttttaaaagttaaatgtttgtttccttatagttcctccagataaacctacaaatttgacttgcattgtgaatgaggggaagaatatgctgtgccagtgggaccccggaagggagacttaccttgaaacaaactacactttgaaatcagagtggtaagttactgcagatatgctggactatgagacactgtggctgggactttgattttgtcggtagcagtactgggtgactgttttgggacatcacgtgctctgacagtggagttatgtgctcttcatgggcgctccgagcagtgtcggcagtgagcagtgtgcacactctaccccaagctgccttcaagagaagccagccacattctgtccatagatactgtaatacctagctctacatgacgactttcaaacacaaccacatgctgtttcttagtcagtgttctctcactgtgaagagataccatgaccatggcatctcatataaagaaaaacgtttattcagggctggtttacactcagagctttagtccactcttggcacagcgggaagcatggcagcctgcaggcacacatggtgctggaggaactgagagctctacatctggatcagcaggcagcaggaagagagagagagacactgggcatgttgagcatctgaaaccccagaccttcctccagtgacacccttcctccaacaaagccacacctaccccaacaagggcacatct

SEQ ID NO: 22355 - DNA, 1104 bp, Mus musculus
tgttgtctgggttattgtgagtcactgaaaagactcgaagcctcactgtgactagacgtgtgactttgcaagttacgctttaacgcttagtatctctgaaccacgggctctctgtatggagagaagggccagtacttttctaaaagactaaactacaaataaaaaccctggtattaactttattaacaaaaggacccttacagaactgtacagagaatctagttcagccttaactaccagttagttgtttgttacttgtgctcaactcagttaactgtctcgttacccagatgtaaattagttcccgagtttaacttcacagggctgttgagtgctggcagcccagccagagcacaggttcctcctgtgttccaggttctaacacagagtggcgataatagctgctaatggtgctacactgcatggctgtaaagtcgtacaatagcatttaagaaaacaaagcactgctccatgtatgttgtttaattcatagagaaggggaatcactagggttggctgtgggtagagagctcttgccgagctgctgtccaatcttgataagcttagatgtctcctttattgaccttagcagataaaaatcctggggccggggcaggcagcctacgaggtatggtcagctctcagagacaaaggtctcaaggctcagtgccccgcaagagtcattattagagcagaatttagaatggcttacttttttatcatagagatcaagaaaaggtaaaattgctctttttaggaagacaaaggtgcatctaatgttatgaatgtagtgaaggaaatagattcctggagaaggtatatacagagtaagaatgaccttgtaggtacataggatatatatcttataaaagaccactttcctaaaccatgcttcagttgtgtgataaatgtctttgataatttggaaggattagaaataaagaaagtaccatatttaagatttttttcttttagaattgagcgggaagcagcctaactcatttttttttcccagctgctctcaccgacacagctgtgcattagtgctccgcccttgatctcactgttggaccttggcaggccacaaattagctaaaatactgg

SEQ ID NO: 22356 - DNA, 2797 bp, Mus musculus
aagcactacatgaactgactttatcctctatagctggaggactctgtgctctttcagaatgtttgcactgccgaaaacaaagtgtgtctgagtttataaagctgttggtttgctacatagaaaacgggggatttaaatgagccacaatgtcatggcatcgttcagctgggctggttttgatgagactgaccatccagatgccagcgagaaggccagcagcatcatttaaaagtgccctgtggcacagtgtccagattatgtcatctagaagacgaaagaatggaggggtggctcgtttctgggtctgtcagagaagcatggcctgctccttgctgttggtatcgatgccggttactactgaggaagaggataaactttaaagagaagcaacatagaagcacccgctttcttatagtcacctacagcctcccaagaaactgcttattattgaaaatgtctttccgagtcaatttcatccaccctatagtggaccaggctggcctcaaactcagagatctgtctgcctctgcctctgcctctgcctccagagtaccgggatgaaaggcagtgcaccaccactgctccacttacgaagattgctgtttttaaagacttaagttgttgacatttttctgaacacacataaccacaccagggacagatgattctagagactggttgaggaagcactttatccagaatgtcttcaactttaaattactttaattgactccaccttgttttgattttcaagaatagcagggtgtttgttgaagggtggcatttcccagagcctcatgcagtcccagaacacacatcccaaccatgtcagcgaccaccacaatgacagaagtcctcctacagagctgaggaagctggaagggtcctgctagtttgcagggtgggctttgaacccacagccctgtgcatgctagacattcactctaccgctgagctgctcctccgcccggctcattatgtcatctaggctctcgtgatcctcctggcccagcttcctgactgtctgggactgtggatgtgtgctgtcacacacccaaccaggtctttttaatatctgccatttatgaggtagagtttttacacgacttaggactatcttaaacctattccttctagttgctttattaaggaatagcctaggcatccagtgtttagcactaaagccattaatgtatttgtgcctaacttcccagtgtgacatggaggtgggggctaaaggtagacactgggcagacaggaattggctgagcgccgttagaggctgatcactaagtgtgctcacaggaaaagggttgaagtttcagagcatgggcacccagatcatttatagcggttaccacacagtgcctaggaggagttgatatgcacttagttggatgcagtttcaccttttactctcagaaggttgtttatattctacttgctgatgtgttatcatttatatttttatactgggtagtccttttctgtgttctttcacatgtataatcctcgtgagactgtacatgctttgctctggtatattcagttgcctccttggcaaaaccagcctggaattgccaaaatgccggaagtgaagggagatggtgaaagtcgggcacaggaaggccaggtcaggggcagagagaccagaattcacactacaaggctggcaccattgccattcaagttggacgtcaaagcctgatcccagttaggactgagttttctatgtatatatctgccaggaagttaacacttgctgaatttctcatcttctcacagtaagcagtctagttatgggactctatccatgttcagctgtgacttccctcatatcagacagtggtgctgtgaacgttgcagtgtgaagtctgtactggctagggatggtagcccagcgtgagttcaggcatgaacatagaggccactgaaggaagagcctcctggaagcaagttggcacgttaaatcccagacagaaagtgtcccagggagccagggcctccgccagcagggagggggtgtgctcactgcaggaacgttcatttagaagatgtaccatggagcacctccctttgctctaagagaaaacccatcttaaagttcatcttgaatacagacttcgctcgagcatgttttagaataatctggatgctgtaccttgtaccttaggtagcagagaaagtaatctggcgtctttctgtaaaaccgtctaataaagctagttctgcccgtgggctcgtattctttcgtgtgtaaaaatgtagtgtaaggcgcaccagagagcagcctggcttgtggccagggctagtccactgcttcccatgcagttgcctctcgaggactcaaagaaaaaggaaggtttaatgctgagtcgccgttacaaaacctagcgttcccatcttttcctcactcaaacataaaatctcagtcctttgaaaagcatgagtcactactcgggggcacagagaagcagaagtaggaaaagtgcagcccctgcccccctcgttctcccgccttcagatcattccatctctgcacagttctgctgtggtcatcagctcggccaggatggacggtttcgggggggttttgtttgtttgtttttgcttgtttgggtttgttttgttttgtttttctgtttgtggtattttggttttttaagacaggatttttccgtgttgccttggctgtcctggatccgcctgcctgctgtgccaccactgtctggtgagactgtagttcttattgtgaacttaaagggttaaagaggtagaaggatttactggactgtag

SEQ ID NO: 22357 - DNA, 1061 bp, Mus musculus
ctttcacccgtgtccacttcagcgaaacgttccttctcgtgtctgctttagcaaaacatccaacacagctgactttccaaagaacacttacgtttccacttcatgggacactatcaaagctgttaaaagtaggactgctaattagacatcacatactatttttaaagctgtctctttttttctactcacataattagtaaattatggcataaatttagacctagtaatcataggatgcctcattgttatagacatatattaaccaagtagaacaagccagtagactttagcctattacgttcattcttctgtttcatgtccctgagtttcttttaaaagcaagtttttaacacaacttctgtctagtaaagtttttaatgagataagtagaatcaataagctgcaaaaaaaaaagtaaataaaaagtaaaggtcaattattaaaaataacctcttgggctagctttcggctataggtactgctggtaggttactttgcccaggtaagattgcatttttcaaatgtgcctttcgatgagttagaacacagccatcaaatggcaaacggtataagtagttcatagacaaaagtttgttttcctgtcacatgcagattagcatatgctcactcagttaacgaggaaaaggtgatggcaggctccagatgttactcggtctaactcttagggctttttgccacctgtaagctcccacaaactggtcagttttggttttgttgttgttgttgttgttgttgttgttgttttccttttacttaaccagttgtcaatgctggtgagggagggttgggatggaaatgtaccaggctggttgggtaggaattcttagtcctgtgattgctcgcttagtctggttgctgcagactgcaagtgctgctacgtaagcaggacaatgtgacgtgccagaaagaaagggatgttggaggggttggaagctctgtagccttaatgcttgtgtgtgatagactttaaagcaaatgcactttgctagcctggcgcggcagtaggcattaggcatggcttcttacacctttgctcttag

SEQ ID NO: 22358 - DNA, 1190 bp, Mus musculus
tacagacttctctccattttataatgtaggctgtgagtttctcatatacagcttttattacgttgaggtatattccctctggccctgtattctctaggacttttattgagtcatgttggatttagtcaaaggccttttctgtctcgaaggcccctggcaggtgttgacgcgatgtgatttctgcccagtgctctgaatgtcaaagtgaagaaattcaatgaagcgtgggtaaacggcgggagtaactatgactctctctctctttttttaattttggttttttttaattaggtatttatttcatttacatttccagtgctatcccaaaagtcccccacacgctccccacccactcccctacccacccactcctacttcttggccctggtgttcccctgtactgagacagataaagtttgcaagaccaaggggtctctccactgatggccgactaggccatcttctgatacatatgcagctagagacatgagctctgggggtactgggtagttcacattgttgttccacctatagggttgccaaatgcctcgtcatctaattagtgacgcgcatgaatggatggacgagattcccactgtccctacctactatccagcgaaaccacagccaagggaacgggcttggcggaatcagcggggaaagaagaccctgttgagcttgactctagtctggcacggtgaagagacatgaaaggtatagaataagtgggaagccccagtgcccccccccattccctgagagaggttgggatggggtacgccggccttgagtggccttactctacacaaaggataaacaggttgagaaagaagttagggaaacaacacccttcacaatagtcacagataatataaaataccttggtgtgactctaactacggaagtgaaagatctgtacgataagaacttcaagtctctgaagaaagaaatcgaagaagatctcagaagatggaaagatctcccatgctcatggataggcagggttaatatagtaaaaatgactatcctgccgaaagcaatctacagattcaatgcaatccccatcaaaactccaactcaattcttcatagagttagaaagggcaatttgcaaattcacctggaataacaaaaaactgaggatagcaaaaactcttctcaatgctaaaagaacctctggtggaatcacca

SEQ ID NO: 22359 - DNA, 1721 bp, Mus musculus
ttcctcccgaggtttcttttctcccgacatctttaaaaaccagtctcagacgttatgtcatttcacttctacagaccttcatagtcagctaatagcccagactttgaacctagttacatttaccatggagctagtctccaaagctctggctcacagaaacgcccgtggccactgggctgcatgggagcccgtgctcgaggaactctggaacttcatgactgcacactcgccttccgttagagacgtctgagtcagagccaggtgatgtaagaaatgtccctgacttgttctcgctatgttcttagtagtttcttttgtctttgaggacttgagagacatttccactccttttttttttttttttttcttaccaaagacgttcttggatgctttaacaatcaaggataattggctgtggttttgcccatttcatagataaaagataaaaggtaaccaaccggcaaaggatgctaccctccagccgaaaaagtaatacggattcatgcttttgttgtcttaaggacactgaacaatttagacctcttcctgatgtcctgttggacaagccaaatgactttgtctccttccacttttgtccttgttttccccatgagcctcctttggccttgccacagagtcagagaactctgcgcacgagtgtgtgtcctggctcgtatgagaatggagggggtaggaacccatgtgcagccatcttaccctttctttctctctctgctctcatctctgaactttctcactccgccacattcaccttatcactctgctgctacggccggccttcagcctgagcttctttaacttaaacacacctgaggacactcaaagttaaaatgagctgtttagggagagatcttccttagaaagcctgtgagtgaacttgagttgtgctaatattaaagctagaaagggaaaaagtagaggtaagctttatacctgtgggcatggatggttgtgccaagtcattgccatcagcacactccagaaatgtgcttggaaggaggactacgtcattgcagcccctggaagaggctgttttaaagggaaatgcttcgtctacattaaatgtgtctcagaagtgcagttccactactcactgtagctgtgggctagtcctctgcttctacttgaaacttaccaaggaaatgtttgatgtgtgtttttaattatcactcccttaagtgttctgtttcaataactgaatagtcagcaatgcacatgcctctggaggagttaaaggcagcacgcatgtcctcgaggagcaccttgagagcagcatcgaatccttgggggtgggcggcgtggcagagggggaggggctgctcagaggcaagggactcgtttccatgtccccgctattcccccagaccgcactccccgtgctcgctattatgatatgtagtagagatatgttacatgtatttgcttctgtgggttttgcagatcccctctaaagcgcgttttgtgacattcagctgctccgggctgttcttctttcttcttgatgatccctgcagtattgatttcctgtggctcttggacagaaagcataattgcttaatgtgggaggtaattagtaatacactgggtgctgcagacatttataaagtttccaaatttttcatttaagtatgaatattcaaaatgtcaaatgtttacattcattgatgtcacggtgtttggttttgttttctttctgtttt

SEQ ID NO: 22360 - DNA, 1224 bp, Mus musculus
caggcaggcaggcaggcttcagtgcccagcttatcataacttggtgagaagcacttgaaagttttcttcgtctataaaaggtttagaacgttcctaattagaaggcgtcgtcaggttgtaaattgtcaggttgcaggagcgatggagatggccaggtttctgcctgatgaggtctgaagaagcttgcttttccccatcccatcccgtagaagtcctgctattggcttatagcgcagcccttgccttggtgtgcctgtctcctgtgacagcctggcacggagcgcctttagcttctttaatttctttagctacagcaaagttaaggttatttccctggtggaagacttcaattctggggtctttcgtctccagatgtttttttttgttttgttttgtttctccttcaggagaaacaaaaacaaaacttcccaaacctccaaaactagagtcatcttgtcaagggataggcatggaaggggtagctttcactttttttctttttcttttttcttcttttttttcctgtatcgtgtctgtcacttgtagaccattgggtcaggcaatttacctagttgtaagctgttggaagtttgggtggtgggactctggtttaagtaactgacatagtcctggcgagttttcaaggcgactgaactagtggcttttgcatcctagatacaaatcagcataatggttcctcagagataggaaatttccccaggctttaacttaatctcgctgttctagactattcctctctcttgcttccagcctgaccatttaggtgcctataatcttataaaattgttaaaattttagtacctgttttttttaaatgcattttctctctctctctctctctctctctctctctctctctctctctctctccttccttccttccttccttccttcctttctttctttctttctttctttctttctttctttctttctttctttctttctttctttctttcttttttgagacagggttactctgtatagccctggctgtcctggaactcactttgtagaccaggctggcctcaaactcagaaatccgcctgcctctgcctcccgagggctgggattaaaggcgtgtgccaccacgcccggtttaaatgcattttcttaaagagttcctttttttttttttttaaagaaacttctttatttggaaggacccccccccccccccccccccgcgccacctttcattga

SEQ ID NO: 22361 - DNA, 1871 bp, Mus musculus
agagagctttcagcctggcttaaacttttcccctttttctgtggagcatccacaggtaagagttgactatactggcagaaagatgattaagcactttgtaagtataggttatgtgaaagtgattcataattacaatgtgaatatgttccatattctgttaatgactgctccaacatcactctgcatacccattttaatatgatgatgttacgtgattttgttacacaagtactttcgtaatttttacccagggtgatgtcttttgaagtggtcattaaacattatgtatatttgtgtttatgtgtgtttgtttctaaataatctccattaattcatcaatatctaaattattaactcctttagtggatttggcaaatccttgaagaagagaaatttgagagatgatatatatttgatcctgtgaactgaagtagagtcgtgtaatcttttttttctggtctttgatttgacaggcctatcgttgatttctgttttaatttgcctccttgcttatttatttatagatagagtctcaccgtgtagttttggctagcctggagcccactatgtgaactcagagatctacctgcctctgactcctaaatgctggaattaaagacagttgccaccacatctggtcttgcttttgttcttgtgatcagtggttctaaaactgttggtaagtccatatacaattacctgaacacatgaaaagctactatataaagaacaatagagagttggcgattttagcccaatattatattatgtcctgaacataacttactgtttaattactaaggattattctgtattttagccaccagttgatagatacagagtccactgatttagtgcacactgacggatgacggacttttgtaccttgcttgagtgctggggatggaaaggtaaataggacagtcccttccctaaagaagctcagagtctagtgaaggaaaagtaaactagatgttacatcatgctaagtgtactaatgcaggcctttggtcagggagaagggcatggcttagacctataccatggtagagccttggcttctcagttaactcagagacaggaaatgctaggtgttgcctagcattaagtctataatcttcttctccccattttccaacttgatctaggggagtagagactcaagaatgtgtgctcgtggtttgtctgtaggtaggcctgtgatggctaggacatagatggaactggcagaacccgtctcttgtgtgtgtgtgtttgctgtgcagtgatcactttataatgcctgtctgtgctgcatagaccttagacttagacatgacaaaggcttcttgatgttgtaccctgaggacacaccaccatctctaactgctttccccaaatccttctgtgctttcaaagtggctcccccattttaccctctcttgactatgttatttgagtgtgttgcttgcttcttgtttgtttggtttttttgttttgctcttgttgttttgcccaggatcctccagataatacccatctgtgtccaaaccagaactgagaaagtttttcttttcgcatggtcaccaggtacatgcctttgatggcagatgaaacaggagcccttggttattgttgaacttctcgtctctaaaggtttgtttgcttaattgtgtgtgtgtgtgtgtgtgtgtgagagagagagagagagagagagagagagagcaccagttggagtttatgtgcactgtgtgtgtgtaatgcctgcagagtccactagatagcatcatacgtaatctccggaacagatggttgtgagccactgtgtgggtgttgggaaccaagagcctgggtcctctaaacgagcaagtgctcttaaccaccaagccatc

SEQ ID NO: 22362 - DNA, 1185 bp, Mus musculus
atataacatccttgaagaaacttcagaatctttgggtcaccattggtatctcagtgtactctggtctattctgtcaacttctctccatcttgataactcctttaacatgagatcagaccaggagagcagattagatggtgttgactatgagacagtgaatctgctagcttctgtgaattcaaggtttacagaggcattttatctagagagacaattccactacttgaattaagcattcagatagatttgcatattattgcaagagaccagaagagaaagattaaggaataaagcattttttaaagataaatcttaatacgccagggcttttatccataacatttctgggtgataggtaaatattagtcatttactaggtgaggaaactgaaattaggaaagaaatgtgctcctgggaatgtgccagaagccaaccaatgcaggcctgcatatctgactactcaaccctgtatagtgttggtattctgtctggactcctcccccacagttacctggaaacagccaggtatgctcctccccacggttacctggcaacagccaggtaggcctgacccactaaaaggggctgcttgctccctcctctccctctctctcttactcctgcttctctcccttgctccccgtctctccccattcccttccccctctctccacatggtcatggccagcctctacttctctactctctccttctctctgcctttccctgcctctactactctcttaactcccctccccatgccctaaataaactctattctgtactatacccgtgtgtgtctggtccctcagggggaagggatgccttggcatgggcccactgaggcacccccttcccccacaccccgccagaacatagtcttacgttcttttctctttctctttttatgatcacatcatccaggactccaacctgctacaccgaagcaaggattacaggagcattggagtagacacttgtaggacaagcagatctctgctgggtggaggggtgaggtcactgtagggctgtacaggtgcagcagatgtggagatgagaggaggcgtcaggcaaatggcagtgcctttttctgttgatgtgttttgttacgcaatgtaaatctctctcttttggcatatatgaacttagatgaaacatttttttaatttttatttttatgtgtgt

SEQ ID NO: 22363 - DNA, 1172 bp, Mus musculus
tgtatataaagagggggtaaatcatttataatcaatattggttcagactttgcacaaacctttggcatgacctgcagatgatctatctgtatctgtatctgcactggtgataaaggctgtaagaaacccggagacaagggaggatttcagtgcaaggaagcggtcagggagcagtgtcggtgaacggggttaataaaagtctgttcactccagcgactcagtcttggctatggagaaagactcgggaggccctaaaggagtggaagcaaggagagctgcttggaagaggtgcaatggaggtgtgccagcgatttcagacttctgggctagcaggccccgaatgaatggaagagcgctgtaccgatgctgtgtggcatagtctttggtggggacatgcaggagctgaaaagagaatgctgtgagcataggcccatggggggggtgggggaggggatgagcagcgatgtagaaaattgccaccttccgaggattctgcttcagtgtccaagacgtcgtcttcagtgcgttaataatattgaacctttactgttgtcagtaaatgagccgtgagacgtactttgagttgtaggattaattccacaatttgctagctgtagacttgaccaaagattaagaccaagggataatagaccaaagggcaggacaaagtattaaatgagttgaagaatatgactgtcgtgtgcagatggaataaagaaagcttgatttagagtttattctggctgtttctcttaaagagcagagcatgtaactttaaaaaataagtacgagacacccttagagccataccaccaccccggtacatgttttactttatgtatgccacttgtgtaggtcagctggtgctctgcaaatcagaaagctggttcctccctcagaggcaggggcagagtttgagtgcctccagctggtgctgggtgtgaggcgcgagctgcactcctcattctggaccagttgagttctgaggtgtggaaagaaatccctgctgctaaaatgatgttaatgcacgtggtctgcctcccacaccaccaaagatgaactccataatgtgctagagaactcttctcactagcagcccttccagaattagcagaagtccccttcgtgacccaaagaagcaatataatctttaaaacagggcagtggttgct

SEQ ID NO: 22364 - DNA, 1195 bp, Mus musculus
cacacttaaagagaggaactcaggtcccgctttagacaagtcttaacaagtagcaccgtccacagctttagctttgattgatatttgtcttcgagttgcaatccatagggaaaagtttgtttcctctcttgctacctctaaaaacacactgtaaaaaacagacaaagcattgaggaaacaagctaataaccatgttctctcacaggcatgcttgtagtgtccagaatcctgagtatggcacacacaggggcctgagaagcgggactcggttaggcatggatttgctgcctgacagacgtccttacaggacgtgagctggtgtgctgccttcctcaagtcagtctcttctctaaaaccagggaaattggtttacctagctctaaaaacatgtcactgcatccttagaatatgtcctttacggccgttaaggggaggtgggggggtaattaaacctttcctgtaactgccagtcatgttcttgtgctttgcaacttctctaatgtcttattcctcctggttggattcacaacaaactcgtgaattccttttctgtccaggcagtataattcgttgtatgaggcgtctggaagaactgcttcgacagatgtgtcaagcagcaaaagccattggaaacacagagctggagaacaaatttgctgaaggtcagtaactagtttataagccttttatggtaatgtaggcaaatcttgagacttggaacttttacacaacttataatcgggacattttaagatatctttagctggagtatcgtggagcgtcctctaatagtgtatatattaaaagtggaatatttagatgggacatttttagggttttgttttatatattacagattcccaattacacatatttattgactacttagtatgtgtccagcattgttctaaaacctgtaagagagaatataagtgcaattggtagagcttctcttgtaatgtgagggaggtgtcggtcgatggtcatttagtctgcaaggaaaggaaagagacgacacagagatgacgtttaaggctttttcctatgcccggaatgtttgagcaacatgagactagtgtggttggaacacagtgagcatgagtgagagatgggagagaaacaaagtggccaagtctgtagagtagcaggaggatgcagggagacaggtaaggaagaatggtaaagtgtaaagagg

SEQ ID NO: 22365 - DNA, 1182 bp, Mus musculus
ggcgtcagatctcgttacggatggttgtgagccaccatgtggttgctgggatttgaactctggaccttcggaagagcaatcgggtgctcttacccactgagccatctcaccagcccttccccctgtatttaaatcatccatttcagaatatgattgctttctttttcttatagaaccattctcttgccacagttagaaaataagtaatatttactgatcgtctgatttaaaccctcattcacctaaccctaaaggtacactcatttagttattcatttctgcgtactaaatataggtatattttgtcttttccacgtatttagcatatcagctagtgtttgagaacttttcaggtacgcctcttctctcctgaactgcatctaagctcctacagcacacacacactagactgtcgtgaaattttaatgaaggagatgggcaggatgaccttaggaaactacttttatgtggggtgttgttgtttatcccacattacactatccagtttattgttaaaccgtctttccttttgtatgccttagattgcactagatatcaagtctgcaaagagagaactgaagaaggcaagaactgttctgcaaatggacgagctcaaatgccgcaagcgcgtgctgagacggctgggctttgcgacatcgtcggatgtcatagagatgaaaggacgggtggcttgtgaaataagcaggtaacatgtccttccacagagacttttaaattatagtctatagtgtacacggacagcacttgttagaaaactgctgttaagaaggtttcatcatgctttcattgtaaatacatttggaccatgaagttgagaaattagaaaaagtctcgtggatcccagtaattaccataggtatttctagctagcctattgctgtattttctatgaaacacattttcttgtgtgttgagattcctatataatttgtatttattatattgtagtttatatatcatcttgtgttttttatactttgaaaatgttctgccttgacacttaactctgatgaccgtaattcttatatataaggaggacacaagagagtgagcaagttttactcaagtttggggtaagaggaagatacacaatggcgtatgataggctgcagcttcagtttgggtattttgcatctacagattcagctcacttgtagatag

SEQ ID NO: 22366 - DNA, 1134 bp, Mus musculus
ttgaatttgctttgtagttagtattcttaagttttgattctttttttttttttcttgatctagctgaaaggtattttgtatgcctttagctggtatttcctagtaactggctatctaaaattgacagttgttggttaatgcacagtgaagtcagttgagactaaactttaagtttcataagattctcacaaacttttcatctttgtttaccaaaagtccatgtttttgtttgtttgttttgtttttcaagacagggtttctctgtatagccctggctgtcctggaactcactttgtagaccaggctagcctcgaactcagaaatccacctgcccctgcctcccaagtgctgggattaaaggcgtgcgctaccacacctggcttaaaagtccatgttttaaatgatatcttgaaatgtgtaaattatttgtaaactctataaaaagagaaaacatcaggatatatttttttaaccagattttctcccaaacttgacaatgtcgtattcagatttcctctggcgagtacatccagatgtctggtcgcgcaggaaggagaggcatggacgacagagggattgtgattcttatggtagacgagaagatgagcccaactattggaaagcagctgcttaaggtaagaggccattctcccatcaagggtcctgggaatgcacatcagtgacttggccatatagctgggctcttctcacactagatcataactgaaaagaacccatttattctccggcatcgctggttacctgtgctcaggtaccatgcatctgtcttgtcacatcttccctagacacttcttcaccttgcactttcccagaatcctttctgcctcctggatgtcccacctcctatttcctgcctaagctataggccatcagatttattttgttttgggttttttgtttgtttgttttgttttttgagacagagtttctctgtgtagccctggctgtcctggaactcactttgtagaccaggctggcctcgaactcagaaatccacctgcccctgcctcccaagtgctgggattaaaggcgtgcgccaccactgcctggctggccatcagatttattattgacaggtgccacatccatacagacacaagatattctctacag

SEQ ID NO: 22367 - DNA, 1194 bp, Mus musculus
gtgacatgcctgtaataccagcacctgggagatgggggaggcggagctagaagaaatgagatcagtggtagtgtaggctacgtgccagggccttgccctcctctccacataagcagctcagtaattatcatcatcatcattatattgttattactgttacttttttctgtggtcttttgagacagggtttctctgtgtatccttggctatcctaaaactccctctgtagaataggctggcctcaaattcacagagctcacctgggtctgccccctgagtgctaggattagaggcatgaaccaccactgcctgtctgactctcaataattatttaatatgaaagaatatatagaccttctggtttacaaaggtaacagtcatttttaagttaatttagttttataaacccataaatgtatatttgtaaaaaaaaaaaaaaagtaagtattaaataagcaagtgaaacaacactgccttaactaatatctcttcaaaagtaaatgtggttgtaattttggatataccagaaaatttaacatttaaaagctaatgtttaatatgtacatacctaatgtaagattgggtttttatttaaagaattcaattagtctatatcggtgtttctcaactttgctaatgctgaaaccttttttaatagagttcatgatgttgtggtgaccccaaccatatgtcatttcattgctacttcataactataattttgatactattaggaattataatgtaaatatcttatttgtgaccccaaaggggtcgtgacccacaggtttagatctgctgatctgtgtattcatgataaaaataatgtaagaaaacagcaacacttttacttttgccaaattcctacagatacttctgagcatattttctatttgctttaaaaaccgtgagtcctggaccaactagtgggttaaggctcttacccctgagactggcaatctgagttcattcccaggatccaaatactaggattagacctccaaacaattgccacggcacacgcatgcacacaaacactcacaccactgagcactgcaaataatctcactcagatcttgtgctaaacaaacttaaatatatcatgaaagtataagaaaaagttaattattaaaataaatattaagatgcaaagagaaaaaaataacgtggaacagagagacattttttgaaact

SEQ ID NO: 22368 - DNA, 1173 bp, Mus musculus
aataatttgtagaataagatgacacgtacgtagggtgggattgtctctggtttttctagcatgtcttaaatattacctgctttctaacaaccccctcttatgttccagtccattctgtaagggaacccactctctggaaggtcattgcattaacccctctaaacaacctaatggcttctttggggcctcagcacctctcgacctgctgggttggggattgaagcctcaactatgagttttagtaggggtcagtccatagcaaccccttccccaagagcacagggatgaacatcttgatgggtgtcattaattatggctctggtctctttcaggtgaaaataaacatgggtacggggcaagaaatcctcctttctgagcaaagacttcgtgtggacgatttggcttggcattcgttggagctgcgctatggcaaggatgctgttctcttggtcattgacaagcactttgagacaaccgtccggctggcgggtgggctgcgtaacttcacctttcaccatggaatctatataggaggccgtggggggctcagtgtcccttacctggacaggaagatccccaacttccggggatgcatggaggatgtggcgtttaaccagagggagatccttacgtcccttaggtcataccctggctttaagaaggtgtctgaggtgtcgctggggtgtaacgatgagttttttgctgggaaggatgaagctattagctttttcagctctaggtcctatgttacctttccagaatggaaggtacacggggaagggttcctgagatttgctgtgcaaactggaaccctgcaggctttgcttttatttcagtccggcagaggaagagattttgttgccttggaaatccatgagggtctactgaaggctcacgtaggaaggggcggaacaaaaactcaactctcttcattcagcttggttagtgacaacaagtggcacgttgttcagcttaaagtcaccgggaggcacgtggacatcatggtggatgaacacagggaaagggcggggctgcctctgcaaagccaagcgtttgtatccgaaggccccctgttcatgggtggcctggatgaccggatgtgggaaactgtgcgcggcttagaagttgtgtctatgcctgggaaatctgttcgaggtatgtctctgaaaggat

SEQ ID NO: 22369 - DNA, 1100 bp, Mus musculus
tgcccggggtcagtttgcctttggaatactaacaagaatgatgttatttctcaaagagtatgttggcgctagccccagttcttttaaagaacaaaacaagacaaaacattttgactattatttccaagagcttttaatttcaaatatgtggcatttttagattaagattgatatatccaaaataagtgttagtgaatatagaagctagaactaagtagcttttgctgcaataacaagaaaccctcaagtcccagtgtcttatgataaccagcctgcccttctcacttgcactatctgacaaccgtgggttggctgtggtctgttgttcataccttcgttctttcagaatctagctactggaacagcctcgctctagtcatgcgtggaaggcagtaaagggcagtgtgatggtggaccatgggaaactgtgcagcttgtattctagaacgtcctttgtattcacataccacaggaggtagcttgtgaccagtgtggtggataaactgaatatttggaactgtgttctaactgctatggtgcactgacatgcaaacggaaaactgtgtataatactggaagccaggtatgttttcctaagaaaacaaaccacctttagcctagaacacatttatgaataggaaattaacacaccaagccaactagaaggtcccaggcaagcaaggtcttgattaaataaaatccagttgcttccagatttgaattgtttgctgccccttctgatttcttctgcctttgtgaacacataggaggtacctgacaaacttgtcagcgatggcagatatgggccagagcaggagaggtgttctatgggagctcagtgctgcacaaggaaacggaggcaggctctagtcgggaaacaaccagtcccaggccacagatcaggggacacagtgtctggtttgtcccctcccatggccctttcttctgcagaacatgtgcctgccattccagaggtgtggttgaaaacttagaatcaaaggacaaagaagaaattattttatcatttgaaaggttgtatacaaagactgtgtatctggctttgtacacaaggcacgcccctgatataataatttctttct

SEQ ID NO: 22370 - DNA, 1995 bp, Mus musculus
gccaccagaccccttacctttacagacatttacaccagatgtgcctttatttgtcactggagagaccctcgtggcctctgtttcctctcagaaaaaacttagggcttctattaaaaaacagacagaaactccggggaatctgacccagggcagatggcaggggacagattcctggggtcaactcagtggcaaagagccaaatatagatgccaaggtctctcccaccagggtcatttggccatatgctgccaccaaagtgggggagtccctttccgggggagccatgcagccggaaatgagccgtcaccctctggtggtcatcatacctttggctgctgtgttcctcctcctgctggtgactgtggtggccctgtgtgtttggctactgagccgaaaggaggacaaacccaaaccacttacccagccaaagacaaacctgaagtccccatccacaggctctagagcagagaggagtggagccattcccacggtcacggtgacaccccttattagaagcagcctggctcctagtctgttccagacccaatcctatgatcggccagcccctctgggggcggagcctgtggagaaatgtgctccttgggacgcatgggtgaacttggatcctgacatggccaagctctgtcgacaaaccaaccccgcactgaaacacaaccagtactgggtataaatggggagcccccctcctacaccacctcatactcattctctctccttcgctcccccccacctctctctccccctttacccccctttccactttcccatctctccccttttccgctctcctcccctcccccatctcttgctgttactgaccacttactgtgtataggtacgaagatcaactcagggttataacgatgaaggaatgcgcttcgaatcaaggaaagctgtccattaggtgtagttacacacagggcccactcacagcccagtgctgttggtgagtgccgtaccttgcactcctgggccttccacagtggtcccttgccaggacctgccactctgttaagaattaaactggactaaggtactgctgagcagtgggacctcattggaagcagtgcctttaacttggagctcggagttaagggaggacggtgtgggtgcttttcatgggagattcaccctcacggtgagtcagcaggaggtgccgggtctctctccacacaagatgccatttattacatcggcgagtttgtttatggaatatttatgtgtgtggagtctcctcaggttggtttcctcgtgcaggaaacgccttgttcagattacagggcaaactgacctcctttgaggatagtccttaaatccgacgtatttttatccagaggcattgtttacagaaggatctgtaaagtcaagaaatatctgaagctctgaggtgtagaaaggtgtgttaaaagctttttattttttgatgccttagtttggcatctttttacaataaatggaagtaatggcaaatttgtatttgaattgtctacttgaaccgttgtccaccattagtttctgtaagtctaaaatgaagctttcagtacttacactaaggcagccttgggctgcagagtataacacacccacaaatgtgagactgaggcttgcacaaatgattcagatttttctgtgaagagtaatatagtaaagattttaggtttgtgggctacacatggtctctgtcatttgttgttcttgtgttcatctttcctaaaacaaagtttgttttaagagaatatacaaaaagaaatccttagctcttgagtttggcccatacgttatgtagtctttgccaggctttgctttaggcagctggagtgtgctgaattatgtcaactagtgaactcagtagagatgagcattccgaaggtggctctgggactcagaattatcaggggtggtagctcttttgtcccttctgctctgccatcctcaggctctttatggttatgagatggctgccccagcacccca

SEQ ID NO: 22371 - DNA, 3214 bp, Mus musculus
acagtcaccattttgaattccaaaggctgctgaaaaagtttaggcaaatactgacggtacccaagttcctgttacttagctatgtcattgggatttgtgcatgtgtgtgtgtgtgtgtgtgtgtgtgtgtgtgtgtatgtattttaattaattgttgtctttgaccacaggagctcttaccaaagtaaaggagagtaggcgacacgtggaagaagggaagatggaggtccaaaaagctgacggcattcaagaccgctgtaacactatttccttcgccacgttggccgagattcatcacttccatcaaattagagtaagagactttaaatcacagatgcaacattttttacaacaacaaataatatttttccaaaaagtgacccagaagttggaagaggcgcttcacaaatacgacagcgtctaatgactgcacatgggaccgcgctcttgttttcagttgaacgataatttccacagcagaacaaaacctgccttctcagagctgttgccaactctaggtggtacaaggacggctttgtgttcagccgaaaccggctggatatataattatgtaggaaagaagcagttaatatggctatgtagcagaaacagtaccacactttgtaactaaattatactatgtatgcctacactaccattgtaacttttggataatgattatactatttgccttattgctttttgaagtatgggtatattagtgtatactttgtagacctcaaaacccatgaagagtctcaaagaagctggctggataaaagcctgctgtggatgcctttttagtctcagagatcgagactacctaaatccaacctattctctgtttacaaactccaaccggagcagctatgcgactttgtgcctttagtccgcttgttttcctttctgtcccacctgggttcgagcccccaacgtttctgatggaaagagcaaagggcgggcatgttggtgacaagccgatgacaagctcccatttctgggggtggtgggagaaccagtggccatcactttgcacaggaagcatcgcctggtaagatgctggcagttacagaggcaggagacgcttctgccgtctctggatgtgaagtctcgtaggggagaaggcagtgtgccatattccctcacatctgtagttcacggcctcgactcaagggtcgcacggattgggcctgaggatttcggcagtgccctgagcacgtggagaaggaggaatccgatcggggataaagaacagaaacagtgggtgacaacgcactccatcttagtttgggggagggtctcctgtcttcctttttcttttttcttttttcttttatagcttgaaattttaatgttcagctttttgtttcggtttcaaatggatctacactgttaactgaatgagactccactgtgattcactcgtttacttaatcaaaaaaaatttcagggatgtctgtaaatttcagtgttgtacgcgatgagaagtgctgttggttgatttaaggagggaccagaaataatttctactattccagtactgaaagaaaaaaaaaatactgatttatactgtttttaaaaactaagtattgataaagcccccctcagaacatttaaccttaaaattattttgaatatcgccttttattattagaagggagctgcaaatgactgacaaataccaaaaagatttacatgcaggcttcatctaaaaagcacaaagaggttctggtgtgaaatgcccaaatctcaactgttttttgtagttgctgagctaaataatgtgattcttgagtttacagatgtaagagctgtcactgaaggctgaggtccctgcatctgctgtccctgtgaactacttccaccaccccggaaaccctggtcctgacatggtaacgtgggggtacagaggccaggctcagagggggtgagccacagttatccgaaagggtcagcttgcagaagggtcaagcaaggaaaggcgagtgggataattacttcacagcacattcactctctacaaagaaatcacatatgggttgacattttaagaacggatgatgatcattttgacctctggtcaaatccttgtgcttcagaactctgaggcggacgtggcatcctgtggcgctgtctttactacaggcacgtgggactgccgccaaaagccatgctctcttaaaaagcaacttcctctcttggattgcaaagtacagcgagataaagaaaacgcatatatatttaaaaattaattttattccagaattttggaggttacaatgatagcatttaagtttgaattggtgttgaagaagcaagctctctgcgtttcagatgatttgagcgtcccatttatttgcctctttgttttgatggtggtttgattttttttttcttttaataaaattactaaacttgtgcaatagtagcaaggacatccatcacctgaggtgtctgattgtgctttagccagggtggacatagcttaaatcataaactaagattaaagtccagagaagtggaaagctgatgctgcctcctgctgagatagcgtttgtcctccctaaccacacagcatcatctcaccggctcgtgggacttgacgtgaattctgtgggttaatgcaccaggcttactagtgtccattttcatccaagatccttactctctaacgttcttggtcctattgaagcatttcagtatctaagcatactgcaatgttaatacccaagagaaaagccattacgtacgtattctggtcacacgatcggtgtggcaccgttttatttgttactgttgttgttttattttgttgtttctgttttttaaataaactatcacaccctccaagccatcgcttgtcttttatttctagaacttgtagttttggtatggaattatgtataccacgagggtgggagggtggccctgatgagcctggtcttaactattttaattgcaggcagggagttgtttatgggcggtagccatggtgcagtgagactggtttgacagtcatgcatagttttctaggtggctgtatctgaaggcacagtcacaccccgaatggagaaacacattggaaagtgaagcatcaatcagagccctttggcttgaacagtgcaggagtgcttttcccagacttctctgctacactggcttgcatttactgctaacaatacagcaggctctcaaatgctgggttgtaaccgtc

SEQ ID NO: 22372 - DNA, 1156 bp, Mus musculus
ctatatgttgcttcagatgtagaagcccctgaattgtgactctggactttgtaggcaggccaggctgcaggtcccacactgaagctgagctgtagaatgcttgtggttgtcttccattttatttctcagtataattctgtcagtttgttttgtctttaatcatcttgctttcttttgacaagtagttctgggaggagccaagcgacgtttcatttaaaaggcatcatttaaagagactgcgctacaccccgagcgacagagccagtggtacagtttgaggcagggtcttactgtgtgggccagaggcctgggatgtgcgatccacctcagaacacagctcttgccggtgtgagtgcacgttcacacctccacatactgtttacctggtctcacctatttcaggtgtgtgtgccttgttacctcaaaaatgatttgagcccttgcacgggggccacatgtttcatggacatgtctcctgctcatctctctgtggcagacttgacccagtatgccagcaaacttgaagtaagtgggtcacctgggatccaagtggaactggctcctggcgctcattcttccctcagtcctgtccttttacagccctgagttgtctttgcagaatgttaccgtttgcccatcaaatgaacccatacattcccgaagcaactgtgtagtaatatttagggttggagtctgacaatctgtgtcaacttctgaagcatctaagtagatggaggaaaaaaaagaaaagaaaaacataaactccctcccatatttgagtttgtgtttagactttcgaataccgtagtgtgtaccttttcaatatttaagataagaaaaccatacatcttaaagtataaaaggttttacaggttcagttagtaagttgaattaggtcagtaaaaggaaagtgtcacacataaacaaatagtttcctgtatacattcagagtaccttttgaattacgcgtttgaaaatgtcaggggctggaggggtggctctttgtgtaagagctgagcaggagccgagcgccaggatctgagtttggatctcagcatctgtttcacaaagctgggtacggcttcagctgccggggatcccagtactctgggaagagaggagccagcaaggtcaccgcgcctgctaactctggtct

SEQ ID NO: 22373 - DNA, 1166 bp, Mus musculus
tgtttaaaataatgcttaaattcaaagagttttgcttctagtgaactgtaatcactagaaaattttgcctctaggtatagctaatgtaactttaccttacgtaagaaaaattttattgtttctgcttctatacaagaagccaagagttttaatctttcagtgtatattgtttcctaagtgaaaagtattttattaactaatgcttcttaaagtttaccttaaatccttgctctcacccaaaagattcagagacaatatccttttattacttagggttttagtttactacaaaagtttctacaaaaaataaagcttttataattgttattaattggtaattaaaaattggttgtgcccaaaacaattctttggccaaaaagaaaacattattgtaaagtcatttttctcatcctcccagccaatcgttggcccatgtgggcccaactagcttctgtggggcggagtcttaagacacagtttcccctgttccagcacagatgatctagttgtgtgctgtagatggtgttttaaaatgctgaacaatcaaaccttaatttgtatattaatactcaatgccatatctctgagctcgcaattgcttaaattgttcatccctcagatactattaattctcaaatttacaattgcttatgcatatttctagttaataaataaattatgaacatgtgactcttaataactttgcaagccttctagttacaactgctccttaagaaaattgattaaaagtgcaattagtcactgcccctttacagccaagtatttaaaatgttttgtcaactagttattaattcaaaagtttaggtattgtaaaattttaaaactttaacttcttaaaagacaaaaaagagagaaattgtatccccgtgcatgctatttagtgcattcccatgcacactattaaagtcttacctttattttcaaaatctaatattttaatgtcaaagagtttaataaatgctttatagtatcttaaagggatctacttattggcttatagattaatcctaaaacagctaccttattagaaaagggaaaaacaggttttctccacagaacgctgcagaagcatattagtaaattcgtgtgacgagctggtaggtaagttgactcatgtcctgattaaattgactaaaaaactaaat

SEQ ID NO: 22374 - DNA, 1129 bp, Mus musculus
ccaccctagcaagctaactttcccttaagatttatctggtagtttcttcatgcttagatttgaattggaagttttagagaataacattatagacggcattctgtcttcagctcttctcatcaggtacctgatacctgtagtttattttattgttgatggttcctcaaattcataaatctgaattctgttttcttcacttgtcaaaaattcatgaatttgttaaaccatagtatccagtatgtattcactgtacaatctatttcattacatctttgcatatgtttttagagatcagataaaaaaaaaaaaactaagttgtctaagttgtttctttatcgaaagataatgaatcaatcactcagtctggtagctgtgagaccccaggttggggtcttcacggggaccttgctgcattggaacatggtggggagggatcacttggaaatagtgagatcaggaaagagacactgaaaagaggtgacttttataacaaagtgacgtcttctatatagagtccctccctatggaaaccctgtcagggggatggcgcctcataacctaagcacctcccaactacaccggcagccggcgaagctccaggatgggtttgggaggggacattcaaaccacagcgcaatgttagtatggcttgctgtcctttgtttttagagccatattattaggcagtgtttttcccttggtggattaaatgtgtgaatcctttcctgagtggcagctctggataggcgtctgtacagacattcacttttccgtgaggaaattagaggcaggaatttagatgcaggaaatgaggcagaagaagccttggctgaggaggatgctggcttactcctcatggctcactcagcctgctttcttatacaacccagcaccacctgcccaggagtggcaccccacatattaaaccgggccctctcacatcaatcatgaattaaggaaaagccccacaggcttgcccataggccaatgtgggaccatttttctttaacgtttggttgattctctgtgaatttcacatcatgcaccccaactcactcatctccccatccctttgtatccaccccccacccttgcaacccccacacctccaaatgaaaacaaacgtaaa

SEQ ID NO: 22375 - DNA, 1099 bp, Mus musculus
gttctcagtcatcagatctttaaggtgttttctcttggctttggttagattctccaacaaagaagcaccagcttggtgaggataagcctggtagccagggctcagaggctactgtagggctgggtacctggtatccctgctacagtcgcaccatactcttcttagtgctgtgtgctttgcctgtaactcatgcctgaggaattctagaggcgagaccctgtttggtcttttcaggaaaaagatgtgaagtcttgggtggctgggccattcgttgtctggctccctgaagctggagagaggacctgaaatccaatcccgtcttagaagagctttgagttagtctgctttcggcagtatgctgtcctgcacctggggtgctgtcccttcctgtgggggccatttgttcatttctctactctgcttgtttaggtttagtgtcaggcgtgcagaggatcaactacagtcttgcatgttcctgggaacaggagctgtctttgatgtctaaagcctctgcaacaatttagaaattattttaaaattttatttgggtgcagtttcaggagcaagtattcatcctgccccttggattagaagtccgttccttcttttcctccgtgacagtcttccggcccaaaggatggctactacgtctgtacggcatgagggcttccgcagagcagcggtcctgagcgacagtctgtgccttttgtgtctctagggaggggtagcgttgcaggtcccagcgtctgctgcagagaggcttaatgagcagatgcagagtctccttcttctcgtgcatgtacagggagcagtacccttgcagtcaggaggagctgggcgcgctagacgtgggtcacgagctctcccctcctctcagtggctttggaacccttttcactgtctgcttaccttgggtcactggccttctcctcaggaagagcaaggcgtctctcaggggagcatgggcgatcagaaaaggggacccacagcgtgcagtgtgcttttgagtggctcggtgttttcacgagtgggtttggctgttaactatcagcatcctgcatctggattgctacatggaggctgtcggagcctaccggag

SEQ ID NO: 22376 - DNA, 1203 bp, Mus musculus
attctgttgggaaacattctgttcacataatggcggtggtggcggtggccgtggcggcgtatataaaatggattagtgtttcacttttaactaaatttgtatttcttcactccttaggggaaaaagcgtatctgtcctaaaactgatgtgggcgaagccctgacagggaggtgcttttgaaagcatatgaagcttgagttctgttacagacaaccgtgcctagggattgcattgttggttttagtggataattctgccattatgaaagtttatacttaaaaatcagatttcctatccaactattacaagataaaaatcctatattgaaaataagcacatattttcaatttagcttccttttttaatctcctagcttccttctttttgactctgatctctctgatctgtaaatcgtgtgacagatctccaagtctggataaccaggcatatatgagaatcctggattggtctctttaaatctacttgttccctacgttccctaactttgaaagccccactttcagttaatctcgaaacccccgtatcaggcctggtgaatactcctgatcaaggatggctgactgatgctcagaccgggagccacgtgggcccctggtctggctcggcgcggcagcactctcttccattcagagcctcagatgtctgcccctctgcaaagccgtgaggccagtgtctaaagctgctaagcatgaaattccctgcttctgtttgtttcttttgttgccacgagttaatagggacagagacaggagacagcccagaacaaagcacaaataatggagtatttcaccccaaaaaaggaatgtgggttgagaaatacaaagagtactgcaaagacagacttagtgtcccgaggcactgtgatatatctgccagaagccccagcccagggacaattctggaccagatccttcatctgtgagctcccagcctacatggcccaaaggtttgacccgtgttctatgaaaacagtttattgttttcctcacgagggttttaaagggacgtgggatttttcacctcaaaaagtggattactcttgccaggcagtgaagtcttccgggctgtctggtggtcagcccggattagtatttttgttacacttggtgtggtttgatcttacactcttctcacaagtttgcaagaactcaggggcttccatgactgtgggatgtgtttgac

SEQ ID NO: 22377 - DNA, 1206 bp, Mus musculus
gttgttgttgttgctattggtgggacatctggcagtgtttcagatgctgaagtaaaaggttagaaaaactgtagagcagcagatacacacttgagatactactgaaatgtgggtttgaatgaggttgtctagaaacaatggatagagagcaaagaggggtgcgaagcatcaactgtatttcattcacccattacatatttattgagtgttttattgtgtctgccactgagctaggctgtagcatagcatcagttaataaggcagacacgcatccccacccctgagagtttatattcctgcacctcttaaggactcttaatccaggcaatatgataaataatgatactcgtagaatagttttgttagattattaagctagatcccacctagagaaatgaggaagtcgtgtacgagaaatgccaataagttatgcagactaatcattacttcattggttcttcataagattctgtagaaactatttttttttcaggacacataaaaaagagagagtgctgtggacctttgtctcaagaaggacagtgatcacactagtagatgtgtgtaggcgtggtcatctgagagtgaaggagattctgaaggggttggggggggtggatagaaagaacacctccacctccagagcactggcattaaaggtgtgtgccaccacagccaggccctagggtcagatagtgtaaacatcagagcaaggagtactgtggagaagagcgaaggttgtagcatagcaacgaagggattactttacctgagagacctgcgtgcttatggacccaacgggaggtcttcaaagtacataacacagaaaataggagacaaatccagagtttagatgagaagtttctcttctaccaattgaacattataggctggcagttactctagagatagtagacttgaacaatgatgtccactgacacgaccgagttaacttttaaagatcactccacccaaccatagaagacatccattcctcccaagtgcctttgaacatggactaaattaagtaattatcaactataatacataaggcaaatatcagttagtttatatggactcctaacctaaatatattttcaaattctaacaggcatatttaatccagcctttaaacatttaaaacattggcatctgcaaaaatcatgccgatggagttgattgaggatgtcctcctacacacacaca

SEQ ID NO: 22378 - DNA, 1133 bp, Mus musculus
cttttgtgtgtgtgttaaccgactatgtctcctttacaaaagaagaaggagaagaagcagcctaactatccctttttgattcactaactgatgtctgtcaatatggaaaattcacattgcgtgcaaatgattccaagcctgtatgcactggaatgcacgagaacttcattttccttcccacttgtatcaactttaaataattttctcaggtgattttgcttgaaaatagaatttatataataccagtttgaagatattttaggtaaagcactttccctcgtcaacacatatcagcacatatcatacagttaccttttttggagtattttattgggtctggggattcctcggtagacctaaggtctgtagatgcataatgaagagctcaccctagcttcagactggctgcgaaaagaaagggaagcatccagtctttctcttaatgacaaagaggctactctctatagtgtgtataaagcctggttaaaatactcttaggaatgtttcaagaattaaatcaataccttatcattagcataaaaatggagttgtgaaactgaatcttccgtgttgtataaacaataacctcaaactgggttggaaacagcaggccagggtaggacatttgaaagcagagtcccatgttccttgaaatacattttagatcttagtgtggaaatgtctttgggcatctttttgctattcttcctttcattttgataccacttggtctgtgtcttatagctttatgaacacttgtttgtttgtgcccacgagtttggcggtgctttgagtgttagaaggttgatttttcaccctgcaaaaatatctgtgacttttaaggggggtggggaattctgcttaaaaaataatcgaggaagacacattcagctacctcggaagcgctaacagcctgacatggttaagaaaagacagtgtgctcttaggtttcttgattcctctcttcctgaaaatcactcgattttgttttcggggatggggtggggggagtatgtgccaggatttgcctggtcgctcgagtaaggtttaagaattcacttgtttattaaggtaactgttaacttaagagtggatgcatgccagtgagatccagagtagagccctgaatgggc

SEQ ID NO: 22379 - DNA, 1146 bp, Mus musculus
tatcatttttacttcttaaaatttaaaatataattatatagtttacctcttctcccgctaagctatccctttcaaatccacggtcttttattatttgttgttattgttacaggtgtgtatgtgtgtgtgtgtgtgtgtgtgtgtgtgtgtgtgtgtgtgtgtgtatgtgtgtatgtatggaatggggagaaaaaaacaaatgtaagttgcaactttcttagtccatttaaggtgtgtgtgtgtgttagttatggataaccatttagggtgctcacttctgggaaagatgaattctccctctctcagcagttcttagctcttcatctagggataggaccccatataatctcttccattcattctggcatgccaactggtggtgtccttgtctaagtattttttaggctaccatactttaaggtctcacaggttcagttttcctgcattgtctagagacgacatctttccggagacttcctggtcctctgggcctcttccctctcttgtatgacgatcgatccctgagccttggatgtaagggccgtgttgcagctgtattggctggctggacctctcccagtcagggtgttatctgcattttaagtagttgttggtttgtttgtttgttttttcctgtaatgctgccagtcagtctgctgtgaagagaacaatctttgataaggttcaagagctatgctaatctattgaaaggaggataagcatttggaatagtttaagaccatggcaggattaggttcttttgtaagatctacgatcctgcttaccacgggtgggctcggttttcagtgccaggatggatttctcttctgtttaataaccaatttccaattaggtagttattggttatccctaagctatcaatgtcacacgtcaccttttggagatacttgtcatacctggtggtggttgtggctcctacgcttcacagctgggtaggactatatactgctttcctcttttggcagtttgcatagcactgtacagtataatgaaagctagcccccggggagacggcatttggatcggatccagatcgatcagttctctcaagttctgtcttcagtgtatggtgtcttcagccaattctggggcaccacaaagggtaacggtacctatattgtctgg

SEQ ID NO: 22380 - DNA, 1224 bp, Mus musculus
tctccagaggagagtcctcagaaccctgcacagtgctcaaatgcagtatttgtgatttcatcttgtaaatggattttaataaaaaagaccccacacttctttaagcttatatatatatacatatatatgtatgtatatatgtatatatatatatatatatatggcatggcccagagaaggacccatgataattcattttgtctaaagtatccttgaatatttttaaaactgtgacgatccacaggcagcacaaacctttaatccacatgagcagttaaacgattcctgtttttattttgtccctcccgtgctcatcttccatgaaaataaataaatgaatgattttttttttccgggctttgctctccctgcaagttcattaaatgcagaatgttgtcttttgaggatcttgtggccgaacgctccttgccatctgttaaatgacttcccgttgtctgtgtgtgttcatgtgcgccagtgatgggcttctccacagcccccgagactgtctgaggcgtcgcagccgtcagaatgaaaacattatcaatcagtacccaacaacagctgtttttgacaagtttctgtctgacgcctgatgctttacaactgtcaataaggctctttctttgtctagcaggtcgcagctcgctgtcttactgcttcttcttggcatcctggactctgtaaccctagaatttactgtgtttgggaaacccaggtgggggaggggaggggggaaaggggaggggacattcgtcttgttcttacttttgtgtgaggtgccacaggtgtcttggtttgcatattcaaagatataggaaaacagtctgttgtgtatttcctcagtgagcatcttgttatatttatggaagtgacccatttttgtaccttcttagctaaagcggttgcctctttttatactggcaattaatttatataagactttgtatctaccatagtttacagtattggttgctggataactgccatatcgccctgtctttctatggagatttactctatccagacttaaaagttgacaggctcacatgggcatttgctaggcaacaagaacttgccctattcacaatttatatgatttccactgtcttgcaatgaaaataaatgctgagtagaacaggcgtttcctgactgactttttttcagccatagcatttgaaagccccagatttctgcttactttgtgtcgcctgtttaagtctt

SEQ ID NO: 22381 - DNA, 1180 bp, Mus musculus
tcattgtgggtagctatcacgaggttttggtaggtttgcagtgaatctgtgattgcttcaggtaggaatatcattttgatagtattatgatttccagtccattcctatgggatacttactcttatatctttaatttctttaaaaaatatttgtccaggcggtggtggtgcacgcctttaatcccagcactcgggaggcagaggcaggtggatttctgagttcaaagccagcctggtctacaaagtgagttccaggagagcaaggactacacagagaaaccctgtcttgaaaaaaacgaaacaacaacaacaacaaaaatcattttgactatgcaaaacttttgccttttttgttaaaaattctgttttattctttcattaagacattataatgggttgttatgtaactttctatacagattgttcattgttagtgtataaaacacagctgggtttttgtgtgttcattttgtactcatccagtttgctgaattagcttattagctacaaccaggatttcttagtggtaatcttggaaggttttctacataatgcttcatatgatctggtaacagataatcttgttttgttttttttcttctggtgctctgttgaatatcacaggtgggctgtgacatccatttcttcgttagaggaaaggatttcagttcagtcattgtcattgttcccatccatgctgtgtgcatagccttcctaagaccatagagaggatcagagccttactggttaagctttggaaatttgattaagctgttctaagctgtgccattttaaccaggattttacttggggtttgtgggtctttaagttgatattttccatatttagaaatcttttagtttttctatttcttcttgtgggtttttcttcttatgtgtgtggatgggggttttgttttattttgtttctcttcatgtgtctctgtctaccacatgcgtgcattgtacttgtggaagccagagaggatatctaagattccatggaattggagttacgtaaagttataaacttccatatgggtgctgggaattgaacccaggctctttggaagaacagccagtcctcttcaccactgagccatctctccagcctcttttctacagcttgtaaactcatattatactacatgtttagtcgggtagttcagtgtgtttagtttc

SEQ ID NO: 22382 - DNA, 1212 bp, Mus musculus
atatgtaaaatatgcagggaaatttattgaaagtttgtccaaatggaattaaggtaaaaatatttctactctaaatagcataacaattttaaacttgtacatttcatttaacaataatgatcgttacggcagattgtttatacatataatttttgtaggtaagattctttatataaatgcagaacttttatttccaaaatatgtttccaaaaatgttattctgacatgtcattaggctgtatgaaacttacacttttgaaatgttacaaaggaaataaatgtgaaaaataatagcttttatatagagacaggaaccattaaagcttgcagaatagctatattaaattgctggaagaacaaaagatctttcgtctacagtattcagccatctctattatctgtgattcttcagcaattaaaagcagattattttcctctttgttcctacttagaacacttgaacaatactgaagaactgaactgactggaatgttttatctttcaaaagctttaaagtcctatccaccaattagcaagatacagtaaaggtttaaacgttaatagccacagcatggtgaatgcatcgacctgtggtactggaggtctgtgtgccagctcctgttgtgggctctggagagtaaccgtgtctctgctgttcttgcaccactacctgctgggtgtggaaagtttgaatcgtactggacacttgtttttaagagtttcaaatttttgcatgttactatattgtcactttggctctcattaagttagagttgataatattttatttattaggatttatataaagcttattttgctattttcatgacagctctagtatgaaaatacagatcagtctcttagtaaccaaccaaagtgcttgtgctgtgtgctgtgtgcttgcagcaagctgtttgtccagcaggtttcatttagcatagtatagccaaccattaagtgtttgttctgtctttaagtgtttgttttgctaattggggcatagaactttaaagcttttgtgaggtaaaactttgcagtcagttctggttttagtttggaattttgcttggttttgatctcattggtagtggagaatatcacactttatgttacagctttttaattggccaatttgccagattgaaaagacttcatctaaattaccactagcttgttaaatgatttgtgtccatcattttgtagtagattctc

SEQ ID NO: 22383 - DNA, 1401 bp, Mus musculus
acaggaaaaggggctgtaggcaggttagggcactgcacagaggtcctaccagactgaagcacaggcctctctaatcacttccctgtgctcatgtagcttcatgactgatgggaatccagtccaccctttctcttagtgatgttcaagtcggtgcgtttgcgaagaagtacagtttaaagctaaaggcattccgcttatcctcttctgtaactgcatcatgtcttgtgacagcttctggtctgtcacctcctgattggagttagaggagcctgcataggggacatgtatttatgtccgtgttctctgtgcctcatgtcccttatgttgttagaaagagtgcacatctacatatagatgtgctatttactgggctcatttgttcagagtattttattctcattaacatgcattttgaatacctgctctcgttctggtttttaggaaatatatgaagaatcaacctcatcttggaaaagaaacaaagagtgcttctgggcagctggtgactagtcaagtgtggtgcgctaagtctaaaatttgataatctcatagctaacacaaacggagaatagccaagtgcatgagtgtgtgggatgaggggctgcctaggacttaaagatggggagaaagggcttgacttaaacctgtgataagatgtctgcaatagactcagccttctgtgactaactcctaactaaccagctcgcagtgcgctgcagccttccttttaccttcagctgtctcaggaagaccttgctgtcccagagtgtactgagagcatcactatcaggcatgtgttaccaaaaaactggcagaatcagaaactcatttacataatgtaaaagtgaatctaaataaatcatgatttaaacagtctaaaaatagatcctgtctcctttttagtcaatgataataacctaagggattagttgtcaatattctcatcactgtacaaattagcataaaattgttataaaactaactagcaacaaggtggtttatgttaaaatgatgtatgtttaaaagttggcccacaattgcttgaggagattgtgcagttatttgttaaagtagtttagatagttttcataatgtttatgtaacaatagcctgtgtgaagttaagactaaacaaattaaattttctgcaagatatttatactaagcatccagtttttgattggtgaatttatcatggcaggtttgaatatacaaatctcgtacactttgtgtttccagctttattgacatatatttgacaagtgaaatacacttaggttctataatgtggtgtcgtgatgcttgtgttgtggtgagatcgtcacaacccagacgattaacatgtccatcacctcagacaggttcactgggaagactgaaggtacattctaagctcagaaag

SEQ ID NO: 22384 - DNA, 1202 bp, Mus musculus
tggcgcggggagggctctgggttcaccggaagaggctcagtggcggcgaccctccagcccgacgacatcccttgccgctcgcgcaggggccgcggggatgcaggcgcaggcggctacggagcggagaggggggtggcctttcattggctgggcgcgggttacccaaggaggaaacgtgggagcccgggtggctccgcatccgccgggtatagggatgatcccgtcccagtaaagctcagtttgatcctgggagctggtagtgagacagggtcggatttttcctaggaagtgggcaaatagagtgcgtgggtttgtgcgggggagactgggggcttctgctagtgtggcatgattatgagtccacattccgcgaggccggctcccttcattagagccacagcgaggctctcgtatcacctttcctcctggcaggtgttgaaattgagtatgatttttagagcagagggtaaaaatcgcgatagccagccaactcaaacaagcccagataagaaaattagacgtgtgtgttgtcttttcataacaatctttataaaaacaaaacatttttcaagggtgttgggttgcgtgtttacggcatgcggacagaaggatttccgtgaaaaacattaccgggtcaagatctattttgccaccttaactcacctttttatactttatgtgttgcaagcgatccaatgcttttcagtgcaagttcctgtgtctgtggcaggttagctcccatttaagtcaccactaactttcttaagcagttgaaagactggctttactgggaactaaatccagacattattccacacaaggttttgcgctattataaattatttccatgaggttatagcatgtagattggttaaacatagtataaaagaaaatggtcaaaaggacacacacacacactgttaacttggattcttctagtccctagattttcttgttccacatgttttccatcataatagtttaggacatgaccttaccaggcgaacctggttcttcggtcctcttccatgcatcatttatcatatgcttctgaaaaatatagcctctttttctaactcgcttcttttgcctccccgcttcccctttccgctcccagctccttccctccccctctcttcctttcttcctccttcccccttccttctttcttccctctgcacttccctctgctgttgtcttcc

SEQ ID NO: 22385 - DNA, 1167 bp, Mus musculus
atgaaaatcaaaacatcagctggccgctttcttgatctgcctggtgatgcagaggtgtgcatttacattgctgacccaacccatattgtgtttaccagccgaggtgtgggcagctgacctggcaaggtccccaggagggaaggaggaagcagagcggcagcagaagctggaggtgcttgtatgctaatttagctgcgttaaggtttggtaatgtcactggagatgatgaaatgcagccctgttgcctagccacaggcaggcgggacctctcaggttgcagggtcaggagcttgagcagatggactgtgtgtgtgtgtgtgtgtgtgtgtgtgtgtgtgtgtgtgtgtgtgttcctgtgcagctgctctcctggactgcttgcctcagggaagaaggatcctagtacgcttcagtggcctgaagcacttagtgataattttaggatcgagttgtcaagtattacataaaaactggtcacgcgcaaagaagaaaaatgtgagtgagcactgacattcacaaggagtgacagaggacgcagtccactagagcaccagacaggaccgaagcagaagctccagcaggacagaagtggcacctgccctgcatcctggttctcagcagcagaaatattagcattgttgactagagaggccttgcatgtggaagtctgtttggggcattgaaggatgtggaatggaatcttagacctttatgttgacgataaaggctgtatgttcatgcagataaatatgtctttgtgctgcaagtaccagagggagccctgtgtcctagtttcttgttactacagtggagtgggtaccagaagcagcctagtcctgaagagggggttgctttactcaaagttttggaagcctggataactttcagtctctagtcagtgtccatggaaaatgcatcttccatgggaagcaggcgtgcgggaggaagcatctctgtgtcttgaatctggacgtagggagagctgtgttctaacaggctggctgcttggactgctcataagaaggcagagttttgtcaagagctacttaatcccattgcagggtttctagtgatctgaggaccacggattaagtcctgcctctttttggtgttttttttttttttgttttgttttgttttttgttttttttttgttttgtttttttt

SEQ ID NO: 22386 - DNA, 1192 bp, Mus musculus
tgtgcacactgggcatgccctccacatcgtgcctcatccttctgccccttgactttcctttgtccctttgtggtaccactttctctccctctgctggctctttacaaatgtgcatcaattgagactattttctagcctggaaatgttgcttttttgttcatgcacttaagggttaaagctctgaagagactgttgcagtatctcagtctgtgggaggaaagaacagctcctttttatttgtttcaaacatttaataatttgttgcaaatgtggaatggttagagttctaatcactagaggctttccttccagttgtacaccggcagatgattctactgaagtcatccatctgctactattagccactactgcctatgcctcctaaagactacaagttggtttcattttatgtacaattaaaattgcataaagagaacaatccagaaatgacgtgggaaaaatgtccataaattgagtacatttgttttgcttacacagtttccataatatacatcttcctgatttttatcttagtacccaaagctcatgggaaaaaaaagtcgttgatcgcttacgtgggggattctactgtgctgaagtgtgtatgtcaagattgtcttcctttaaattggacttggtacatgggtaatgaaaccgcacaggtaagattgtatttcctggggctagtgagacagatcccttagtgagtgtgcttgccctttaagcaccaggactagagcttggatgcctatatccatgtagagagtgagacacacttgtaatccaagcattggggatgcgagacaggacgatcccagaggcttgctggcctcccagtcaagtgttgctagggaactccagattcaataagagactcgctcaaaaaaccaagtggattgaagtttcgaaggcactggatgacagtttcgaaggccttcatgtaatccacacacaaaaacatgctcacacccttacagacaggtacacccacatgtaaacaaaaatgacctttttttccctctgatttgaagaaaaccaaacaagaaatcttttagttcataagtaagagtatagctgacttaaaattcctcggaaaactaatatttctgtcctaactggtaattaccaagtaaccacagtgataaatggagctgtccttgggcattctcgggatatcaccatatgtgtgaag

SEQ ID NO: 22387 - DNA, 1101 bp, Mus musculus
ctacctaaagatgtactttcattttgtaattgctttccattaaagcaaggtcaattgtttcagctgtgttctgtgagctgtaacctagataataaactcccctctgtgggtacagggtggacaccagcaaaatcacttaataatccacaaataaatatcgccgaagatctgtttattaccaaagaatttattaaagagaaagcgtttgccagttgtcttaagtgtttgcctccaccagacatcttacctatagaagtatttatcacagttttcatgtgaagtgtatccagtgttgagtgtgatttctctaggaaatggaaagtatgctttcaatatcggtggctacactgcagtctagacactaagataaacttgtgctctataaataatggtgcaaagtaagggagttcaaatgcttgtgccatggccactacattaccagagcttctcatcttcattgcactcatttctgctctttctatcccaagccgaagagcttcccagccttaagtagaacattttccttgttctttgtcattggggtttggacttcaatagtcttcagaggccagatccacgttgtcacagtacaaccccgctcgctacctgcatgcctttgtggctcatggtttctgggtgcctttatgtgccatctctttcctggtaccatacctggctaaaatgcattcttagtgttttccaataataattcctttgtctagtatacaggaggactagtgcactatctttatgttgctgcgaatgccttagacttaacttcaaaattgtatctgagatactttatgaacttagaaccaaatcacgtcagaattttaatggacatggaaacttgtcaatggttttaaatgaaataaaatgtgccttggatggttggattaaatgtcccttgtgctgctggcttttgtgatacactgcctgggaaaacagggctacaaagagagaccaacttgggatgatagttaaaaacaaaaaacaaaacaaaacaaaaaaaaacatggttcttggtgattctgggattagaggttgggtaaaaagagtccaccggtttaaaaatggaaatgtatagaagtgtatgccttt

SEQ ID NO: 22388 - DNA, 1200 bp, Mus musculus
ttattacttcctagaaaatgaggatattatcaattatcttttgtcttttaggtagccagtcatagcacaagatccataatcttactgtagttggggagaccgccctgcaccccccaccccctttacccattcctgtggccccacgatggtgctggggaatgaacaccaatttaggactttttttctggcttgatttgtcagtagtaagcatgaatataacatttatcatccacacactgaaaatgaaaggggatactatatacagcttcactgagatgtggagagtggcccctccggtctcacatttagcccatggcgaggagctggcttctctgtggatgctctcacagtgctgcagcaaactggaatgattgatggcaatcagctttcatggaaataactgactgtaggtaaggcagggaaatcaccaatttcagtaaatgtcaggtgagtgccaccatggcgaagtgcctataatggcatcatttgcccagcttcaagttttatttaagtatcttcggatgacagggtttgctggcattcggaaagtgggatgcacgggatgtaagagagaagctggcggagaacattccgcttttgctgctgtgtggacgaactggctgattccttggatttgtgtatcttctggttcattgctgtagtagctgtgagtgagtgtgagtgagtatgtgtgtgtgtgagtgtgtgtgtgtgtgagtgtgtgtgagtgagtgagtgtgagtgagtgtgtgtgtgagtgagtgtgtgagtgagtgtgtgtgtgtgtgtgtgtgtgtgtgtgtgtgtccagaaagtcaagaatggcagattatgcctttactacaaaagttaactgtgtgtgaaagtcacgtacaaataaaatgggcacaagtacttttaattccacgaatgatttatagtctgtatttcttactcctttgcacctcagtgggaacctgttatggaaacctgtttatagactgttggatatatatatatatatatacttgttttaaggcattttcaagaagaattacttatataattttcatttcagaatgatatcacaaattatttttctaaagtttatttaagaaacatgaaaatattagatttattacatatataattaatgataatgctatttaatgttaaaaaaaaagaatagctgcttatattttctaccttttaaaatagata

SEQ ID NO: 22389 - DNA, 1453 bp, Mus musculus
ttttgagagcttgtgtatgtatctgtatttagtgaaataaatggtcatactgaatattaggttttatgtggtgctagtgtggacattttttgagcatactctaagtcattaagttaataccagtagcagaatgcttcctgtaggcaaagcttctcataactaagtagatgctagaagctactgaagaatcagtttgtagaaaaggatggatcataagtctcgggacgctagaagctaggaaacagtgataccggaatagaatatagagttcacgaaaaaaagcagggaaattgggagtcagggatttggtgggtcagcgtgtccagcggtcttcctaccctcccgagtattctgtttggatcacatttatcagtgtgtacacaggccaacgctgttttcttccacagggttctggagcgaagcagatgttactcgaccttttgtctcccaggctgtgatcacagacggaaaatacttttcttttttctgctaccagttaaatactttggcactgactgtccaagctgatcaaaataacccccgtaaaaatctatgttgggggtcacagagtcagcctctttatgagaccgtggaggataatgatgtgaaaggctttgatgatggtactctcctgcagatagttcactttctgctaaataaaccaagagaagacggagcacagctgttggcaagccaggagaaggaacttgatctgggaccttgacgagatttaagtttcaccagaggaacaataaaatcatttaaagattgtgtaactgtctgctattaaacacattggtttttgaaaaaccagatttcttatgttgacctgtcattaaaccttgcattctggtcaatttcttgactgaaagatttagttttagatgtaaagatggtgacctccacacatttgcttccccacccccaccccatatgtgtctgtctctctaaatatatgtttaaaaagaaaaaaaactacatttgtgtatcgctaataacagtattgggctatctttaatagcttgctattttgtgtcatttaaaaggcaatacagtggggtgctaaagagaaagttcttgcttttccacagagtctggttttgatcccagcccttaacttacatgtggcttaaaaccctctatgtcctgatccagtgccctcgcctgacctctaaggcaccaggcacacacatggtgcatagacacatgtgtgcaaaacactcatacacataaaattaaatacattgaatgtgagtttcatgttcttttaaattgttaataacaagagagttttagagcattcttcaaacagggctgttttgcacaagctacatgaaggcttttaaataaaatgtttgatctttattttaaaaggaatgaaaaatggaaaatatgactaggctatagtggcagcatctttttaatccagcccagtgaatgtttaggggcattt

SEQ ID NO: 22390 - DNA, 1131 bp, Mus musculus
aacaattcctgccagttgacctcaagttccgggtcgcggcgggcgaaaatggcggcggccaggtattggaagctggtgccccgcggccggggattgtcccagaatgccgctgctaaggcgtccgctacggccccggaggtgagagacctggaggtcgtggcgacgcccgtcgcgcggtacccgccgatcgtggcttccatgaccgccgacagcaaagcggcgcggcagcggcgggtgcagcgctggcaggcgacggtgcacgcggccccctcggtggacgagaagatacggattctcaccaagatgcagttcaagaagtacgtggtgcatccgcagatctccgccttgaacgccgaccgctggtaccagagcttcaccaagaccgtgtttgtctcgggcctgccgcccgccccggcgctgtcgccgccgccgccctcgctcgacctcgccgccctgcgcgccgccgtgtgcgactgcatcttgcaggagcaggtctacgtgcggcgccgccggccccgctccctcttcgatcgtcgccaggccctcgcctcctccatcctggaccaggtagtgaggacgctcgtgaacctgctcgctccactcaaccctgtcctgagcactgccgctctcggtgagcttggaactcccaccctgaacgggggaagtggggacgccgtcggccaagctttcctgcaggttcagtagcactcactgagttaggacttacggaccaagtttcaggcggcctgccctcctaaggactacttgttaaagtttagtctcacccgaagctcatcacgtttccatgctttgatcaggttttgtgtctgagcagccaaaagtttctaagagacggttgtcttttgactgcttcacacgaaagctgggtgaccatgggtaaaacatcaacctctcttactttgccttaatatcaagatgagaattactgtaatactgtttggccctagaatgtcgaaaggtaaataagatattatcagcgttactaacattttcttagcatttactactgtgtgtcgatccctttcccaaatgttctaaatgccacctacttaatcctcataataacagagtacatatcatggattcattttataaatgaagagtgaaaaa

SEQ ID NO: 22391 - DNA, 1224 bp, Mus musculus
atgtaagaaaaaaatggaagctacaaacaagacaatggagtgtagatcattacatggcttgtatcacatggaatcaagtattatcaccatctgaataaataactgtgtttcccttgcagaaagagtttaacaacgactgtaagctgaaagagagaatagaggaaaatggatacaacacctatgcatcttttaactggcagcacaatggcaggcaaatgtatgtggcattgaatggaaaaggagctcccaggagaggacaaaaaacaagaaggaaaaacacctctgctcacttcctccccatgacgatccaaacatagaagaaaacactgttggtggatgcagtacaaccaatgactctttggacagaaagagatggtatcctcactgaagactgtagctcaaaaggcaaagacatagccctgaattcagcttgtttaaaggaaggaaggctttggatgtttttgtactcactgctgacatacaaagttcttttcactagctctgtgtcattgtgtcatgccttataatcaagatagaggcaagtcaagtttggatggaagttatcctcaagtgaacaatgttgtggtgggggctgggctttttttgtttgtttgtttgtttcatttttaagtttttgtttttgaacttctgagatagaacttaaagaacatggaacactctgttgaatgatctttgggaaagttatttatggaatatgaacacatatcaaagactttcattgctcattcaagcctgatgattcaatgagcagtaagacacgcaagcatttactggaaagcacttgggtcatatcatatgcacaaccaaaggagctttgggtgtggcaccatggaagaattggatcagatttacaaatataaacatagtagtatgaaactgtcctaatacaaatagtatggtatgcttgtgcattctgtctccatccttttctatttccttctaagttatttatttaataggatgttaaatatcttttggggtttaaagagtatcttcaatgctgccctctggtttaccttttctctctctctctctctctctctctctctctctctctctctctctctctctctctctctctctctctctctctccctctctctccctccctcccccctctggcaccatacgcacattcatgacaaagtgttttaaaaccttggcaaacacttcagaaataggagatgagatcaaggaagcagt

SEQ ID NO: 22392 - DNA, 1330 bp, Mus musculus
atctttggttcttaggtcattgtcatgaagaggtcccttggcgttggctacgctgccgtggacaatccgatcttctacaaacctaacacagctatgcttctgggggacgccaagaagacatgtgacgctctgcaggccaaagttcgggaatcctatcagaagtgaagattgaagatccagccgatgccttcggttgcaggaacagagaaaggaggcgttcatagatgagcaaagctctcaagacccaaagaagcctcacaaaacaatggagattttcaagatcagcaccccatgcttctcaaaaagcattggaaattctcatcgcctacctatgtactgtcgccattgcccaaaaagcaagagtattttgtccacagtgaaaaagcagcctcactttagatgcaaccccactggattcttaaaattccctttcagtagctagaaatcagttcagaagttgaatgttcgagatttcaggatatgggttggtctgaaaaatattacacaatatgatcattgtagacacctgcatttagtgcctttttttcttttttcttttcaccagatgtgactaatttgaaacctttatcaactcctgacctgttctcttgcatcttagccatactccggattgatcatgccaaatctgcagcaggttatcagccttcactatagactctagattccaaagatctattttctcacttctattttaatatgtaaaaggtctagatagtttaagtaataacttaaacataataagttgtatttttgaaagtcccattgccaattggtctctttaactgcaatcaactaagtgttcttgaatggactgtattaagtgcgcttgaatggaatgcaaccatctgagtaataaatgagttcataaaagtgatgtagcttcgtctctgatgacaaagagctaacattaaatggttccactcattaacactggaggaagacctactactttgtaataggtcgagttaatctctcttcattgtttagaagatggaattacttttcaaagccactgtaatttgtgaggtcgtatataatttgatgacactgaaacataatagcagtacttttagccatatcttcagtgaacagtgaaaaaaggaacatctttcatagaagtttagattttctttgtgactttacctcttacatcaaaagctctttagtagagatgaatgtggctcattattaggattctgtctctctgtgcactcggtttggtaccaagtctcccaaagcagttattaacccatacaaggcttggggctagggcttaattggtcaagtgcttgccttatgtgaggtcctg

SEQ ID NO: 22393 - DNA, 1150 bp, Mus musculus
gacctgtagagaataataactataaacaaagttttcggtcaaatttagagttatttgcaaaatattctttgctatcaagaagggaattagttggagccaacaaaccccatagcaaagccagagaaacacagagctcttggactttgaagctgaggagaagggtgaccctagaggaagaccagcagtctcaactaaccactgagtaaccaccaactaaccaccaaccaggcagcatacaccagctgatatgaggccccaacacaaatacagcagaggactgctgggtctgggttcagtcagggatgatgcacccctaaccctcaagagactggagaccccggggattggggaggtctggtgggaaaaattaaatcatctttgtatatccacgtggcagattgccataaagccccttaaataagattttagaggcagaatctttcaggattaaaaagacaagactatgtaatattataaaacttaagtgaaagttaggtacagcatatcagcctgccttcctgtaatcctagcacagggggacgaaagcagggaggaccaagggttccagtcccaaatgcaaggccagccagggcagggtaggaggagcctgtctcccatcacagaaagacagaaggattctgcgttgaaaaatacagtaagatcagactagcaaatacacagtactacacaaacaaagagaatgggggggaaatatcctaaactaaatattatgcgttactctccagatggagaacagtattagaagagttttaccctttgagcatttcctaactccttgaagttggatatctttaaggcagtcttagaaatttcctctaaaaatcctcatatttctgctgaaaaagatgaaaaccaatagatttatttctgctgcaagcacatccgcgtctccgggtcattgcccttctcttaagcacgtgcatttcttaccacacacatgatgtacgacaggattgcaccagaggagccgatgagcgcgcccacgatggtcagcaggttgttgttgagcaggaagccctcggcacacagagcccagcccgagtagctgtttagcacggtgatgacgacaggcatgtcagcaccaccaatagcagccgtcaaagtcacaccctagccagaaaaaaaaaaa

SEQ ID NO: 22394 - DNA, 1168 bp, Mus musculus
ctggcaagttagaaggggattttgttttgcatgttttgtcagttcaggtgttagttcctactttaattgttttaataatctgttttattttatatgtatggatgttttgtgaacaagtagtatatgtggaccacatgcatgcctggtgcctgcagaggtcagaggaaggcattggacccccaagaacaagagttacacacaggtggttatgagctgccatgtgggtgctgggaactaaacccacatcctccgagacagcaacaagtgctcttaaccactgaacttttgtctgccaactcccagatgttctctctcaagactctgtctggccacactttctatacttacttccacatctgaatgttccttttatcatgggattatgagaagagaactttaattttgcttgcagatattgtatcgtagaagtactttgagcacctatacagtttgttacttagcaggtactccgtatgcggtttgatttgagattcagtcttcctgtgtagtctagactgacctggaactactgatccaatcagtctagtctggatttactggtgtgtctgtctgtctgtctgcctgcctctctctctctctcttttaatgtatgtgggtacactgtcgctgtcttctgacacatcagaagagtgcattggatcccattacagatgtttgtgagacaccttggtgtgtctcttgaaaggctagggggtacagtcttaccagaaagaacaattccgtcacaggaaagtttgaccttgtgtgctattttttatactcactgactctagaacttatagtctttcataaactgcttctctattttacttattatttctaatttgagtttacttggaaaaggataaatctcatcaagcaatgtagtacttgagcataacagataaactttagcatgctttggatagtattccatgtgatgagagcaagaaggatgttattctagcctgttataattttgcataattctatcaagactcctggcattaattacaaggttagcagctgccaaaaattgaatatttcagtgggaaaaatagtattttaagactacggatactatcaagattggttagaaattgcataaagcagccagaaagtctcctgccatgtacgttatgatgtaattttatacttaaacatttca

SEQ ID NO: 22395 - DNA, 1212 bp, Mus musculus
gttttgtctgagtttctatcctggtgggaggtactgataaagtctatgaggacaaaagatatgttaggatagcaattatggatggagtagtttagcttaggtgataaagttgggccttggtgcaagtggtatttgtgttgagatgtgagttctgatgaagagtttgtgatatgataagcaaggagacgacaagctagacagagagagcagggcaaagttcctgagatgagaaacaccttctttcaagagcaatctctacaaagccagtgtgattaaaatgatcagaacaagggaattaggaagtgacatttggagaaagtggtgggctagcctgtgtggcctctgcaggctgtagtgtaggactattgatctaattctgtgtgcaaataactaggattaatgggctccagctaaagaatggatttaggggatgctgcagaaatctgcttttggtgggagtgcttttgttatagtttaatcagattctgtttctctatggaacaaagacatagaagtctatgctgctaccggtagcctgaattgtgcgtaccttatttgcatatttaaaaataaaaaaaaagatgaggatgaaagtaaccatcgttattaggtaaggtcttgaagagtctttgatttaagtaatcaataagaatgattaaagtaacaacagagatggcagtagagaagaaacccttactaactgtcttagttagggttttactgctgtgaacagacaccatgaccaaggcaagtcttataaaaacaacatttaattggggctggcttacaggttcaggccattatcatcaaggtgggagcatggcagtatccaggcaggcatggcgcaggaggagctgagagttctatgtcttcatccaaaggctgctagtggaagactgacctccaggcaactagggtgaggatcttatacccacacccacagtgacacacccattccaaccaggtcatacctattccaacaaggccacaccttcagatggtgccactccctggtccaaggatatacaaaccatcacactaacctaaagtggggttggaggaggatggagggaagagtttgggagaggggacaatctacaacttagtcacagaccaagtaggtctagtaggatgaggtcttaagatattagtacaaagacattgatggccattgtggatggattaatgccagtggaaaggcagaggagaaag

SEQ ID NO: 22396 - DNA, 1197 bp, Mus musculus
aagtacctctaactattacctccacaatcacttcaacaagacagaggatgtttaacctagtgagaggagccttttatgcccttaatagaactgaaccaagcgctactgaggactgctggctatgcctgtcctcaggtcctccttattatgaaggaattgccttcaatggagatttcaacagaaccaatagccatacttcctgctcttggggaacaggacaaaaactgaccctgactgaagtatccgggaggagtccaggtctctgtataggcaccccaccttccacccacaaacacctatgcggacaaattcaatcagtgtccaggacagaagctaattactatcttgtaccttccctggttggctggtggacttgcaatacaggacttactccctgtgtatcaactaaggtttttaattcatctcatgatttttgtgtcatgatccagctgttaccctgcgtatattatcaccctgcatccagtttagaagaaagctatgctggccggcggtcaaaaagaaccaattactttaaccctggctgtattcatgggaataggtatggcagtaggagtggggacgggagtgtcagctttgatagaaggaagacaaggaattcagtctttgagggatgctgtcaatgaagacctagcagcaatagagaagtccattgaccctttagaaaaatcttcgacttccctgtctgaggaagttttgcagaacaggagaggccttgatttgttgttcctaaaggaaggaggactgtgtgctgcccttaaagaagagtgctgcttctatgcagatcatacaggaatacttagagattttatgcagaaacagagagaaagattaaagcgaaggaaacaggaacgggatgctcaacggggtgtggtttgagtcacaaccatcttggataatttctttgatttctgctgtagccggaccagtccttatgatatgcttagctttagttttcggcccttgtataataaatagaggaatggctttcatccagagtagaattgatacagtaaaactcatggttcttcaaaggcaatatcaacctatatttcaggtagataaagagttaggggacaccaatctctaaaattctatgattagaattagtctaaacagaagaagagggaaatgaaaggaaattaaacaaataaaaagtttaaactaaaaacgtctggg

SEQ ID NO: 22397 - DNA, 1195 bp, Mus musculus
tctgctgtgtgattagaaggaccagccatatataccagagttaggaccctggtcttaggcaactggccacaatggatcttctttagccaagactcaatgtggctaggcttcgtaccttccacattttcactgaggaactggagcaattggtcagttgcctcctttcaactccagttgccctgccttttggacacctgaagactacaactcaggcatggtttgtggggcttaacaagtcagcctcacaatgccagtgagccccaggcacgtgagcgcacgagggctgtgccgttgagggttctgtgggagcagccctgtccaggaactgctgctaccagctcaccacaggctctgtttgaacaacatcatcccagtttccaggtgagggaacggaggtgtagagagaagaggtgatggagccgaggatacgcccagaacctgtcctttctgggctctccctgcctttccttctaggcctagaagaggaggagatggggggtgggggggagttccaggccaggaactttgagaaccacagacaaggcatcatgagatcaggacatctaaacagggctgagcacatgacccagaaaatctgctctgagtaccatggtccttcagccaggttcagtcagctcctgactagtctctggggagcgctgtgggggaggggctccttggggctgtgtgagttttactgctcagctcactgatgtcttgcttagtggagagctcaattctgtatgccctgggttcacagtagtgtggtggtcaggaggggaggccttggagtggcctcctaatggctctcctaatgaatggcttagctgggaactgacaagctgaacagttcaactgcatttaagtccaccaagcacttcttttcatctctggttagaaatgacacttgaactatgcttccggctctagggaggaatattttacatactatgaaaattataggtgaatgaatgcaggaggagaaagagacttattaagcacctactgtgtgccagccttcacactcaactcttggcattctctggccttaccctcacaccactctgtcaaatcattgattataattcccatttgtcagatgaggaaaataaaggtcagagaagcactgtgttgtccaaagagaaaaatgtagttgagctgctggttccatggccagtttttgttttgttttgtt

SEQ ID NO: 22398 - DNA, 1157 bp, Mus musculus
ggtgagaccctctcaaaataaattaaaaaaataaataaaataaaaaggtcagtcccaaaggagaataaagctttcttaggcacaaaagtgacccgccagaatctattctagttatacatggtataatacacatgtggatcctgaaatttaaaatggcacaccatttactgtcacatagaaaagaaaattggtgtgagtgtaataaaacacacacatgatttataatctaagaactaaataaaaggcctgagtaagaagagagactggaacaaagtcatgggttctccttgaactgtcacagtgcattgcaattgaagttttggcaatgaactcagcctcagtatacctgcctagtacacacgaggtcagttcctagcaccaaaaatcaaaataaaaagaaaagaaaacagaattttttttgtaggtgtcaacaaaattccaagtatatgtcaaaagaagaaaggcaagggagctgaggcacttgggttttgaaagatgtgtgacaggaatcagtacggtgtcggaagcacagcttccaagctgctctgacattgctggaagattctagcccaggtggaaccctgagttccagggcagccagggctacatagagaaaccccgttgtaaacaacaaacaaaacattacacccaagcggctagagatggccactggctgagaacattggttgtgctaccagaggatcagggttcaagtcccggtgcccacgtcatgactgaagtgtcccacgggatccagtgtcgtcttctgttctccatgggtaccagacacacacgtggtacacagaaatagaggaataaacgtccatacacacaaaataaataacttttaaaaatagaatcatacctaactcaaaaatcagctcaaactgaaccatttaaatatgcaacatgcatcaaacccacctcagagggaaaacaatgagaatctgaatatgaatatgcgacatgcatcaaacccacctcagagggaaaacaatgagaatctgaaatctagggttaggggaaaaaagagttctgggatttgacaccaaaagctcaagaagagcaaaaaattacaacttcatcaaaaattaaaaacaaaaccaaaccaaatcaaacaactcccccaaaactttcaagtcttaaatatataccta

SEQ ID NO: 22399 - DNA, 1156 bp, Mus musculus
agcttcatgatgcagaagaatatagccaactctatatgaaaaataaatattcaaaacgttcctgttataatttactccgaagggatgtgctggtaaatcagtgacagaacataggctcagtacccctaaggtacacactcacattgtatttgtctttgtattctataccatagacaggttctcagccaatggggttgctactcttttggggatcacatatcagatgtttacatacgattcataacagtagaaaaattagttatgaagtagcaatgaaataattttatgattagggggtcgccacaccacgaggaactatattaaaaagtcacagcattagggaaggtactaaatatctgagaaactcctgcctgagaggtattgccacacttgtggaatcaagttaactaaatagaatggcttataaaatgtttgtaagcgagttctggcagtaagcaggctggtgtgggctgatcacatttcactcccccctctttccaggggagcagggatcggtgggcttggcataactgtggaggggccgtcggagtcaaagataaactgcagagacaacaaggatggcagctgcagtgctgagtacattcctttcgctccaggggattatgacgtcaatatcacgtacggaggcgtccacatccctggtgagctacccccttgggcagtgcttcaaagaataagtgatagcgcatgaaaacagattaaagatggttttgcccatcttcctttaatagaacagtgtgactttggagaaaccttaaataaggaccacagcaccaagaacactataaatctcattcgaacccagcaacatggtagaaagcgttgacttgggccttcagctagaaagagcggctcgtgtgacttagtttctgatttaagcaaaagtttactctttacaatattgaaaatctctgtttttaaagtttttattgttgttgttattattattaatatatatttgtggttgtaggagcttagttatggcatgtacacgtaggtatccatagaagccaaaggattttgaatctgctgaaattggagttacaacagttctgagccaccctatatgggtgccagaaattgaacccaggttatcaataggagcaataaatgcttttactcactaatccattcc

SEQ ID NO: 22400 - DNA, 1204 bp, Mus musculus
tccactgccagtctgtgtcagtgcctaacaactggttgagggcatgtgtagtgagagctggggacctccttctggcttttcagagctgtgtctcctccccctggctttgcagggatctttttcttgggctgctggtgcctgttggcctcagctcttgttctgtcgtttggagctgtcccctcaaccagatgcacactacttcctcttcccactgtgtgagcagctttcttagcattccctgtcgcgcccttctgcacattttgaccagtgtggtttcccttcataacttgttatactgcttaaaagtgagagacaggccaactggctggctgttgtttggggaggggttgcaaagctaaacatggttgatccagacactcctttgagcagcacccttgccagtgctttgagatgcccctctgcctggcaaacatagacagcacaacatagtatggcctgttctgaggtaaatatccacagccaatgcctctggtcttttttacaggtcctggtattgcccccactgtgaaaactggcgaggaggtgggctttgtagtggacgctaagactgcagggaaggggaaagtaacctgcgtgattctgaccccagatggcaccgaggctgaggctgacgtcattgaaaatgaagatggcacctatgacattttctacactgctgccaagccaggcacctatgttatctatgtgcgctttggtggcgttgatattcccaatagccccttcacagtcatggtaagcagggttccttctcctgagccggctcttactagcagaagcagtcacaaccgtcatttgttgaacccttatttggccatcttccctcacacccttgatcctaggtatataatcgctagaagcagcaattttgggggaaatctcttgagtcatggaggcatctggcatgccaaggaagttaggcaatatcctcctgtaagccagctcagagggagacagtttcacaggaacattggaaaacagtactaaagatacatgtgcctcttttcccatccccactgctggagaagggggatcctcatgctcttgtctacacacttgactgatatctcaggatgcacagagcctccagccgtgtttgcatgagattcagaagggggaagtgtgttgtcttttatagccagaaagatctggaatagaagggaactattgtgtgaacatcccaggt

SEQ ID NO: 22401 - DNA, 1132 bp, Mus musculus
gtgcggttttcccccacgttcaaagagcaagatggacggctattggcaggcctcctcctgactccaagccaccacttgtgcatctggtttctgtctagggcaaagccacccgctaccactctgtgccacttaaaacacaccttcttttctaggccacaagcaactaaacctctccaggtgtggagcctcttgggactcagtcattgctctctgccgcctccattttcctgtgggcgacattgggaattctacaagcaccctgttgaccaagtgttttctagcaaatgatcagtggaacttctcagggccgtccaactctctccaggcccagtcacacaaagccccataaatactcgtggccacacccccaaatttaggcctcattgccttgtagagttcccagtggttccgcccccccatagctcccccagcccacactgctgtccggttaccaagtgaacgctctcgtgtttttaggttacagaagaggcctatgtccctgtgagtgacatgaacgggctaggcttcaagccctttgacttggtgattccatttgccgtcaggaaaggagaaattacaggtaaacccttgtggggctcaccttactctttatttgttgttgcatctgaggcccagagcagtgcttgggcggtgactactgtcccttatttccccagccagacaccagaaagtgtttctctgaagaggtggttgtttatagcttgcattacattgctgaggaagcttgtgtttctcctcaggctaggaacttctttgtttagatacctcttgctgccaggtttctgtttctttttccatgctttctctaaccactcactttccaacctgtctgtcactcagatctgtggtatcagttcccttctgggagcccagcctcccttctcctgcttctcttactgctttgtggtcttctcagaccctctttgcacttgtaattggcctgttagagataccatgtatttatttatgagctaattgcttgctgcattttgtggaaaccaggtggaagccatagaaagccaggcagtctcagttttcctggggggaggggggggcacttggacacttcaggcagcatgagtgttctgggatctgaggacctctggtgaag

SEQ ID NO: 22402 - DNA, 1145 bp, Mus musculus
cctctttctgtttctctccaacagacacacacacacacacacacacacacacacacacacacacacacacggcatctgatagaaagcatgtggtgttggtcttcctgagtcagcttgacttcagttaatatgataatttccattcatttgttttcttgcagatatcctgatttaaatatcctgatttaactttttaaatattatttcattctatatacatagcccattgaattgagttgtgtacagaaagatatttagtttagttcttctgcatgtcaaagattcctctaaaagtgttcacagggatttgtagctcagattccttccagctccttgtctccccctgaaccagtcataaccacccattgtcctgccgtggtcattatatactcattgtcagaggcacatgatcttcatacacctgtgggtaaaagattcttgacgtcacatctccaagtgccatgtagaccatgttctctagacagcccagcgagcacatgtaataggagctctgttgctttttctcagatgataacagacgctgctcccaagtgaagctgggctcagctgctgacttccttctggacatcagtgagacagaccttagcacactgacagccagtatcaaggccccatctggacgtgacgagccctgtctgctaaagaggctacccaacaaccacattggtgagctttggccagcatggtggggtgtgggagggggagcagagactccttaggaagtgggtgatccgttggaggttgctacagtaaacctgtatcacacgcacgcttccctatcagtgttaacatctgtggacgttggattgttgcaacataagacagtcctgtttccaattttgagaataagctgtattagtcacttttcccactgctgtgacaaactaccctgcaaatgcagcttaagaacggagaggtgtattttgactcatagttcagtgatacaacccatcatgatggaaatttttatgtgacagagagcaaaacagatgaatgctgttgctctgcttgacttaatctttattcagtctggaaccccagccccggagagagcccaacattgaggctggctctccccacctcagttaacctaatctagaaaggccacccatcacagacatgca

SEQ ID NO: 22403 - DNA, 1981 bp, Mus musculus
ctggcatgtgagcccaaatcaggttgtctctactgatcatggccacgatttgccaccagtgaaaggactctggtgccatcatcccagctcggccagttatccctcatctctctacctttgtcacatctctgcttgtcctgattggtcaggtcagtaacaacctcctcttcccgcagggtccaacatgctgttgattggggtccatgggcccaccaccccctgtgaagaggtctccatgaagcatgtgggcaagcaacagtacaacgtcacctacgtcgtcaaggagaggggcgattacgttctggctgtgaagtggggggaagagcacatccccggtagcccctttcatgtcaccgtgccttaaagcatctgatagccaatgctggacgtgtcccttccggttgcttttgttgctagtttgtaattcattttttacaatgtccacagcctgctggtgggccagcgtccccatcccaaaccttgccgctcactccaagtgccttggtgccctagacttgactcgaggtcatgtgggacatcttcagaaagcaagctggggccaaaaaagtgcagagccctctgcccaaatcaagactcttaatttcaaaggtcattgcagacggaacaagaacatggacaggactgactggctctcctaagcttctggtctactcaagcgataaccaaacaagaatgtcattgcagaagggggtcctgcaccccacttgccaaagaacagtgcaacccactttcctcaagactagacaacaaataagaaagtctgacccagattatactccatgcctgggcttcgtcttggggccctgatcactttgacttcatcctaaagccagctctggagcagaaggcatgcagaacactccataccccatttttggaattctgtacctgcctacttctttattaacagccttgaaggcatgtgctcatggccaaatgcagggcctctgccagctgcccccagagttcattgcggctgctaaatggcagagaccactgataaattatttcaggacctcctccttgcaaaagctggaagggatgggtacccctcttatgacccatgagaggccttaatgaccaagacactagcacgtgcacccacctgaggtctctaaaggttttggtgtaagcattgtcaggctgtcaaatggctggagcgagtgttacacacacacacacacacacacacacacacacacacacacacacacacaatggggtgtggtggttctcatgaatgtggcaggggtggagtaggtgtcccgcaccaaggcacagcagctggagaggtgtgggtgctaaaagccacctgttaggacctggagcagctgaagccggatgtgaaaggcggaatagacacggagaccgaactggaatcaaatgccgactataaagtgtatcttataacttattaaataaaatgtttgctccataaacgctccctgtcattcttggagtggaatcagtggtgtgggcctctgatcactccccacccaccatctctttgagtgcagatgttatttaacaatgggccagtccttttcttgcaaagggtggtccttttctgagaagccagggccaacctcaggcaagggactcaagagaacatgcgggccatgataccatcgtgacttcttaggaaccctagatatggagcccaggtagaggcaatggcttttaattaagcaggcctcttgcctgataccatcaggaatctgtgttctgggaaatgttctcagataggatctctcacatgcccctgcacccttcgacccagtactgagtgcctccacctgccctcccgaggagaaacgattgctgatgttaaccctccagctatgaatccttatagtggtcgggtgacggtttacatatgacagaacaaacatgggtacagtttccaccaggcatacagcccagacctcatatggggatagagttgggcatataccttctg

SEQ ID NO: 22404 - DNA, 1123 bp, Mus musculus
gaaatttaggctgcttcaggagaccatgtttatgactgtgtccatgattgatcggttcatgcagaacagttgtgtgcccaagaaggtgctgcagctggtcggtgtaactgccatgtttatcgcaagcaaatatgagatgtaccctccagaaataggtgacttcgcctttgtgactaacaacacctagctaagcaccagatcagacagatggagatgaagattctcagagttctgaacttcagcctgggtcaccctctgcctctgcacttcctccgcagagcatctaaagtcggagaggttgacgtcgagcagcacactttggccaaatacctcatggagctctccatgctggactacgacatggtgcattttgctccttctcaaattgcagctggggctttctgcttagcgctgaaaattcttgacaacggtgaatggacaccaactctgcagcactacctatcctacacggaagactccctgcttcctgttatgtagcacctggctaagaatgtagtcatggtgaactgtggccttacaaagcacatgactgtcaagaacaagtatgcagcatctaagcatgctaagatcagcacgctggcacggctgaactgtacactagttcagaatttgtctaaggccgtgacaaaggcataactccaatggactgctacatctgcagatgcagttggcaccatgtgccgcctgtacataggatacgtaccgtgtttacttgctcttcaataaaggttgtgacttctcattttacatagcttaactcatttgaatgttgttgcttccgagtttaggctaatggaagttgtcgaatttaggagtatattaaaaacttcatctagttttaacagtggatccaactaatgtatatatctgtagcctatatgtctatatacatccttcactgtgtgtccttatatcatcatgtcttctgcctcactctagtttaaactctaaatctaccagctagtcctttgttccattttccagtggttgccacctttaaccactgtctcttgggttgtcaactttcagatctgaaaccaagtatcttttttatgtaattatttatttgttcctaattggaaaataggatgttcaaaattaa

SEQ ID NO: 22405 - DNA, 1324 bp, Mus musculus
tcatggaggccagaaaaaggtgttggataccataggactagagttactacaggaagtgtgagctgccatacgggtgctgagaatcaaacctgggtcctctgtaaaagcaaccaatgtccttaaccctgagtcatctcttcagccccctatttactttatatccttcattgtggagctggccctttgggtccctggcatttcttctcaaacttagagtgcttgagtgaatccagtagtttctactgtggtccttctttccagcctaacctttgcctgcatagagaaagctctttagagaggtggtgaccccaccctgactcccttctgggattgcacttacggaattctgggccacaccaatggctaatgtcttggtggtttccccttgtccacaggtgaagaggatccacgtgtggaagaagacgaggaagtgctgactctgttgtatgacccatgtctcaactgctactttgaccctcagactggcaaatactacgagttggtctagctccttcatcgtaacagcagcgtgaagtccacaatgggcaccgtgactgggtgttgggcatgggggcccatggagtcaaaaggaatggagagaagggctttgtaaatagcatttaatgttaagaacatctgcattctctttgtagctgagtgcgtggctttgaaagttgtggaggaattaatacagacaccagattttaggctttgaatttgttcttagttgttcattccagtcctctaagtctcatttcgtatacattatataagcaaattaagaattactcattcaaatttttccagtgttaatcgataataaatgatggcttgatacactacagaaagtgtattcttgtttaaaagatgtctgaaacctttttatggcgtgtttgtattaaaaataaagtatagaggccaagagagtgcttccttttgttcaccctgttgtccttaccacattattcctaggcaagttgccattgctttaactccttggaaccgtgagctgctcagacttatggatcaggtttgtgggcgtgacctcactatgtgctttcagttctcgctcctccagagctggccaagttcacagccttgttaatcattaagctgctttgcactgtaattttcttttactcctcctaacttttaccactgatctttgaatcttaacagtctcactccatggatccagatttaacaaggagttgccatcttaacacccttccattcctcactgcttctgtgacccatggctagagagagccaggtggcttcctttgatctttaaggtacatcagagcagttctgctcttatcac

SEQ ID NO: 22406 - DNA, 1152 bp, Mus musculus
gagaaaagccagttgaggtggtatgcacttgtaataccaacacagatgaagcagacagtgaggatcagtgatgtctgaaagtcagccagcacatggtaatcagtgcatcctgtatcccacaagagactctatctcataaaccaaggtagacagctgagaaaaacacccaggcttgacctctggcctctacatgcatgtacacacacacacacacacacacacacacacaaatgttcaatatcattagtcacagggaattcaaataaaatcatagcaagtgtttcccattgaagctggctgaaatgttaagttctagtgacctcaaaaagatgaaaatgtagaaaccctgcactaactttaaagagatgtttctgtcagcttagtgaatcagtgatcccattgctagttatgtaccaaggagacatgagttcttgctcaccagaaggtaccgcaggcatgtccaaaaggcttgagttatcaaaactcaaaactgttgatgacaagtagccttggtttctgttgcttctgttcttgcccttgcctttcgccatctggttgtctctggtgttagctggtcttgctgtctctgaatgtggcttgtccctcctgcaagcctctctgtcaatactcgtgggagaccagctttctccgggaggaatttaggtatgaagaactgtggtacagggtcagctctgggatgaagatagaaaccagaaggatcctgtctccagctgatctttggttcctgtgtcctgatggctctggaagggtccctcttgggtcaagaatttgaaaagatgtggtgatcttacctgcactcacaggcttgtctgcactccttggaggccagctctcttcaggcgctatttgggtatggagctctgtggcagaggatcggctccaggcacagacagaaaccgaaggctcctgtcccaggccactcctctgttcctgtgtcctgaggattctgggcaggttcctgaagctggaagcaacccagatgtccctcaatagaggaatggatacagaaaatgtggtacatttacacaatagaatactactcagctattaaaaacaatgacttcatgaaattcacaggcaaatagatggaatttgagaatatcatcctgagtgaggtgactcttttacaaa

SEQ ID NO: 22407 - DNA, 1429 bp, Mus musculus
tgccccataaggctgtgcagtgaagacagtaaccctctgtcgaggcagagaaaagaggtgtaggtactgtggccagaggggtctcagagcacagaggaaaaatgtttcaaaaacccagaaaagggatcatttggaaatgcaaaagaaaatggagatgcttagagtggattggatttcctcctcagagggagaggcatcctgtcacctcacacggtaccagagctccacctgctgtacgagaaaggcaaagaggcagagctggggctgtgaagggctttccccaccccacaattagcagttgatatttttgatcttatgtttctttactcaaaccaagttgttgactttccttattctttcactccactcatcccttgtcttcctgctaatttcagtttgaaagatttatgttatcatttcaaaagttggcaattcaaagaaaacatgattggaaagtatatttgctggtttgttgatgtgtctagaaatacatatacataaagtgcagtttagatgcttggtatacctgcataaacatagcatgcctgtattaaacatagcatgcctgtatgaaacatgggatgcctgtattaaaggtgtgtagcaaagagtggagaagagagaggctgtattgccgctgaggagaacagctctggctttaaatacttgtgttctctgacattaatttgattgcctccgtgggaaagttatttaactttctttgtgagctacagtttctccaataaaaaaaaaaatcttaggataatgacactggcttttttctgcctcatagaattcttatcagatagaagctcaggtaatgcccaagttatccagccaccacactccagcctcagccatctgtaatgaagctcagaaccagaaaagggctgcatgcatgagaaaggctaagcccaatgtcttacacttggctataaattaaacctatgagctacagtactgccacaacataaagctgggatgtaaagtaagcacagtgagctgtttttgtgtgcacttgggtgtgtccatgtgtcttctctctatagttacatagagtttttaaaaggaaggcagaagagtacaatatgagtatacttgaaaattcatcacacacataactggagaaggtgcccagaacttggggtaatcaagttgagattttagtctgccacagtactgtataaagcctttagcaaatgtactctgaatcatagttagaatgttctttaaaaaaatcttttatgtttgtgtacatgtatatctgtctgtgtatgtatgccatgtgtggccaatccctagatctggagttaaagtgggatgtattttattcaatgtaggtgccaggaaccaaatgtagtttctctgagtgagcagccaaagcacttcactgctgagcaatctctctgtcccagaaagctctttttat

SEQ ID NO: 22408 - DNA, 1706 bp, Mus musculus
atgtctggcttctaaaagtttaggtcagacttgcatcagtacagaggttgcacctctcgactttagaccttgtgtcttagttagggttttactgctgtgaagagacaccatgaccatgccaactctttcaaaggaaaacatttaattgatgctggcttacagttcagaggttctgtccattatcatcatgaccagaagcatggcagcctgcatgctggagaaggagcctagagttctccatctgaatgaccggcaacaggaagtaaatgccattttgtgcatggcttgcacttctgaaatctcaaagcccaccctgcagtgacatacttcctacaacaaagctgcaccttctccaacaaggccacaccttctaatagtgccactccctatggccaagcattcaagccatacctattcaaaccactacacccaagaacagagcccccagtgaccagcattttaaagacattttcttacctcttatctgaagttcaagtgtagaggaggccacttgtaatttatttagtataatgccatatttctacctttgtgggaagctttttaggaacaagactaactcctgaagcaaggcagatgggaatcaattgctgtaagattgtgaagcaaggcagatgcaggcaatcaattgccgtaagattcgatgagctgttgctaggagctgactcttgcttcctaatccctctccctgtccctgctctccctcgtgcgttcttgcccagtttctgcctcttccttaccttctgtgtctttccatcccttttactcttcattgccgtgtgctttctcctttctgtgtggtcatttactggatcctcttgcctgtcctcctccctcctgtctactcttgggaggaaacttactcaaggggacaacattaccatttgagggcccaacaagatgctaaaggacatgtctaccaccctggatgctaacctcagacattttaagcctccaaagaagagaatccaggctctgagacctctctctcctttactccctcagcacgaaatcaactttatgttcaccagctctcaagcctattgtgctcaaccccaacacacacacatacatttcagtccaaacaatgagtgtattgctatgtactgggcgatgggtagcactgtcacttggggaggagggactctcatgtgtagctcttgctaattcctgtggtgtaaattctcccaccacagctgactgcaaactgttagccggatatcagccatgaggacctggatgaagatacttacatggagtctcataagtcagtcaggcctgtctctagaccacagttaaggaagggtcctcatttgcaccgtgattccatcagtacacatttgaggttagccatcagtgtgtgcattgctgtaatttaaaacagcagatgactgttcacactccaacagactcaactaccgtggaaatcattaacagcagcagtatatgataattgtcacagcactaccttttagtctgattaagtacaagccaatcgcaaacactgccaaaaatatttaaacctttcactaatttgcaaactgttactctctttcatgtgtctgagctcagtcaaaataccacttaaattgacataactttttgaaatataaatgtcataagatttttattaatattcagttaaaagtataatatcactgttaccttatttcttgtatttacatttc

SEQ ID NO: 22409 - DNA, 1099 bp, Mus musculus
agccttccagtcaaggatacaagaagagggtttggaatctccctccacggctaagaaacgctgccaaggtcaggcatgtgtcaagagagtgcttgtatgagggcacagagaggcccttgagtgaagcttgaaggtgaagtctgggctgccaagatgttagagatgccagaatcatgggatacttgcttaggaaagctgcagacctggtgtggaaacagcccacgattgagaaatgtgttgcactcaacaaagctgaaagaagttggagctatgaagagcactttgatgtcagacatggagatgcagagcttcgagtttatccagctagttttcagtctttggtctagtatttccttgtctgctccctttactcccttttggaatggtaatatttatttgccattataagttagaagtatgtgacttgctttttaattttgattttacaagaaaagattttgatcttttgacttttaaacagttttgtgactgtgatagactaaatgcattttgcattatgatatgactccaaccctttgatggtcagggagtgggatgtaatggtgtgaacaagaatggcctccataggctcagacatttcaatgcttgagagggattaggaggtgtgacctttctgggataggcagagccttgctggaggaagtatgccactgggatgggctctgaggcttccaaaaccccagctagtcctaagtacctttcttcctgcttccttcaggtctggatgtagtactctcaactacttctctagcaccgtgtctgactgagtactgccatgcttcctaccataatgataatggactaaacctctgaaaactaagagtttccatggccacagcatcccttcacagcaatagaaaacaggctaagacagctagtgtccatcagggtagggaagggcaagcatggcagcagaggccagaagccagatggtcacatcatctgcatgtgggaagcagagaaagcacagaaaatagtgcattctaaactttgactgtacagagcataggctaccctgattaatcctggaactttgtatatcactgaggtagccttaggattccaggcaacagaaata

SEQ ID NO: 22410 - DNA, 1198 bp, Mus musculus
tgcctaaacttattaagacagacaatgggccatcttattccagtaaaaactttatttcattctgtaaagaattcggtattaaacataaaactggaattccttacaaccccatgggacaaggaatagttgaacgtgctcatcgcaccttaaagaattggctttttaagacaaaagagggtcagctatatcccccaaggtcaccaaaggcccaccttgccttcactttatttgtcctaaatttcttgcacaccgatatcaagggccagtctgcagcggatcgccactggcatccagttacttctaattcttatgcattggtaaaatggaaggaccccctgactaatgaatggaagggtccagatccagttctaatttggggtaggggctcagtttgtgttttttcacgagatgaagatggagcgcggtggctgccagagagattaattcgtcagatgaacacagattctgactcttctggtaagtatcattctaaagactaaaattccttttgtgcttaaaattcagctgagagcaacagctctcaaagctgtttgtgtctccagctactctctgaaccagctcccgacaggaggccggagactagcctcagctttacaatttgcatttaaataaagtacctagacttccccgaaagaagttctgctttcctactttctcactgtctttcaagattttgtctttcaagcaggtaaatcaacattcccgaggcggaccagcggatgtgcatccccgcccccctagagcacacaggcggcagctgttacccccagtctcaggacatttccagcatgtggctttcagtctgagttaaaaatttaggtttacctagagggctagaagagtagatatttccatattaataaagattggtttttattttgatagacaggcttagccccttagctgacctctggcttttcacccttgctgttactgcaaggtgtccttagctcaataggctgtggaaaaaacagggatgaggaggaacgacttccagctcctattttagccacaaatcgtggtgttactaacgacataattcttgcttaggctttgctaattctgaggttgataattctcctttaggagctgcacagcactcagaactgtgcatactggtttgtgattgtacaaattcagtatgggcaccgcttggtgcagagatacttactgcaag

SEQ ID NO: 22411 - DNA, 1824 bp, Mus musculus
gaagtatgttggaatttttgtggaaattatattgaatatgtagattgacttgtcatagaggtctttcacttgctaggttagagttaccctcaagatattttacagtgcccactggctgctccgaaaagccatctttgcattgttcctgggtcgtgctccgcgctcgctgcagccaccttcgccgcccaccgcctcctccagcgcggactccggcagctctctcgccagagtcctcgaactcgactttaattccctcactcgcggcatcggaccaccggcgtgccccaccatgtcagacgcggcagtggataccagctccgagatcacctgaccaaggacttgaaggagaagaaggaagttgtggaggaggcagagaatggaagagatgcacctgccaatgagaacgctcaaaatgaggaaaatggggagcaggaggctgacaatgaggtagatgaagaagaggaagaaggtggggaggaagaggaggaggaggaagaaggtgacggtgaggaggaggatggagatgaagatgaggaagctgaggctcctacgggcaagcgggtagctgaggatgatgaggatgacgatgtggacaccaagaagcagaagaccgaggaggatgactagacagcaaaaggaaaaataaccttacgcaccgtgacctattcaccctccacttcccgtctcagaatttaaacgtggtcaccttcgagtagagaagcaggccccgcccgcccacagcgggcaatgccacccacagatatgacatgcgctctccaccacccctccaaaactacaacatgaattggcaacatgggaggaaaaaagaaccagaacttcccaggccctactttttttcttaaaaatactttaaaaggaaaatttgtttgtattttttatttacattttatatttttgtacatattgttaggggtcagccatttttaatgataacgggtgaccaaaccagccttcagagcgttttctgtcctacttcagactttacttgtggtgtgaccatgttcattataatctcaaaggagaaaaaaaaaaaccttgtaaaaaaaaaagcaaaaacaacaacaaaaaaacaatcttattccgagcattccagtaacttttgtgtatgtacctagctgtactataagtagttggtttgtatgagatggttaaaaaggccaaagataaaaagatttttttttccttttctttctgtctatgaagttgctgtttatttttttttttggcctgtttgatgtatgtgtgaaacaatgtccaacaataaaccggaattttattttgctgagttgttctaacaaaaaaaaaaaaagatattttacagtgtttgtgactattatgaatgttattgcttttctgatttctttctcagactgtttgtcatttgtatgttgttgttttttttttaattaatcttgaatcaagccactttgctgaaggtatttatctatccctggtacaattttgatggttgctatgtatatgatcatattatctttgattagcaataatttgaatttttttcctttccaatttgtatccccttgatctcctttagttgtcttattgctttagctagaacttcaagtactgtattgaatagatatggagaggatggacagtctgtcttgtcccagataggtgaatgcttttagtttctcttcatttaatttgatgtcaacttgttgtaaattgcctttattatgttcatgtatgtcccttatattcctgatcctccaatacttttagcatgcaggggtgttgtatcttttcaagggcctcttcatcatctaatgagataataat

SEQ ID NO: 22412 - DNA, 1197 bp, Mus musculus
tagagaaaaactcaaggaatttgtgctgaaattgatctttgatgttcagataaggtgattataccagattagccaggattctcaacatactgaggaactggcttctccttgatgcttcattgtgcactgaagtctaataatctagaaaaaaaaatctgtctggtaatagctggaaatggtctagtctccatcttaggctttcctactatacactgggcctccttgtaagcaaattgcaacacccccccccccgcaaaggctcatttgtgatttacaattccttaatcagaacatgaagaaagagtatacacccaaaataatttctgaagttctgatttactgcttgcgtcatacagtgatagagagagccacaattttagtttcctactttcctttcaaattcacaaggaaggaaaatgtaggaagcaatggaaaacaataggaaagatattcagaacaaataatggcttggggaaaactaaaaaggtatgagaaatacttcaagactgtcccaggggtgccacctgtttctgtcatatggaatgcatggcactatttcaaatccttcaggatctgtagagcttttgcctctaagctaataaacttacaagatacatcatccggccagtccgctatcagcacatcccgcctcagactcttggcgataaggctttatctcccccctccccttccttctttataattcccagctaagctaatgaagcccttttggtgttgtgtgcattcaaatggctcatctgcatgaaaacctctgccccttaattatggaaaacagatattaaaaaataattccatgtcgctagttgggatcaaggtgctagggccaaatcctgacatttaagctcttttcgagcctcccttttgagctcagactcatctgctaaactaatgccactttgatgctttctggcgcttttgagctgctgtcctctcttcccccttacctacaagtggtggtgcatgctaggtggcactgagccaccacaccattcagtaggatatataagccttcaagttgggaatggaattgtaaggaaattggatatggcttggccatccactctcctttcctaagtgtctcatttcgccttgacaggtgtctgacatgagatactgtcagaaccagaattgaaccttggcacgccaccatccattaggatgtctctggataggaaa

SEQ ID NO: 22413 - DNA, 1109 bp, Mus musculus
ctgtaattagtgtgggacagaagttgctatatttcccatgtcactcactcactcagtcgggatactttcttttgctattatttttaggtggcagattgcagtgcgtattttaggacctgccacccactttgatttgaaagcttatgttgtcgggatgtttagctactgcaggtaaagacctaattttgctaaataacggacttcaggatcttgttaattatattacttttgcaactgaaggtgtttctctctaatttgttaagcaaataactaaattctataagagcaaagtgaaacttttcatgtttttggaatccattttctggtttagcatagtctttaatagctttacattaatagaaaagaagtatgggttgctgagcaaacatgaaggatgaaatattttggctctttgcagttagtagttgcctctgcctctgttactcttttcccccttacgttgcttctaggaatggatatgtgctcctttgaaggaagtgtagtgctctttttgcctgttctggaactatggcgtcagctcctaaagctcaagggcaggccgacttttctactgtgtgtgttcacagcaggggaatctctcacaggcatgttcaggagcagggtttttgtggatgcaagcaacagaatggaaggtagctttggaaggactcgataggtttgctacagaataaaggaaaggttggtgagggcaggagccagcatagcgggggaatgatgacttagtgcactagtcagggatctccagaggaacagctgctagaaggaatttgtatatattaaagggggatttattagagtggcttagagctgggtccagctagtccaactttgccgtctcccaacagagaggccgggaacctggtagttgttagtctatgaggctggatgtctcagtttatgttggaatcctaaaaaagtatgttctaatactagtgaaggaacaacctagctgccagatagatgaacctgtcaacaagagtaagaacaagcaggcaaaaagcaatagcttccttctttcatgtccttttatgtgagctgccatacaaggtgtggccccaattcttggtggccattctgacttcaaatga

SEQ ID NO: 22414 - DNA, 1143 bp, Mus musculus
tctaaagacagcgctgagaccctcactcctcagcatgactgactaaaacctgtgcaaagtgatttagtcacagctctgaagacccgaggctagcaatcaaggagtagtgggtcccctgagactcctttgctgctgtagcttttggtagccccttctttgtttccatgggcccattgactcctccttgttctttgcttgtcctccttagtgacacactcatgaggtcacatgtcatggtcacatcctgtgagagtaatcaagaatgcactccgagagcatccttggtatgctcatagattatagctgttaggatgtggattcatcatttggatggggatgggtagtgctgtgccacacactgccatcaccagcagagccagcaatcccgaatgccaggtgccgaacagaagatgaccggctctactgaagccttctggcacagacagtgtgtgctgcctgttttttttttttttttttttttttttaaatcaatgtgacacaaactagaaccatctgggaaggaaggacaaaacctcagttgaggaagctctcccaccaaattggcctgtaggcaagtctgtggggacattttcttgattaatgattggtgtgtttgagcctggctcattgtgaatgatgctactttgggcctatggtcttgggttgtataagaaagcaggctgagccaggccgtggtggtgcatgcctttaatcccagcacttgggaggcggaggcaaacggatttctgagttcgaggatagccagggatatacagagaaaccctgtcttgaaaaaaccaaaaaaacaaaaccaaaaaaaacccaaaaaacaaaacaaaacaaaacaaaacaaagaaaaaaagcaagcaagcaagcaagcaggctgagcaagccaataagcagctccctccacagtttctactttcaagtttccttttgagctcctgccctggcttttcttagtgctgggttacaaaaggctgacatcagtccttcacttccccttgcctcggcttcccttgatgatggactgactggactttataagcggacacaaactgtttcttgcccacagtgcttttaatcacggtgtttatgacaataatggaaacaaagtagcagagcaggcctcacctaggagag

SEQ ID NO: 22415 - DNA, 1099 bp, Mus musculus
ccagattggttgacatagaaacagcattcttcttcaggaacagtcaaagaccaccttctttagctgtcaggacatctatcccccattggttccgaagcaccacggctgccaaagaatcgatctgtttctggatagcaagcacagtttcagtcatttcttgaagatcacttttcaactgggaagtgaatgtattatattgggtcatggaagtcgttatccctgcaattccagtgccagcacctatggctatttccgtaatgaccaagagtggcaagacctgaactgccctcttatgctgggcagctatcatatctacaactgggattggcaggggctcatttccctggattactcccagttcagggaaaaggagtaccaacgtgcaaactcctgaccagctggtgggtaggggatgatatgcctgagtactacagagaatcgatgtgttctggactgcagggcattgtggcagagatgatatcgagggttatgcttctattgcagtctaggaagcacaacaatcctacaggatgtgtcctggatgtctgaaaacagtttgccacgtcaaagagtgggatagaggtaaggtatggagtcatggcaacatcggagtcagggtagttgacaaaaggtgaggttgggttacttggcagtatcactggagatgctgtaagtgacaattgcgagttaattccagggggtacacataaccagcaatctttaaagtgtccaggcctggtgacattaaggagttggtatgcggaggtcaaggtctgaagcaaaaggcgaagttagtgccatttatgaggggtgatatcaaagaggtaaagaccttggaggagtgtttgattatcttccccactttcccaatatccaggggttgggcaattgagacatattttctctggatatggatagtatttactggggaactgggctgatttttatggtagagcttaccaacaactcctgtctcccacctggaatcccatgggtcttgtatgtagaaaaagagtgtcctatgattggttcgtgatcctagcatatgtatctgacaagaccaatatgagccattgtctggccatttgctacaataatc

SEQ ID NO: 22416 - DNA, 1099 bp, Mus musculus
tcctcttagctggctggtcaagtccaagggcgtcgctgaaggctcctgactggtgcgaaggtgatgagatttcgcttctcctgctagctgtctgaattacttctgagcttgacagagatgcagtcttccactcgatagcaagtcagaggcttgggatatctcatttcccttaagttacaccgaccagtcttcatttaaccagtaatttccccctctgagctctgtgtgtggtaaacatgacaggctggtgcccagttccctgcttctttcttatctcaggctctggcttggagcagtggcccagtttcggggaaaattgtgttttgtagggttgctgtgaaggtcagttgtgatggtaaatacaaggtaactttcaggggttccctgctacggcgtttctgcctaagacctagtttctcagccccaatccaagtgccaggtttgatattttgggttggataattcttggtactgggctcatcctgcatattaaagtgggaaagattttatttatttttatattttaatgtatgggtgtttggcctgtatatctctgtaccacctgtgtgcagtgtccacagaggtcagaagacagctttgtatcctcctggacgtggagttagagatggttgggagtcccaatattgatgctgggaattgaacccaggttttctggaagaatggcccttaaccactgagccacctctttaggtccatcctaagcattttagactgttgagcaataccactgtcctgtgtcttagattctactactactactactactactactactactactactactactacacttttttgttttatgatatggaacattttcccagacaaaatgtatccttgccttttgataaaaaatgtacttaggaaaaatatgttgggtttttcttcctttaaaaagttactttattttatgaatatacatgtatgtttttgtatgtgggtgtccccagatgccaaaacagagaatccgatgcatcagttgttagctgttgatgaggctgcttgggcttgaaccctgtttctctagaggaacagtgagccccttcttcagcctaggcatttcttttatttagaa

SEQ ID NO: 22417 - DNA, 1164 bp, Mus musculus
actgttgctatggctgttgtacactgttgctatggctgttgtatactgttgctatggctgttgtacactgttgctatgactattgtacactgttgctatggctgttgtacactgttgctatggctgttgtatactgttgctatggctgttgtacactgttgctatggctgttgtacactgttgctatggctgttgcacactgttgctatgactgttgcacactgttgctatgactgttgcacactgttgctatggctgttgtacactgttgctatggctgttgcacactgttgctatggctgttgcacactgttgctatgactgttgcacacttttgctatgactgttgcacactgttgctatgactgttgcacactgttgctatggctgttgtatactgttgctatggctgttgtatttgtgtacagatgctttaccagagtgtgtgtcacttggatattttataaaagacacaagatcttattttgtatgcagcctttctcctccaacagaacatcctgattgatacagtgtttgacataagggtatggcgtgagtggagggtaccctccactcctagcaccagattagttcctgatatgaagactcaaggcatttcacacagagtcagaatttaataacaacatcttgtgtcacaagatcatgagatcgtcccacatctgtgctcacatttatcattatttcccagacacttgtcatctctctgggagtttggggatacaaaattctcaaataaagccctttatgtcatcacgttagtccttgtcgttcttaaagttgtatagaatactctctgtcccctgttttctggcctcagtgaagacagttactgttgagctgggcttatctgaaggaggacaccagtgtgatgagatagcagcggctaatggcagcaggatgagactgtgccccagtgagactagatagttcagaaagctgcctttccagtgatggatgtacagcaaactcccaaatgataactgattttgatttggtgatgacaaagttgtaacctattgacctggagagatcactcattgattaaaactgttcttccagaggtcctgagttcaatttccagcaaccatatggtggctcacagccatatttaatgggatctaatgccctcttcttgtgtatctg

SEQ ID NO: 22418 - DNA, 1170 bp, Mus musculus
cgtcctctctctagtccacagccatccactgtcagtagccgttcactcaggggtggggtcttaggttattatagtgactcctttgatcttgtgcagtctgtctgagctgctgtgagtacccgagtgtgtcagtcctgtcaggaaaacactggtcttgttctggtcttcccttacctctggctcttaaaaacagtgctcctccaccacccccattgtccatggcctggaatggtgtatgtatgcatttcccaatttgtggctaaacactccattgacactctgcatactatcactagttgtaggggaaagggctctttttagtctgtgtagtggctatggtctatcatagaggacggatagctaggattcttcctactgtatgtagtttttttcggacaatactttgtgtcagaaacactcaactttaccctgagagtcataccaataagtatgtaatgactgggcatggctgtgtgccaatgaaactttatttacacagatacacacaatggatttggtttgtggtagctctgaacaatgagtgtgcctgttcatcctgacccatgagctgacttgtgcctttcataccctttaatctcacatttcctttgtacttgtaaatattaataggaaggagtctcccagctgctgtttatatggattatgtcttagtgattttgttttgttttgtttgggttttttgttgtttttgttttgtttttttttgtttgtttgttttgttttgttttttgtttttgaaactgggtttctttgtgtagccctggctgtcctggaactctcgcactcagaaatccacctacctctgcctcctaagtgctgggattaaaggcatgcgccaccaccgccctgcttagttagggttttactgagtgaacagacaccatgacaaaggcaactcttatatgtacatcatttaattggggctggctaacaggttcagaggttctgtccattatcatcaaggcatgagcatgccagcattccaagccggcatggtacaggaggagctgagagtactacatctttatctgaaggctgctaggagaagactgacttccaggcagctaggaggagagtattaaagcccaagcccacagtgacacacctactacaacaaggccacacctccaaatagtgccactccctgag

SEQ ID NO: 22419 - DNA, 1105 bp, Mus musculus
caaatttcactggttaaccttattgccattcttaccctagctcggttttactttacacctttgagatggtgaaatgagaatactttattataattttagtgcatattacattagaaataacttccttgcctttagaggcctttctggattacgcactaactaactaactagaaaaatacactaggtgctttgttatttttaaaagagatgttaaaactcagaatttatggaaaaacggatcatagcgaattaaggaggaatacttgaagaagacaggccactttgaaattactatggcactgaataattcaggttccttgtttgagagagctcagaggcacgggtattactcttcataataaatctatggagtatgcagtgttgttgcatatagaattactgcaattctcctcagagttagggcttccttttcaatcccaaatctccacctgcaaatcttgttaaatttatgtcagtgtaaaatttatagacctgatctttaattaccccttatctgttggcggtttgcattcttttgtcttctgataaatctcctgcccctgcagggagagtggctaaatctgttttgtttagccgctcacagacagccatggtgaagaattccaccccacctcctcctttgtgattcgaattatccaattagagttttctctcaccattttctgataaatgaaggaaattgggagatggaggtcaaaattatagacatatagcgtcttgccaagtcatgcaaagaaaatttatcattgtgtactctctggctgagggatcagtcatgaaggggcgtaaagtggcctgttatttacagttcatcaatttagagtaataatgcagttaggcaggaaattggaagttataagacattgttgcaaatggcagtgaagaagccaaacttctcccattactaagtacagccagggggaggtgagtggtggcgtttatggaatggggtcattgttgatgcccttatcacaggtgggtcttactcctctcttctggggtagcagagtatatgtgtctgggtttgggttctgcctccagctgaaggctgatagttcacgtttagggactggcacacttatac

SEQ ID NO: 22420 - DNA, 1150 bp, Mus musculus
tttttaaagtttgctttctggaagatgccaatatatttattttaaccgactattgtttttgtttttgtttcagacaggctctcttaatgtagcccagagtggctttggatttgttattctctaactttggtctgccagtccttcacattcatgtgtgcatttttgtgccttgtggaaaacagtgttcagatgtgagcttctcaggtggtgggcaggcggctgacctgactctcactgaggcatgtagcaccactccatatatctcttgtagatcatgtacactactccttaagagattttaaagtagacatatgtcttgggtcttttgggtctgttagtatagtaaggagacatttggagagccaaagatgtaactccagggtcttctgtctctcctgggatgctgctttcaggtatgaagaatccaccttgccatgatccatttgttgaattaatcacttgctttcccttggatttgatttatggtttggtggaaaagtctagaaggtgcttagagcgagcaagactaggttccttcttggagagaatgcagggctggttccgaatgaagaaaaaaagaacagttgcccagggtgaggcaaaagatgaaattcccttgggctacccgctcttctctttgtgactcttctggagtcttgtacacagaggccaggcaactgggccagctcacagtattattaaacgttcttttggatagatctcagctcttgttgttttcttctgtcagttgctagataaaggctcccgtcctgccactggaaaaaggctgaggctgacatacagttaagtgggaactcactgatatcctcttgggtacaacctcagaccctgagcaacccaactgcttcataaagaggggggatggtggactcagctttacatttgcctaactcagtttgcatctctgtcccctaaatggagctgggaccttcttgttcaggtgacagtgtttctggcaaccttttcagccagggggttaaaatgagtcggcctcgtctgtgccattctgtttaaggagctgggaaagtgctgacagggcttgccttggacacatgctcagttttcatttttactgaaggattcacggactttcccacccttctttcccaaaaagaagaaaaagacttta

SEQ ID NO: 22421 - DNA, 1149 bp, Mus musculus
ttatggatggttgtgagccaccatgtggttgctgggatttgaactcaggacttctggaagagcagtcagtgctcttaaccgctgagtcatctctccagctctcacaatccttcaaatactaaaatagagttttgttaattagaagcctcgtgaaaccagcgtccaccatgtatctgattttgctgttgatgtaattttaggaaatcaaatgaacaaagggaaattaagtttctctgcggtggctcgtgtactcttctacattctattagatttagcaaaagttctgcaggtgggaagacagcaggcccacagccatcagcattttgaagggcagtgctttgtaaatatgaggcctagaatcctatcttttactttgccattcaaaaacttgcattaggcttctaagttattgaccacatgcacagagaagacaagtcgggatgttgtaaattttgtgtttgaaaactgtatccatttattttccctgtacaagtgtggaactggccatagtggacatgtgaaggtcagaaaacggcttctgaggttgaggctctctccccaccatctgggctccaggggtcgaacttgggtcatcagagcgcttttacctgctgagtcatttcactggcccaagatgctgttattttgaaagaggaaaacagaagctcttcaaactcttctttaaacattactttctaatttctgacaccaatgtaaatcagaggatgggaggtcagaggaggagaggaaatttgtttgcctgagactggtaagaaggggcttccactgagaaatcctgggttaggcagccagaagatttgagtgtagctcaagctcagaagcagcccgagtttagctgacacttcttggcacacttccagtgtgctataatgggccttggggacacagtgtatggtttccatagacagtatcaaaacttggatttgaccctaagaaacaaagtgtgttgaattctgtttgataaatcttgcttagttttgactccactgaactggattttataattttacatctttttatttattcatttattttctgcctcacattgttgacctgctctaagtctgcctggagatagttaataatctatacgtatttacctgtgtgcaattctataagcacgtacac

SEQ ID NO: 22422 - DNA, 1189 bp, Mus musculus
gtgggtaatcctttgatcgcatcaaatttagctttgtggtatgaaacttgttggtcaatagctatttcggttacttttacctcctatacttttctgcacagtaagagtgatatatgtatatgtgtgtatatatgtatatgtaactccaatgtaaagctcaatcactctttttatttaaattaattagatgaaaacaaaaacttaacagtttaactgaaaacattgatatgtgagaatgtgagacttttggtttggagaaagttgtttgtttgtttgtttgtttgtttgtttgttttttactttgaggtagggttttgctacatagcccaagttcatctcaaaattgctattgctctctggcagcctccaagtggcaggcagggttctgagtgcgggctaccatgtccagtgggagctcaggtgcttttggtgaccaatccagtgatgggtagccttttcttaagaatcattgtaatgctgccagttaattctaaagagctccagttactgaagatggcagctttaggcttcagttctcttcaaggaactgaagcaactcggagaactaaagtataaaatcttaagcagaacctgcagtgagttaggctgttaggcatccatccacctcagagtgtaagcccggctcagaccacacaaacgttctgcttctctatgccagtacaacagacataaagctgattttgggaaaccttccaaaataaagcaggtaaaatttatttcaagtaaaagtgggttaaggagataaagagggaatctagaggttatcagagatttaaaagcatattgttttatcttaatgagtagagctcatgtgggcagttattcagacaaaacacatagtaaaacagaagaaaattatgtaattgacagaacgtctcaataatggaatttttggactggaagatttatatcttttaaaatattttttgttttgttttgttttgtttttcgagacagggtttctctgtatagccctggctgtcctggaactcactttgtaaaccaggctggcctcgaactcagaaatctgcctgcctctgcctccccagtgctgggattaaaggtgtgtgccaccacgcccggcttaaaatagttatcgtattttggctttcgttaataataatgaaaaagaatatattaaagggtcttggaggcaattatagagtat

SEQ ID NO: 22423 - DNA, 1200 bp, Mus musculus
aaaaggttgcttcgtgaacagagctcatgccttatttattgtaaagccctataaaattcttatggtatggggtaataaaatagtacatcgcttcatatataccacttaacagatttttatgctttgtcaaattcaagttctttttttaaacatcaaaatagattttaccttaatatgtttcttcagttagttgatgattcttaacacaattcagtcattattgctgacttacttctgcatgtagcagcatgtagcagcttttatttttctgttagtattaagtgactgctacatgtgttttgtttatacctctctgtatgtttttattgtgaaatttcatctcacactgcatggtgtctgtattccacattttcccattgacaaaataattgttgtattttgtattttaaagggttattatttaggacatgcttttccatagaaactgagaccttctcactgtctggatactgtttggtgtgtgtgtgtgtgtgtatgcacctgaccaccctttcacatagcgatacatgtgtttataatcactatgtgtctagtgtagatgccggacacttgccatacattattgggcacttcctgagtgctcttgaggagcttctgtgggaagcagaggatgaaggaaggactgtgtcctggaaggggtgggattcactggaacagagtcagttagggtgggcttagaattgagccagttggaatgggctgggaaaggaactcctaaggatagggtgacacagctggtgtgtaaacacaaacaccatggtgaggattgtgagtaaagaggtgcactgtggttcccaagtccctgtgggtctgtaggtctgtggatccaggtagtatttttcacagttctgtttttttctttgatccacagtatgagacagcaatatgtgtgattggcattttgcttaggtcgaacttgactgcatcatgtcttttctatgtttagtgtgggctttatttgcctctgctaaccttgtgcctagacatatgccttaccagttggcttgtgataggaaaggaggtattcaatatttgttgagactcttgcatcccaaaaaagaagtaaatgtctcatagtgtcccatataaaacatgaagcactaaataatatttagaaagcctcacggagccttccacaaatagtacattaatgtcaaggaagtgttggggaattcccag

SEQ ID NO: 22424 - DNA, 1172 bp, Mus musculus
tggctgaaataatcatcgaaattcacagccataaagtactcgctagtgggaagggagaactcattttcatttccacctggccagaatactcatcagagattctgggtatctattccagaccaactatacagagtaacagcaattgcatgtacagacttcaccccattcaagctctaaggagccacacaatgaagaggagtgtaaatttgaaattaaatccacagggatctttcaaatcaaatcaatcaataaatgaatgagtggatagatagatagatagatagatagatagatagatagatagatagatagataaaagcacccatgtagttttagtggtccatgtgggtgtagggggtgtgtgtatgtgtgtaggggtgtgtgtgtgtgtgtgtgtgtgtgtgtgtgtgtgtgtatatgtgtgtgtgtgtgtgtgtgtgtgtaggggtgtgtgtatgtgtggcggtgtgtggaggtgtggcaaatatggaggtcagcagacaacttgcaggaagattcatgcaggttcttggcatgaaatttgagtcattatgattgacagcaaggacctttacccacggaaccatcttactggcccaggactatacagttaattcctggtttgatcttagaaaattcaacagcatcactcctcccaagttagctgtttcttaggtgatactcagttcaagacaacgaccctggtgagtttaccatcctccctgaagtcacatgacgccttggcccagatgtacaccccatctatctacacagctgctgcacgactccgggatttcaaagtcagttaggctgtactaagatgcatagcttcttctccatataagatatcccaaacccttaaaacctagcacaagatgagaagaccaaagacttgctactttgctttgtacttagcaggaacaatgcacttggtaccttgaccctacccattctgtactttagttccaaggcagcgtgtaaaaatcccagtggcttccctctgctcatggggtcacaagcatgctagcatgccacacaaatcatcagcctcaagaaaaagaatcaaaactgaaaactcctaatctgaatgtttaccactttgcagtaaaaacagacttgaaaatcctaaacaccgtcactgtgtgtgaggggagctggggctgaagacagag

SEQ ID NO: 22425 - DNA, 1200 bp, Mus musculus
gagtatcacctaagaaacagctaacttgggaggagtgatgctgttgaattttctaagatcaaaccaggaattaactgtatagtcctgggccagtaagatggttccgtgggtaaaggtccttgctgtcaatcataatgactcaaatttcatgccaagaacctgcatgaatcttcctgcaagttgtctgctgacctccatatttgccacacctccacacaccgccacacatacacacacccctacacacacacacacacacacacacatatacacacacacacacacacacacacacacacacacacacccctacacacatacacacaccccctacacccacatggaccactaaaactacatgggtgcttttatctatctatctatctatctatctatctatctatctatctatctatctatccactcattcatttattgattgatttgatttgaaagatccctgtggatttaatttcaaatttacactcctcttcattgtgtggctccttagagcttgaatggggtgaagtctgtacatgcaattgctgttactctgtatagttggtctggaatagatacccagaatctctgatgagtattctggccaggtggaaatgaaaatgagttctcccttcccactagcgagtactttatggctgtgaatttcgatgattatttcagccaggggtgctttgtgtctgctcttgaactagaagtagtttccaagaatagccgtccaagttttatttcagttacatcctaatgtcccacaagaactggctgggcagagccctgctcggctcactcgccctgctctcgtgtatgctgctcctcacgcactttctcctgctaacactgtcatttgaattatgtcttgtcttgtgtttctgtaaataagattgatagtgtgtcattagtgcctttgcttgcagcattctggcagtttgagtttttaaaagagctatatgaaatctgagcatttcctgcagaatgtactggtctttacagacagtgttttgaagttagcacatgcaaattacaatgtctgcaaaactaatgctttatgaattcagtgtgtattgtgggaagtctgagtatttctgacttatttgttgttattgaatgttctgggtatatagctgtctcttgtgagactatgccagggcctagcaaacacagaagtggatgctcacagtcaac

SEQ ID NO: 22426 - DNA, 1112 bp, Mus musculus
atgtacccaggttcttatagagagctctaatcattcgctcatagctctgtaaaggatctgcagtgttgagagcctataaattactcaatcgtggctgctcttggttgcccattgaccatttagcaattaatctagagaaattcccatggtggtaactgaacaggtagaattaatcccctttgtatgtgagggcaatgagccacacagagtaaatcatttattgtaagtcacagaaacagccttcttttgtcgcactgtcactcaaactgacatcttccaagttagttccatgtgaatccaattccagcatgtttttctctgtgtgttgttcctatgttttcgcagataaacacccctcctggatttttggctattttttcccctgataagttcccatctgactcccccgattcttgcgtgtgcctaatcgtttttctttactctgttgacttactctcaggtatttagtatttgatacttccacacttgaggcatataaactgtgttatgggctggagatatgtgtggccccggggaggtagagagtttgccatccttgcagaggatccaagtttcgtcccagcacccaggttgggtggctcacaagagcctatccagttttagtttagagcaatggctctcaatcttcttaacgctgcgaccctttaatccagttcctcaggttgtgctgatctccaaccatacaattatttttgttgctacttcacaactgtaattttgctattgttgtgaatcataatgtaaatatttgatatgcagaatgctcttagtccgcccctgtggaagggtcattctactcccaaacagatttcgacccacaggttgagaagccctgctttagaggatctgatactttgacctctgtgggcacttctaattttgttcataaaacaccccagataaacacacacaaatacatagttaaaaattaaaaaacaacactattacttcagaaatgtcagattatacgttcttctttagaacatagaatctttaagattcgaaggtccttttaagatctgtcagtgggtatttgaatcaagcataggcagagagtgtgagtggtgaacttgagttcatacagccctcca

SEQ ID NO: 22427 - DNA, 1241 bp, Mus musculus
ctccctcccttcctccctccctccctctctccctctcctttcttagatgcacatgtaccagagagcagacatgtgccaaaaaagggaggatgatgatcaagggatgcagtcaacctctggcctccgtgcacatgtgcacacagccacaggtccatgtccatataccacacaagcacacagacataaagttgagaaaagtgttctttcagatgctgacctcacagaactaagtagcctgctagttgaaacttgggtgcttttgaaagagaggaggaaagccagatgtcttatgtggattccagagtttggaatagtttcatctaaaccttttaaaggcctgctaccctagaacttaattttgttatatatggatttccttttgcctcatttccccttaagccatattttgttgccatacttatgcacacattcggctggcacttttcaacagtgggacaaaaccttttaacaaaggtttggcagttgggttgcaggcaaagacttgtttcagggttttgagttttggtatataaaagttatctgaagactttctgtatctaattactatccttgttgatagcttctgctgagaaaatgctcattctgtgtagtaatacattggggtcaggttacaattggaagtatgattccagaagccctgggtgtgacattctaggccctttggaaattatcacgtgaatatgactttcccttacataagtaaagtgtgtactgattcagtaggaaagtgcacatatgcagataatgcatagtgtgagctccctagcaccaccaagctcctgtgcacagctacaggaacaggtacagaaagaaacagggtgaggaacgttagaacagtgtgtttggttgccttctttccatggagaggggcctgagtatggctcgtaccccaggccttgacagcaccaagccccaggccttttcacacggattctgagattaaccaattggccacgtgctcacctagcctgggctcttcttcctaggctctgagaagttctgttgaaaagaaattcaagaccacagcttatagattgactgtttcttgtcctctgttttgagccattgatattgttgccagagactatatatatatatatatatatatatatatatatatatatatatatatatattccttcccccatgtcctctccccttctcctctgaaagggtggggatccccctgcatatcccctgacgctggcacatcaagtctc

SEQ ID NO: 22428 - DNA, 1158 bp, Mus musculus
ccggaggctgagtggcagaaagtgggagataacactggcctcttcacagtgagacctgggaaagctgtgtatggtttgaaattcttaattttcattctctccatctcttttataacatatatgagtatagtaccagatacttattgagactaaataaaaagcactgaattctcagtaatgaaatactaaattttaattaaagttctaaggattgtcctctcttgacctgtattcttgaatattgacatagttaagaatacaataacaaagagcacattatctttttttaaaaactcctacaaattgcttttaagttctccacgatctggttgacaatcgcaagtgtaagtatttatagagggtggtagagacggagctacctacacgacatctataaatacactctacatacagagctgacagtgacagccatcttgcctgtatcaaatgtgcatgattttcagatttgaaaacggagcctttgtatttgcacagatcaatttgtgtattttttgtgacccaagaaaagctattcctggcaagttctgtcagaagagtatctgtaggttctctggagacggagtgggagttgggggtccctttcttcttaggactgctgtgaggagtgatctgacgagtttgttctaggtgtctgaaggttcatacacatccggtcttatttttgaactgctatgagtgaccactgtcctcaccagccagtcagccagaggcacattagaagcaagaacggacaggaaatggttgcgtgtgtaaatctcaggacttcaaagctgaaagtgtctagcagcccgtggttctttgtgagggagccacaggctagtgggcccgtcttccagggggatttgttgagacatgataccagcgatagtgtcatcaaactttccagagacagcatccagaagcagccagccatctggcctgaactactctgttccctccagagcttcagtctttctcaccctgtggaccatattgtgacttggcccttgctggcctccccagattagtcatcctccaccctatttctggatgttcctgtcttccttttacctcagcttcttgagtctggtaggctctggaaagtgcttgatctactgggctcctttgcaagcagagcatttctcccaaagggttcaa

SEQ ID NO: 22429 - DNA, 1149 bp, Mus musculus
gctagaactagctctgtagacaaggttaacctccaactcagagatctgcctgctgctgcttctccagtgctggaattaaagatgtttgtcaccacacctgtcttgccattgttaataaagcattttatcctcttctgtgtgataactggctcatgtatgcttctatatttcctcctggtcccacaaattcaaggccacactgtgactgatattgtgcttcccattcaaattctgatatcaacaatattgggtatctttaggtcacaaatcaattcacaattaccctagaaaaagtgaaacatcatagaaaaggttaccctgttctcaggttctcaggccattttgtgttagaggtggattacaagggacagaaatgatttccagagacatgaggtagatatctacagtatattattgtactggacttggggtcacaccccactagccagatttgatagggattggttgttcatctttgtgtcctttcacagattgggcacacctaacctccctcttctgtttctcactattaatttgactcctaatcagctttgaaagacacgtggctggtcctggattgcaggggcacaggatgtaacactgagtccaatagcattcattgcaaccatggatggacaaaagacacattttggggactctgccacatgaacacattgaccccagatggagaggaaacactgaaggtctcaacagctgctgcaattattttcttccaggaacattttttcaatctccccacttcaggagacaacagctgcttaaaacaaacaaacaaacaaacaaacaaaccaacaaaccaacaaaccaacaaacccagcatttggtagagcacaagcattagtgcttaacctccattttggattcctgagaacaatctgaccctttgtaaggctcaccctcatcctgcagcttgtctgtcattttcctatttgcttttggacttttttgagcgcattgggcttcctttgcatcagtgttgtcagctgccattcgatgatgggctttgctttgtcttttgttgtgttcaactgatttggattattgtttgctttcaagtctcattaaatctttgagaagttcatacaatatattttgatcatgtttgttttactgccccctgccctgttt

SEQ ID NO: 22430 - DNA, 1162 bp, Mus musculus
gattcttggttactgatacactctacattttttcttcatctccttttctccacaccctgggtggccctttcagccgacagcctctcctgcctcttcagcagacatggcccccatcagctctggctcttccacttggacatcctccggcatccccttctcatttgtttccatggcaactgggatgggcccttcctccagtggcagccaagctacagtggcctctgtggtcaccagcacactgttggcaggcctgggcttcggtggtggtggcatctcctccttccccagtaccgtgtggcccacgcgccttcccaccgcatctgcagccagcaagcaggcagggaggacagttcttgccaccaccgaggccttagcttcccctgggccggatgtcgactcggcaccgacgaaggacagcgagggtacagaggagggagagaaggaggagaaaagcgagagcgaggatggtgagcgagagcatgaggaggaagagaaggactctgagaagaaggagaagagtgaggctactcacacagccgcagagagtgaccggactgcacctgcccccaccccctcttcccctcataggactgcagcggagggaggacatcagactatacctgggcgcaggcaggaccactctgcccctgccacagaccagccgggccacgttgccccagacttggatccccttgtggacacagccacccaagtgcccccaacagccacagaggaacattattcagggagtgatcccaggaggcccgaaatgccatctaaaaagcctatgtcccgaggggaccgattttctgaggatagcaaattcatcacagttaacccaggtaagtggggttggtccacatgtgaggtttggggctgctgtgaacaggctggacctatttctaaacgttggggacctggagaatgaggactggggaagtagttagctccttggggttatccgtgtccctggtgttctatgcatgaaaccacctctttttgtgtcaccctaatgagatgcattctctcactggaacaagtctttctctatctttctgtctatttcagaagaagccaaggcctcagacagatctaaatgaagaaagtaggcactggatctaagtttgctcactctgactttattcctgcgggtggggagggt

SEQ ID NO: 22431 - DNA, 1141 bp, Mus musculus
aacagtctctggctaagcatgcatacaagtaggtcttctggcttaaagataaagatattatctcataatgaataatgggataatattcaatgtaccagagaaagactgcttgctttgacatcagaaacaagccttgtaatgtgttataaagacgacactttaatagacactgtttacacatatactaatggacttcttgtgagaaagattagagatatcagcagtttaaatggtacctcatcccctccctcattcccttttctagtataagtcaaagttagagtagtgggccataatatcccttacaggtgttttggtttggtttggttgtttgcctgattaaaaagatctactgttcacaagtatggtgtgttttaatgacaagtaggtcttctgtaatctgggcaacccaacactgttcagtttcctgtgatgcgtgctttctagggaacaggcatttgattatagacatgaattacaggaagacctatgattgtgtcttgtccattgcaggatgactacgtactagaggttcggcactttcagtgtcccaaatggcctaacccagatgcccctataagtagtaccttcgaactgatcaatgtcatcaaggaagaggccttaacccgggatggccccaccattgttcatgatgagtaagtacctggtcctgtgttagacttgggtgctgttcttacgagactcatataaaagtccaaagggaacactgtcttctctctgatccatgttacttgtagtgtggacatacatgtgcaaaagggttgtggttgtgttttaattggtcaaactttgctgggctccaagtattcctagagagtatgttctagaaggggaaaatattgcacttcctttcctcaccaaaaagtatgcagctcttctctgaggacaggcacaccttaaccttaatatgcgtcatcctcagcatgccgtgctcacctgcacaagtctattctagtccaaggctagtctgtttctaccacagtcttttcagatggttgtatgcttttcccaaataatgaccgctagtttcctgtgtaactaagctaaagtcatttaataattctcaaagtgtggtctgagaaccctgtgggttgtatctccaaggcccttccagagatca

SEQ ID NO: 22432 - DNA, 1157 bp, Mus musculus
accggggacaaaaacggtgctgtgctaactgcagaggaatcagaccctgcagagagcatggagtctctggtgtgactagtcccctggaagggcacttcatttgtaaacttctgagacttgtaaagacagaaattttttgaggccttttttgccagactctaggttatacaataacccagttacttttttacactgataaaagttttgatatttattttttgccattttctgtcttaatggtatcctactgagcatttgcgcctgttcttcatttcacacagtgaaacgcaactttacctagtttgcactatatgatcagtgttaactgcctataatctaatactacagaaaccctgatgtgacattccatgaccacatacatgctattttttagttccgtgcagtgaaggtctttgttatgacagtgaatctcagttttactattattctaaagcaactacaatttcttagcaggcaacagtgtacttttctcagtcccctctattttttaggcactgttcaatactacatgccttctgttttaatggagtggatgggcgttgtctccttttgcaggacagcaggtgactgggagccctatagatctgttggcatcagttccatttgtaatggttgagggaccactaagaagttaagagggcttcagagttacttcatgtgaacatctcttattagttaccaagttatattcacagttgaaatgtgtcaaaataaagaatcattctgtattacagatttcacagtagctatgtggacagtgtgtgttatttctatgttgactctctgaagtagcaaaccctaaaatcagggctgtcttttacaatgggaagatggccttattttacacaatttacttatgacactctttagttaactcaactatagctttttggtaaatagtaccatagtagctacaaccacaaaataggtattgacatttaaacgtagtctttgaaaagtccctactaactactcctatagcaatctaataaacactacctatagacagcattttttttgccaaatgtttcataataaatctcttaattacatccaactctacttaagattgaattggaaatatatttgggagtcaatttttataggtcttactttgagaaagaaataggaatctt

SEQ ID NO: 22433 - DNA, 1175 bp, Mus musculus
agactacagtaagtcattggtgtgctaggcgctgcctgcatgcttagcaaatgggggcacattgagaaaaagacttgaactttcttgtgactgtaactaagtagaattttctgtgttctctgatgtctgattgtttggtttttttttttttgtttttttttttaatcaggctaagacctagattttagttctttggttttaatgaaatctatcacacaaattatatgctcttaataatatgtaaaaataatcaactataacaattacgttgtgggggttgcgcaggggctgcatacataaccatatttgctaatgcaaaataaaacttctcatgcattactaggcacaaaatgtaggtgacatggagtaaggttctgtgtcttcttaactacagatgatgacaagctgtcagaggtggatgaagctcaagaaagcaccatggaagcagaccctaagccatagatggactgaccgtcgccatttacagggacagcgaatagctgcatgggcttcctgggttcagtgtgttgtacttttgggatatttcaacttcagcattgaagtactttgctttcaagtattcatgtgtcgttcatatttcttcacagaacggaaatgtatcccatatatatgtattttttaaatacatttttatccttaaacatagaaatcagcatctgaaaatatttaataaaatgtctcaaggtggatctttgtgctcattcaaaactctaggtaactgctaacacttgccttagcgaaccaggtaaggattatctaagatggcgtttgggatacacatgagaaaatgaatagatttctagaagatgttagtaaaacttgagaaaatggagtccatgagtaggccttagagggccatgatgagtacttatggcgtgggtctattgtaggggaagctttcacactgttaagaatggctgtcgtatgaaatcagtccatctgtgttgcttttctacagctctctcttagtccttgaggaatgtggttggtaaatgcttcttctatcattttgttttaaagaatctttttaaaaaatacttctttgggagcatgcatacatggtacatatgtttgcatgcttatgtgtgagggcgtgcacctgctgtagcatgtggctagattcagatggtagcgttggctgctgcttgtctacc

SEQ ID NO: 22434 - DNA, 1117 bp, Mus musculus
gccctcatatcttttttcaattgggacacttaattgtaatgcttacaacaacaatctcctggctcaagtttgtgtcaacagttcttaccattgattctctgccttgtcaatgaatgcagatcacctaatgggtgggcagaatacagaatagggtggaacatctgccaatcagaggaaggagataggggagagacggagatttatatcatggaggaggatggaggatttggagccataaggaagaggtccagagagagatcatggaaacacacctgaaacccacagaggcagatcagtgataataataatatgcacatatcatgggatggggctgggaggtagccagattggtttagggagtaaaggtagatcatttaaataatctcaaatgactgttagtttatctgtgtaattattgaggactaacaggaagaaaatatagcaccagattaaatcactgtttacatttctagtaagagtacttttttatatagttcatctgcttttagttttgtcatttggggtttgtggactctctttgtgactgaagttgggcccctagcctcatggtgcgttcctcagtggggccttttaggaagagtgaatgttctactccaattgtcagtctgtccaggaggaactgccgtgggtagttttgcacacgcacctgcagggtatagtttctcttgggaatatttttgcacttggtctccaatttcctaggaatttaagattcattcagagtaaatttagccctcattcaactttaatactttgtttagctgttttatttaaaaaaataggaaatttgagaagtcatcacaagttcttacaaactctttcaaaatatgagaaaattaaaaggtggcacaacacatgtaacacactcacagtcagttttcacacacagtcttaccaccaccagatggccccaggcagccaacacagcttatgtatcctcctgcctgctgcagtttcttaagtgctggattatagacaggcatgattattaccctgttggctttatgcattctactgcaatccagttatttgactaatctgtttaattaaaatctataatcttaaccttatttagaaggatccagagtagagactc

SEQ ID NO: 22435 - DNA, 4096 bp, Mus musculus
gtttgttttaaacagccctgaaaagcctgtgagtgtgacaataaatttcgaagatgaaccgtcaaaaaaatacatggatgctgaaacttcattgtaaagtcaaaccaaaaggaatatatagagatatatgcctatctgtatatatacacatatatatgtataaaaagcacatgtgccatgccattatgtataacagtactttggggctttttcaagtagcgtcagatatttgttgtggacaccatagagactacattaattaagtgctctcttagaagcaaggttcatgaatttttactccagatttttttggggggtggggtaaagcctttctgttatgcaatagaaagatgtggagcactgcgttccatctgcttttctttgatctgtcagtggcaatcaatcataacaatcttaagtctacatacttaaaattcgacctgaatttcaaaagatgtttgttttcccttttggtagtgtttataggtagaataaggagtctgcccatgtggtgggaaaatgacatgtcctggcttctctgtgggctttcttcatgtaactgtcaatcatacttcacaggatagtggagattttctaagaaggaactttatgtcttaggagttatttttaaattttaaaactttctgagtttccattttgatggacaggttaaaaatttttatgtcacttctaatttaacacccacacaagtcataacgttttcagttttagaacctatgaagtgcccatttacagtaattaactattgttagttttgtggcagggctttgccggtactcagtacttgcctagaaaccagagtcccactcttctttgtctttgtttttctttactgaggtggtctggtgtgccaggctcagttatctttctgttgtaagtagcaaaaagagtcagcccactttcaataggcttgtgaccagtgtgcctgtagaagaattacctttcattttctgtgtgtattctttctatttatatacagtgtatttaattggttaccacccataatttccttttaaaatattttatttattatagttgatgtgatacttcaatatataaatatttgagacagtaaaaatatagagtaaattgttcctgttgtagatatttggtgcttgtatttcttttcacatcctgaaagcaggtgacaaattttacatctttactataaagcactgccatatttatatttttaaaaggaagttggatatttcctgtacagctcagatcaatggcatttttttctgttttgtgatagcattgtgtttccaatatttctgagctgtttcttaaacatgtagcaaatattcatagctcctcacaaaataagtaaaggctattttagcctttgggacagagagtttggggctatgaaacttgatttggcaagaggacagataatacatagaaatggtgagcaacactagagacaccgaaggtgatgaaatgcgaaggttcaggcagatgttttaaggaaattctaatgttctctagccactgcaaactaacatttaaaagtatgaagaaactgatctttaaatcaaattatttttagcaagtttattctaaactttagcaaatcattttcgtttattctaaacaatgtaccaattaatgtaattccctcatctgagatcatgtagttggattcttattagaatagtagctggcagcatttggtactatctgacgagttctattgggcttcttagcatgtgatagggaaggttgccatggtgcttatggtcacaggtgacctccattgaagtggttcctttgcactcagcagcacattcatttccaaagttcccatttgctgctaaatataaccctaccccaacccctgaagtacccaaacaagagaatttcctcacaccattttcttgtgtaaggacatcaaagggttaaatctattttacaggaagtgattttaaaatttaaactgaagactacctgttatcataatcttcctgtgatttatttaattatatatgttttgtccagtgccaggggcggaaaaaccatgacttacggaatattttgtatctaagatgtttcactgtggttttggttattaatggcttctgctttcttttgactacttgacttacaaagtgatctaataggactactcccctgaagagcagaggtaatttactgcttctttcaggtggttacatttcttgtgctatttttgaaaataacaatcatgaataacattcattgcaagacagcaagagagataattttaaatatatatatacatatatatgtgtgtgtgtatatatatatatatttttaatgctgccttaaataggtgtatatgagcagtagtaattgctatgtactgatttacctcaaggtgcaaaataattaaatttgtacatacccatttacagaataagttcagagacacagccctgcactttcttagatgccttgattttcaaacggagcttagtgctactgaacaccacggccatggggccacctcaggacgttcttccctccaccatattttatttatttatagatgtccgtttacaaagactataatgaaacctggtgtaaactatctgatacttatttcctttctattgctatttcaatctaaagtaggagcttttgagaaaacagtaaactagcttcccaatgctaaagggttgattctatatatatttttaataatattagatatgcaaaagttaaagtacaaggtctttaaaatattgtgtgagtgtttgtgtatgtgtatgaaatcactcttaactctcttaacttttttaaaactcgtggcataccaatgttcagatttgccaagctttctctaagacatgtaggatgaaatgtttttgtgtgttaatgcatgtatttataaagatttgtttactgctgagaatcactaactcttgttttcatccccaaagtgtttgtttcttccacatgctggaaggcttggcttgagtatacgctttctggctttcctttcacaaaggcacgttcaaaattgttcagaaagaagaatggtctctgacagtgaggtgtgatgccagagctttctgaagtttgagcagtgtgtgcagctctgcatgtgtgtcctgacagagtcagatatgtgagccattaaaagaacattgtaattcagagtgtttatttaagtaacttacatgtctgaaatttatttatgtagattccatcattgttatcatttgtagtgcaaatacatgaactgtcttcatttagtcccaacaattatttatttttagaaagtaaatttaaagccaagctgcattcaacttttaaaatagtgttctaatcataagatgtgatcattgtaaggtctcttttaactttctggaaagtaaatggtcaaaaggaatcacataaagattgttttacatttttaacctgtatgtacttagagggtaagccccagttctctggtttctaatcattttttgcacattgattgtttctgttctgtagcttttcttttgctcctttggttttggctttgtaggggtaaggtgtcttccaatgtttactatgttaggcttaaattaaattttaaatttattgtccatttatataatatttgataccttggtgtaacttctcaatacaattacaatttttatgacatttataattgcgatggtattttcttttataataaaatccaaagtcaattaaacaaattgtagacctgatatttttcatctatatgaagtacaagtctctacctgagtctataatgtgaaccatcctgcctttcacatttgtttcctaattgttagagaaaactattttctgtagatgttattgtaagttgaaagagcaataaaagtctacatatcacggccttggctgttgttttttaccttgttgttaggagtgctgcaaatgttttttgtttaagctgaggctggagaacggaaagtgagtggcttctgcctcctgcacccagctcttgtgtaagagggggaagagagagaggccgggaagggagggaggaaggggggggaagagaagaaaaaaatgttttttatagttgggaaatgttgaaggtaatgtt

SEQ ID NO: 22436 - DNA, 1218 bp, Mus musculus
tcttcttccaccatcatggctgttggggcagcagagttggccctgaaagactccggctggcatccgaaacgagaagcagatcaggtggctactggcgttgccattggcatgggcatggttcctcttgaagttatttctgaaactgctttgctgtttcagaccaaaggttataataaagtcagcccattctttgtccctaagattctgatcaatatggctgcaggccaggttagcattcgctacaaactcaagggccccaatcactcagtgtccacagcctgcaccacaggtgcacatgctgtgggagactcctttagattcatagcccatggtgacgcagatgtgatggtggctgggggcacagactcttgcattagtccattatctctcgctgggttttccagagcccgggctctgagctcaaacccagatcctaagctagcctgccggccgtttcatccagagagagatggttttgtcatgggtgagggagctgctgtgctggtgctggaagaacatgagcatgctgttcagagaggagctcggatctacgcagaaattttgggttatggactctcgggtgatgccggtcacataactgcccccgatcccgaaggagaaggtgctttaaggtaaagaacggttgttctgttcaaaatatattttcctcttaagatactatattaaggcactattggaacttcaaattaaaaaaacattacctggtcttggtgtatagtatatattctcttagatcaaaggctttttaaaaattctttgcttgaaatgattgaaaacatttgaaaatatttaaacaaaaattgaatggactttagttagagccaatagagttgtgtctttgctagcttcttataccccaccttctgtttggaaatcatgagtgtgctcccttcctcagcctccctctgaacacttatcagacctggagaatagagatagatgtgtctaggtatattctgttcttttcaaatcttttcaaagcagcatttcttagccctgaatcacccaggagtcttgttaacatgccagttctgactgcggatctagattgatgcttaagactctacatttctaactagctccagtctaaagaccacactttgaaaaaaagtccttgattatatgatgccatctaagcttaaactgtattatgttttatccaattaaatcagccagaagtttagcaggctttcctat

SEQ ID NO: 22437 - DNA, 1156 bp, Mus musculus
taaacactgcactgcgtgtatatttaacttgcacagttccccatgcatgggcactgagatcactctctgttcttatttgtgctgaatgccatccactgaagtgctcgtgaaacctgcttcctgttgcttggacagattccctcttgccaatggcatgtggcattgtttcacagaaagagtatttgtccttctgatgttgatgttactttaagagggattattatcactgatttgtaggacagttttatgtgttctagattgatagtttcctttgctagacacattagaattttactactccctatctcaatgttctttgttaatttattaggtgtaccttctaaaattcagaagttttaaataacataattttccatttctggattctgtattattggtcgaatcatgcttttaagaaaaccttcgcaggctggggaaatggccgcacaaggatgaattcccgagcttgagtacccagaattcacaaagactgatgtagtggaatatatgtgtaatctgcactcctacaggaagatgggggatggagtcagtggacttccagaagctcagttattccgaccatacaagttacaaaaggagatgctgactcaaacagtgtgagacgcaaggatcaacacctgagctcgccttctgtgtactgtgacacatccatacacatgtgcattgcacacacacatgcacatactagggaggccttctggggtccagttataagcatgctctcttgtaactcttaactactgtagtactatagagaaagacagacttcttacataaatgtattaacagtatcagatatctaggtaaccacttgtctcaacttaatgggtgacccattctcttaacatttctttgacatgacaattttgtcttggtgtttaatgattttttttctatttaatgagtttgtttttggttttgagctactgttttcctgtatatctaggctagcctggactgcttttttacctcagtctcctgcgtgcttaagattacaggcctgcaccattgcatgcagtgccacctttatcaaatgccttttattcacttttaaactatcttttgactgatacagaagacctgtctcaaaaagaataaagaggtttgtctctcagtactctttcttttttcattg

SEQ ID NO: 22438 - DNA, 1137 bp, Mus musculus
ctgctctaggcggcgcacggtcccgtctgcagttcgctagctccctccggggcccagtccctgggggcggctagggcttcctgcctccctgcccccaaccctccccccccccccccccgctcccgctccccccgcggcctcgcggcaagtctgcaggacacagtccggaggtttccacagcccttgtcccaggactcccggctcctttggatgccccggaatgactcttgacagccgcctgctctcccttctgacggaaaccccattcactcgcctcgctctcccttacactctctctcagacacaaacaaaaaacccaagtctgcctctcagttgctacccgcaatgacgttttcccctcgggtcccgcccccctaggggcctgaaattttgggattggtcgaagtactgtagtgacaaggctgtgattggacgatccatggttgactgacagccggtgaccaccgcaccctccccctcccggagcgcgcctgtgtgtgccgtgttatgccggactaaagggaggccaccacggcggctctgtttattgtccctcttggactgtgctccggaggaccggttcagacgccgcttgggcggttttgaggcagtggcggcctttgaggctgcggcgaccgcggcgaggactctgcggcttcggtggcttgaggagaagcagcggctcattcctgtcagggctctggctcgcgagtcctagccggcccgcttcaacctcgtccctcatccgcgatcccaatcgcccgcgtgggtcccggaaggccgcgccgcatcgccagcccttcctagtcctcgaccactctgtaggcccgggcgccgcgctcgagtttgagggcggcgggcagcgcggcctcctcagcggctcgggcccgcgatggggcgcggctaggagtgctgcgcgcagcggtcagtgcgagcggcgggcccggcgtccccggagcgcgagcagcccctggcctgcacgggaggcgctgccatggccaagtccagcctcgcgggctctgacggggcgctgacctgggtggtgagtgcggcgcgggcgggcgcattgttcgtgggccgcgggcgacgcgggcggggtgagagcgtggtgcggcgggcgccctgtcaggctgcagt

SEQ ID NO: 22439 - DNA, 1224 bp, Mus musculus
attagaggatatgcatatcttctttttaaatattttaataaaggcatggttatgtagtttgtaagtctgcgactttatgtctgtttatgatcatgattaagaaggacagaggagctaagacaatgcgcgagactctgggcctgaaactcacaaacaagaaaaccaaacaaacctaaccaagatgaaccctgagagagacctaggagaactggaaatctgttcattgcttatggagataaggacatcagaatataaaagtgtagaataaaatggtgccataagaattggttaaaagtttaacatagtgtgtgctgtggtttacttcaatagtgataccttctagagctgatttatttatgtttactgtggctttggcttacatatattattctgcttgatttaacatttttgggaagtccaaagttagacttttattgttttactctgctatatttttctatagaatatagataaattttgaagtgaaagtagaaagtaaataaatgttcttcattattttaaacattatgtaggtattatttctagggatccatagttgttgacagagaacagaaatttctaggccttaagaatttgatttggggttcccatctgctgtagaatggttagaattaggactcttaactctttatgaaacgagcagagaaactgaagttagaggtgttttgttggacactggggattgagcccagcgccttatacttggctcagcacaaactgttactgagttacagacttatattacagctgacctacatgtgaataaaatacaagcaatgcaacttgaacaacttttcaattttagttatttaagtttattgtgagactacaggacttgacttcaggtttactttgaatgcctgttttaaatagagtaactgacaatatggatttttagttttctttgtttgtatttgattttgttttgttttactggttttttttttgttgttgttgttttgttttgtttttgagactgggttttactttgtagttctgactagcattgatttgcatgtagcccagattagcatcaaattgtggtagttgtctttcctcagctttctctgagtgttgagattatagatgtgtatcaacgtaacttgttgagtgtgtgggtttatggtatataaacttggagttaagaatttgtggtgtaataaaactgttttgaatcattctcctgacacagctaatgtgggt

SEQ ID NO: 22440 - DNA, 1186 bp, Mus musculus
ggtaaataattttctaacttattgacataaagttcaatttaagtttgttatatcaagtaaaagtttagtagaatgataatggtgggaaaaaaggatcatttagtttttctgctcagggagagtacttcaaattatttgatcataaatttttatgcattcctggtaaaaattcagtgctaataaaaataaacctttattctgcacctaatgctatttttttagactgaaaggaagggttaggtattttattcagaataattggaaattcttacaaagttatgtaataatattaaagcacttaagaaattaagtaaatatcaaagtacataaagactcatactggcttgtgcttgggagaaatatgccttttgtactaatattaggtggattttattatgtgtagtcaaaattattaaaatctaggtccttataaagtttcatttctcagagtaatattcttctatttctttttgatagctctctggcaagacttctttttccagctgtggatgataacttgcttaagttcctttatgatgataatcaacgtgtagagccagagtggtatatccctataatccccatggttttgattaatggtgctgagggtattgggactggatgggcttgtaaactgcccaactatgatgctagagaaattgtgaacaatgtcaggcggatgctagaaggtttggatcctcatcccatggtaagtttttatagcttagattgtttacttaaataacggacaaaattaatttctcctagaaaaatatggaatcttcattttagtgctgttgtagataggatcctattaagatttaaatttatatttgattacctgaaatatataaatgaatgagtctgaagataagttttatggggtgaaactgtttattgaaattttaaaataaccttgtaccttatcagggtttaaaatctccgaattgtataaagaatggtgttcttggtacactcacatgttaaagtatcaagctgtgaaaagtttccatacatacacacacacatatacatacacatacatacatatatataatacatacacacacacacacacacacacacacacacacatatacatacacatacatacatgtatataatacatacacacacacatatatatacacacacatacatagacacacacacgtacatgtacatt

SEQ ID NO: 22441 - DNA, 1101 bp, Mus musculus
taagagccacaacaatgaacttgaatgctaaagaatctagcaattaatttctttcctctgatgctaggtaccaaactcaggtcttctgcaagaatagtatgtacttttaactgcaagccaccactccagcctcctaagaaatcctctaaaaaatagtcttttacaatttttactattttaaactttcccatagtttatggtaattgcatttatcaaatttctgtcactaaagaaatatttatagaaatgtttttaataattttggtttatttttaagtggtttcaggggtagtacatattcatattagagttattttaagtactatacatattatataaattaaaataccagtacagatttattggatttaaagcaaaatctttgtattttatgtaggtactctttgatcatatgggttgtctgaagaagtatgaaactgtgcaagacattttgaaagaattctttgatttacggttaagttattatggtttacggaaggaatggcttgtaggaatgctgggagcagaatctacaaagcttaataatcaagcccgtttcattttagagaagatacaggggaaaattactataggtaaggcataaccattaaagatttgaacattagttaaaatggaaaaaaatctttattaatagaagacatttttttatcagtagaatataagcaaatacaaattgatctcttttcttgatcctaattttatttttccctcacatagagaataggtcaaagaaagatttgattcaaatgttagtccagagaggttatgaatctgacccagtgaaagcgtggaaagaagcacaagaaaaggtaatcacctgcagaaagcagacactcagagaagctctgaaaccaaacaatccccaccccaaagtctgaatttagaacggataaaggcgctaagctgtttggtgactgaaggcttctgctaacccacagagcagacacagtttaggagttcacagtgcatacctaccacaaagcacccatctccaccagggcttttagaaatggctccatgctgagaatgtggctcagtgtccttgcaagagtctgccatgaagaggtggtttatgtaaag

SEQ ID NO: 22442 - DNA, 1195 bp, Mus musculus
ctttttaatacaagccacacactttcagactgtataatccctgcctactcagatgacccttctgacctcttggccggaaccctgtttctttatttcttttagttcttttctaagatatcagctggattttatatccttaaatacttgaatattttagtacaattttccttctttgacagacaggtttattttctatcacctttagcaaaaataggatgtaggtggttgttattaaattttgtgttcatttcttgtttgctaaagactgcttaggtcagtcagtattgtagcatccaaagccattagaatgacagtcatgaaataaagattcaatcatttgtctctaaactctctgagacaaccacgtacatgttgctctagtgttagtccatgtcccaccaagttgttgacttttcttctatctattaactttattataactgacaaattatattaactctttcacgaagaacatcatgctaaaaagtcagatgatttagatctaagagcaactgatttagatcatgtgaattataagatatgattatctctgggatcctcccattttatagtcctgatgaacacacagcaaagtactggctccatcctgtttttgaaaaagagtctcatgtacgccagactgacctcaaactctctatgtagccaaggataacattgatccttggaatcctgatcctcctgcctccatctcttgatgagatatgtgctaccatgtctagtactatgtgtgctattgtggttctggggattgagcccagggcctcatgtgtgctaggcatgccctctaccaatgagctacatccctagacctttaaaagctttgtttctaacactatgtgcagtgtgttccagagaatacctaaagcatctctttgaaaaagaatttacttaaatccatgcttgaaattttcaatatccaatcagcacctaatagctttgctcagtagatccaacaacagttcagggatttgtaaatgttagctcagttttgttttcctctacctaggtttctgtctgttgctctaataaacaagaccaaaagcaattcaagggaggaaagggtttattatacctcacactgccaggtcacagtccattattgaggaaagtcaggacagaaactcaagcagaagcaggggagaaacactgccttactggctcattctcagccagt

SEQ ID NO: 22443 - DNA, 1195 bp, Mus musculus
aaagaggaaagtgatggtgtgtctgtcattcagtagggaccataactgctgcttacgttcagtgggtatggcttttatgggatatacagctaggttttgtgaattctttacatgatagcattcttttattttttttcgtaggataaaaaaatgcatagttttcttctatgagggatagagaacttttttgaaataatactatgttgattctttatttttgccttttacataagtgtctttataacatgtatctttagagcagttaagtctttggaaatatgtaaccagaactgttagtattgcttgtgatgctttagttagggttagtatatacatgtatacaccaaaatacaagcatgtagatttgcattttgtctcgtaaaattttattttaataaattcttcctgaagtaatgggaaacaaaatccatagttcatatgccacatgtagtatttctgtatttgaaagtagcccaaagatgagcattctaattctaaaatgaaaccagcagcctcatacaagcacattctttggttgagtcatggtctaacagttaataaatgacatcagccagatagagaacctctgagtcagtggggtactgttgataattaacaatgtactgtatgaattaagtgacatgttaaccctgactttatgtttcaaggttaaaatatgggcattatctcatcagacttatgggcattatgttaacaagatgaaccattttttcctgtgcttttagtatgtgatatgagaggattccagcttctagagagtgaacactgagggaaaggagagacatcgtaggataaagtttgttctcctggtaatggttaattgcagataaaaaaatttgaagggtgtttcagtagattaatatatagatttcatatctacattgtaagaaattaccattgtgattgggtcagaattgatgtgtgttatataaacattgcaaagcaaagctgtgagagaagctcagatagatgtatctttttgcaatataaagtttgctgaatgtatgagtttattgttttgttctctgtttccctagtagaccaaatccctactgaatccctcagggccgcccctaacactgcaacagaacatcaacttcagccttccttccccactgcccacactctctgtggatcccacagaacattcctttctagcctctcttccctgaat

SEQ ID NO: 22444 - DNA, 1171 bp, Mus musculus
tattatgtactatattatcatcaccttgggtcaggctttcttagctgtcttagtctttttaaaaaaatttttttgaggtagggtctcactgtgtagtcctggttggcttggagctcacagagattgtccagagtgctgtgtggttgcccggctttagtaaggggctggtatgctttatattgcggttcttatatttttatgtttcttagatttttgcttaggaaaaaactcaacgtctttttcttacccttgttttggaaagttttctcttctttctcatttcctttactgaatcagtacccaagtttagaaaaacttaagctgagacatgtagatattcttgacttgtatgacaagagccaagggtttcagagctagttttgtgtcattgttttatgtaagcagagcttattagaatatagacgctaacttgctttctcttcatagctgttcgatttggccgaattcctaagcgtgaaaaacagagaatgctaattgaaatgcaaagtgcaatgaagaccatgatgaacacccagttcagtggccacctgcagaatgacaccttagcagaacagcatgatcagtcagcactaccagctcaggaacagctgcggcccaagtcccagctggagcaagaaaacatcaaaaacactccttctgattttgcaaaggaggaagtgattggtatggtgaccagagcccacaaggatacctttctgtataatcaggaacatcgagaaaactcatctgagagcatgccacctcagagaggagaacggattcccaggaacatggagcaatataatttaaatcaagaccatcgtggcagtgggattcacaaccacttcccctgtagtgagaggcagcaacatctcagtggacagtacaaagggaggaacataatgcattacccaaacggccatgccgtttgtattgcaaatggacactgtatgaacttctccagtgcttatactcaaagagtctgtgatagaattccagtaggtggatgttctcagactgagaacagaaatagttacctgtgcaacactggagggaggatgcatctggtacagtgaaatcgattctttgctcgccttgtatcaaggaaagcttggaaggttttcttttggggggcatgttgagttgggaggtgggtgagaaagcccaagag

SEQ ID NO: 22445 - DNA, 1150 bp, Mus musculus
gagccttttatgcccttaatagaactgatccaagtgctactgaggactgctggctatgcctgtcctcgggtccacctattatgaaggaattgccttcaatggagatttcaacagaaccagcagccatacttcctgctcttggggaacaggacaaaaactgaccctgactgaagtacccgcgaggagtccaggtctctgtataggcaccccaccttccacccacaaacacctatgtggacaaattcagtccgtgtctagaacggaagctaattactatattataccttctccagttggctggtgggcttgcaatacaggacttactccctgtgtatctactaaggtttttaattcacctcatgatttttgtgtcatgatccagctgttaccccgcatatattatcaccctgcatccagtttagaagaaagctatgctggccggcggtcaaaaagagaaccaattactttaaccctggctgcattcatgggaataggtatggcattaagagtcgggacgggagtgtcagctttgatagaaggaagacagggaattcagtctttgagggatgctgtcaatgaagacctagcggcaatagagaagtccattgatgctttagaaaaatctttgacctccctgtctgaggtagttttgcagaacaggaaaggtcttgatttgttgttcctaaaggaaggaggactgtgtgctgcccttaaagaagagtgctgcttctacgcagatcatacaggaatagttagagactctatgcagaaactgaaagattagagcgaaggaaacagaaacgggatgctcaacgggggtggtttgagtcgtgatttgagtcacgaccatcttggataacttctttgatttccactgtagccggaccaatccttatgatatgcttagctttagttttcggcccttgtataataaataaaggaatggctttcatccagagtagaactgatacagtaaaactcatggttcttcaaaggcaatatcaacctatagttcaggtagatgaagagttaggggacaccaatctctaaaattctatgattagaattagtctaaacagaagaagaggggaataaaaggaaataaaacttgagacctgtgattcatgtaatgtatgtcaaatagcccaaa

SEQ ID NO: 22446 - DNA, 1965 bp, Mus musculus
ggtgtgtggggacctggcctgcttcagtctcatgacccagagttagaaggatttttgtctagtttacaggaaactgactggtctttctctgcatattttaggagagagctgggcgccattgtggggctttgagagtcctgaattcctactgggttggtgaagattccacatataaattttttgaggttatcctcattgatccgttccataaagctatcagaagaaatcctgacacccagtggatcaccaaaccagtccacaaacacagagaaatgcgtgggctgacatctgctggccgaaagagccgtggccttggaaagggccacaagttccaccacactattggtggttcccgccgtgcagcctggagaaggcgcaatactctccagctccaccgttaccgctaatacacgtgatatttgtaaaattcatatccaataaacaatttaggacagtcatttctgcttaaaggtgttatttgttaaaactagtctacagattgtcatgagtgttctgtgaaaatgtagaagttaagtgcaataattgaaaactgcaggtgatggcatatcttgtttctgatgtactttgcattatctgcttatgagattaagtgtatatagtgtttgtgccaagtggtgttctgtgtgtaagaccctgtaagaggtaaaaagtcctgaaactgaccctggatgtgttggtgcatgagatagaatctacagctttacgatggcatcttttggttcactgaagtggctgcttgggagtttgatgagtacaaactttatagagttggattttgcttagaaatgtgtaggaagagagggtttcaaaacctgttttgtgcatagaaaagtgagatcaactataacccacattttgagaattgaatccagtgttattttcagaagaccaggtaaatttgttggaagaggtttcactttctgttggatctagagtatggatttggagatgaaggttgaacattggatgtagtagggcttatttagggcagattatttccattagatttgtaaacttggttgtggttgcaagttaatatcaaccaagcaaatataagtttgattaagcttgcagacattaagcttttctagcagctggtgtgtgcagaggcagatggctctctggttccaggactacctacaatatagagaaattttctctattccagtcaattcatcatgggtaagaatagtccattttggtagtgttatttcatcgtttacaatctacctatgggtagtggctggtaactgcctggatgttgacatttcacaaaggccatacttaaccacacttttatttctatttgtgcgatgccttggagtagtttcccaaagtgattttgagtgtggaagaaatggtattgtccccgaacagctggcttggtctcaaaatctaattgatgcttttattaaattggttttcctttggagattttaaaaggatgatttgatttccagaaaatactagactcaaaatcttgatagctaaaattcttttctattcagcaaaacaagtcactgtatagaggttgttcaaatcaactaaagtaataaatgtcttaaacaagtggacctatgttatcttttatgttaaagcaaatgaggaacttggaaaggatagctaattgtagaaatgacaggcataattcgagagaacatgtaatagtatcctaagaattaggaaactgcttgggcctggtactgtggctcagttcagtccttagcactggtaagatttcctgctaacgccagtcagtggtcacagaaacttgcctttgtctttgccaccttaaagatcagtctacagggcagctagaggagtcctgttaaattgatcctggcctttttgtgctggaagctaaaagctacagcaaataagcattttcacgaagctaagcctgtcattttaactcctgccttcccttgtataggttcagggagc

SEQ ID NO: 22447 - DNA, 1113 bp, Mus musculus
gtgtgtgccaccactgccgggcgagaaagggtcttaataaattacccaggctttgaacttggaatctttgtgcccagacaccctgaatactgggactacagccacccggtttgcccttcatcccactaaacactggctggttggaactatgtagaccaggctagccttgatctcaagtcctcctcagctgggattaaagttctgtaccattatacacagtcttggccaattctttttttaaaaaaacatacttttttggttatctctcaggttaagtcagcccgcccttccaggtacttttctctcagctttgtcttctgatatattttatatagatcctgcctggtgtttctgttttttcttttggctgcatttagatcttgtgctttaatatacgtggaattgtttatgtaattaaaatgctttttgagactgggtgtcatgtagcctaggctagtctcaaacccagtgtgtagctgaggatgactctgaactttaatcctctggcatccaatcaccctgggatgaaggtgtgtgaatgctactatgctcagcgttcacttgactgaggctggagccatagccagcagcagtgctactgagtcactgagcctgctctgcaagatgagcaccagctcaccagagtggctcatttctcctgtgtctgctgccacttcatctgcagatcagaaaatgctttgagcaacaggcattgagtatatctttgacgctttagctggcttacactgttttgttttttgagacagggtttctttgtgtagccctggctgtcctggaactcactttgtagaccaggctggccttgaactcagaaatccacttgcctctgcctcccaagcctgggattaaaggcgtgcaccaccactgcctggctgtttattgtttttaagatatctccagggggctaaagagatggctcaggggttaagagcactgactacttcttccagaggtcctgagttcaatggccagcaaccacaaccatctttaaaggatctgatgccctcttctggtgtgtctgaagacagctacagtatctttatttatacacataaataaagtcataaaaagacatctccaaaatgtgctgtg

SEQ ID NO: 22448 - DNA, 1321 bp, Mus musculus
gaagggctaaaacagtggcccagctgaagagcaagtgttcttgcagaggggttcagcttccagcacccactaggggcccacatccataacctgcaaacagagtacccaaaaacataaaataaacctttttaaaaactgtttttaaagattagaagaaaacaccttctgacagtgagtgtttcagacatgggcaaagtatctgattttctttctccaaagtaacatacatgtttttcttccagctgaccctttggtgggaagtattgccactcagtacatgaccaacagagcagaacacgacagaatggccagacagtggaccaagagatacgctacataaactgggttttcagttcttacatgacttgtctgtcacagaagagagctgcttatgattttgaaagggtgggggtgggagttggtaaagagtaggctatttctatatcagatattattcagtcttacttcccaggattttgttgtaacttaaggtatcttgctacagtagacaaactggtaatagcgacttttagagctgaaactttgcaagattagctgacttttagtacaaaagaaagcatgtgtagatacttgtgttccattgatcagcttaaatttgtataggtacatgtcatttatgtaaagtcctattttcttgttcaaaaaaaatggaatttgtttttccttcttaaaaggaaacaatggtatttaacaagtttgcaaagatgagtttgttacctcgtatatgtaaaatggacacctggctacaagacaccatgtagttaatgtattttatcttatatgcaaattacttcaagggttgaatcacaatttgtggaaacctgtagtgaaataccttaagctgttaactgtaagtgtggaataggaattgttcagtcaattggtttagacttcttacgtctgcatttgtgctaataaacaatattaagaacaactactgaccctgctgtgttcatttcctctctgcagtctttgcttctgaaagcaggttaaggaatacttatcacttaatatatgccagagctgatacttacacagcacattttggagatgtctttttatgactttatttatgtgtataaataaagatactgtagctgtcttcagacacaccagaagagggcatcagatcctttaaagatggttgtggttgctggccattgaactcaggacctctggaagaagtagtcagtgctcttaacccctgagccatctctttagccccctggagatatcttaaaaacaataaacagccaggcagtggtggtgcacgcctttaatcccaggcttgggaggcaga

SEQ ID NO: 22449 - DNA, 1150 bp, Mus musculus
ctgccacaggatggggtgtgggatggcagaatttgtagacaaggatgtgacctccaaacaggactgggacaagtactgccactactttgctgggctggtgggaattgacctttcttgtctattctctgcctcagagtttgaagaccccatagttggtgaagacatagagtgtgccaactcaatgggtctgttcctgcagaaaacaaatatcattcgtgattatctggaagatcaacaggaaggaagtaagttttggcctcgggaggtgtggggcagatacattaagttggaagactttgctaagccagagaacgtagatgtggccctgcagtgcttgaatgaactcataaccaacgccctacagcacatccctgacatcctcacctatctgtcaaggctccggaaccagagtgtgtttaacttctgtgctattccacaggtaatggccattgccacactggctgcctgttacaataaccagcaggtattcagaggaatagtgaagattcggaaggggcaagcagtcaccctcatgatggatgccaccaacatgcctgccatcaaagctatcatataccagtacatagaagagatttatcactggatccccaactcagacccatcatcaagcaaaaccaagcaggtcatctccaacatcaggacacagaaccttcccaactgccagctcatctcctgaagccactactcccccatttacctgtcatttatcatgctcttggctgccctgagctggcagtacctgagcaccctgtcccaggtcacagaagactatgtccagagagaacactgattttgtttagccggaagtggaagttcccgtggagtgggtttttccttttcctccagctggatttttgacttcccttgtttttcctcctactctaaaatctttgggagaactgagtgtgggacctttaggaactgggcagaggaaaggatgccttgccctcagcagcctggtgctggctgggacttggttcctctgcctcttgtagccactggcagcacgccgactgctgcactttagatggtgaggccacatgtgatggtcacaagagcctagtgaacctggctagaatgctgattggatttatttaatttgaaacagcctttgaatacctatgacaat

SEQ ID NO: 22450 - DNA, 1239 bp, Mus musculus
atggtccttctttctgtctcagctccaaactttgtctctgtaactactttcatgggtattttgttccccattctaaggagggacgaagtatccagattgtatgtcccaattccggggaatgccagggccaggttgtgggagtgggtgggttggggagcagggtgtgtgtgtgtggggggggggtataggagactttcaggatagcatttgaattggaaatgaagaaaatatcaaataaaaaattgtaataaaaaaagaagtgtgattcatgccactgaaagtataacaacgtaaaaacagaattctaggcctttaggcccaggcttgggaatgtggcctttgtaaaggtatgctaatcataaaagagatagcgacattcctctacccacctgcttcctgggttcaaagagtgctcattcaaagaaaatcacccagaacctgcaatgcaaatgtgctattgttaggggctcttagaagctgtcttgagagttaacaattaccaggtattccttgtgactcttgtaactttacacttccttgtgactcttaactggtatcttccaacaacgccctccccacttccttgagtttcggtttcttcctttaaatacccccttacccagctactcggggcgccacggtcctctacccctgcgtggtgtatgaccatgggcccgagagcgctcttgaacaaaaatcctcttgcaatttgcagcaagacccgtttcttgtgggtgattttggggtgtcgcctctcctgagtcagaacgtgggggagtcctcacgttgtgggtctttcaccaccacttggattagccttgaatacacgctaagtgaaaatagccagacataaaagaattgtacagttcttttatgtctggctattttcttttttaataacatgtccagaatcaatcaataaatccacagaggttgagaatagattagaagttgtctggagctaagaattgactgcttattaatgaataaactctttattttgggggtaatagtttttttgggtaagacaatgctggtggctctgtgacttgataacattaacactaaatcatacactttaaaattactggtgaatttcatgttatgtgaattgtatctcagtccctgaaactaccctctttaagaattcatttgcacctaattcatccccctgccccccgccccccgcccccaagcacatgcagtttcctgcagcagtaactttgtgaaggactttta

SEQ ID NO: 22451 - DNA, 1200 bp, Mus musculus
agaaaattcaccacggtctcagctctacataagaagttcttcatgcgccgggcgtggtggtacacgcctttaatcccagcactcgggaggaagaggcaggtggatttctgagtttgaggccagcctggtctacaaagtgagttccaggacagccagggctacacagagaaaccctgtcttgaaaacccaaaaaaaaaaaaaaaaaaaaaaaaaaaaagttcattacagcttcctttgtctttaatcatttccatgataattcaggcttttggaaggccaccctctcatccttgctcagtgctgtagagactttatttctccttgttgagctgtctcttcatattttccttcccaaggcctgagttagctcttgatatctccactactttgtttcccagcagaaatgcttcctttagccatgcataatctttgttaggtagaaatataatcattatatttctcttttcaaaactcccagtagtttttgtatcctgtctgctaaatttgttgttcatgaaactttcaaagaccctaccttgcttttactcccatccagaaatgctttctcctaggccagtgggtctcacctgtgggttacaacctgtacaaatgaccctttcatctgggtcacatgtcccatattctatatttcagatatttacatggcagttcataacagtagcaaaattagagtcatgaagtagtaactaaaataattttatggctggtctgaccacaacatgaagaattaagtgtctcagaggatcacagtgttaggaaggttgagagtcactgtcctgggcaatactcatccctaagcttgggaacacattatttctcccagcttcacagttactagtgttttcctaccactgtcatatgtcctcttctggttctcctccaagtcctagcacagtgtggtagcttagtgacctccatgccctgagggatcttctctggactttgttcacactgacatggccttttgttaccactgtgccactgctcatagtaagtgccacactggacacataaacccaggaggcctttggagcttgaaggtaatcagccagttgtcatctttgcattttataaatgatgcatgatttgtgatttaccttgattatgttagttggcactggattccaaattctaccagtcctgtaactgcagaagtatttgaaagcacccagtggcagg

SEQ ID NO: 22452 - DNA, 1212 bp, Mus musculus
gttcctggagattatcagttacatatgaagcacagtggcccaggaatgttctgattgcagatccctgaccctgctgttaggcacagaatcactgcctactaagtaagtggagattgtagattttaaattatccttaatactgtctcaaaaagctagtttcccgagaacaagaagagaatttattgctgaaacattacaaaagactagttttatattattgatctgattctttgttgtcttgttttctgttattgatatttacataaaaaacattatggctttatactatgtctctgagtacaccattaaaaaaaaagaattattttagaccaaagaagacttctctcacagtatggtaaacatgtttttgtttgtttatttgctttttgtttttttgctttttttccaacattgagtgaatttggagtctttccaatgcaccttcccaagatattagtttataaaagaattcagacattttcttcctttttctttttattaaagagagcatcttgtgtaaagtcatttgcagattcatatgtgactagtttatatccaaatagcagctctaaagtccatgttgctaatgtcccagagcttgaccccatggtgagctgccatgtgaacactgtggctgacatagtgcagttgagagctgttgcagatgccacacacgtacattttatctccaccacaggtctttaaatgtgttcttcctgttccactgttgcagaatcacaggccacattgctatatttctgtagctgactacagttttgtgttttgctttgttttgttttgttttgttttgttttgttttgtttttttctcccagaaaagcagttactggccgagcagatcctaacctcagttttctacagatgggtcaattagaagacatgaatacagacccctctggggtgggatgctaggatgctcattaggcagcttggagaggagaggattactcataatctcaaggctccctctcttcctgagtagatgggcgagtgcttcctttggctctttatgaagactactctttccctctatcatcctgaactaaagaaagggttaagggatcagatgaaatttgagttctgctgacatggtaagataacaaacttttagaacacacacaacacaagcacctcctaggacttactgtgaagacctcttaaaagaatctggcacattatcagctgaggagat

SEQ ID NO: 22453 - DNA, 1184 bp, Mus musculus
tccatatatgagttcaaagggtgagatgaggagagatcacttggggagagctcatagcctgaaaagagccagaggtaggagttttacccaatcgaagtgaagttcctataacagcatagcaacagtgattattaaagagcagttagtttttctctaccttacctgaagattgagggtggtatggaatatgaaaatgccagggaatgtctagggccttagatagaacttgagaaatttgggaagtaaattcaggaccattgtttgactagagggaggctgggacaccaaacctggggatgatctctcggaggagatcagagactttctgaacccttttgttagctgtgggaaatgtttccacccaccccctgatggtgttcaccaagaccaggaggtacttggcacgtctgacagtgggcttttgggtaaatcaagttgccagtcagtttcaggaagggaacctctagcctgatgggtaggaaaagggatgctatgatacctcgagttggagtctgatgtctgacagattttgcagtgatagattttttaagaaacttaagaagtcttcaggagtaggctgtagatgggtcatgacaaaataagacaatgcttggctgttaggatgaaagagttggtgaagataggacagaatttgacaagtgtcagggggtgaaggggaggatgtggtttgcagtgtaaggatatcctgaggaaggtgagatgagtccaggcccctaagggccacagctgtagctgcctcatcggctcagttgttccccttggagacaatagagtcatctgtctggtaggatctgcagtggacaattccaataactggggagacgggaggcctttagcatggacataatgtggtttgcattagttactgatcctccttttgtggtaagtaaactgagctccttccagatagtgtcatgggacaggaggatatggaaagcatatttggaatctgtgtagatgttgagggattgtccctgtgccagttgaaaggcacaggttagggctattggttcagcctgttgattgatggtgtgggtaggaagtgcctgtgcctccactacctcgatgtctgacactgtggcatagccagcttttctggcccctttctatagaaaggagcttccatttgtataccaggaataaaagacttgagacaatgtgcc

SEQ ID NO: 22454 - DNA, 1120 bp, Mus musculus
accctgaggcccaaccagaaagagaacatgccaggaacccagtgacaccaccaagagcttggtcctggcttgagatgcctcctcagtggatctcagttccaccatccctctagagagaccagaagatgtaggcagccaggtctttcctctgcctccctatgtattctgcctccctatgatgaccacagagatgtcttctcttggcttattaacacctgaacaatgtgccatttggcttcagagccctcaagcctgtggttttagaagtcagatcatgaattcaatgtccacaatacttgggtgctctggagatactcagatctttaaccctgtcactcaaggcccatgtctttggattaaaaagtaatgcagggggagcacatggtcaacacactgatcaattctccttacttaaagaccaaacacccagatttggtaataggatccagtttctgtctgggtgtatgtagtctcccctcccctagcctgaaacctgctttctcgggatggagcttcctgctcattcgttttgccacgcccactgctggaacctgaggagccacacacgttcacctttctactggaccagatattattcggcgggaatcgggtcccctcccccttcctttataactagtgtcgcaacaataaaatttgagccttgatcagagtaactgtcttggctacattcttttctctcgccacctagctcctcttctcttccaggtttccaaaatgcctttccaggctagaacccaggttgtggtctgctggccggacacaacaggtgtatcaactctgacaggtgtatggtgatagtaaagaagtgcctgtcacccacaacagctgataatgaaagttaaggttcacattgtcagggagaggaggtcagaggagttctgagaacatgaggtcatggcctagaggacaattctctccctagtactactgtcagatagccactgaagctaaaagaagccatgagagtgaagttcagtaatgccctgatctaaactggcataggatagacactaggtgactcctgattatctcattatgtccctatgtaacatccacgatccccaataaaagtaaaaacttgaagttcacagcataacag

SEQ ID NO: 22455 - DNA, 1066 bp, Mus musculus
ctgggttccagggtgacggacggagctgtgtgggtgagagacatgttctccatttctgtcgcatagtcctggttttcaccttctctttcctgcatcaggcaatgattttagcctctcttaatctgggcaccatcatatgaaagcggaggcagagtctggctaggtttgggaaggtagtttagaggtgggtatttgtgttagagctatagaaagaaatcatcttacaaaaaaatataattgtttcacttttctaaagtattcaaaaattatcttcctatggcttaactggaaagatttgaaaatggttgtctttgtttctgatgaactgcaacttgggtctttctgcccagtgtccaaaactctcaaatttctatgctttccatttgccaacaattatttccactgaagcatcagagtgctggggagattaagttcttggacctttgtttctggaacactcaggctcagtgctttctgtcctcatttttttgcctagatgtcaatgagtgtgccactggcttccaccgctgtggccctaattctgtgtgtgtcaacttggtgggaagctacaggtgtgaatgccgcagtggctatgaatttgcagatgaccagcacacttgtatctgtgagtaccagaatccctcttcccttcagctaggaggctgctggaccccaccttgtgcttcactgacgtctctaccgtgcctgttacaatgaggctctggtgtgtagcgtttctgaagtatgtagccctctgctgcagtatgtagccctctgctgcagtatatagccctctactgcagtatatagccctctgctgcagtatatagccctctgctgcagtatgtagccctctgctgcagtatgtagccctctgctgcagtatgtagccctctgctgcagtatatagccctctgctgcagtatatagccctctgctgcagtatgtagccctctgctgcagtatatagccctctgctgcagtatgtagccctctgctgcagtatgtagccctctgctgcagtatatagccctctgctgcagtatatagccctctgctgcagtat

SEQ ID NO: 22456 - DNA, 1149 bp, Mus musculus
cctgaggatgttctcagttgggattctggagtcacaggaccagacagcaattagtaacaccccagctctagaaagaattcatgttgaaaggtacctgtcttatgtgaggagccaaagatccccatccacaataaatatactctctatggatggatctgaaagacctagaattccaaatttatccaattgatggagctgataataatacacatttcagtctccagtaagctgacagagtaccaatgggactgggaactgtatggggtgtggctatctgtcggaggtgtgcagtgctctggggagatgcaagctgtaacctgcatctgttttgaccacttattgtcatgtctaatattttaaacacaaacatacactagcacatctcaactctaataggtacatgaaccttgagctagaaatcttgctaaaattgagattctgactgagaccccgtattccttaagctccgcaggtgtgccgatgctgttagtctgtgggcgggacgatgaagagaaaggttcgcactcagctctaaactctcactttctttccagtgatcgccccacctcccaacccttgcctcgatggcagtcacacctgtgcccctgaggggcaagccaggtgcattcaccatggaggcagctcattcagttgtgcctgcctgccaggcttcattggcactgggcatcagtgttctggtaagtacctgtgggtgactcttgaggactctgcatggtccctttaggtatacatcctcatagagacacagcttctcccctcctgtgactcatgcagccttgggattgctgaaagagaacaggcatctttagagtcaggagggagcccaggggtgttcttcaggcgccagactggtgaacacccatggttgtcttggagtgttgccatcagtttggaaactttctgttccttggagctagtgtaggctggagggactcatacctacagttctaactaaattctcccaccttcatcatacacctagtgagatgggctgttatgttggttaacttggttggttggttgattggctggctggctggcaggttgcttggttggctggttggttggttggttgattggttggttggtttgtttgtgacaggctttggtctccctttgtagccatgg

SEQ ID NO: 22457 - DNA, 1145 bp, Mus musculus
atggcccaggcactcctgagtgtcactgagggttttctgttggggtttctgaggtgggaataaagtcatctcatcaatatgctgggttgacttatcatcaaggtatctcaggatcccaatctggatttaacactggctttgccactgttataagaatagcttgtctcaggccagagtgagactattttgccccccagccctgggtgaaaggggacagtaccaccctagggccccagggtacatttggctgctgtaccacatcctaaaaccctgcacttggttagaaggctagttatctttatcttttgagtaaatggcagaaatatgagtaattaatcttcaggaaaaaacaaaacaaaacaaaaaacctcagaaaccaggatttctttgaaatatgttccaggaagaactgggtaattgtggaggttcttacatacagaagtaactttcctccctctgtccaccttcccacaaacaggcatacccaccgtcgctccacccgtggtccggcccacaccccggcccgatgtgactcctccatctgtgggcaccttcctgctctatgcccagggccaacagattggccacttgcccctcaatggcagcaggcttcagaaggacgcagcccggaccctgctgtcactgcatgtaaactgagtttctccaggagggctgggctccacgaggagggtggggtctgagatgaggagggtggggtctgggatgaggagggtggggtctgggatgaggagggtggggtctgggatgaggttgcgccttcaggcttgtgggcctggaggaactgagctttgtggttttcagagggaaatgcagtgctgtgcagtgcagggactcctggcatgcatgcctctgggcttcatctgctttagtggggctcagttgctggaaatcatgtctaacccactctagccactatatcctgagggcatcatgaaagtccaaatagcggaagaatttcggagctgttggctgttcatgggaagatcattgttacctcaggttcctgggggttctgttctggtcacagacatttggaagtgaaaacaaaacaaaacaaacaaacaaaaaaccacagaggaggtggtcatttgagacatcagggtagaaatcaggaccacttgtca

SEQ ID NO: 22458 - DNA, 1740 bp, Mus musculus
tattaagaggcaggggtggctacaccttgggctggggaggatttcattctgttcacccagtagggaaatcttgttggcatgtgttagcagattttagaaagggtctttaagaaagtgccaggaacacttagaagcgttcatcttttgcaccattaaatattaagggcttacctagcgggatgctcctctcatcagggaaagggctggtttttctcatgaagtgaccgtgttcacagccagtgctaacagtactggaggagcttgctgtctggaggtagtcagtggggccctttataaatgccttactgactgccgttttggagaaaatgaaagcatgcaggttaaacggctgagcctggctctgatccgagggaggaggctcccccagcaccgcaccaccacagcgcaggttgttcacagtagtgctgtgtagccgtgaacttaaggttggggattcaggaatcctaatccttctgatgtcaccattggtcctcaaagggctccatagttgtggggattgactatgactgccgggagaggatggtctactggacagacgttgctggtcggaccatcagccgtgccagcttggaggcaggagccgaacccgagaccatcattacctcaggtcagcagctcctcccatggatacttggcggtaccttgtgtgttgcttccgttggcctgtttggtcccagtttctcccacgctcatctaaagggaaggttaagttctctgctggtgactttagaaaggtggtttaggataggatgaatgaactgccactccaagagtggttcgcagtgagactgcagggtctggcagtttagattgcctgtccctagcaccacggatgccaggtgccatcagggcagcaaggtccagcacagaagagactggatatggtttaaaaagttagccttcgtcctggggcttaaggcttttctgttctatgctctggattctgtaagctgctcagcagacggggaacttgatttcgccttctacaccagccaatgctcctgtcttacttttatttccaggtttgataagcccggaaggacttgccatcgaccacttccgtagaacaatgtactggacagatagtggcctggataagatagagcgggccgaactggatggttccgagcggaaagtcctcttccacacagatctggtgaatccacgagccatcactgtggatccaatccgagggttagctggctttctttggtctctcatgcagatctgttttggagaccctggctcttatatatgtcatgggaaggtctagatagaccagaataaaaactcaaatacagtaattcaccagatatgtagacccgctgctgggtgtcaagcattcttgtaggcaaaaatcaggggttttttttgttttttgttttgagcttgcatgcattgtacaaggcattcggaagtaagatgacattcagtaaagatgttagttagtctgggatgggatgtgtcacacggagaagccagaccccatcatggagaatccagaggatgcctgggtcagacgatcattaggcagggccttggaaaaggatgggtctgcagagggagttgtttccttcagccgttccctgagcagaaacaccacagcagggtttttgggtttttttttgtttctgtttttttctggatggagagtgtacaacgtcaagataaaaatgttctctctgtggcagtgccaaggccgtcaactggggtatccag

SEQ ID NO: 22459 - DNA, 1733 bp, Mus musculus
aaacaaattatagataataataaatgttttccttaaagactaaaaaatgctatttgactccccgctaagaacgcttcaaaacagaacataggtgcacgcctgaatcctttcccccattcctacagtttcacaagacctaatggtagtacttgaatagaccccatgggcctagccagaattaggaactgatttaatcactagttcctatggccacagaacataaatacattctgtgtgctgttctagggttttgacttagagaatggccagggagaaggaacagtcgtttgcatttcctgtaagtacctaactgatactggtggaggggctacatccagaatcattggtatagacaaattgagtcaaaacacatttagtggaattgctttttaatgtattatggaaaagtgcccaactgttatctactgaaacttgaccttgtgactgaccatccatgaatccttccttccttcttttcctagggatggtgttatatcagtgaataaggacagtggccagtttactgatgagtttctccctgagcagcggtctcatctctatgggatcactgcagtctacccgtactgtccaacaggtgagtctatcaaagtgcatcatgaggcttccttggaccagcgggtagagaggggctgtgctaactgtcagcactgcgttccttaactaatgatacactgctgtccactcccctcacaggaagaaaatgaacactaaatgtataggaggatttcaagtttacaagaatcttgtcctaagaatatttgctacgaaggcaaagacagtggaaaaggaattggccattatgagctcttggcacacaagtgagcattttcagtgcagtgagactcaagtatattttgtgaaatgtatacctcaatctttactactgtatttttaaaaacaaaggttatcacaagtttaaaatagaattttaatcattgcttattaaatcaacttttgtaaacagttatttaaaaggccaaattcattcaacatagaaccaatgagagcaaagacactaaatctgatttttgtttgccatggattctacctggccaagaaaagtaaagcaaacagatggctatgagaactgattcctgaagcccactgaggcccgccacagacggaccatggggttggcccagcgaagtcctcagactttatttatactaaggtgctacaaagagtccccaagtgcctctacagaagtatccctcaaaagtactccgggtaaaacaccaaagatgcagcagttcttcaattttctatataattccaataaaatattttaaagctttcttgtggtctaaatatctatattgtctccaggacaaagttaagggttggagtgaatgtaaccataaagggtgcacaataattgtagaaacagaatacatggactcaaaacagagcaaaacaaacaagccttttacttctccaactttattaaagaaaaagcagcggtggtaaatctctagaacatagtcaatctcctggggttctcccttcaaagtgtgacatctgatttccaagcacatgctggtgtaatggttcccatcactaggcaggtgagaagctgacatcctcatgtgctcatctcccaacttttcccagtctgtggtctgtctttggatcagcaatgatggcctggacggctactatggcttcattaatttttgtctgtagctctctgagctcttctatgtgcagcaacc

SEQ ID NO: 22460 - DNA, 1156 bp, Mus musculus
atttatttatttatttatttatatttttagaatttgagacaggcttttgacaagctgcccattgtccctggacttaatttgtagctcaggcaggtgtgtgacttgtggttgtcctgcttggcttctgtaactgggaccgtgccctgcttctgtttaatttctaggtacctcatagttgtgccctgtcgtccctccatctgcccctcccccctttacctgttcttcacttcttcagtcccaaacttaagaggtctaaaagactatatttcctaatcttttgggaagtagaggaggaggagggtcaaaggtcagggccagcctttggtgcattaaagcttatctcagaaacattactgagaagacccttgtgtccagtgtaccagtaaggacttaaacttaatcaaaaagttacattattttttttgaaattttaattgtagtgaagtataataatttttgagtggatatcataatctggctaaatgacattcagtaaataagcaatatttatcttaatcttaagttgtagttattttaccttgttgcttgttttttatagctgaaaagtacaaggacttagtacctgataacaggaaaaatactgacaacgcagctaaaaatgcagagccactgatcaacttggatggtgagtgtggtgcgtacaggtggcagccctggttttgtagctgctttccacttgtatgcccaagtgcaagcccaacaggagtgcatagcagcctctctcctgtttgagactcagttgcagtgagctttccctctctcccccatcccctcaacacagaaatttgaatgttaaaagcaatggtgtttatttttttgcttcaagtaatttggattttgatttcttgctcattgtgacactcattggttaccttcctggcaatataatttatttttttaatctagtgacaaatggtaaaatgtttcattattacaagtcccacatgcccttttagcaatttccatttaaagcctgaagattatggaaatcacctagagtatagtgtgttaaataagctttccccgactgttgcattgggacctgcagtaagctattttcaagagggaatgagcttgcatactccaaagcctctgtgacaggaaggcacatctggggaatgcacccatcgagtgc

SEQ ID NO: 22461 - DNA, 1141 bp, Mus musculus
cttcttttaaaagttgcactttttatctaattgccctgtgcattgggacctggagtcaaagctaaggttctggtcccagatctaagtggtatggccagtgttaagtatcagatttttgtaggttgtagtttcgttgtctaaatgagattattcttgtatcttgtcctacctgggatctccagttacaaatattttaaaaaggattattttattgttttcttctaagcatttttttttctgacctgtataatgacatcaaaggtttaataatgatcgatgtggtggcgcacactgagatcctggcaccaggaaggtggaggggagagaatcaggagttccaggccagtcctggatatctgggattcaaggcaggcctggaagaaattcttaaagctccaaactgaggcctctgtcggtctgctgttctgtgttctgtggctctatgataatgaaatagattttttttccccctctttcccttcacagtatctcaaagatgttaactgtcctttcaagattcaggatcggcaagaagcgattgactggcttcttggtttagctgttagacttgaatatggagataacggtatgttttgtgcaggatatagggtgggtgttggcttatggggcttcttaaaagatttttatttttaattgtatatgtattatatgcattcctactgtattcagaagccaggaaaggatatcagatctgcgggagctagagttacaaatgtgaactaccatgtgggtactgggaatctaatctaggtcctttgccagggctttaaccgctgagacagcactcactccagctcatctttagttcactgttgtggatagtttttagatgagaaagaaggcggtgggaagaggtttcttatcttgtattttgctcttggtttattttattacaaaaagtggacctgctttgtttctgatgctttcattattttttagaatttggaagttgttttctgaaaaaggttaatagaattccttaacaaaggaacgttacttggttaatttgccagcttccactgcaactaagccattgacactgctgccaacatcagagcccttggggtttggagtattggttgcagcagctatttcacaggagatagaaacatactggtgt

SEQ ID NO: 22462 - DNA, 2102 bp, Mus musculus
cacgggctgggacctcaaggggatagactacccaccatccctgcatccctggcacctttggtggtctattccaagaatcgggtgcccagcttggaagaggtatctcagactctaaaaaacaagggacatgtgtcaaggccacttggtgaggaggctggggcacaggcccccaaggatagttaccaaacctctgaagtgtttattaaccaactggaccgtatcagtgaggagggagagccgtgggaagccctggactaccacccgctcatcttccaaaatgccaacattacctttgaaaatgaagaaaccggcctctcagacgaggagacctctaagtcttctgtggaggacaacctgacctcaaaggagcagcctgaacagggacccatggctgaggcacccttgagcagcacgggtgaattcccttcatccgatgagtccaccttcaccagcaccgagtcagagctctccgtgccttacgagcagctgatgaacgaatacaacaaggcagataaccccaggggcacgtgaggtgggcctggctccccacttgctttccagtggcttcctctcacgaggattgtcctgtgatggccagaccccagggagaaggctctggaaatgagatggggagccagggacctgcctttccttctgtcctctccacttggttgcttccatgggatgtggtgttggcccaggacaggcctccgttctgtggcccagtagggaggctgctgtcctgggcctgcccggcaggtgtattgctgattcaggcacgtaggccgcaacactcaccctggaggtcctgggtttgctgcttgtgtcttcccccatcactcggttgactgttgtacggttctctgaggccaggagcttcagctgagttcaccagtgttaatgggcaacgcccttgtgccttgcactaagctagacatttggaaggaggagctcataagacccaggtttggcatgtggttctcgggtgttctgggaaagcacagatatgatggggtttggggcctctcagtaccccagcagtagcaggacctgcttgcccaagtaggcatcactgcccagcaagccccttactgcaaacctcagggcaggggatgtaggggagagctatgtgtgtcctctgtgtggagtcatgcccacctcagattccctctgaacaacaacagcaggccaaagggtccctgtgccccgaaagtgcagaagaaagatggagcctccggatgtggtcagggagctcagagatgaggtgcaggcccctcagccccagcctaggcacccatactcccagcccaccgtctcatttcagagagattctctcactgcctctccctcctctcttagtgggggccaaattgttcttggctcatagaactgtgaattgagcccccccctccagccactatatggtattagcatgtgtaactgccaatcaatgggcatgcgtgtgcacatttgggctggggagaaaagaaaatgtgaatcttactggtccagttcctagcgaggtctgggaactagctgctgtatatgtccttgatgctcagcccactctggcctaaatgctttttgttattaatattttttaatgaactgttatttttatacccagagccagtaaagaacagggtccctgccattagaatggaggtctgtcaggcactctgttgtccttccaactcagcttgtcctttgtcaagccaaggtctagctacggaggggcaggcgcaggtctcgggtgaggggcagctgataacctgcctcagccccttcccctgctgtgtgcatttgcggaggggcatatagggccagagcccccacacgttaggacagtgagaggtgtgtatccatacctccaccattatcaaagcggttgtagaggccacagcagcctcggtggggggaagagccaggctcctgtgagaggacctcagctgaatgtcctggcggcacaccaaccacgctgtgtgcatgtgccgatggtgaaggcagatgtaatttattttaacatttttttacaataaaacacatgaacaagcccacttggtgtgtggtatgtttgcggtgggagcacggtggggccgtgg

SEQ ID NO: 22463 - DNA, 1147 bp, Mus musculus
ctgtaaaatgtttcagctatataataaagaactgctacccaccttggtatcctggtggttaaatgaggacacttgagatgtgtggctgctgctggtggtattagtttggggcaggggctcaggtagcccggcctggccttgaagcataatcctgattcccttccccctgctttctttcttccttgttgggttttggtttggtttggtttttgagacagggtttctctgtgtagccctggctgtcttggaacttgcactgtagaccaatggggcctggaactcatagatttacctgtccctcctccttagtgctgggattaaaggcatgtgccaccattggcgggctcctctgtttcctcgagtgttggcattacaagtgtgtgccaccatgccaggtttatgtcatgtttggaatggagcttagagtatgtatgtttgctaggcaaggtggactccaccttggagctacatctcttgtcactgataaatcctcttgtctctgaccttctctttggttttcttttttaggtggtgtctgatgctgcggatcagggtgtggccatcaccgggaaccagactttcaacaactggaactggcccaatgcaatgatttttgctgccacagtcatcaccaccatcggtaagtccccgaacaccttcagtacaccaagatccacatcctcactcctcagaaccgtacaggaatccagctttggtgactgtaagtttcaccctggccttttggttaggaaggacttagtaagtcccgagtgattggccatacctatgcaaccacttccataggtcctgatttagactgtatttttttttcattatttctgcatgcctatgtgtgtggtgtgcacacatgtgagtgtgtgtttgcatttgtgtaggcacacatatattcgaggatatatgtgtttggtggtccaaggttaacatctagtatcttctttgattgttctctaccttatatattgagatgtggtctctagctaacccaaaaattcacctagtctagctagtttgttctagagatcctatgtctgtgccaccgtttgttgggatgataggccacccacctcacccacccagcctttacatggctcccaaggttctttattccatttggactcttcaagca

SEQ ID NO: 22464 - DNA, 1209 bp, Mus musculus
accgggaagcaagcgtgcacgcatgcacgcggcagggcagctgagctgcaggtgagccagctctttcctaggttgtctgccgtggatggggagttgaccagtcagcagttcccacggtgacctcctttgtagcctgctcaaggtgctgtttttagaaaccttgagcaatggcttcctgtggtcactccttccatctctcctcaaggtcggactgaattgaatagagtggggagcctaagtgtacacgaaccctaaagttgtagtcaagattagataagggtgtgtgtctcctggagtcttttttaagctttacaaaaaactttcctttgacaattccgtacagtgttttcagtcatatccaccgtagctcccccccttctccatagttccccccaacatgtggcctgcctgctatcacgtccccctaattagcgttatctgtgtgcacatgggcaacctacagggagccacaatccctaagaaaagtaatccctcattccctagcaggcgtgagctgcccagctcctcagctagggcggatgggtcctcatgagccatgctggagttactgacagaccttgtacaggtaaccatcgtggccgcgagtccctgagtgtaacagcgtgcgccaacctcgagacagcacttcttggcattcatctgcctctgaccctcttttatagtattctctgcatagtccttgctctgctgtaggtgacaggtgacattccccaacacagtaccagggttgacactggagaatcaggtttttctgtgcaaagggactctactctccctttggcttcttatggctctgccaccagcttgcttgtgtggtttcaaccatgtcacggaccccctcagcagattcctcacgtataaatagtaagagaggtgtccagggctctctgggtattctggctccccttgaagggtcttgtgctgtagagagagaggactggtgtctgctgtatggaggagcgggagatgctgactgacatatgagctcctacagtttgatacgggagagtgagggcacaggactgaaaggcctgcctgtttgtctggaagagatacattcaacacaggggctcttcccagagccctaaaccacccttggaaggaaacctctctcgcttgtaaagcacatcccaagcctggtaggcctgtggggcctaactgaagccattaccctcttggcattggtca

SEQ ID NO: 22465 - DNA, 1193 bp, Mus musculus
tgatgagaatggaacctcaggtctggcatatgctaagcaaatgcactctcgccaagccacatcccaactgtcaactgaatattcggttttactgtctttttttttttgtatgtatacgggcattttaactgcatgtatgtctgtgcatcatgtgtgtgtagtgaataaggaaggcagcagagggccttgcatcccttggctggagttgcagatggttgtggggtgctacgtggctgctgggacttaaaccctagtccttctggaagagcagccagtgcactcgaccgttgagccagctctccagcccctcgatggaatattttcaacatgaaagtgggtggggaaggatggcgtgggtcttccccttccaaagcccccagagaggtataatttagcaccatggtgcttgaggtgcagccacaggccagagaggtgagggtcagatgacagagccttgtgagtgtagccaaggaatttgaactccatcaaatgtttgccattttcaagaggggaagtggataacattacagaaagttccctccttcttcacagccatttacaacttgcaaacagtggaatattctgactgaaattaaatttccgtaggccgagccactcactctgtgagtgttctgataaggacgcctccttcctttcagcttctggtgaaatgggagtgtggcttttcccagaagctcatagtctttagccccttcttcacctcagacctcattaaggtgcctcttttcctgtgtaggtcagggtctgggatggtctacccagacactccattccaggctacctttcccagccgtccttcatgtcctcttgtggaaaaggacaggataccaaagttcttcttgaagccttttgtgagacttaactccaatccttaagtaaccaaaaaccccaatgggcgggtggtgtggggggcttctcttgctggccagcttttctgtgcaggaagcctcaaaaaaaaaaaaaaaaaccaaaaaacaactggagggtcttgagcccttgagctcagtcttgctggggagaggaaattgctctgggggtggcagagtgaggggaaatgcagactgacgtgccgagtgatgggtgacagatggtggaggccagaggggaggacacggttgcagggccttggaagtttcacttgccatttccagaagtctgcgcaagaacccttt

SEQ ID NO: 22466 - DNA, 1182 bp, Mus musculus
aagttaaagtggccacaagggcaacagctccagtcttgggggttcccctacagcaatatccacctttgccagcccaccgcaggagacttgctgtctctaagtgacctgagttaattggttcagcttgactttggactgctgggaaattctattttttgtttcccttggaacaggcacacagtcttctccagtgtggctgcctgattgactcggcactgtctccgtcactgaagctgtgtgtacacccttcagttctgcacagctgtttttagaagtccctctttcttctccctcccggaaagctgaggactgagttaaattgacaggctgacaattcatctaagtcttttaggtagaaggttaaacaaacagtgttatgccttcatacagaggcgtctcaggaggtcaggtcagagtggagaatagagaatagtggggggagagagtcttaactttgtggggtgtcctctcttagcctaggaagggtcaacaagcttcttgatgggatcatatgtcccactgtcttctgagactgggatagggcaacaggccttcttttctgccctggtatcccaaagtgagccctggcgttccctgaaccccctcccagcttctcaccacattctaggggattttgggtatacctcctttcttttttttaaatttatttattgttatatgtaagacactgtagcagtattcagacacaccagaagagggcatcagatctcattatggatggttatgagccaccatgtggttgctgggatttgaactcaggaccttaggaagaacagtcagtgctcttaaccactgagccatctctccagctccctggtataactcctttcatggttaaacccttaaatacatcccagttttgaaattctgacatctgttctaacaccaaccctccgccaaatttatgaaaaaacaaaactgtggactgtttaatgacttcagaacaaaatgttcaaagcgaagaatattgaaaggtttagagaaaaacttctctgagcccagttcaggggaacagagggttaatacgagcactcactttgtttcaagccaaggtggacactgtgaggctcactggtctcacccacctttggtaaaagagtcattaggtcttttgagccttgatctaaccctgcttgaattctcacagtctagaactgcaga

SEQ ID NO: 22467 - DNA, 1182 bp, Mus musculus
taacaggtccctactaggtagcacatagtggtggtttctgccttcattgtgtcagtgtgtcagtcttgaaggagctccaaggcagcatcctcatctttgatgggaataaacctggggagaatgaaagttcagggcggtggctggaggaagggagctggacacacaccaggggatgcctttgatgcatacaggaagccgtcctcaggagtctcacagctgaggaacaagaaggctgccagtcagaattccccagctctccttgcccacaagtggagaggaatcctagaacaacactgggggcccctttcaggggtcccaccactttcttgaacatgacctcctctgaccctcagagcacacttagacctctttactcccccgcccccagagaagctgggggtggggggagcagcagatcccaagggcttcatagcctgtcatctctccggtggcatggactcccaccgagcctggttcttctgccagatcgtgacattgtgggccagaaggcaggaaaggttcgtcccagactcacaagactaggaactaatttttgtttggacttcctttacctctccagtggcaggggtgtccccaagttctgtgtcctctttatagcattaagggtgggggtgggactgtgagccccagaggttgaggggagtccctgagaaggacccgcattggcagagggttcccagcacccaagtcttactgccacccaggaaaggattgaaatatgacgtctctaacaccccgacacctgctggaccccacttcttttctgggtggatggagatgcagggacttccctccaaagcagcaaggaaaatttgggtccggtcttcttgcctgctagcctcccagcccgggacagcacagacaaaccatacccccctccccattttatttcttatagtacactggctgtagcgagatctagggtgatacaaggaagcactcggaggaagtccccagcccctcagcttaggcaggagtcctgtgacaataaacttggctgctgtttcttctctgcagtggattgcaggagtctctcctactgcacggaggcgccggggtgcagtggggtgagggtgggagagaaggaggtttctgagcccttctctcctgtggctgtggctgctgcccaacagtcctctccttttctctgatgtggggagg

SEQ ID NO: 22468 - DNA, 1101 bp, Mus musculus
tgctgggaatcaagcctgggtcttccagatgagcagcaccgagccatctctccaacacctacagacacgcactcccgtgtgtggcagtcaaaggttgactttttagtagccgttgttgctgcagatcaaacctagggcttcctgcttgatagagacatgctctaccatggaggcgcatcctcagcgcaaaagttagggttctgtttttgtttttaagctctgaagggatgagggaagtgggagcataggtcttccttggagtattctgcaggcgaccagaggtggcgttcttttgaagtagctaaatcccagaagggtgcaagataatttatgatttatactgtctttccttctcttgctcactcagtttgtgacctagggaaaaagactaaacatgaaacacacacacacactgagggcgctgcttcaatgaggaattagtgaggataggcaagcactaagcctgaagcctgaagcctgagtcgggattccttcccacaaatatgaccctgcacccccttcccttcccattgtactagatgcagacctcatgcatctaggccagcctgtcactgacctgtatcctagacccgtgtcatctgtaccttgccactgtaagggagaagtttctctggaggaattaaatttcaatgcctttattcagactcttttcttctcctcctccctccttctcctttttttttttttttttttgattcgatgacccaaagtttggaaaacgagagtggggggggggggatgggaaaagacctttgtgtgtaacggtaaaatatttaagtttaaatttccaggaaaatgtgcagacgaaaccatcagagagtcagttgggaagagtggctggggcaagtcctaacttcaggtaatggcaccaactgatggctaaaaggcaaaagacccaaccaccctcagcttacacagtagagccccacaacaccaggcagaagtttctggaagtgaaaaagtcaaagctttgaatttcctttgagcatcctgcagtcagaaaacagctcagggtctgtgtgcactgccagtccatgccacaaagggggtgtgttcagggtctgtgtgcactgccagtcc

SEQ ID NO: 22469 - DNA, 1254 bp, Mus musculus
ctatctcatgttgttctctctctctccttcccttcttctttctagaataaggaccctccatcccacactgcaaatgacaattcagatgaagaagattctggtgcaggagattgcgctgttgaagcagtggatgtagacctgaacctgatttcaaatatactggaatcctacagctcccaagcgggcctggcaggacctgcttccaatctgttacacagcatgggtgtgcgactgcccgacaacgctgatcacaacccccaagtcagccagtgaaggactagcctgcacatcagccacccttctcaggaataaacgactcttcataagcacgcctttaatcccagcactcgggagacagaggcaggcggatttctgagttcgaggccagcctggtctagaaaatgagttccaggagagccagggctacacagagaaaccctgtctcaaaaaaaaaaaaaaaaaaaaaaaaaagagcatctgtcttctgtgcaggtttcagagtccccgggccaccgtctcccaagtcctgtgacctggacaccgattctcatgagcttgtttgatttgttttacatttgcccaggacggaatctccattgtagtaaaccactgtgctgttggctgttggtgtaattctgaatattcagtttctcccttaggtatgttcctcctctggtcagaattctaagttggcaaaaatcccatttcattcactttttaatgaaatagaaagtgctaaaacttagtgttcagtctgtgacattctgcacgcgctcctaattgagggtaagaacttattattccttaattaacaattaaagacattagcagacagactgggtctgactgaggcatctcacacctgggtacttgcttggcttctgtcccctcctctacccaggctgccctgcttcgtgtctttgtatatacatttaagtctcagttccacatgtaaggagatgttctttttttgtcctctcttggtcccctccccattaattcccttctggttccgtgtcacattgtcacatttaccttttttttttttttttttggtttattgagagtctgtggccagggtggcctcatatcttctgttgttggaacacattgaaggaaattgattttttttcatttgaaatttagacttttgcttcctgttcctgtttgtcgtagtgacaagcccttgaccctccatttctacctcctaagtgcaggaatttcaggtgtgggccagcacactctgtctacact

SEQ ID NO: 22470 - DNA, 1074 bp, Mus musculus
tcctttacctcacaaggcagcttcaggtgctgcgctagctgaggggaggagggcggagcaggcgcaccaagcacatttccgagtgtcacggacagtggtggtgcttaggggagaataatcatgaagtctttccctcttgcttctattccagggaagagggatttcatggaaacaaatcagaagcagctacagagaaacagaagttagggtaccctcccattgcgccatttcactgcatgaaagaggatgttcttgctcatgtgtttgacaacgtgtggagcaaggctgtgggctgtatggagcagttgacgcgtagtcactgggagggatgtgcttctggtaaggatcctcatgacaccagtgtgaaaataactattgatgacttacagaccccagtcagtcatttgtatgtgtgtgctgctgctcaaacccagcaccctgtgtgtactaggcaaacactaccaccaagttacaacacaacccctcttctgctttttaattttgagacaaggtttctctgagttaggcaggcaggccttgaacttatgaccccctgcttcagcctcttgagtagctggcattgaccagcctgtactatcaggtctggctctaagacgtcagggcttaaatgctttactagagcagtgcttagagaggagagagagcgaaaccattctttctttcctgtctgcacacacataaacacacacacacacacacacacacaccacaacacttctaacactaagtgtataggggtatccccacacttacttaatagactctgatacaccatctgagtgccctcttgctcagttctcatactgtctagaagaagctttagatccaagggttcagtcccacagcttagccatcccacctcgtacctcgtgtgacactttgaagcctcaagctctgatctgggcttctcgtcaagcattagaagtcacgggaaccctttcttaggtttgatcaatttgctggagtggtgtacagaactcagaaacgtaggcttgctggcttgtaaagaataccacaaagaatatggatgaacagccaaacaagaggtgcaaa

SEQ ID NO: 22471 - DNA, 1314 bp, Mus musculus
acaagtcagagaattgccacccccgctccaagctgtacagctgtcaccaccacagaggaagcccgtagccattgttagtcactggggtgctttactccaacccctcctaatgatgaaatgctttgtctcagtgttgcatattgaaagctatattttaacttctcaaacagagcagacaaaaggatcggcaaaaggaaatggacagttttctggctcaaatggaagcaaaatactgcaaaccttccaaaggagggaaaagaacagcactcaagaaggaaaagaaatgatggagtttttctcttcctgagtccttatgtgtcagtggtacagtgtagacaaaatgatgacagccattaatgtaacctttgagaggagttgtctgtcccgcctaagccgagcagggttcatcgacctgatcttagtagtttctagaattcgcctaacactgtgtgagggtttcatgtgaaggatgtgtagtggtgatagttgggagggtgggtctgacatttgcttttgtgggcccctatttagaatattagtttctcttgctgctgtgcatgcactgacgagaaacactccacctatggagaacatcctcagaacacttgctgaaccgctgacttctaaataaatgctaccgtgcttttgggtcttaatcctacacggatcttcttttcttggtctactgttaggttttgtcttctgtccttgcagtaggagacgtcagtgttcatattattgcaaacttttcataagactgtatatgctaaataaagaagaaatgacaaaggtctggtggattatttaaatgactccattggtctatgaagataaagtgttttatttaaaggacttaagtaacctagtcagcattgtaacagacaggctggctttggcacacatcctgtctttgcaggtcacaggcttaggcatttcactggcctcttttgaactttttatctacaagagtgagagccaaattcattaaattgcatttattaagtacagcaggatttttatgtgttttgaactgttttgtgtggcttcagatgagtctctctatgtagctctagctagcctgcgatttgctatgtaaactataatcaggttttttgaagatgaatactaactagctttaaggggacacatacacaaaagggtaaggaactaggctaatgacctgagggtactctgagtcatagctgctcagaaaggccacgaatgtagatctgataacagtgtattcattgtacagacttctgagaaagatgctcattacatcttgagttgataactgttcactatagtatgtgg

SEQ ID NO: 22472 - DNA, 1195 bp, Mus musculus
ctgtgtgtctgtgtatacttgccttgcttctgcctttgtgtttgacaaatgatgctgctatgcttgtggtacacactaatcccttcaaggccctgctacttcgtttggaaatttagcaagaaatggagttgctggatgatactatagttctgtagaaccgccattttaaacaccatacagctttgcacagtaactaccccatcttacattcccattaggaatgtacacgtgtttccatttcttggcatctgtaccaacactcactatattattaatattatataaagctgtcctgttatcagataactagtgtttggagaatagcaaatggttcttacatcgcatctctccagtgctctccatggcaaatgagatcttcaggggagacggcagcgctactgtgaatgaaatggaatgtcagccatttgtccttccccattctgattgttatatagtattaagacaacaaaagcattttctcttaacagattttttttctatcctgatatttcttacagattgaccttgttcagataaaacagatgttcacccagatgtatcagaagaccctaagcacaatgatcgcaagtgacacgagtggagattacaggaagctgctcctggccatcgttggccagtgagaagggtccttttcccctttaaggaatgaagctcttcaggacctatccttccatgcaatgagacctgcatgcagccatgtcagataccacctgaccagagtagttttctactgaagactgtcagggggtgtgctgggtttgcacatgttgttactgccttaattctaatgttaggtttttttttttcctgtatccaatcagtgtaaaagccatatcaatgacgtagtaatgtaatatttgtaaagctttgctctcactgcttttattttaatccggatttcaaattgaataaaagtcacaacaatctctaattctgtttaatgttaaaagaatgagaggatgggaacggagtttgttaaaacacgctgttctggttgattgcagagtgtgattttcagctcaggaataagccacagtaactcgggtcgatggctgaagtttcctggtacaagtggaataaaactctcagctagtagtgtaggactgacaggccatgtagtgttcacctaaataacgtagtctatgcaagcaagattgaaacccctctgcctccc

SEQ ID NO: 22473 - DNA, 2369 bp, Mus musculus
accccggaaagatgctgtgcagcaagatggtttcaattccctgaacaccgcacataccactgagaaccacgggactggcaaccatagtgcccagtgaccagcggcttcccagggactctcacatcttgggccccaaatggacagatcacttcaaggagctggaggggttgaccaaggtgatgataaatgtcataatctctctgaagaaaccattgtgctttctgagatccgtgcccccttcctggatggaggcttgagggccctgggacttgtgccgtctataagattgggtaatcgctgccacagaggagagcagtgagcaaggggcttggggcaatttccagtggaggatatctacacctccatttatgcttgtggttcacacatttacgtttacaaatgagatttcctttgtttttcccctcagtagaattagacatttttcaaccatgactttaaatacaatctttagagataacgtggaactccccccatcaccctcaccccatgaaatgtctttaaaaggatggattagcatggtcttaaaatatatttctgaggttactagatgtattttgacttgtagacaaaatctgagaaacccagttggtgtttatataaaatgctgacctcaggttatagttcttaaatgtggctaattctgtaacatagtcttggtatttttcaattatgaatgcataaactatttctaagaagactcttacttgaacaaaatccaaaaaccaatttagattcttttttgcccatatcttttgtgatttacaccccagagatttaaggaaaaaacaaaaacaaaacaaaatgaaattttaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacaacatgtataggttacgtagatattatgagaaattttagtttattgtgagtactccagttgctttaaaaaccaccagggtgatttgctgctggctttgtatcatctttatgtttaaatgcaaaggaaattaaaaatgtctggaaatgtttttgactaagtaatgcagcctagaagcaatggttctcttcaacccttcagatgtctagtggaagcataaaagtcaagactgcatgtcgaaattttacttttgatagttacagaactgcttggttaaactaaatggaaccatgtgctaattttacagtgactgacctgtactgattaccactgtagtttggtatttccctttactttggtggcctgcttccctcatgccctggagtacagctcatagcaccaggcagcggaaccatctgttgttttgtttgccagaaagtgcagcctgtatggtcttctgtctaagttggaaatattatgcatgtgcaggactattcaagtattttataaacagtagcacacaataaattccatgcatgggccgctgctcctatctctgtgttgggttttatttggaagatgtagtctgatataacctttttatgcaaattgtaaaatctctgttaacaaagctaggatatttttagaaattatcctatagataattaatgatgatttcatgagttaaattcttgtctccataaattttgttttccccttcaacttttgttatacttttttatttaatatgagtagttgagtattaaagaactttggattcctataataattttccaaaatataatataatattggagtggtagggtgcttgtcagtcatgtgcaaagctccaggttctacacctagtactatatgtaaaataaaagtcactattttcaccaactctgggttagaagagatgttctagtcttgaactttgttagagtgatactgataaattgggtattttagcaataagccaaaatactaatagtagcttgctttgcctcctctgccattgttgaattgagtataacattgtgcaaattgagaaattactcacaatatataatatggcaagtaactttaaacagtggctatgagacacataaggcatcgttttatatcaaaatgtatattctaggcaaattccagttaaaaacaatctaaattgtttattatagtgtctaatgcaatattaaattgtaaaccaatccattagctgtctctaaaattactgtgtaatataaactttgaaaatttttcctaattttgttttatgaaaattacattgttaaagtagggacttaactagcatattatacgaagttaataggtaagcataaagcatcattctcaacttgtgggat

SEQ ID NO: 22474 - DNA, 1113 bp, Mus musculus
ttacgtaattgtattagattttgcttatgttttcaagtatttattttttgagttaaaattctgcttaggccccaaaacttcctttatgcactcatttgccaaaagatttatgctaaattttgtaccctggtaaatgattagagtttgttttctgtggtgtttgtcaaacgttctatgtataattgactgtctgtaacatgctgtttccttcctctgcagatatagctgctttcctaaatctgtctgtctttctttaggatagctgtatgtctgtaaatatatgttcaattaaattactctatcagacgcttgtctgtcttttgatgtagaagcaactttgtagcaccttgattttaggtttgctgcatttgttgctgcacttggttcagtctgaatatgaatgtaacattagatattgagctattgttataaagggttgaatttaaatcatgtaagtcaaaattgaaagggtgttataaagtgtgcctttattttgcatgaaaataaaaaaattatacgtaaagcattcctgtaatctggctcgttgaatattttatgtttcttttaaaaagctaactttattgttttaagcatctgtgtaagtactgggtaaactttgaaagcccattacagattgaatagaagaaagaggtgtgaatattgcagccagtacacattagcacacagtctcaatttctttcccttatggatagaatacaaaatttgtgatgtggaaaaaactatacatgaagtaagtttgacaggccattgttttattaaaacagcaatgatctgttgtttttactacattttctggttggtgtaattagtaaatttttaaagtgggggcaaaaaaggaatttaagtatttgaataaatttcaaactccctcataatgttatttcactcagttccaaaacaaatcctttttaattaaagtaatttttggtagacataatttttagtttatgctattttaaaatgtattgttaccactagtgcaaacaagaagtacagctagtacagtagtggctttcattttgaattgaaactaaatataacttcagatttctatggtgaatgaggttttttgtttagttggtttttttgttt

SEQ ID NO: 22475 - DNA, 1197 bp, Mus musculus
gatcaaacagcatactagataattttcatatagaatatgtgataagcatatataagtaatgaaatatggcttccttttttaaaagaaccatttctaagcttatcaagattaaaattgattggtacatctgtctgccagtacccaaactcttcagatgtgttgtctcttaatgtaaaaggagcaagtattcactgttagcttgattgcttcctttctgcttgtcctttgtcagtttgacttaggaggctaaggaaatcagtttttatttttaatttttaaaagtgggactcaaaccactaaatgctctgtcagaatgaaatgtctcagtagatctgatttgtgcataaatgatgttgatgatttgagtatttatatagagtgggcatatttttgatgtttcattcttactcagaaggcagttccctgattttgtattttttttccttttctcctttaaataaaaagtctgaaaggttggtatcagcctataatttctgagactatcattaagatgtttttgtttaacatatgagttgtataagggacaaaaaacatacttgtgagttagtaaatggtaacagaaagcagggttgctttttgttctatgctaactagaatttcaaatgttggatttagtgtctccatttcagtgcttttccttaaaagggggcagaggatagtccatcttattataagatgaacaggcctttgtggccatacttccctaccatgctgtattaatccatctgagacccaaagcactaggcaaattaatcatgaactgaagtcttagaactatgagccagagtatttttatgttgaaaaacattcacatatttataaagtattttaaacctttttaatggtttcatatggaacactttctgatctttaacttttaaaagacagggtagacatttttattacatcttatagatgaaaggtaatgaattgcatagccagctcatgctgtacttcagttttggatatatcacttctaattctatgatccataaagtagtataaccagtatctgaaacttaggtaggtaatgctcatcttattgtattgggacattagaaagatatctaaaattgaggtgaatatatattctgggagtatttagttataccattattctcttctggttattttaataaattagtttttttcctaaatgaagtaaaatactccttc

SEQ ID NO: 22476 - DNA, 1134 bp, Mus musculus
gttgttgttgttgttttgttttaaagaacagaaccacaacaacaaagaagacattgatttttttttcccctaagggtgtttgctgctttgagagggaatatttgaaattccagctttagagttggggatgtagctcaattggtagcgtgtttttgtaacatgcacatcagccatggttctatccttagaagtgtgtgaaactgaccatggtggtgcacaactgtcatcctagcacttgggagacagagggaggaggatcagaagttcagggttatccttggctacataacaagttctagactagtctggactactttagttctggttcttttggccccatctccatcagagccctcatcttctggtcctactatactcccaacttacactctttgtttatccacctgtccatattacttaacattctttcttccctatttcgtatcaatggaaaaggggtatttatccccatagtcaggattctgaccacgtccttaagggaagcccaactgcccaggtattatggcctgtcagccttccttgtgactcagactttaggcctagaatgtggagctgccaatacactgtttgcccttctgaacagatggagttgggcacactaacacccctcctgtccttagcagcagagccattactaccactgctcactcacccttgtaaactctcaagagtcagctaaagtattttagggcaaagcatactggttttgtaaagtatttttcattaataaatctataagatagttgtatttaatctcttgtcttttacttttgtatgtccttgctcttttcttctggggtcgggaggcttcaacatttatatgaaatgcctttgaccaagtgaaaatgaatagccaaagaggaatttaaaaatacaaactgaccaggtgtggtggcacacacctttaatcccagcacttgggaggcagaggcaggtggatttctgagttcgaggccagcctggtctacaaagtgagtttcaggacagccagggctacacagagaaaccctgtctcgaaaaaccgaaaaaccaaaaaaccaaacaaaaaaaacaaactcacttatggagtcaacatatctttaagagtctttccctcttgttatggctgttagc

SEQ ID NO: 22477 - DNA, 1084 bp, Mus musculus
ggtgtgctggttggagatgcatgtgatgggaagcagacccatgactgctgactcgtcttcccatgcagcataccgggctgttctgaatagtcctgtgaagactgtccgtgacactctcatcacccagtgtgcccagatcctggcctgttatagaaagaactgtgccagcccttcttctgcaggacaggtggggcaaggatgttactaactaggatttatctacagaatgaaataattatatataaggcactctgtgtgctacctgctatgtcattgtcactgtcgtccttgtttttactgtggcttttagagggaaggggtgcagggagactgactacagggtgaactgtgtcgattgattcaacaaaactttgcattttagaaggacttctcatgaccattgactttatttccataaatccctcagttgattcttcctgagtgcatgaagctcctcccagtttacctgaactgtgtgttgaagagtgatgttctgcagcctggagctgaggtcactactgatgatcgtgcctatgttcggcagctggtttcctccatggatgtggctgagaccaatgtcttcttctaccctcggctcctaccactggtgcgagtgaggatcagagtgtgagacactgtactgagcacagggcctccaagaaggagggggtggattactttacactaagaaatttgtttttacgtacattgcatatgactatctagagacttagctttcttagtttgtgtgtataaaggagtatgttgttcttggtgatgtttttttcttcttttgtctagacaaagtctccccttgatagtaccgctgaaccaccagcagttcgagcctctgaagagcgcctaagcagtggcgatatatatttgctggaaaatgggctcaacctctttgtctgggtgggagcaagcgtccaacaaggtgttgtccagagccttttcaacgtgtcctccttcagtcagatcaccagcggcttggtgagaacagggtgtcaaggatgagatgggtatgggaaatactctggtgatttgacagtgggtcagtgtcatgctggtccctttattatgt

SEQ ID NO: 22478 - DNA, 1822 bp, Mus musculus
tttgaactcaggaccttcggaagagcagtcagtgctcttacccactgagccatcatctctccagctccagacaagtactcttatgctcagcgcagtagccctgctctgagtcctggatttcttgtcaggtcatcaggaaggaagctggggagggagcatacgcgtgtatgcgttcttccttaccatttgcccttccttaccatctgccttctgcctgtagcttatcgtggtcaagcaggaagacaagctggagatgctgttcaagcacttcctggtggaagacaagagcctaagtggaggtgcatcctatgtggactttctctgtcatatgcacaaggagatccggcagctactgagctaaagcaagtgggtaaatggcatagggtcccaggccagcttccaggaagaaccccaggatgacagagaaattgggacagttccatatcgtataagtcatgtaagctgacctcagttgacttcttttggggggagggcgagatataaggagacaccgtctttctgggctcaaatacactaccactctgtcatgtcctgctgatcgaaggtgcctcaggccccttactctaccctttctcctgctaatcctcttgtaatgaatgtagtttctcagttcactgtatatgattcggtgttgggggtttggaggcagctgggccctggcaacagtgtgtccctttggatgagcctccaagaggaagggcaggcaggaagaagtgggaatcccagggttattacaggaggtggcaaattcagctccgtgtcatcaacaacttcctatattagggacaaaatatacaggtgcacaagagctggggtacaggccgtaggtggtggagagtaaaatagttggtcctttgggtgcctgatggtcagtagcaaagtcatagttaccgaggatggatgactaatctctctacttccactgcgcgtgctctctctcccctgcaatgattggtgagcacttcgtggatgaatgagcctggggtaagaattgcaaaacatattaacaccttggggaagtagcagcctcctttccagatggagaagccccaatcctggatggttctgtagagcgcctgatggtcaacttgcaatacctcacagagccagcccacatcccactcagcttccaccagaaacgttgttggggagaggcagatatggctggagccctgtcttccggtgccaggacgttactgggctttggtattgactgagtggctgacaagttatcttccaactccagttggctgggcaggacaagggctaggaatgaccgtggtcaggcctgcctgctcccagcccaggatgcccctgctatggacctttcatttcttttcattggtttatttttcaatgcatctttaatttgtaaagaaataaaataagatgtaaccagtatccctctcattactcgcgacttttccccaccctgcctgcagctgagaggagttacgcatgcgccgcgtgcccctatggcgtaggacctagtccactccccacccgccgcagggcggggtttcgtgctgtccgagggggtccggtgtggacatggctgctcgctgtaccgaggcggtgctggccgccctgggggtgctcagtgtctgttcggccagcagctccgggtccgaggcttccggggaggcagagagggaggagccgtgggatggcgcggttttccggcctcccgccgccctaggcgccgtggggatagcgcgcgggcccgggtccccgcctccagggaacagagaggcggtggacctaccagtgttgctgtggtggagcccaggtctgtttccgc

SEQ ID NO: 22479 - DNA, 1822 bp, Mus musculus; identical to SEQ ID NO: 22478

SEQ ID NO: 22480 - DNA, 1141 bp, Mus musculus
taagaagtccctttctgtactcctacctacagctgagtgaagtgaggggctcttcatttgtttactgtgggtcaggtaccaggatgggggagaaggtgaagggtatatatccgattgtgtgcccatctgtgtttcctagggatgctggcactggagatgctaggtcgccgggcacacaacgatcaccccaacaacttttcccgctcccccccttacactgatgatgtcaaatggttgctggggctggcagcaaagctgggtaacacctcccctcctcaggaccattgtccccctgtttcccttcccttcctatcccagacctccttcctagctcttactcagagttgaggccttggtcgggtatgtgtgcgagcgcaggggggtggaggattacctcagctcctggggtggagggtggatctctgtagggctagagctgagatatatgagtgggtccctagggcagaggtggccacccccgtctcatgcccctcccctgcccctcaggagtgaactacgtgcaccagttctgtgtgggggcagccaagggggtgctgagcccgtttgtgctgcaggagatcgtcatggagacgctgcagcggctgaaccccattcatgcccacaaccaccttcgagccccggccttccaccaactggtgcagcgctgtcagcaggcatacatgcaggtgataactcaggaagtatggagaaaggtggaacacctcctgggcagttggatcagatccctcagcatgtaagggaagtggggccccggttgtatgtgctttgtgctgattcccctccaacccaccctccagtacatccatcaccgcttaattcacctgactcctgccgactacgacgactttgtgaatgcaatccgcagcgctcgcagcgccttctgcctgacacccatgggcatgatgcagttcaacgacatcctacagaacctcaaacgcagcaaacagaccaaggagttgtggcagcgggtctctctggagataaccaccttctccccctgagtctggtccctggagggccctatttagggacacaggcctgtggctatggggagccctcacacagagggtcaggcgactcttggctggacagatcatccccactcaattcccttgtagcc

SEQ ID NO: 22481 - DNA, 1132 bp, Mus musculus
ggcctgatcaccccagttctaggagtggacttcgtcagaccatgcattgacacctagtatgagaaagacgcaaacaccgtggccgctggacctacattggagagaatgcagcactgccagcctgctgtgtgtggaggcagctgtgaggcgtggcctcaggactgaaagcctggactttgctgtaccggtccagttagcgtagacaggaagagaattggtgctgcagaagtgtgtccgccaatgagaaacctcgagttcgtctgacatgcacttaactcatccatttctagaggatgcacaatgcacgtgggcctgagactgaggcccgatttctgctggtggaaagggggagggattgctactttgtttcctgttggttttcctgacataacaaggagagatccagaagtcgttggccagggctccttttgccacttttggcagttgtttgtgtgctgatctggaccatctttgtcttgtattttcatggtggtggtccccatgctgaccctcatctaggcctgggccctctgccaagtgcccctgtgggatgggaggagtgaggcagtgggtaagagttggtggttgtttctatgcattctggctgccctctgggctgcctcccttcttcccatgctgcacgcccaactctttccctgggtttgagatcgaactgactgcttgggtgagaagtgtcctctttaaagaggctctttattgaccaaccgaagtatagacttttctgctggacaatctgcatgggcatcaccccctcgcctgcatgtacccacaaaggggtccagagccaaggctcctgcattcattgtccctctctgtgctcaaggaggtccattccaggaagaaaaggtctgtaccttaggcagataacagagaagataatggaagaggcaattggtcatagtcttggttccctcccaccaaacaactgcacattatctgcattgggggggggggtagatttcagctccttgggtgaccttcaggaggcacaggagctgggaaaagagaactacagagtatggagccagctgagaagagaacaaacgcatgggtgctggtgcttgaatttagccaggctcctcaagcacttgtgcatgcctcagaccctgga

SEQ ID NO: 22482 - DNA, 1101 bp, Mus musculus
aagtcataattgcccttcgcctcttagtctactctggtgtacctttaatgtgctgtttggtcttgattttgatgctccagtctcacatgaacctgagtcagagcatctggtggcagttaaagagttacttacaacccagcactcccctggcttcccatccctgcgtctttctgatcactgtagtcttaattaccagcactgctatgtttctatttctagtaatgacagaaagcaagagaacatgcacgtcttttaaaccagcatggctgtgctgacagggaacagagtggcaaattttaaccataagatccacagagttttatctgaacagcactcacagtttcattgaggtctgagttcagaagtcaagagttactaaagctgagagcatcctgtagtagcttttgttgtatctctggtagctacccactcacatttcagacagacctagctgtagaatacccttgttggtgtgccagtcctatcaacccaaacctgtaattttgcagcagtcaaatattgtacacacacacacacacacacacacacacacacacacacacgtgactgaacaagacatacttctcagagtacactaaattttctttgtgaatccgacagaagagttctccagcggctggaaaagtgtatgtgcctgtggtctgtgtactgttttaacccctttaatgctggactccgggttgctcctcttcttcctccacctcctcttcttcctcctcctcctctccctcctctccctcctcctcctctccctcctctccctcgatgcagagcccgagctggtgcactaacctgcggtgtgtctgggcttctcttctcacctcctctctccccttctctttccctcttgctgtggtgtgtccagaaaaggaagtcgagttccagcgtgcacctaatggtgagccttgcctgcccacccaccctccacttcatgctgcttgtgcccgcctgccagccatgcagacccattctgccatgtgcgtgtgcgtcactcatcctcactgcatgtctgtgctgtgtgggcaggtgtggcctgtcctgccaggcggggggccattgcccaaggtcaccagtggcctt

SEQ ID NO: 22483 - DNA, 1195 bp, Mus musculus
tttttttcccgagaaacaggttttaccattgagatgggataagaggccaataaacaaatgttgtagaaaggaatggtcaaagttaacagactagctacaattcttagagctgtatggtggcatggcaatgcttttaccaaagtattgaagtgattaacaaatacactacccaccccttttttagaagtagaaaaaaattatctaaaaagatctattggccacatgaagatggaaaaataggtcaggaagcaacttattattagccttattactaccaatgaaatgcaatcgaaacaatgagtgtggtctacagagcgagttccaggacagccagggctgcatagagaaaccctgtcgggcaatgtgccatttttattattattaatttaagttagtaattgtagtaaaattggtgtcaaagccatacaaatgttcccaactttgcttctgggcatttacttctaagaattctaaaaaaaagtaggaaaagctgaaagtgggtgttttacatggtgttctgtgaaaggattaaactgtttcaaaagccagccagaaataaataatgatttattattaattaataaattagtaataaaaaattgctgctcttgcagaatgctgtagtttagtcccccgcatcagcctctggtgtcttacagccgctctcctgagcccctcttctggcctcttcaggcagacctggaaccgagtagccagttatgagttgccacattggtactgggatcgaaatccatatcctctgcaagactgtcatctaccgagccatctctccggctcctaaattgtattctttaaaatacagcatatatgttgattcttattcaacatataatatggggacaggagaaaaaaagaaaactcagaagtatttcataatagcttccttaacatttttctgttattgtggtttttctctactttccatacttttcacctggaccatgtgtcaatactaaacagcaaatcaaattattctctactaaaaataagaagaaactagtggacaggttggtacatgcctgtactcacagcacgtggagacaggagggtccagagttgtactggttactaaggttatgaagttaccaagattatccttagcaacggagtgggttcaaggccaaccccccctaaaaaaatacatttctaatgcaaaatactaattttagagtgt

SEQ ID NO: 22484 - DNA, 1150 bp, Mus musculus
tttttttttaaatgctcctgttagctataaaattaaggaactcaatgaagctctttggtctgtttccacaaagaatggggaaactacgtggcatgttatattacagagggagaattttagaggcttctccactgttttggaaccttgggcacattgcaaaacctgttttctccttagtaaaaagagaaaggtgaagcagaaaatgtcagttcccttccttcaccgacatgatacatggacacccttacacttatcattctgtcttctttgagttggcacagcatacccactcttgggtaccacaaagtatctcagttgtaagagctggaatgaagtcgggttacatttcagggtagaaggctcacaaatttcctgtctcccttttccctgttcccgctcctcagttcccatcaccagaatgggacacagtcactcctgaagctaagaacttgatcaaccagatgctgaccataaaccctgcaaagcgcatcacggccgaccaggctctcaagcacccatgggtctgtgtaagtgtcttttcccaggccttggagattgggtgtggcagccctggggcactccttgaacttctctaaggaggattcaggaggagggctggggaggtgtgagtggaggccagggtcaggaaatgtcatcagggggacttgggagttaaaaagtgctcataggtcttcacttgtctctcgcgcttgttgtgaggctgtggtttgggtctgttgctggattggaagaggtagttaatggtggaaaacagctgataccccagtgtggagtcccaagcttggggtatatgtgggcctcaactctgacaaggacccagtgaatgaacaaaggcgggaggctcttgaagctcagcatgaggccggctctcagctgagtgctgaggagcccctcctaggccctcagtgcaggctgatacactgtttccatccgtggttctatcaagctgaaacagctaacccagacaaaggaaagggctggtatagtatagcatcttgaacaatgataagtttttcatttcccatgcttattgaatgtccttttgtgctggtcaccagacagttcctgaagatgaacaggaccatggtctttgccccaaagatttgggaaaacaggcattcaaaccagc

SEQ ID NO: 22485 - DNA, 1148 bp, Mus musculus
gtgaaaacatgatatgggaatgatcctttttttttttttttttccttttgagacaagttctcctgcctctgctggctttgacctcactatgtaaatgtatgtaaatgacctcactatgtaaatgtatgtaaatgacctcactatgtaaatgtatgtaaatgacctcactatgtaaatgtatgtaaatgaagatggtgctgagctgctcatcctcctgcttccttctccgaagtattgcttacagctgggtgccactatgcctggtttgagtgatcttaataattgaaaaatccctcacttttgaaactagattgtggaggtattttgtttgttgttcttttgataggtactaaatgctggcctcaaactggtaacaatgttgactcagcctctagagtgatcagattgtgggtatgtgctaccatgcctgtgtttcagacatgcgtaagtgaaggtaacagtctgagaattgatgtttgactcatgccttcctcttgtaggttggaaaagagactgttcagaccactgaggatcagattctgaagagagatatgccaccagcctttattaagtgagtaactaacaatttgttactaaatagaatagtattcttgatagaaagaaaaagtaattaatcccaagagttacttcccctctctctctctctctctctctctctctctctctctctctctctctctccctccctccctccctccctccctccctccctctgtgtgtgtgtgtgtgttcatgtgtatgtggaggtcaaaaataaaataaatcctataacaaacaacaccccgcaccgccctgccccgccccctgtagattacccttggtggtaactagggtagcaatcctttagcaactggaaataaaaaaaataaacttttctcctgctattcttgtataaagtttatttcagagttactttgtagccctatttgatgaggagaatgtgaactgtaaatatggaagaaatgatagaaggtcatcattgtatatatttcagtgaacatgggaaaaccagtgtgttaggatgaactgaaaattactgagccgtttatttaaaaagtgtatcacttaattagctccaccaaaatcttactgtagcttaaagcccaaacaagatgtatgtggttgtc

SEQ ID NO: 22486 - DNA, 1138 bp, Mus musculus
atcactacataatactttagggcttatgtgaagtctgacagtactacaggtgtttttcagtcttttatgtaaatatcgggtgtgggatagggagaagtaaagaagcaaaaattccagcaaaagagttacaaagatacagccatgtaaagtaaaggtgtcaaatgtgctcttactttttagagccaagaaataacaaagaacaagttattcacaagcctagtgcacagagtgaatgaactgccactagcagcaaattttgagatttcaaaggccaagtcctgttataaattggccttggctatctaccatatagaaaaataaatagattcacatgtattcattttttgtgttttcgtatcatggtcttctatttgctttcactaaggagttaacccatattcttccccctagggttgaaaatgcttgcaccaagcttgttcaggcagcccagatgcttcagtcagacccatactcggttcctgcgcgggattacctcattgacggctctaggggaatcctttctggcacatctgacctactgcttaccttcgatgaggctgaggtaggcaatatgaggctcataaagacctcccttagacagaagcctagttttagatttatttgtatgtgtgtgtatgtgcacacgtgtgtatgtgctcatatatgcttgtttatgggtgcccatggaaatcagaagaaggtatcatattcctaaggccagagttataggcagttgtgagccacctgttgtgggtgccaagaaccaaacgggggtcctttggaagaacatcatgagttcttgacctggagtcatctctccagcctctaaagtgcaattttaacggtaataatggaagccagacatagtggcacacacctttaatcccagtactcaggaggtggaggcaggagggtctctgtgagtttgaggccagcctggtctacagagtgagttcccaggacagccaaggctacacagtgaaaccctgtctccaaaaaccaaaattaaaaagaaagggtaaacaaacaaacaaacaaacaaacatcctcaaacaaacaaacaaaacaaaacaaaacaaaacaagatcatgcaaaccaatactggatggttgttttagaatgctaacatattaaaaag

SEQ ID NO: 22487 - DNA, 1193 bp, Mus musculus
gtatgtaaactatgaatattcagtaatatgtagtaagcagtcagatagttatggttaatataataacatgtaacctcgtgcctggagagatggctcagtggttaagagcactggctgctcttccaggagccaggttcaatgtgcagcacctccatggcagctcacagctatctgtgtacatcaggcaaaatactaatgtacataaactaaaaataaagaaatgatttaaaaatatataacatttttaggttatatttttgtttttgttacttttataatgctaggaaagtagtctgccattatgtcacactccccatccatagaccatgctttcaaaaaaagatatttagtaaatggaagctgctcattgggaagaatgggagtcaaggaataaaggttaggcttggttataggtcagtgttagatatgtgtgaggtaccccccccccaaaagttagtgcatagtgtattccaaagagttatgtttactagggaaccccatacccctattaaatgctatctaaaaaatctggagtggcagcatagttgtctccctggctctgtgtaaagctcagtgttttccttttggtttaggtcaggctgccatccgtggacttgtggctgaggggcatcggctggccaatgtcatgatgggaccttatcgccaagatcttcttgccaaatgtgaccgtgtagaccagctaacagctcagctggctgacctggctgcccgaggggagggggagagtcctcaggcgagagcacttgcatcccagcttcaggactccttaaaggtatactttctgatgccttagtgttgagaaacaacagacagaagagatttctgtgcagtgggtgtgcatgcatgtggaggtcagaggataactcagatgtcaggcaccatctacccttaggttttgagacagggcatctcattgttctgggacttgcagagtagggtaggccagtgagcccctggggacctgcctgtcagcacttctccagtgccagcattgttaatgggagctttggagctcacatacaggttctcatgtggtaaggcaagcactttactgactgagctgccccatcttggcctgaggcttgagatttttgggtttagggaaaattaaaacgagacaagaataatagaaaatcagagtttattaggagaaagccaagtggcaacaatta

SEQ ID NO: 22488 - DNA, 1178 bp, Mus musculus
gtgcaagcagtacagcccagaaggtcatttggcctcaggagttatactgaccgtggtcactggccctcttaaatccaccacagacaagcagacacgcaaagacatcaggaggaaccggactgagtctaaaaccttcaccgcatccccagcacagtatctgctaataacactctctcccttccgggctcactctccaccacctgttgattgttggcagcttgaagtgcccaagacgagccacacggaggactccagtaacctaacagcctgtttcttacttctgttacctagctttcgacactttgggagctccgctttcatcactgactgctgtagacccctgacagcaggttctacagggacagcgaagagcctacactcctcatttctgcctttctgtcctgtccctctacagagaactcagaggcacttctgcagtcgtacaggcacagatgtctcctctttttttttttttttagaactatgtagttgataagttggaggaaactctgagacaagctgggttaaatggtagctattgtggttccttgaaatgtgaaccctctgaaaatgacagggacacttactgtatccacaaacaccgcctcccagcctctgaaaccaaactctagctgggactgagcaaagacactattcaaagagaagataggggctataacaatgaacatcacaccggagggcggttctcaaataaagacgctcacacagcctctcatccaacaaagtagcagagcttgaatgagaagccgccactgctcaacagcctaatcagagcccagcacactgtcaagctctgactgtccctttatccaattacagctgatataaccggtcctgcttgaggtcctcagaactcatgcatcagcccaaaggcattctgcagaactctacctgtcattttttcaacattatcaatccactggttcttcatggtctcaaaatgttcataagcagcctggttaccagggttcctcagtaagatccgagcagcggagatgacctgtcaataacaaagcaattttcaaattccagggtgccagcacagtccaaatacaaacccagagtaaagcttttctccatttcacctatagatggcaccagaaaaccaaaattggcaagcctcgtcaggctaaatgcattaagtctgatgccatgag

SEQ ID NO: 22489 - DNA, 2179 bp, Mus musculus
ctcatgcagtctgtgaaggagactgtgcgagaggctgaagctgcttcaatcaaaatccgaacagatgctggctttactctgcgctgggtcagaaagactccctggtaccagtaggcacctcgtcaaatctggctggtacatacacctctgctaaagagaagagaaccatcttgagttccagaagccattcagagttgtcaggaatggaaacatcaatccctggcttcacacaccagaaaggaacatttatactcttgtcatgggcactttgaaatgtgtctctctataaaccctgtactttcagttactatgcgcactctctcccatggattttacagcagctcagaataagcgtgaacactagccggaagccctgctctgccccgggggtcatttctgtgtttacggttcaccaactccctttccccactataggctctcaagacctagagctgaggcaagtctaaataactgtgcttccaaagttattttgggtttccccccctgctgctgaccctgcctaccttctctgggctgtgcatcattgctgcaggaaaaagtggtctctggagagttctagcttgtgcggcctggattcatttcctgctttctcccagtgtaaccctagttcctcacaatgggaaaccaactttcactgttgtgaggaaatcattatttctgtttttaccatgccactaactagtatgtgttatggaaacttcctgtctcacatcctgccttgtttggttgccaaggtaaccatcctgtaaacacactggtgctctgtcactagaggaacagagtcactggggtgttatcctgcccatcctcccagtggggccactcccagattttctatgctttgtcactgccagtagatgtctgtgctgaggccttggcattcattcttcgcccttattttctttaatttctgagctgaagtgctgcatttacttttaaccaaatcatcctaggctttggcagtcttcttctgtatgcttctttaaacaagactttaaagatacataggtatgtgtttgtctgtaatccctccatcccccacttttttcttttttttaaattttgagactgggtctctttatgttgtccaggctagtcttgaacttatggattcaagtgatctacctgtgtcagcctgttagctcctaccaccacacttgactttgcttgtaactttgaaaggttcattcaaaattgagacttaagaattagggcttgctccttaagagacttgaatggaaaggcaatcttgtctgggagactagcatttgcagattatacttctggtgcttctagggaaaaatcagtaggaactattatagttcccagttgcttttaatcaactacaaccaagcatttttcatccttccataaatacgaagtattcaagaataatgagtatggtatctatttatcagaaaggcatgtttcctattgggcaaagttagtgtaaaagtgactttcctttttttttgcatttatcctggctgtataagcatttcccagtatacaaatgcttctttcagaaatcaggaaccagacgaatacaggagtgaggccttcttcctggatgttcttcccacatctagtatgtccaatcccaacactgaacttgtaaatcttaagttgaccctgaatactcaggctccccctatttctttttgctgataaaagattcttttcaaagctctcagcagatctgtatagttgcttacctgatataaatgcatatcaatgcctttaaagtatgaatctatgccaaagatcattttttgtcttactaaagatttcttagaggaactaagaagaatcatgtttattctccaagttccttcagttctggagacacatgtccaccagatgtgctttctagtgtcagtgcttacagtacaaggaggcaaaaggaaacagtccctgaatgacgtgttagagatgccaccactaaaaactatgtttataagctaggacttatatgtaaatgtttctgcctcttcttttgttctgtttaaaacaataaagtacatttatatgaataatgctctaattgaggttattttactaacaactttaggtcagacttattttgtattgaagctaattctcaaggtctggaaaccaacagctttattcaatccataaaggagttatataatagtgt

SEQ ID NO: 22490 - DNA, 1478 bp, Mus musculus
tttgtgttcaaagaaagtggaactagctagttttgtgagcagaggcatcttaaccaaggccatgctccttagagtacagcatgtgggggatagaaaagggatgttgtttccacatgatgaatggagcactgtgcagtgtcacatctaaggcacagtgttcattgttacacaagtactgcattattactctggtagtaatgattcgtttcattctttttgacacaggcttaaaagtgaaccgcttggacatgtatggtgagaagtataagccatttaaaggagtcaaatatgtcacaaaggctgggaagttccaagtgaggacatgagaagaggccaaacttgctcaagatcagtttgttttttcaagtgtcattgcaatttattactattaggtaccaagtgggtgggaataatatacagcatttgtgtcaagctaccctgctaacaaagttgcttagtaattgatgtagggttcttacggagctttaagctaaggaaagttttctaaagacttagcttattttgtatcttttcacttaggaaaaggtttagatgatttcttccatgggggctaccagctgaatgctgcacattctaacagtcaaagcagaaggctacagtgatatcctctctcctaaagcaagccaactggtctcatctaccagcaggaactgtctcagtctgtgatgtgtcaggtgcagccaagtgtcacaccttctgatcttagccatctcagtgtctgtcccaagagaggagattgccccaccccaagaagtttacagaaaactgcctcttcaagtgtttgccttactcagcttttcacttgtgccattaagcaagcactgtagcaaaagccacttccacatggccctggcagggagcactacagctccgtgctccattctcactgtacttggtattatattttttataaataagatttttatgtaaagctcagattttgatttacaaggaccttgctgcagtaaatattccatcaatcttgtgccactagttcagctgttaagatagcacagtcaaatcatttgcatcaaaagggcaaatactttattaagacaacgaaagggaacactacttctgttgttagcgagttactgcaggcacagctgtttgtgcttttaaacaaattaaagtagtaaaagagaaaatcaagcaaaacctttgccattctcatgttttattaaagctttatttaatgccactaacctaattagcttgaaaccctagtttagctaaagaaggaaatcatgagtttcactatgttgctcttttcaatctttgtgtgtttaaatagttgaatttgcttgtgtgcccttcatttgggggagcgcctttccatactacatatatctccaggccattgtgatgacaccttctccaaactcctatcaaattcgagtgaagcacttaagtgtctttgccgtactgcgtacgtggaagaaccattcacggaagga

SEQ ID NO: 22491 - DNA, 1150 bp, Mus musculus
tgatgaagctgacacgtgttacttgagacatcagaacattttgaaaaaagtaaacttggctttaggtgtttgatccatatcttctgaacctaaatggtagctttaagacagggtatcacagtagcccaggctagccttgggctcacagcagtcattctgccccagcctccagtcatcctttatgagaccaagtgggaatttgtgagcctttcctccggttttttattgtgtgatgctgggaatggtcagagagttcattaatttttgtttgtttacactgctaatctttaaaatttttaagcagtttcttcaatcctcactaatctgtttaagtagaaagggaaaagaactcagtcggtgaagccttgttagcacaaggactgagttttatccccagaaccttgctagctggtcagttctccgtctaacgagacatcctgtctcaaaaagaaaaggtttcctaaagagcagcaggcagcttgttgcctgcttctaggcagacatatatgcaatcacccgcacacgtttgtcgatgctttgcctacacacattttcattcacagactgtcttttggtcaggattttctgcttctttgtaaagatataattattaagttttagaaactccatcaaaccagtatatattttatactcagaataaactgtgaaataaatggtttctccttctaccaaaccactttcaacctgaatatgaggaatggagctgtgcatagttaatgatggatggaagtcacctttccaagcctgttcatagaaagctctccactcctgatgggagcctgtgatgcagccaaacctaaggttactctaagtgcagccaagaaaatgggaccccttagtgctagaaacttacagtgaatgaaaatgaaatgtcagcacagaacgtagtatctttctaacatgttctccccattcactccctcttactgttcctcctgggccccttgctcagagtagtatgtggggagacacataggacaaaggattaatgtcttcagtctgtagatgaggactagagactcgtggcagccttgtgagaacccttgagtcagagacaccgcacttcccaacctaagtccagatcagagtttctgtgtagtttttctttggctttgttcctttggttttg

SEQ ID NO: 22492 - DNA, 1198 bp, Mus musculus
tgatatttatttgctgatggtaaggatcttttctggtggtgggggctagtgcttgggcttggtactggctaggcagtcattctaccaacagacaaggtcttcacccaaaaactctgctaagcttcaggagatttaaagtagtttgggtttgtttttgtactgggaactgagcctaggtcctttcataagacaggaaaaatgtttaaaagtatatcccaattatatgccgttttagtcattacctttcagagataacatgttaacacatttatagactaaattataaagtacctgaggtttgctttgaaatacaatgaatggcaggtattgaaggaggagatgagataagaccctgtcacaaatgtgaagttttgggcagactgatccaagaagctcttggggataaataaataaagctgtcctctttatctttgtatggttaaaaatcttttcaaatgtgccatattaaatactgaggtcccagcagcagcagaattgttaacatactaagaaaattttcccttgccctactgatcatgaattttttcccttcttgttaatagactaaagacattaaagaaatagccaaaaaggcgcaggctcttccaaaggtgaactcgaagaggcagaggaccgtgatcttcacacaagggcgagatgacaccatagtggctgcaggtactgtgaggactctgtgataaatccagggttaaagagattaatggcaacaaagttgtatttttcttctacagcgagccatccccagtcatgtgccttcgacagtgtgactcccatactcctcccttgcaccctggggacgtgattttcctttcaaggttataatttatgaaaagccaattgataaagcttgtttactttttaaattgggggggtctcagtccagaaatctctttcttttcaaaacaataccttttacatataaaacccttgcatcagaataaaatacatttattcgattatgaacaagtcaaatccagaagtgtttcttctgaattttttctgtcacttttgatttgtttttgcaatactaggaattttatttttgacagtctgtgtattcctggctgtctctggaactcacctgcctctgactcatgcccaacccaatactagaactcctatttagggccttttgcatgctaaacaagtgctgtgtgttggtgagctctatccttgg

SEQ ID NO: 22493 - DNA, 1198 bp, Mus musculus
ccttgtcagaagcaagtctattagtttgtagaaactttggccttgtctgcctcttcctgcaggcctttgctctggggtctgcctggccaggaggcaggcttgtcgagggatcctgggaagggaggctgattactgcctgggagggtgagcaagaggctggagcaaaagcctgcttcacttgggttttgtgtgcctgacagccaccctttagcaaggtgaattctttcagtaaggctctcattcacattctgccaagacatccgccacctattcttgagttcacacaaaaaaattaaaagcaaaacaagagtcctgctaatttagcaacttgggagatgcagctgctgctccctgggcaccagaaaggctggcctcagccttcaggcctcagcctgagggaggtctcccaggagttatattgtatcctgcagctcaaggcctcattgtgacagctgagtgacttagctggcactgtgggctggagaatgataaaggtacaaagaacaggcagcttggtagttggggatggcactggatggtgggggcgggtacatggctggttttgcctaggcctcctatgagcccctacttaggcagctgctgctgcccaaggcacagcagttctggccgttcactccaccctctttgtaaaacaatcctcgcatcaattaagtgtaaggcttttgtcgtccaaagaaagtggtaattcccatatcctttcagttggttgtgtgcctgtctgcctgtctgtccatgtctccagacctatccatacctgacctatgactgttgtcttggtgactaccagtaacaccttcttttttatgcattgtgtttcaggactccttccttctatccctagtatcagttcaccctccctgggctctgatatctgatttcctggtgccagtttcctctcccactgatggcctatagtgtagtaagatcatgggctcctcagatctgcatctgtcaataatctgctgctctcaaaagtgcagtcctaagctgggcgtggttgtacatgcctttaatcccagcactcgggaggcagaggcaggcagatttctgagttcaaggccagcctggtctacgaagtgagttccaggacagccagggctacacatagaaaccctgtctcaaaaaaccaaaaaaagaaaaaaaaaagtgcagtcctgaactcctgaatacctagaga

SEQ ID NO: 22494 - DNA, 1863 bp, Mus musculus
tttattttatatctctggtagacatgtaccttagactgctttcacatgattataattttgataacaggactcagattttccatgttttaacttgttttgtactttgagaggtttggggcagcatatcccacagtgtgtgcatagagggcagacgagtttggggggagaggtctttcctttcactgtgtgggttctaggggttgaactcaggtggagcaggtgcctttaccactgagtcatctcaagcctgtttgacagatgtggtctcttaagttattatgtgtaaataaaatcctaaaaacaaagtcgtgcacagagtgcacctagtgcctggttgcacagagttgtcctgtggctggattgcacagtacctgcctttcagtgtgttagttttgtacctgataaagaataatgctgagaaatctttatttttacaagtttcattattaagagtcttttctctctctctctctttttatcctttaaggtcttggtttcctaaagatgtctttcacttgaagagtgcagtccttcccattggtgaactaagacaactctccacgttgcctggcagtcagtcctctctttaaggatggttgtccctatgctgttgcttcacatgggctgggatcctctgcccttgtgttgaattgtgactttggaatgtgcaggttgtgttaagtacaaggcgaatctctatgggtaacgtctgtgttggagaagccatttgtcaaccatggtaaaacttgcaaacccactttacacagagtggattcttgaagcagtgcagaaaatcaagaagcagaagcagcggccctcagaagagaggatctgccatgcggtcagcacgtcccatgggttggacaagaaaacagtctcggaacagctggaacttagtgttcaggatggctccgttctcaaagtcaccaacaaaggccttgcttcatataaggacccagacaatcctgggcgtttttcatcggttaaaccgggcactttccccaagccaaccaaggggtccaaaggaccgccgtgtaatgatctacgcaatgtggattggaataaacttttaaagagagcaatcgaaggccttgaggagccaaacggctcctccttgaagaacattgagaagtatctgagaagccagagtgatcttacaggcaccaccaaccatccagcctttcagcagaggttgcggctaggggccaagcgtgctgtgaacaatgggaggttactgaaggaaggaccacagtacagggtcaatagtgggagctcagatggcaaaggggcgccccagtaccccagtgcttttccgtcctcactcccgcccgtcagccttctaccccatgagaaagaccaggtgagtgagcccggcggtatcgacgccctggagatattactgttttacctttcgcttccacttaggcgtgctcagcctgtgggtcccaaccctttcggcaaacatctatctccccaaatagttacattacaattcataacagtagcaaaattatagtatataaagaataattttatagttggctgtattaaacggtcccagcattaggaggctgagaactaccgatgtggacggaagatctgaatggagtttgaaaagatcagttgtttgtgccttgaagctggtttttataatttatattaggatgtttcatagcatgattgtttaaacatcattttatgacacattgagggtttcttcagtggctaatagttaacataatactcacctgacttgctttatgttgtaactaccaggtaaacttgaatctaccttcttcaagcccaagaaaggaaagtgtgggagtttttcttcccttaattgtagagagaaaaacctccata

SEQ ID NO: 22495 - DNA, 1187 bp, Mus musculus
tttttaaatgtgtgtgtgtatgggtgtattgtctgtgcaccctgtgcatggttggtgcctgtagaggccagaagatggtgctggattccctgaaactggaactatagatcaccatgtgggtgctgggaaccaaccctgggacctctggaagagtgtatgtgtgtacacatgcgagtatgtatgtgcgtgtgtgtgtgtatgtcccctcacccccacaccaagtcctttcttatactcttcccattcccattgattccctctctctccactcctaaacattcttctactttgatgtatgtatatatgatgtatgtatgtattttttgtgaaccagtggttttgattagagttagtagttacaggaacgtactagttgttatacttctgaaaaaatatttctcttctcctagcaaccattagttaggttgggatctgaacaataacagtatatggtcttaatcactgatctctctctcttttttttttttttttttggtttttcgagacagggtttctctgtatagacctggctgtcttcgaactcactttgtagaccaggctgtcctcgaactcagaaatccacctgcctctgcttcccgagtgctgggattaaaggtgtgtgccaccatgcccggctcactgatctgtttcttaagctctagaacatgtttgtttttaggggttagctgctatagtagttatcataaagaataatttttttgttctgacagatcttttgttccaaggcaaaattaagtcaagcacttaattttgattaagtgatgaaatttttgtgtctgtgaggacaatgtgacaaaagatgactttaaagacaaaatgtgtgagcttgggagctatgaagtggctcagtgggtaagaacacttggaatgtgtgtgagcatttgtctttggattctagcccctttgtaacaagctgccctgggcctgtaagtgtgcctataacctcagaggtggggatcttgctgactgccagcctggcaggaaaaatgtgatctgggagagaccctgcctcaaagaaatgaggcagagtgaaagaagaggtcatctcacatccttctctggcttctgtgtgtgtgaagaggtgcacacacccacgtgaacacacaccctcgtggacagagtgtgtatgaaaatgtatgtacacctacaggtatacagtgtgtgtg

SEQ ID NO: 22496 - DNA, 1098 bp, Mus musculus
gtcaacagacagaacaaataaagaataatgacatcctgaggctctcaggttttgttttttgttttgtttttgagggggcgtgttgaaagtttgggctggttaagagtaaacaatgaacagtattgtgagatacaaaaactttttaaaaagatgatgcaggttgagctggggagatagttctgttggtaaagtgcttgcctggcaagcatgaggacttgagtttgatctccaaaacccatttaaaaagctcagtctggtgtacacacgtgtaaccccaacactggagaggctgatccccgggccgtctgatgccagcacagccaatgttccacagttaggagttccataatgttaagttgaaatacagttaagagactatttcaacaaaacatggcatctgagactgatagctagcccctccctcccgcacatgatcatgagcacgcgcaccccccctcccccagtccggtatgcagttctgaagggcacacatcacatctgaatgtgagggaatagaggcagagttagcaggcttccaacagagaatggggtgatgctggttcgggaatttagccatggttggtaaagtcccatcttttagtctttggtctgaactagtgtcaggctgactaggttggcacatttaagtaagttgcttctgcccaagatatttagaagggaactgaacctggctacaccctcctgaaatgacacacaagcctggctggcacagtgctgtccagtacttgttcttttgagagatgggatcaggatagttggcacaaagcattgcctggccagaaatcacaagtttgtaaagaataggctttatattagaagaataatcctacctctgtggaagcaatctcggcatagataagaattgagtacatctgcttgaaggtttgaagtgtctgtcaccaaggacatccccagataaagaccaacaataacctagaagagcagttggttatgtataggagacagggtaaatatgaaagatgtaaagaaccttttgcaaataggagtaactatttaaattggtaaaaccgataaaaatgcattttgtagaaaaaaataagagcagccagtaattac

SEQ ID NO: 22497 - DNA, 1180 bp, Mus musculus
gaagaagtgtacaagcaaggaagcagggctggcagctgacagggaggttagaccggccgggccagatggccaagagctgaggatggaggtgctggctcatttgttccctctaatctctaggctaatatagattttggtaccaccagttaaaaatgtcactctagctcaccttataagagctttagaatatgtggctaagcccagtgttaaaagtacgaggcgtgcttgttttgtacttccatgtataaatggttggatttcaaaattatgtgtgtgacacaaactttgttttcagtctctctgtctaacagtccctgcaaacagccacctcactttcagaggccatctttgttattccattcactaaaaaagcacagaactgaacattgtttgtttgtttgtttgtgtgtggtttgttttttttttttgttttgttttttgttttttcgagacagggtttctctgtgtactttggctgtcctggaactcactctgtagaccaggctggtctcgaactcagaaatccgcctccctctgcctcccgagtgctgggattaaaggcgtgcgccaccacccggcagaactgaacgttttatgaggaggtgaaattgaatgttgacacgaacataggcgagctctgagccatgagccacacacacacacacatacaccccatgtagtgcagtttggaacaggatcgatgctgttcttgtgcagtggggctggattgtatggtgacttgaacatttaatagcattccctggtcctcttgtccctggttcttgctggtcttactgtttagtgctaccgtggtaagaagcctctagctccttcctgcatttgggtttgggctctgcaggtgccgtgctaagctgagctgaccttaggcatctgaaccttggggagtcagacagaaatgtggcaatcttgtgcttgttttgccattactgtaagttcttagatcttggtttgttgtttttccaccctaagtagtacaaggggttactcatttatgtctgcgatgttttaaaaataacactttcataagtgtcacagcatgtatttgtcattttagtaaatggatattttaataggcagcaatttgcaaattcaaacatagacaacatgatttgacattaaaaaattagagaatttcctgccatctttgccatcagccttg

SEQ ID NO: 22498 - DNA, 1101 bp, Mus musculus
tgggttttgcctgatggttttgagtttgagcagttgttgattaattcatgaaccccaactgcaaggtagatgttcagtattgattagacacatgccctggctgtatgcagttaaaaggactctgttgtgaaaggctcctaaagctaaatcaataaacggctaaagtcggacttatctataaatcttggtattttattcctttttctacatgagaaaagctgttaggaatattatgatctgcactgttaagaaaactagctatgtctttaggacaattcatgtgttaaccattctagataactatcaattatttacatgtacatcctaatagaagaaaactggcttagtggagataataacaggatttctttggaaaattatcatctttattctgatgacatgggtagagaactttgcttagagcctatctaaatactaataaaaatttcaagacatagatccccacagtgttaaaatgtctacagtctctgtggtgatcatgagcagcaattactgagcaattctctgcactgagtgagaagcaagcaagcttcctaccagggtactttttctgaacactgtagagtacctctccaagtgagcaggctgacttcctctggataatatcactctctaggattcctagaagttcccaagctctgtagcttcagggagcaggcctccctgctttgcctgctgcttgccttctttaagctcctagaatgcctgcatgaactctaagccttacgccctttcttgctctcccaggagcttcaccttgtgtgaggttgtcagcagccacccctggctcctctcatctccaacacctgtgcaggctccaccttttctctgtagctagattctgagcctccccaacaacacaacatcattttcttaagccctgtctactgcattgacgacgtcctccacacctttagtttcttcccctgataagcatctttccacttcaggatgattgttgttggtcacctagatgctacacatcccctagaccttacctcttctggctcctccatgcccgagggccctcctgtgctcaggctctcttcagaaagactaaggctataggaacatctatca

SEQ ID NO: 22499 - DNA, 1130 bp, Mus musculus
tcccctcactcatggaatcctggtcttgttcctctggggctttctgcaaactggacgtgcagaatgttgctgggtaaaaaaaaaaaaaagtgcccagggttgtgtggagcaacacattgttcaagcaagccgagggaacctgcccagggtggcttcctaacgtcctgcctgagtctctccttcagctcccaaactccatgcttgttcccctgcttttagaattgaaactcagtgacccaggaactggatggcagtggatgttcttcatctgtcctagtagtaaatgttctttgtgtgctatgtaatgagtgaattcatcaagccacttggagttgtagcattccaaacagtctcagctctttgttaaggcaggatcttgctttgtacagaccgacccctgaatcatgttattacaggtgtgcatccaccatactaagctcaaccagttttttgtttagccatcttttttaattttatatgatttcaccacacagagatcagttgtttggacatggttaccactatacagcacagcatcctcaatggctgtgggcacgtggaggttagtgacgatgacaggccaggctactgctgctgctgctgctgctgctgctgctgctactactacttcttcttcttcttcttcttctttttctcgttctcctcctcctcctatccttcttcttcttcccccatccctctctctttctttctctctttctctctttctctctttctctctttctctctttctctctttctctctttctctcttcctttcttcctttcttcctttcttcctttcttcctctcttcctctctctctttctttctctctttctctttctttctctctttttctttctatctatctatctatctatctatctatctatctatctatctatctatctatctatctatctatctctcactccctctcactcccttcaagtcctatgagactgatagctgaaactgagataaggttcagggttacctcagggaaagtctcatacagtcacttcatatacgcagggaaagaagtcagagacaaagaagagaaagtaagcccgtgcagctacagctggttttgttctcgagttcctaaggctcactggtcggcctca

SEQ ID NO: 22500 - DNA, 1656 bp, Mus musculus
agacatacggcctacttcctctaagggttcttaaaggacatttcaggaaatcataattacttgtaacaacactggggattacttattttttgtctaattataccgaaagcattgggtgtttttagtatctgcaaaattcttcttccttgtactgtcctcgagtccatgtggattctcttagtacctgttgacaggccctggtaggagcctgacacacaaatagaatctgttttccagccaagaaacacataggtggtggcacccacagaaacccagtcttaaagttgcagtgaatcgtctcaagttcaagtacattgactatgcatctagtttctatagatttgttattagatgcctttatagttctgttatttaatgctgatactattctctaaattcttgcctaggtctgtaaccagtgatgaaggatccatgagtgcattcacaggaagggggtcacctggtaggggtcaaaagactaaagtcagtaccacaccttcatctggtcatgctgcgtctgggaagcactcaagcagcagattggctgttacagaccccacccggcctggtgccaccaccaaaaccaccacctcctccacctacatttctgcctctacacttaaagttaacaagaaaaccaaagggctcattgatggccttactaagttttttacaccatcacctgatggtcgcagatcccgaggtgaaataatagacttttcaaagcactatcgtccaaggaaaaaggtctctcagaaacagtcatgcacttctcatgtgttggctacaggtaccacacaaaagctaaaacctgcaccttctgcacttctgccccctgcccccatctctggtcagagccccagttcacaaaagtccagctcttccacctcctctacctctacccagagctcttccagccagtccggtgagccctcctttagcagtcttactaacaacagccagctgaaggctctctttgatggactttctcatatctataccactcagggacagtctcgaaaaaagggacacccaagctatgcaccacccaaacgcatgcgtcgtaaaactgaattctcttccacggcaaaggctaaagcccgtttctttggaaaacgagattttaggagcaggcttctctctcactcctcctgtagctgggggatgactagaggacatatttttaaagccattgctcacttcaagcgaacaacttttcttaaaaagcacaggatgctaggcagattaaaatataaagtgacccctcagatggggaccccgtcatcagggaaggggagcttggcagacggaaggattaaccctgatcaggataatggtaagcaaaaggtgaaagctccagcccaacctctgcccgcccctctcccaccccaaagagccaggaaatcagctctgcccgggacataggctctggctcgctcgctctctctctctgctcctcactttgacacacatgcagtgagactttgacctttttctaattctgtctaaacctccaaaaaagtgttttttcaactaatatctccagcctcctattatttatttccattcgtagtggcactaggcacttccccctccagataccttcatagcgttgctcccagctttgtagtccgcatgagtagccaccaccatgct

SEQ ID NO: 22501 - DNA, 1184 bp, Mus musculus
ggcaaagttcatcctgcgtccgtctcagcagagcctgatctgtgcttctgtggagtgtgcattggatttgagtgtgtttgcatgtttacccattcaccttaggaaggagaccgatttcaaaagttcagtgaacaagttggcccattacatttgttaccctttatccaacaaaaagccaaaatatgtcatgtggaggaataggtagattttgtgagctcaaaactaatgatggtaatgttgtaactagacatcacttcttatcttggttgaagaatatgttttgctttgtattgttcttacgttccctcgtatttgttatagaaagatgacagtgatgtatgtagtagggaaagagttactgctggatctgtgagcagggttagctatataagcttataccgctcaatgcagaaagagatcccattgcccactgtgcggattcggtactgttgttggtaatgtgcactggtcacccatgcttcaaatcactgaacaccctttcttctggtttcaaatgacagatactgatattaaaataagcatcaaacaagaaagtgcagatgtgagtctggtgggaaacaaggagctcgtgactgaagaggatctggacgtttttaagcaggcccaggaactgtcttgggaggtaaggcccagacccaacacagcagtaatgagatctgtgggacttctaacctttgcagtgaggctgtagagtcctttgtggctctttaatgcttatgcgggtttttgtttctttctttattttttagctatggcaataaatgtagattatctattcttctcaaaatagaagaagacttgactgatctcacaaagcagaccaaagcagtactagttatacagatagaacaagaattatagaataataattaactggctgtggtggcacacgtcttcaatcccaacattccagagacgggtgcaggcctagctctgaattcaaggccagcctggtctacagatcgaatttcaggacagcaggggctacatagagaaaaaccaaaaaattaatagtaatggcagaaagatggctttgtgggtaaaggcatttgctttgcaaacctgacagccgagttcaaaacacaggtatggtggaaagagccagctcccaaaagttgttctctgaagctcagcacagcgcagaggtccacacaagcatgcat

SEQ ID NO: 22502 - DNA, 1219 bp, Mus musculus
ggataaaactaaaatggatgcctctgctgtttaatccacacttttgaagaatcagaataactcaggcggttcatttatattatttttatttgaagtccttttgaaaataacaaaagtttggcatgcatgatgaaatttttatttgtttttttaattttcagatttacttggctccaatttaaaagtaagagggcatgcctgataaattttaactcataataaattgcaagtgaaagtgactttgctaacgttgctgtttcttgaacgagcttaaggaggagacgttagctgtcttgaatttaccttaacaagaggaaagatgggattctggctctgcaagtaacagctgttccctggttaacactgtctttgtttaatggagtattttaatcttagagtgtaggatttagaaataaaattatatactttttaaaatgatatacagaagaagcaagtttatattctgatgatacttttatgttaaataatgttgtctgtttctctttttctaggttgatgggaatatgagtaaaatttattgccaaaacctttgcttgttagccaagctcttcctggaccacaaaacattgtattatgatgttgagccattccttttttatgtccttacaaaaaatgatgaaaaaggctgtcatctggttggatacttctccaaggtaaaccacgagccagcatggccttctctcgcttgcttgcaaatgtttttagtggagctcaggtctttgaacagggtttttttgttttgttttctcttgtttttgtatttttatgacaataatttgagtaagtggctcatgtttctgaaaacctcagctttttgtttaaagctcatttgaaaggacacaaacaagaaacaaaacaaataacaacaaaaggtgcctaggaagtgtgtaaaggaccccagaaccctgtgctgtgctgacagtgaccatgcgacatttcattaccaccttgtagactgcctcgcagctttgatttccaaatgttgagcttctttcttcttttaagtggtgtgcacatgaagctttctgtgatggagcacttaagacctcagcctctctggctcatttcctacctcgtggtcagcagtatccagtgttagagcattggtgtgggctgctgagatggctcctgagaaacgtccaggacctgcttggtaggagagaactgactcccagaagttgtccgcatgcaccctacc

SEQ ID NO: 22503 - DNA, 1195 bp, Mus musculus
ttccaaatagttctcggcaaaagtgccattttcttcctggctgcaacttctttgagggtctctggattcccagaggaggaggagacacactacaagcagggccaggcacctcagggcattggctttgggtggtgtttggtgctcatcatccctgggatgtgtgcaggaggttctgactaaacattgggtttccagtcatattctcggcaccctgaaaagtatccctcccaacaagtgcttgcagagtccctgcctcttcacagcctctgagtgcacacacaacaggagggtgctttgctgggagagaccagtgggctcaatgtccatgacacatagagcgtgttaccttccacctatggggcagcagtcctgcgctgcagtcaaaaggccaaggaattgtcaggagtcagccttttgacactgcaggagtggagggtactgaaaggtttgtactccagtgctccccaggggctcagcttgctggctcgcctaaattaccgcatgctttttagactcggggtacaagaacagctaggtaaaattgaaagggagggtgggaatgcttccctcttaggtcaaagtgtgggaacatagagacataataaaaaccgtgcctccagggtaaggtagttctgtgtagtggtgagcgtaggtgggagggggaactgcttgtaggccaaatttctgccttcaacagtgggattcacatgaatcagtgagggcctggggacttccatagttagtcactgcagggaacttttaattgtgggatcttgtggacaaagggaacagttatcatccatggttctatacctgcgcctcacccccccacccccggcagaagtacagagctggggctcccagctgactaagtaaatttctcaggctatgccaagcacttagggagcaggtgacgggatacgccagttttctgtgctgaggtttgggcttcctccactgctctggcaacgcagcactctccatgttgacaggacacgatatgggctggctgcagcacagcagctgtccacgttagcattcctgacaccgctgttgaaaacctcagtgtggcagagcggcacgcgccgacagtggcttggctgttaaagtctggtgtttgtttgcattcaatacttaaacaggacgagaggagttaaaccaaaaatcttaggcaaaacacgatgcttattttatt

SEQ ID NO: 22504 - DNA, 1920 bp, Mus musculus
aagaaggcagcaaagacaatcctgagcctctaaagtgcagacaagtgtggccaaaaggagcgaagcgagggctctccaagtggaagcaaagcaaggagaggaagacgggcttcaagctgaacctgtacaccccaccagagacacccatggagccagaggaccaggtgacgatcgaagagcagaaggagctttcagaggacaagggcagccccgtggggatggaacgggaggtgacagagaccgtggatgccttgctgcctcaggaggggagcagaagggaagagacaggcatacccgtgagtccacataaatcaccaggtggaaaggtagatgaggaggacctcatcagaggtgaggaggagggagaggaagagggagaggaggagggagaacgagaagaacaggaagaggaagaagaagtaactacagaaaaagacctagatggtgctaaaagtaaagagaacccggagcctgagatctccatggaaaaggaagaccctgtgcatctgggtgaccatgaagaggacgaggatgaggaggaagagccatctcacaatgaggaccatgatgcagatgatgaagatgatggccacatggaggctgccaacatggagaggggagacctcccaagagaaaccttcaaagacgcactagagggccaggaggcttttttagacctgagcattcagccgagtcactcgaaccctgaagtcttgatgaactgcggtgttgatctcacaatgtcctgtaacagtgagccaaaggagcttgctggggacactggaactgcacctgagtctgacgcggagcccccggaagaacagacacagaagcaggaccaaaagaacagcgatggtgtggatgctgagctcgaagagggaggcccagccgctgtggaaattgactccgagaccgcccaggctgttcagtctttgacccaagaaaacagggagcacgatgacacctttccagattgtgctgagactcaagaggcctgtagaagcctgcagaactatacacacacagaccaaagtcctcaaattgccaccacgctggacgagtgccaacagtcagaccacagtagcccagtttcatctgtccattcccatcctggccagtcagttcgttctgtcaatagccccagtgtccctgccctagagaatagctatgcccaaatcagccccgatcagactgccatcacagtgccacctctgcagaacatggagaccagtccaatgatggacgtcccgtcagtgtcagatcactcacagcaggtcgttgacagcggattcagtgacctgggcagtattgagagcacaacagagaactatgagaacccaagcagctatgactcaaccatgggaggcagtatctgtggaaacggctcttcccagaacagctgctcctacagcagtctcacctctagcaatctgacacagaacagctgtgctgtcacccagcagatgtccaacatcagtgggagctgcagcatgctgcagcagaccagcatcagctcccctccaacctgcagcgtcaagtctccccaaggctgtgtggtggagaggcctcccagtagcagccagcagctggctcagtgcagcatggccgccaatttcaccccacccatgcagctggctgacatccccgagaccagcaatgccaacattggcttatatgagcgaatgggtcaaagtgattttggggctgggcactacccacagccatctgccaccttcagccttgccaaactgcagcagttaactaatacacttattgatcattcattgccttacagccattccgctgctgtgacctcctatgcaaacagtgcctctttgtccacaccattaagtaacacagggcttgttcagctttcgcagtctccacactctgtccctggagggccccaagcacaagcta

SEQ ID NO: 22505 - DNA, 1978 bp, Mus musculus
actctgaatgccatgaatgggtatagcatgtcccagccgatgatgaacagtggttaccacagcaaccacggctatatgaatcaaaccccccagtaccctatgcagatgcagatgggcatgatgggaagccagccatacgcccagcagccaatgcagaccccaccccacgctaacatgatgtacacggcccccggacaccacggctacatgaacacaggcatgtccaaacagtctctcaatgggtcctacatgagaaggtagacagcctggcagcccacccagcccactgggccccactattggattgatctgcacaaatacctttgaagagtacgatttcaaaaccagcattggtgtgaatgcaaaaacatttgttggcaccatttatttaaaaaaaaaaaagctgtatgcagcagaaagaaagccttatacaagttgtttttcttttttcctttttttcttttttggtacctttatttctgttacttttatataaaattctctgcaaaggaaggcctctcttaggactctagttggcagcggccacacgtcgtgcctgcttccattaaacagtgtggatacaagcccctccccaaatcacctgttttaatactgaacctccagcttttctccttcctgtctactccatggaaatgcctttagcatttcaattactgtatattttgtttaaggtgacccttcagcatgccgctaatgtctttgttagtgacagtgcattttgtagtactgtacaagtgttgtgctaacggtaagccatttcttaagttttttgccttgattagggtaccctaatttgagggttaaaaaaaacaaaacaaaacaaagctctatttttgttaattataaaactgtaaagagctacagagctatccccgtctggttagtgaagggggtttatcgctaaatgtttggtgtaaagttgagaagacctttttccattttggtggcaggctcctttggggggaggcagctttctgttttataaatgcacacttctgtttattgaatgaagcatatctcagtgtttatctgtcaggttttgaagcatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcagaaaagttatttgtgtctgtttctattgcgtccttttttagcctttgtacctggacaggtgacagtaagggccaagcaggagaggcgggcgcggccttgtataaaataggagccagcgggactcttgtatctacctgttctctttttagtcagttacttcaaaaaaaagaaaaagcaaaaacaaaaaaacaaaagctgtacattttaacataaaataaattatgatgagccatttctagcctctcgtgtcctgtcatgttatgattgatggagaatgaccagctgagctgtgtcatgtgtcacatttcagaacacatacacgatgggggaaataaattatttagtgtaaattgaagttatgagattttttttttctgatttgttttgactttgggggaggggttggcaataagtatgaatgagtactatctaataaaaccatcacctataccaaatacctatttaataaattaatttataatggattttaatgcttttccatgaaagttgactttatgctggtgcataccttctgtatgccaatcattgtctttaaataaagtgagtttggttttttctttttgactttgatcttcattttgcccagagctcccacatagataatccatttgcttcctttgtgccaagcacgtgtaaagccccagaggcctggtaccacactagcaagctgcttg

SEQ ID NO: 22506 - DNA, 1146 bp, Mus musculus
ttaaacactttcaaggcattaaactgaagtaacatgagctcacctcagttgtttactgtcaggggtgggggtggctgatggtccagcattttgaattgttttttcatatattttattgattgtttgattattttaaatcagagtaaaatttgttctgctcttatatcttggccagaagcagcggtcctgctgataattgatatgaatcagttattagttaaaatggaaagcatccttgaacatttattgactaaaattcatttggtttgtacagaactagtaatctgacatgttctttattcgaagtcttctgttccctgcaattcttgtggttcaacatgactgttattaaatggaccttaaagcttactatcattttttatattcttctttaatgcttgctctcagagttggagctaactattggttagtgtggccctgtaactattctgtagtagcgcacaattaaaggacatgcactaacctgatgaggcagagcagtggaatgtgtcatgcttttagggcattctcacagcaggctcaaaggctggcttctgtgttacaactccaattatctagtggctaaagcgtggccatcaaagccagcttgattgaagttgaaagaactggtgagttagtgtgggggagaaacatgaaagaagagaaaattattttgctccgagatgagatgaaattgtcctaagagccgtgctccaaggatgggagtgacttggaacccgctggcggtgagcccttggctaagggaaaaggagcagaatagagatagagcggggaatgttggttgttgtagatgaggtttgctacttggtagctgctgctgagtttatagcacatctcgttgggtatccaagtatgatgctttaatcagcatccgggggaaggaggacacagatgaagcaggggggatgaaaccatccagcaatgagtgtaaactcaaacgttgtagaaccatagttaatggaatcctacgtatgctttatgtaacttttcagcagtgctccctgtagatgggtggtggatgttcattttctaagattgggaaagaaaaatgtgagttgatgatgtaatgctggacatttttgtctttgggtaaattttctcatgtctgtttcttatttcctgaat

SEQ ID NO: 22507 - DNA, 1222 bp, Mus musculus
aatcttcttcatcttggctgcccatgaacattattccattgatgtgtttattgccttttatatcacaacaagactctttttgtactaccatactctggctaacaccagagcgtatcatcagagtaggagagcgaggatttggttccctatgttttctttctttgaatgcaatgttaatggcacagtacctaatgaatattgttggccattttctaaaccagcaataatgaaaagactaattggatgaagactctctctctgtaatgagtttgttgttaaatatacagtagttatggaatgaaaatgaatactttgtcccaggctcctggatacgttgcatttggcttctgtgttgacaggtttcccgttctgagaaaggccgtgactgtaaaactcaagaaagaacacacaagactccttattagctgtttgaatggagaggtcatggaaagagtttccgcccctcactgtaggaagacccagcgtggggtgatgtcaggccgatacctgtgcatgctgagtgtttgcttacggaactcaagcacatcagcttgggctggttgaagaattgttactgattcccagtaggactcaagtcaagaatatttctgaagctggctttccttacctagtgagccgttctcatgtgttcattgaactaatctgtgtctgtctgcaaagtgagtgtcttactggtaaatatgttttaccttttgagccatttgaaagaaaaacacattgaacacagcagaaacaaaagaatgcggggggcaccgtgtgaggtgacacgctcgctgatcaggtgtcgccggcctcccactaatgcaggggtcagcatttcagagcaggtgcagcgtcagttgctgtccctttctgttcggaagcttcagtgtgaacaacagaaagggctcctgaggggaggtggctgtgttcctgtagtgctgtaagtccccggactaaatacttgttgtaactgttagttaggcagatgacagcccaatatactgctttttaataatgtgacttaagtgaacacatgagtgttttaccagatgttagagttcttacatcagtgagtgagtaaatgtgcatgcagagaattcttttcttctggaaaaaaacaaaacagaacagaacaagctgtaggcgcagtgctaattctcggggtgggggtgggggtggggtcctctttttgttgttgtttttccctgaaagttctcat

SEQ ID NO: 22508 - DNA, 1176 bp, Mus musculus
ttttctccttgacagcttagtacagaagcaaggaaaggttttgagttcttgggggtgcaaaggaagaattgcctacattctaatcccagtgtcgctgccctccctgtggtgttaagcccagggctgtgtgtgcgaggcaagtgctctcggcttttacagtgcaaacaggatctactgaaaggtagacatgctgggtggaaaggaacgagctcctatggaacataagcttgctctcaccaccacatagttttggcagaaacctttgtgttacacttcccaacgaggccagagttgctgtggcaaaaataacctttctaaagcaatgggcttcatcttagaaccagtcaatttaaataacgtgagctgtaaccaagaaaacccacacttccaatagcgtaacattgacactgtaagtggtgaccagccccattctacctgcctgttaggactgagaattccaaaactctgtaagttataagtggggaacaggggtgctggatccttctatagcagagagcaagtagtctttcaggaacatttgtgcaaaagtgtttggttgtttgttggggggggggggttctttgtttttgtttttgttttattttgttttgttttttcagagacagggtttctctaattcagggatcacctgtctttgcctcccatgctgggattaaaggtgtacaccaccacacacatctttttgtaaaacttaattcgtataaattcagatttgtggcaaaaatgtatcttctttatattcagcaaaaagaaattttatcattgaaagattctagatccaaaatgcttaacaatgtttacaatattcttgacttaaactctctgatttagtacactcaattatttgatggtcttgtggatagaaatcccatagcaaaagcagacagtatagtcgccctctcagctgacagacttaggagacaagaacggtctttagaatagtccacttgctttccttcagacagcgtgaaagcagaaagcatgtcaggggtttttgttgttgtttttttgttttcttttttttttttttttttttggtttggtttggtttgggttttttgttattgttggttgtgggttttgtttttgttttcattttaaacaagcttatgtaaataagatgcttgacttgaagggaaaactatctaagatcat

SEQ ID NO: 22509 - DNA, 2388 bp, Mus musculus
gagtaatttattccctaaagacatgtaacagcttcaaaaaaaatataaaaattgtccttgaagctgggcatggtggagcacgcctttaatcccagcacttggtaggcagaggcaggcggatttctgagttcaaggccagcctggtctacagagtgagttccaggacagccaaggctacacagagaaaccctgtctcaaaaaaccaaaaaaaaaaaaaaattgtccttggttttgcaatgataaatgaaaatcattaaaattctccaattgaacaaggcatgcaaggatttggtggtgttgtgttcttttgttaaaacaatgagagcaaaataacttactgaaatataaagatgagagctgaatgagcatgccaccaatggagaaggggtattttcacagacccagtactttcccccagaccatctccatctgatgccaaccagaacagaacattggccatttcgtttaaaaaaaggaaaagaaagagagagcactatgcgtgtgcacatacaccagttactttttgtacaataaagaaatggggacagggaaatgaaagaagagaaaactatactgtgtagtcaggatgtggcgggaccaaactgtggctttttaattgagaatgtattcttggtctataacaaattctggagtaaagtagcaggctccctttttaagtagacacctccagtctgctgctggaacacatacatcgatctttattctccactgattggttgcccatcgaaccggaatctgatctgcctcattgacaaaccctgccgttcacaataggctttcattagtttactaagtggtatatgcctcttaaccttacactgcaccacagaaccatcctgtcccgccaccttcaaattaatatgatcattgttctcagtcttgactccttccttgggtttctcgtcagccatggcaagtgcaggagtctccttgtggccttcgctgtcctggaactcagacatttttctgcctctgtctttgcctctgcctctgcctcccaagttgctgggattaaaggcaagcatcaccacttactgcctagcaagcatgtcagggtttttttttgttttgtttttgtttgtttttttgagacagggtttctctgtatagccctgactgtcctgaaactcacaagcatatcaggtttaatggcaactttacataacagtttgtgtttattaaaaagtgagattagtcccagtcacccctattacctctgcagctgaggattaaagtaccatcagagatgcttcaggctactggatggaaagagaaagggttttgtttgtttgttctccttatgaatagctttaaatgactaaaattactgtaaaagtaggtgttggtttgcctgtagattcagtggcactgattttacataactaatatgatgaattactgtatcaagttcagtacaaaggtctgtgaactctaagctatttctccagctacactaagttgtttttgaggatacattctacactgtgttaatcaaaggactctttattctgtgaatttcccatcttggcataaggaagctttgtgctttgatgggagaaggaatattctattgtttgttttcttttttccattgttacttcacatctcttttaatctgaactagtggattgtctgaagaaccaaaccgagcctattgttattaacatctttaaaatgtttaattttaataatttttcattgaattcatggattgttgggataatgaagtatttgtgatgtggaacaaaggaaatgaaattggtactcagtggggaagcaggttgcttggactaagccaggcatgttcagttttgagaattctacctaaaggtctccctgcccacagagaaactagtgttacttgaagacatgaaaatccctgtggtagccagaccttgaagcacagtgttgtaataagtaaatacctgattctaaattaaattcagatttaactaatatatattattttataactttgttgtattaaaatgttttaaacactaaaaaataaagcatttgaaagttggtatgtggcttgttataacccttgcactattaacatagtgcgcctttatgtctcagacagagtcttgctgtgtgtggtctgctctcaagcctgtgtgcctcctgcctttgacttgctgtcctcctgcaccagcctccgtgttagaatggcagggttttttccccaaatggttaaacactgcagctttaggaaggaaaatgggagggaaggaagaaaagaatttaaattgcatttcacagtacacacatggaggtcagtagacaactctggtcactgttgtgtctcaggggttgaactggagttgtcaggattggtggtagccctgtgcatttacctattgt

SEQ ID NO: 22510 - DNA, 1146 bp, Mus musculus
catggtgattctcttctcccctcggtcccttgccttcacagtctaaaagtcctgtcccatctccttgcccagccattggctgtatggtagttctttattatcagtcgaaggcagctgggagcaggaactcttagtgctgggagcacggcttttgggagccaaaataagacaaggcattagaaccagttcccagcatgccgcttaacatacttgctctccagcgctcctctgggctctggaaggcctgggaccgccatcctaaattgtcagggagataaggagttgataaaccatgctcctcgtcaagcctcaactagttaaagccaagtccagcagcttagcggtcagagtgtgaggaaggaaggaagccagccagccagccagccagccagccagccgtgaggatggaggaagtagtgatgctgagctcataaacttcctactatgtattcaaagatggctctcacctctagtgagtctgacaggtgccatcagtgacatagttacttgtttttgtgagtttttttagtgtattttttaggctgtggattatgtcaggagctgtatacacatcctaaggtgtgtaaagaatatcaggttctgctgacgattggattttgaattcatatctaatgttcaagtggcacttggtgtttacttagtacataataatattttagtatctcattgacctaaaggcacaggcttcacagttccatgatggggaaatttccaagaactttgtctcccttcagaaatgtttttttctctctttctaggcaaaggtcaacaactctagtttaattggagtgggctatactcagactctgaggcctggtaagtatctttgataaataagttttgttttacagctccctctcaaatccctttaaaaagattcatttatttaagtttatgtatgttttgtctgttggtatatctgcacactagaagagggcatctgatcccatgggattacagatacagaagggtgggtgatgggaattgaactcaggacctctggtagagcagccagtgctcttaactgctgagccgtttctccatttgtacgttattttcaaaattacatttttttttttttcctgagacagggtttgtctgtgtatctggctgtcctggaactca

SEQ ID NO: 22511 - DNA, 1319 bp, Mus musculus
ttcagttgtgatctggtctccagtgttaatttagtctgagtagtccagtgaagacggtttttagaacatggcttttagggcattttgaacttgttatttattactaacctccctgtgccctcagatggtgttgaccatcagtttttagcaccactgttgatctaggtgctctctgctggctggagtcagtgtggaggctgcgtgctgaggaagggccggcagggtggagtgctctcaggcccatcatggtggtttgctttgttcacaggtgtgaagcttacactgtctgctctggtagacgggaagagctttaatgctggaggccacaaacttgggcttgccttggaattggaggcttaatccagttaaaagaaacctctgggaacgaatatcagaagatttggccttaatatatttccatgcgaccagcaggctccccttccttcccccagaaggtgatcacatcaaaggatgatgaagcaagagctgtattttaaatatttagacagtcactgttggctggttcctagttggatggttatcagtgctgccgtggtgcggccccctatacattatttaaatgtatttaactgttaaatgtgctacccaccaatgatgaaatagacgtttatgaaaaccgtgccatggtgtgcatgtttgttttatgttccttttaacattgactattgtactgaatgagatggatcagtggctgttttaagatgaggtaaaagatttttttttgttatattcacccatcattagaattactttggtaaccccaaacatgacaaattatgaataaaacaagtgtacataactaatggctcacgtatgtgcagttacagattgccagcctagggtctaatcttcttggcaaatacttttttctggtgagcattttgctctttacctaaacctgtgcaaccaaattccttgtgtccctagcataatccacgaggtctttgagattacaataaaatacaaggatacatactttaatactctgcagtttctaagtttgtgcaaagttagagtgaatcactgttaacccatggatgatgaagggagatgcaggggtggtgctgagtggctaaataggcatgcatccccttccttctgagccacgctacagaaagtggagcctgggtagatggaagcaacaggccaagagaggagaaagtgggcaccattctcttctattgacagcgttgaaaagctgagctggggtctggaccaggcagcccccttcgccatcacctgggtgatatgtattacctagtgatcctggttggaaaagtaggaccgtgccagcttcc

SEQ ID NO: 22512 - DNA, 1141 bp, Mus musculus
ttgctccctagccaaacaatttgtacaaaaaaaaattgaattaacaatctgacttttttttttgcattgattattataacattaagagagtcccaggagtttcgaggctgtaaaaacctaaattgtataacattactcacaataacgcatatgttataatcgcaaagaacttacttaaaattcaatccactttggcatcattatcatgtatcaacataataaatgagtccttcagagcatggtaattataatttgataaatcatcagcagaaaattaactggatgtcaaaacattcattggagagggtgatgaatcggggatgattgcggtgatgaattgtgttaatctgcacagtatgaagccagcgaaatggctaagcagcccaagatggatggggcacagaaccagcaaggtcaggacacagagctgggagaggagggaggcagcaggcaggggtgggggaggagcctaggagggggagaagaaagggctagctgctgcttcccttgaaggcccactgttaaccccttccccacagctgcctgggttgggggtggggtctagcaagggccctgttcaagatccaggccaaggaggaagtagaactgtatcccacttaattagaaggcttcttcttctcccacactgccccctgtaactctgtggttattccttaaggacacaagtgcttagtgaaagataaggaacctggcaactaacagttttgtattaacatcaattgtgtgtgtgcatgcactagctctgttatgggcactcctagcctctttccacctgctctgtggctttgtgggctcatagactcctctgcacatagctgacttgaattcccccagatatatcaaaggagagagactatatcataagagttcttgctagtagtgggggtgtgggggtgtggcagcatgtgcaaccaaagcatttctcttctcctcggccatctacatgagcaaccatgttgctttggctgagtggctagtctgtgtttcttccaaagagtttttcaagcctgaatcttgtcagcttctcaagattccatcatggaggaaattatactgggtgccaatatctagcaccatggtggtactatctgtgctttctagtctcttctctttggcctcc

SEQ ID NO: 22513 - DNA, 1126 bp, Mus musculus
tgtacagaacagctccttaggttcctattgggtttttgcacaggctttcctgcctgaccctttactaggcaccccctcttaacacctgcctgctatcaccccatccaaagcagttcttctaaactttactcacccttagtgattcatcataaacagaaactaaatgtgttactttccctactaatatttgtgttttaatgatagtctgcacattgggattatatttttaattatgagtgtgtgttgtgtgtgggtatgcacacatgaaggcaggttactgcaggctactgcagaggctagagtaataggctgttgtaaggcaagcaattcagttactaagaaccaaactctggtcttctctgtaagagcagaatttgctcttaactgctgaaccatctccctagcccctgaagatttcaatctagatgcaaccatcaggtctcactccccgttctatagaaatctgtgtacagattctaactcaagagcctaacaaggaattccctttaagtagattctagactatctactcatccagtccaccacttgcttgctgggccatcagaaatatatctgaaatacaaactaagttgcaaagaacaaaggtggcatcttggtcccatcttcactgtggagttatgaagtggcttagtcttcagcagcatctggtggatatgaccaccatattcaaggtgctgaatagctgtataattggttgctcacctggtaagttcagcctgtgttccatcacctgacttgaacagtatgtcttgggcatgctcaatgcagacaggaggctgggtgttccatgctgtctgagcaggaaaaaaaatggtgccaatctctggagagtccaggtgtttcctgtcctatccccctttttaaggaatgttctacctaggaggccacctcctgaaggtcctgaaggcattgtgtcttttatataacattttgtccctttagaaattatcatgacacgtgtcaagagctttcacaccaaaaagaaatatgtcacattagcttccaagtttctgattgtctaaataacgcagcaactcaacatacagctgtctggcattttgacagtacaataacccataattctttctgccactcaacacttcaa

SEQ ID NO: 22514 - DNA, 1687 bp, Mus musculus
ggatgtcatggagaatttatagcagtttaacacaaatactctattccagaaaacagtaaaacctgggttgccttggtattacaaggaggaggagaaagaggagaaggaacaagagcaatcgagagcaggagcaagaaagcaagagagacagagacagagagagagagagacagagagagacagagagagaggcagagagaatcggatagactaggatgcttaattcacagtgctactgcaaggtctgcatcgatggcaccatgtcacataggctgggcacgtagatttcaaagcagcccggacagccacctttggtcatgtcgttgcataagatagaaaagaaaaagccataacaaaacattaaaaaaatgtattaagtaatgttaaaacaagtacacagtatcatcacgtaggagtgattctaccaaagcaaaacctgatctctatgtgatggtgagtccagctgctgttctgagactggctacagaagttggtgttaccctttccttagaaatgtggaactcactaaacctatgcaaatcctctacaagggtactctgagagtgctgctggttcttttgcatgatttcccagagttcctttgtgattaccattatgggttctgtgatgtgatccctcctaattgtatccagttaagaaatttgatcctgagtgccttcccaagaaacatgaggctcccagacccattcactcctaatctgaaggtggacatgttaagcgaaattaacatcgcacctcggatcctcaccaatttcactggagtgatgccgcctcagttcaaaaaggatttggattcttatcttaaaactcggtcgccggtcactttcctgtctgatctgcgtagtaacctacaggtatctaatgagcccgggaatcgttacaacctccagcttatcaatgcattggtgctctacgtagggactcaggctatcgcacacatccacaacaagggcagcacgccgtcaatgagcaccatcacccactcagcacacatggacatcttccagaacctggctgtggacctagacactgagggccgatatctcttcttaaatgcaattgcgaaccagctacggtacccaaacagccacactcactacttcagctgcacaatgttgtacctttttgctgaggcgaacactgaggcaatccaggaacagatcacaagggttctcttggaacggttgattgtaaataggccacatccttggggtcttcttatcaccttcattgagctgattaaaaacccagcatttaagttctggaaccatgaatttgtacactgtgccccagagattgaaaagttatttcagtctgttgcacagtgctgcatgggacagaagcaggctcagcaagtgatggaggggaccggtgccagttagatgaactgtgtatatcccttgcagatgcatcagccttggtccgctgaaccaagttcataaactgaagagtcctcctgactttcctagccctttggttctcaggggtctgccccgccaactgctggggttgatctcctgtctatgtgggcaagttccaaagtttaaatgcatttttttgactcttggccaaaatttagaagatgctgtgaatatcattttgaacttgtgtaaatatatgaaagagaaaatttttgtctgaaaaaaaaaaaagaagtcggtgttac

SEQ ID NO: 22515 - DNA, 1431 bp, Mus musculus
ccctatttttattttttaacatggatactgggatctgaactctggttcttatgcttgcacagcaagcactttacctgctgagccatctccccagctctcctctgccccttctgtttgtggaggctcagagagaatgttctgctaaagccccatgccagtgtggtggtcagaccaatgagggcagtcttggtgtgaatgactcccacactcactcctgttcccacaagttcccccatggccttatccacagcctgcagagctgtggcacttgaaggatgggctaggcttgccctgtcttggccagatgctcacatccacaagggcctgcttttacctcctaggatcccagatctcgcatttaattattatcaatcacaaactagcagtccccacttctaacaccgtgacatctacttctctatgctcttgtttgtcctagatttacagatagctcgggttacttttcccttctacagcagaaggccatttgtgtccttgagaccacagactggtttctaaaggcatggaggactagcagggcagccccagggtgctatactgcaagcagccatgagagggggcatatgagctttcaaggtttgtaccactgggtttggccacagccacgtggttttgtgctcaccgtggcattgcatgaagtccctcagatcatcctgaaaaggtcaaactgacatgatggtatccccagacttagtgtttgtacccaatgagattgaaacatggatggcctctctattgattactttgcttctggtgaacaaatacctggcagaaagcagtgtcaagagggtttattctggcttacagttggggatcattcggtcatggtggggaaggtatggcagctggagcaggaggttagctactgatatcacctctgcattcgggaagggaagggacgaaaagggacgggaaggggagggaaaaggaagaggaggggagggaagaggaaacgtttaggaagtggagctatgctataaagctcacttcccagtaagctacctcccctggcagggctccatctcttaaaggttcctagcaaggctgcatcgcttaaaggttccatcgccttcccaagcaatgctaccatctggagaccaagtgctaaacgcatgaacttctggggcaacattgcatacccaaactacaacctttagggccacttcccaggacatcctccaggattctgtgatgcaggtaaggggatagttctggaaggattggcgcttagggttagtgaaggcttgcaggaagtgccactatgaggatagaggacagccaaggcctgggagctggaacctagcaggtctggagcctgggcctttcttctaggctaagagcaagttttaaaacagacagcaaagcttgtgggaggggggttgttctggtagcttaagtggctacctcatt

SEQ ID NO: 22516 - DNA, 1503 bp, Mus musculus
ctccctggaaaggcagctttggcgttcttgcagattcacctctcggcctttctcctgcctccttggcctcttgtttcttccccagctgcagtttatatttaagcatcacagtttagtcagtccttgacttcctcagcagggggcatgggtgtgccattgcttccccataggctctgagatgctaggcaggcagcctttgtcagtgcaaggttgcaaggtaacccttactctggcattgatgtagcagctctttctggcataaaactattcatgtcacagactttgaaatgagagcttctagtgggtacaatggtcagactcataagaagaaaacctgggagctttttcatcttgattacaacattctcagcttgattccacaaggatatccccattctttgttaggttttctgtttttgtttttcaatctattttttatcccccaccccctcccctcaccgcacttctgatgcccgacctatctgctaaagagcggattcagtcccttcttcaattgtgtgtcctgttaataggtactgtactgggttccgtgtgtcactggggtggtacctatattttaatactgttcctaacatttcattttactagcaagaaatctttgatttcattttattctttgtaactctagacattagattgtagtttggctattatcgacattttttttaaaaaagggatatattttcttgcacagctgtttaaggggcgagagagagacagttgcagccctcaaggctgttctgtgccttacaggcacgaattttctagctcagacaactgaggaaaaaaaaccgcagaccacgctcaaggtcttactctgcacagttacaggacaggggctatttccctggtcataggccctgttcggtgttcagcgaggaggcaggtatggatctgacaggtgggacatgctggactaaaatgttactttgtatcgcaaacaaaacagacttcagttcaacaaataaaggtcagtttgtgtaatccctgtgtgtagaccctggtggaggcagctcctcctcctgctcaccctgtttgtagcgtcttctctctcctggcctttatcccagaaccaggcctctgcagctctgggactagaagccttgcggagctgctctccactgggacccatgagtgccggagccaccgtcctcgggctgatgaacgaggttcactgacaatgcgcagtctcttacctgatgctcccacccacttctgctgactcctcttgtgccctgccatctgtctgcctagtggtgcactgggggaccattgaagtgtgaccagcccctcaggtcctcatgttcaagcccccatgtgtcaagctgtgctatgagaagcaaggaggaaggaatatttgggggttggggggggtggggaactcggagtgtccacatttggtgtgctatatgaagcttcaggttggaaatgtcctacctggcttgggaccctgttgtaaaaaaaaaaaaaaaaaaaaaaaaa

SEQ ID NO: 22517 - DNA, 1174 bp, Mus musculus
acaggtgtacaccactttaggtgttggcaggtcatgtggtgagtggcacgtgataggagtttcacgtcataggcattggtagtaggacaagatgattgtaaataagagttgagccattgctcatgggatcagcagttggcctcctcgggaggggcctggtctctcggagcagatgggatcagaggctgcttgtgggtcagtcagtatgtgatgttgttgtgatgttgtactccagctgcctgcggcaactcaaggcacaaaacaagtctcgtagtggagacttcctctttagattgatttttattttatgtgatgagtgttttgcctgcatgtatgtataccacatgcagtgcccgtggaggctacaagaatgtcaaatttccttgagctgtagttacatgtggttgtgagccagagtgtagtgctaagaacagaatctgagccctctgtaagaacagcaagtgctttatccattgagccatctttccagcctgttgtggtttgaattgcttggtccagggaatgccactattaggaggtgtggccttgttgaaataggcaaagccttgttggatgtgggcgatgagactttcctcctaaccacatgggagccagtctgctcttagcagccttcaggtgaagatgtagaactctcagctcctgcaccatgcctgcctggacactgccatgttcccaccttgatgataatggactgaacctatgaacctgtaagccatccccaattaaatgttgtcctttgtaaaagatgtcttggtcatggtaccagcaataaaccctatctaagacacaggcccaacaatggaggcttctgtggcttccgctctgtgctgcccgagcttctccatgacagatgcctctcttgctgtcctctggtcggtgtggtgaggagcaacactgaacttaagccttgagctctggccctttcctgtcactgaaactggcagggaatggatggaaattgtcggtgaccgtggcaatagggctatagaaattcctgcctcagctactggggcagccccagaattacttcagaattactgcctcagaatgccttcaccaaagctttgcccaaaggtttctgtcctgaaattcagtgcccccaccgggctctcctgcagtctggaggggaagatacggggtacattgccatgtg

SEQ ID NO: 22518 - DNA, 1239 bp, Mus musculus
ggttggcctcagtacatgacactggctgctgacaaagattcacttagggaaggcagaatttgtcgtaggcacactactaagtagccgcagtgaatattactcagtagttttagatggtgataacaactttcatttggtctcagtgtggacctaaggaaagacaagaatagaaagatcactgccgcttcctctccatcttcccaaactaaaggagtagtagggagaatggtatcttttgactttttccaaatttatttaatcacattatatcacaatcacagacctctgccctgctttgtcattgagtagagggaaatccttgctgtgtaccagcttacctggcacctcaagtaactgcaggactaggcacatcctctctcactgaggccacacaaagcaggccaagcaggacaaaaggatccacacataggcagcagagtcagaataatcccccactctagctgctggggcttcccacatgaagaccaagctgcacagctgctacctttgtgttggggtgcaggaagggacctagatccagtccatatttgctgcttggttgaagattcagtccctggggcccccaaggttttaggttatttgactctgttggtctttttgtggattccttatcccctctgagttcccaattctttcccccaagttcttctcaacgcaaaaggtttggcaggtgaggctttggggtagtgtacttcggttttgtattactgagacaggttctcatggatcccaaggtgtcctcagccgggctttgcaggttcaccttgagcttagatcatcctgcttcctcttcacccgagctagtattacaagagggactgccaagggcagcaaggacagctctagtcagctctgggcttcatatatgccaggcagtcactctgtcaactcaagtatatctacatctattgtcttcttaccacccgcaatcgtgttgcattgctctctgtgtaagtcacaaaggcctgtcaccagtcctgctttggtatctttggtgcagagaggagaccaccacattcagtctagggccttttctcccgatgggaccactctttcagtttcctctgccaacagttcatcaaagtgtagccagcactctgatggcttccttctctatcttggaagatgtcttggagcaatttcaaaggctgagcacatggctcctatacttgttcccgctaatccacatcccagtttgcagccagccctgcaggctgt

SEQ ID NO: 22519 - DNA, 1175 bp, Mus musculus
aaactggttagtaatatggctgggtcctgagtttggaggtgctttgactaagtttgatgttaagaagaaagctgggaatttttagtaatatatttagtgatgtagcaatcgttttccattgattgattgattgattgattgtgatgttgagtatcaaatccagggcctcatgcatctactctactactgagctatagccctatcttagatgtggcaaaatgtaactacatatttactcagacccttaaaagcattagatttaataatccatgctcaaacttagagcctggggcttctattactgtactttttgcttattgtgaaattctagctctctaccttggctacctttcacctgttgttctacttcctgcccctggtgttcacctagggcctcccctcctctgtctttgcttcctactcttacacacacattcagatttcttctccctttcgtcctctgtatataaacccatgaccagaaggccagtctgtgaaaggttgcaaaggctcttccctccaccccacacatgcacaagcccttcccttggcttcacctacattgctgtagctgttgctgtagctggcctccgtggacgcctaggctgtgagcatagggttgtgctgtgtccctttctgttttctcctctgtctggctgccttctgttactactgtgctgcattacatttttccagtataatttacatttctgacctgtaccccaggttccttcataaacatatcacagatgattgcctgtgtgggacagcaagccatcagtggctcccgggttccagatggctttgagaacagatctttgcctcactttgagaagcattcaaaggtaaatggcagtggaagactgaaggcttgtccagattgtcctctgagggacacagaactatcagggtgtaacgccacattggttgtttccatgtggttccactatgatgtcacttgtgtccccttcatgtcagtcttcaaacatttgaagtgcttgtttggtgactgttggtatgtgagagtttcaccaccatcacaatggtctgtttttacatttttagttggctgtagctacatatggctcttgtgtggaggtgggtggggctgaaccacaataagaatgccttgaaggcagcagctcccagggaatgggtcagacaccctctgagtt

SEQ ID NO: 22520 - DNA, 1073 bp, Mus musculus
tgacgtgagagaaaatgagttgttttatggtagtttatgaggcgctgtcgcctgctttggggcttttttgccttttctttcctttatagcttgtccccaattcctgcctctttctagactgcattgctagtaattgctgaaaggccagagcaaaggcaagacgagatttttaacatcttactgacttgtgtgttacctgcagaatgacacagtaaccatccggaccaggaagttcatgaccaaccgtctgcttcagaggaaacagatggtaaggatcagagtcaaaatgtggtctttgtgtctgcttttgaagatgtagttaacttgtaaggagtactgactcttacacctctttataggtcattgatgtccttcatcctgggaaggcaacagtaccaaagacagaaattcgggaaaagctggccaaaatgtacaaaaccacaccagatgtcatctttgtatttggattcagaacccacttcggtggtggcaagaccactggctttggcatgatctatgattctttagattatgcaaagaagaatgagcctaaacacagactggcaagagtaggtatcttattctttaatggatacatgcctgtaatcccagcctggactgagttaggatggcaagttagattttgttttccagtgtatattgggatacaataagcagtttgggccaaacttgtggtgttctacctacccactagcccatctccatgcagtttctctggccttctgaactggaacttagcagtctttactgggctttctatttctaagtagtggaattgcaggtgtgcactgccatacctcactgttttgtatgagccgtgctgccgtccatgcctaggaaaagttggtatcatttaatgggaaagttaccatatacaatatacaatgcacacatggtacctttaaaaatgtacaaacttcatgtagtccaaaatgggtaacaagcttggttgatggtcaggatgcacctggctggcttatttcattcttttaggtgacttctcactgtcgcccaggctgacctcctctgtctccagcgtggtgagattacag

SEQ ID NO: 22521 - DNA, 1097 bp, Mus musculus
gctaggtatcttaaaaaaaagtggtgctttgggaatcttgctgagagccttgtgaagattctgtctagaatgccaagaacagatgagtgggttaggatccgaggtgggggtggggtggtagggttcttagtaaaagtgttccttccttcactggagaaatagaaattgaaagacaagatgctgagcagtgttgtggcagggtttttgggttttttgtttgtttgtttgttttttgtttgtttgtttgttttttggttttttttgtgtagccctggctgtcctggaactcactctgtagaccaggctggcctcgaagtcagaaatccgtctgcctctgcctcccaagtgctgggattaaaggcgtacgccaccacgcctggctgttgtggcagctttaaaaggttgagctggtatcagagtggtgaggaaggattccattaaatgcactcttctctcatagcatggcctttatgagaagaaaaagacctcccgaaaacagcgaaaggaacgcaagaacagaatgaagaaggtcaggggcacggcgaaggccaatgttggtgctggcaaaaaggtatggttcatggctgctgcagaaatgtcattagttgttaagcttaatattttctgtgagaaggggctttcttttctaaataatctgttttggtgtttttctttcccctcttctggattgcagaaggtaacgttttgagaagctctgtagtgtggtagtatcatagagtagattggcccacctcttctgctcgtagactagcacactccaacataaggccacattgatccagcgatcctagtggctgcttttaaggcctgattgttgtagaaattttcttgttagttgacacagtcccctcgagggagagcaggtcatgctccctgggactgcctttttttttttttttacatgggctggtttttgaagcagttggatcaatgtggcttgtgctttcctctccagttagctaagatcacagtgattttgagtagtagctgcataccagctttgctagctaatcttgtagaatggaatttaaggtgttgggttgctgaataatcaagtgttctgtgaattttttccc

SEQ ID NO: 22522 - DNA, 1847 bp, Mus musculus
atagacaacgctgcttaggtgttgcagatcatacctgttgatcagaagtgttgatgtaggtttgtcctttgagccagaactgaaggccatgaaacaaattctttgccaggctctgtccccctggatggggtgttctgtggagctggtgatctcactagtacactacactttgaaaggctagcttaaaactgggcttaaaatagtaatgtcctgaatttgttttgcttgatgttagaacatcctttgtatacagtggagcatacaaggcattggtcatatatttgtaaagtaattggatttttactttagctaaatttttgttactaatctgtataccttgtggtatcaagattggtataaagtactttgagcagatttcaaagacttgcctgcctaatcatacatacagagctcctcccattggagtctaaagattcccaagtctgggtcctctgcctggcacaaggctgacctgagccaaagggcccagccccattgtcatccatgtgcaacatgggttggtggcaccactctggcattaatgcagttgcctgttactttgttaacattggaactggtaatcagggaaggtgctgtcagaagtgggtgctgtgcaaggaatgttctgtacacaacagaggacagtcacctgaggtatctgcatgtacttcagataattttggtgtttgaaaaaggactactaatgaactgtctgttttcctccttcccattccccctttcctgccactgattcagtgagtggagattggatacaggtatagttcaagctattccgtagatcactagactccttgttactgatgtagtagaccaagcacgtgaacatttataagtagattggcaagtgtagtttataacagtactaacattgactgtctaaacttcagagatggtgacttgtttttgtttcatttctaacgtgaatgttagtttagtttctgtgtgtttgcatcatccttacagtttctgttctaggttaatacttgttctgcatgagttatttttagaatttgtttgtctttgaactttaaagatcttttttaaaactgttgctgactgaatttctttctccatttacagccaaaggagtagatctgcggtgacttgatgttttgctgtgatgtgcagatttctgagaggacaaataaactaaaaagctcctacacgtctgctctgctgcttattgggcattagaagaatcaggtggctgcttgggtgttgatgcagtcaagtgcactgggcttggtgaaaagcccagtgtaagaggccggtacagatccttcctggcagagggtggtgatggagagaacataaataactacatgggcaaagtgtaggaccaattaccctgttagcatcgtctttgctcaacacctttctgtgtccctagactctgagtttttttctaattgatttttattgaacactgagtgttttgaggttttatttttttaagatttatgtatgtgagtacactgtagctgtacagatggttgtgagtcttcatgtgaatgttgacaattgaatttaggacctctgctggctccggtcaaccctgctccagcccaaagatttattacaaataagtacactagctgtcttcagacacatcagaagggggcgtcagatctcatgggcaggtgtagccaccatgtggttgggggatttgaactcaggaccttcagaagaacagtcagggctcttacctgctgagccatctccctagccccttcaactttgttcttagaagccaggccttcctctcctccctctgcttgatgatctctagctctagctggtctggaactcatgtagactaggctggc

SEQ ID NO: 22523 - DNA, 1117 bp, Mus musculus
gttttgcaggtagagaaggagagtaaagggtcgctcggcaaccaacttgcaaactctagtcatcagggaattttaagcaaggtgatccatgacaccagaaggtctcttttgaaaagttttgagttgggctagctaatgtactgctgaaaaccctttctaagctaagaaaacaaaaggccatagcactgaggtgcctggtgccagttggcagggactgtaaatgccaggaagttctgagttgtagattagaggacggtccctgggtattgtgagaagtcagaaagcatatgcaaaccatatgcaaatgagatgcaagccagcacctgctgtgggctttgtgtactcaggcactcggtgcctcagggaggtaagctggccggtctttagagctctgactagatgtaccagacattaggttctgtgtgagaaagaaaagtgcatcaagacttctctgggagagaaaaaagtcccaggttgtaaactccagaagggagggatgaagcccaaggagttgcagaagcttggaggcctcgctggctgagtgtgtcccggtgacagtcaggatgcttatgcctctgcccagatctgagcagtctctggctgaaaggattccccagaactaaggctgagtatacagggggttgtgctttccttgatctgccgtcttctggatcagcctccctctgtgagtcagagctggtttgacccagtgttggtggtgtattatcctggacccctctcaggggactcagtggttacctttggccctgcctaccttgaagatgtacccagcagttgtggactgaggctcactggactcctgcgagtagaaagcaaacacggggcacaggagaaaggcagttttacactcagatctctctctacttaggacttgcatcaagaagcaagaggccatggtggggagatagctcagtgactaaagtgcttgctgcataagcatgaggacccaagttcaaatccccagcacatatggaacaagatgggcgcgtagcatgtgcctgtaatctcaggactaggagctgagacagaaggtcctggggactctgctcagtcagtttagctgaagcagcaagcttctgaattgtgaaaggaagtt

SEQ ID NO: 22524 - DNA, 1189 bp, Mus musculus
agaggccagaggacgatgccagccagagccccacagaagcagccagggccttgcagctttgccccaagccaatccctgcttttaaatgacccgcagcggggagctctgaagaaggagctctgaaggaaaggaacattgtatctggacagcaagcaagccatttccccccatgttctctttccttcctcctacccatacttccttctctgagactattccatgggacccacttccctctgggttctcctttccccagacagctgtaggggcacatggtagggaagcagcataggcccccagggaaacgactccacagcagggccttcatggatctccaagtctctcagtctggtccagcaggttctctgctcaaagctgcctgtctccagcccagacctttgctgggtgcaccagagcatctcagcaggcaggcattttgtggcatttatggcctgtcactccctgtatttctccctccatccagagctcgctccacactcctgctcacccagcaagtgcagcctctggccctcctctgctttttcactccatccagcttagagtcccctgctggcttgtcactcgcctgctttgtgccaggctggtctgtgtccccctgagcctcatggcctacggtgatgcctgtggtgatgccaggttgtccgctcacatgagtcccatctgtaaattctttgctcccttctccgatgctgccacccaaggccttctcctgcctcctgtccactgccagcgtcctcatttgtcatcggtcattagcctccctctgtgctccctggcactcttaatatagattgaaccagaaaggtgacccctagctgttgacttattgtcaccctaaaaaaaaaaaaggcacaaggaaagctgccacctccccacccctcctcttcctttgtcctgttgttaaggttttttcaagcagtgtgttcagtatgcaaatcaattattttaagaatcgcttttgtaaatatctttgtgaatattttagtattgtctttgataatattcaacattttcatgacctggttatagcctttgctggtgtttttaaaatatcttgactcagtgacaaaacccgagtccttttttaaaaaaacaaaaacaaacaacaaaaacaaacaaaaaccaaccagggctatttgtacagatgagagaggagcagaagaggcgg

SEQ ID NO: 22525 - DNA, 1376 bp, Mus musculus
tgggagcctggaatccagtggaatgcagctgaagagctcacaagcggtaactaggctttcagggtagtggtgttcctttggcaaacaactctgccgagtggccaggatgctgggtgttttcttacttggctcaaccctccccacaggctagatggcaagcatgtcgtgttcggccatgtcaaagagggcatggatgttgtgaagaaaatagaatctttcggctcaaaaagtgggaagacgtctaagaagattgtcatcacagactgtggccagttgagctaactcacagccaaggtgctaggacagcagcaggcatccatgtcttgattcacccaggttctccaaagaacagtttgcacccacttctattgagtctgaggaaggccactcaggcatggtcctcccagaccaggctgctctccactgtccatcctgcctcagatcccgtttctgggcatcagtatggccatcgggccatgtaccctcagccgatgtccccgtgattgccatgtgcgtgtgccttggacattggcaatgctgaccagttagtcagggaaggctcctgactcttttccttgatcagtggggatagcagttgctatttaatgttgtcttcctccttgcaataatttaacatagaattcaagatctcatcgaaacaaagctgtgacactcatggcactgtccgtgtgtgacctgtgttgctgtgacactcacggcactgtccatgtgtgacctgagttggcacaagccacagacacccccaacccccccacctcccagcctggcttctgagacatcactcagggctcttgtgaaagtcccagcgtcaatgccttccctcctggtcactgtgaatcctgctggctgctgctgtgatttttgaaagcctgtgaaatagaagcagcaggacctgggaacagacctgtgagcccggtctttctgctcaatgtgaattcccgtggtgaaaacttacagacactgcctgacctcatgctgttctcaagagggaagtgtcttctggcaggctttgctttttctgtatgttgaataaatccaatctatcaataatatatatgtaaaagatttctgggacagtcctgtgtgttcatctcaaatgtgataaataaatcctattttctataaaatggctgtctctggttttggaatgaaatttacatctttggggctcatttgtttttgtgacagggtcttgctgtgtggtccagggtcttgctgtatagcctttggctagcttcaaacactcttgaccttcctcaatgctgttgggattacaggcatggaacattgactccagctggggccagtcttggagttactatgtgttaggttctatgctttgaactgttttttgt

SEQ ID NO: 22526 - DNA, 1099 bp, Mus musculus
taatatgctcttgtcctgtatttatacatttgtgtattttggaagtattgcctttttaagggaagttatcagtgggcaacacggtaaaaagggaacagcgatcctttgtgcctcttccaatgaagatgacaggtggcatggaatctttccccctgcatctttgtgtcattgccttgtttctacagttttattactttttaggagaagggtggggaactgacaaacgaagaggactcatcgaacaaacagaccctttggtctgtgagcccagtggccttgtcagcaggacccaaggaggtacaaggaccccggaggaggttccaggcctgcctggaagccccatgctctttgatcttggatctgtccactaagccctcacacctgccccctagctctaatggacttgaatttactttaaagtctaatccaacctcactacagtgtagccagtgcaaaaactaatactgaaatgaggggtgtttgcagccctctgggaagtggaaatgaggcttatcccctgcttcatggccaacttccctgtaccaactcctgcagccctgtgtggtgaccctgtctgtgtctgtatctgtctatgtgtgtgcactcagctaaaaagacaaacagagcccgtgagccccgccttgagggtacatggagaaagttcctcccctccccgaaagggacggcctcggggtggcattccgttgtgtgccttattcctggagactatataaagcttgcctatgaaaatatagcctttctgtgctgtattaaaaggactttggaaagatggaggctcgtgagtttgtatatgggaacacgggggtgggggtggggcgagaagctggaccttttcacagatgtgggacaaagcaggggtgggaagaacttgggtggcatttactttcaaagttggacatattgtctctgccctgtttccaccaatgacctgcctcctcccagcccctttgccctcctcatgtggacactccttccagagtgagggttctcgccaagtggggccccaactgggtgagattgtcagcagattaagtcacacattagctcagatgggactcactcctgggtaaccatatat

SEQ ID NO: 22527 - DNA, 1211 bp, Mus musculus
gggacatgaggcatcaccacttcccatgacctcccccagactgtcctgtaggcttgggttctgtcacctgctctctctcttgacccttagcctcccacccatgaccgggatgccaccccacaaaagccgtaagactgttctggcatgaaggaggggggccttggcagtctggagccgctttctgccacttggggcaaggacatctcatccccagccttagtctccccattagttaaatgacaaagtggcaccagaaaacaagaggtcccagtgacctctgaacttctagaagagagctggctgcctctggaacagagtgtcactaggggtcgggggtggggggagatttgtctctaaacatctaggtgccccgccctccagcctctgtcctgatagccacttaagatgtcctctcctatagccctccttacctgattgatgtccccatcccctgagaagacgaaagaggacccctcctcctctttctcctcagccccccaacactgggcaagcctaaaatgagccacagaacctctcctttggaaactgaggatagagatttcctacttcctaaggaggcagagagattacctggcatgtcacatggtcgcagggtggctgttgtcctggccagggtcagcagtgtgccccctaccctgtgacaagccacacctctctggtctttctcctcttcaccagctgccaggactgactttcttgactcatactatgcttctatggagagagagagggaaaaaaaatcagaccatgaaatcggcctgaaattcagtgtttacatatggtgcccagttgccttttgttttcaaatgaaaatgttttgtatgactgacgtgaagtgttaagcaagggtccagggggtaagtggaagagatggttgtatgtctgcagcagctagctgcagggtagattttgggagaacatactctctgagcacttaacaaaggtattatctgtggcagcccagactattagctgccaccgtgctgccctcgagtggtagcatgctgggctgcagacggtgagcatccagcaccaaggactctccagtcttgctgctgcactaaggctgccccatgccaagcttcctgttgctaggaaagggatttttttctttttggcatcccactgggactctaaagagggtgtcatggcaataaacagtgcacctgtgtcccaaatgaggacaaatt

SEQ ID NO: 22528 - DNA, 2399 bp, Mus musculus
gaaacacatttagaagtaactactaagtttcaactctgacaaagttgaaagctgtctcggactttcctgggacaggacagccctgctagtgtgtccctccttagtttctttcctttttacacttacctttacaatgcaaacacaagagctttcctacagtcttctaagtatgtgggcctcagttcaccaaagggtaaatatgtatgaaaagagaggggagagtgtgatactgactcttggtttctttccacacagaaaccctggccctggatgcccatgttggcggccctggttgcggtgacagctatggtgctgtatgtaccaggtctggccagagcttctccatgacagtgtgtcttgagtctgtacaccgtcctccctctagaagccggcagcacactcatgctggggacaagcagaaccattctcttcctttttacctcttaaaacagcaaagtgcaagaatacagctggagggtcattgctttaatttatataaaatatatctgtctatagagaggatagaaagttgtgaatttattcggttttacatgtaatttttaaattagtatgttgagattctgaatattatggtggcctaaagtacgcttcttagtgcaccaaattatttataccataaatttatagatattttactctgaattctaatggccacacaattcatttttctgattcgataactactcaaaccgaacaaccaatacatacatgggaatagaggccctgtgtgctcagtgcctatcagtttgaatatatacacacacacatatatatattttttttacatatttacgccatttttacttgttataaaaccactgagctattgggaacaagacttagacaattatttgtgtggattttttttttaaaggaaaactacatttgaaaaatattctcttataataattatttggggaatacatacgtgtttgttcagccttaatgtgacttgaagatgtgaaggacatcagctttgaaaactttccatgagagtttgtattttcttgagcaaactgaaatattactgggagcaaaaacataagtgcataatttcaatgcaatcaaccaaactgttgagtgaattggaatgtaacttactaaacctcatgtatttaagaaatgttttctttaaaagccaagttaccttctcatatacagcagtttagaaagcatgatttttttttctgtcatctgttcctccaagcatgtttaattgaaagaagaattatatctgtttagataagcttttattgacttaatttggttatgatgtggagctaattcacattcaaggtgaactgatgttctctgctagcagatttcttggttgggtatacaaatggttattctctttttgttgttaattggaacagcctgtcaattagtagcactattcccaagattggcattgttccacacacagtgacacacctcagcactgcttggcattatacatttaaacacagaggttaaagtttagctgtggttttgtgcagcaccatagtgatgtcaatgtcctaaagtatcacgtgcttaggttttcttcagtcagggaagactggaagggaaggccagtgagttggtttgaatgttgtatgagaacacccagatctagccagatattgaaaaaggactttaggatataatttgtctgtgatgtttggcagtcattatttttactttaaaagttgtatttaaagctatttgggattgttgccgggagaatcactatattcatggaggaattagccacaaatgacttgtagaaaatactgtcgtatagttcattttaccattctctgttgcaggaagccaccccaccacagaatgctgatatgccagtggtacccagtacctcttgtatatagttattgcaaatactgttatgaaatgcataacttcaaaattaccttttttaaagtaaataattgtttgaaatctattttgtaaagataaaacgtacaatagaatttctggagtacagattaaactatttgcactaacacacgtgatgtgcatgatttaataaaataactttaatctccctttgcatgtttgagttgtacatcattgaagttcttagtgctggctctgccttcagtcatccttggccttgcttgaagtgacttggcattaaatgtgtgttagatgttctctggggtttaaaagcaatcccctacagtctgcttaactcacccttactgctttcctcccttagtattatcattgtgaaaatggattccttgtcagactcacggcagcaagtggaaggcctggtgtcaatatttactttatccaaatcaaataagtggggtttggtagatatttccggttttaaataagcccgttcataagcagtgcctccagcctgcctc

SEQ ID NO: 22529 - DNA, 1205 bp, Mus musculus
taccattttcacaacttaggtgtgtctccgaggaaggaggcacatgcagttctggctatggaagagctgatttctcctctctcttttactcactggcctgcatacactaggtagcttgaatgtcttttgaagacattctcacaatgaacatcatagttgttttttaaaagaatatttttatgtcaaagataagccattcatgtaataattatttgagagttttacatttaccttttaacgttatttgttgggtgacactatttcccctagtggatgatttttagaagacttttcctgttgttgtttgacatgggaccttttgtgtaaatcagcattacacttttgtttgtttgttttcattttgtttgtactaccttgccaaaagtagaatgagatagtttggtttcagatgggagtgttgcagaagccactgttcagataggcacacacaaagcagcacatgtgtaaatagctgtgacttaagtacctgcccttctgagcagccacacggtggcttcagaagccatctcttattcttttgctgttattttcaagggcattcctgatccaagaaggtttctctgtgtgtgtgactgtggtctcatatctagggtgccccttccttactcatggatacagtctcttgaagcataccactgtcctaggaagaatatggcatttgaatgaaatcatttgtctggattgattgattgaaaatttattttgtgaaacaatactgacctttcagaaaaggggcaactacttttatatgctaaagtacttcataactttctgggaaactttatttaggtagaaatggtcatcttattatttttcaaaaaaatgtattttaataatttcacaatttatatacagtttgtgacatgaatatgaaagtcattagtattatatcaaggatttttgaaatatacttctacaggatatatcatttgaagtttattttgcacacctaaagaaaaacatgaaatatcaattagcatgataatgctgtctttatgtttaccacatataacagaaactcaacacatggtgaaaaccaaatcatattcacctactttatctcttaatttcaaattatgcattggaaacccaaggaagactgaatggttaacttaaatttttatgtcagttttagaatttcagaattgtctctttcattgtttttgttttttgttttttttttt

SEQ ID NO: 22530 - DNA, 1202 bp, Mus musculus
cagccagggctatacagagaaaccctgtctcgaaaaaaccaaaaaaaaaaaaaaaagaaggattggttagagataggtgtgtaatccagcaactgagaagctgaagcaagaggaacttgagttcaagctctgggctataaagttagatgctattagaaagagccaggtgctggagagagaattcagtgggtgagaggacttgctgtacaatcactggggcccacgttggttcctagcatccttgtaagaatttaaagttacatgcacctgtaaccctagaactgtcggaacgggcaagagaacgactggggcgttctggggtaccaacgtagcttcagttttagtgagagaccctttctcaggggagtaatgggaagaatgacaggatacctgatgtctttttctggcctttaaatgtgtatgatgcacatggcatataaaccacaaacatacagcacatacataagcttacatatatgcaggtaaacatacaagacatacataagcttacatatatgcaggtaaaaagtagggggaggggagatgggcgtgaggaatgaactggtgtgttgagaatttggacaatgttaccatgtctacctcaagttgttaggatgaatgagatataggaaatgaagtatagaattggcctggataaacagtagcaatcccccccccccagggttcagtttccttacttctcaagtaacaagtcattgtgcatagtggctacataatatttatcatcagaagaaataggttactatcctaattccatttcccttacaacttgagctacgtgtgtggttcaatctctctgatcctgaataaccttatctgtataatacattccagcaggctagatgtaacctgtggccgctggcagctacagttactattgttttgtgatcagttgcctacttgatatatagcatattcttaattaaaagtctaaaaatatgttttgatattacttttccttttgtttgttttaggttttgaagagatgaacagaataatagatcatttttacttatttattttaaagatttatttattttatatatgtgagtatataccagaagaggacatcagatcccattacagatggttaggagctaccatgtggttgctggaaattgaactcaggacctctggaagaggaggtcattgctcttaactactgagccatttattcttct

SEQ ID NO: 22531 - DNA, 1757 bp, Mus musculus
gtagtttgagattttcccattattcctcagattatgtcggggagtggtaaactgataagttcattgaggaatagatggagctttaaatgggtagagtgagaagcaagaggtgtgagaacatacctgaaggatgaaggttgaatgacctgtatagttagctagaacattaagttcatgtttgtgggatgtaagtacttatttccttatatttaatacagtgacctttttttgtatacttgtaaccactggctcagtagtacccttaggcatttatggggaggagcttaatatttcatttaaaaatggcactgtgtattgtcttgttaatcaagggctttcttgttctttttttcacagtggtatgtccaagccacttgtgctacacaaggaactggtctgtatgagggactggattggctgtcaaatgaactttcaaaacgttaaatgaagctggatatctaaccaaggacatgtttgatagaattggtctaggcttgttacaacaaaattagtttgcatcttggttattaaaggatatctgagacaggtttgggcagaaattacagcgtttaaaacttgttttgttgccaattattgtttaccaagaacaatgttgctatttagcaatatgcttgggtttaagagaaattctccttgggaaagaaaagtatccattattatgcttcccttgaacctaaatgcctggatacagagctatcctgacacctttagacagatctgagtggtttttgagcccaaaacaataatgttttaaagttattcccttgatactttactgagacctttatcattcctcagacagtctgctgatttaaaaatgtagcattccatttgtatttatttctaccctttgccaaaaagatttttctaataatgcttgtacaggccaaggccgtggtccaaaacactattcagttttcttgtactgaggatccccccaccccaccaccctcacattattgactcctggcttctatcagccaaactttgatgtggtttggatttgatagccaattctgtgctggttgcaaagagttcatattgagataacttttaatactcagcagattgtcttcctttatattgttatcttttttatgttgcatgttgcttttggaatcagcctgactctttgcccagtatatgatagttctactggtattttactgtttattgatgaacatatcttcattaagaattttttgaaaactcatcaaattcaatgaataagttttcttcataacccatttggaattattcctaataaaatgattttaaaaaacatgattgtgtgttcttttgagactttgcaatatttgaaactgatttccttacataacaaagtatggccaaatcccagtgaatttacttatggtttaagttgtcagtaaacttagccatgggttatcatgtgcattaaagtaaggtgcactatgaagaattttaatttttctagtagaataccatttgaagctatgaagttcaaaggtcagatcaagaagaacaagaacaagttatcataatatgaactccagaagcagagtatgaaggggttgctgatgaagctcagccagtgatgattcattggtgatgaagcttgccttgtatacagtgagtttgagcccactatcacgtgccacagagatggcagaaatcattgtccacttactgagtttgaggccagcattagacctttctcaaaaaaaaaaaaaaaaaagtaatttgacaagtgggta

SEQ ID NO: 22532 - DNA, 1099 bp, Mus musculus
gagttattacctgggtgaatttttagcattacaatataacaatattgcattctggttacaataccaaagcactgaggtaaaactaatcatttaaatacataaaacctacttgtatttaatacattcactgttgtgtagccgactctaaggcattttcatcacttcacaagggaagcctaaagtatatcctcattctctaccagtagacacatcatctgccagttctgatatctgtccgatttgactggtgtttttcaagcttatctgtgtaacagtatgtaccaatacttcatctcttttacacatttcctactgcatggataatacatcttgcttatgtgagcatttggattggttagtttcctgttgtgactagtatgtggagatctatgctcaagtttttgatggaacatcctctttttaatttgttagtactagggaatcaaaccctgggctggtgtatggactgctctgagctgcacacccagtccaaacatctgttttcagttcttctagagaatataacttagtgaagtgctgtagctttctgcagcaatgccatcctttcccacagtggctacactaccctaaacctccctcactgccatatacaggttcaggttccctccatcctcacaaattatatccattttttaaacagccatcctgttcacacttcagtgacacgctttgaactttggaattgcagttgttgcagtcacaagcaagcttatcttaaacagcttagcaaacctcttcccagagccactttcagcagctgctgcttagttttatgatttctgcgtcaagtaggaaaggttttattgcttcctttaaagaaaactgaatatcaaagttaaaaatacaaccgtgactataaagaattttggtaaaggcctaagacctgcacagcaaaaggccatatttcacccttcagcaactgcagagaacttacttttaaattggtccactttaaaatctaaaaggtacagattagcagatggcaagaatgtctaagttttgagaaaactagatggatataattgagtataatttataatataaattatgtataatcattgaaagttcaagctattct

SEQ ID NO: 22533 - DNA, 1532 bp, Mus musculus
tcatttctctgtggtttccacctcttatcaggagctgccctggaaaggatccggtcatgctgcctgcctcttttcatctgtcatgatggatttcatccctttcacgggcctctccatcctctctttccacatgggttgtgagcccagcattcctgtctctggcttcctgggccactgctctaagtttctcttcatgcttcttttctttttgagtcatcttactttctacttgggcttgcatttccactgctgctcaagccttctgatcagcaatgtatagtgtttcagccagtttggcaaatttttcacttatatggaccatctgaagtcctcttccatcagcagctagccatttatctaatggaatggtataccccttagagttcttccacttggaaatacaaggagggattttccacttctgctgtttctttacagtcatcttctgaagaggagagtgcattacaagtgcaggaggagatgatggtccctgagggattttcgtattaactttgaatcttggatgctccatttggtctttttgcatttctgctatccagttaaccctgtttcgctccagaattgaatggtactccttctgatgtggtgtgtcactggtgagctgagacatgaaagatgactcattctttctgagatagggtttttctgtgtagtcctgggagctctggaactctagaccaggttggcctagatcacatacccgcttgcctctgtctcccaagtcaaaggcagcaaggagagactactgtccatactgaacttttaatgagtctctggctatacttgtgagtaaccagcttcagttacgtgaatactggggactaagtgataatttatgtgtaagactgctttgtatgttttgtggttttgtaatgtaagtaaattgattaacttttatttcactgatattaaccaattgtgcagtgtacaattaaacattcagtatccctctttagaattgggtttgtgatcatggtgtggcttgtggagcagaggacttactttctcatttgtcaaaataggtatttgcagacaaggcttcgagaaatatgtcgttggattttttaaatgtataataaagtccatgatttttatacagtatttttgtatgaaatatttagttactttgatttttttttcctccaagtaatttcagatgttttcaatctggggccggagagatactccacatactcctcttccagagcccgagttcagcttccagcacccacatcagatggctcacacttgcctgcagcttcagcttcagtgtacccaacacttcctcctaacactgatgcagacacacatgcatacatataattaaaaataagacaaatactaaagtttcttttactctattgtaacacatttgaccctttggcaatcccacaacaggcaaaaggggagtcacttatcaagaaaagctttgttgacttttttttatagcaaaggaaagactttcataattactccactgagttatttatgatatgcgcttgatgcagtta

SEQ ID NO: 22534 - DNA, 1026 bp, Mus musculus
gtgattagtggtgacaagtcttgcttttaaaactttttttgatattggtaaggcttcttgttttgttgttgttgttgctattgattttattttgtttttgtttgttgattttcgcagtgatcagttactaaactaccacagagccacacccccaccccaggttttcagtttcatgaatcttttcttgatggaagacgtcatgcttgcttcagatgaactgtgttttatagtaagagtagtcatcaggaggcacttttatttggttggtgctttgcatggtaacaaaatagtgatatttggataaaaatttaggccagaggtaagaattttctaattctttttaagtcatgtttcataggaactcccccagttgtgttcatgtccatgggtcagaccaaaatgtgttccagtgcctaggacgcattctgagtggatcagtccgtttcagtgatttaacttgtatcactattaaactgtatgcaattctgcacatcagctgtagtcagctctctgcttgaagaaggctcctgtcagcttcttcctaaatgttagtacagatgtcattctgttatactatccgccaagatctcccacaacttttttattttgggggaggcacagaattgattttcttgttctgagtttgggttcattcctgtcacggtcactgagccaaggcaagtagaccttgcctcttcagtcttagtcctgcgggcgtctgctcagattctcttccatattcaaaatgccctggaaaagcttcactgttttaatacgtcctagatgttcaactgaagcagagcgaagaaatggccctcccagccccatccacctaaaacaaaaccagcagctgctgctacagccattatgaaaaaataacacaaactcttcttaaaaaatagatcacacagaaagaactgagggcagatgcacctggggggaggggggggagggctgccccagccacggggagaggcctgggtgctgagatgaccctgcagggctggggtgctagtaggtggctgc

SEQ ID NO: 22535 - DNA, 1234 bp, Mus musculus
aaaagagagtcggaagcataaacttgttgctgctttttgagttctcatttccctgggatgtggcacagcgtatccatgctgaagatcatggaagagataagctttacagtagtgtgcttcagcttcatttaaaaagactgaacttgataaccggttatagcgaacatttccccgtaaaaataaaatactatgcattgtcatccaactctgctttcctaaacaagacctgcttacttttctgtagtagattgctgaggaattacaggtcttcaagatatttttcctttaaattgtgaacattttatcttgcactgtaattggctgtctccataaggaatgatttattcttggattctgacattcctgtgtatactctccctttcattaggaatgttttattggtagtgagggagggctcaattgagtgagcttaacatcctttatgtggagaattctataagtgtgcaagtgttgtaacaatattgagtgtgcaatagaatttgcacaaaatcacaaggacggggcaggtggtgctgttgacttcaggatgttttgtggcttgctccatttctctgatgtactagatcatggcagtgggagacctcaagtgtctgttggtgtttgtgtggcacttggtattttgttaccatcttctcagttctcaggttgggactttacttattgctgcagaacaggaaaggttagagagtaagacttcagaatttattgagattgttgttgttcaaacattttatattagaattgacatgtaaagggagtgttgtagactgatacattgtattttctgtattgtgaaataatttttaaatgacaatgagtgacatttcaaaagatgttctataacaattatgtttattgcttaaataaaaatgtgcagtttagtttagaaaacaatcttttgaatttcagactgataaccccagtattttcataatcccacattttgataatgtattgaattgccactttttatccataaaggcaaataactaatttgagtgtagaataatttgcactaataattgtaaatacttttacttttcaaatgagtaaaaggtctaattccatgaaagactgaaaaggaactgaacacctcatatagtgcaggacagagttagcgtgtactgagggtgattctgtcaaaactttctttactaggactttaaactgtgtttacagattttattttcattcattctacatgaaaaggtgt

SEQ ID NO: 22536 - DNA, 1183 bp, Mus musculus
cattcacagtgttgtacaaccatcatagttatttaggtcaagaacatttttatcatcttagaagaagtctttttcccttttatctatcactttccctggaatttttccaaattgttgccaatgattgcattttgctttctgtctctatagatttgcctctttggatatttcatataaattaatctatgtaatttgtggactttgaggtgtgtcttctttcattttgaatataagtttatagtgacagttttgttgttgaataaagtttcattgtattcattttgcttattcacttgtgggagttttaccttttagttatcattcatatacatatacatcaacataaaagtttaatcttttaaacactggcttttagttctttcctggtatatattcaggagtgggattgcttggttttataataattttatgtttaactttttgtggaatcaccagatttttttgtgtgtggtctgtgagcagtataggagagttttgtctttttctttatctttgctagcaagtatttcatttttaaaatgataactacttaatgggagtgaagtgttatctcattatcattttgacttgcagcttttggatacctaatatgatactgagctttttttttcatgtgatcatcagccattttgtaatctttgaggaagtatctgttcagattctttgcccatttttaagttgagctatttgttttttattattaaattgtacgagtttgttacctagatgcaggtttcttctgagatgttggcaatgctttctcattctgtttgtcatctttatagtatctttttatgcacaattttattttaatagaggtcatttgacatattattttgttgtttgtgcttttggtgttatgtctgagaaattgttgtcaaataaaggatcattctaaattttcttttaaaagttttagtctgggcatggtggtacacacctttaatcccagcactctggaggcagaggccagcctggtctacatagtgagtcctgggactattaggactatgtagaaagactgtattacaaaacaaaacaaaacaaaaacaaaacaaaattttaaccatataatattttgtattatactacagttttgagtttccatatataagatagatcaggctatataaatttagccttttaaaagattagattctga

SEQ ID NO: 22537 - DNA, 1189 bp, Mus musculus
ctgactgctcttccaaaggtcctgagttcaaatcccagcaaccacattgtggctaacaactatctgtaatgggatctgatgctctcttctggtgtgtctgaagacagctacagtgtatttacatataataaataaataaatattttaaaaaaagaaagaaagattctttacaactataattcaaaagtttagaccagctaataattgatatagatcatgttttaaatagtgtatttagtgttttatagtaaaaaagacaagaatttattaattgatcaactgattactagttctgtttaaaatagattaaagaccaagctaggcatggtggtgttcacctttaatcccagtactcttgaagcaggtgaaactctgggttcaaggccagtgtggtctacagatagattgagtttcgagcatccagagctatatagtgagaccctgaagggagggggaaaaatcagcaaaaagtcattgtgagtactaacattggctaggtacttttttttttttttctgctaggtacttctaataggcatgtgaatctgtacaaattgatgttgctggtgttagtgtatgtacacacacacacacacacaaaatcatcttatgtcctaagacatttatccattaagcataatatataatattatgtaaaacagtagttgtggtcttattatcatctctaatataggaatttgttggggctggattacgaaaagaaaaaagttagaaaccagttaccaagttcccaccacaactaccaaaacataaagatcttgttttctattctttgtcatctgatgtagtaaagaaagaaaatgctttgcctttaagtcatagctgaatttcacacgtctccctgtcttttctgaccctgtgagccacatttcttttttaggctctgcgtggtgttatgcctaagtaagttttgatacattttcttaattcttagactttctgcctacattcttgtatttatggaaaccctgttgtcagtttggcatcaggaatgggaaaggataaaaccttgtagccattttctgttcgttgtctcttcagagcttagtaagcaggctgcttttatattacggacctcagtaaatgaggatactggaactttacaggtgtgataagatcttgtcttttttctatactagtataaaataagctggttgtagttaggatt

SEQ ID NO: 22538 - DNA, 1182 bp, Mus musculus
tttttttttttttttttttggtaaaacattatagcctgtgacctgttgttacaacctgacaacttggcctgtaagccttgtaagtatagctgtctgtcaagtctcaaaagtgttaaccccataatggtgttggggcagcctttgggtgcttactctgggcccttctcctcacagtctggaagcctcgaaacctgaatatcagccagcatggttctgacatgcacgtgtccttcgaccatgccccgcagaacttcggcttccgtggcttccatgttctctataagctcaagcacgaaggccccttcaggcggaggacttgcaggcaggtgagtgactgtgtgtaaagaacacatgtgtttcaaagtgctactggatggtgggagtaagtgcggtcgcggttgtttaagaatgccactgggtctgtctccagctgactcactcaccactgtcccttgtccccgtcatctccaccttagccgctctagggggtggtacagcgctagaggatcaaaagcaatctgtctcatattttaagcatctgcaggtgctgtgtgtcaggaaatccctgaactttctgctcttcagatcctgactgctcatcaaagagcttgcttccattcctcctttagaggtggagaacctagggctcggggaggtcacgtaactaggaaggagaaaaaaaacctctagccaagtcactagcaaatcaatggccctggatttttaattttgtttgtatgtatgtgatggatggatggatgcatgcatgcattttttaataaacaaaagaccagggttaaatagaaacctgaaaatgagcatcatgaacagagtatggccagaacaatgggaaaggctttgtggatgcttgacgctgtgcactctctacctgtcctgtgtgtgctgggtccagtcgtagcctagttcttctgtggtcctgcagctttaccgctgcacttctgggagcatctgctcaagttagatatgacagatgagtgcagacgagccccagctcttctctccttgcttgaaacggatttgcattgatttttattgtgtaactatggtctgccaaagttctacatgaaagttccacatgtatttcttgtaagatgggtgtctcactactaggtagccttgattggcttgagactcacaaggcagtacaggacccatgatgaa

SEQ ID NO: 22539 - DNA, 1177 bp, Mus musculus
tacgaaccattgatttttcttactactccaccagattggaccagcattaagggggttgctgagaaagatcccaaggtcaggtgtggaggtgagatgagccggggatttcccttctaggcacctttgcagtggggtggggggtgggggaagggagcccttagttcctgctgagaagaagcggtttgtgtgcattttggatggaaacacccttctccctgctctgcacaggcagctggcagcttctcaggagagcgtgctccacatgttctctagcagagaacagagcagctgctctgggcaagctgtgagctggtctcgcagtaaaaccaggcatctctgcagaggagttcacgccatattatcactgtggaatccagactgagcagacagagctcccacctccatgaggctctcctggccgtgctcagtcttggcattcattctgtgagggagattggtgggcctaaattgctaatgtatgaccgttccctgggaacatcatcagagaatgtttttctctttttaaattgaggccaagaaatattttatccccccccccaaagagccattagaaaccacatttcggatagatactgagctttgcatgtggagtgtggggtccctgagagtgcccaggagcagcatggggccctgggtggaggagggcttagcttcactggatcccaggcccaggctcgatgcatgaactcagatgaggaaactggagggcagccctgtgagccatctagcttgctagtccaaaaagtcagagtcaggtgaagttttgtttgtgtttagccattgggtgactttattttgacatacaagtgtttttgatcagaagagagagccagattctaacgtgccaggtgatggtttcttagccctgaaggagcagatagtgggcggagccatagtattagccagcctctttcccatacacctcatcgttgagccaggaatgagaatggccttgcagattaaggcaaggtgccagttctgacaaggcacaagctttttgatgctaacgggagatggggttggggctgagagtgaatggtttgtggggaaatagaccaggtcctttgcgggggaggggggcaaaggtgagacgggtgtgaggggggctagggtaccaggaaaccaagaaagaaagttgttgacctgtgtttatgcg

SEQ ID NO: 22540 - DNA, 3460 bp, Mus musculus
tggctgctggtaattggcaaagtttgtgttttctggggcacctgtataccccggcataaggaaaacagtaacatagcaccttgaagagagacatcagggcgtggcaccgactggggcaaaccaaggcacccttgtccagccttcagcagtgtttcctgggcttcttggttttcaagaaaagctgaggatgtctcattttgaagctgtcaatgcctagcgctggcaagacagctcagaaagtacaagcatttctgaaacaaacccagacaacgtacccacagtggaaggcgtgaagcaaccctgtcccaaagttgtcttctttggcttcctcatgctggctgtgatgctcacagataccggggtgtgtgtgtgtgtgtgtgtacgtgggtgtgcacgagtgcaacaccaaaaccacatgcaacaacaacaacaaacaacaacaaaagctaaatattagcaattaagctttggaaactacttaaatgaacccaggaccaatagaacatgtagatagatctaattttgcccagtggctgccaggttgtgaattctgctttgtaagatgggaaatgaaaaccagccacagtaattgcgcatatgtggggccctggggaaagctgtattagccctatctatctttcagacaaacttgatgctcttctgatgattttgcttcttaaaacagggtctcggccaggctatggtggcccacgcctttaatcccagcacttgggaggcagaggcaggtggatttctgagttcgaggctagcctggtctacacagccagggctacacagaaaaaccaaccaaccaaaaaaccaaaaaccagggtctcatgtcgcccgggctagccttgaacttctgatacttctttctctctctggtgtgcacatgacccatagccttaatatgattttgaatacgttctaagcattttgatagtgtcttttatatttcataattctcaagagaaaggcaggtcagctgttttttattggtggtggtgatttttcaagataaggttctctgtgtagccctggctgtcttggaactcgatctgtagtccaggctggcctcgaactcttaagatacacctgccttcgcctcccgagtgctgggattaaagatgtgcgctgcctccactgccaccgccatcattctgctgctgttaatttcaaagtcagatctctatcgtcccatattaaaaagcaggcagcagttgcatttaagccccagtctttagggccttatttatagtttagttctaattgccatcatgtttttatgtgtggtgcaattctgaggttaggccagggtgttattaggggaatttatttgggggacccagagtgccctcatactgtgttttgccgtcttcctttctctgaagtctgggacagggtcttctggaggaatgctataggaggtggcaaaatgctcttctattgttgagacaccaggtatccccacagtgtttggcccttgtcatatcaccacatttccagacccaagggggaaagttggccaaaggagagccagctggaagcggttggttcggttccggttttagaacttgggggcaaagaaaggctgaactcacccagtgtgatccctcagcgactcaaggcaggctgtgcttgagttgttccagactcacggctgtggctgagattctggctctttagccgaggggattctgcaacctccctgctgatcagatggtcctttgtatgtcttccttgcagaaattcaaaccagctttcttttgtctgcagcatagaggagaaagaacagctggtcaccttcccagcagtggaaaccgcagtgaggtcatcccctggtgtgttttttccccccagtagtaaataatcccacccacttaaggactttcacagctcttgtgctctgggggcttctcagcctcacgctgttttgttatccgaatgacacccatgccttgttcacatgggtgttgcctgacaaccatgctccagttaggattacagggagatttgtgtgggctggctgctctcaccacataaaaatatcatggtgcatatgctcaatcagaacaccacccgttgcttccttggtggcagtccttgtcttgtgctttattctctcctgcaggtgagcagctggggcttgtgtctggtgtcttcttcaaggccagcacctgcctacctgctgagcggcagctatcccacgcgccaacctggggttctatttttacctctctctagacttgccctgtattttgtgaatcatattgtttaaatggcacacacttcaccagaacctctggcaaggtgaggccagaggttgccaagggccacctcccgttgactgttggggactatttccaaacaccttggaatgcctcagggagggcctctggagaatttcagccagtagtcttctttcctgcctcttggttcacccttgatactcactggggaccccagatacctctccctcctcctctagggctggatctctcagttaagcaggcataatgtttgatgcaatcaagagccagacagaagcgatcacccccgactggatagctaatatttatatcacatggactctggccggaagagaaggaagaatattggccctgtgtggctaccactggattatattcaatgtgttcatatgtgtgtgtgtgtgtgtgtgtgtgtgtgtgttaaatccatctttctctcaaagaagcatatcaagtttgaacagaagcaaaaacttctgttcaaactcaagtggtcattttaagagtagcttcggtttttctgatctgtttaaaaacaaaagtgtttttactgtggaagcttccatgttatggaggagggcctcaggcgtggggaggactggtgcccttgttctgttttatgtccaagtttgtcctttctggggcttttggcagaatggtaagcactgacagcctatagcactgtgccatatttttacattggcgatattgctggtatattgtggtatatttgactgtataaacattgtaaatagatgatagtaagtcatggctgacatttgtaagatgcttttgtaccttagaattttctacatcaaataaaatgttttcttgtaagcctgcagtggctccttatttccgaatatctgtcccgtttcctccctagctcctgactgtcggcagaggagtctgcctcagcctgagacggtaggtaaggagggcttgcatctgtgtcttgctcttggaactcatcacatcccagctctgctgcaggtattgtgaccctgtgattaggggaccctggtgcccactttctatagaatggacccaaagtcctgctttaggggttggtggcttcagctgagctcctgttgtgggtagagtgtacctgaaagtgacaggtatccagaagggggcaatggctgatgatagtaaggaggctataagcctccagccattacctaaaaagg

SEQ ID NO: 22541 - DNA, 1147 bp, Mus musculus
gtgtgtgtgtgctatatgtatgtgttcagttttgcatgtgtgtgtccacatgcccaggccagaggtgaatgttgaatgttatcttcagttgttctcctttgcctaattgtttgagacaggttctctcattaaacctggaggtcaccaattgtatgggctggctggccaccaagctccagagaccctcttgtctctattcctactccatccccacagtgggagcattataagtacccactgcctatccagattttacatgggtgaggggaatctgaacccaggttctcgtggcttgcttagcggatgctttgccaactgaaccatttctctgacacccatattgagcttttactgtggagaagcactcactgtccccattttacagatgaaaagggcaagaccatcagacgtgtggacagttgatccaattgttgactctacaatccacagatgatcactgagtcagattaggtacaaatttgctatagaaaacttcatggaacatgcaataattttagtttaaataagccaatattgtcaccagttcatatagactaatgaagaattatgtaagttcctgccttcttccttctccccaatctgattctgtaggttcagggcactgaggtgttatttttatctacaggaacatgaagaataaagttgcttcataaaaggttggctttcatatcagccggaggcgaaggacgcttgattcagtgtaattaagataaaaataaaaccctccgagtggttttactaaagaaagaactggaggcctgctgataataattagtattgagttcagctttcagaaaagccataggtacctcaagggtgctgggagggctggatggtaattgctcagttctgggctcctaggtcgcccattccagggctgccctgaatggcttgccttagaggaaaaaaatcatacgctacctatggtcaagctctgccgtgttttcatggcagagagaggtgttattactgttattatagttccgggccctttgtgtatatcttatcttaccatttagtctttaaaaagctatcttcagaagacattcaagtcaccgcacagctggggaaactgagggcccaaggaatgaaatgaattgcccaagaccagagctcgcgttagcac

SEQ ID NO: 22542 - DNA, 1120 bp, Mus musculus
attcagccactttcccaggtttttacattcgacaggctcttaattctgatctctttgcttccccatcatggcgtggtctgtcctaccccatctcatggtagaatccctcttctctcctgcctgggaatcctaaaagtcccacttcttcctccctgccccgccattggctgttggctctttattgatcaatcaaaaaccaaatggggacagggaccctcagcatctggacacacagattcctatgtgattttgggagccgaactaaaacaaagcattggagccaatccccaacacatatacaaaatggaattctattaaggtctaaagaaaaatgaaaccatacaatttgcaggtaaatggatagaactagaaaatattgcactaagaaaatccagacccagaaatataaacatcaaatgttctctcatattagtatatcctagctccaaattcttagataaaagtatttaacctagaaatagcagcaggagacaagaaagtaaaaagggaccatggaaaacaaagaaggagcttaagagagggcgacttttctggggcgtggtggcgcacgcctttaatcccagcactcaggagtcagaggcaggcagatttctgagttcgaggccagcctggtctacaaagtgagttccaggacagccagggctacacagagaaaccctgtctcaaaaaatcaaaaaaaaaagagagagagagagagagggcgactttagctagggagggaagggggacgagggaaaggggaaaggataaatgcactaaggcttgtcaaagccacaggaaaacattgttttatgtttcctttatatatatatatatatttatatgatatattgtgttatgtgcatgtgtgtgtgtgcatgtgtgtatgtgtacttttaaaagttgcactacctgaagcattgatgtactccctaagacccatacagaatatctaacaaaatctccagtgccatgcatgggaaacctccctttgagttgttggtctgaggtatccaagactcccccaaaataatataggctgctgctgttgcctttggttatgtcccaggacatgaatcaaacttaaaagcattgttaagtaacaggagtgagataaaat

SEQ ID NO: 22543 - DNA, 1127 bp, Mus musculus
ccttatttcaccaggacatcctaattgtgtccagaaatcttgaatattgattagcccagaaatactataattacactatatcatgatgttaaatcaacaggtttctttcttgatgtaatatgcttccttaggtaggagaagtagaagaatactttgaaaaatattttagaaataaaaacaacagggctaggattagtatctctgtcatataaataatctatacagatataaaatggtctactgacagataggcaaaagacaagaatacgcagctcacaatcaaagaactgagggctaagattgttttagatgttcaccttaacagaaattataattcatacccaaataatattatggctatttcatagaaatgacaaaacacagtgttgtggatattgtctaatgcaatttgtttgtgtgtgcacactgaaagacagaagacagggttttgcacttgtgatcccagcactggggaggcagaagcaggccagtccctaggatctgctggccagccagcctagtccgcttgttgagtttgaagccaatgagagaccctgtgcagatggtacctgaagaatgacacccagggttgttctcttgttttcacatgtacgggaacataagtgtatacacagagatagatgcacacatggacaaagacaaaagagatttgattcagatctttgggcctactgttcaagcttgcttgggaggaaatatatgtgcagagttgttcataatgatgcttgtggtagtgttcattctttcagtgtgtgcattttagaaatcgtagagcattcttatatcctttggctcacctgaatataattatttgtttttaaaacaagtgtacaaaagggaaggaagcttcagtggtttccccagggtcatacagatggaaatggcatagtcagaggtggaagtccatcatccttgccccaccgattctggacctatggtgagacagaacatcatggctgcaggatcatgtgacagaggctgttcacctcttggtagactggaagcagagagaaacaaagggactggggaccaagtctaaccttcaaaggcatgctcccagtgatctgattcttctacctggcctcttgcctcctaaaatctcttag

SEQ ID NO: 22544 - DNA, 1215 bp, Mus musculus
tggagcgcctcacgcccgcgcgatggcgactgccgcggagacggaggccccttcgacggacgcgagctggaaaagccgcggcggcggcggcggagacgacgggatgaagccagcgcttccggagcttgagtcctccctacaaaatggcggcggcgacggcggcggcggcgcggggcctgaggagaccgcggcagctgaagccgcccggagctacggccacgagcagcctcagcaaacctccgaagcggccgcggccgctctgcccaaaggcgccgaagagccggaaaggccttttaggcggagttttcagatccccaggaagagcagagaaaagaaaggtggtgcctccccttcctcccaccccctctctcgcttccctccccctccatctttttcattaagacctctctgtctcctctccccacacccatccgagacacgtaaacacgcacgcaagcgccagcagcctctccgctcacggccacggccgcccagccgcccttggtgcgagaggatagggtggaaccacgctccgccgctccccctctccccgtggaagttggaagtagctcaggtttgaagcgtttccataaggctgcggctccccgagcggaaagatggtgctcggtgcccctcttttcccccaagccccgaaggcagagaagctgatggtggcctcctaaagatgcttctgagaagtctgcttgtggaagtagcctgtggccatggattctgaggctttctccaaggccactgcgttctaaggacaagtgtttctcactgtggaaattcttcagctctgtgtgtctacttgaaatgtgctcgatgtcagcgtcttctatttagaaaactctccattagtatatgcgctccatgcagttttccatcacacttcatttccatgtagtttttttttttttttttttggaaaagcattagcttacgtaggttcttctgtataacttccaagcctagaatgacttttcttaaacgattataggaacagttgggttgcttactttttgagatcttagtgccatattgtaaaacgtacacttttttttttcttagagtaggttttgactgtccgataatttggaattttctggatttgacttaaacacttaccttcttactgcgtgtttttttttttaattgtttatttcccaaatcttttttttttgtcatttgaatatctgaagatttagaatcttg

SEQ ID NO: 22545 - DNA, 1149 bp, Mus musculus
taaatatattttcccatcagctgtatttattttattgtcgttgagagaaggtttcaggtaacagttggcaacaagttcactttatagcataggatgacctagaacttatgatcctcctgccttctccaccacccaactgttggcagtacagggaagtgccaccacacctgctttatatgattgatttcaggcccttctgtatgcaggactgtaagcactgagcagcggcactctttaccctgcccccccctcatcaagcatattttaatgatgtatctgataacattgctagagttaaaaatacaggaatgccaaacatgctcttatattttctttcagtcctgagaaattggatgttgaaacagttatgagtattgattgtttgaaacagaaaattcctccttcattcttttataaagacacatatgtgggtcccaatgaaggtaaagaaattaaatttcatttattgaaatatgtaagaagcagacctgattttatattttactgtgtattttttctttgtctcagttttaaagaatggaatgtattgtagcctttatgaagttgtagaaaagacaagaattggaagtaatatggaatgtttactgcaaaaactggagaaagaaaaacttgtgagtgaaaagttttaaatattcccattattccttgaaaatatattattattattattattattattattattatttttggtttttcgagtcagggtttctctgtatagccctggctgtcctggaactcactctgtagaccaggctggcctcaagctcagaaatccgcctgcctctgcctcctgagtgctgggattaaaggtgtgcgccaccacgcctggctccgaaaatatgttattattaatgttttaatttattcttttggaattcctacacagtctctattggatgctctcatttagttagtagtattttattattagtagtagaagtagtacttttttactttggagatgggttcttgttatgtagtcttatctgacctggagtttgctatgtaaagcaggtatagtaagatatagtattctttttacccaggaccgtagactttatttagacccatttttattatacattgtgattataaatgttgtatgattatcaaaaatatttatgg

SEQ ID NO: 22546 - DNA, 1179 bp, Mus musculus
gatgttgaatcctaggctttgagttctagcaaatactttgcttcttagctatatctgtagccacatttaagttcaatttctcctatgtgtgaaaatgatctgcctgtctctgccccctgagtcctggtattaatggtgtgagctactacccagcacataactaaaactaatcttgaaactatgttccctgaactattttttttcctttaaagatttatttatttattatatataagtacactgtagttgtcttcagatacaccagaagagggcatcagatctcattacagatagtggttgctgggatttgaactcaggacctctggaagagcagtcagtgctcttaaccacagcgtcatctctccagcctcctccctgaactattcttgaaactctgccttgatctcctaagtgcataaccactcctgcctgtggatttagtgttcactgttttttctttttttttttttaactttgatatagaaatgtgtattttaatttgtaaatgtatgataacacttttgctttcttattctaatttaattgcattgtaatctgaattgatgttagtttgatgtttgtttggacttatgtcctatgtgtttagttttttaatgcatcctctcttcataagtatatattccataattgttaaattttagcttgacaaattttatttattttagaaaagaaaagagtttactaagcacattttttttttatttgttctgagatatggtttttctatgcaactctggctggactggaactcattatgcaaacccaggctagccttgaactcagtggtgatctcttcctgcttctggttaccaaagactgtgattagtagggtaccggttttaatatggatacaagtatgagattcttgtctttcagattcagctcttagtcttcagtattttttgttggtaggttgacccctaaccccttgtgccgaacatggaatttaggaattcatatgtgttaaaccacttctcctacaaagctataattcccagctctttctttttatattttgaagaaggaactatcagagattcccagtctaacctgcagcttgtgatcttatctcagcctcccaagtagctgaggttataggcctgtgccaccagacctggctgtctgtgtatatttgtgtgcacatgtctgatgctcatg

SEQ ID NO: 22547 - DNA, 1100 bp, Mus musculus
tttgttgtttttaaactttttttttttttttggttattcgagacagggtttctctgtgtagccctggctgtcctggaactcactttgtagaccaggctggcctcaaacccagaaatcaacctgcctctgcctcccaagtgctgggattaaataaacctttttaaaaagaggcactttagaacacttggaagaacctttcagtgctgttactgaaatccaaagcgtagcctataagtagagcagataggacatagggtttacacagtttattgaggtattaaatttactttgcagtggatatttttaaatatatacctgagctgacgtgtttttaactgagtttttttgttttttttttttaatgctactcatttggattgctcttttaataaactcttcttgtataggaatgaaatcaccaggagaacagctggtgtgcctgccaccagtggaggcctttcctaatgatccccgggtcatcaatagagaaagaagctgtgattaccagttcccatcctctccgtctacagacactctaaaaggcactaccgaggaggacactgtaacagcaggtcaggcgatggcagtggaagagcagtgtgtgccagcagcagagcttcctagagtgagcgagattacagaaaatacagtgttaggagagttccatcttttctctaggaaggtagaagagattttgaaggagaagaatgtttcatatgttagtgcaatttccacacctatcttttcagcacaagagaagatgaatcgcctttctgagttcatacattctaatacttctaaagctggtgttgaggaatttgtagatggtttgcatgaaaaactaaatactgttgttattacagcatcagctaagggtgtgagtttgccgccagcagttagcgctaatcattcccatgctgcagcagcattggcttctctgggaaggcgtgttgtgtcaatttcctcaagtgacttcagtgctaaagaactttttgagccgctctgttctgaacatttaaaagataacaactctaatgaacagtattcctcttcagtggaagtagaaatgaatcggccacaccattgcaaagagttaatgt

SEQ ID NO: 22548 - DNA, 1889 bp, Mus musculus
atggttttgtttatccaataatgaaatgtttatttgaaaccatttacctacagtgacatcactgtagaacttagcatgtacaagatctgctcattgattataccatagttagtacggagtggtttgttactgtataggctatatattcattagtctatactgtggacaacatatgtgtatattaagctttattgcctgctgtttgctgtcagttttttaaagccagatagagggattgttgggctacaaaggtccttagatgtatgtgctagtttaatatcttactaagtagtgagactatcttaccttcagtcttccgtgagatggcctctgcttgttccagactttaaaataaaagctgttcttaaattattcttggtgaaaagcagagattactaagcattcagttgagctaaccagtttagtaattcagtgcagctacatgtcagaagttttattttatatttgtcttacgaaatactgaattaccgtgtaactttagatgctgttttgacattaacccctttggagctgggagttgggatttcccaacattaaacgtgaacacatttcgcagaagcttttagcatcggattatctggacactcacacctagtgtgagtgttgtgactaagtgaccttgtggcagaagaccaagctttaagggattgtggactttgcagatcctgacgcactatattgtgtgagtagtgtgtaattaataactaaacaaattgtattacaatagagaagggctttttgttttttaaatgtagctcttttagaaaacgatgaaaaggatgaagaggatatgtccctggattcaggggatgaaatctcacatatagaagtattcagcaatgttcattcagaaatattggcgggagaaaccaaaggatcaagtggaacagatcaaaaaaagaatatccaaattgaattgcagtcatctcttgatgtgcaaaacagtttattagaagataagacttatttaattgattgtgaagcgagcgctcctattgatagagtatgctctgaaggagagagcagcaattcagcagaacaggatgcgtatagcgactttcaggctgaccaaaatcagttacaaatgtcccatcagtgtagtcattttaatgttctcacgcaccagacgtttctggggacaccatatgccctttcatcaactcggtctcaagaaaatgaaaattactttttatctgcttacaaaaactcgggtacagagaaatctccattaagttaaggatgtgttcaaggagaaattacagtgattaaaaaaaataggttgtggtggactttgtattgatgatttataaacaagtttcttggcctttctgaattttttttcctttcctgtttatttaaatcatgatggcctatataacattgaagcatctgaaaatttgaaataattttttgacatattgtaatcagattatctcatgttagcacctttcagttttacatttgttacctgtacttgggcttcaaattgaagtctgttttatatgtaaaatttcatgtttataaaagaatggtaaatagtaatgacgttctttaatgtcagatgataactaattttgctgaaatgtcaactatttattttgattaaagcttttgtatagtgtttttacacaggtataagccagcagtgtaaatatttataggattttggcttagtacctcaagctatatttaacagtacagttgaattctaggtagtgaatctattgtatagaataccaagtagaattttctcagtctttaggtttagctgtgaaaacatttgcttcatttaaattttggttaactttttgagatctctttgataaataatattttgtgtgatcctttagttaaatgaacttttaaaa

SEQ ID NO: 22549 - DNA, 1506 bp, Mus musculus
ctgtgtgcaaaggaccttcttcatctttgagccatcttctatattatagaaaagttagtgagattagcttctcagggtcttctgaatatggtgcttcccttcttacagccccccacccccttcccttaatgctcattctctccagaaggcagcacacatatatccttaactgagcctacagcaccttctactggaagacctgggccagtctcgtcttgtaccacatccttccacatctgagctacctgctccatccttagtgtggcaagatttgccttgccacggtcgttcctcctcttcctccccattgttagctcctccaacactcatttccttctcagccccactttccatgtccccagcgatctgaggccccgtcttacacagagagcactttactagcacctatgaatctgattacctatgcttaaatctcagttgcttcctggaggtgagggagagctaagggggtatggaggctgccgtaccatttggctcatgaacctccctggaagtatttcactttctgatagaaatctgagctaataccagcttggctgaacgaatgactctttgacaggttttgctatcagcccatgttatactctaccttttggtgggggtcagcccgctgacccttccatcggattttctgactacaagtgctttggagctaagtacctgtggtcacatttatgacaaagatctgttctcattggctctcctcgagttacgagcagttgccttatctctgtctggcagagcccgtgctgcttctcagatgtggaaaatgggattgtttggaacagaaatctctttatccttaaatcaaattaacgttctccaccactgtttcagctgtgttctgatttgcctgctcatgaactcctcgtgaacttgctgctctaacgttcctcctgctctgtcttgtttgtctcctctctgcagcttgcttttttaagcagtcagagcagtttagccgcgatgaaagcagtgataggaagcttgaggggtggcctctgctgtcagctctcagacgactttcatcctccgcttctgtcactgaatttatgtttgagcgccaatccgcatttatgcatgcaaatttatttatttgtaaattatggtatgccacagtgtcactgtgttatgtgtcttctttgataatcacaaaaaaatatggatgagacaaagtaaaataaatacaatgaggtaaattttaatgacattcttgtttgtttgtttgtttttagtaaaaagcatattaaaactcctgatctgtgttattccaaggtaaagaataaaacattaactttttttttaaagtggaaacccttttactacctcttagaagtatatttacagatatatgtatccctcttgctcaggatagggtaggctcttctggagtgacagcagacttcaaatctcagtggcttactgcctagatcccccctcccctgccctcttttcttcctttctttccagcatctcattttgtaaccc

SEQ ID NO: 22550 - DNA, 1155 bp, Mus musculus
cgttcccattttcctgtgccatagctagtagccatctctcaggggcacacaatgagccacgtgtaatgagtagaacattggtctggctcttaactttgtggttgctaccgaccaatgggagcactgagctgaatgttataacacagtggctcccaaccttcctaatgctctgaccctgtaatacatggtgtggtgactcccaaccctaaaattattctcgttgctacttcatcactgattttgcttctgttatgaatcatcatgtaaatagttttgaagacagaggtttgccaaaggggtcgcaacccacagattaaaaactgctggtcatgcttgacaacagaatgacaagttccaattggacaattaagaatttggtttagttttcttaattaggaatttattttccctagaagtggttttgatgcggtttctaatttccccttaacttaggagaagagaaagtttattttgattcatattctgagaagttccagtcacagatagtggagctgttgatttgggcctctgatgggcatggtggatagcagtggtgtagtgtgtggcagaggaaactgctcagttagagtttcacaatccccttcaaggacctggcttcagtgacctgaggacctcttacacagccccatcatctcccggtagcattacccttgggacaaagcctttaatatttaggggaacatttacttgaacaatatcaatgctacttattcgaacgtaatgttgccttttataggaaaagggaaaatatgacacctttttctatatagaagaaagggacctaaaactcttagtttttttaaaaaaaaaaactgtgatttttaaagcacaacaactagaaactgcagctgcaaatgtcattcttccagggatggtagaatctaaaacaatttgaactgtgctatgtgtagagaaatgagaggcagacccattatggaagggagatgaagaaactcatgtgctcttctctatggcattcctggttttataacattgcctccaaccagcacagacatgtgccctcaggtgcagtttatagaggggattgattttgatgtcatcttggttctgtccatgggagatgactccatctctggatttaaggagatccatactccctctgcacattagaga

SEQ ID NO: 22551 - DNA, 1145 bp, Mus musculus
gcaggaatctaaatgattcctgattctttttttctctgcatcatgttccttgggcaatgggatttcgttgtgcaagtgcaaacaaagaaaacgtattgaacttcttcagtgtgtagattctttcagtcccactatgccaaaggttcttattgaaaccacacacagagaagggacggtaggatagatgatagtgagcatcttcaaaacattgtctaataatcctttccgtggacaacattaattcattgacaggggaaaagcaacagggtgattttattggccaacacagatggggtgggttctcttctggccagagttcaatttcaatttctataattagttgcaggtggagctcttgtgatgttttttgggtccattggcatctgtgtgcaaattcccaccactaccaggtggactcaataaatagtttggctttgcaggaatatagaaaattataaatctctctctcacacacatatacacccccagataaatctgctttaaaggtcaggctttgaaagctgtggagaacattttctaaagtttgggaagtggggtttttggcagagtgtaggcttgcagccaagagctggggcagcctgacaaacagaattctggcatgggccatttcttctctttgtctctgtgaagctagcatttggctgcatcttggaagagacctgtggccattttgtcttttactaggaaaggaagaaacaaagaccaaagcagcagctaacttctcatttcatcctcttggcaggctgggaactacctactggtttagcaacatttattgatcaagctaacgtggtgtaactaggggtaagttttgtctcccagaagacatttgaaagtgtctgaaaacattggtgtctggtacaaattggaggggggggtgatattatcaatgaggaaagaaggacagagagacatgattgaggaagggacagtggtggggtatgtggcagaggaggcagggcaagcaagagacaccatatgcattctggccaaataaagatcagaaaatggctggtgctttggaaacttatcacaaaggatgggggaagcaactccaggactattaatttataggcagcgaggggtgggagatcaggactattaatctataggcagtgaggggt

SEQ ID NO: 22552 - DNA, 1199 bp, Mus musculus
catgtgtacctcacccactgctacatataggttggattcatttacctgttaggtggctttcctcattcacatgctgtggccatggacccaacaatactagtctttaagccctggagatgtctgtctcttattgctggttgatgagaacaaagtttccttcagctaacagattccgtctgtaatgagtgtcttccatgtaatagctgctgcttaattggcttatattttcttgcattccctcatctttttacagtgtggtcatgagacagaggagggtatttgtctatccctacaagaatgaattctcatgagaataataaaaaacagaattttaaaaggtctcttgggaaagatggcctttgcctttgctttgggaagtctatactctaagctttaagacgtcagggactgtggattccctcagatgcctgtctcagtactaagtacagtcctttgtccacactgtgctccatagacattcagtgtgaatgttatgattcagtgtgagatgataggttgtgatttgtatctgaaggaatgctatcggaaaggtcttaaagggagagtctgaccacggcagggcctattacttttctgatgctgtgataaaacactttgacaaaggcagtgtgaggaagagagcattctcttatggttccagagtgctgagagtccatcttgaaggaaagggtaagccgagacagagagagagagagagcaagagagagagcgagagagcgcaacatggaagctaatgaggctttctagtctcaaagcttatcccagtgaggtacttctcccaatatgactgcaccacctaagcctcccctaacacaaccaccaagtgggggcaggtgttcaaatacccaagactatggggggcatttctcagccactcaaagcaccgcagaggggaacatagtgggagagaaataagaataaagtgtgggaatgggatttcaccatagagttcccagtctccccagcacatcagattgtcttagtcacaggcattagaatcattgtttaaaataagagaagttgtctcctgtgacttactctgtcttcttacatggtcctgtcactagcactgatgtatgaaggcccatactcttcttgctaggattctcttggaaaagacggtgacagggggacgactgtattcctcattgaaatggaatttgatgatccttttgtta

SEQ ID NO: 22553 - DNA, 1171 bp, Mus musculus
tatatatgtatatatatatgtatatgtatatatatgtgtgtgtgtatatatatgtatatatatgtgtgtgtgtttgtatatatatatatatatatatatatatatatatatatatatcatattaccttttataatgcaacatgcgtgtaaggaacgtaaactccttgggttctgtccctggtatttgccagtagggctctacctgcctgttgtgccttgtatcctagcacactcttcacccacacgctactttccttactgcagagagacgacaacatgaattgggcttcaaaggtagttttcagccttgaagagagtttatcttgtgctcagattctctaagaaaagtgaagtcactcagtaaacatttggtgaattcgtaataatagctccttataaaggatttgtggatgcgttaggctctggaccacttcctcattgtgtccccttctttttcttctttagcccaaagcattttgtcttttaaagtcatcccatttaaaagtctccctgaaaaaaaaattgctccataaacctccccttctttcttctttagctccacttctgtcaatatttttcccttcttcttcactcatgcaaaggtctgtgtcctgctgtttgcttttcattatctggttttaacagtgcctttgtctctgaaatgtgtacagccccaggtaagagtcattactatagactgcatcaggaactttcacacagtaagtacccaaatcaggatggcataatctggtgggttttttctcttttgactaactggaagctctgtttgctaccatgatactcactgtgagtcactaaaatagtccaaggagtctctcgaattggggctgtgtcgtgctatttggtagagtcgcacagagagcatgccccgtagatatatgggaaatgatgatgctttgaagttgctgtgagttggttaatatttaagtgttacgtgttgtttgtagtgtgaaaggaagtttgtggtgttcaaaccatctgcccaatgcaattaatggagaatttgatggacttatgctaagccatacagctcgtgtgtgcttgatttagagatgaaacttgtcaaaagaagggtaaaatggaggagaaatagcttctggaaatgaacatgagcttgaatggggacacttatggaaatgtaccagaagat

SEQ ID NO: 22554 - DNA, 1099 bp, Mus musculus
tggcaagccttttattttctttcatgtaactatttacacatgctgagtatttctctgttccacagtttggggtcttgtaaagaacagtggcagagcagagcataagccattggcactgatggctgaccaactggtcacctgtattctgtcacagtagggtcagtatccaaagagccttcctaggcaaagcttctggaaagctgctcaaatctaagtttgtaagacagtgcagaatactagaaagatcttggagacaagaattgagttaccttgtgctttaataagccttgttcttatctgcctggtagaactttctgtggtgaaggattttctgactaggttcactggggtagtggtcaattgatctgtgtaattcttgagagcttaagatgtggttatcaggactccgacactaaattacaaattgtatgtaattcagctactttaaacaatcctgcatggttgcggaaagtgtactagaaagtgtaggtagcctctgtagtctgagaacgttgtggaattgtgggcagcaggttagtgtgctggagtgaagttgctttggttcagttcctgactctcacttgctgcagaataaggtatgtgttttctctatgccttagtctttttagtacatcaaatagggaagaagattacatccacctcattgaaccatcattgtgaggactgaaataaatgttacacctactattcattcattcttttaatggaccttacattatagaattgttttagccagattgctggattcacgatacatcattagcataggcccatgagtcccataaacataaagataattacacatgcacaagtcccccccctttgcctttttcttacaccaagaaccagaacattaattatagcttaatgtctgcatggattttacccctttccgaacacaacttggattttgtatttttatctccctataaactggtgatatttcatatgtaaggtgtgatgtgtttatgccctttaatgagttcttctctacaggcctctaggtcttcttgacactcattgaccatgttcttcacacttcccaccatttgaaattgacaactgccttattaattgt

SEQ ID NO: 22555 - DNA, 1123 bp, Mus musculus
aagagacaaagaccaaggttttagaaattctggcctaagaagaaaaagaaatactgaagagtcaaaaagatgtaggttcaaaggagggaatttgacccaaacactccgttgttccacaactcagtttcctcccagggaggggctgctactcaaacaagtcagtgtgtggtaccctcagactcccttgagataattcatccagagatactggaacaggcagcctgctccgaacatgagccattaatactcctgaccacaataataattacaaaaataaatcctaaggaaacacagccctgtatgcggccatgtccaggtataggtcgcagagcagtctgagtcccttcatttaaaatatgggtgaagtcacacccagcgggaggagggcagagatgaaatgcaggatccctctgctgttgcctcctgcagctctgtcatcctaacagcttcaaaacggggctggcaggctggccctgcccccaccctcacagccctctgggctctgaagtgttacattttattgccctgtggagctgtaggaggccactctcaaggtaaaatgttgctttccactcagatttctgagttatggcttcaaggtggtttgctcctatcaagaaaattaaatgatttaacataatttgttgccactttgatcacaacaataataaataaatcttcatgaagaaaacgagaaatccattctgtcccattttaaaagatgttaaatcataacacagatgtagttatacatatatatatatatatgtatatatatatatatatgtatatatactgaaacgactgagttgggctttcctgtgcacattcactcagaggagctattctgtaggatgcccaaggccctgaaggaaccctctcctttgccatggttaattagtctatcaggggctggccttttatgtgggcaccatgtgtaacacgttaggttatccgtggctgttgtgaatgggtgtctgtttttgtacctggggcgcactgcacacatttgggacgcacatggaatggagtggacattaacccagatgtcaaaaatagcctgcattttactactgttattaaacagtttcccctttaacccctctgtgtttaccaaagaccc

SEQ ID NO: 22556 - DNA, 1161 bp, Mus musculus
gtggtcagctgtctgcattcgtgccaattttgacacagctcctgtttggggaacatttctttgccccacttttgccggttgaaagtattatcgatcttacaagcatatcattcagtccctgcaaaatccaattctatctaagacagcatcttttcccattttgtgtaccattctccaatatttgggagttccatcaaaaatatccctttccacacactgaaaattgtgtctgggtttacaacaaacactgtgttgttcagaggatatttcctttgtgaaaactttagcaggttcccttctaatcatagtgtagttgaaattaaacaaacaaacaaaaagaagtttgggctaacatttaggagaagttggtctaagtcttaccttgtgtaaaagcaggcttgtatttataacctatttgatttctatatacagtctcaattttgtatttaatgatttttgtgtattaagtatgcacgttcacagcgtgtcaactttcatttggaagtgggttttattttttaaacagtgtttatgatgagccctcaagcgtattgatataagctctagctgcaccgtctttgtgtagagcgccgtttgaatgctgccaagggtccctgtatctaattccccgagacccttgtttgatagtgcttcttgtaatatttcttcaagtgagtggcatgtgggttgtgatattgatccatgtgattatggacattgatatgaaaaaaaatttaaaaataaataaataaaattaaggaaccctcgaaactatcactgggcatgtatcagccagtcattgtaacctcttgtctagtagaatacccatgtgcaaggtatgtacagctcataactttgtactgtgtgtatgaggagtgctttgtgccgattgtcttctttatattcatcaaataaaccttgtttctttctgaagtgaattcatcttaccttttacaaatatgctgtataactgtttctagctcttggtgtgtgggggggtgtaggggttactatttgaagaccatacaggccaaaagaagaaaaagaggaagggagggaagaagaaaagccattgtcttgcttaactggaaaggccaagatggtcagctggtcatataggtgcagttcaggaagttagatcaagggccatctcctccttcc

SEQ ID NO: 22557 - DNA, 1103 bp, Mus musculus
gagctttccgctagtctgcttctaagtgaggatggctgggaccttaacaggcatctgatccccactgttgggggcaaatcctcaaaactcaaatgctaaggatagatatttcctttcccaaagtaaacggggcataaatctgcgagaggaaaatcaactgtaccagatgaaggaaatctaaaggaactgcagaagttttgtgaagacatgctgaccaaatgcgtcaaggaaacaaagcccaaggaggttcaccctgaaaaaaaaaatcaaggaatggagcaacaaagagatggatggtttaaataagacggactttttttatcttcctccttctaattatttatgtttacaaattcacagaggtagaaagatcttggaagggagaaataatgtccatttgaataacacaagagaatgtcaaacgtgaggaggtaaagggaagaagtatgtggaagtagcctaacctttttaagcacataaaaagaaaaaggaaaaagaaaaagggggtggaaaaaaaaaaaaaaaaaaaaaaaaaaagtctcgactgcattggtgtgaatcatcagcgccatctagtggatctcgggagtatggtgccaggccgcagcttaaattcaaattagatctcagacctcagtgtctcaccctatcttaacattttattgcttgcagaagaaaactaggtgacctccatttagtttaatttaataagtctgctcgagtttagtctgaagatacggatatgaaagaatccgttaagttgcttagtcaacctggcaaagatcaccctcaccagggacctgggaatgcagaagtgttgtctgcgctgagacctgggttgtataaagctgcattgttgcttggattgatttaattccagtgtaagaagaaagggctgcacggtaaacaaacactgaggtagtaattacgtgaccatggccaatgccactccagtcctgtcaggctcattatacctccgacatttttcaaaacgacttgacattttttctgcatgacatgttttgggctggatacagtaaaaacagctggttgcctcctgctgcctggaccatccagcactggggaagtgaagaactcttagc

SEQ ID NO: 22558 - DNA, 1327 bp, Mus musculus
ttaattcctttgaaaaggaacacaaagcagcgagtttagaactagaatctgtctgtattgggaacccatggtgttctgataagttttcttttgagggaggtgtcttgggggtccccttcatctcatggcacttccaagggcctgtgcctgcctatggggcttgctgtggagtagtgaagaatggcatcttcagtattaaaacttgagacattctcctcagctgtgtcagagattggcatgttgggaggttctgccttttgttctgcttgtggtagttcagggaattgaacccagagcctcacacatgttaggcaggggctatgtgactaaggtacagcccagccagttttctactgtgtttcacacagatgtaaatcctggcttggttgctgttgactgagcaagggtctcagccccacttgcagaaaatggtgttgcatgtctgtcttccctgccttggctgaactctctgtcgctgtgtaggacatggacccccggctgatcgcatggaaaggaggtgcagtactggcgtgtttggacaccactcaggaactgtggatttatcagcgagagtggcaacgctttggtgtccgaatgttacgggaacgagctgcctttgtgtggtgaaaaccacaaccgagtctcaggacataaaagacttaaagagtgtatgtattgtaagttattgaccacgaagcttaattttcctagaattaaattaatgcaattttatgttaaagtatgacactgatttgagataatctactttcagtcgggcttaccctgtccctgatgggaaaccttgctgtccagccttccatcctgatgaacgtgtcatgtagccctgaggggtgaccactggaaccagctgtggcatcttctctttttttctagcaatagttaggagctaaagcggtcaggctgggttctgtgtacatcacacaaggtcctcttggagttaagcactgtctttgtaacacatacacacgtcagggagcaggaggtcagggagcactcctgggggccacagcacaaggcaggcagggtaggtagagcagaattgtttagctggctgttaggcatctgctcctaccgtgtctgtcaccaggcttgtcctggggaggactgggaggcaggtaacagtgggtcagatgagccgcgggatcaccatggactgtagcagtctcgggtgcacagccctgctggcgctgtaagagtaaccagctaaagcagcttcgagcaagcggggcatactatttggagatgtacttcctcatttgaaaattacctgctttttatgttttggatcaaatgtataggatatgct

SEQ ID NO: 22559 - DNA, 1192 bp, Mus musculus
gcggggcaggggggacacagttcacactgacatgctcagagtggtttaccatgagacagtcagagcttctattctgcctcatgcatcaccttcaaagttgtcagcagagtcctgattccccggtgatacgtgttggaggttgtttctgaacagagcagaaagaaagcctgctcagtgctgaagttagttggagctgtcactgcaatgcagaaatccagccgttctgaattccaaaccacaaaatggtctcagagcttattggtggaagaacggggggagcgtgtgagagctggatctgcagtctctgttcctctccttctaagctcatcagtcacctttctaggtcgccatcttgtgacatagggatttggatgcataattgcacttgatgcttacagtaattacacatgcaaatttctatgcacggggtggaaaaacatgtggcctgcaaggcctttctgttttgtaatgtttattttaagtaaataaccaaggtggcgcttcctatcgttactaatatgctactctatttaactcgtgataaatatacattactttctgcaactctgaggatcagtttacttaactgactctagcttcgagccttaactgctttgcaaagctttgcttcttgctagactgagcaacccgtgttataggctgacagcccagtgccctttgtgcaccgtcccaccccacccctgcccccagccagaagtgagggtttaggctcttggtccaaatgtgctgattcgggagagctgtgtctggtctctccgtttagatgatgaggtaaccgtggggaagttctatgccactttcctgatacaggactactttaggaaattcaagaaacggaaagagcaaggactggtggggaagtaccctgcgaagaacaccacgattgccctacaggtgaattgccctcttgctctgttctcttctcactaacaatgttgccagctttgatttgaaacactagagagctgactattcatggttgagcagtgccacaaggattttgtttaaactgagatactgcccactgcccctcccactgtggactagccatttccgggtcgcaaggtaagtacttcctcctcttcgtgtcttctccgttgagcctcgcacctgccatcatctggtacgcgtgcaaaaccctcaggacagcctgcaatgggaaaggagtgaa

SEQ ID NO: 22560 - DNA, 1202 bp, Mus musculus
gttgagtgtgtgtgtacgtgtgcccgcgtgtgtgcgtgtgtgtgtgtgtgtgtgtgtgtgtgtgtgtgtgttggtaattactttttgagaaagggagttgtgtatatctgttaagccatgagagatacatgtgttttcaaagtcaggaaaagacacgggatcactgtgagaatggcctcagtttgtcagaagagatgcactaaaagattccttttgaagacacaggtatggaagagtaccagtgtggttaggtgtggcacaacaatggccctgcatgactgatgctcagagtagagctctggtgacttttgcattgcctggccaaaccccactacttgtgacagaaggttcaaaatgggaaatgcaagatgggagacacttttgctttttaaaaagatagtatggattgaagtcttcttcttcttcttcttcttttttttttttccaaaaggaataatctcttttctcctctcctcagaggcaaactatgcaagaggcaccagactccctatttctggtgaaggaccaacttctcagcccaacagctccaagcaaactgtcctatcttggcaagctgcaatcgatgctgctagacaggccaaggccgcccagaccatgagcacctctgcacccccacctgtaggatctctctcccaaagaaaacgtcagcaatacgccaagagcaaaaaacagggtaactcgtctaacagccgacctgcccgtgcccttttctgtttatccctcaataaccccatccgaagagcctgcattagtatagtggaatggaagtatccttttttttctgtgggaagtctttctcatttgccatctgtgcttcaaaaggatttgctttctgcagtgacacttctcagagccttagcagtctggaatgtgagcaatggtggcaactgcaggcaaggggcttcatgggctacggcttcctgtctccccagcttgcagagggtgtgtccatgagtatatttagcctgtgtgtgtgcgtgtgtgtgcgtgtgtgcgtgtgtgtgtgtgtgtatgtatgtagtgctgtgtgtgtgtgtggggggggggaagtgaagattgcaacttcatagtggtagggagttagaatatgaacgagacctttggtcatagaacactggataggtctgaagctgttattgttttgggggcagttatatgcattttaatttgttgaaaatttg

SEQ ID NO: 22561 - DNA, 1208 bp, Mus musculus
catatgtatgctgacaaaacattcctgcaccttttttaattgaaaaaaaaaacttaatacataaaaataataagtaaagctaagtgtgtgtgtgtgtgtgtgtgtgtgtgtgtatgtatgtatgtgtgtgttttcctttagctgttccttactggtggaaatagacataggctacagatgaagacatattgttggattagacattgcatacacttatataaacacagggttgaatgggtacacaatttgtttagagttttaaaaagtggcatgggttggggatttagctcagtggtagagcgcttgcctagcaagcccaaggccctgggttcggtcctcagctccggaaaaaggaaaataaataaataaataaataaaaagtggcttgctttacctgctcaaaagtgattaatttggagactaaagagacagctcagcggatgaagtgcttgcctcccaagcatgagagcctgaggcattcacatagaaagctgggcatagtgcttgcacttacaatcccacactgggatatggagccacttaggatccaacactggagcccgctgaccagcaagtgtagcttaattgtccatcttctggccagtgagacccccgactggaaggaatgacacctgagagtgaccactaacctctacacagttatacacgagcgccggcatgcattcccgagagcacatacacagctgattccaccgtaaataagacaagttggcctgaaagtgtgtctgcttcagctgagaccatttggcattggattatttgtggaaaactaacagagttattgtctgttacaggagaagactgatatagaagggacgttatttgtataccgaaggtaagtttcttaagggtgtttctatttcacttcaatggtgatgatcattgtcgtgtagcatggtcagtttctattgtgtacctgtgtttggaaccttcctgtctttctccagttttccttcatccaagcagtgcaatcctacaatagctgcttctcctctccaagcctgggaaaagtggctcagaatttttaaattaatgcatcccaaagagatgcctgcctaacgactatcccatgttaaaaagaacacatgcatataaatgtctatgaaaacagtataatacagtggctataaagtagttgagacagcactctcgctggtctgtagtgtctgataagaatttgcattctg

SEQ ID NO: 22562 - DNA, 1244 bp, Mus musculus
cttgcaggttctgaccaagaacaaagacaaccacaacctatgactgcagtgaaggcaatgtgaagggagagggtccgcctcaagacacgcaggcttcctcatggaacagctaagcagagcatggagcttgaggagcctgagagccttgtccgtaaggatgtttcctagagacgttctcagtgatgatggaggtttcactgtgcagcatcaccagcaaacctttgtttgacaaaacaacaagagaccattgtgttgagtgacgtgggtgttttcatcagctacaagccagtgggtggaatgaggagcctgactgccggcttgctttccaggcctcgggaggagccaccagccttgcagcagagctcagtggagcccacgccctccctcctctactcctagaagaacttaatgtcagctcacagagtagcttcaggttttaaggatcagaatttaagttgactctttggaaggtatttgttcaagtgaagtatattttctatgagcaccccgcttgggccttaagacttctgggatgtctttgtgttccggtaagtgtccctggtcctgccctgtgcaaactccggtgaagcacagctcttgggataggccggctgggctctgatggaggaggcttcacacccttgaagcagaggccggggccacacagatccagatcctaccagaaggctccattttagtgaactctcagcagtttaagtgtcaagtttgtgtgtgaagcgcagccttactttccttttctgtctaaacacagttcaagttattgttgattgttttccttaacactttggcaaaaggaccagtggaccattctgacaaagccattctggttccattcctcaaatgtgctgagcagtttaaagctatgcagaaagggagctgtgctcacactgcctgccttccttccttccttagttgtagactctggagtcagaaagcaagtgtgagacctagcacctcacagtatatcctaggctgcgagctctctggccgcagtcagaactgtaaagatgctttgtgatgctgctattgatctgccatggtttctatttatgcttttatggcatgtaatggtgtttggtaatattttaatgtagaatttgattatttcagcaatagtaattttgagatattctttgaatgaaaagtgtcttcgtttctatgatacaggtcattttctagtatttaaccaattaatgcactgcttacttttctgagcactattt

SEQ ID NO: 22563 - DNA, 1177 bp, Mus musculus
ctaggaagctaggccagaatgagtccccagatagctgggccaagcctgaccataggtgcggttggatgagtctggcctgagagtcagcgctgttgccttattcctcattcaggcatattgtccagacccgctgctagctagcctagcttgcatgtttacagtgtcttctggaaccttagtgtgactgaaagagacgttggagatacttcttgctaagttggcagaatccagaagaccttatcaggccatttggtccatctgtatacacaccccaccccctcaccccagtggtcaaagggtctgggaagagcagcccagagtttgtcatgcagcgttgtctgggtgtcaccgatgagtgacactgctctttttgttgtagttaacattatgtctttgaatgggtgaacaccccagctgatcccccagtccctctcaggctgccttgttccctgttgttacctctctggggccccgcttgatctacttgactttgagtgctaaatctcaagtggccatcagtatcaggaaaggcataccctgcaggctccgtccggactgtccacagctagccctggacagtgatgttcattccaaacccgtcaaggccttagcccaggcttggcttagatacctaggaccagagtttgcatatgcaaacattggttatatctgtggcctggatcttcttgtgggaattaattataaatgccattgaatccactagtaaataatctttgtaaaccatgcagctttattgctctcttcccccaaagaatgtcgtttgaaattttctcatttcagtagtagaggccgtaactgccattgtaacactgataatgcaacatgaaactcaaggtgcctacctgctcatacagcggagtcggccatcatactgcaactcagagggaagagaaggaagggcacgggcacaggaggaccctgcgagtcaggcactgaggggtcacagcctgcgtcgtcctgtgtcctcgtggcacacctactgaggaccatgtgtctcttcctgcctgactttgttgttcttcagtaccagcattgcccgccctgttcaagaatccagaatgctccggtctgagcagagcaccttacagtgggctttgaaggccactcacgaggagagtttccatgaggaccagggcctccaggagcctgtggggtt

SEQ ID NO: 22564 - DNA, 2356 bp, Mus musculus
tcctatgtagcccaggacaccctagatttcagtatgtagctaaggctagtttgaattcccgatcctcctatgccccaagttgctgggattatagattgcaaccatcctggtgtcaaaggaaacttgttgatttttggtctttttttttttttttttttttttttttgtttggtttttccgagacagggtttctctgtatagccctggctgtcctggaactcactttgtagaccaggctggcctcgaactcagaaatccgcgcctgcctctgcctccagagtgctgggattaaaggcgtgcgccaccatgcccaggaaactgagtttaagagttttgaaataatcatttcaagtcaaaggagtttggggctgggaaacagatgacagagccacgggtacccaggcaactctcgagggttagcatactaggatcgcagcctcttctgcctcccacatgtggcctcgggagggttctgggctccctgttcttcagggctaatctggccctcctgccctcaggtgagcattgccgtgggctgtgccacacgtgaccggacagtgcccttctgcagtactttcgcggccttcttcacacgggccttcgaccagattcgcatggccgccatctctgagagcaacatcaacctctgtggctcccactgtggtgtgtccattggtgagttcagacctgttgctaagcaccagtgcgtgtgggagggcacgctggaagctggagccaatcatcagcctcttttcaatactccaggggaagacgggccctctcagatggccctcgaagacctggccatgttccggtcagtccccatgtccaccgtcttttacccaagcgatggagttgcaacagagaaggcagtggagttagcagccaacacaaaggttagtcgtgtggctgttcttttggaagctagctcttccacagaggcagaagaggaggccagcgcaaggtagagctggtcacttgctgcctagggaggcatttcctggccatgtccctcgtgtgtgtataccttaaagaaacaagactgagaaaatcaaagcataccattcgtcatgcatcatggcagacactgccagctgatgggcactctgccagcttgaccactggtgtttgccttccttgggttgaaggacagtaacccgagtctctggtccaggacaataactgacttgcctcagactggcatacagagtttcccgtgtcccacccgagagccggggccagccttaccgaggcattctggggagtagccccactgagaagccaagccagtttaccttttagaagttgcttccagtctgagattagccaggctgtgggtgcttcttctcctgtgttcagaggtaccagctacagggaaccagccccatctctttgccatagcgccaggacacaatgactgtgcccaggttataattgactgactaaatgaggcttgtatctaggaagggtggccctctagaagaccaagctgtcgtgtttctcagtttatctgttccaatcccagggcatttgcttcatccggaccagccgcccagagaatgccattatttatagcaacaatgaggatttccaggtcggccaagccaaggtcagtgcccttcgtgtatgagaacccgagggagccacccaccctgctgctgcttctactctcagaccctgctctggcccctcactgtccccatgtcacccgcaggtggtcctgaagagcaaggatgaccaagtgacagtgatcggggctggtgtaactctgcatgaggccttggctgctgcagagagtctaaagaaaggtaagaagaaagggaccagggaggtcacaggctggtcacacagaatctctagttaagtcatgatgacaataactgaagccaccctttgagccattacgccatgtccatgctatgttctaggactggtgactatcctcacctatgatccctttgtatcagatcggaggccatggagcctgccaggaaaactgaagtcacagctcagccggtcactagttaaatgacttattcaccgtctttgtgtctccgattccccacgtgtaaactggcacttagcctttatgactgtcccaaggccttaggtgtgccttggcattcatactgttattattactataagtataatgttgttagctagtgataccgtagggacagagcgtcagcctcgtcctctcagtgagatcgccagacacgtcacatctcaagcttgtgagcaccaggaagcaaaaggtggtcccttggttgggtgacctgagtggcctgtgcaatgtgggggtgaacaggactgaggctgtagcaagctgggcctgagaggtcaagaaagctcc

SEQ ID NO: 22565 - DNA, 1099 bp, Mus musculus
tgtggctcacagacatgcaggaaaaacactcggtacacgtttaaaaacaatttttttttaattacataaagctaaatgttgaggctaaatcccaggactcagaaggtgaagacaggtgaatctctgaattcaagaccaccttgagctacatagggagttctaggccagtcaaagctacaaacaaatagatgtagggctctgatggtagagtccttgccttgtgtgcatgaagccctaggttcaatccccagcactgtgtaaaatcaggcaagtggcaaagaaaaagtgacaaaaagaaagtgcacatctggacttagaataaatcatgggaaccctggtggattagtgatgtctgctccggcaagggctgtgtctttgtcatctctggctcaggactaagacctctctgactttcctctgcacaggtggcataggagaggcagtgtctgctgccgtagtgggtgaacctggagtgacggtcactcgcctggctgtcagccaagtaccacgaagtggcaagccagctgagctactgaagatgttcggtattgacaaggacgccattgtgcaagctgtgaaaggccttgtcaccaagggctagggagggcatgggatgctgggtgggtgaactacacattccagggaggttctggcagaggtggcgaaggtgtactgagtggggaggtaaatatatgttttgagaaaaaaattaatcctcagactcttttttttttcctgtgatataaacatatccagtgccagtatgagaaggagactggggagagagggagagagctggctctctaggcttggggtcaggatctaggtgtcccctggatctaggtgtcccctggaatccccttctccagttcagcctctgcaaagccacaactgctcccaccaagtcataactggggacactcattgcagcctgccttttagccaaactaggatccagccccttcctttgccagtgtaccctaaatgacaccatggagttccctcctgccttataaaaccttcctgggccctccatagctgcaccatggcccccaaggtcccacaactcctccttttatgggtggtcactgctgtttcc

SEQ ID NO: 22566 - DNA, 1100 bp, Mus musculus
aatttgcaaggattgtttgggatcttttgaataagctcacttagcgcagtaccagcatcctagtgtgcacttaataaactgcatctgctgtgtgtccttggacagactcttttttggctttgtatttttttttctttcttttgcagatgacacttgctagttcgtccacatggtccagagtccaccttcacctttatcctagagaggcacaaagaggttaggagagagaagcaggctgaattagattcaggttaggtggccccttttaagataagagttacttgggttaggtgtagtagctcaagtctttcatcccaacactcaagaggttgagttctctgtgagttccaatctgagctccagtctagatagggttacatacttagaccttgtctcaaaaaaaagttcaaatcaattggctttttttctgagcatcggtttattcttttcttccttccttctttccttcttcgtctttgtcttcttcttcttttttttttttttttaaagacaagatctctctatgcctccctggctgtcctgtaactcactgtgtagaccaggctggctttgacctcagatatgccctgcctctgcttataggcatgagacaccagtcctggctttatttatttatttatgaaaagatactgctatgtagtccaagctggccttgaattcttgatgtacttgctgcagtttacaaagtgctggggtaacaagcacatacctccatcccggcagcttcctcattttgaatgagaacagcactgcagcttcacagggtgattagggagattaggggaaataatttctgttatgtcctggcacactacaaggtacttagtaaatgttagctacttttattagcataagaagtttgtaaatggcagtgtagggataaaataagctatatataaaggatatagaaaagtgccttgcacacagtacatgcataatcaatgttggccactcttcttttaactccacttgtttagttctttgtttttctgtttcacagtataggtgagttcaatgtgttatacatagtaggtttttttaaagtttatttattttatgtatatgagtacaccatcact

SEQ ID NO: 22567 - DNA, 1195 bp, Mus musculus
ggtactcatttctagccttcaaacaaaagctagctggctacttctgaccaaaggcgattcttttgtcccagttgggtggagggtgaggtagaccttctcatgaccccaccttttcctcttggagctggaagtagctgtcaccctgccaatgccctgggtggggaggagagagagccagtagctcaattctgctttgtaatcataaatggcacaagttccatggtttatggaaaacccagtcctaaatgttggcaaatcccggctgtcagcaggcaggacacctggagtcagtttgctgggtgggtatctgacatctgagccgtttgagctcctggctgtctaccttggaagttgtgttctccaggcaagtccagtgttagagcctatgcacaggagccacggtggcactggctctgagtggtgggctgtgctttggagggtgcagttaattaggacacttttatgccttgattgaccttggagtaatattgatagttctgttgtgattatgcccctctcagaacagttcaattccaaccctcggctttcttgtttcagcttctctacacgactgttctggtgctctgctatgccatctatttaatacaattactgcgttccccagaatcagccaagcaactaactcttcctgtctccagagtaacacaactgttgcccagtatttcaagaagcagagtgagtaatgcattttgttcacagatgatggttttcctcgagatagagaaactgcagctggcttattttataataggaaagataaatttacagattgtatttattgagtgcttgccacatactaggtcaggatttccaaatcttagcactggtgatttttgcatagggcatgcttggttatagggactgttatgcaccttggggtgtttagcattcctggctcatgatgccagtaggtcttcccgcaccagcccagcacttacagcacctccagacactgccacatctcctcagaggctcacctctcccagtagagaaaaactgccgggctctgtaatccttcacgtgcgtcatccagtgcttccatctctgaaggctaacattttcactcttcctgcattagggttaaagagctaaggctgagttaaggctgtacctgtccagggtgaggatagagcgcaattagcagtccgcaggggatccagtgcccatgttccac

SEQ ID NO: 22568 - DNA, 1243 bp, Mus musculus
ggcccgggtccataacccgccgctttgctcgcgtccccctgtccgcacctcgccgaaagacacccgcgaggccgtggcgctgggcgtcgcggcgtgagcctctgatccccgacggcgccatggacggagaacggcttggagacggcgtcctcgggctccggaggcgcgtcctggccttgcttgggattctggaaagaaagacctcacctcgggcttctggacagagcggctcgggaccccgcgaagtccctgatccatccgtccctggcgaagcgcgccactgtagcccgcacgtgaccacctcgagcaagatggtattagcagagaggcagcagttctgcaggtccccaaggggcgcataccgtggccgagggagctgcgcccgcccgccggaccacgtcgggaatcctacacgttctttgagatctagcagggcactctagtgctcgtctaccgagtccgactcgaacgcctctacgtacctcatgtccaggctcagtaaatgagttgtcctgccgcaaaggggcacaggttgacctaagagcttcaggagaagctcaaaaatgctgtgaatcagcctcgaatcggaaggtgcccacaggcagttacgttcggctactcaacccttcttcagcgagcacaggtgtcaataggaagcacacccacctgctccagaaagttccctcagaagaaaatcccagcgcctgtgggatcccggagtgccaatgagaccagactctccagcctaagatggcctcagtcaggggctcctactcaaggaagactcctttcttttagagaagaggaggcgagacacacacacacacacacacacacacacacacacacacacacacacacacgaaggtcttgggatgctcccattagcatctttctcatgtttttgggcaaccttgggaaatatgcacattacaaacgccagatgatttttttctttttgtaagtgtaagcaccattgaaaagacaaagtaacaagaaaaaaaaataaagaagaatataaaaggatattcaattattgctacacaatttgagctcccacccaccccctcccaacaccccccccgccccggccaaaaacaaaaaacaaacaaacaaacaaacaaaaaaacccttcttcatagatacatgcttgcaagcacacattttcatttatttgctactatgactaacattttttgtttgcatggtcgtttttaaggtatatagttcctgcttgtgtatt

SEQ ID NO: 22569 - DNA, 1140 bp, Mus musculus
catttttttgtatgatgccatttttaagctgaatgctaaaactatgacagaaattagagaaggcactgcctgctttcttaaagatatcatgccggcacttacaccatcagtcccttaaccaatttgtcctaagaattctactgttgtgtcctccatcatgacccggttttggtcaccattgttaagtggctttacaaagaccaatgggtaattactctctccctgttagttctgaaaagtatttaagtggctttattttatgtttattcttctgttagagttgtttaactacctctgttttatttctggagtttctgctctcagtgaaaaatcagtacgtgttctttggacccactgtcaagcccatttttctggttttctaggtatgtccaggtagacacatagcacagaaatgtatctttggggatggcacaaagtatgaagttccttaatagtgtcctcggttatgagtactgagaggtagttgagtctatgacaagctaccccaaatgtcccagatcttatccttctggaaagctaagcagggcctggttggtacttggatgggagaggtggttaaggagtctggatatctctgtctagccgcatttatgcctgtcttcagttaaaccaacttaaattgaatgtaattacagtctgaagattcccactcagtagctcattcttttgaagttttttctttttctttctttttttttttttaaattaaactcaagttgacatgaagttccaggtgaattttcactttcaatggcattgttagctactatagaagaacagcacttgctctgccacagctgtgagtaaggaaagatgtgtgtacacagttgcctcttttgctgttttccttgttgattatttatttatttatttatttttgattaccctaattcctacagatttataccctaagcatttttcctcaagaattgaaaatgttttaaaactgcaaactgagtaacttctgaacaagtatacaaatataaggtaatattattacaaatttaaattgtgaatttttttttcttttctcaactcaacccccacctgtttttatggacactgggaaagtctgtagtctgaattctcttcttcattggataaccatctaacgaagtc

SEQ ID NO: 22570 - DNA, 1203 bp, Mus musculus
tacacagattctctgcttctttgacactcttgttagatcacttctaggaatttctcagtttcaactaggttataaaatcggttgctgtacaatcatttatagttgttatgttttaatttgtgtagaattgaaggtaatctctccattttaattatcatattctgagtattccctcttgcttcatctgtgactgtcagtggcactggcttgtcgttgcaagtctcagagtgctggggcaggaggtgtttcagactcattgggcaacataaagatgtctgaaaaagagacgggagcctgggtgggtggtgatggtcaggggcatgggctggaggaggagaagcctggagtagtagtctctggctttcttgggatgctgtgcccagtgtggcatcttcactttggagtctgggcacaggtaatcgaaacccattgtttttagtgctgctgtctcggatcttcatcttgtaggctatgctggagagagagaagatgatctcctgcttcttacctgaagtctcctgagctcttctgtttccttttatttctgttttagacgcggttgcatgtattctactctgaccttagacttgctctgtagctgaaggtgacttgtacttttgatcctcctgcctccatatcccagatactgggattataggcatatgtgtcaaacccagtcaatgcattgctggggaccaaacccggtgctccctgtatgcaggcaagcatttactaagtcacatcccagccactgcaccttactattctctgctgaatagtgtcacattgtgtctccacctccaggttgcatacttttaccatcaaagtgatgttgtttattcagtgaattatatcaaaatctgtgtcatatccaatcaacatactaggtgtcattctaatgttaagcatcattcatttgcacatcataagatacattgtatgctgtgcccttttggggttactagtcaggtttgggaagccccacccttctttatgttgagattgggtctaagttactttgcttgccttcagagtcactcaggcaggccttgagcttaagattctcctgcttcagcccctgagtagctgggattcattccagctttgaagtcagcaagatgtctcagcaggaaaaagctcttgccatgtaaaggtggcggagagagtcaactccatggagttgtcctctgatctccatatgtg

SEQ ID NO: 22571 - DNA, 1414 bp, Mus musculus
tgaaattctcagttctccagggtgtcagaggtgataataacgtcagaatgtcagagatactcgtttgctgagcccattcacagctctctcatcatgaaagtatttgctctcacatcaaaatagagtgaccagcttttgtgtcaactttacatctttaatcctagcccttaggggctggggcaggagggttcaaagcccacctatgttatatgagactcagtctcaaaatgtttatatacatatataaattttatttatatataaattatattgctgaagggtaaaggttttcttccaggtctatttttgtctatgagatctatcttactaaagagatgctgaatactgtggttttacaaatcatttaggataacccctttcttatggttgtgctaccaactatgtaaaaagttatgcttatgccattttttccacttcgcatgacaatacctctctctctctccaggtaggaagagtggtgtttctcctaagaaatcaaagtacatgactccaatgcagcagaaactgaatgaagtgtatgaagctgtaaagaactatactgataagaggggtcgccgccttagtgctatatttctaagactcccctctagatcagagctgcctgactactacctgaccattaaaaagcccatggacatggaaaaaattcgaagtcacatgatggcaaacaagtaccaagacatagattctatggtagaggactttgtcatgatgtttaataatgcctgtacctacaatgaaccagagtctttgatctacaaagatgcccttgtactgcataaagtcctccttgagactcggagagacctggagggagatgaggattctcatgtccctaatgtgacgttgctgattcaagagctcatccataacctttttgtgtcagtcatgagtcatcaggatgacgaagggaggtgttacagcgactccttagcagaaattcctgctgtggatcccaactctcccaataaacctccccttacatttgacattatcaggaaaaatgttgaaagtaatcggtatcggcgacttgatttatttcaggagcatatgtttgaagtattggaacgggcaagaaggatgaaccggtatgttttcaaacccatctctttatgataaatacatgtgatttttaatgcaaaacagatgagagagttatgctttgataaactttctgcttaggtacatggttatagtaggtagccttcctcttttttttcttcaaaatatttatttattattatacataagtacactgttgctgtcttcagacacaccagaagagggcgtcagatctcattacagatggttgtgaaccaccatgttgttgctgggatttgatctcaggacctttaaaagagcagtcagtgctcttaccttctgagctatctca

SEQ ID NO: 22572 - DNA, 1221 bp, Mus musculus
ttttgttctgtagaatggttgcttaaattaatgtcagtttgttttcattcagaaaggccatattgaggctagctatattggtgaacacatataatcccagctacatgggaagctgaggcaggactagaacacttgagcctgtgaattcaagaacaggacagtttagtgagatcctcccccacctcaaaattccagctacagcttgaggtacagactgttgagaatatgctgatggtgctatttttcctgattcctctctttgaatgccactgtggtgctttatccccacagtcccagcagctagtgcaagaggaccccaaatttgaggctagcttgggctatgtagagagaccctgtctcaaaaaggggagagggggaaggagggaagagactggattaaatgtattaatttgatgtgttgtttgaatgtttttctgacaaccacaatcttttactgagtgtcttttatttacttatttttaacccaagaagctgaaaaaagtgaagattcctcaggtactacaggcctctcaggcttacatcgtacatacagccaggactgcagctttaagaacagcatgtatcatgtcggagattatgtctatgttgaacctgcggaggccaatctacaaccacatatagtgtgtattgagagactgtgggaggattcagctggtaagtttgatttaaattgaaggtcaggtgctagaaagatggctcagtggctaagagcagttgctgctcttgccagggtcctggcttcagttctcaatccctacatcatggctcacaaccatccttaactctagttccaggtgatctgaagccttcatatggcacacacatgatacacagtcatacatgcaggcaaaactctcatacatgcgtgttggatttttgtttgtttttaaagagttacttattttgtattagtacactgttgcatagaatcccattttaaatggttgtgagccaccatgtgggttttgagaattaaactgaggacctctgaaagagcagccagtgcttttaactgttgagccatctctctagccccacatgtacatttgtttttaatcctaaaaaatggggggtgggggggggatttctttttccatgatcatcaggaagaaaaaaattttaactcatatttaagccttttaacaatagctacatcaataaatttactgttcagtgtatcagtaaatataattaaccacc

SEQ ID NO: 22573 - DNA, 2994 bp, Mus musculus
taatttttattgcattttattgtacatcacacagccatttttatataaggacacttttaataagctatttcaaatttggttttgttacattaagttgactatcaaatacacaaaagattttttttgcatatgtttcctttgtttaaaaccagtttcataattggttatatatagtaatagttttatctttacttgttaaaggacttaaatcatcaaaggttttggcttggcttagggttttcgttttcttttttataaatatatattatatatatatacacatataaaagaaaaaatgaaaaaaaagtttacaaatttaagttgacaatgaaatgtgaagttggtcctagtttacatcttagaggaatgtatatgtatgttttacatgcctaaatatctgcaggttttcttacaggtaaagcgaagtgctttgaaaagtttagattatacatgtgtgacagatgcggcatatttgctctattaacacagaggcttactatagaaatctaaagtcaatgctgtacatccatccagttagtgtaactgaagggaaatgtaactttgtgctgagttagacatctgtattgtcagtgattcttgtagaatatgtgctcagatctgagttatatttagttttggaaggtaagttgaagagtacttttgatcagtttatgattcagtttatgattttagtttttgccttcatgttatacatttatgatttgaaactgtacatctgttaccttgaaaaacattgaagaaagtactgaagtgtgcatggaggtggtttaagcataatacttaacccaagaaagagtgtaagtggacacaagctgtgcctgcacatagctgtgcagggtagactgcctacatacacatggccgggattctttatttccttgttatcaattatagtgctttgtttgtttcagggttggaattctcaaccagaaataatactttctaaaatattttaaaattcagcttgtgctttggattatagaaggaaattatactttaagaaaatgttcacaaaaaaaaaaaaaaaaaaaggactattacagatcccaatacttggatttggtgaccttgtctttctttcttttcttgagacatggtcctactaccaaccctggctggactggagctcagtgtatagaccaggctagtctcaaactctgcctcttcctcccaagtgctgggattaagggcaggtaccatagtgctcagcaaccacaaccctgtctttccaacacggccctagcgtaagcactgaggcagtgtgcagtgctcaggcagcagcaaacatttcccgggggtggttttgaacctgcttgggtggttgtgtggtgctgacgctgccactgccctgttgttcattgagaatgattgttaaatgacactcttcctttagaatataacggatcagtactcatgtttaattgccatgcttaataaatcatgagaacaaaagagtatagaatggaaagcattccctggtagctactttaaatacaggagccctgtaacttaataccagtagtcaaccactggatctcagttttcatcaagtattttaaataaataatcttaaattttaaaatacgtactgcagagtatgccagtatcttattgttaaaactgaatcaaataaatcttcgattcctggttatttggaccattgactcatcatggactatataatgtaataagattcttttctcttaaggtatccttgaattacaccaaagaaccagaaacttaattttggttaaattatttatttatttcatgcattaattttctttttctttttaaaggtttagatgaggctccttagggagtctctaaaaccgcttcactatcagcaaccaggagtactagaagccagagcactcttcctcctggctcctccccagtgctctagtgctgtaggaaccaagagccagccccaggttccccgaggcagtaaaaatccagcacagggggctgtgtccctaaggcaagccctgattacctttaaaaaaaaccaaaaaaacaaacaaaaaaaaaaaacctaattaactaaagcatttaaggcactatttattttagaatcatgcttttgaagagcatcagtgattacttagggtgtaatatgtaaagatcagacatctccaaaaacagaaaaagtacaagtaaacaacacactttctcatgacttttaagaactgtagtaatgtggcttaggaaatataatggcctaattgttttcaaaatgtaagttcctgtgaagaattttgtttatattgggttggggacctataggtttaaaatagaatgtcagtcagctgacttaaaaaacattggttttactaagtctgccttccccttctaaggaagaactgagtgggtaagggacaggtgtgtaaaatctccaaatggatgttacagctttcagcttgaacgtttgtttccagacctgattaaaatttggtttattctaatttctgtactatatcatctgaggttttaagtggtaactggttctataccatgtatgtatcatatgtttgttcatcaaagctttttaatccaaataaaaacaacagtttgcaaagtgatttggatcagccaggtttggtggttctgtttaaagtgtgtcaaatgtttggagcagactgaagacaattcctacaagccctgatttcatcacgctgaggctgctagtttatgtaagaatacacttctggtcaaggtgagctccaacatggagaccccatgcagcctgacatccccaggactctcaggatgagcagcatgagcaggaacaaaacaagggtttcaaaaaggaaggacacattactgcgggtaggaagggagtgtctagaagcagaaactgtgaccataagacaagtggtccaggtaaacctttagttttacaagttcttaaaatgtgtcataatttcagtagaaaatgatggtaaaatcagcaagctgttttcttctaacacc

SEQ ID NO: 22574 - DNA, 1115 bp, Mus musculus
ggcacggctggcgcacgggagccatcatccctgagctggagcgcgagatccgcatcatcaacacggagcagtacatgcactcgctgacctggcagcaggctctcactgggctgctggagcgcatgcaggtggacagagggggaagctgctggatcggagccgcagctgtggctgcagggggccggggggggggggggtcggcggggactgcacctcctcggtctgtgctcaccaccaccccctgcccccaccgtgtctccccagacctatcaggatgcagagtcacggcaggtgctggctacctggatgaaggagcggcaagaactgaggtgagcagaaagcagccatagcagagagcctgtcccagccttttctctgtctgcacgctggctgcctgactgtgcctgactggcgtgcatcgcgtttctctccccagatgcatcacaaaggccctattcaacgcccagttcgggagcatcttccgcaccttccacaaccctacctacttctcccggcgcctcgtgcgcttctccgacctctacatggcctcactcagctgcctgctcaactaccgcgtagacttcaccttctacccgcgccgcacacccctgcagcacgaggcacccctctggatggaccagctgtgcactggctgcatgaagacaccctttcttggtgacatggcccacatccgctgagggcacttttattgtcctggacagaccattggccccctcagccaccctgacaagcaataaaaatggtctgtgtcttctcagagcctctgcttcattccagctcatcatttgaccttgaggaccctctgggtgtcggggaagtcctcctccaggactgaatcctgcagagagggaggcaggatgcagctaagcaaggctaggcccagggccagtcctcacagacccagccagcacacttcccaccccacactcacatcaaagggttcacaaaagatgtcactgctgccaaaaacagggttggggacagaaaccagggttgggctggtcccttcttgccatggggagaagtcatcgtctgcattatcttctgcctataagaggagtattgactggtaagccccccccacccccaaacaa

SEQ ID NO: 22575 - DNA, 1320 bp, Mus musculus
accgcagagggacagataccggctagacgatggccgccgggtccgggatttggaccgggtgctcatgggctactatccctacccacaggccctcactcttgtttttgatgacacacagggtcacgacctcatggggagtgtcaccctggaccactttggggagatgccaggtggtcctggcagggttggccagggccgagaggtacagtggcaggtgtttgtccccagtgccgagagccgagaaaagctcatctcactgctcgcacgacagtgggaagctctttgtggcagggagctgcctgtggagctcactggctagtgcacgccatagcagccctggcctcctgccatgcccagcctagcctggtgcccgtgaaggcagggaagcggccttctgcgttctttttaaggtctttctcctctcccttggttcctacattgattgcccgtggcccccacacatgtgaccagctcccacagagactgtgaacatgtgtgatcagttaatcctaacgctgggaagacatatgccagccccaccagagcgtccttgtgctgttagcgtcccttgtgtcgcctgcctctgaagtggcatggtcagacgcgccagcattgttttgtctgtgattgatgctgttgttagcgtggcgctgtggacctgataacccccacgtccttttctgaagtgttaagtccagtccttcgttgctgtttgctgtcattgtgggcgtgccgctgctaattacaaagctggtagcagagtacacaggcaagctcccacgttgtgggcttttccaaaatggaggcctcctcaagtccagagcagaggaggccctatggggagttcccaggtcatgggtccaagaggagccagtacaggggacctagagctgccagcaccaagtataattcctgttgcctacgttctctattctaataaaatggagtttgacacaacatgagtcttcaaggttatagagaactggggtcccaaaagggcttcaaccaaaggaatggtcagcagggggagattggagacaagaagagagagaaggaggggaaggtgggagggtccccagagcagagcaatgctgagctgtggtcaaacctggggtctaggtaaacaatagaaaccatcttcagctggaagtggtggcgtacaccttagttccagcactcaggaggcagactcaggtggatctctgggttcaaggccagcctgagttccttccaggacagccaaggctatatctgtctcaaaacaaaaccaaagaacaacttcattttatcccttccttgtctgttccacaccggtgtcag

SEQ ID NO: 22576 - DNA, 1096 bp, Mus musculus
aacgtcggccttttcgaccagtacttccggctgacgggtgagtgacgtgatgtgttttgtcccagtttgggtgaaggccagtgtcaccagtggccttccacctcgcacatgtaggtacactatcacgtgacacatatatctccacttacaagccagccactcgggtaggaggaagcggcttcgggaagtgctgagatgacaggactcccgccccacggtttgtagcaggagctgggtatacagggaccagcagagtgggccctgaacttaggggcaggatgtttctgactcatacttcctgaaaggagaaagctaagccctttccctaatgcctctatccccttccagaaaaatgtttcagcccttcctgcctgagatagggtcatctccccaggccccatgatgccctcccacatagaccctgtgggtcctggttttctgtgggggccttgcagggacgggaatggtggcctgtgcctgtgaccagccccttcttgtgcaggctcctccccgacgcaggtggtcacgtgcttgactcgcgacagctacctgacgcactgcttcctccagcatctgatgcttgtgctgtcctccctggagcgcacaccctcgcctgagcctgttgacaaggacttctactcagaatttggggacaagaatacaggtaccctgtccacccccagaaccctcactgcctctgtccccacctttcccttgtctctgcctaactgaccaggctttatggatcattttccatggcagaggttccatcccagcaatccccaggcagccagcagacctctctcagtcctgggctctagcttgaagcaccctcgactactctcattatgtggggctgctgtttcttttgactgcaccacaggccagctcaggccacaccctggtgtttctcttcctgcagggaaaatggagaactatgagctgatccattccagccgcgtcaagttcacctaccccagtgaggaagaggttggggacctgacctatattgtcgcacagaagatggctgatcctgcaaagaatccagccctcagcatcttactgtacatccaggccttccaggtggtcacaccac

SEQ ID NO: 22577 - DNA, 1132 bp, Mus musculus
tcactgttcccactaacctctccgtgctccaggccgaggaagggaagctaggaccgtggggcttgatctagttaaggaatgaggtcactcacctaggactagctgcagtcagtagaggctctttgtccttccccttagtgtcaggagcaaggtgatgatccaaactgaccatcctcatttgtcactgggtgtgatgcacggaatgtgactaacatatctatcttctgttccgtgttaggcctttacacttaattgctttacttggcccaccaggttttaaaatggaggaattgaggcccagagagagcttaggttcccagtcacttacataagtggcacataagccacacccaggaaatgggatagccagattttgaacccaggttttggtggacgattaaccaccagagctatatcgccttctgttgaggctgattgagccaccgctgcccctggaagcctggtgatgccttgcctcctggttcagctgccaaagtcaaaaccacagctagtggaagaggttgactgaaggccttgcttctaggatggagttagggctcctggaaagatgtatagcagagacactggtgctgcctcactgggctctgctctgcctcccttggaaggggcagccttgcctatagcacaagttgggttttgagttatacagagacaggaggtaaaaaaaaaaaatctaaggaggtgtgtggagctagtcacccataccattccttcctgataatgggagccagagctcttctccagaccttacagggctgtcaaggaggctgaggaaagctgggtgcacagtgggtgtgcaaggatgcctgactctggctttttggggagtggggactgagtaccttgcagctattgtgagttggggttctcttgtcacaaaaaatcatttttccctttaggtttatgtcatccaggttaccgatggcaaccatgagtggacgatcaaacaccgttacagtgattttcatgacctacatgaaaaggtaatctgaagaccttggcacctgtatctcaaggggtggggcttgtgggccaagtctccattgtgccacatgttaattttagggcaaaactgcctccacatctattgcttgtaagttttaaaaacatt

SEQ ID NO: 22578 - DNA, 1865 bp, Mus musculus
ttgatgaccagcgaaggacccacaactatgacgagtttatctgtaccttcatatccatgctggctcaggaaggtgaggaggtgcctactatgtcttaattgtcctaccctcttgagggtcatgtacctcaaactcctccccctccctcccccaagacttcacctttggccgatgagactcaagctcagggagggctgtgagagcctgggagacagccacctactaaggagtttcctgctttacacaggaatgctggccaacctagtggaacagaacatctcagtgcgccggcgccaaggggtcagcattgggcggcttcacaagcagcggaagcctgaccggcggaaacgctctcgcccctacaaggccaaacgccagtgagaacctctggccctgactctgcagcctctcttgccgcaaggccctcatcagggcccttcactgtccctcttttccaagtattactgagtagttcaacgagagcccaggtcctgggagtgggagtgacatgtattctgcactgtgctctggggtctggcagggacaaggcagctcctcaatgctcaggaagcagcagctggaactggagggcatccaccatggcctccacagccatctgaggagcagcaggacctggcctttctgcctgggcagcaggatgtacattctacctattggagatgtttaggttttgggcttttgtccatcttgccactgtattaacatggcagcttcctgactctgctgtctctcccagcagctgtcattctgctgggccaggtctcttagaatacatcacagtcccagctgagaaacacaccaccactagcctgtcctcgttgggaagaagcttggcctacacttcattcctctgggagagcaccaaactcagggacctggctgctgagctggaatgggcatggggtatcctaataggatgtacagcctatcagggtcccacggctatagtggagacaagtgtttgaactgtcccagtggcatgcagactgtcctgttagtgagtcagagcaaggctctggggctctttgccttcagtgttgtggccctggccatgggtctgccttaggctcctaatctctgtctctggggcccaggggagcctcgacctagcccctcagtattaccatgtcttctcttaggaatatcagaggcagggctgcttgaatggagctggtactattcaattctcccgactgtgccagcttccttgtcctcttgcaaggtactcagggtagggacagggttgagaggagttagaacttctgtatccccatagggcttggtagtaagtacagcactgcttcaaaatccagcccccaaaagccctgtaccctctgctagatacaggcgatccaagcaggccccttatctgtacatagtgactgtaggggacccctctagtttctgtaaatattgaatcagtgagtgaataaaaatgtgctaataaatgatcttctggttgctatctcgaggtcggtaggctgggctgtggtggaatgagagactgactagattctggcctaaagctttgttgatagtaaggtagtatgtattcctgaagtagaaataactggttgctatggtaggcctgggatgggatttaggacctaaaatgaggggaagatttcagatgggctgtggtcaggtatattgaattgaggtatggggctctggctcaaagctaggctgcccatgtatctacctggtacctttttggagagtttctaggatctgagagggtgtatgtctcatcccttatggcatttgggcaggtaccgcaggccagagctgtctctgcttctctctaccttactattctctgctgagaatgctctagccccttt

SEQ ID NO: 22579 - DNA, 1194 bp, Mus musculus
gaagatgtggctgagaatattctgctccaggttcccgggcctattgaattgcaagaggtgacaaaaaagttccctgtgctgtacgaggagtcaatgaacacagtgctggtacaagaggtcattaggtaatttcttgccacgcctaggcaaactgagtcaggggccactgctatagagaaacagcgggtgttactattagccagctgttgtgctaagtgctaaacatctgtcctctaattcatctgtttattatcattttatagatgaataaactgaggcccccaagaacattggctgtcttaagtcacagatttgttaagggccagggctggtactgtacccagttctgcacttaagcttctgcgttctatcactgtctgtggtctcaaatggagagccaaccccagcccactaacaccctgccactgaccccacaggtacaacaagctcctagaggtgatcacacagacccttagtgacatgctcaaggcaattaaggggctagtggtaatgtccttggagctcgagctgatgtccatcagcctgtacaacaacactgtgcctgagctctggaaaagcaaggcctacccatccctcaagccactggcttcatggatcatggacctgctgctgcgcctggacttcatgcattcctggatcaacgatggcatcccgcctgtcttctggatcagtggcttcttcttccctcaggctttcctgacaggcactctacagaactttgcccgaaagttcgtcatctctatcgacaccatcacctttgatttcaaggtctgaagtggggaggggctttaaggttggagtcatcctgagtaggaggtgaaaagatccaggccaatagtcagagggacagggcagactataggtcacagattatagcagataggtgatgggcaggcgacagctttagggagagagatccacctcctgatacaaatcccaatcttgtttccaatgtgggtctgtgtgcccaccacaggtgttgcccgaggcgtcatcagaaattaaggaaaggccccagacagggtgctatatccatggactgttcctggaaggtgctcgctgggactccatgaatttccagctggctgagtcacggcccaaagagctgtataccgagatggctgttatctggctcttgccagaagctaaccgaaaggtccagaaccaggactt

SEQ ID NO: 22580 - DNA, 1459 bp, Mus musculus
tggatttgaggttgtagcagtttccataatgggagatcctggtcctcatggctttcagaggaaatctagtggtgactataggtaacattgacattttgtgttcagtttacactttgtggggcatgatagtctacaaaccttattctcattttccctgaatataggtgtggattttgctacttagaactggaaaacatacctgctgggatctttaatatcatccctagtacttttttgcctaaacaagaaggaccttttttcttggactttaatagtactgtccccatcaagacaacacaactccaatgattgagaactctcagctattactggattccatatttcccagtctcagctcttcagacaaggagacaaatcacgatggtgaaccatcagaatggaattaaatcaaaagcatgttacggagtctggtgctcgttgtggtgtttggtaaggattttagatagtggaattaccttaatcacctgaaatactgtttacatggtttgtgcacacagagctggcgtgtactcggtggcggctctgtgtaaatcacaggctagattcagccatcactgggagatgctttcgttaataggacacgaggaggacaatgaggaccacaggtccactgagtgcaagagcagcctagtttaggatcttgaaatacctatgtttcctgtttttacagagcacgtacgtttagcccatttatgttgaccccaccatacatcttaaacaactaattaccaaatgaattaggtcactgcaactaatttgaatttttcattgtgtctttaatgtttattgtcgtgtagctgttaagctttaaaaaccgctgtttagcttagcatggagatgctcaggcttaagaatgaaggttgtcagtgttaggtgcattgtccattgtagagaggaccgaagtatatttactgttgctgttcttagttcttagcaggttggtgaatgtagcaatcagatggaaatgctgaggtttaaccgtagggttttaattgctctgtagtcagtgctttcatcatggggacttggggagtccttgagaatttagtatatggtgactgagttatacagcattcataaaaagtgagtggtcaggaattagtgtttacataaaatcatcactgcagaatgatgctcaagattttcaagttctggaaaataggatgggatctgtcattgtctctactttataattatcaaatctatttctactgcctttgattgaaataaaatatttatacttatggaaactatgtagtttaatgtccagaatttgattttacgtccctgtaaaagaagacagacatgcatagaaatacttgctgcaagaataaaaccaataagatttcacttggctaaaattagccacatgagcttactaaatatgagttaatttctgtcatcaaaaacataatagaaagctgtgaggccactcaat

SEQ ID NO: 22581 - DNA, 2343 bp, Mus musculus
cacagctaggaaaatggacgcacacagcagggaactgccagtcactgtccctgggcaagcttgctcacgaattcctctttttgaattacacttgctggcttcagattctctggcctggaactttctattggattctgaaaaaacaaaagcattgctggcattcagcttgggttcagactcgggcagttccagctgtgtgtgcgcgttcagctcatctgaggtgtttgcttttgtgcagatccatccctaggttcttcattcccaggatgttagcagagggtagaaatcagagggatgtggtgaagaacttctgagcacattagccagcagcaaggctccacaggtgagaatccagacaggagttgggcagtatggaacagtctttagaagctgtttgctttgtgctgctgttggtgcctgactcccagtctcgtgggttatttttatagaagagaatcacaagattgccttttgctgtgtgccatttccaaataaatgttcttgctggaaactggtcactagtcagggttgcacattgaggaagtatgtggtgacttatgtgtctgcccatctctgtggtctgaatgaatatatcctaggaaatccctgtctttctgctttaagacattaacaatgctgttctttcctcctgcatagtggaggaaggtggtctggacctggtggggccgtaggtcatatagattagctttatggtcgacacaccatacagatcagctgatccactcagagactgaagtgaactgagatgggtggggccattgcccagcagcacacctacacgtctcagcacaagctcagatgcagagtgtgcacccataccctctgctcagtctcagcccactgggagatgctctatggatccatggcaggtggaacctatttaaagcaaactgataattgctttataattctttggtaatgctgggtgtggtgccgcacgcctttaatcccagcactcgggaggcagaggcaggtggatttctgagttccaggacagccagggccatacagagaaaccctgcctcgaaaaaccaaaaaacaaacaaaccaaccaaccctctttggtaatgacagctcagggaaggtgagggttgtgactgggtgacttgagttgtcaccagatgtgggcattgaactgtttttactgctcttcgctgttcagactgtggcaggctccaggaacttgaactaaaaatgcctatttaagtctccccttgccccgcttttctccaaaagccttggtttgtgtagacagagctgtggtgttggcattccagttggggactgttgccataggaagtacttgcatgtggcactgggcttgataaattgagctttctgtgcctcagacgatctagtcacccggcttacccagcaccacaggtccttctgtagatggctccaggttttgctctctgcacaaatcctccggtgattctttctgcttcccccactagagtaagaaagctatttttggaaatccagaatgtagcctcccagatggcttctcaggggtatccttgtgccaaccaaaggactccttcctgtcgctgtgcctttgctgtcccctcctcttcacccactctaaacctctctccagagcgcctatttcacaagctcttcatttctttcaacctatgggtaagccctggtatatatacaaactaccattctacctggtcttggttagtattagtgcctcaaaagcaggggctgtcatcacggaactagacatgcaggtgctcctactctggttgggaaagagatggagacaactactagtgaagggtggagggtaaactgaaacattccaggcattgagacaaagctggaaatctgtacgcagtgcccatgcaggtctctaccgaatctgtcaatgacctttttttaatttgctctatgcaatgttcacttgggcaaggtggaaggactaattctacagagatgccatggcaatctttgaaaaccattgggaaaatgcaatacagataaactagagattcgtataatgccacgtgttagcttgtttctgtagcagaataactctctgcggtgacgtgctggagtgagagggaaacttgaaaattccaaagtccttccctcttttgagagactggttgtgtgtgtgatatttattaattattttaagagagaattgttttgtagatagatatgtattaagaacagccaaactggatctttccacttggcaaggaacagaaactttttgaaactcaggccttaaccagtagcttggaagaccaactcaagtgttaggaactgtgtgtttttgtttcctgttatttctgtcttagattcttt

SEQ ID NO: 22582 - DNA, 3246 bp, Mus musculus
taaaattacagctaaattttaatgcaataaaagtttggtataataggcattatgtacacatcaaattgccaaggaccaaataacatacagatttttttattagaactccattttgtggaaacggaaatagatgaaatgagaagtcgtctaaagcaaacttcagtgcttctgaaagtgaggccagattcggtttggtgttggtttttataagaaagcatctactgtattaagccatgagaggaagcagatgtatttttacattttttaatataaaagtttttaaattccactttttatagacttcagaaccagttaactgggtgcagcgtggttgaaagtactagagacagacgcagatgaagtcagggctgttgcccacgattgagtggtttgcttttaaattgaattgtttttgtttaaggaattccatagaggaaatttttaatgaatttaaaaaacagactatttcacctcttgtaatgcagcggtcctggagaagggacatctgagcctctctgtgcgcggcacacctgcatcacgttagttactttgggacctctaccttttttggctggaggaattctattgtcatttattttaatctttgaactttaaaaacaagaatcaaaattttaaaaagtttgaagactcttgttatgaaacattgtcgaaagctggttgtgaattctatacaaactgggattgtaaatgttttatgtaaaagaaaatacttaaaaatgtacctgcttcctctcctgcgtcctcacagcactggaaggttcttgaatgcatcctttcctttgttgttgttgttgttgttgtagtcgtttgttgttttaagacagggctctctatgtgtagccctggctgtactagagtttgctttgtagaccaggctggcctcgatctcacagagattcacctgtctcagcttcctaagtgctgggattaaaggtgtgcaccaccactgcctggcttcagatgttttctttataaaaatcaacatcaaaccatttggcttccttctcagaagcattggagtttgctttagatgatgactcataacataaacagaatcaggtcatttggaaggcatttctgtactgggcaagatttaaaatacttcaggctttaggtcctcctgagatctagagtagcgggtgtgcagcttcttactgtcagagcttgcctgccaaattgaagactgcctttcaggtaacagagaagaggctgacagtaggctaattttaaattacacttttctgtggttcttttattgtaactgtcactttcccagtaacaatgattttacattggggggaggggtcttactagagctgggtaaagttccatacattgcaacaaaatgatacccaattccatcttaccctttttgtattgtgaaactggaactttatgacattgtaaattatcagctggtttttctgaatataaagtgtgaaaacacagaacagtattttgatctatttgataattttgtgggttttttgaagaattaatgagcatgtacatagaaatagtgactgcttgaatcctgtatttacttgcactctttcagtacatcaagattcctgtatattttagagtataataaaacacagacgtgagctgtatttaatgaataatgtatttgtatctgtgcatattacttaaaaatctataaagtttctagggcattgactactagattttaagcatttttctaaaatatttgcaaaattataaatataatctccatcttttctttataatataaaggagtcgtaatgaacccttcgtaattaatagtgggagaagggtaaatatgcattttaaaagaccgtagactacatttctattgtaccttttaaaaaagaaaactcaagaggattctaaaagtataccatatgtgtgctttctctttccttttaggaattctcttctgaattccctgagggaattttctagaatctcagaattgaaagagacctgaggtccatccagtctaacctcttaaatgcaggagtcccttctccaaggttgtctttccaccttgaacacttccagtgactacctcacgagcagtccattcattgttgagcagctctgttaggaaggtctccttaatggagctgaagcctccctcctggtaacttctgtccttgggcccagctctgtcctccaagggaatgctggaaggatgactttccaccctctgccatgtcttctctttcacaggctgaagtgatttccagatggactcattagacacattgtctgcacatctattgaagtcaaatgtgtagctataaagtaacaaactcatcttttaatttatcctcatatgtatgtagagaccaagatcctgcatcactttaagtaaaacactcgggaggtggtttgtgctgttaccagccgactagaaaagctgttcctttgtggtagtttgtctctagcttgagcaacccacttcctttggtgtgcactggaagagggaaattttgaagtactatcccagaaagtgttgactaacaccagtatttggaataaatacaggagcacagcatagcgccatacgttactttatagttacatacacctatagtgtgcacaaagcattggtcctggtgggtcggttgtgtatttatcctcgcccacaaggggaaagtctgtcggcctttaatttctgtgagaaaggtgacatctaagatatgtgttacagaaataccagcttttgctcagaaacaactttgggggagataacgatgacaggtgacctcaaacagtgccatttagttcagagatctctaaatgtagctgtaaatttggggttaatttggcttcaaatattggatcttttaaatgaaataaaaatttttaatgtaaaaaatcaagtgtctttcttttttacatataaagaacttttttctttaaaatgtgttaagttacagcaggtttttagacaagttttttgcaggttgttagtgtgtttcctacagcctagaatgaattcctgagtgttcctactccacgtctaggtgctgcatcacctacaggtatgtgcctccatccccagctctgatttttgtcctttaagaactcagtggcttcttagtagttattttagacttttgtacttaccaaaatgaatctttcacatgtattaactcaacaagtatatgtttcttacctgctatgtacttgagtatcagtgggcagaatggtggtggtgtcctttaacggctg

SEQ ID NO: 22583 - DNA, 1174 bp, Mus musculus
agcctttgaaaacaaaccatgtataaacaaattggcaaagtggctggatgtattatcagaaaatatatacaagatttgcttgtgtgtgtttttaagatttaaggtaatttgttgcgaccatgaaatatgaaagccccatattttggatttcttccaagaatccagtaagaaccagtttttatataaagacggtctctaaaaatatttttcttaaaaatgtatgtatgtatgtttgtacgtgtgtgtgtgtgtgtgtgtaaatatggcatgtatattcatagttggaaattggaggcaggtggattgaggatttgaggccagtctgggctatatagaaaaatcttcgtctcaaaaaggaaaaaaaaaaggaataaaaatatatagcctatacaaattagttttcttgatagaaggagaaaaactaaatctgaatcagtaaaaaaaagaacaaaaaaattttgtatcatttaataactcagtggttttttaaaagtatatagctccttcctattcttgccttggatttctgttttctgtcacaggcctatagaactcaaataatacaactactgcttccataggagtatggaaaacaatatgggaattcctgtgagggtaggttacgttcagtagtcgtgtgtagtaatcttgtcaacatttgtaattggcaatttttttgctacctagatcttcttaatacttattcttacacataattacatgtgacttaataattaatgtcagccccatttagagacagttcatgtatagtagtgagcccagtattggttgaagacttcagtatatagcaacttaataattatggtagattttcagtgggaaggggtctataaatcctacttaatgttgtcagagaagcttagagaagaaaatattaagtagtggagataatgagcaataccgcagaatttgttttattttgtcctgtaaaaccaataaatacttgcatcccattgcccagctgtccattacttttctcattctcttacatattaaatatagcacatcattatcagccatagtaaacacaaggagacttcagttatgtgagtgtctcctgtggttttagtgaaagtatcttagaatatctctcagactctagaggagaagcagcagactggggacactaacaaggcagtttgataactgcgct

SEQ ID NO: 22584 - DNA, 1163 bp, Mus musculus
cctttccaacattttaggttgcagggaactttgtagtttcttttttgaggtctaacactgtattcacattattaaaacataatttaagttaatcacttgctaatgatatataaaactttcttttgcattaagttttaaatctccattaaaagcataatggacacatcagttgtgtttgtgttatctgtaaagctcagaatgtaacgattaaggggtacaataaataatcttatctctagccctaaactacacatatattaaaaatacacatatcccagtgtgatttggccatgtgtttagtacttttctgttagactatctttcccagaggttgcttagtatttaccatgttatgcaccctgcagtgcagttttgtgatgatcacttttccctttagtttttccaggcttagaaaacttccagctcttaattattccgagttaccatacggaatgaaggtcaactcttgtacagagtgttctgttctaggatacaactctaatgattaacttgaaggacgttgaggttgtttatgtgagcgtgctgcagctgccttggacacacactagaagagggcatcagatcccattatagacggttgtgggaattgaactcaagaacctctggcagagcagtcagtgctcttaactgctgagccatctctccatcccatgttgaggttgtttaatgtcatccatgttggaggaaaatcttaggttatgctaccagtagcccttcgttttacatggttttggcctaattctggcaggaaagaaaaagctatcactttatactccagtagcgtgtgtgtgcgtgcgcccttgtcagaggctgtcattctcaagcattctttaccttatctagtggaagcagtctcgcacttgaacctagccagcttgctccaagtatcctatctctgcctgctgaacactgggattataggtgggctgtcacacttgttggacatgtatgtaggtgtcagggatccaagcccagtcttcacacttgcacagcaagtgatttacctggaagtcatatccttacccacccacatgttattaaatggagatactatgttttatgttggaattatgactttggttctgttttcaccctttatttggaaaacagggcaacatttaagttttagattttttaaatga

SEQ ID NO: 22585 - DNA, 1135 bp, Mus musculus
ttacacctataaaacttgcaaatacaaagccaacagtaggagatgggcaggccagaagcaactgtaagtgcagtggatctcgccagtctgtgaaagactgtacaggctgtcaacaggaggaggtggatgtgctaccagagagtcctttgtcagatgttggtgccgaggacattggaactggaccaaaaaatgacaacaaattgactggacaagaaagcagcctaggtgattcgcctccatttgagaaagaaagtgagcctgagtcaccaatggatgtagacaactcgaaaaacagttgtcaagattcagaagcagatgaagaaacaagtccagtctttgatgagcaagatgatcgttcctcccaaacagcaaataaactttcaagttgccaagcaagagaagctgatggcgatcttaggaaacggtatttgactaagggaagtgaagttagattgcatttccaatttgaaggagaaaataatgctgggaccagtgacttaaatgccaagccatctggaaactcttctagccttaatgtagagtgtagaagttccaagcagcatggaaaaagggattctaaaattacagatcatttcatgagaatttccaagtcagaggacagaaggtaattccctcaccctccctgtgggagcatcccttatagcatgatgcagttttacattttgtagagggaattaagaaagtgatcatttatagtaaattatttgcatttttagtaacaatatatgctaaactaaatttaagtctagatttcaaagtataaattctaaaaagcaggagcagaaaacaagaaggaatgtttaattggtagtcagggttagttttcatcggctttgttatggagtttgtgggcattattaaaagatgaaactattttgttgactgtagtgatatttagcatccatctagggcttttatctctaatgctctgacagcaagcatgtaatactatattttacaaatgagaaaactgagatttggggtgagtgatttcactgagaccctataactggagatgatattactcggatttttttcatgtatatttgaatatgtatttttgctgttgttccataaggaattttctaaggtattttttgtaacttaggatact

SEQ ID NO: 22586 - DNA, 1142 bp, Mus musculus
ttatgtagaagttatcttgtttttaaaccttgtaactgtctggactgcccttctctctatgtggcttttattcctccttcaagattcagttcagagatcaaagatcaagtttttagttacctctgcctgtctggatagtattcttgagtaccctgtacctgcctctgcttgtgaggtggtgtgttttaatgaccctaatctaacaaacaacaagaatgagttcctaaccactgatgtgtctgttatagcctaccgttcttctctctgtgggagtttctaggcagggaagtttatgcaggaatgaggttttggggagcctatacctcatgtatagaaagaatgagacttgaacactgtcttctgcttaggtcgggtgcttttcatgtctgacttccttgcaaaaactgagtactccgagaatgctgaagaaatgaaaggcaaaatgaagttccctttcccctgtacttctagaagatcaagtacaaattatagactattttccttccccccttcttccctcctccctccctccctccctttctggtttttatttagagttacaacttctggcaattcgggtgtgggtagggggaggctagaattcagtctcagatgaggtaaggctagctacttgagtgaatatgaaaaatggtagaagtgtgtggtgggaggctgacgtcaataaattgaataagccttccttcttttatttattgttgtgttcttccaggcctgcttagttatgttaaatacctctgaccttttcccctgcttgcctttctcagcctgaacgtttatataaaggcttccaatgtgattagcattgatgcttctgaaatcacatggaaactagatggtcagtgataaattgtgggtctcagcagtgggcagcccaggaggcttttacatctgcctcttccctgaattgaaaatgctgctggggccatatggcagagtgcctctcaaaggaggactttctggccaggtttcatagcatcacttgcttctgttttaactggaggttatagtgctttggacttgatttactgtatgcaagtggagttcagtcttaatttaaagaggggtgtgtgtgtgtgtgtgtgtgtgtgtgtgtgtgtgtgtgatctaattccagtaatgtt

SEQ ID NO: 22587 - DNA, 1198 bp, Mus musculus
ataagttcaaacctgacagttctcattctatcagatttatgagactggactgtattcatcaagtgtgttgctcccgtgggagctgggtgtaaagctgagccagtgaactcagcagacaggacatggacagtggatcgtagacagaccatgttattttagcctaggttactttaaagtgtttttcaaatgctaaagtttatgtcaggaaagccttctaggcattagaaattcatactatattttcagaagtcaaatctgaacttaatactatttaagataatttaaaatagcaagtttttgttttaagtttttctatgaatataacttaatgtgcacatttttctggcctttcactctctaggaaaagtgtacaagttattgcttagatactacaatgaagaatgcagaaactgttccacccctggaccagacatcaagctttatccattcatataccatgctgttgagtcaagtgcagagaccactgactagccaggacagaaggcaggcacctgaggaacaagtgactaggacctcctctcaaagagacatcctatttgaaatgtggggtgtgatgtctgaattgactgaatctgatctaagtgtgtatataatccacatttgtaatcaaggatgcagtctcttctgcatatgcagttgtttcttgttcatcctggtggacatgcctttagacatggcttcttcaatttttcttctccttcagtctttattctttgattttttttttccaacttgatttcttgggaaaactcaagaaaggttgcactcagcttctagatctttctcttcctgtctgtgtgttgtccagactgctttggtggctagcagataccatcacacttggaggaagttacaaatccagaaatctgagtttgctgcagatttacctgtgagcttctcactcccaacccttgttaggcttgtgttgtctacattttcaattttggaagttgaagtttttcttatgttacttaatgctagtatcttttaggctaaaactattttctatttaaggcagactaatttccagtttctcttttgaaacatcatccctataagtaacggtttttttcgtccttttttccccagcgctattttagaagctggccaagaggaaagaaaatgtagaataaaaggattttcctcggatgctataaagaagccaggttcaagagcg

SEQ ID NO: 22588 - DNA, 1143 bp, Mus musculus
tgtgtggctctggatcaaatgcgaagaacaaagctgcttttgtatgcatttaaaacaattaactaagagaaacagaggtcagagtgacatcgaaaacatcccgagttccaggaagggaacattctggtacagatgaattagtgacgcatcggggtcaggaaacctaacgcataccaagcagaagagatgaaaagggaaccaaacgaattgtagagcagcaggacctgacgggcagaggggccgggcttctcataacaaggccaatgctaccagagccgggattttgacttctgaaggattttctcttgtaaacatgctatattgagaggctatgacatcgtgttctaattaaagcagtttttaaagttctttaaagcagagtcttatttcttattttcttttatttgtatgcagtagctagcccttccagtattgaaagggagcatactcgtcgtcttcctgaccataccagaaaggcttttagtccctcccactgaatatcacctaacactttttgtgtatgttaccaaggtaggaaccttcccgtctagtcctagtttcccgaaggtttaaatcgtgaacggaaactggattttcccggatgccttttctgtgtctattgatgtgatggtattttcctccttctggcagcgctagagaccaaactcagggccccgcaatatggaaggctatatgccccgcctctattttatttagactgttaatgtgatggcttgattatacgaattaaaaaaaaaaatactacccagccttatatatctgggatagattccatttggtaatgatgtacatctaaaatttatgctgttggacttaagtagctaactctctgttcaaaacttttacttttaagtcaagagatactggtctataatttgttttctttaaaggtgttgcttggttttgttgttgagggtagtgtttaccttatagcatgagctaggtgagttcccttctactctccaaaacacactctcgacagttgctttaagaccttcatttcataggattccttaggaatcatggtgtgggagctttctgtttggaaggtcattagctactgatttactgatttcttcctgtaatttgtggctgatgcttttcaaatataggtccatttct

SEQ ID NO: 22589 - DNA, 1189 bp, Mus musculus
gatcccaagctggaagcagcagatgaggtgggtgtcacactgttcctgggggacccccagagggcctggtgtttgggctgggagagtttgggacttgaactgccaggctgacaggcatggagagagtcccagggactgggctgcttgcatcaggtccctcaggcttggtaagtaggtgctgccatggaccctccaggccagccttactctttccagccagtgggactgaggcccagagaggttcagggacttcccagaagtttctcccttgagagtttgtagctgagcctttgcacccacagtccctttatcagcctctagtgacttgttggctccagagaggcatgggtggactgatggtttcctgtgcccttggcccaccctgtagcttgtatgccactgaggttcttagccatgccaggccctcagccctactgcctgccttcctctcctttgctgcattcagtctctagctaaacttctggacctggacattttgtctgtccttcctcttctgtgtccctctgctttgtctctggcctttttcattcccctccccccattgtgtggtgtgtgtgtgtgtgtgtgtgtgtgtgtatgtgtctgcatctgggtgtgttgtgtatgtgtgttgtctatgttggtgtgtgtgtgcgcatctgtgtgtgtgtctgcattgtatctgtgtgtaaccccatgtgttcatccatgtctacaagttcatctgtttttctttcaagagcgagggagggactttgtctctgaccacccagcacaggtgtttagtttggttaaagaaactggtccaggagtacccggctcatggtgccagagcaggcctggtgcccacatggctggcttccagcccaggatcttcctgcatcctgttcatgtcactcagccaccttcacaccgttaagactcttttcgctcctcaatagagaagttacaaagggccctgccccagaatggtgtgaggaattgaagagaagatttgggggaagaaaacgaaaatttttgtctgagtagcacctttttattttattttttttatttttattttttagatttgaaaacatgtaagtattgttgaaaggaaaaatataatttgaaaaagaaatgggacattatttaaagaacatttaaaacttcatccgtgtggtgtgcccgcgcatgcttgcctgcattt

SEQ ID NO: 22590 - DNA, 1174 bp, Mus musculus
tgaggaggcctacggcaggtccaaggataagaagatcctgcatataaagcactggctggactccccctggcctggtgagtgaggaacacgcagccaagtgagccctttgagcctcctttaagcattgcagtgactctggagagcagccactgcggagctagaaggtgaggcttgtgcctggcgtgcaggtgtgagctgttcctgcaggtggaggcaggccaaggtggccttagagcaagagtggcaatctgtacctcgccagggatgggggtgggtggtactggaggcgtctactaagagggtccctctggtggggccaagataggccagctgtgacctcaggggattattagggcaggtgtaggtgctatggccgaaccttttcatctgtggcagatccaagggtgtatactgatgtctcgggagggaaggaattgtagccttcctatcctaggacagaaaactaaccaggggtgtcaaagtcccctcacctcatcaccggagtatgaatggagtctgtcccctcaggcttcttcaatgtggatggggagcccaagagcatgacatgccctacgacaggcatccctgaggagatgctgacccacattggcagtgtggccagctctgtgcccctggaggactttaagatccacacaggtaaggctgctgtgtaagccccagcatggttaccctcagagctgacactgtagccctcagagagagttgttgggataccaagggagaacagagattgtggcatggccctgcttagcctcttggtctcctggtttggctcagagcctcatatgggcccgttcccatgttcctaactccactcccagtgggtatggggagttaggcatttgtggatatcacattccagctgggtgccagggtgagctcttagattggaacattgaaaagacagcctctagggtagccccgggtcatttaggagaacagagaagcttgttctaagatgtctgtgtctcttctagatagcttttgggactgcaactctcaaaagtatgcatgaggtacccactgatggcacccaagattagagctgtattctgtacacattgcaagggtcttgctgggtgtatggagtttattagctcagtctcctcttctagagtacagggacagtcctctatggaagtgtcatagagaa

SEQ ID NO: 22591 - DNA, 1237 bp, Mus musculus
ctgggtagctgaatttggtgtaggcccacagtgcaacggcctctaagtagaggaccacctgggcaggcagtcttcttcatgtgtgcgaccctacccggccttccctgagctgactctcctcctccaggtatgtcggccgggacccagcagccgcaccagccactgggaataagaacgctcacttggtgtcactgaggaggtttctggatactgccttcaatctgaaggccttcgagggcaagacattttagagtgatcttctgaaggaggttatatctggaaactctgggccccagatgaaccacatccatgtagcaatttggaccaaagagtagcgctgctggctttggtctgttatttcaggattaattggtcaggatcaaggattagctttcctcagatagaggggacatcgatgtggtgtcttgccagccctgctaacctttctggattttttttttttttttttttttttttttttttttttggtgtggtgatggtttctttagctttactagtcatgtctctagacagccactggagccgtatagggttgtgcccatcctggcagacttagttgccgatcaccttgttgtagccatttcgtctgtagattcagagatgctctctgttgtgctcttggaagtagagagtccagcaataagagcaggtaaagctcagccacaccaggagatgcagtgagatgcagcacacgtgtgcgaacctaagcaggagaccaaagcgcagaggaataaagacatgcctgagaaagccctgctggcctcctttcctaccgtggagctgggggaggggtggcagggagaagaaccaacctggagagatgatgtctgagccacaggcagggctttccagcttctcccttaccgagaacatgctgggggagctgggggtggggcgagggaccaggcctttgtacagattgtctgttgatgtgtccctttcctagagtgtctccttggaactagatgccaggacctccaggtgcagcttcatgccctgtttgggagagatatgtatggttccttctatttttccctctttccttccctgtctttcttacggaatccaaggtctggcacatgatagcatgtctaccaccgagtgacacctgtaggcatgattttatttttgttgtggtatttacagtctcacatgtgcaggctggccactctctcccctaccatccctgtgcctcttctctcttccccatcctcac

SEQ ID NO: 22592 - DNA, 1190 bp, Mus musculus
tctgccttctctcctactcttgtcattagatatttggactcttttctttctgatgctttggttgttttttttttttttttctcccaaatgttttcatattggagagtgtacaaaccattcgggcactgttcaatggtcttgctttattcaagtgtgtgtgactgggatagtgtgtcaggttcagatacagggatgctggaaccccgaggcacctctggtcacagacccactaagagctaagccctggcttgacacaccaatttgacttatttatagcttcacatgaaagaagatacacagtgtgtactcgggggttcgtttattttgctcacgattatggtttttgttcttaagaatttccagagcctctgccatctgctccaccctccttaaatcttgttcacatggtgctgtaaccattccggctttgaagctgtgccactgaatgcccacctccctcccagcccccagcagccaccaatccactccacttcctgtctgtgtatgacaatgtaggaatgtctcaccagcgaggtcacacaacttttgttcctttgtgaatgtcttatttcgcattgtgtcttctggattcttctgagtcgtagcctctctcagtgtttcctgactttgtgaggcagaaccgcgtctcgctgtgcaggtgtaatgcattgtgggtattgatggggtgcagatggtctcccatcttttgttgctgtttgcaaagctgctgtgcctgtgcacacacacctcatccatgtctccgttcagttctgtgtctacccagagctgggactgcttgcagtcagtctgttctcagttccttgaaagtcccaccacactgcatgtctgcctcagctgtaccatctcctgttcctgctagtggtgcccagtgattcattcctccaccctgagcagtgcatagacctgctcctcctcttcctcctcctccttcctcccttcttctctccctccctctctccctcttcttcccccacccctccccccgctctgtgtgtctctgtgtgtgtgtgtgtcataaggcacatatgaagatagaagactaccttgggtgtgtgaccttagggacagggtctctggctcactgctgcatattccaggctagctggccaataagttttcagggaccgtcccaccttcacttccccatcctgccctggggtcacaagcac

SEQ ID NO: 22593 - DNA, 2529 bp, Mus musculus
tgactacttgggccttgggtgggtgggagggatggggaattggttagtcattgatagaactgctttaaaaacaattcagtggtcatatttttgagtgatttttcagaaaatgtagaattcattttgtagtaaagtagtttattttttttaatttcaagtgttgtaatttaaaacttaagttgtgtttttaaacagcaacaaaactgtattgtatttttgctgtaattaactgtataatgtaaacctaattattttatcatggtttaaattttgcatatttgctttatcttatgctgctgatttttttactgaatttgtaaaatttttgtttatcaaagcaactattatgtggtgacttgcatatatcatgaattatttaagatgtttataagttttttattagaatttatttcagatgtttgttcatgatgctatccttcagggttatgtgcttatcaatgaaataaccccagaggaataagggaaaataacctgtagccagttatattcaggaataactactgtaaatgatgaacgcatcaagaaacctccaatatttgctacttgccaatcccaacttagttaaaacaattggtaggcaaccttacctaaattttagcaaacaccttatctaatggcagaataactcagagcatgtctttaaagatgctgggcacatccttctccattttgaatctcctacaccaacccaagaaaaacttaaactaaggaatgtggtatattctgatcatctgtggcatgcttaaagcttttgatcacacaaagttaagaggacacttcatgaatctacatttccgtggagatcaacagatgcttcccctgtcctggctacgagcctgcttctgtagacactgagttaatctcctcaggctgtaggtcctggcattggccacgagcctggactttccctgttggacagcttctggcctctggcctttcccagttcctgttccttagcgggtcagtctgttgagcaccagtttgtggtgtttctggccatttgattctacctgtagcattatcctgtttctactagctgtcaggaggttccaaagcctacttaaacttgtgtaggtgacatttaaatgagcaatatgccgttcatctgaaaatagtagcacacagccatatgtaggatgtcattttctaaggactgtttcttcacagtgagcagagcaggcatagtggtggttctttcatctgagtctttggttttttatatctgatttccagtatggacgttgagtagtgtaagaatggtgctgctcctgacaagtgtgtgttaactgtttacattttatatctgcagaatcctttctctgtaactgaattttcctaagtaaaatgtcatcaaggtctcattatttctgaaatgatgtctataatgcccaggcacctttggtattatctggaacaagagggatttcatgtaatgaactgggaaatgcatacttcatgagctgcaaggttgtaggaaggagcccggagccccttggagctcacaatcagcaggagtaagagcgggcacagcttggcagatttctgaaaggttgcttagcaggttcttttgttttggtttttggatttttcttcttttggttgctttttaaaaacatttagtgtacaattactttcaagtaagctattttaagtcttgttaatgtgcaatacttaagattaagatattacctttttaaacatagcaagtttatcaagatttctagcgtcccatcttttagtgattccttttctatatgtacaacatggtgcatttattttattagacaagtatgaatttgagactgttacgcctcttggttctagaaatacaaggttgaagtcaggattttagcagaaattggagcatgagtgtgttcttattttatattagttttgcatctaactggttttggttttgccgtgataaaatgtgtcactattgcacttaccagctgatatgctgtagttagttttctgtgtttgtgtttgattgctgagaagccatcttcttcattcagatttcgggtaagtaaggaatactagttgtttgattgtctcatctgttgtaattgccagctcccacttgccagcaatcatgtttcagttaaatttaaaaaaaaaaaaaacaacaagctctcaatgcttaatgtaagctgaaatacctaacagagtatacctaaaagcaaggtctgtttgttaaacatgtgcccaacacattaagatccactgtacacacacacacacacacacaaaacacaccactgtgtttaaatcttttaacataaatcctactggtacttttagagtcttaaagcatcttaagtatttttttaagaaattacaaataacatttctgtctatcagtacttattaagccaccctataatttgacttttcaattatatatacttatgatacccattgtcttactgtctaaaagttgtttagctgagaattagcattccacttcatggtttaggaaagagagccttattcttcctacatgtc

SEQ ID NO: 22594 - DNA, 1128 bp, Mus musculus
taggcacttagaaacccttgctgagagagacttccctctaactagttcccactgagtcagcagaagagatctgtatggtaataccctggctcacatgctggcctggaagtgacacacataacctctactcagtgcatccacagagctagccataaaaacctgcctccttatagaagagcaggaaaatgtgaggaaggcaaactcatgggtgttggtgagtaccgggctccatagcctgtggttgtctgacatacctccgttctctgtcccacacctccttaatgtggatacaccttagtgtctgtgccaggttcagatgttgatcttctgagcccagaagcataggaactggctctgtcttccctcctctcaagttccttctatagaatagtcaggtggttccagggtagtcaagacagtctcattggaaattgagaaatactgatgttgatttattagttgcatttgacattatgctggatggacattgtaagtgttccttcctctggaggtaggagtgttccctcttgaggagctggatctgatttctgcacagtgcaacttccccgctgttgtccacattacctgtctgctccctatggaagtcttcctttcctcttatctcccttaaatagatcttaagtgagtattgaaggctgtgtactgaaggggtgctcagctttcttggcctgcttcttatccctgaaagatagggacacaagtgtgttctattgttgacattttggacactctttgttgttatcctgtctttgtaagttacttagtaattttgacaacagacttgagttgtgttatttgtggttcagtttattatatcagtaaccttggtagcttttgattgtatgtctttttaaagcatatttgttagctgacagtctatgtattattggacttacttgaaactcctgagtctaccttcaagcttccaggcttccaagatgtccatgatttctaacaagctattcatggcttacaaaagcacagtgtgtactcagggtctacagtgttggcccatgcagcattactacagacctcaggtcaggttcagtgttacttccagggacatccttttcccatgctatgaagtagaagaatagaaactatgct

SEQ ID NO: 22595 - DNA, 1152 bp, Mus musculus
tctattgtgttttgagatcagcttccaccaagtacctggtcagttagaacatgtttatttcattcattcatttggcaacagttagtgctgtatccaggtggagaagatgtgaaggccaagagaaagacccttaaaaattagggtagtatggaacagaatagatgtgcctttaaatgagacgattatgtaagggatgtatgttaagtaaggtatttggctcatttgactggaacttccaaggatagtgttaggaagaatatccaggtttggcttaaatatactacctttattcttaaatcccaccccccccttgtcaattttcgtatcattggtaatggttacttcagttctcttattgaggctgttaaacttggaaggtttacttctgtgtctgacgaagtaatcaaaatggtacttagaggcctattttgcatcatttccccatcaccaagcatggaagtcatactcattgggttgattgaaagacttttatagacaaaaatttaaaataaagccttaaattctccacgaagtttcagatgtgtcacataccactctcagttggctagatcataaattaatagaggatgttacctgttaaagaccaccaaagggtttggaatcactttttcacttctaggttaactattcctgatttttttctatatagttaataaaatagaggattatggcttgtgtgtatagtcataaaaagttgagtagccatacttaaaagtcagagatgctccaaactctccaaatgaaacacttacagtgtcttgtagataaaggggatttacttggtactctgtcatcaaagttgagaactttgtccacttctagtattttaggtaagagctttctctagtcatgtatgaatacacccagacacaacagtgatgtttcattaagaatctagcatgattgcatttatctcccttaaaaaaacttatgacggtgggtgtgcctgcatgatgtttttgtggggtggggtcacacatgccactgtgtgcatgtgaaagcctaagagcaactgtgtgggcttcattctcttcttccacctttctgtggggtctggacatggaactgggttcccctgcttccaggaacctttacccagtgagccatatttatctttttgtgactattatt

SEQ ID NO: 22596 - DNA, 1132 bp, Mus musculus
gtctataactctctagcctgaggttcttggtctgttaatggtgtccagtttgggtttcatcttgtggaatggatctttcatcctgtcagaaagtagttgcttgcttccatgatgttggccttgaggtcttaacaattctcttcgttaatgttatcccaactcaagcaatgtctttgtgcaaacttgagtcttcctgaagagtcaacaaacatgtaattacttggagatttgtcgagcccagaaaggctgcatagactgggacaagcaggttaggagtttaaattgagtaattgtggtttgtatctgtaagttagatttttactaaattattcaacacattcaatctttatttttaaaagtaaaagtgtttctataaagtagcattttggatggtgagatgttgcatcagttagcaccaggtactgctcttgctctcattttgaaatttttggtgtttttctatatttgacagtagcctttttattcctctttataagagaattgtgtatcgtatgttggaagtcatagagcttgtttggtgacaagtaagcataatgtagctggagcattggtggaccagggcacagatgtctatgtgcagtaaagcaggagcctgaacggtgaagattactttgggacaaaatggcagttttctctcctgcttcctgacagtgtagacaagcctcatgctgtttggagccagtactttctgtagcatctttgttgccatataccttgttttgattgccacctcactccactcagtggaaggtgagaaaggattagaaacggtggctgcctggctagaatttggacattggtagacttccattaatactagtctccaaaccattttcctattttgtaaaaactctcttctctgttgccctaaacttacagatttccccagttttcaggagaataccataccatttgctgttgcccctgagggtgcttctgtgctgtattcattggcacagttgtagacaccgagagccctttcatcgcacactactgtgtctcacagaagtcctataggacagtgctgatggtactctttcatttcttaaaagatgctcttaaagtcctcctaactgtatgtccctaaagtcttgcaaataggttttatgga

SEQ ID NO: 22597 - DNA, 1132 bp, Mus musculus
aagatacatctacggagaagaaaatttggggtccacactccagaccaggaatttctggtgccttagtccttaaagctaagcttctttggttacatgaaaattcaagatgtgggtttccactcacagggtactctgagacccacagccattgttctgtggcaatctatgtgcagctgagtaaccaaattcttaaagaagatgcttcctggatgtgacagcttagcgatgtcttctagcagaccttacttggtgacttcagatgagtcccacagatgcccagtgcattcacatctcgcccttttccctggctgttctgggcctttggagctgtgcccactcccccaggctctgcccttgccctactctctgccttacacaaagcctttgttttggagctaggtggcacacaaagaaacatgccaacccttacacaatactaacccttaacgcccacagaaacacataaacaaatacaaatgtatgccacacagcctgcaccctcctaacattaacagagttttcctgtttgccagtgaaatgcacccggaacgtccacagctactttgcagagagactctactacgccatgaaggtaactgtcctgggtgctgccccctctgtagtcagccctatatgatgtcagatgtacaacaggggtactcagagtccctgccatctgaacactgggctctctcttggtctaatctctcatgtgtcagaaagacttgctttcttagagggccaactaagccttgggaagggaagccacagtccctgaaggaacatttgagcaggttcattgaagactcatggaaccttgacaacagctctgagtggtccatatcaccattgccatctgaagtgtggtgtgtctaaggcttgtgcaaggccacaccccttctaagttgtagagccatgcattgatctcagacccatcagcttgtgctttttattgtcctgtatctcctcattgaagacaataggcaggcatggctggaatcccaacccccttgacatggacagactctggggacattgtcccaattggcatgtcaattttcctactcatgatcaggtgctaacttcagatttcctctttcctataaggctgccctggcttcagaaatagatg

SEQ ID NO: 22598 - DNA, 2247 bp, Mus musculus
ggatctctcctgggctcgggtgctgccttatcccgctgatgtacaaaaccttattcaattcccaagagattgttccttcctcctttccgcagtgaagcacaattccttaaagcaaacagtgattcaggcaaaccattccttccatagaaagtattagtggagtataatggtcaagtattacagtctggttttaaaattgcatgctaaactcaattaagagatttgtcaattatgttgaaggagctgagcttatggaatctaatcagtgaattatttcattatatttttctaattaactcttcagactctcttatcaggttgctagcttctccctgctccttggattaaaaacttagaacaagtgccatgacttctttccctcccctcccctcccctccccttccctcccctccccttccctcccctccccttccctcccctccccttccctcccctcccctcctctcctctccccttccctttcctcttttctcagtattgtgactgctttgatcaccatgagcagtaagtaaattaagtagaattcctctagtagtgtctggttccacaggtagactgtccacacttccagcattcagctatagctaactcactgcctgggtcctattgctccgtcttgtgcttctgtccatccttcccctcccccacctccccccaccacacccctttctcaggtgcttggtcaccccagccggagcctgaatgtggcaaggaggaagatctcctgaggggcaggaacctcgagctgcagaacttccaggacctccctttagtgaggtctccccaccactccatgaccgaccttggtttgctacagtgtttgttgcagcaacaccattcaaatcccttacagcaggggattgcctttgtctggaaaaggaagtcagttttgaaaatttattcctccaactctttttaaaattaatttattattataattaagtacactgtagctgtcttcagacacaccagaagagggtgtcagatctcattatgggtggttgtgagccaccatatagttgccaggaattgaactcaggacgttcggaagagcagtcagggctcttacccgctgagccattttgccaacccagtttttccaactcttatgaacagaattctgggtaaattccaattgtgaagtgctcaagggagaccagaaagtagcaagaaagtgaaaaataatctcccttcctctgctaattatcctctgacagtgatgagcacaggctgctcatggctcttgaagtaatttgggcagacattccacacagaaaagtaagaaaagcataattgacaaatgactgcacaaattacaacacatcattatgggatgccaaattggcagccatgacaccaaggccagtaggcagcttcaggaagtgctctcccccagagatgctccttcaggagagcacaggcccctggggctgcctcacatcgcccctcaaattcttcacccctccctggagctgtgcccactgttgtgtagctttgccaaaaaggcacgtctacttctctgaccctggattttcagcttggccatatggcttgctttggcccagggatatctaggggcaccatacaagcagaagacaaaaaacatgctctcctatgcttctgcctccatctcgacaggcgctgtccctgggtagctggtggtcagtgtgaacagtcatggcactgctctggtaaggatcccccagcccatccagacccacggcgtgagaacaagttacctcacctggggtaactcctgctcggccaacccacagatgcagaggataaaaatgttgatgctgcatccactgagaacccgtggtcatttgctatgcacagagtcaagtgaagacagcagctcacccactgtctttgactggctgtccttgaatcctggttctcctggctctacctaccaagttgctgccattctgccacctccccaccctccaccaagctgggccttctttttctgggaaaggacttctttttccgctagaggcagatagatgttcacattaacaacaagggggaaagctggatgaagcacagacctttttaaaaagagcccctgagtcagaagcaaagcacagggatgaaagagtttctgagaaccactttgctctccgggaactttctgggtttgaccgagaggctaagcaggtgggcagagtctcggttcagggcagcaaaggctgcagctgcagctgcagctgcagcgtctct

SEQ ID NO: 22599 - DNA, 1187 bp, Mus musculus
agaggccaggagagggtgttagatcccgagactagagtaatagatggttgtgagccgccgtgtagattttgagaaaatgctcttaactgctgagccatccaaccctatgatctatcttttgaaatgaaatgacagggattttgcttagagtttttaaaataggtaatttattagcataatataattgtgctaaatacataattttttaaagaaaattctgtgaagcttttattatttgtttttctgttggtattctccccagcactgactttctgctataaactgaattgctttccttcattataactgtgtctactgggctagggatgcagtgctgttgctatggcctcaggcgtggtcgtatccatccttgcctgccactgacactttactgtggggctcttggcccctggtctgtcctgtaagttgtcagcactgtgtggagtttccttctgggagacaagcttcctcttagactagggtaccaccttttcatctttagcaggagacttcaggagagattccaattccttggcaccgattgtctcagtatagccaaagggaggggcacaaatgcttctatttagagtactgggactcctgccatgatatttaagttaattgactgaattagtatcatgaaaatggctgtagccctgaaagcaagctacaatattcaatgtagttcttagcacaatcccagtgagtttcttctcagaaatagaaaaaacaatcctcaaattcctgtggaacaaaagcacccttgagcagagcctcccctgaggacagagagcacagcgtctgatttcagacactttcacagagccacaatgacaataacagacagacgtgtggatgaagggaatgaaatagagggtgcagaactcacccctggcaggtatgatggagcagtgccaggccatacaccagtgtgtgtggcattcgtgtcaacaagtggtcctgggaaaaccacgtgagaattctctcatccactacagaaggcattcaaaatggatcaatacttctaagatctgaaactttgacactactaccagaaaacacaaggaaaatacttctaagatagagacacaagcaaggacttcctggcaccttcggactggtgtggctgtagaaggcagagcctcatggaaaggactccagtagctcaggaaataagatcaagaact

SEQ ID NO: 22600 - DNA, 1151 bp, Mus musculus
cctttttttagggaagaaaaatacgtttttcattttctctccactacagtacacaatcatacagcgttaaaggtgctttaaaaaaaaaaaagactattaaaagaaaaaccaccttttttctgttgcttaaacttaatgtattgagtaggagtcttgatggaggttgaattggcaagtgagcagaggttagactagaacagtgattcatttcattgcaacttcataactgtaattttgctactgttaggagtagttatgtaaatatctaataggcaggatatttgatatgcaaccccttcaggggttacgggggacccacaggttgagaattgcaggactagacctttgtctgcctcggttctgtccagtagtctttttactaccagctgactaaaaactatagaaatgtttctgcactggaaaaactggggctgtgatggtgttcccagtggtggaacaaaggttgtggcaaaaggtttaatgatttaccaaattcgcattgagtctacccaagtctaggatctccctttggagcctaattgtcccttagccctgtagttccctctgctagaagccattggaaccactttgacctctgatttcccatgcagctcaaaattatataaaaggggtagtcattctcctacacctcaccttcctctttcttccttccctccctccctccctccctccctccctccctccctccctccctccttcccccacaagccgggaactcaaattctacccccctccagaacaaacaaggatgtctgtcgagccagaggcattgtattgcaaatgctaaactgtccttgtctttacagagggtgtgcatcctgtgatttggtgggttttttctgtcttgttagtcattaaagcaatttgagtttgccgtagttttattattttaagtgctcttgtcacagaagttttaatagcaaaatattgagcctagcaacaaatatcatcagccttaccagatcacagtaaccaaagcacttgctcaaagtggagtgaacagagcagaaatagagaaacccgtttgtagttagttaacagtaacagcattgcatgatgatacagcaagataaagtaacgttctacaaagtaaaccattacatttatttaacatcacactgcctcttcgc

SEQ ID NO: 22601 - DNA, 1248 bp, Mus musculus
atattctcacattggtctaaatctgtctcttgttagcatgtatttcacttcgaggtttggctttgctgttaccttaaaatagcactatacctgtatacacacagtcataagaccactgggctgggtgaatatggttgtcctaaactactccagggctcagtttcagaggtaacagaaagtttggcttcatatttttgatcatagaaatttgttattgaaaaagctgcctaatatattgcttcatttaaaaaaaaaatgtgtaatgtgtctgtgtgtcacagcacacagaggccagaggacaagttatgatagttgcttctccccttccactgtctgggtccttaggataaaactgggatcatcagaagacacttggtggcaagtacctttaccatcaaggccatctactgtcccagaacattgcttcttttagcaaaaggattttgagacttgcttctaaaccagtagaatatggatttatgttggtcaaaacgactcatgctatctgcactaagtcggtatcatgcataattgttcttctcagggatttggtaatgtgggcctgcactctatgagatatttacatcgttttggtgctaaatgtgttggtgttggagagtctgatgggagtatatggaatccggatgggattgacccaaaagaactggaagacttcaagttggtatgttattctgatatagtcgtgtgctgtggcatacagttgggggttagacccaactgcaggtcaggcctgcaggagtctcttctctcctaccatatgggtcccagggtttaaattcaggccattgcttgatggcaaacactgagccatctcaccctttaaaacaaaattctttgcttgtatttatgtagtgccaccatgtacatatgaaggtcggagggcaacttgcaggagttgtttctcctactgtgcagccctgggtggcgaactcagatcatcgggcttggtggcagaaaccttaggtcttatttcttctcccttttggtttatctttgagtggtgggattgggtgtcttgttttgttttaattcaagcttgggttggttagttagcctctgccttccaagcattgatagggtgtttttgagagatgctcttgtgtgtacgctttgttggcctcgtatcccctggctgcccagcctggtttcagattcacggcactctccgtgcttcagcatccctaacacagggatatgagtcaccatacctggttttcaaagagctct

SEQ ID NO: 22602 - DNA, 2139 bp, Mus musculus
taaagtatacagtttatcagcctgcagcatagtcataaggctacggagatgtcatcattgtagagtgttcccacttccctatttctggttatttgaaacagtcataagtatgtgctctgagctcattacagataatagataacagaaaagttaaccgccagagaaaccattcacatctgtagttctgaggagtaaggtcttgctgttccctggacagtagcaacttacattaattccagagaattagtccttcctgctagaaacattgctgctgttgtggtcttttgtcattggccatctgtgtgttacctgctcatgggacagatgaccaggactcacatgcgccttgtgttaatagcctgctactcagtcaggtgatctcactgccttttcccctttgttccagcaaattatgcgcacagccatgaagtataacctgggattggacctgagaacagctgcctatgtcaatgctatcgagaaagtcttcaaggtgtacaatgaagctggtgtgaccttcacatagacagctcacagccgacttctttaccacctcttcacctataatttctgcagacctgtcacaagtttccatataaccatagaaatctgttcttgtgactcattagttaacggacactgttctgaacaagtcagttggaatcagccccttaagagaaagagattaagttagaggatcatgtacaagctgatggtataaaagtaggaatcacgtgtatccaagccagttaggtggtttgcttttaggtaaagtcttgctcctgtgctgtcttgctctgggcccttcccagcagagtcagtgctgttgccagggaaggagtcaggagcagtcagtcacttcttgacatgtctgggaactccgacacatataagaagtaggtgtgtggcgttttccaaaggtggcatggtcctcaaatgagttattgtggttttacatcaaaaaaaaataactcagttttctaagttgcaaacaaaaataaaagctatgtctcatgtattttattctctcagaataaaccagtacatgctgctgtaataaattgccttcaaccacttaagcctaacctttactcaagcagtgaacacctaaaatagaagaaatggaagaagctagttttttatactataaaacagtatcacttgtagcttattggccctgcatcattgtccagcagaaataaagtagcactatggggcgctctcctcagacctgcaagggacaagggactcttgggaactggtaatgcagtccagagagtacagtaaccactttaccatgaaaactacttgttcttcccatttgaaggtctattctgttgagtaattgaaccataattcaaatcgagtgtcccagaaaaaaagacttgggctccctgtttggagtctggcaggcttcgagcacgagccagtggccaggctcaacctgtgtgtccccttccaaggctttgcattctgctcaccgcttcaccagcagcaggctagagactgcctgcctgggcttgacttttgtttggggggttattggccagggcttttgaacaggaatgtcccacagaagtaccagacattatttatataaggatgaacgcttttttttaacagtaccctttcagaaatttctaactactttgtaactgcatgattaacttggtgataaaagcagttattaaaagtctaccttttccaaaatgtatgtttcttttctgtgttttcatatttaataatctgttagtaaatataaaacggtaattgaggttcagaaattttcataactgtctatgtcactgctttctgttaacaagctcttcaaattttattcctggaatttttttttttaccttcctgggaagaggctgtagtgtgtaaagctaatatactattgtgatttctggcactttttgtttgaaacaaggtcttacataacccaggctgccttcaaagttattagctgaggctacccttgaacgcctcctgatcctcctgcttcttgctccagtgtgcctttttctggtatcttagaaataaaagcatggaagttttttcagattagaagttctctatggggacgccccagcccagccgccctggatcaccaactggacccccagaagtgattac

SEQ ID NO: 22603 - DNA, 2139 bp, Mus musculus; identical to SEQ ID NO: 22602

SEQ ID NO: 22604 - DNA, 1735 bp, Mus musculus
tctaggcctttaggcccaggcttgggaatatgacctctgtgcctcattgctccaaggtatgctaatcataaaacagatagcgacattcctccacccacccccttcctaggttcaaagagtgttcattcaaagaaagtcaccctgaccattgccggaacccgctatgcaaatgtgctattgttaggggctcttagaaactgtcttgagagataacctgcacaattaccaggtattcctttcgactcttgtgactttgcacttccttgggactcttaactggtatcgccctcccacttcctgagttgtggtttcttcctttaaatacccccttactcagctactggggcgccacggtcctctacccctgcgtggtgtatgactgtgggcctgagagcgctcttgaataaaaatcctcttgcagtttgcagcaagaccgtttcttgtgggtgatttggggtgtcgcctctcctgagtcagaacgtgagggagtcctcacgttggttgtgggtctttcaaagtctcttgccttgagccactcagataatgaaggttggtgagtcctgctgccagagcacttagtaatctatagctctgggcccctccttcctggcttgtttccttaataagggagttagatgtgagaaactaaggctgggacctgcctaacaggtgacacttcaaagtaataaacagctgttgcttctccccaccctacccccaccacccaaaggaggttgaaaacaaaaaattccattgggatctgggaacctcttggtcccatctgacttgtactgggagacccagcaggtggaggtcttgctggcagaggtccacctcagtgaagctttaccatagcctggtgttggacctgttacctgcttggctcctcagatgggcttcagcaaccaccaaagcattgtcccagataggtgtcccgtggctccttcatctcagggagactatgtcagaggatttcacactacagagacctgccgctcctgtcagtgtgcctcaagaaggtgctgctgctgatggtcaggtaaggcactgctcactgacaccctgggcatcttctacttgctgcatcttgtcttttgtgtccttgctgccacggcttggaggagttctgggttgttgaggacatctgcagtgggtcaatcccgctgactgtgctttatctaaacatcaatttggatttttaaaagtaagccagagccagctcacccggccgagggacagggtaggagcaggtcagcagacagaattatgggggcttgaggaaaatagggagtaaaaggctgtgagggatggaggagtggagacacgtgcaggaccttgggggttcctcatggggaaggcggagaccctaactagaatgggcaaagcaactaaagaatacagaagggctgagttcggattcagaagaccactcacccagtgggtgtggcttctccctcctctgccttggggattccacctgacgatcatgggagctctcaaggctgaagatgattctaatagacacttagcaggggtatttctattgctcatttgcatgacgtatgtacgtgcgtgcgtgtgtgtgtgtgtgtgtgtgtgtgtgtgtgtgtgtgtgtgtgtacgtacatgtttaggcccttggagtaaaaccctgctaactcaagcttgtttgttctcagaaaaaaggaaaagatttgggactttggtaaggaaaggctgggtgtctggacacttg

SEQ ID NO: 22605 - DNA, 1098 bp, Mus musculus
agaaagctgagtcacaggattagccacccctgtcccctctttagaaagagcccagaatgctgggggtgggttgaacactaaatgggacccattttcacagactacccttcccctctaagccaggagtggcctggctcagatgcagcaactcccattggagaaagcggggtccacctgagcagatcattacctcagggtctccaggttaggagactccaggcatgtgtgtgcatgcttttgagtgcccacacgtaggtgtggcactccggtcctgtcccactcagagtcccttcccccagagtatcaaagacaattagatactaccatattctccagggtgtgcgaccctgcctcaacaatcagaatttcatctcaaaacgctttctagaagctgggggaatctgcagagggaggcatctgccctccattagggacccctccaccctgccccgccccgccccgccccacctaccacactcacccacatacataaccccctccttggtcttctcagctgcctccgttactccctgcttggtcttttctacagcacccacaacaccttccttggcaatggagaagcctttcttgaagacgtccatggtgtttgcaaggatggaacctggctgctgcaagctatggactggagtgctgccgcagccgctgtctctgctgctactgcctcttattgacgcagatgaaatattgatgctgtggctgctggctggagcccagccagcccgggccagggtgggggcagggagggcgggccagagagaaggcatgcctcacggggataccagcgagcagggcccgggcccctactggctctattctgccctgctgactcttgttggccctgggggagggagagcgtgttggaggctggacatatcctaatctatcattacacctcattcatccttggaaagccctggtggtctcgtgccctggctcttatatgcagaagaaaagtgccttgactgatgatgcctcagtgtcccaggctgggccggggtcagggccaatccaatgaatggccaacctgcaggctgccctgttatccagttccccactgtatcctggatgctcttgagc

SEQ ID NO: 22606 - DNA, 1113 bp, Mus musculus
cggtaaaacaaaacaacttggtgcctccacaccctgcgtgcccaggctgccaggtcccagggcagaagagggacctggttagctgtttcccaagcccctggagatcctgcagaggcagggccagcaaactagcaaggagtaccttggttcttcccagctcctttttgtttttcaagacagggtttctctgtgtagccctggctgtcctggaactcactctgtagaccaggctggcctcgaactcagaaatccacctgcttctgcctcccgagtgctgggattaaaggcatgcgccaccaccacccggctcttcccagctccttggtggggttgtgtatagagaatatggactctccagacccaagtcagctgctccagagaggctgggtctgtggtagaggccatgctgaacctgaagagatgggctgtcttctactttgattccattcagagcctcagatctcatagttggagcctggtgttctctgtcctgacccacccccatgtagagtgtgattttataacgttactcccagtagcaggctccacctaatggaaggaacactagggactatcgtagctgctagctcaaggcccagagctgttcagcacatagctagaggacacacagcagcagagtggagccaacacatatactcttgtgcctgttctcgctcttgagcacagggttctgggtataggcagaaccccacagaccagtgctgagccctctaggctcacggtcagggagtcccaaacccaagctgcctgttagatgggctttgggcttcctgcggagacacaacaccactccactactcctggttcaaggaggagtacttccttgggctgtcacattaacagctagatgcaggcctcagaaaacatggctgccagacggggcagcctccagctgaaaggaacctgaagagatgggctctttggccagcaaagacgctcttacaaaggcagcttcacagcccaagcacatccattatgtagaaagcaccagcccctccctgcaacaggccctgtcagcctccccacaacccccttctgtgtctccagggattcggcctctgcacatttccaggagtgggaggagggcctgac

SEQ ID NO: 22607 - DNA, 1117 bp, Mus musculus
tatttattttgttttggaaacaggatctcatagtgtgtgtgtgtgtgtgtgtgtgtgtgtgtgtgtgtgtgtgtgtttatttgtttgtttaattttggaaacaggatctcatatagccctggctagccaaaaactcattgtataggtgatgttgatgttggcccccttatcctcctgcctccacctcctaaattgctgggatgatagacatgagccaccaagctgtttttgctctgtgctgggactgtctccagtccttcctgtctgctaggcaagcactctgccagctacactatgtccccagcctgttttgttttgggttttttttcttttttcccccatttctaacataggcctttcgttttcaagtgttctctttgtcctctgaataccctgctaacccttatacttcctccgccccctacgtactcctgtctgtgtcctctgcatagcaacgtctcttacatccctggaaacactagtgtcgatttggagctggtattcattcttcatggatagctgtggtccactccggcttgtcagttccgaccttcgttgatctgttttgttcttttcaggcctgaggatttaactagggccccctacatgttaatctcatgctctaactccaagctgcatcttggtctggtttctttggtttgtaacatatttctctcaggggttagcctcagaggtctggatgtacccttctgagctgttttgatgtaggagactctgttgggtggttcacccagaggctcccatgatgtcagcatcttcaggtctcctttgctgggaccaggtagttttcctgctaagcatttctagcctgcttccggaaggtaaagactgtcttgtcaggcttctaaaagcctgatggggtagggtgggctggagtgagtgtgggcaggaaggggtgtgtctcaatggatgtggtcacacaatgaccattaagtctgtccttccacccctcccagaagtatctttaatggtgcctaatggccctagggcaaagagcagcttcagaagtgaaattccaattccaacaagccacccaatcagcaaagcccctgaaccttgctctctgatgcctacagacatggccacttcctccatg

SEQ ID NO: 22608 - DNA, 1149 bp, Mus musculus
cagaaaaagccttacagtatagctcagattgacttcaaaatcaagattttactgcctctgtctcctgagttagaattacaagcgtgagctactgtgctggcttcaagaagtttctcagtcctttttctttatggtcttgtgcccacttttggtcaaaaccaccattcctgttcccagtactaacattattttgaggataggcactattctctttcccacacgatgtctcaagatacctagcaggtaggtgctgggacgacttagtggcggagcacacgtctagcatgtgtgaagtcctgtgttccatccctagcactgatgtggaaggaactatccctggcaggtagcagacatctaggagttggatactcaggtttctagcaccgccctcccacggctcaggtagtcaaagacacttatctctctagagttgaaaggatcaaagaaaaaaagggctttgttgaggatcaaaggagaaaatgcatttgccagccagccagcagatctgtatttcccttcccctatctctgaaatgacactgactgtctaagacacacctctgggatgtgatggtatctagaaatggtctccggcttctcatgcaattaaggtgaagaagggagagtttggcagtgaatggataactgactgtctcctctacctcaggctcccctgtggccttctatgccggttcttcagaaggggccactgctctgcagatggtgaagttcaacaccacatccatcaatgtgggcagcagctactttcctgaacatggctacttccgagctcccaaacgtggcgtctacttgtttgctgtgagcattacatttggcccaggcccaggaatggggcagctggtatttgaaggtcatcaccgggttccagtctacagtacggaacagaggggcgggagcacagccaccacttttgctatggtagagctacaaaagggtgagagagcgtggtttgagttaatccaagggtcagcaaccaaagggagccaaccaggcactgcatttgggggcttcctgatgttcaagacctgaaccctgggctcggctcagcttgtatcagacatggtagatccgcctgctgctcttagactgaggctctggccagcaaaggctggagaacatctagtggcct

SEQ ID NO: 22609 - DNA, 1311 bp, Mus musculus
tctctagaaatactgtaacaaaaaggtattttagtcagcatgttatgttaacccttccactgtctagaaacttgaataagcacataaagacaccttttgctgtcatcatctgttgtcctggaatgtgccagttttaatttattcattctaatgatattcaatttgcttttcttttttagatgtttttcttgtttagagtaaaaggacgaatttttcaagaaccttgcatctctgatttggcctaaggtcaaattggatattgagtagtctattccagggcagatttcctaagcaatacttgtcttttcagctatgtattgttttgaaatgtttccatttcaacagaggtgtaagtcatgtgaaaagaaaggtggtgtagcccttgtggtaatgacacaagttgacttgcgtcagatgttaagcagggacagttctcccacctcctggctgtaaggagtggaaactaggcaagcagtgtatcagtccacagaggacaggaagggtcatcccataaagaaagcctgtgagtatggctttggcaaaaaattagacataatactgtccttttaggttgtgctctgttctttcctttcagtggaattatttaagctctttagtggcctttgtttttcccacttaaaaactaaaatgtagcatatattgtataaaatggaaatattaatagcttagggaaactgtacataaggcattgacaggtttaaaaaaagcatttttattatgcagttgtaaaacaccaaaaatatagattcatcttgatatgtaacactaagtgtattttgtacagcatctgatttgaaaggtgccttatgaagtttaccattaattgctttgttctatatacagattatgtccaatgtatcatttttcagtaaataaccttattttagtatacttcagtgatgtgttttgtgatgctgttcttggatttattgtgtatcagacgtcaactgttgagattttgtacgtaatgtaagtgtgcatccctacgctgctgcgcttgcatttcggcttctggaaagtcctggagcatggccaggtaagtgacgcatgcttttccttcatgtagatgcccaacccaccttaatgaggggattgttttttccttttatacaaagaaaaaaaaaagccacattgttttctggttataaaaatgtgtgtttatgacagaacattgggaaacaagaaaagaataagcaaataaactgctccattttattgccagataccactattgacattggaaagtttctccttttttttttttcccccgtaacattaagattgtggtat

SEQ ID NO: 22610 - DNA, 5257 bp, Mus musculus
ttttttttttttttttttttttagttgcttccaaatctagtcaaaatgacaatggaaaaataaccatcagagatgttttataacaaaatacaataccttgtatcggttccactggaaagtggtttccagaccctcccagtcagtaacaaaacattcatgtcttcaagtctaaaaatcagtgcaaacctcagaaaactaaaaagtcagccaagtgtggtggtgcacgcctttaatcccagctcttgggaggcaggggcaggcagatttctgagttcgaggccagcctggtctacaaagtgagttccaggacagccagggctacacagagaaaccctgtctcaaaaaaacaaacaaaaaaagaaaaagaaagaaagaaagcaagcaagcaagaaagagaaaacttaaaaagtcatttattactgattgactattttatagatattactttgtttataatataagtaaattaaattggatccatgagaaataaattttttttgagaaatcaattttaattctacatcttttttgttttttgggttttttggtttttttggttttttttttgagaaataaattttaattctgcatctttttttgtttttttgtttttttgggttttgttgttgttgttgttgttgttgttgttgttttggtttttcgagacagggtttctctgtattgccctggctgtcctggaactcattttgtagaccaggttggcctcgaactcagaaatccgcctgcctctgcctcccaagtgctgggattaaagacgtgttccactactgcccggcttaattctgcatctttaatgttaagatgattgtataagaatggtaaaaataaattatttttcttttatttttatactcctttctcagatataattgtctgcaattgtacttttcttatataaaatattgtcatcttttttaaagataggatcatatgtagcccaggctggactagaaccaactattcagccaagattgaccttgaaattctgatcatcctgtccctacatcatcagtgcttagtgttaggatgccaggcatggatcaccatgctggatttatgtggtgctgagaatggaactctgggcctcctgtatatgtacaaaaaaccactgtgccagctgagccacaccctaggccagtgttgttatcttttgatgaaaacagagcttctttggtgacagagcctcagctgaatttatgaaaggtatttgtgttaatccagtttagtgtgaaaaagttagtgatttgttgcagacatggtaccaaggctcagaacagttgtcccagatcctgcttgggatattagtgtacgcagcatataaaaactataaaggtgtttaacttcataagaatgtacagagatgaaatattgtttggtcctcaacctgactgttgtcttccccctgtcttagtgatacaaatgaagttgacatacccttgaataccagggtgggcaccaagcggtacatggctccagaagtgctggatgaaagcctgaataaaaaccatttccagccctacatcatggctgacatctatagctttggtttgatcatttgggaaatggctcgtcgttgtattacaggaggtaggaatttgaaaagtgtttctgattgtatttacttgtcatttaaaaaataattacctaatttgtgtcacctgggtcagggtttctcaggaccactctcagatcctctggtttcatcagaatggttgtctaaggggaaaagtgtcaagagcaaagctcagaaaatccaagacaggtgtccaacagccttctccagtgtattcagaggtcatgcttcgttcctccctcagtcggctgtgaccgagactcggtctgctgagcacgcacgtttgcgtttgtgctgtggcatgggctagagccccatcctctcaaggaagtaggttcagcagagcagcggggtttgcaccgaccgccagccagagacagtgctcggggactcccaggtccctgctttgtgagcttgcccagtctctctcccagcagagagccatagatattctctagtaggaacaaagaagtaaatttgcactaaaagttttttttaattaaaaataatcttatttctactcatttcctttgtttttaagtgtttcgtttcttgtagcccaggctggcttcagttcacagtcctcttgcctcagagtgttctaccctcaaaagaaacactgtcattgcgatagactttcattctgtcagaggtagggaaagtaatgggtcataaataatagagaaacatatttactattattcagattgtgtttcttctttatataggaaccattcttagttccacaattcagtgagaaatgctgtatgtcaactgagagtagtcctactaccatggatttgctcactgtgttttctcactccctgcaggaatcgtggaggaatatcaattaccatattacaacatggtgcccagtgacccatcctatgaggacatgcgtgaggttgtgtgtgtgaaacgcttgcggccaatcgtgtctaaccgctggaacagcgatgaagtaagttggagccaagtccctgtaaagtgatgagtgagtgccgagttactctgtgctcaccacactctgtttgcatttatttctctttagtgtcttcgagcagttttgaagctaatgtcagaatgttgggcccataatccagcctccagactcacagctttgagaatcaagaagacacttgcaaaaatggttgaatcccaggatgtaaagatttgacaattaaacaattttgagggagaatttagactgcaagaacttcttcacccaaggaatgggtgggattagcatggaataggatgttgacttggtttccagactccttcctctacatcttcacaggctgctaacagtaaaccttaccgtactctacagaatacaagattggaacttggaacttcaaacatgtcattctttatatatggacagctttgttttaaatgtggggtttttttgttttgctttttttgttttgttttggttttgatgcttttttggtttttatgaactgcatcaagactccaatcctgataagaagtctctggtcaacctctgggtactcactatcctgtccataaagtggtgctttctgtgaaagccttaagaaaattaatgagctcagcagagatggaaaaaggcatatttgccttctaccagagaaaacatctgtctgtgttctgtctttgtaaacagcctatagattatgatctctttgggatactgcctggtttatgatggtgcaccatacctttgatatgcataccagaattctctgctgccctagggcttagaagacaagaatgtaaaggttgcacaggaaggtatttgtggccagtggtttaaatatgcaatatctagttgacaatcgccaatttcataaaagccatccaccttgtaactgtagtaacttctccactgactttatttttagcataatagttgtgaaggccaaactccatgtaaagtgtccatagacttggactgttttcccccagtcaccattttgttctccttttggtaattatttttgttataaaaagccacctatccagaattggagctctctgtcttgaaccatactttgaaagaaacgcctcttccgtactgcatctgatcacaatgtgcatacctatgatcaaattctggagtctttgttctcggtacctcctaaaaaggaaagttgattcttgtgtaacatgcttttattttcagaacctgcacagctgtcattctagccatgttttacctacacactcagttctatacaagacagcccatacactctgtctcacatctgatccttggtgggaagtgttttaaagtagaactatgtatgaatttcagaattcatgcattttaaaacttcactaagatattgtctcatatctttatgagaatgtcagctgacttttcaactaacagtaaatgtattttagatatctaaatcttttgaaatttggttttacaatttctggtccctaattgtgaagacaagaggcagaagtacccagtcactacccatatttacactgaacgttattaaataaaatgatgtgtattttattataaaataaatataggccttgttatctcaaaaaacagatctggttcaaacttattataccaatatcatactatttaaatgttctaagtaaacaagccatgtgagcatcaagtggcattggctctttggatgaaacataaacttaaggtgattgtatcaacacatagagtgactgaaattaaatgggaggcaggtagagcatatgtccatctgtccacctacaggcatgactaaactacagctcatattccacaaatttgagatttgtcttgcctggtttgtttagtgagtctcatctgatgtacctaaagcctgagagtactgaggtctgattttatatctttcctgaataaactaaatcttttttgtcacttatcatcttaatgatatacctaaggaataattctttggcatgtttcagttgtgtgtggcagccactgtaatgactcttctctaagaaaggctgtcaggagttaattataaggcaggcagtgagcgctctagtcactgccttcccacgctgccatcactgcattcatgggaatcagtgacgttctcgaaatggcaaacgctgctgcttttccttatttggaatcctaaaatcaaaagttgcattaaacttactgtgttctcttctccctctcagccataaatgtaaaattcagtaagtaaaaatatttaaagagtgtatcagccctttggccagtgagatagctcagtagataaaggcatttgctgccaagtcctcaacctcaattcagactctgggggacacatggcgaagggaggagccaactaccccatcattgtcctctgacttccacacactccatggcttgcgcccctccccacagacacacaccatgtactccacaaaagtagtttaaaggaaaaaaagaatagaacccactgtgtaatggaataagtattatgtagttacttaacaacttgtaaaaatctggaaactatgatttggttcccctttgaatctagagtttaaaaaacagatggctaaaatcagccatcatttaaataattaaaaataaaagccccaaaccccaaactgcctaaataaataccaagtaatccaggaagccgtcatgtgtggtttgtatgaccagtagttctctggtacagagca

SEQ ID NO: 22611 - DNA, 1233 bp, Mus musculus
ggtggctcacaaccatctgtaacaagatctgacgccctcttctggagtgtctgaagacagctacagtgtacttacatagagtaaataattaaattaaaaaaaaaaaaaaaaaaaagattattttatactactgttcagatagccctgctatttgttaatttgcatagtgatgacatttatgtttttaaccggacatatttttcatttttgtagataaagtggagaattttagtgaagaacatgaaaaaaatagtcaccactttcacaaaaatgctgaagatagtactaagaaacccaatgcagaaaccgcagtggcttctgaatataaagctgatgaaactaaagaaacaaatgatacttggaactcccagtctggaaaaagaacagagtctccatctgaaagttgtccagtcaaaggatctgtaagaactggtttatatgaatgggataatgattttgaagatatcaggtcagaagactgtattttaagtttggataatgagtctcttttggagatgaaagacgaggatttaaaaaatcggattggaggattggaaaatctaaatgaaacctttgaagaagatatcatacaaagtgttcttaggccaagcaactgtaggacgtactgtagggccaataaagcgagatcctcacagggagcatcaaattttgataagctaatggatggcaccagtcagtccttagccaaagcaaacagtgaatcaagtaaagatggcctgaatcaggcaaagaaaggtagtgcaagttgtgggaccagttttcgaggaacagttggacggactagagattacactgttttacatccatcttgcttgtcagtgtgtaatgttaccatccaggatactatggaacggagtatggatgagttcaccgcatccactcctgcagatttaggagaggctggccggctcagaaaaaaggcagatattgcaacctccaagaccactactagatttcgacctagtaatactaaatccaaaaaggatgttaaacttgaattttttggttttgaagatcatgatgagacaggaggtgatgaagggggttctggaagttctaattacaaaattaaatattttggctttgacgatctcagcgaaagtgaagatgatgatgatgacgactgtcaagtggaaagaaagaaagacaaaaaaagaactaaaacagctccatcaccttcccagcagcctcctcctgaaagcagcgacaatt

SEQ ID NO: 22612 - DNA, 1165 bp, Mus musculus
tgagacttaactccatttgtcaggctggtactactagaacttgtattcaatgagatatttctttatccccaaggaagtactttataacaaacaaaaaaaaggttcacagtgctgaaatttgttaccattactttaggaagttagactcccattaagtgatgatttgttattagtctaaataatttatgaatttatgcaatgaccttattaggttttctgggtaatgtgtatagtgtagatgaaacataaactctctgtttttatgttcctcttagaaaactgttgtatatagtctgtgtgtgttggcaattttaagtcttttttttcttctggttaattggtttcacagaagagtagttactggttctgtgctaaaaaccaaagtgattatgtccagcataggcatggtaatagcactcactgtttttggtctaagaatgtgtgtttatgcatttcagttattttatataaatgagacctttttgtaagggatacaaagtgaaatggaagcagttgattttttttttctttgtcatttcactagtcacctacaaaagctgtatataatgccaggcattggaaccatccagactcggaagaattgcctggaccaccaatagcaaaacctcagcgtgtcacagtaagtaaatattttttctttctcttaaaataaattagaaattaatctagatagctattatcttaatttttgttcttacaagattataatggaaagctttacaaattaaaactttgtagtagctcaaggccaatgtaggttttatactgagacccaatctcagaaactaaacaacaaaaaaaccaaaccagagcttttaatcatgactcatgttttatagaatttatagtatttagggcttaagaaaaattattccttatatgaagtgttagtactgatatgtgtgtgtggtattatgtatgtttttgttttgttttggtttttgtttggttttttcgagacagggtttctctgtgtagccctggctgtcctggaactcactttgtagaccaggctggcttcgaactcagaaatccgcctgccactgcctcccaagtgctgggattaaaggcgtgtgccaccacacccggctttatgtgtgtatttttgtgagtgtgtgtacaggtgtgtatgtactcagtagag

SEQ ID NO: 22613 - DNA, 2839 bp, Mus musculus
tatctgctttctccttttattccagctgtgcttctaggctgtgggatgatgccacccacaaacagaaaactattgtggcagaatgttatattactaaggcaatgatttaatttcagtgtactctttactacgtagactttgatacttttttttgtttaccattttgttaagtattaactctaatttctctccttcccctcttagtgtgctgttggaacaacaggccagaagtctatctctagagtgattgaatatttggaacattgctagctgctttacctttgcttcaggtgcttggtaatgctgaagctatccttagacaaagaaaagacatgaaagaagtccttgaagatataccaagaacattcatcagtatcattcattcgtgtttggatttttatgatcacccgatttcttcatcatgcattctgcgtttgctaaatgacagttactacatcaatctgcagctatcaaaaatgagggaaaaggttcaggctgttaacaatcccatgcagtatttaaatacacttacttggcagagtctatacctgcccctgtttccttgctgtatttcaggcaaggtttaaagagggcaatttgtgctgctgttagtgcaactgctgtgtatgttgagccactgttgtcatgccagtcaggtgcaaaggcagcttagctactgaggtattgaatgttctgaggacattctagacaacagcttagatcctttttcaggctcatttgcttttgctttttgttgaatgattccaatcgtaaataaagcttttaataattttgtgaattttttggttgttgttccctgaactactgtctatatttaaaatgagatggaatccaaagacacaagggattaatagtatatttttttattcttgattaggtttgggtgttgaactatttttcacttctgagaccatgaccatattcaatgtcataccattatgtgtcatagctataggcacaagaaaacaaatagcagtttgagggaatattatgttatataagataatgtgccctgttaaaggattaagcaaaaatagacaaacccagggtagtttacacttaatgctggggaggctcttgaaacattgttacgttttgagggacgttctctagatatattttctaatgttcagttcagtaaatataataaggaagctaaaacaccaatgtggaatccgtttttccagatagcgtgtatattcttctatagagtgacaggatcaattgcataagcgcaaagccttaaaattgctggtgtagagaagacccttttttattcagattctatgttcatagagcaattgtttagaaaatggttgtggaacacacagaacatggtttatagggtaaatttcatagattgttttttctttttttttttttcttttttttttttgtattgttcagaccactggttatacattttctcctttttttattaattggcctgaggacaggctttccagagatgtttcattaatacttttaattacctttcagatagttacatcatgtttcttcattggatttgtaaaacttaaagccataaaaatattagtttggtgtgtattggggaaaatagctaaaagtctaactttgactcattttagactttgttatttccttgtataaagtaacaaaccggggctcttgtatccgtgccagctgtaatgtttttaaatgcagtggctgccttctattgtcttcctatttttgataatgcagattgttgggaaatctataaggaagtaactgactctaggcaaattgttttcttcctcctacccgcccaaccccctacccgtccgtcaccttttaggaacacagtatgccagtgtaatgtgggaaccattgagactgtatttgccctgagtaccaaactaatttagtgaatttttttttaaacatactggtaaatgatgtccacaaatttccttagatatattttaattaattgtcttaaaatacattgatatttattaatcattggatttggggacagatttttgactgtggcagatggtagggaacagaacagtaaacagttggatgagatcaatcagggcgaattacatttttctgttacactggtgatcatttgagaattgatttacctcagtgtttaacagtttttgttttgtttttaaaatactaactaattgtcaagcactgatgagatgcaggtttggtggggtgggctgtgaggaagacctcaccttaccaactgcagtgcgtctctgtgttttagcctcagagaactctcattctagggtacttgaggctgacttgcaaagtgactaaagttttaaggtaaccttttttccattgtaaatacttctgtaaatactaccagttggatattagaacagtaggatacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgatactttaaatacacacgttgtctttaacataagtctattgacctgttttggaggaagaagtctcagaacttgttaaggccagcacaccgtgtcatttgagcataagtgtccaatttttcttaaatattttatatacttgtaagtactggtctgaatggatgtagccgcttagcactttgggctggttagggatggtggttttctgagtgtatagttaaatccttagaatgccctctatgttacttgaaaacttttggctttctgaatatgacggtaaatttctttgctt

SEQ ID NO: 22614 - DNA, 1105 bp, Mus musculus
ggagatggaaggtgatcaatatgcctgggtggtgatgcctttgtccttcccatccttgggatgtagtgtatgtctttttgtaaatgctcctagcgattgtaaacagtttataagatggctgagcagaatgtgagaagatgttaaacgaggagggaatcggtcctgtcctccaggaagatgtcacaggaaccagctgtgggatattacctctgggctcctctgaagtctcagttcttctctacctaggctctagccccctgttactgacaattgttcttgagatctgaggctctgaacattgagtcctgtagtagagcctccttcagtgatacatggagaatcaagccatggctactgaactgagggaaacataagagcccagaggctgtggttacctccaatcaggttgaagtggatgcactaaggacttgccttgctgcatcctctggcctctgacctcagggcagcctcaggaggcagagtagtggctctgtctggacctcctttcctggcactgtcttctatgtaggatacaaggtgcagaggactgtggtcttcttgttgacctttggctattgcttttgtcttcctcccttgaccttgtggactggttttgaattgcactatgggcctgaagctcactgaatcacctaggctaggctgggtggccagcgagccccagggatcagctggtctctgtctcccaaacctggggttacaattgtgcatactatacccagctttccccccattaattaattattatccactttatatcccaatcacagtgtcccctcttcccagtgtcccctataatcctttccccatccttctctccccttctcctttgagaagggggaggccttctactgaataccaatccatggtggcataccaagtcactgtaggactaggtacatcctctcccactgaggccagatgaggcagcacagttagaggaccaggatccacaggcaggtgagagacagggacagcactctcaccagttgttagggggcctgcatgaagaccaggctgcatttctgctacatgtgtgtgcagggggcctaggtccagtccacatatgctctttgtttagagttca

SEQ ID NO: 22615 - DNA, 1144 bp, Mus musculus
tatctcattagatgttgaaaaagcctttgacaaaatctaatatatgttcatgataaacatcttggagaaattagaattgtccacagtcagaaatggtgatcttattgctggtcttgccattcctgaacccaaaactttccatggcttccataatgttcatgacttctttcattttcccaaagaccatatgcttgccatccagccattcagtcttggcagtacagatgaaaagctaagaaccattcatatttgctccagtatttgccatgcacaagatgccaggacctatatgcttcaggatgaagttttcatcctcaaatttctctccatagctggacctgctaccagtgtcattatggcatgtgaagtcaccaccctggcacatgaatcctgaaataattatgtgaaaggaggaatccttatagccaaatcctttctctccagtgatcagagcatgaaagttttctgctgtctttctaattttgtctgcaaacagctcaaaagagactcagccgaagggcttgtcatcgagccttgtggacattttacccatcaaaccattctttctgtagcttaggggagcacctttaccccatctgctcgcaatgtcctgtaatctctgctctcactgaagttctttgggttccatattttcttcattccccctcaagtctagctggatttcgaagttaagattatgattacgaataaaaactaagacctattttaaaaaatcttggagagatcagggaaacaaggcacatatctaaacataataacatacagcaaattaaatcaagttacagccaacatcaaattaaatgaaaggaaacctaaagcaattccactaaaatcagggacaagacaagactgttcacttcctccgtgtttattcaatatcgtacttgaaattttagctagaacaagaagaaaactaaagaaaatcaaggggatacaaattggaaatgaaaaagtcaaaatagtgctatttgcagataatatgatagtatacatttgaccccctataaattctaccaggaactcctacacctgataaataccttcagcaaagtgagtggatacaaaattaactcaaaaacaaaacaaacaaacaacaataacagaagaagaaaatacaaaagta

SEQ ID NO: 22616 - DNA, 1202 bp, Mus musculus
tacataccatttgcacatacttgtctcaggtaaacacaagtttacttatccatctcagaggcccaagtccctcctcatgctatccagccttctctctacataccagaaaagtcaaaatattccatgtatcaggcaggatgtgtacttggctgatgtagtcctgttgtggttatcagaatctcaccccgatgcttattcttcttgtgagtatggctgctattttaactaaagattcaaagtgacggtggaaggtagctgtctgtaagcagggttctggccaggttttgtgtatttaggaagtctatgcaaaaggtccccagtgaggaaagaccaggcttttagtgggggagtccttagtagtttcatctctcctttctaggatcagtaatctagtcctactgcttctccatttatcagacaaattcccatgctgacagttgtcatattttatgtaaaccagttatatgttgctgtaacatcttgttttacgtacacatttactctttgcttatattgctactgggtagatttggagagctggagatgcctatggcatatcagttgtaaactctgttggtgctagagttttgtgctggtaattgagttttgaatcttattaacttatggatccatcatactttcaagtttccataacatacattggaaatttaaaattataataatatttgtatttattgactttttcctagtgtctgaagactagaataatggacttgaaatatttgcacaaaattttgatgagatataaaagagggttttaaagcttattttctataaaaaatgagttaaaacactttaagagaaatatataaatttaagactatcataagtcactttttgggtttcctaagtttctcttttctgttggtggaaggttgaatgacagtttcttgaaaagtagatttgggggaaattaagttgtaggtaggaaagaatactttcttaagagagattgctccagatgtcctatggaaggtagctgtgggttaagagagattgttctagatgtggctgtgggcctccaagtgaccatgtacaggaacccagctgggcttctggcaacttcacaagcagttgagtgaatttacctcatgtttgcccaaatcatgccatctttaggctggtcataatttgtttaattcatagtaagatttctcagaaagataaccttacaagatcag

SEQ ID NO: 22617 - DNA, 1205 bp, Mus musculus
catcttaaaaggtttctcatacctgatactgggttttcattagacatggctcttgcaggggctgttaatcactccaagtggtacaacttaatttaaactacataatgtatgtatacatgtgtacttatatatattatacataattttaggtaaatatgaaatgattattttctgtcattttcaaacgtgattaatgttattttccctcctcctccttacttctgtattatcctccctttcctctcctgagttaaaaattctttcttgtttttctcatttccccctttatatcacctgcatcctgctatttccccctctaggtggggacatccaaaattcaaaatatagtacatatgaattttttaaaaaagttttaaaaattaaaactactttattcttgcagtacagaagataaatctaagttattatgtgatgatactttcaaaataaatgcctatataagttataggtatccagatgaggtcatggtactcttactccttgtgttcacaggatattctgaataaccttgagtcgtgtgaccttgaggatgatgaccttatgttggatgtggatttgccggaggacgcacctcttgaaaatggtaagtgatggtcagtggtaagtctccagatgcatgcctgcaaatggctgcattgtagcagcttcttaatctcactggaaccgttagagggagaatcagcctttactggcgtgagataggtttacttgaatgttacatgtttaaaacctgattatgtttgtcttaaatataattctgtatgattcaacaactttctacacctttatcaaaacaaacggtagtgtatgtatgtgtgtttaacaacccagttttccctcactcttctttattttgaatttcaaaagaaatatatgtagagaagcatttgtacagtaaagcggtataatatatctggtaactattttaaggtcagctctgggaaagcactcaccttctgactgagccatacattaccttttgactcctctgtaccgataggtggttaatctgctctaatctccctggtggtggctgcttgagttccttgctgcccacccagatgctctggattcttgaatgaaagacacacacacacatacatacacacagccttatatctaatatgcctaaatcagctgaatggctgggccactcccacacttccacgttgctaacgcctccc

SEQ ID NO: 22618 - DNA, 2109 bp, Mus musculus
ccgttcagtcttctttggtgtctgagctcaagcaaaagtttgagaagaagagtttagacaacaaggcctatatctagagtgtgtcccatgatttttctcttctcttcccccaattctgaccctcaaggtcacccctattttgtataatgttgtaacactatatgcaggactctacaaagggctttgggcaagagatgcctcagactgtgagatgcagttggcaaatacatacccactgcccaaatccttgacacatctataatgctctctattcttcagagaatagaagtccacaaggagtcaagtctgtgtatttctacccaccaactctagaccccacaatcactggagtcctcctggggccttgtcatctttagttgagaagtagggcccctggccacaagtaacaagagtggcaagaatctggatccccaagcttcagccaaccaacaggttaatggaggtttgttctcagctgaagttgaaagtcagtgagctttgtaggatgtagcgatacaaacaggtaagaaaagggccaaaatgctctgaaagctcatgttgactgtgcccaaagccactgagctatagaattagcatctagataagactatgctcctgatggtaggtgtaaggtgacctcttcctagacagagagcagaaatctccagcctcccttgaagagacaaggcgaggtggatatcaagcttgagcttagggaaggctcccattctgatccagctcttctcatatcacgtgttcttggagatactgttaacatcgtattgtcttcttccttgtctgtaagatgaagaaagaaaaccccaggaaaatggtgagtctgggggttttaagcaagtgcaaagcattaggattacaaagtatttgttggaagccagtaatctggctccatctcattcagaaagtgttagcacccaggaaggactatgatgaggttgggaacagccagcctgataatggctttccctcaactcacataagttttcttctgttcgccactctccaccatgtatgtcattgtcacaaagaaccagagtcaggcagtaagctccagtccaagtctgtttggctgagacagggaaatgactctctagggttattgactccatgcatgcagtgaattggtggcagggatctggtctgagagccccccattccacactgttgactgtttttctcttcttgggatttatcttgttcatatgtaataatcttgaggagggatatcctgcaaagcagaggattttggtgttcttttgagaaaacattaaggatatcatatgtatactctatgaagccctctagaattccagagttactgatgtggtcagattgtatgaacatgtggttttcttgctcaccccccttaccgcccccagtctgtgtttggaggcgttacatagacatacgagcattcagagtcctcatctggaggtctgtagtctctggcccacgtagtattgagggacaggacctaacctgctaaagtccagcctggaaagtgctgagctggatcatgtttgccaccacagggagttcagcatcctataatatgcatgctgttaacctcttctgtaaatggtaaataaaatctattattcaaaggataaactgacctcccggtcctcttgtatttatgtatccttgacttacagctcattcagtgggtgatgttgctcctgacctccattctgacactgagggattttgcaacattttgtctaaattgtctgcctacatcttcattactgtaccattgcagaccttgtttgttcaggacttaaattctactttttccccccaatcaagaagagtccagttgcgattgcttggaggaagaaataggtctggagcatggactaatgactcgtaggaaaatccagcaggaataggatttgtaaggccttgagtgtgtgcgacagccagaaaagcagttcatctttgggaacggggagtgaagacctctggactggaaattccgctcagcactgtagtccttagcaggatggtggggctttatggacaaactcaagaacttgatccaaggaaaaccactgaccatggaaggggaaagggcctagtaggaaacat

SEQ ID NO: 22619 - DNA, 1417 bp, Mus musculus
agtattgttttatgtattggataagtaaaatttagcaaatttgcgtgtcttcatattgtggaagcctgcagaatatttcagtggcatcatgagtgacaagtttttgtatagaggtcagagagataaaaggcacctgcagtcagtttgaatgcccaggacaacactgattgtggtgagccagtgaaagacatcagagatgtggaacaagggaccaccaaatgtggggttaacaaagacacggatgtttcttctgtgctcttaatgtccttgaggttgactgctcattgtcaggacagtccagagtgttaaccatacagagaatctctgctggaattatgtctgtgttttactatgaagtctttagaacaagcaggttggtggtggcgcacacctttagtcccatcatctgggaggcagaggcaagcagatctctaaattcaaggccagccaggtctacaaagtgagttccaagccagacaaggacctgtctctaatacaagcaaacaaacaacaacaaacactacccgctatgctcggtatgatgtactactccaaagctcaagactcctttgctgtcagatgtgtggtgtatatgcagttggacaggatttaggttttggtttttggttttgttttattttgatatttttctcagtgtctaattgaaagcatgcttgctttctcatcacagctttgacagctgtcagaaaagcctctttgtggcttatgctaagattaggattggtttttcttctaaaactgttggcttcctccgttccctctcagcttaagcatgaacaaagcaaacttagttgaccttgggaagtatttgaatgaaaactggaatggggaggtgctcagcttccttgtgacataagattttaatacagatcacttgtttgtggtgaggggttcttcattgaagtctgtatgtatttacaaaataactatttttgagaagtatttattacagtaatccataagtaattcttttaatcactttaaagtacactgaatgctaatttctgaaataaaagtttcagctaagtggctattgctgtacttttttctccctgatacgtccagtccatctcagcagagtctcggatacgaaagcagcttgagcttttcctgtgcctgcattcctgcagtctgctaagacaggagaccagtgactagatggccggcctccatttgcatcttgactgattcttatatgatcctagacaaatgacctaaccttccctcacctgtaagatggagacaacatcctcctgtggagtgaatgcagacatgactgggcattgtgtgaattttagctgttgctgttcggtttttgtttttgttttcccctgcagtaaaaaaaactctaagtgtctaatttctgtctttagtctccataaagtttcactgtcaa

SEQ ID NO: 22620 - DNA, 1203 bp, Mus musculus
tgaaggtttttatttattttattttattttattttattttattgtgtgtgtgtgtgtgtgtgaaggctactgaaatgcctcagtggaaaataatttattacaataagagacatgtctcttttatttttggttaggagcctgacctttagtgcttgagccatcttttcagcccaagaggttatttcttggtatccatgaaagagcaccctcctacaacttttgatagaatcaaaccaagaatacttccagtgttgcacaaaggaatacacaagcaaagtgaaagtagatcggtatagcaaactatttttgttaataaataaaaaagtatgtgtgatggtttatatgtgtttgttccagggagtggtactattaggaggtgtagccttgttcgaatagatgtgtcaccgtgggcatgggctttgataccctagtcctagctgcctggaagtcagtattctgctgctgcctttagatgaagatgtagaactctcagctcctcctgcaccatgccggcctgtatggtgccatgctctcactttgatgctaatggactgaacctctgaacctgtaagccagccccaattaaatgttgtccttataaaagttgccttggtcatggtgtcagttcacagaagtaaaaccctaactaagtgtgcaacaacctaaagcaggatatcgagcatatctggcaggaagttcacttgctttttactcacaccaggatgactctctctgttccccattgactggggagccaccttacaacctttatgattaactagttttaaaagaatttgtgcaaagaaatggagaaaaatgagaaggtaacagccttttaattcacccaaattcttgattacttcagggcttttgcataaacaacagttttatccagtggtgtgatggtgaggcattaaaacatttgcctaaaggtattacaagaaatgtgagtgggagcctgataaaaacgtttgcatcaaagtcttacaaggtggactggagagatggctcacaggttaagagcactgtctgcttttccagaggttctgagttcaattcccagcaaccacatggtggctcacagtcatctgtaatgagatatggtgccctcttttggcctgcaggcatacatgcaggcagaacgctgtatacacagtaaatcttttttttttttaagtcttactgaaaggaaataaaactgta

SEQ ID NO: 22621 - DNA, 1134 bp, Mus musculus
tttagtcagccagctttcttatctgactctgcacctggcatgctagaatagtttggaaagtctcttcagaggggggaagggctgggtggtcttgaatttattttggatcctacattaggatcctagtgcctgagagcatggaaaacttccttttgttccttgcagagttttctgctgggtctctgggggtataaacctagctcaaccaaaaaataggctgtgtttcacagttccacacccacatacctatggtcatttgatctttgacaactgtagtggctattcctggttgtcaacttgacaatatttggaatgaactgcaatccggaattggaaggctcaccagtgacccttatctggaggcttggagatccttatctggatcttggtttgaagatcttgagccatagtggctatggattccagaagattgaatctctgagtttaaggaacacacctttaatctgggctacaccttctactggagacaatataaggacattggaagaagggagtctagctcttgctcttgctccttcgcctgcttgctgcgtgagaccgagtaactgctagatccttggacttccattcacagctgcgactgaaccattgttgggaattgggctgccgactgtaagtcatcaataaattcctttactatctagagactgtccataagttctgtgactctagagaaccctgactaatacaacaacgatgttaaaaatattgagtagaaaaaggacagcattttcaacaaatggttctggtacagctggcagttagattgtagaagtatgcaaatcaatccattcttatctccttgaactaagctcaaggccaagtggatcaaagacctcttcataaaaccagatacactgagactaatagaaaagaaagtggagaagagtcgcaaatacataggcacaggggaaatttctctgaacagaacactaatatcttatgctccaagatcaagaattgaccaatggaacctcataaaattacaaagcttctgtaagacaaaggatactgtcaataaaaaaaaaaaaggcaaccaacagtctgggaaatgatctttaccaatcctaaatccgatagggggctaattttatatatatatctcaagaagtt

SEQ ID NO: 22622 - DNA, 1099 bp, Mus musculus
gtgaaaagtatgttttctgttacccgaagacaactacagttaaggatccttccagaaagtgtctttggatctttatccaaatgggagtcttttttttctttcttttattttgggggggggggtcagttttctgtagttctttttatgtattgatcaggtacgttcacttggttaagccacacaagtaagtggccgttgctctccaggggattatgtttgcagttccaggtaatagaaaaccctattaacccaacctgaacaatgagtggagggttttagctcctgaaactggaaagtccagaggcagcgcgagtttcagggttgctgtgatccaagtgactcagtgaggtcagcaggatctggtttcctgttcgctgtctgccagtgtcttcatcgtcggagattgggggtgggggtgaggaggggggctccacttgagactgcctctagcctccgtgatgggtcatcacggtagtgaggtcaaggagggtcagcctgcctccatgtctgctccttctgcttcacgcacatgttaggaaatgaccttccctgtaggatgctgggaacgctgcggtgtgagtttcccggtatcctcctgtgggctttgctcttacagtgtttatttaataaataaacacacagatttcaaaacaaaacacagaaggtgcctcagtatgggctggggagatggtgctgtgtgtaaagggactttttgggtaaagggacccgcatttgcatgaatgtctgcaatcccgctgtccctaccgagacaggcaaggtgtagacagggatatcccaggaggcttgggagtcagctagtctggcctgttcagtagaagaacaaagagaccctctctcaaggtggaagtggaggaccaacaccagcggttgtcttctgacgttcatgtacgtggtatgccatgcccacatgctgagtcacacagaaggatgtgaccctgttgtacctgagtcacgcacaaagggaacaaacagaaactgcagagcttcttatccgggtcgcttagtcacttaagaggatttagatatttgtttttttccctaaattgaattctccaggaagaatggatggttatgggtg

SEQ ID NO: 22623 - DNA, 1476 bp, Mus musculus
ttccaggaatggaggaagtgctcagggtacataagttaataaactcatttggttcacagagcagttccgagaaagccatattcatgaccaaagcataaatttcagagaaagatagctccttgccacccttgcatcccctcagtgtagcttctgcccagtgactagcctaggtacagccccattccctgagggtgttccaagaagctcctggggctatggagggctgcagccatttggcaaaggtggagtgtagatcctcttctctagctggattggatacttgatgggaaagttacccacaatgagtaggggcactgccctggcttgcagctctggcaatgggcagtgggttcatttttctaagacccaaattcaggtagtactgtgttcagtcagcaaactgctctctgatctgtgtgaagcactagtttccccaaagcacagttgttgggaaaggccagagttgtcagtcacatggaagctcttggatgggttttctatgctgaacagtgcaggatcagacacttccttcttttaagagacatgttggaggcctctgaggcagcatgtcggctgctcctgttagaaggctcctctgcagagggaggaagcctcagtgtctgcatgagggacgaccacttgattgcttcccggctcatagcgtcagacatgccagaattggtttaacttccccagctctgacaagaaagaatgtacatgaccgtggctggacttttgttccagtattacgtttctctgtgtccctgagactcttgggtaccacgttgttagcctggaactttgggaatagcccaccgccccgttgtgatcttcgtggaggtgcttgtgttgaacgtgcccagggtgggtggcggtggcaaactttgtgagctgagcttattcatgtagcgtgtaaaagtgcccgtcctcctcaaagcaaggtaaagggatcgccctttggtcagttactcttggtgtctccagggacctcctggaaaatgtcagatgagtattataaaatgggctgggggtgggtggggagggcaagaaaaatggcttaggaattaagagcatttgttgctcttccagaggaggggtttagctcccagcacacacagggtagctcacaaccgcttgtaactccagcaccctcttgggaactgtgggcactatgcacacatgaatcgtgcaattacagaggctgtgggcactatgcacacatgaatcgtgcaattacagaggcaagcaaattgcccatatatacataataaataaatcttttttaaaaagaggcaaaatcctgggagagctttaggagattgttaagggatgtctgtgggggatgctcgcttcggagtgagaggacacagctactccctacagagctctgagaattatttcttcacttggctttcttctatattctgtgcctcatttcccagcaggggcttcaaaaacatagcttaatgactacca

SEQ ID NO: 22624 - DNA, 1382 bp, Mus musculus
tcgtttctccatagcattaagccctactgagggccagctctcctgttcttatagtgtgtaaatagtttatttataggggtaagagtgttccttcaccatatcttcatagcctcttccgtctggcattcttttctcagcagccttacccagtgtctgggaccaagctgtccttttcagttccccgagtgtcttaagaaccagctgtgacagcttctccctctggttcacatcccctccatgcgcccctgcttggcttccctgtcttctggtctcggtgctactgaaatggccaccagaacttgaatcctgactgaccctttctccttccccgctgccctccagggagccccagctcctgattgccagctggaaactgggttcctctcacgaccacatacagctagtggcccaaagtatgctgtccctggagggcaacgctcctgcagccaggccctggcaagcacagacagctggtgctgtgtggaatgctcagtgcatcttatctctaacttccgtggtgactcccccacccacatgccgtgttcactgtcagcactgttctgaggctgctcttgaaaatgatgtctgtcttacgtactggatactccgaggcatgctggcgtctgtccacctggggctgggctactctctagtgcttctttataacttgtatctgtccttaccgttcagggattgagtactaccttcagttacttgccgaagtgtacattctagtgtggtgtatactggtgatactggtgggggtgtgttcatgatgatgatgatgttataattttctaaataattctctatagactagaggaagaagaatgcttgtgtttttaggaagtgtgcagcttctctttgacctgccaaactcttttatggaatatatctttatattaatgctgttgtttgggtcttttttttttttttcctttctggtttgcaatcactattaaaacaaaaaagcattaagcattttggtgataaattgagccactgagtcaggtgtgactggtgtacaggaacccagtggttgaggcaagccatcgtttgcacattctgacaaattccatgtatcctccacattctccctgcagttgaaactaggtggcttacagctttgccattcttggctgtaagcatcagctgcgtaactttcctctccaggactcaaggaaggattattctcagttaattttggtctagccttggcagtattgcccatccaggcaaaagttcatggttccagacaggacactgttgcttgcacgagctgtagacttgctggtgatctatagtaggtggggtggatggtcattggccctgctggaggccatggagagtagacactccctgctggcgtgttgacaccaatg

SEQ ID NO: 22625 - DNA, 1118 bp, Mus musculus
aaccgtttcttaagcttgagtattatagtctaatctcctgctttagaacaagtgcagattggagtgcagaaacaggaagatgtgattagaaggtgccacgtaagccagaagtgagcggagtctgggtggcctgctgtgcatgtgtgcacgtgcatatacacatgtgcttgtgtgaacgtgcatatacatgtgtacttctagcatatgagaattcagcagtaagacacagtttaaccagaatgtagcaccggacactgaatttgccagcgccttggtgttaggcttaaccctccatggtggtgagaaagaagttcctgtcactttaggccactatggtactttgttgtagcatctcaaaagaccagagagatgcatctgtatgaaacctagtgtcctgttaagaatgtcatcgccacttggggcagccataacaaaatgtagagactggcaggcttacatgacacttattttgtcacaattctggaacttagtaggtcaagatcaagctgtcacctgagttgagtccttctgaggcttcttaggaaggctctgttccaggcctgtcttcctggcttggacatctccccgcctctcatgacttccttctgtgtgtactactgtcctaatctcctcttgtatggacagaggtcagttgatcagaccataccctggtagcctcattgaaacttagctctgtaaagacccgtcttcaaatacagtcacaacctgaggttcagaggtttggaatttcagtgtgggagcatgatggcacagtgtattccataatacctctaacatctctgttaacgtggagggagatgatgggaaagaaactgaggttgattgccacttatgaggtagaaagagtggggtgtgtactgggacagtgtccccatgcactgacaggttttttagggggattgacagaaaaggagctgcctgactctctcccagaaccaagcttaccagtaggagacagaatctaaagagccactgcccttctttcttccaccttctgtgactccgaaagcatggaatcccctttcctcttcaccttgagagacacatttttaattccaggctgcagattaccttgcatctccagatgtggagattca

SEQ ID NO: 22626 - DNA, 1191 bp, Mus musculus
gccgggttaagagctaataccagaggagcatttgcgcggcgtaacttggccgagcgctcaactctgcggccacaagcgatcgacttcgccagcgtccgggagccacagagagggcggaaccgggtaaatcccgtttggggcaccgcccagagccggacaaaggggcgggtcagcgatccgcctcattacctatggatgaccatttgtagggcggggtgcacggtagggggtggagcacggcgacccgggggcggaacacaggcggggcgtagagaaggcgtggtgatcaatgtgggaggggcaatcagcggtgggatgtgggctgatagcacagtggggcggagcgagcggtgagagccaggcctgggtgggggggaggagcgaaagatggggcggttcctgcatggggaggagcaaagagcgggggcggggcttgggtgcgccagacgcactgggcggctgagcggtgcgaggaagcggcgcctcttttttcgccgcggccccgcccctccgcgccccgcccccgccgctcggacggcccgagtcgcgccctcccgctcggagctgctgaacttgctctaacttcctcggccaaccgggccgtgctgccgccgctgctgccgcgcccgggtaagtagaacgcgtggcctcgctgaagcgtcgggcctgtctttattgtctcgggccggccctcgtgagcgtcctctcgggacagcggctgctccccgcgttcctgctcggcccctggactcccttggctggcgggggcggccccgcgggtggcgcgggctttgtctgctgagaccgcccgcgagctctggaggccgcggccgggaccccgctgagccgaactggggcgctgtatcgagtgggaggcgcggcgggctacccggaaggtgtgtctgctcccggctgctgcctgggctctgtcggtcctcacctgcgaacccagcggaaggctctttattcagctccggtcccggatgaggggacggtcgcccagcccccacccaccctgaatgtgcacgctgtcgcggggtcccacgctgtccggcaagagtttaaggaggtggcgatcctggcttctcggtgctagtcgctaaaggctgtgtttgggagcagagcccgacccctgacctagcccgaggtttggccaagttgtgattctggctcagcctaggttggagctcc

SEQ ID NO: 22627 - DNA, 1133 bp, Mus musculus
ctgctctgggtatagtgggatggaagctactgcacattaataacccaatagggaacagagaaccataagtggtggagatgactaggcatccctaatagccatatctcattttgcctttcctagcataatttccaattctatctggctacatacatggctttccaaaataaaggcaaatgtttctgctacatatgaccatgtgactcagttccagccaataggaatggaagggtccacgtgcagcttctaaactaactttaaagggaagcaatgtgctttccttggtcagcattccttccaggaatatacttataaaagctatggctccagtagccatgggtgtctgtagcagaagtcacgtggtaacgatgttgacaaaccaaattaggataactgggttcccaggtctagagaatcacctatcctgagctatctttctatttactgtgtagatgaaaggaagaaaattatcttattcacatttatctactttccattttaaaattttacttatttatttatttatttattttgagaaaaggtctctctggagccctggctagcctggaacttccatgtcgatcaggctggcctcaaactccacagagatccacctggctctgccctcatagtgctaggattaatgatacttacagcccacttttgtttttgttttttcgagacagggtgtctctgtatagccctggctgtcctgaaactcactctgtagaccaggctggcctcgaactcagaaatccacctgtctctgcctcccaagtgctaggattaaaggcgcgtgccaccaccgcccggccagcccactattaactttaatttgtgttagccagttggggaaggaggatttaggctacagagaaaactatgggagatttgtatagtaatgagaatgatctgggggaggaaggagtaatgatttgatgagcagatgaacgaagttgggttgcaggcacaaatcagagtggttgatcacatgaccttcactagctacaggtctaatgaggttatatctgtcgctgtgaagatgagagtcaaaggctacggagctgtttccagtgagggacaggattatattcacctgatgattatattcacctgatgagttgtggggaagg

SEQ ID NO: 22628 - DNA, 1223 bp, Mus musculus
tcccctttagggcatccttcttgagcaccgagaaaaagaatttggagacagagtgaacccactctctgttctggaggctgtaaagaaaatcaagctacagactccagcgtccgggagaagctgatcctgtacagctgctggctgggagagaacgcacggggcctgtgctgtgttcatcagatgagctgtgctttccccagggccccaagagccagaaggcccttgcaccatatttactaagaattggtgatgcattttaacattgtctgtttaggtcccagagcctttaacattccgtttaggcccagtagggcaaatagggtcccagacagaacagagttcaatctaacaaaccagtgagagttatttgaggaaagatctagaaaatttaatgtttaaagtttactgctgaagcttctttcaaaggaatatgtcctaagtgccggtatttgaagtgaagtttattttcatgcctagttaaaaaacaaacaaacaaacaaacaaacctgaaatctgagaaaagtgcggctaagaaacagctcagtggtggagcatttacctaacatgcacatggccctaagtgggatacccagacagacagacagacagacacacacacacacacacacacacacacacacacactctctctctctctcctaagaaaagctgatggctgacttgataattagagaattatccttttgtttgatgtgttttctgttaacaacttgttacttaaggtcagagtaccacataaagcaattgctgtgctgtgttcttggataaattacacaggtaaattacaaagtgaaggttctgtggtcttcccttatagacgcagagatttgcttccttgggaaaaactgtcacctgggaaactgtcacctctaataaaaatattcaccaggaatcacctctgtgcacaagtttctcttgtccttgttcctcttgcttcagcctcctacactcagggcttatagacatgagccactacacccagaaagacacaagggatttctggtgacgagtaacaaaagccagactactagctacaagtgaaaaaaatgtagagctggagagatggctcagcggttaagagcactgactgctcttccaaaggtccggagttcaaatcccagcaaccacgtggtagctcacaaccatccgtaatgagatctgatgccctcttctggggtgtctgaagacagctgtgcttagat

SEQ ID NO: 22629 - DNA, 2549 bp, Mus musculus
agaccaccagtatgccatgcttgagaatcagaagtacagccacacacagtacagctaaggaatggtctttgctaagcctaccaaggtaactagaccacagctaaccaccaagaacagccattcatcgttttgatttctggatctacagtgactgactgaagacctcaagtccagtgactgtccctgttgcactatggaagttcaagagtcacgactgatcttgatgtgtgttggatttaggggtgtttcattgtcttaaatatttgtgaattagattcaacagtgtttccatagttgctctgcgtataaaaccaaacctgcagccagtggtcattcaaacatctttatgttcagatgctgagccttcgcaaggttgactagctcagatttgctgcccttagttgtggatttcatgtggatcacatcttctacataaggctacagctactagtgtctgtgtgaaccttgaaaccaactctactggattcctgtcagaaagccttcagaagtcagccatctgggttctgatccgctgtaaaagatgaagagttaagtgaccttaattaacctgttctgtgccccatcctaaggcatactctgtaggctgtggctatgttagactccctggaacaagccgctgtcagaaatgatgtgtttggatcatctgtgtggggcttatgatttataattttttagttgtatgcgttaactgtggatttagttcaaccaaactcgggtccaccaaatggggagtgggtggggggggtagtcttatttctttgaataatttttcattcagatagtgcttgttcggttccacattaaggccttgctttgactcggagtaagttctttaagggcatattgtctgaaatatgtctgaaagaagcattggaattgtaaaatgccctatgaatttgccaatccttaggtggaaccagatagcctttgatgcatataaaggacagcggatccgctgcactccaggtgctgctcaagcctcctaatcaggtctaattgaactgctgtggacagagtgtggtgtctgctcactgctgtggacagagtgtggccactgctcactgctgtggacagagtgtggccactgctcactgctgtggacagagtgtggccactgctcactgctgtggacagagtgtggcgtctgctcaggaggagagggtttcactgagctggcttttaacagttcaaagcaacaggagcaaaacacccaagttgagcatgaatctagcatggtgtctgataaatccttgtgtgtgccccaaatgtgaaggttatgggctattcattgtttagccagctcttgacattcaccttgggagtatgtttggtaatcacttggagacgcaggagaatagtcagtaatgtagcatttctgttgtaatttcaatttaactatctagtagtacttggctcttagaagaggttactgctaaatttctttctacctaatgaaatagcctgtcagttacctaccttgtcactacagatggttcagtacacatactctgtgttggcatatgactatgtgatacaatactagtgcctgggtttctctctgtaaacgaatccctttgccaaacacaggtcagacttgctcactactgacaggagtgggacaggaaatggatgttttcccagcttgggagcatgtttagtggatttagggcagcagtgtaggaagcaggaggtggaggccagtgtcacctgaccagactgtatgccacttcagagcaataatgttggcatgatctgaaccagccaggaggaggttgagtgattagaggcttgagattcttagttgaactgaagacttcatttgggcaccagaaacgttaacaccttgagccacaaacttcccttaaagtatgctttactccagcgtgacacacaaacacaaattctgtttggggttatgttttaagacgtgaacagaaacatgatgaggtttgtttaatggcatactgtactggaacgctgaagaactgcagcagatgtaaattccaagtcttgttattttttaagattgcgaaattatcaaaatgcatatgaatcaagttttaatacactgtctgggtggatgaggctgtccattgcaccatttctttctttgggttctcaggcatggttctgacagtgtaagaactctgtaacatttaacattgaataaacagtaaacctatgaaaaaaaaaagaaatcagatggcaaatctaaccaccaaacatgtggcccaaagagcaatgatcctggaagtgaaggagcctaaagattattataatgtcagagagaccagctttagatacacgcctgaacactatcaagttatggacattacttgacccacctgggggccaagaaattaaaaggtgtggttaggtcctttaactattatgttacaggactctctgacttggcagaagaaatagtcaaaagctacaatgcgtgtgctatgacaaagtaaaattttcagaaattaagccagctagatatggcaacaagtacttattagtgtttatagacaccgttt

SEQ ID NO: 22630 - DNA, 1140 bp, Mus musculus
gacagggtaaggcaatattttttacatgaagcatccgttgcgatgttaaatgtcatgtaattcattttggaagatttaacaagtaagctgtgtttattgtagtcagcacagtaatcagtagtaaattaagtgtactggttcatgtttttataaatgattttaacagggtgaggagccgagcacatacatagatatttaactgaaaaatagaaagtggttgctcctgtttcttcatttatacactgtaatacataaacacagagttattttgacaacaagcacctcccccaaaataaaacattctacctgcacatcttcagcaactgtctaaacagcaaaactaaacaggaatatgacagcaggtccctactcttagatcaacctgatgccaaggcttcgaaggagattcagcatgagcctagtgaatcacagttggtgcatcttaaggacatcattttaaaagatttcaaagtaaaagtgaagtgcttaaaacatggaaataggccgaaccaccatgtcacagagcggggaggagaacctgcagggctcctgggtagaactgcacttcagcaatggcaatgggagcagcgttccagcctccatctttatttataatggtgacatggaaaaaatactgttggatgcccagcatgaatctggacgaagtagctccaagagttctcactgtgacagcccacctcgctcccagacaccacaagataccaacagagctgaaagagacagccacagctttggcgagaaaaacagcactctgtctgaggaagattatattgagagaagaagagaagttgaaagtatcctgaagaaaaactcagattggatatgggattggtcaagtcggccagaaaatattccccccaaggagttcctttttaaacacccgaagcgcacagctactttcagcatgagaaacacaagcgttatgaagaaagggggaattttctcagcagactttctgaaggttttccttccatctctgttactgtctcatctgctggccattggcttggggatctacattggaaggcgtctgacaacttccactagcaccttctgatgaagatttggatctgacttctgttcacacagtgaggattcatgtctgagctgtgacagcta

SEQ ID NO: 22631 - DNA, 1332 bp, Mus musculus
cctcgtgggatggcctctctgtggcacaggaaacccgagatcaaatctgtaaaggaacaggactaaattatgccatctctagacaagtgccattgaatgggcttgtgatacaaatgacatgtaaaatttcttagtagttactcttaaaaaccgtaaaccgagcagataaaccccagacagcttaattactacgaaaatgttgacatttactttttaatgtgaagtcttcaaaatacagtccatttcacacttaatgcctttcctcactaaggagatccgtttttgagggcttatttgccataggtggtacatgacagttgtatagggcagttcactatcagacaaacaccagtgtgcttgacctgggtctagccatcctgtgcatttgaatcaaattgggatgtaactccactgaatcaccgttgactctctggttgaatcataactggcgtttgtatttattttcttgtagccatattaaaaccagtactttccaggatatttggcaagatgaagagacagttttaatattttgatttagtgatactattggcatctacaggacagaggttgaggtgcccctacacccaaccactctacactgaatagatggatcctccatcaaagaattgtctttcttttaatgtcattagtcaccaaggttgcataattagcaaccttgtagtagcctgtagcacagtgggatctgcatatcttccgtctagttactgtgtttgtaaatctttggacattaaaaatgagtggctttcatatcctgactattaaaagtcattttaaaaaaaatattcttttgcattgtacatgtttgagtgtttgacctgtgtgcattaaatgtactgcatgcattcctggtgctcacagagaacagaagagggcattggatgcctgcggactggagttgtggatagagtaagctgccttgtggatgctaggaaccaaactggggtcctctgcaagagccagtgctcttatctgatgagccatctctccagccacaatttttatactttgaagaagcaataaaagtctcttcaaaaggacttacaatgtatgtaaatctgtgtgtgcacttctctgaatatacatatctgtacattttaagtctataagtgcaactttctatatacgtatttgtggattataagggagtcttaagtgagcccttatctctctaagttagaatgctaagtttcagattaaataggaattaaatattgtgttactgtctcctagcaaaaagaggctgccttatctgagtcatgtatgaaatctaccccttcagcttggggaaaagcaaatggtcttcttggg

SEQ ID NO: 22632 - DNA, 2569 bp, Mus musculus
acttgaatattaaaagttagcttgtgttgggcaatattatcttgggttttccttgccagattaaaaactaaaggatataagtagatttatgtactttttttttttaaatgtttacctgatggtttatttatttatttatttttatttcttaaatttatttattgttatatggaagtacactgtagctgtcttcagacacaccagaagagggcatcggatctcattatgggtggttgtgagccaccatgtggttgctgggatttgaactctggaccttcaggaagagtagtcagtgctcttaaccgctgagccatcttgccagcccttatgtacctttcaatttgttgaaataaactactttaaaatttttatatattctaaaaaatgcagaatgattaatagaatttatgaaagacagtttttacatgaaatgtttcttggttacaggatttccacaagtgtgagagaactagagaacttcaggcacttgttacagaatgttcactgaggaggacggttggaatgtgcctgtttctgcacaggggaatctgaagggcagaatctctctgagcaccatggttgcaatgactgtcctaagccaaacgtttatataaagctgcttttgtaaaagaagagatacattgtcttaagtaaatgacatttttaaaaattgtgttcatgtttaatattattgtgaatagaagtagtattttgataatatacaaattttaatactaagcaaaagtaaggtcattaaactcccttatgataaagctaggtaaatattgccttaggctctcaaactagagttgaatttaagaaggtaatgaaagctaagctaaggtacctgtgacaagtgtttggtaataaaatactaagaggctcagcagtaaaccatggttatcagcctcagataccaatgctttttcatttgcctcatatacaaagaaaatacagactgcccagttagatttaagttttagaaaagcaaccagttttcctttcaatgttaagtgtgttgaagtttattagggcctatttatactacaagttatttgctcgaagttcaagtttaactgggagccctgtgttttcctggcaaccttaaaatacactggtatgaaacattccttttagagttaaatagctattttgattgtgctgttttggtatgttgggaagtagaacaattcaaaggcacaggagatttctaaacatcgtagaaagataaatagattatatatttattctcataatagtttccctaatggaattttggggaaaattttatttttatataatttcatatttacagaaaagtttcaaaaacagttaaaaaaaaaaccaaactggttttactcagattcatggattgttcacatgtgttttaacccctcaccccagctcagagtggcgattgagcccaggacctcagtcatgctgggctagccctgcattcatgagctgtgtcctcaggccttgcttaagctcctacatagacatagacaccctgtttttatttaagggtttgagtcatgggcctcatgatttaacccaaaatacttcagtgtggtggtcaataatttcctaaaaactattttttgttttctttttaaaggaatatccaaaccttacaaatctgagctgaactacttactataagccttaaaataaggagacatcccacatcccagccacctgacgtttgaatttggttgcctttttcgacctgtgtagtcacaggctatacaactcatgtttttacgcatgaaactctgtttttctccacaggatggagctgtaacgtagataggatgggttgttagtagaagctctacactgagagcagtatttgatgtggcttaagaatttacatcacatggcaattataaatggcatatacctcaaaattatgcccccttgaggtcacatctaatgtcttgagcagttaggactggttgagatgtcacataagaaaaagcaggacttacgtatgtaatggctaggaatgtcactttacactgttgtgtattttctctgtccctaagacttggtctagtgccaggcatacagttggtgtctaatatttattgatggaaagtatatgtatttagtatacgttaagtgatggtgatgtagcttgtttagtaatgtatcctatttccccctccctctcactttttcttttggatctcataataaaagacatcaacccactaattaggtcagttttcttggggacttaaaagaactaaatgatcaccacacacaagccagcccttttgaaaccctcactgctttcacgtgcttttcccacttgattggctatgtcctctgtccctccaagtgaagtctaatacctaattctaagtttatagttaacaagcagtttaatttttaagaaatcttaacttttcctgtacatgacacaattgacaatccctattcctttgtgtccttgtgtttggattactcctgggtatctttcttctggtctcttcatttaacctaagtatcattcctcagactttttgctcttaagtcactggaccgtacttttgagtaattt

SEQ ID NO: 22633 - DNA, 1198 bp, Mus musculus
gcaatttgttttgttttccacaggtatgtttgcaattcgtgccgatcatgattttgtagttcaggaagacttcatgaaagcagtcaggaaagtggctgactccaagaagctggagtccaagctggactacaaacctgtgtgattcactagaagggtttggtggctgcatgacagacattggtttaatgtaaaaataaagttaaggaaaataatgtatgtattggcaatgatcttattaaaagtgaataaacatgtataagcaacataatagtatgtaattcagtaattttttaaaaattggtacagaagaaagtcatgtttggtgatgttgcatttacttcagcagaatttacaaaagacatcctgaagcttttcatatttgctttgtgagcattttgtacaacattcaaaatgattgagatagtagaggagagcatttcttatgacttattttatattttgttttcctcgtccttaaaaaaaaagcaataaaatctgttttaagttgtcctatatatactcttgtcttttctaaaagcacatttattcttgtccttttggattagtaagtatatgatttgaaaacctggatgaagttgaaaattaaaatagggctttgaattttaaacagtactcacagagtccacaagaatgtcttcttttatagatcatagagtgtggggttatggagtatatacatgtacttgtgtcttccaagaaattctctttacctattgcagttaggtatttgataattttaactttttaaagattatgactggaagtaatacttataatttggtttatgtgaaaaataattccctttttgtggtctggatccaggaaaagtctgttcatggacatgtaattttacatatatgtgatttctagcgatctattatttcttaggttcaccagtggattctataaatatcttccagtaaataccaggctgagagtgtctactctatggaatgttaaatgttcaaaacaaaagttctgttacctgtacacaattctaatttcatgtggcaatcaaaagttgtataaggaaattgtcaatgtctaaaaattgagattatttatagttaattcttgtttaaataaagacatcaaacttcagtttcataaataccaaaggactaaccataaatgatccagctaggtatgtaattcttcttttctctctctctctctc

SEQ ID NO: 22634 - DNA, 2054 bp, Mus musculus
gacctaaagagggccattctcattaattgcatcactagagaccactcgggaccttaacgacgtaaacgccttgagaacttgcaaacgaaagggatgtggggatgatacacttttcttactgtttagacctatgacatcactgacatgatggctgttcccacgtccctgcggggtggagtaccataacttaaagtccggaagcttccggggaactgacagttctttgtctttgctccaggtcactgtagagtttgcagatgaggtccggttgtccttcatctgtaccgaagtagactgcaaggtggtccacgaattcattggtggttacatatttctctcaactcgtgcgaaagaccaaaatgaaagtttagatgaggagatgttctacaaactcaccagtggttgggtgtgaataggaaaacttgtaataaaactccacagccataacaatatttaactttaaagctattgtttcttatatgctgcttaataaagtaagcttgaactttattattttatcatgatacctttttgccttaccagaccagtacatatgtgcactaacaagcacgattgttaatctgctgcctaccttgatatgccgtatgtggactgtggaattcccaacagtccttagggccacggaaagctgtcactgactgacagtaaccaaactaagaaacaagccatctaccaagccacccagggcatacatataacctatatgaagtctatttatcatgtgtaatgcatgtgtttgtgtttaattgatgccttcttttaaagtaccctgctcctggtacccagttaatcccctctcccagtataaagtcggtctacagtggatgcttggtatttgttgatgctgttgaccttgaaggaaacactgctaacctgttgttattgggtgggttttgtctttgagtaagcatgctgtacattgttttgtgtttagttttacaccaaactgtattacagtactcttagtattcaccagcatactcactatctgcctaagatatgcagcctttgtgttacaatatgaagtaaagatctatgaagtattcattttgtgtaactaatgtacaaacacaaattttataaaattgtacagttttttttaaaaaaaactattcacaactaggaaatggcttaaatgtagcatccttacattaattaagtgcttttaaaatatataattaatttgcagtttcagtatctgctaaattacgaatgacttcatgatgctcgtgacttgccgtgatgcccttaactacagcctggaccggctgtgttctagtctgttgcgctattacatctgcgttggtgctagttagacaattcctagctcacgagcccagaagggcgccagggaggggtggacttaccagtattgtccaataatccatgaattaaagactgtataaatgcattttattttaaataaaagtaaaaccttttatttaatgttttcttttgtacttctgatctctctcaactctcccaacactgtgtgttattagaacagcccgccagtgctaggccatgtcccagatgaagagctctctctctctaggagacatcctttctccggcattgagagacctttgtggttattcagttagactccagactttcatcatgggcctggctgccacctctgtcagtcccgtgcctgtgaggccaagacagcttctaaaaacccagctctgctcacctcttctgtctcccaccaccactgcttgccctgcctgctgagccctggtgtagcactgccctggttacctaaagctctgatgactgtgccctgtgctacagaagctcaggctccaggtcctctgagctggggcatctccctggggcccatttgtccttaagcagtctggacagccacattctctaggccagtggttctcaaccttcctaatgctgcaatacagttcctcatgttatccccaaccataaaattattttctttgctgcttcataactgtagtgttctactgctatgaataataatataaacatctgtattttcccgtagtcttaggcat

SEQ ID NO: 22635 - DNA, 1199 bp, Mus musculus
tggaggtagagctgagtccaggtctgcatttcccaatccttgctctgcgcccacttgagtgccaaagctggagtaagcccccttccaccgaataggggtgttcttaaaatgggcacagttcagcagagtcagacctcagagaatgaagctactgtgtgggctcaggatttcttttatgcatttctgtaattaaatttatttttctaggatgtgaagttactccggatgtaaacatttcaggccagaaatttaacataaaactcctaattccggtagcagagggcatgaatgagatctggcttcgctgtgataacgtaagttttccaattaacacataaaccttacctttctgactcctaagtgtgttggcccgctgaccctacattctgtacctgggtcctagacaccgtgtgccttcatctctcagtctgaaacagttttgctttccacaggagaagcagtacgcgcactggatggcagcttgcaggttagcctccaaaggcaagaccatggcagacagttcttacaacctggaagttcagaacattctttccttcctgaaaatgcagcatctgaacccagacccccagctgatccctgaccagatcacaaccgacgtcaaccccgagtgtctggtgtccccgcggtacctgaagaagtataagagcaaacaggtacttcatcctgcctaacctgctgggtgtcgctttgtgctcctgctttaaacgctgctcctcctgttaaatggaagctagcaccagcttgggtagaatataaaacaggaaataggggaggcggaggtcagcttaaactggttgttagatcgtctgtaaagttaatagataaagccaggttgttgctcagcacaaggaaatgattttccctgtggaaacaggcgaaaagcccagtcacacattcaggtcctgccagagggcctcgttcttgggtttgctgaggaagattttccacctttagaaataaactgtcatgtggtagagatcctttaccccacgtcactgtcttaaccggagtcaaacctaatagaaccttacccagggttacaacgtcttatcaattttaacttaaaattcactgcctttgtccactctttagaactcctgtcctggaaattaataccataaaaggtttgctatttgggcaaatggctctttgatgcatcacaaaaggtcctttgcggg

SEQ ID NO: 22636 - DNA, 1155 bp, Mus musculus
actctggtttggtcaggtcaaacaagggcttgccataaacattgcttcaccacctcaaacttgttcccgtatttcctccgatgggaagtaagtacctatgtccagcctctgtaatgccactttacaacttgctttcctggtaaggtactttctgtgacccccccccccctcctcgtgcctgggataaaagtcttccttccttcctttttttttttttaagatttatttatttattatatgtaagtacactgtagctgtcttcagacactccagaagagggagtcagatcttgttacagatggttgtgagccaccatgtggttgctgggatttgaacttcagaccttcggaagagcagtcgggtgctcttacccactgagccatctcaccagcccccttccttttttttaaaataccaattatagtggcttttaggcaattcgtgattactctattaactatgtctgtggggtagggaagaagttgattcaatagtgccaaaatggtggtaaggagatagagatatgagggcatagacagagccataaatgtctctgggaagtttgactgggaaggagaggatggctgcaaggaatgggaaagggcggggcattctgagccatcctcccctcttccccctcttccccccccaccccgcttccccctcttcccccccccccccgcttccccctcttccccctcccctccccctcccccctctcccctaccccagacctggcccaagagggagggaggagctgagcatagtacatgctgtgagggaaggatcaccatgtccagaagagactcgggagtccctgaaaaagagtccagagttcacaaatagagaccaggagggcacgggatgcagctccaggtggaccagcttctaatggagatctgggtgcctctgcactgcaatcctcttaggggcttgaaagagagttggtagagcaaggcaagcgggctacttcctgaaggcttcggcttcagtgaagcacagaagtcattcgaggagaagcatttaggctgtgtggacagggggccaaggttgactactgaagggcagtgaggggaggggttacagacccatacctatgaggacattaaggcagtacacagcttgtttacagcacaacatcagaagcagcacatt

SEQ ID NO: 22637 - DNA, 1211 bp, Mus musculus
ttcaaaagacagtccaaattatcaagaaatgaactcaacctagactatggaaggctttcttgtagttagataaaagccagcagttctcaggaatttgtggaacggattcccttctgccaaaaggagccatttcccatacccctggcagaagagacagttgactctctgattaacatacgcctgtggccctatcaacgtatcaggcgtctcagcatatcaaggtccttgtaactacatgtgtagtgcctatcagcatgtcgaggttcttgctagcttccaggtgcctctggctgttgtctatgaacatgttttttcttttatgaacagtaagacatggagtgttcatgtcatcagtttatatactaatgatatccacaaaattaatgtattcatcaaagcctacagcttcaaatgactaacaatgtgactattgctgaaagcttaaggcatgtttctatgtgtgtttgtgtgtgcgtgcatgtgtgtgtgcatgtgtgtatcttctcattcatttatttctatttgcttctacttttagggtaatgttaactttcatcctgaccagtctttggctttgtgggggttgtttgttttgtcttaactttgtgctgttattgagaattgaacctgggacctggtgttgctctgcaagcaccctgatactatggtaaatgccaccctagttttgctttttttttttataaaccgtttttggattcaagatgacatgttccaacatgacctataaaaagcccatcattgtgttcacagtctctagacactatgtctggaatgctaccctgataagcttgaactaccaacaaaacattgcattaaagcccttaacctccacacctggcttacacaggacctcacatacatagacagttgctcatctgtcttcctaatgataaagcaatatactagacattccttgtctagatagcttaatcttgataactggaaaaccctccagcaagtgtagtgggtcacacctgtcctcacactcaagaggcagaggccagggactaagggccagagtgagcctctgactgaaacaagcagagaaggtacatctggcttgaagcctgcttgctctaccttaaatgattatgctctgtcataaaagcctgcttggggaatagctagtgtgcctccctgtgagaggctgatcttgtgatctctctttcagaagctgataaaataccagt

SEQ ID NO: 22638 - DNA, 1197 bp, Mus musculus
tagagatgttctgttaccccaccatttgtcaacccggagccttttcttcttcttcccaaggagactcagctccacgttgatgtgattgaagtccctccgcagagtccccctggggcccttcacaatgactgtgcgccccttcagagtgatttcgacattctctggaatgtccacagtctgattgctgagaatggtcttcatcctcgcagtagatggggccccaccgtcaggaccatctgcagtcatgttcagaacatgatcaaaggtgtcatgctgggcttccgatacaagatgcggtctgtgtacgctcacttccccatcaacgtcgtcatccaggagaatggctctttggttgaaatccgaaatttcttgggtgaaaaatacatccgcagggttcggatgaggacaggtgtggcttgttctgtctctcaagcccagaaggatgagttaatccttgaaggaaatgacattgaacttgtttcaaattcagctgccctgattcagcaagccacaacagttaaaaacaaggatatcaggaagtttttggacggcatctatgtgtctgagaagggaactgtgcagcagcaggctgacgagtgaggaggcctcagttcctggccccagaaacgagatcctgaccacaagaacaatttgggctcttttgggagaataaaagacttatatattgaaaaaaaaaaaaaaagaattagagatgttgagctgggagtgaaggtaaaggcacattagccacacaaggcttaggagtgcctgaccattgagctaaaaaccatattaaaaataagctaatgtgaatgtgtgtgtgtgtgtgtgtgtgtggtgcatgtatgtaagtcagtctccttctgtggctttccccttagtaccttgagccaggatctttcagtgacccagaagtccactcttttaactacactggctgctcagtcctggggatctgactggggtcaggcattcgcagccacatttgatctttatgtgaactgcagggatttgaactcatatctttatgcttgcatgaagtgcttttatttctccccagcccaacctacttaaagtcttttgcacttaagcatttaataaaaccccggatcatattcaatgccttagtttcatcatccttttcttgacacttgaaagctgcttttgttgtccttctgagagtgactgcattttcct

SEQ ID NO: 22639 - DNA, 1134 bp, Mus musculus
cccccatggaggaagatggactaaggtggaccccaaagtctcctctggaccctgacttgggcctcctctcatgtactctacctaatgattttgggggtctgtctggtcctgaaggggagcgcagcctggcaccccctgatgccagcatactcatcagtaatgtgtgcagcattggagaccacgtggctcaggaactttttcagagctctgacttgggcactgcagaagaggcagatcggactggggagaaaactggccagcatagcccccttcgggaggaacatgtgacctgtgtgcagagtatcttagatgaattccttcaaacttacggcagcctcatccctctcagcactgatgaagttgtagagaagttggaggacgttttccagcaggagttctctacaccctcatggaagagtctggtactacagctgatccagtcttatcagcggatgccagacaacgctatggtaaggggcttccgggtatcctataagtgacacgtgctcaccatggatgacttgggtaccttatatggacagaactggctcaatgaccaggtgatgaacatgtatggagacctggtcatggacacagtccctgaaaaggtgcatttcttccacagtctcttctatgataaactccgtaccaagggttatgatggggtaaagaggtggaccaaaaatgtggacatcttcaataaggaattactgctaatccccatccatctggaagtggactggtcccttatctcagttgatgtaaggcaacataccatcacctattttgactcccagcgaactctaaatcgccgctgccctaagtatattgtcaagtatctacaggcagaggcagtcaaaaaaaggccaagtggacttccatcagggctggaaaggttatttcaaaatgaatgtggccaggcagaataatgacagtgactgtggtgcctttgtgttacagtactgcaagcacctggccctgtctcagccattcagcttcacccagcaggacatctcgtcagatctgcaaggaactctgtcactgcaaactcacagtgtgagcttcataccccagacccttagcccatcagtgggcagggggaaagggagacccttcccaagaaactccagttcc

SEQ ID NO: 22640 - DNA, 1397 bp, Mus musculus
cggtgctgttccagagtagcgtttgaattgctcctgtgagcgagctttgcttctcactggggttcagctgcatcattctgcttgctaaaactggaaaagaaatagggacaacaggccggtgtccatgctagttaaaatcactgacaacgtgtcggtgatcttcctgggacgctgatagctgtgagctgactgtgtaaaggctgtatgagggctgtctaccttgttgtaatgagtattggaattaataataattcttctctttcgtttcagcatgatctatgttctggtgagctcttagaacaacacagaagaatcggtccagttaagtgcatgcaaaacgccaccaatgaagggattctatccagcaaggtcctgtttccaagagtagcctatggaatctgatcagttactttaaaaaatgacttcttattttttaaatgtttccacattttttgcttgtggaaagactgttttcatatgttctacttggataaagaatttaaatggaattacgtataaattaatataaaatgattacctctggtgttgacaggttgaacttgcactcttaaggaacagccataaccctccgaatgattgcattaatttctgaccgccctcagcccgttggaagcttggtttagaggacttgttgggctcattttggttttattgaaatgccatctaaatatgttagctgtagataggaggtgcttctggtgaactgaaagtgtctgactcgtgaggaacatggtaggttcctcacttatcactgtagatgattctatatggacacaacagtaagaagaatggggcctcgtccctgtcgacttgaatattatccctatgtattgcatgagaggggtctccctcattccatcagagtaatacacttgctttaattcttaagcctaagtgatacaaacatgccgaattacctgtaaagaatgcatttaaagctattctaaatgggtttttatttgtaagacattatttactaggaagctggtgatattaatgcttactgttctaatccagtggccaaggtattaagaatttgcaagtattttagattttcgaaaatgaatgagagaactgtgtaaacaccccgctgttccttcagtgcaacacaataaaactctgaaatgaagatgctttgctgtgcattgtttgaaagattacaaacagctgtttctcaaaccctctcaatccatcataataaaatacataatattgtcatctttagaagtaaattattacattgtctattttcttaaaagtaatattgaagagctttgattgcccaggcccatcactgttaattggcaaaattcttgccctctgctggcacagctccggcattctctcccaggttctgaagttccggagatgtgtgc

SEQ ID NO: 22641 - DNA, 3814 bp, Mus musculus
gtttgttttttctttccttaaggtatttgaaataagaaacactgaagatctaactgaagaatggttacgtgagaaacttggatttttccactaatgtgaacttctgtgtttctaaagtatttatgtattaacctgaccatactggaaccagacataaatagttatttatgcctaaaaatgcactgttacttacagtttgtttcctgcagtaaagaaaaattcttcatttgtgcagtttgaacaaaggggaaatcatcttcatagtaatgagacgttgtgaagtgttcctgcatctgtcattgttagggggactacttttctccagggatgctttgcacccttttgactaatttctataatttatgattcagaatttgtaactgtttgcagacactataggaaggtgggtattagactgtgatagacaacagttcctcctctgaccactcctgggtactggcagtttataagtgcaagtagcattttatcacctgtcacatcattgcggttcatttgggactgaagcgtaagtgaccgattctgagccttgagtagagatgtagtgggacctctgttgaactctccgccagttttcctcctctcttgggttcctgtatctttgcaatcaagtgtagaatcttcatcaatcactcctccttaaggtccggaagttgatttttatggtagagttaggattgttaggttttcttcttatggagaatagcatctgaatcttagaaactgggagctctataatcaagggcttcgttcttggttatgtcactggcagggagcttagactgtagcttggtaacactgcaaagcacctcctaatatgttaatactgtgcctttgattggtcagctttaccattagcttaagactgctacactgccagtgttctagatttggtgaaattaatacttttttaaagggttcaaataaaacaattttctaatatatataattaaaatttgtaataaaccaacttgttacttttaaaattccaactatctgcccaaagttatgatagtaggtgagagttataatttggggtatatttgctattagttttgtgccatatgtaagcattatttaaacattggccacaattaataacaacacatcaatagatgtcataccttttatcctaaatgtcagaagaaattctaatatgaactaagccagtcacagtttgatgacaccatcatcaggaagcaagatttctaatctacttggaattcttaagtttcacttaagaaaacaatgtaagaaatgctgaatagtaatttgacttaaagagacaagttaagagactgtagagacgaccaaattcttatattaagaaggtagtgattttgattgggcattggtggcacataacatttaatcctggcatttgggaggcagagacaggcagatctctgagttcaagaccagcctggtctgcagaagcaagttccagggtaaccaaggctaaacagatgaacaccctgctcccctaaaaagaaaaaaatagcaaaacatctttatgttggcatgtgttcattgcatagtatttgtctcatttagggctttgtgccggttttactggagggaagatagctggaactgtcacagtagagtggagtgtgttgtattcccaactgtgtgctcactagcctgtatgtcaggaagcaattgcaagtgctagaggaggtgatcatattggttcatgaatggaaaagtccctttatttcagtgtccagagagcaagaaaacttcatctaagaagtttaggacttcattatacaggtattttggtatgagctagagaataacttgcttataatcccacaggaatgcagatgagacccaagtaaagggggactttgatgtctctgactgatgcacataagggttcgtttcacctggttatagaagcacgctttcagaagcagtgctacaagtctacgttttaaattcagttctttattttggcttgcatatttaaatcagtttttgaaatttccaagtctttcatagagtgaatggccctgacctgccacacacaggactcttagtctctagttcaagcagcaacaccagtggtgagcagctttccttttcaagcttgtctgactcttacctgtagatgggtcgtttgtaaggtagcacactgagttggggcattaatagaacatggttattctgtctgtccttagacaagtttgtaagtcctgtgccctgcagtgttcatgaaatatttatgtaagtttccctttagctaaaatttacagtatttttcttattctttttctgctgttccgtaaagagtatgtccagatttcataattccaggttttttacactccatgtctttcagcaacaaccattcccactcagccttaatcttaatctttcctttttggaagccactcttcccgggaaccttttaagcaagcattgctttggaaatttctgatcttactaagttgtgcatagcatctaatgtcagaaccgactaggaatcacaatgtatatgtcatgtggttttggtgacaacatgagtgacacatgaagaggggtattctcaggttaccgtgctgcaattccaaaaggtctgagttttaaacagtgatttgttctggtattgacacaattatgttaggaaaaaagctggttgactgttttgtttaattgacttctaaactatgtttgaattgtctgaggagtttactggatgcttagcgcagttaaacattctcgtcctgtgagagaaacattctcttgtaggagaggtgttgcagattgtgattataaaataatttgtagcaaaaatatgtgttagcattttccctccctttttgtctcctattttcaggagacaaacttagccataaactgaatcctggtctgacacttccacaaatggtttccagttagaggagtttattgccaaattaaacttggctcttttcccacttagatagaaactaagaaagctgcacataagaaatgtttggacacttgtaaaactcaagtgactacattaatctgtatgtaaactagtgagcagacacatccataagaattgaaatgccaatatttgggaagtagagagtaacttatatcctatcagatctattgagtgttaatatggtagcactctgtatttgttctgtagactgataatactggaatccataaagtttgagcctttacaacttatgtaaagaaatgttgcaaacatttctggatgagtcttactttgtatctccagaagaatgtagatgtctcctaggcctcctcgtgctgatggttctgagctgaatatttcttggtaggccatgtgacacttcagatcagtgatcctactcctgtaatgttaggacaattatattacgcttatgatagaaacagtttcttgcttttcggaatattattacttgaataccacttgagatcattagcatgccaggaaaagtccattgattttgatggtccaatgtaatctcattcaggaggcttgaaacattggtggtttagtcttgtgaattttaacagttctctgtcattgtttaagaaaaccaacaactggcactacttcttaagctgtggtttcagtctctgctagttcataccgcatgtttattttggagtcttttggtaagcatggtgcttgtactggtttaaataaaatgctaacatgaaagaacttctagtgttttattttttaacctgctttcacttcccctttgtggcttctgatgcctgcctgtcaatttctgtgagccacgtggctagttagcagtttactttctttgggaaaatc

SEQ ID NO: 22642 - DNA, 1160 bp, Mus musculus
ttgacaaggatgaacgcctggtggtgctggatgaggagctcgaggtttgttcaatgagctacatacaattttatagttaagccattattgttgtcaaacaatgctgtcagttacaagtactaaaacaagttctggaccttcttaaatgcatactaattatgcatgaaaacatgagctaattattggttctacattgtcttgctgatttaactgccttccttaagcattaatgagatgcagtgtggcaggtaggggttcgagctctcctaaaagcagaggcagctcccttcttacaagcagtgcatagagtggaagaagactgaagcccgcccgccacgtgagcgcgggactggagtggaattaatgctctttgaggttttgctatgtcattcagtcaccctgtgtctcttgacacttggaagataagcatagaagaaacactgcccttcatacccatgtgttgttgaaagtagaagtaatgtgataatgagccatagctcttagcagaatggggtgcagtggaccttgggtaaggacatgcttgcttcagagttgtcttttctctggtgccagggtgtctctccagatgaacttaaagacgaactacccgagcggcagcctcgatatccttttctaagtggtttggagattttcgttcgttatcaggattttatgtatgaacctgtttgttaaactttcaaaagatatattttataaggcatgaaaacagaattggggactgtttgggaggagagagggaacagtgaagggggtgtggaggggtgactatgagcaaagtattgagaatatacatgaaacccatgacttcattatgctgactaagaagctaatacaagaataagaacatatcttaaaagtagtcctttctcatcttgaccacatccaaattaaaacatgtatgcatgtattagacaaaagtatgaaagttgatgtcttgactggattttttaagaaaaaacaaacaattctctttgttctaataatgtgcatacagtaaaaactgagaaagaaaaaagtccatattatacttgtatttttaacaagtttcttcttgagagactgcaagatattataatttgcttttggagcctattttgtagaattctgtcaaaagcatggtcttatgagtaaggcattca

SEQ ID NO: 22643 - DNA, 1194 bp, Mus musculus
tttcattctttccttcttcatgcataaaaatctctttacctctcaccccactgtttttcaaaggcatggactaacaaagccaagggagaaactgccagcgatggagctgaagcaaagaagcgaaagcgtgtggtcagcgagatctgtgagacagagaaccaggaagaaacagtgaaggagaatctagatctttctaaaaagcaaaaggcgttaaatcttcctgctaaccagaaattgtcagcgtttgcatttaagcaggagtaaaggaaggattgtctgtcaggaagtagtgagacctggcttcagcttctcttggattctggacgtcttttaacctttagggagtatattcttataatcctgtgtgtttagacacagcgtggttctcataaggcagtgtaggggctgggtgtgcagctcagtggtggagggcttgcctaagcatgcgcaggccctggttcccttactgccgcaaaacaacacacaacaaagtggtgattttcctgtgtcaggaacaccacatgtaagagctgtctgtggggattcctctgctgtccatgagcagaaatgccatgatggcagtgactaccagggacaccattctgtctccgtggaagccattatcggtaaaagtcactaaaagcctcagtcttaagacttgttcacattacagtacctcctagggctttcccgcctttgtttaggttttgcagtagaagtgccatggtcatcggcttcccaagtgagatgtcatagactgctctcttgtcaacttgacctcaggcccatggcttttaatatgggccccaatgtgtaaataatgttgtaaatgagatgttattttatgtgtttggggtcgtttttcgtgttattactttttgtatatctgtatagactgggtcttctgaataaataaaactttctcatttgcatatttgtcttgctatggttttaacaccatatttccatgctcttcacatcacttgtgaggtggagaaaggctgcaggccttactttgagattgtggctgtgtggacatccatgctgataggtgctgcccttcttatcagcagcagcagtgttgctgagtgagcctttgaaggcttgataagacagtagttagaggacaggggagtgtctgttcttttacaaagccacagtttgttttgtgcattttgcctgtttggtgtgtgt

SEQ ID NO: 22644 - DNA, 1097 bp, Mus musculus
gtccaggcatatttacaatttcaaggcattgcatatacatttgaatattctgtattttttaaataatcttttgttctttcctatgtgtgaaatattttgctaatctatgctatcagtattcttgtatgaccgaatagttacctattctcttttcatcttgaagattttcagtaaagagtgttgtaatcaatccattataatgtaattgacttttgtaatttgccaataggagtgttaaacaacaaaatgatttaaaatgaaacttaatgtattttcattttaaatattaactaaaccaagtttgtttgttagttattctagccaataagaaaagagaatgtagcatcctagaggtgtatttgttctgcagtttggcaggaccgtcagttagtccaaataaacatcccctcagcgtggaggcgaatggaacctgtgctcctttcttacgggaagctttgcaaagcaaaatagcagggttacaagcttggagttgttaaggcaactagagttttctctattaatttatagactgttgttgcacctacttagctcttttttgggaactctagttcccaggggaaaatacatagtttctaaacagctcctggatccaccaataacaaaaaactgtctcattattttaaattgatcttaaataaagatgaaaacaaaaacatggctcaatatttaggaagcttaacattgcttttggtatttacaacctaaatagtcatttctgtcctcagaactaacatgaattttatgtggtgtggcagtagctccatgacatgacgtcacaggcctagagtaacaaacagtggaggggtgccctgtttcttcagtgactgaccttgacagagtgcccagttttccttgtgggagctatctgcctcttttaaatattgtactaattattttacttatctttttctgtgtgtaacagtgtttctccatgtagcctaggctgacctcaaatttgagctccttcagcctgaatttcagattactggtttaacccaccatgaacagctagtgatggatggatagattttttcctttccttccttccttcctttctctttttctttgtttttgtt

SEQ ID NO: 22645 - DNA, 1117 bp, Mus musculus
tagcacttgaaaaccagagggatggggattgctgcaagtttaagccagtcagagctgtgtgctgagaatttgtctccaaaaagaagccttattcttgttgcatatatgttaaagtagcctttcccagccttgaggatctgttaatgtaaaaacatgcttcagcaatagctttcactgaatatagcagttcatgcctgtattcccaaaacttgggagactgaggcagaaggatcaccatgagttctggaataacctaggctacagagtgagaccctatctcaatatccctgccccccaccctgcaaagaaactaacagttttaaattcttcaacaattacaaagttaaatgggaaaaatcttttaccattctcttctagaattttttctcagcggtctaaagatcgtgtgatccctgtgagaggtagccactcaaggtgtacctcttagagttgtactgaggctcaggctgtgaacaccagtgtcagggtaacttaagtgtttgaagctgatgctgacctccctgacagtagacaggccgactacctcatctcgctgtggcacttttgtagttactgagatgctcatcttattaaccagtgcgatatttcctaagtgtccatctttgctgaaagaaaaattatagtgtggtaagactctactcataattacagctctatatcagaatttgataaaaccttttgtttctgtgaaacaattatttttaacatttttcttttaaaagtaactttttatcagtacagaactatctaagggatgactagcttatgaatattctgttaaaaggtagttttataaagaaaagtgaaatatgtcttttatagtggtaaaactaagtatttatatgaaagtcaaaatcagtagcttttaatatacttcagactggttgcttatgatatattttctctggcttttttattcttttcaatttttaggtattaacaactgttaatattttcaaaatactgccatatgtgtagctttgaaatgtgtattaaatgaggacaagagagcgacttgtatactctgaaatgctttgtatctttcctttggtacttactacaataaaaagaaatttggaaagtagagatatataaa

SEQ ID NO: 22646 - DNA, 2114 bp, Mus musculus
atttatgtaaatgtacaattataagcctcacgtggtggagcaagctgaaggcagcaaaaaacattttccatagaggcatataaagaaataacaatagccagttgtaatgaataatctgaagtgaactatctgctacatctgggaggggcacaaaagcagaatgtaagaacaattccctgtgttttgaagaaacaggtcacaagactcctgtctcggtttcttggagttttcttacaggcactcagaaatctcacatgattctaattttgagccctgttctgaccgttactctgctgcttctggtattcacagagacccacaattatagaagttgatttttttttcccttttttttctgttgcagtcttaccattaagttgacagtggatgaagagatggcgcaatgctttttgaagtacatgtgtatgcacgagaaagcatatataatggctggtttcgctgttggttgagggcatttgtgaaagaactttgcacctcagttcctgcttcatgtgtttgaatatgtagaacatcacgtgggtacaatcagataaatgtagaagcgaatcattcaagtgtgcttaatgtgattatgtgtattgaataacatttgataatatttgtttaaagcatagctatgccctcaaaatctaaataacatggattattgttagaatctacatcttaattgacaacatcaagtactttttataatcacaccaccaccactaccaccgcaccccacagaaccaagaacaatcacttaattgaaacatgactcctcaacattttgagctcctcctacctacacaaacctggccctcttactatatttatctatttaactctgtgtgtgtgtgtgtgtgtgtgtgtgtgtgtgtgtgtgtgtgtgtgtgtgtgtgtgtgtgtgtgtacgcgcgcgctaagtttaattcaaccattatatccagttctctcctatcaagattgcttcatgatctaaggacagattcttgctctgacggagctctagaggaatgctggcactacatgcacctggagttttaagttttcctgtggtagtcagactgcccatgctgagtccaacgggaggaaacaaggaaaatgagcgaaatgcgtaaggcagcgctgttgaactgtcacccagccatctgagtagcaaggccagcacaccgatgtcacatgctatgccttcttaacaatctaagtttggaatttacaaatcattgtctccttaagaaaacaattacaaaaggtggttcatttctatcattacattatttctttgtaagttagacaggtactgggccttttatgagaagatgctcagaaccccagcagggcttttggctgtgccctggaggcgtgggctttggcattttggtgtagtctgcttcttgcatcttcccttctcaccccgccagtctgggcctgggggtttccagcttccggtcagatctagagtcttcaccctcacagcaaagcgttactcttgagcttgtttgggaatgcagagctatgggggcagtaactggtgacccaaaaatattgctggccttcccaccacgtgggttaaaacagacttataaagacaccttcctaattaagcagggaacttggctcgagtgcattcgatgccagctttttttttctggagctctcagcaagaaacctgtcctcggagctcagtgccattttgagagaaacattttgttattttggcagaactaggtataatggttaaattaaacttagtaatacaagtatgtcactaaaagataaaaagaggccccagccttaggtagaggaactccttttacgcccgaggatttgtcctctagagtatgtttgaggttcttccattggtttctctattggatgccatcctattaggctttgctgaagtaacaacttcttttggactccacaaagattgctggttctcccctgggagcttcttggatatggagcctgacctgccagcctgagtattggagccctggaacatattgtcactgccctgcctacctacataactctaagccaataattatcagttgccaagttcatcagccagtgtggggttttgttgttctttgtagggtcattggtgt

SEQ ID NO: 22647 - DNA, 1294 bp, Mus musculus
aaataaccagtagccaaatgaggaaaattatctggaaaggattttctgttttgttttaacccaagaataatcctgctttcagaacaaacagtgtaggccatgactggtctactgaaaagacagattgtcagtaagtgtttggtcttaaaggagtcaattatagaatttgttgacatgtcctcacaataattcttaaataagtacaataaagatagttgagatgtgtacaaggatagtttttgtgaagttgaagtctttggttttgtaatgttccgttctttacaaagcctccctcccgaccttgttggttttgctgtcagtggtggttaacagtctgtttctcatgacacacttcacgggtggcctcccctagacagcttttggaaactgtggattagagatagccccactctgtttctggtaagatactgcctcagtatcagtggttgcctacacttatcaactggtgccacgtattcctcaaaatgccaagattataaactgcaagtttcacgggcctttgaatccttccagcgtttagtgaagcgggcgcctaactgaaccagctgctggagaacagtggatgctctggggggaaactgatggaactttcagaattctgccaatggaaactacagtggacgatggcaattgggactgagatttcctgcttgcttctatctgcagagcccatctgaggactgacgctgtccgtgtgcacatccgggatggagctctggtccctgtgcttaaggagcttcccggtggggccacaggtgcagccaccagaggaaggggattagtgatagctctcagagaggagagcaggctgtcctgggcattttaaaaaatggcattttggtttggtttttttttttttttttttgaggtggggtctcgccacataactctggctaacctgaagctctttatatagttgaagaactcacaaaaaactttctgtttctgtctctgtctcccaaattctgagattaaaggcatgtggctggcttaataaactggttgtgtgtgtgtatatatgtaaatgaatatctttcatgagccacatgtggtgttgcatgccgttgatatcccagcacttgggaggcagaggcagtcagatctcttaagctcaaggacagcttggtctacagagaattacagggcaaccagggttatacatggaaatgaagtctcacaaaaccatcattccaagattgtagtgtttatcagtgcaactattcaagtgtacagtgtagcaggattgtttccgtttgtctgggtaaaggcccag

SEQ ID NO: 22648 - DNA, 1215 bp, Mus musculus
gaattctgagaaccaggttctcatgatgagggttaagctattagaagctcactataactatctcctacaaactagtttcagaatactttgttcttcaaccagctgtgaagggccatgcttataatcctagcaaaagagaagccaagacaggagggttactcctagttcagggccagcctgtactgcacgcagtgtcccaggccagcaagagcaatgcagcgagaccttgtttcaaaatgggaagaaaaagaaatgaagtgatgcttcagagagcaatgctgacccacactggagacgggagcccttgacagtagacctgatctgttagactcagaacttccctcggctctcttcagcctccatccagacgctaccttcagagtagcctgcttttcccttctaatgcctgttgctatgtactatgttgtgattgttctataaggaaacgggcctcatatttgtgttacaatgcaatggtggtctgttttcctcactattctgtaggtctgtcagagacctgaggtaaaatgaaatgttaacagctgcacagtcatttaatgtcttttgtctgcgtgatccatgatctcactgtgtagccctggctggcctgcaacttgctgtgtagaccaggctgtccaggacctcatggagagccacctgccctgcctcctgggtgctggcgttacaggtgtgtgcaccaccctggcctctgtctgctcctcttcagtaacatgggtacctttaaaatgacgaggatggtgctttcttatagaagatgctcatacttaaagagcatttaaacaaggtgacacagccaggtgtagtaggtctgtttcttcatttgattgattaaagctttgcccacttgtaacaacccttgatcaaaacaatgttcttttaaaatcatttcttttatttttcagtactgttacataaaagtctcacttctgaatgccaccttcttgaaccagtaagttttagactataatcttataatctagatttgtgcagttgtaaaactgttttgagtgtgtcttatttatgattattctgagggtgtgtgcatgccacagcatttgtggtgaccagaggacagctttggggagccaatcctcttctgttggggtttcagccctttaacctgctgagacctctcaagcaccctgtttggtttcaaaatagggtccagaatagggaccaagctggcctcgaact

SEQ ID NO: 22649 - DNA, 1193 bp, Mus musculus
cttttggtggggagaggattaaaacaaggtttcacatagctcccaccagcctcctttggagctgagaccgactgaccatgagcaggccctcttgttttggttttccgactgtggttgcacagtatttatcaggccagctttagccaggtgttaaagtcacaggagtgtgttcatcacagtagggtgatgctgcgatgaagggtctaggtgggtttcagaccttacttacttcctactcataacccccaaataggccgtggtatctcatctgtgatgacttttctactttcatatctactcatattttttccattgtgagttttaatattttcatttcaaggaagtgcagagtggtgtaggagatagattgaagtcttgatcatttttattagtttactaatttatctctttgagagaatgttttactctttagcccaggctatgcaaagctcacatgatttgctcgcttgagccttctgcctgccacagcctgacctgagattttattttactttttttaaataataaaatgaaaatccatttatgttggtgtctgtttctcctctttggcaggatgctggtgtcacgttttgccagtcggtttcggaaagactcgagcactgagatggttagaaccaacttggctcatagaaagtctctgtctcagaaggagaacagacacagggtgtatgagcgaaacagacacttcggtttgaaggacgtcaacattccactggaagggcgagagcttggtaatatacacgagacatcgcaagacctctctccagagaaggccagctccaaaacaagtaaggaagggtcttttgtaactgtaagtacttttgagacgcaaggggtctggagagatggctcagcagttgagagtgttcactgttcttgcagaggacctggggtcagttcctagcatggtggttcgtctgtaactcaggtttctgaggatccgactttgccggctcctgcatgggtaaggtgtgcatacatccccttggcacaccacatgcagataaataggaaaagagaaacctgggagggaatttaaagggctgaactgattaaaggaaattgttctaaataactcgctgagaacctttgaaatacaaagatttcaccagtcgccgagagaaaagagatcattcttaaactttgcccgaagtggtttggggccacaagga

SEQ ID NO: 22650 - DNA, 1101 bp, Mus musculus
attaatttacattaatagccctttctataatgtatcattcaaaatcagctgattttgtggctgttagttccacagaaagtgcttagtttgcttctgttctccgtgatttgtgtattagaaatgagccagaatgcgacttttggtagagatgttagaagttgagaaaatagacttctcttgctagaaacagtaggatacctaagtcagctctcttctctcctgttccagggcatctgttatgcaccttaagctgtactggaaactccagaagaaagagcgccctcttgaggtcagcagggacaccctgagaacgcctatgagccacggaaaggccaacggtgatgtgaaggccagagccagctacatgaaacccaccgtccttccttcagcctcccttgtcaaagcatcgtctagaaaaccttttgggatcctttctccaaatgttctgtgcagtatgagtgggaagagccctgtggagaacagcttgaatgttaaagccaaaaagaacgtgctgtctgcagccgtgcaccagagtgaggaggggctgcctgggacctgggctattgtcaaacctgggaacacgaaggagaaaattgcattctttgcagcccaccagtatagcaataggataggctctatgaaaattaaaagttcctgggatatcgatgggagagccactaaaagaaggaaaaaatcaggagatcttaagaaagccaagttacagctagaaatgatgagagagatcaacagccagtgctaccagtctgagccgtttgtgtgtggcgtggagcactgttctgtgcactacatgagtgacagcggggacggtgtctgtgctgcgaggcctctgtcggtgatacagatggttgccttccttgagcagaaggccactgctctgctagctagctgcacaaaaaactgcacaaattcgcctgccattgtgaagatttctggccagtcccgaggtataccgcctgcacctgagcccttctctgctccggaaacttgtgaagaacccaaggaacaagaaaatcccgagactggcagatcccagggtgagccagtccgtgtccttgacatggtagccaggttggagtctga

SEQ ID NO: 22651 - DNA, 1440 bp, Mus musculus
cttctggagcctcagcagtacatggcatgcctgccccaccacatcatagtgaaaatcttcaggttactccctaccctgagtttagccattcttaaatgtacctgtcgctacttcaagtccatcattgaatactacaacatcaggccagcagattctcggtgggttcgagacccacgctatagggaagacccttgcaagcagtgcaagaaaaagtatgtgaaaggggatgtgtccctgtgccggtggcaccccaaaccctattgccaggctttgccatatgggcctggctactggatgtgctgccaccagtctcagaagggctttcctggctgtaagttaggccttcatgacaatcactggttacctgcctgccatagctttaaccgggcaatccataagaagacgagagggagtgagacggaagaggagtactgaagtccatgggacagggaggcaagaggaccgtgaaacacttgggccaacctccagggctgcgagctcccccggcccttcctgatctctgctcagctctgactgccattgctcaggcattttaaactgtttctcagctgtacaagaatttagttccatggttttgtatggtggtgcctcacattaaacctatccagctgtgaagaactcttgcctgttttcctccatcaaggacattcagaggtcaccaggcagtctccacaaggggatcctgaggtggtccaacactggctctgcacttggagtgagtgaggagggaagcacacggttgagaattatgcctcagaaagaaaaccaggcaccttaccctaggcctgtatgctcgttcccgtgagagtggtgactgcagaccgacatgccctgtgctgtttacagtgtgtataatggttgtgcttgcacagggctgtgaacgtgcacattaaacccgagcgcctttacctgtagatgagtgctttggcccctctgtaaataacgtgattaaaattcagtattgtatattatgaacagctgactaaacataatcaccacagaataagacaatatcatataatagattaaaatgttgtgcatccttttgtctggttaaaaattttttaaaaaaacttcaataaaaaaataaacgttttaaatgaggtctggtcttaaaataagattttactaactttatgaatgttcatgtaaattcaggcagtgttggaggagaccagccaagggtgttggaccccctgaagctgtgctgggaagtgatctgtgtgttgtgcagagcaacaagttctctactgctgagccattacagcccaaagatggatttcgtgcacgtgcgtgtgcttgctcttgagtgtgcgcacactaaggtggcagagccaccactgtggtggtcaagtggcaggcagttgtgagccgtgctatgaactggaccagattcctgcctacgtcatctggtccaga

SEQ ID NO: 22652 - DNA, 1196 bp, Mus musculus
gtccttcagcagtctgccacgccctggcttctgttgactcacactgtggttggtactttgcctgcagattgaggtgctgtggcgctttggcagttattagaagtgtaggaaggacttcatcctgcccaggttccccacgttcccaagctctagatacccagctgtggagcaggcggctggagtctgttctgtgctcagctctgcgactgctgggctcgtgttttaccacctacttctaggacttacagactgagtgcgctgggaggaagctacagaaagtgcagaggccaccaactaccgcctacagcaatttaaccacagttgcagaaagcacagggctgggtggccttgttttatttcatatcaatcagaggcacttttgtcatcgtccctcacagtaagtgaccagcacggactgcctaggctgctcaagtccttggggttttgttattttgcactggatccacctgttgtaaatagtcttaaatacacatttcaaccactgtttggttcctacactctttgctgctcattaaaactttttgtgtaggtgtcagaaccgtacacaaacagctttctagaaaaaaaaaaatgaagctggtgttttgttttttttttttaaaccgaaagccatagaagttgatcatgttttccatttaaaaatgatttcttggaacaaggtaatactaatagacactcagaggcaccacatgggctgctttacatggtcttacgtagaaccaagaaatgtaacttaccatggtatgggggtcagcattgggtggggttcaggtgtgcattgggaaagctgcaacgtcagaacccccttgctgcgactgaaacttccaggtcaggttgatcacacagatgttttctaaacctttgttgtattactgcaataaatcctttaacagtacttggctgtgtgtgtctgtcccccagttcctatttagttctgctgctacattgatggtagcagcaaaagtgcaagctaacctggagtacttcatagaaattaaaggatacattttaaagaatgttttgctaggtaagaaattttttttagccgggcggtggtggctcatgcctttaatcccagcactcgggaggcagaggcagggggatttcttagttcgtggccagcctggtctacaaagtgagttccaggacagccaggactatacagagaaaccctg

SEQ ID NO: 22653 - DNA, 1145 bp, Mus musculus
tcttttttttttttaattcaaaaacatgtggataaatacctgtcaaccaactaaaacgcagggactaagtattccaggtgagtactgtgtcatagatgctagggtgactacagccttaatcccttacccctgtggattgcactgactaaaataaagacaatctgtcaatgattgttatgaactatagtcatggctacagagcaaaaaccactctgtgctatgggactctgaacagggagggtactttgtgttattgtggatgtggagaggtcaggggtgtagaggtcaggggtcagaggtgaggtggtgtgtgaagctggaagatgacttaaggttgaactgtccaagaaaccagtgggtttttgataattagtctctactgaagggtctctgttcctctccctttctctccttcactctcctttatttacagacacacagagtaagcaacacatctctaatcaggaattccttgtgcttgccactgtcggagaaggttttggaagtagacctgtgggaatgtgtgaccttagagaacaaaagatgaccgctgaaagtccttgctagagtagcacgctggggaccttctgctagaaggttgtaaggttgtgaggaacactcccttcccagaatgaccccggaaaacaagctttacaaggaagcctccactgcaaggcaggtgcagctaaggaccaagaatgtttcagttccctcttctgttgactaagacctcacctcacccagggccaacaatgctgcttagggaaggtcatgaaacacttgcctctccagaagggagaggctaattaccatttctaaatcggggaatgaaaaggtcagcttgggccaacaatgggtttaaaccaacccttgttgttatcaaggcctacccttaaactgaataaaaagtgtgtgcttgagagattcggggttgtagggctggagagatgactcagaggttaagagcaccgactgttcttccaaaggtcctgagttcaattcccagcaaccacatggtggcttacaaccatctgtaatgggatccaatacactcttctggtgtgtctgaagacagctacaatgtgtgcatatacattaaataaatctttaagagagagagattcggggtcaactctgccccattg

SEQ ID NO: 22654 - DNA, 1116 bp, Mus musculus
agctctgaatttctatgtctgtatggaacccttcagtctcttatgaacacctgaagcaacagtgtgggtttgcttcattcaaaaatcgagtcaatgattgcattattacctgctccttctgaaaaagtcgtacattgggcttctttcttccagattctgagtgagcagaataaagcattacagtcggaagttcagaaactgcagaccgctgtttctcagcaggtgagcttgtgtgggtagtgtggaaagagcccgagggtgagaaggtctgagcacaaaccagctgatggagagtgtgctcaaagttaggtgcgcctttcaactaccctgttcattttatgcttcaaacatttctttcaaaattaaagttttatgtctctgagaagaagaagttgttaatcttctcataagcattttgtagaaaagaaggaaaggaaaaaacgttctgttctgggagccttacccttacaggcagtttgttgtttttctaaaacaaagaatgggtttgaaacttaggggtggggtgcctcagagttggtttcccactctcctaatcagcctctcacaccaggattgtatgtaaggatttctagatttgaatggcaaaacttgaatatattgcttagtctagagctttgcacacctaaatgatttcttaagaatatatgtgtatattctaattgtatgtatttatgatattgatagtacatatgcgataatgaagacacacacacacacacacacacacacacacacacacacccctttgtaagtcagtaaagctattgcagtcttgaatggtcagcagctggagctcctgttgttgccttcacgttttctcacataagcccttccagtcccactgttagaaagtgttctgaagttgtttcccaccaatcctgagtgtgatttctggggactacataatggaaggggaggaccgcctcccacacctgctttctggcatccacatccacgtgcccaatcacaatcacaatcacacacgctctgtcaatgagcaagcagatcaatgtaagagggtttagagcagagtagtcgagaaactcttgttgttgcatgttccattagaatatcaactttgcatgtttccctcat

SEQ ID NO: 22655 - DNA, 1152 bp, Mus musculus
aatacatttcaaaagattttaggtttttaaaaagtccctttggttctcatattttaacaactgctaggttttgtttttttgtttttgtttttgtttttgtttttgtttttgtttttttgtgtgtggacaggagatagtgtgagaacgctcattcttttgatttatttcttagtataccttaattggagatgttgcttcttgcttatgtaaaacctgctctgcatttgacacctaagacatgtgcatttactgatgctgctgcctaggtgggctgacatggggtaagggtagaactgcgctaatcaatccactgtctgtccagtgatgggtaactttctttaattggtgtctcaaatctcatattccttatattgaaatggtttgtagaaatacttatttgtacaatagtcaaatggacttggactataagaacacttgagatattttacaatcttcagtacttttgctttttataatgatgtaaaatttttctttctctcttgtcagattaagaggcaaggaagagcaggtgaacagcatgaaggctgccttagaagacagggacagagacctgagagggagagggacgtgcgcacaggtgagacgctcagtcagaacacaagcgaaagcaaccctcgccccgatagctgaggatccgttcacatctgctctttttaaggatagtcaggaagaaaattaatctttaaaggcttgtgttcaggaggtagcacagcctagtatgccagaggtacagtatgcacggacagcagtgtgcttcttacgaagttgccgttctgtgtaatactctaggaggtaagaaggtatatgttctcggtttctctgttctgccatagtttagttattgctgttaaagtaagtagacttttattactgtcaaaccatctttaatggccagatttgtcaagctaatagtgtacacatttctttttccttcctttatcaaattcactccaggcttatgcttagctgtttatttgctatagtaacctgtggtcctttagaaagacgctttaatagttagctatgataaggaaaattcattcactacaggtgatggctcatatctgtgacttcctcttttggaatgctgaagtaaaagggtcactgtgggcttgaggcctgcctgggcta

SEQ ID NO: 22656 - DNA, 1383 bp, Mus musculus
gcagtcacagaaaggctggacggatatgcccagtctgctgcctcggagctacggaagggcttaattattagagagctttaagactgagactgagtctgactgcctcctgccttagactgtgtttgttcttacagatgggctttgtaagtttcagcctggtccactttgctccttgggtttgcattatactgagcaagacctaataagagtggcttctcagggttgtcatttcaaaatctttacctaaaggcttctgagtcctgaggtgtcctctcgtgtgatcaccatcagtatgaggggctccgggtgccactgaagcgccaggctgggtcttgtgaactgtgtgtggggtgcgtgctcgtgggttgcttctcttaccttgttctaaatagatcactttcttctcttttgcagagtgaagtaattgggaaattactcgttagaagttaacagaaggcgttgtattgtattttgccaaattaaagccttatttatgttttaccctttctactttgtcagacactggacagttttgtcttttctaatccttgttagactactgacttaaagagaaacactttaaaaagccaactctgtagacaccttcagagtttagttttataataaaactgtttgaataattagacctttacattcctaaagatgaagtaaatgtaaacttttaccttattttgctcaattaaattgttcagaagatcaaagtggtatagacaatgtgaaatttaacattttaatactgatgttgtacactgctttacttaacatttgggaagaagccgcctctgacatcaactcaaggaaacactttttgttgctattataatcagcaaataaagggacacttattattcaacatgactcactctgattgtcgttgagtttcaacaagtttcactagcgcttcagaccgctgtttctaattgcagccaccaaacaagacaagtcttgttgcttctgtaacttcctgactagacctttgtgtcttctctgggtcaggactgtgccaagtcccacagcgtgggtgatggcaaggtgcaggcgtttgagtcccattcaccgcggaggagagctctgctttatttttgctgctattactactgtttcaagtaacacctgttaagtctccctcttcagagagtgtgttagtacaggttacatgtgttctcttgtctgttggaagccgtgtgtctgtgtgtgtgtctgtggtattaagaacactgtcttctttagatgaaaagtatcctgtgccaaagaatattaaagtaccttttagtattattgctattttaaattttgattttgattttaagtgcatgagtggtttgcttgcatgtatgtatgtgcactacctgcttataatgc

SEQ ID NO: 22657 - DNA, 1189 bp, Mus musculus
gactctgtctggaagccttgctgcctcaggtctttgccggtcgtcttcactttgcaggtatctgtgcgaatgtctttctaaaacattgtatacgttatggttttgtttggtctaagaacccagttgtctctttgaaaaggtagatattttctgtcttagtcttgttattactgaaggatatttactgtcttaccctcagtatagaacgtccatttcccccttcctcttccttctttggtgatgatggagaaataacagatcctgcatccctataagcaatcacactgactctatgtgaatgacttagtggcctttgcagaactctgtggaatagacaaggagacctgaacaacacagccttctctggtttgcctgttcccttccttctcaaggcaggggaagagtcgctcagtcctctattctgagaaagctgatttacacgtactgataaaaggaggaggcctcaagacttgggatggttctgccttttacatctcaaaacaagagcttcagtcagcctcatcctatttgaagctggagttaaccaaaaggaatgtaaaatgatttgcaggttagataagcatggccctttagtcttgaagcataacgcctaccccaagccatcaagtgtccctgtcaactctgagcatagttgcagaggtcatagcatgtggcccctggccaaccaatccctatgactttgtcttgtcccttgtgacactccccatgcacccaatggactgggcctgtccccctggcttgctgctctgcttcttggtctcagacactccagccctgatattttattagtgctttgagatctgttcaggacagcattctccctgtatgacatgtgagtttctcacagtcatgctgcctaaacatgccccatattttggacattaccacccctgctagattctcctactacccatcctgctgtcccatctctgctacctaatagggtagcggcatgtctcagagtcacccagcatgtctcagtctctctcctcatcatgttctttatgaagagtcaaggagtaaaggcaggtgaagtgtgcttaggcagccaagtacttctctcttgatctaagtagagaaggtagttttttttttttattaagaaagtatcagaaggtattgcagaagctaatccaggcccaaatgagagccatctgtttttaagcag

SEQ ID NO: 22658 - DNA, 1190 bp, Mus musculus
ctaggatggaaattcaagctctaagcagacagcaacctcatgaatcagctctgtgattttaaccaagataaagaaatctctcttggacctcattttcttcatcagtaacaatgagactcttaactccctagtgtccccatcactctgctttttgggttgtttgtttgcttgtttaagaatgaaataaatgatgggcagggagaagggcacattgaaaactaagtgctatggaaaggctagcacattcaacatgcatttattaaataccgcttactcatcgaccgctattactaataaatatcaccattcactccattgaaactcatgctggaatttggcatgcaaatttcctgagtgttgctcatttgcattggaaaaagggaaagaggtgggaggccttttgaaaccttttgaaaattgagctcagggggatgaattcttatcactgggcccaaggtgtaattgattttctgcacaatggctcacaggtgttacatttaacaccccaagtaggtggagggcggaaatgtaccccaaggtgcagctattactttaaatatctatgaagtcagcccttccctgaggagggccttgtatcctgagagggtgtaggggcggagcttcacccagttgtgggagtgtgctgacagatagattctcctgctccttggcattaggattttctatggccaggagccaaaagcgcctcttttccaacctgcaacccaaggtgaggggagaagccagggcagacccaccaagaaatacatattaacattgtaacaaccctctcagaatccactgttgctatgtcaacaaagcagctggggaaattggaaaatgaggttggctttgacaatatggccggtgtttcctcctcacagaacaatcaactgtgagcctgggtggtcttttcttaccttcactttcctttgcttgtttatttgaacattgagcacacacctgatggctctccacatttgggggttagggagcttctgtgtcatgtgtaagaagaaacaaaccaaaggaccccgcctccccagcctctctttacctgcttaagtggatttcttggtcccgctctggatctgccggaaccagtacctgcctctcctgagactttaaaagcagcatgtacttcatctcagcaacagttcgctctttgtctaaggcaagagtatgtatgt

SEQ ID NO: 22659 - DNA, 1190 bp, Mus musculus
ctgtccttttctctcccagcatgccgtgcttttgattctagatttgtttactatctaggttccagaaaagtctctcaggagactgactgtaggagacaggctctctcctgaattaagcttcctgtccacttgtgaagataagtaagaatgaggaggagggctttaactagaatgtctgggtagccaaaggctaccacacacgtttgtaaatggagaaagaggtggggatgccagagaaccaatttaatagtgatatttaaagataaatttatttaactaaacatgtgcttctttttttgttttttgtttttgtttttgtttttgtttttctttttctttttctttttctttttcttttttgtttgtttgttttgtctaattttgagacagagtttctctgtgtagccctggttgtcctagaactcactctgcagaacaggttggcttcgaactcacagagacctgccttcctctgcctcctgagtgctgggatcacagggtatgcaccaccaccatgcctgacaattttcttattaaaaattttcaaatatatattctgggggctggagagatggctcggcagttgaaagagcgtgctgtccatgcggagaaactgcattctgtttccagtacccatatcaggcagttttcaactgcctggctttgggcagccaaacaccttcttcactccatgagcgtgcaccttcctaaatattacagagataaaatacgaagaacactttaacaatgttctgagaacttttatgctaggcttcccaacatggacaagtccctcgtttctgaccacttttctctgtgcacttgggattaactcagtcttgcagatgctagcaagggcatctgttttgttcagtcctcactcttttttttttttttttcttttttctttttttggtttttcgagacagggttttctctgtatagccctggctgtcctggaactcactctgtagaccaggctggccttgaactcagaaatcagcctgcctctgcctcctgagtgctaggattaaaggcattcgccaccatgcccggcttgtctaggcatcttgactgatgatcaatgaacttatttagaaatgggaacataatcgcttttcagccttttggctaagatcaagtgtagaaatggaaacgttaccagagctactttgaaaacaggaagaagc

SEQ ID NO: 22660 - DNA, 1165 bp, Mus musculus
cagttttgtctgtctatctgtctgtctgtctatctgttatctgtctttcagacagggtctcacaatgtagaccaggctgacctcaacttcccgagatgcatccaccttcctgtgcctcctaagtgctggtattaaaggtgtacaaaactctgaccacctagtgtatatcttttaaagacttttatatttttacagaagttgcacttatttgaataaagttatgacactttcttacattactgtcttaccagtttttgtggaagctatagtaataattagctattttattcccaatatcagaaatttgtttcacagattttttcctgaacaaatgaaaaaagatttatttattttataaatgtgtacactattgttatatgtgagtacactgtcactgtcttcagacacaccagaacagggcattggaccccattacagatggttgtgagccaccatgtggttgccggaaattgaactcaggacctccaggaagaacagtcagtgctcttaaccactgaatcttctctccagcccacaaggtgtattgattttactgattttaccgagaaccatttttttgtttcattagtctctccaccccttgggtttccctgatttttgttctttattgttaccttccttcaacttgcttaggtgttatttgtccctttcctggttgtttttgtcttggtttggtctttcggtaaaagcagagtgtgctgatcttttccagtgtgtgcatttaactacatttctctcttaagtactgtgttagttgaaaactgagttgtttaatatgttttaattcatttcaaaatattctttaatttctctttgattttttttttctggccctaatatgataaagaaattgtgttatttggttgccaaacatttggagacatactagatgcctttctgttaatgattttggattttattccattgtagtcagtgggaaaactttgcatcataatgccaatcccttttaaatttattgagatgatttatattataagatacagcctgattaaggttgtctatacacgagagaattgtatattcacattctgtaaatgtcaggccttattctttgatgtcttctatactttttttaaaatcagttttctgtttatctcttctatatgttatgcatggatttggg

SEQ ID NO: 22661 - DNA, 3834 bp, Mus musculus
gagtggcttcgctttagactagtctttagtctctgtaccacacgtcccttcctgtcccatggagagagaaacagtgctgcaatcagagtcccttccttgagtaagagctcagccttctcctagtgcaggttcagtcagccatcctatgggctgtaattgatttacaaggaaactgtgtgcttatccaagcctcagtacaaagagcgtgctgttgcagaatacccatggtctggttaaagtaatcacaaattgtttctttcaaaagagccagtgggaaataatgggataatgttcaaatagtagcctggtttttatcatatctctcctgctagccaataaacctccatattcctatttgatgttctagaactcctgtctttctgagacagggtctcataaagcccaggctggcctgggtctcactgtgtagctaaggatgatccctcttaagtgctgggattacagtggtataccaccatgtccagtacccttctaggactcgaactcagggtttcatgcctgccagacaagcaccctcccagctgagctgtgaccctaacccatcaaaggctgctgtaacaaattcagttatatgccagaacaactgtgtttaggatgccagtagacttaagactgtagtaacttcagaagatgagcataatgatctatgattctttagtgtccttagacaaggctttaaaataattgtaggtattatagtgtttgtttagtttttaaaaataaaataaactctgttaatgaatgaactcaggtaaacaaccaaaagcctttctgtgggtatcatttagacttatttaatatagcaatttttttctctttaagtctgtccctgtcgttttctttttaccattttcttgattcctttaaaactgtctagccaagttccttatcttctctcatttctacaattacatgacatattctttttttagagcagcatactgtcatcaaattgaacttaaagtgactatttaaaaaaaaaaaaagatctaaagatcctgggaacttaactgatgccaaatttagaagccagacaataaatatgaattgtagaataatattttttaattaaacttattctgggttctgcttctttttgtcttttttttccccttgagtcttctaaaaaaaaaaagcttggaagaagctgctgattcttagaagtagagttgccatcattgaagggaagtatatataaacttaggacttgaaatacagtttgtagagtcagtcctactcattctagacccttattgccttcaaaacattatcctagaattaagttctattttcatggtcctcctgaggaaatggaggagatgggctgcctgccggggacctgagctagctatcctgacctacccagagggagggagggacggaaacatctttcctgagaaaacactgttctgtagaggctttttatcactcttcaactcaaaacttaacatttcactttaatttattaatggacctgtttggaaattttgattgtacaaatgcttaaccaattgtactgtggtagataagacacatttatctagtgagcagggaaagattccatgtgtaatccttgaagcaaactcttcatagacaaattagaaaaaccagtgacctctaatttgacatttctagaaacctggggaaaatctaggggttactagaaaagcgttggggtgacagggaaccagtgccatctgttgccattccgttgtaacacagcactggggaactcaaagccagctcacatttccatcccatggagatcagctggacacaccgatgcttctgattttgtctagaaacctgtcacttcaggataatttctgaagacaaagcgtgttcccggtttggtaggtgacctgtttaatgttttccctgtgtctgggaactccttagtgtaattagcgacctttgaactccgcagctaatcctgagctgttttgtattccttactcatctttacggctggacctttcttttcttcagagtccactgccacaattaaagaagaaacagctgcatttcaaagggattccgattccagaagcttaatcgtgattgacatgttcttattctaagctataagacactctaagagtcctttctttggttaaaacttcaatcattttctaaaaaattatctcactatggattttattcattttctttgatagctattctttgcattttttttaacttgaaaggtgctttgcatgtgcagtgaatatgagtgtcgacttccagtgagagatttggacattgtcagacttgctctagattcgatcgtgctaaattcacatttagtgacaaaatatgattatgaaatctgatatcagtgttgtaatcattcttgctcaacccaaagggttaaaaaaatgttcatcctagaatgaactctagaaaagctaggtcatgatttgagtcaagcctgttctccacgtttttagtaagcagtgttttaaagcacacactagcagctagagagtgggatgttttatatgattaaataatggaacctgtcaacttggaagcaaataggttccttggacgatgtccttggagcatttaattttatttaaaccttagcccatctcagaatcacttcctttcatgccatctcagtatttctcctgttaaaatattgtggtcttagatttcttgtgctatgtttaacagcagaaattttgcacatagtaactattgccaatttttgttgttgttgttgttactatattttaaaaccttaacagtcattcatagattttcacattacccctgagaattagataggtggggctcccacccaaaacctctgcatggactgcccccctcgcagaagttgtctctaagacaaaggtcaaaaaagggatgttaataaacagtcctcaggtttaagggactttttaggattacatcttaaattccaacaaatcagatttaggagttgctgaaagtgaaattgatccatccctcatccaaactttgcaatacttccctgttctgacacccctgagatagttagctgtatcatcagattagagaccattgtgccaggctgctgaaaggaaaaggagccaaaaagctaaacatgggatgaatcctgaaccttttaacctggctgaagtatgttggttgctgttatgcaaataccttcaatcctctgctaagttccgtggaaataattttcttgaatgacaggttgattcagcaaggattcggtcgctgattaatccccctttgatctagggtatttcccttaaccaccagttagctcgttctgacaaagtgcagccgagattagggagatcactagagcactcccagcctgtgcgcctattctctataaccttttaaagcaagggccaagaatgcaatttagtctcagtttttgaagatgtaaagtcttgtctgctaagttagaaagtcaattgaataccaaatgaagtttatttcttacgtaaaagaacaaacatttcttctttgctctgcctaacaatgatattaagaatcatgggctttgaagagagaaaaaacaaaggccaccttccaaatacaacttcgtgttttgtttcatgtgcatgtttactgccccccagataacccaagaatcaaaggagtggctacagttatgctgagaaaacacttgggtttcgtgagactgcagtgcctcctcatctccccagccgtccccagcagaactggaaaatacactgcatagcatagcacagagttgcagttagggaagcatgcagcacacagtcttgttagatttactttccgtgaagaagtagcgcctcatagtctcattaa

SEQ ID NO: 22662 - DNA, 2884 bp, Mus musculus
ctgaccctacttgggaaactgagaaatggcttaaagggatggagctgggaattgtggggtttggatgcacttttttgtttttgtttttttgagaatgggggaatttttgaaaacaatagaaaattaatgtaaattggtatgatcttatttaatcaaaatgattgataagctgtgaagaacagcttctataaactagctgggttttttcttttttctttttaactttatttgaattcacattgcttccatttctgaaaatacttcacttttggtttagtgttagaaatgaatttcaaggagcattgtatccatttcaagctgcatttattttctttttactcatgagcagattgttgggggacctttgctttgttcctccagaaaaaaaggagagggatgaaacatttttttaatgagttctttgggttttctgagcagccaaggtgtttattagttacagtggattttggctaatcagtgtaatgttagcaaattgtagctccctgctttgggttgagttggtaaagctgtgatgagtaatttatttaactaggatacctaagcactcataaggaacaagagtcagtttctcaaaaatgcttataggaatctggcattcatgttgtttttttcttttgaatatacttttcttctactctaatacttggtttgaattttattttatggctgtaattactgtatttttaaaaaccctacctccattaacagttggtaaaggccccttttcaggaaagtttgttgcgctttttttgtttgtttgttttaaaggaaagctgctctttgctcagtatagtattttggaagtgaacatggtaacaagtacttttaaaataaagatgcacagtttatatttgaaaataaaaacttcctgctggtgggatcatttatagttccttatttttaagaaaatgtgtctttccattttatattgctccttaaagtttaatattaaaaatgtgataaccacatagtactcagcttttctgctgaccattttgaatctgttttggtcaaacttcatttgggtcccagcatttagaagaatgccagtcatcataatgcctctgttctcattttcagtgtgaaggaaagtagctaaacagtgtacttgacatcgtcaaaagttgttttgatttgctggtacatagggatgacttgttgaggaacatacattttcttgactcactctaatggatatagttgtaaaatagatatgtgctagacttaccaattcaaaagttttgttcttcctaggttgtcagggaagtatcactactacccttcagttcagaattgctgaagtaactgattgtctgatgatttgtgaacatgatcttaactatgtgactaaaatatcagatcattacaatactgctcaattgatggatacatgttgaatatcagtgtatactttgatgtttttaattacttgaccctttttttaaacctaaaattttaacctaatttgataacctagtaacaaaactttgcaagttgaattgcttcaactttaatttgacattaggctttcaattctcttttatcagcttaaagtggttccatttataattgacagtgggttcacttggctaaaactgagcaaaattggtgcaactttcttttagtggggtgctgcctctttaagactgactgtactatctatccactgacactggtttagcagttgatactgctgaacatttaatacatgctaccatgaagctgtatatgttagtattgaagaaagctaacgggtatgctaccagtcttgtaatttcccatacattgggatgaaactacttaactcgggaataatccaagtctacagatcataaaacatattactgcttgatgttgaagtcagcaaaataagataaaaattgattttaccattttctgcctcctctaatacacacgtaagacaaatctatgtaaaggagtttgtcatgttttaactcttaccatgccctgtgttaaggtcttggctggtatatatgactagatgtgtatgtttattatggtgtctaaaaattatgaggttcattactttctaggaccatacaggaaatcaggttggcagtacaccagttacttttcagtatacgtctacattactaggatgagtgctataatgtccaagggctttcaggtttgtaaaaacataaccataagttacattgtcatcacatatgagttgagtatctatgaactatcacgtgtatctcaaaaatattggactgctgtttaatgactggggatattgctgcataattttctcctattgacccctatccttttggagagagagatttgatgggatttgaaatgtgcaagctgtctgaataagatacagtcaaataaagtatggttaagttgtgtttgcatttttctttaagatacagctgtgtgcattctataatttggtttcagataatcaaaaagcaacctgttctatttctcactgccctctatcaggagttatttggaaggaacgatataggtgctatctctctactttatattctgacaaagtaaatttggaaataaaataaaaaacttgattgctaagtgtacttgttagtcaactgggctagcagtaccagggagaacatttttaagcattcatcaactgaaagtagtttgctttttatccttgctcctagcaacttattcctaagtcagttttgagttttactgtttgtacaaaccttcttgtgtaagttgtattttttccccttttgttaaacactgaagtggagcaggatctaatgggctttttgacctattcttgggagaaacttgagtgggtagttatgtattctttcatatttgaagtactgaggatcagtgggaggacgagatc

SEQ ID NO: 22663 - DNA, 1237 bp, Mus musculus
tttagagtccttccgacacatggcataaggcagcccaagaggctgggtctctaaagatatttctagtttaggtaataattaatgtggttcgtatcctaaatagtaaaatttaaaataagatttaaagcaatgtctctttattaaagcattaaagcttgctttaataggtattcataggtattaattgacatccaaacttcgtaatatgatagtaatgcttctaatattgattttaaagataataaattgttttaaacttgggttttgctttcccaaggttacaggtattatcctaaccttgcacaaaaaacttaaaaattatggttaaaactgctattgttccattgactgcagcttgcagtttgatttcaaatttaagatctttaattcacctgtatactgtaattaagataattacaagagtaatcatcttatgagagcgctcatacagctcacttcatacaaaactgtgacagagttatctagttatgtttgtctttgtaaatagattagacaaacagtttggttatagttgctgcctggcaggaaactgtagtacaggcaattttttcacaacattaaagttgtgaagaacgttttaactgtaagtcatcttaagaaagagtatcaaaatttagaggcgtagacagctatattgtttctctaaaatcggtccttattacaggagggccaggatgctcagattaaaaagtatttcacgtttgagtcaatgcagggctctgggcagccccacagcggcttgtggcctttcttttgttttgcaaacagtgcctgagaaagatttttccctgtgttcaagagaaattctttttaacagtgttgcagatctattcagatgtttaaaataatgcttaaattcaaagagttttgcttctagtgaactgtaatcactagaaaattttgcctctaggtatggctaatgtaactttacattatgtaagaaaaaattttattgtttctgcttctatacaagaagccaagagttttaatctttcagtgtatattgtttcctaagtgaaaagtattttattaactaatgcttcttaaagtttaccttaaatacttgctctcacccaaaagattcagagacaatatccctttattacttagggttttagtttactacaaaagtttctacaaaaaataaagcttttataattgttattaattggtaattaaaaattggttgtgcccaaaacaattcttttggccagaa

SEQ ID NO: 22664 - DNA, 1143 bp, Mus musculus
tcagcataaggagcaccttggacccaaactatagtctggccctttaccatggcattggaaggtccttctttaaaaccaaatctacttggtcaaaaaacatgtatcattaatttgtgtttgttaaatgaatgaatctttcccacaagtactttcctcccacacaaatttaagtatcatctctagggaactaatgggaaattttcatggaacccagttttgaatgctggctatctcacaaaaaaatatttttcctaagtttagttcttttggtcaagaaatcaaatgtataaagttgattaagagaaatgaaaagtctcatggagcaaataaaagctagccatccataaatcagactaaagtcggagttttaaaaaagtgaatatgagtcatgactctcatcagtgagtcacagatccactaggagagctgccctgcttctgcataggggatgctttctaagaacagtctcttcctgtgttcctgatgctgggaacaagtgaacatgtggggactttgtcacttgaaatattgaacaagttgtatatagtgaactaacaacaggttctcttaattcaagaactcctggatgatactgacaggcaatcgtgcctggagcaactcaatctgtagctttagattagatcagggctaatagtgcctcttcaaactgttgtataaaaagccactcttttgcctgcttttgggaccttttccctcatactggattgcctcgttcagccttaataaggagggcagtgcctagtcttactgtaatttgatacgccatatttggttagcatccatgggaagcctggccacttctgaagagaaacagaggagtgggtggaggcagcagaggagaggcggattggaggatggggtggagagaaggactgaggggaaactgcaggcagaatgttaaaatacagataatcataagtatctgtcacaaattcacatagggaagataacatgtgtgtgaatttgtgctttaacagccatcttggtatcccctttggcacacatgactatgtagagaaatcagtttatttagatcacagcagatttctgtataaacccatttagctgtctgtataaggaaatgtgatataactatacattagactgttacccagtcctaaa

SEQ ID NO: 22665 - DNA, 1475 bp, Mus musculus
ggaggaacaagctctaaccaaagacaactattacaaataactccagagattaccagatggctaaaggcaaacgtaagaaattactaacagaaaccaagaccactcaccatcatcagaccccagcactcccacctcactcagtcctgggcacaccaacacacccaaaaagctagacctggatttaaaagcttatctcatgattatggtagaggacatcaagaaggactttaagaactcacttaaagaaatacgggagaacactgctaaacaggtagaagaccttaaagaaaaacacgaaaacacaaccaaacaggtataagtccttaaaggaaaagaggaaaacacatccaaacaggtgatggaaatgaacaaaaccatccaagacctaaaaagggaagtagacacaataaagaaaacccaaagtgaggcaatgctggagatagaaaacctaggaaagaaatctggaaccatagagacgagcatcagcaacagaatacaagagatggaagagagaatctaaggtgcagaagagtgtaggacccgaaagatggtgaactatgcctgggcagggcgaagccagaggaaactggtggaggtccgtagcggtcctgacgtgcaaataggtcgtccgacctgggtatgggggaaagactaatcaaaccacctagtagctggttccctccgaagtttccctcaggatagctagcgctctcgctctttctcgacacacgcagttttatccagtaaagtgaatgattagaggtcttggggccaaaatgatctcaaccttatctcgaactttaaatgggtaagaagcccagctcgctggcgtggagccaggcgtggaatgcgagtgtctagtgggccacttttggtaagcagaactggctctgcaggatgaaccgaacgcagggttaaggcgcccgataccgacgctcatcagaccccagaaaagggtctttttagacttttatgactttagactttttagactttaatgaaaatcaagccacaacatacccaaatttatgggacacaatgaaagcatttctaagagggaaactcatagctctgagtgcctccaaaaagaaacatagagacagcatacactagcagcttgacatcacacctaaaagctctagaaaaaagaagcaaattcacccaagaggagtaaatggcaggaaataatcaaaacaggggcaaaatcaaccaggtggaaacaagaagaactattcaaagagtcaaccaaatgaggagcgggttctatgagaaaatcaagatagataaacctttagccagactcattagaaggcagagggacagcaacctaattaacaaaataagaaatgaaaagggagacataacaacagatcctgaagaaatccaaaacaccagagatccttcaacaaaaggctatactcaacaaaactggaaatcctggacaaaatgaacaaatttctagacagataccagga

SEQ ID NO: 22666 - DNA, 1133 bp, Mus musculus
acatgaaataaaaataaattcttttctttttaatatataaagaaacttctggaagcacaagacctgcatactactgggcccatttggttttgttttttgtttttccagtagtagggcttataagatccccacctctcctgagggtgtgtaggcagttaatggtggttgggggtgggagagtcattttgtccagtgttgtgaccactggtacggggtcaggtacataaccatacccatgcccttctaagcattaaaatgaacatagatgcgaaagtagaagaggcagatgggaaaggggatcagtgaacagggaagggggacaggaaggggatgatggaggatagaaatataatctacagtttgtgcgtgtatggaaatgtcatagtgaaactcatgattatatacaataatctatgttaataaaaactttaaacatacagacttccgagagctgctggtcgtatcttggactgggctctgagatggcccactgctgttgctcttgcagatatcctggggaatgcatatctttctctttatttcaatactggccagaaccctaagatctcccagcaagccctcagtgcctatgctcaagcagtaagtacttgcaatcacccagggtggaagtagaggcaacaacggaatcaggagcctttgtccttcctgcgttcctttagcgagtagtgccagcagacgttgctggcacctcgcatgtctgcagagctgacttagaagatattagggacggtgccttggtgacagataactccttgagtgtctcagtttcttacagccgtgtataatgagattgtggagccactcttgctcgtctttttttagtagggcaaaaaaaaaacaaaacaaaaccccaaaacccaaaaaaaaccccagtaaaataatacttgtatagctttgacaaatgaaagctctggaaattaaatagtgctagattaagtagttacagcaaattatgtatgtatttatttcataagcaaggtatcacaatgaagccaaaggtaaatcacaggacacggccctggctctcccacggctgggcatcgatgcacagtttcttccaggaactcgcatgttgtaagccatgtttctatagagacacttgcttggggctt

SEQ ID NO: 22667 - DNA, 1114 bp, Mus musculus
tctcattgcctcccaattgcaattttccctatctcctctcctctctctcctcccattccccagccccttctgaaaaaggcaggccatgcagggatatcaacatgacatataaaggtacaagtaagactgggtgctcttcactaaggctaaacaagcaaaccagtaggaggaacagggtcccaacagcagggaaggtcagagacagcccctgcccactattaggcatcccaaagggtcagccccgcgtaggctccctgctgtcactttagtctctgagcccctatgagcctaaattggtttctgtgggttttcttgtcacaagaaagctcttagaagtaaaaatatccttacactgccatcttgtggccaacaggggctccaagtgatttttccccctatgtttgggggaagttgtatttcttatagaagataaatttaattagtattggctcaagaaaatgacttggaaactattttggattactgttctacttactaaaaaaccttaagaattgtttttttttttcgtactgttttgctttgccagaacagggtgttggactcctggcctgctgtgagctgcctgataatgggcattgggagcagagctgaggtcctctggaagagcattgtatgcctatgtactaagtacatacagtgcccactgaggctagagcaggaggacatggattccctgtgacagaagttaacagtcagccctgagccaccatgttagtgctgagaattgaactggggtattttggaggggtattttggaagagcagctagtcctttctctagtccccacatttgagagttttaaacataacacttttcagtctttttggtttctctgtagccctagctgtcctgcaactcactctgtagaccaggctggcctgcctctgcctaacacgtgctgagattaaaggtgtgcgccactacaatgcctggctacttttcagtctttatatgactacttaatacagtttcatgagttttattaaatgggtttgcataccaagcaggttatagaccatacataattccttacttgacactttttatatgcatgtttgtataagaaatttggaagcacacacaacttatgaag

SEQ ID NO: 22668 - DNA, 1444 bp, Mus musculus
catggtcatcagtaaagtgttcaacggtctggactgaccaacttgctgccagcgttgctatttggagctttagaacctgtaaattcattgaactttagttgcccgaaatataaaaccgagaccacagacacagtatacggtctacagacaccaattctaagattcgaattttactttctgaaatcggatgtatcttaaaaggttgactacagctaatcactttactgtaagcgcttatccgtgacccgcctctttggactgaagtgtaatatgaaaaagcgagaggctccctgtgacactgggccgagcattcagcctgcggactgagttcccacctcgccttccagagcctgatctctgccgccgcggcgccatcgctcttgaaggacgacgtcatcatcccttgcccggatgcgcgggcttcttgtctagcacaggagcctggggtagagcgcatgcaaattacgcgctgtgctttgtgggaaatcaccctaaacgaaaaatttattcctctttcgagccttatagtggcggccggtctacatcctgaaagtgggcggaggaagctcatcagcggggccacgtgctgagtgcgtgtcactcttcggcccctgggaaggtctgagacttgggcctcccgcggccctaaccgggctctccccgagcggggaggtgagttcccagagagcagggctctacgcttgggcagactgggcaggagaagccccgagtcggggcggatgcctccctcgccggagcggatgcctccctcgccggagcttggaacagactcacggccagcagtgcgagttcaatggctgaggtgaggcacctcccgggcctcataacccaattcagactactctcccccgccctcttttttgatcgagatccttttggagtattgactcgaaagggttttatatatttactctgtgtctcagcattcagtcagtcattcattcattttgaacagttgtgactgtattgaccacaaccctctactataaaaagaccaagcttgagagttgttcaaatatggattaaaccataaaaatatagaagggagtttgacaacatttagtgaaacatgatatgaaccccctcccactgttggatttttggggctatactttagctatttgtctagcaaaaataaacgtagttcataccttcatgtaacttgttattgggagaatatatatgtagacttattacaaaaccaaaaaaatgaacctgtaactgtaataagtacttaggaaaagcacatagtatcataatagagaaacaggctgggaattcctcatgaagtaaatgagcagagttgagctacagcgaagaacactgagaaaggagaagcaattgagataggagtggaatagggctcataccaagcccagctttccttacaaaggcgcgaagctgtgacttgactagtgtgtgg

SEQ ID NO: 22669 - DNA, 1533 bp, Mus musculus
caatcctggttcactcagtagatgtgagaaatgctggcagatgcctgggatggcagagtactttactgcttaagggaaggaagcactaaaccacctgatcttggaaagacccctgaaggtgttacaagtgattggggtacagagacagaagtttgcattgcattactgtttctaggactttgaaatagtagataccaaaagtaacctcatctttttcttcttcctcatctgtcagtttggtacatggaagcatgcacagcaatatggagggatctacgcagcctgggcatttgtcattttgttggctgttctatgtttgggtcgggccctttattgggcttgtatgaaggtcagccatcctgtccagaacttctcctgagccccttgatgcagtctgtgcctgaccgctgcctggtaccaacagtaacactacaaaaggctctctggacttctacaaggaagccaaacagctgcctcccttttccctggggagaggtaggaaggaagcagtcccttccttccttatgtttggaagggtaggtaagaccattgctggctggctgctctcttccaggggttgctgtttagggtaaataggcaacattgcccctaagcctggatcctaaagatggttctagccatgcccttcctgtacgtgctcccgagaaccattcctgtcccttaatacattccagggcagggttggggtgggagatgggagggggtgttcccctccctctgtgcaccattaggaccttgctgctgctattgcacttcaccaggggctggctctggcctcaatacccagtctcttctccccacatttctcgtcctgtggggtggggtaagccactgctctgtacagaactataggaactgatgtgtatatatataactatttaatatgggatatgttcccctaatcctgtacttccctgaattcctccttccgattttacttccagttgcagtattgaactgggctgaggtagggtcactgtcttgggagaggttagggactcatctgtgcttgtaaataaataatgtcatgactctaacctttcccacttaacaacttttgtgtatgaaaaagggaatatgtagttttcacaaagggacaaagaaagccaagctgaaagtagggccttttatttctcttggattgtctaaaggaaaccagaagtttggtttaatgtttaaaatgagggagcacatacaaaaccaaacacctgaaggctaaaacaccagacttctgcagagagagccatctcccaggcaggaagctactgcaggagggtatcacagtgctaggtaaagggtgatgggacagtggtcactgccaagagccttggaccggatcttgctgtcacacaatgcaggtaaaagagagtgggaaagcaaaaagtaatcaaggcgccaaccaacattcttagagcgggcattcatcatgtaagtccagaaagtgtaagcgtaagcagtgttggggtagagatgccggaagctgtcagccaatggtacagcttgtagcagttc

SEQ ID NO: 22670 - DNA, 1185 bp, Mus musculus
tgtgggccgcctagaggaagaggcggaaagaacggctgaaggccctccgggagaaaaccgggcgcaaggacagggaagatggggagccacagaccaagcagctcagagaagagggagaggaagttgggaagcacaggggactcaggctcaggaactatgtcccagaggatgaagacctgaagaggaggcgggtcccccaggccaaaccagtggcagtggaggagaaggtgaaggagcagctggaggcagccaagccagagcctgtcattgaggaagtggacctggccaacttggcaccccggaaacctgattgggatctcaagagagatgtggccaagaagctagagaagctagaaaagcggacccagagaaccattgcagagctgatctgtgagcggctaaaaggccaagaggacagcctggcctctgcagtggacgccaccaccggacaagaggcttgtaactctgactgacaagttctccgtgtcccatctgatctgttcagcacacacatcctgtgggaagatggtctcaggcagggagggggttaggctggccagtacttctgggtcttgagaactgagccaacctactgagtctcagtttctgttggtgtgacctgttcatcgcccaagggtgcccaccaccccgagtggctcaaagctgggatctgtacatatgtatgcaaactgagcttttttcaacttctgcaaataaacctctatttagtaggaaaaaaaaaaacacattggtgggacagcagagagataggcacaaagagatgagagaagctttcctgtgaacacaagatctatctgatgacattcttagctttttttttttttaagatttatttattttctatatgagtacattttgtgtcttcagacacaccagaagagtgcatcagatcctattacaggtggctgtgagccaccatgtggttgctgggaattgaactcaggacttctggaagagcagtcagtgttcgctcttaactgctgagcaatctttccacccacattcttagcttttgggttggtggaagctagtggtctgctaagttaatagagttctaaagttgttttttttttttttgctagttgcaacatgtcattagttcagacagaggtgggtaaggaatgctgttctggaggttggggtggtagctagaacttagcccaa

SEQ ID NO: 22671 - DNA, 1211 bp, Mus musculus
tgtacggggaggctacaggtacaggagccagaggcctgggaatccagatacttcactgtctcgcgcaggaaataaagcaccgcagttgtcgtgagaccttggtcactaaaccatggaatggactcaaaacggctgtggctatgacttccagtaaaaagaatggcctttctccaaggagagcttctttattgataagtgctgaggttaaacctgggatctcacccaggctaaccacagttcaagccacgcctccagcccctgggtttcttagctgtggtggcatctcacgcctcccacctgcagagtgtcgcgcggttcgggtgcatagcgcttgttttcggatctctggtgcccgcttcaccgcatgcgtgctcccacccggaggcgggcatccttaaagctctggcgttgtctggaggacaggacggcgatcccggcagggtgtccgagtagagctccacatacccaaagccacaagtagggccgagtcggctaaatggtttcctacctactgaaaaccactttcgaaagagcactgcttgtgcttcccttcgatagctcagctggtagagcggaggactgtagttacattcgttgcagccatccttaggtcgctggttcgattccggctcgaaggagtagcctgtcttttgggctctcaacccctgagataagctggctctttgttcagtgtttggttgatcattgctcgtcctcactaacattagcaatctctctttcccgaaagtggtttgctcaatcactatacctatctctaattgaacagttaccaaaaggaaaatgagtcttggagtttggtttctggctccctccttgtttaattttagtttccgagtctaccgtgccgccccttatccgaagtccagacatcaaagactcgcaaggtacataaccttgggcttgtttgtgtacattttttttttttttttttttttttttttttttagcgctctgatggccagcagggaccttgatttgccgaacgttaaaacctctgaccccggtgatcgccccactaactggcaaagtgacgctttatttatttaggtattttatgtagcatttgacgtgagttgttgacgaggctggaggagtataaagttcagacggatgaagtactttaaacaagggaagtgagattgaaaacgcagttcttactcaggaaaactgcgaaggtctacagaatatcg

SEQ ID NO: 22672 - DNA, 1211 bp, Mus musculus; identical to SEQ ID NO: 22671

SEQ ID NO: 22673 - DNA, 1184 bp, Mus musculus
cccatttctttccaatgaaaactcccttgtacttggcaatagaagaagtcagggataggggaaacatcaaattgtaaagtctatgtcccttcttcaaaagctcaaatcccacattctctctctctccaaaacaaccagaccaaataagcatctgtgaacaaaggccaacagagacatcggattgcttctttgtagtcccattagctctcacttctccagtttctacctttttgagttcccagatataggcctgagtctgttgggggttggaatatgattctgtattcataagatacctaagactcaattggatggatagggatgaaaagacctcgggtccagtgaaacctcaatttgaatggatccataatttcagaaggggctctctttggcattgacatcagtgcctcctgccttcttgaactgggtgtgcttagtgcatggtaaaatgccacctaaccttccaggtgtaagagtggagaaatcatgcaaaggctttccacattgattgcgttgtctttggataccaccttcggttatggaatatcactacaacaaggcccaaagttgtctggggagatggtgtggtagtaggatgtccactctgtatctctggtaatcgtatgaagagcctttatggggaactggacaacatggctaatgaaaaagaaatagttatattttggtgagctgatgatatttgagcctggaaagcaatggggcaggcattccaataaaatagatagggatgaatccctccctgtattgggtacaataggcccaaagtaattaggaggcccatccacctttccctgaactcttctgagagatttgtagtgtttccttagggaactgttctttactttcatgagaccagaactctgaggtctgcatgcaccatgaaggttcccatctaatcataaatcattcactgtttattgacatcttttggctatgaatgctctgctatagtttgacacaattcaaagggtgtggtgtaattgttggtcaagtacctcaaagagcttttcagctactcttttagaagtttcagactagtggataaacccatagaaggtttcattaaaaacaagcatggactcttatcctcccccagcaggactcatatcagtgtaatcagtttcccacaattgaccatagtttggcccctcatatgttcccac

SEQ ID NO: 22674 - DNA, 1173 bp, Mus musculus
gaggtgtcctaatatctcttagagatctgggccccctaaattaccccctcttccattttggtgttgagaaggcttgtatgttctctccctgacctaggttctatagatgaggaacaatgagctgttctagctgacacggggcctccatcactccccctctttagcccatatttgcaagggtaggagagagagtgtgtgtgtgttgtgtgtgtgtgtgtgtgtgtgtagggttgatggtgagagatggggagctccttccccaaagctgacagtggctttgccttgatgtgtcaggcctctctgaaggcaatagtcccaaatgaatgtttatcaggagaaggtttgctggtgggtcagtgatccttaatgtgatagaaatatccagcatgtaaaaagaaaggatgggagatggtggcccgtgaagaacagtggtaaacacattgaagctggggtagaagggaggggcccgggtcctttggccacactaacttggatagctgtcagcgtgcacctaaagtgggactaagggaaagagcttaggtccgactgcttggggcttggcatcagggtgggaagagctacctcaggctctgaccatactgtgacgtgtagagcgtgacctcctgtctcacacaacttctgctgtgacaataaactatagaggaaactgaacagcattgttaatccgggtctgaatgcgcctgtaccctgccccttgcttgcctttccttgttcctctgaaagcacctgggatggcttgtggggtataaaagctgcacagagtgtgaccacgggagccaagaaagtggtgtcattctttttattaatagcatttttaagcttgggaaagaggagctgttgtagagatgtcatcaatatcatgtcctttaagaaaaccgactgaggggctggagagatggctcagcggttaagagcactggctgctcttccagccgtcctgagttcaggtcccagcaaccacatggtgatggaatctgatgccctcttctggagtctgaagacggctacaatatatttatttattatatgtaagtacattgtaactgtcttcatacctgccagaagagggcatcagatctctttaaggatggttgtgagcctccatgtcacctttgcgttacctagagtacattttagatggatcattcagca

SEQ ID NO: 22675 - DNA, 1246 bp, Mus musculus
tcaccttcagcgtcaccaccgagagcagaggagcagtgcgggtcctgggcctcccccagaacccccgccaccttcccagcggggctcactgcagccgcagtcaggagccaagccaactcaggcctcagccacctgggtagagggcactgcaagtacccggcctccttcgagcagcaccggaccagggtcccgtaggaagcctgctagccctgggaggaccctgcgaaacgggcgaggtggtgaagccgaacccctggacctgtccctacgggcgggcccgggaggtgaggccggggcagggggtgcccttcaccgctgcctcttctgcccctttgccactggagctcctgagctcatggccttgcatctgcaagtacaccatagccgtcgtgctcggggccgccggcagccccgagccgacacgtctccaacctatgtccgggcaccatcaggagagacccctcccagtcctccactagaagaggagggcagcccagggctgtctagatccggagaggcaggtcttggggggcaagaacggtagggagccctcttaggagtgattagcttagtaagcttaccccgcaggagcggggaagtgctagaggtagttgggtagagcagccagcagggagcagtgtgggacccgtatcccagcccaaggtggaccaagaggtaaagtgggcagtgggtggaggagagtgggctagcagcacccacccagcccagaggagtcacagtgccttagaagtggcagaggtgagggtcaaagaacggggtcctcgggctggtagaggatgtgttcctgttaaggagccgctctgccagttcctgctggtccataggcatgagagtttatttttgtataaggggtgggggtggggggcactgtacccttctagccctatcaggggcccttgtagacgttgctatttttggtacgattcctgtcatccctgttgaagagtcatgtccccaataaacaggtgtcttgaggcacaaggccctgtgtgtgtctgcctgtgtttcactcctcctgggcacttcgttatcaacgaggtcgataaggatgcaaatctttgattcagtaactctggatgaggccctaaagctagcgtttgtaataaatagccgtggcctctcttgcactgaggcccgaggacatcatagataagtgctgcattgtgctggacccatccgaccatctcaggcctcaagaagtgggtgcagaatggaggagggactt

SEQ ID NO: 22676 - DNA, 1345 bp, Mus musculus
tcctcctcttgtgtgaggaagcctctcccctgcagagaggaggaaagcccgcttcggagcagctctggacaaaggggctgagatgccccgtcaaaccacaggctccaaggtttgaaacggggtgaaacctaaatgggatttgcagtttttaaccccttccctagactggtagtgccccttaacttccaggcctccccccaactctcttcattccctctgtagctggctctcccttcacgcccctccccctctgtctccagactctgctgctgggaggtgtttctctcccatgcatgaatgagtctctgtaatgaatggaaatgaatggatcaggaatccaggaagggggagggggaggaggaagaccagaagactgggtgccggcagaagctaggaggaggaacctggagggcttctggctggctggccctggtctgagaggagctagtaccatttggataacaggagtatggctagccctccacatttgtttatccaggggcacagcccaacgcgagtggaagaggggtatactatgatggcctcccacattgtgtgtgtgtgtgtgtgtgtgtgtgtgtgtgtgtggtggcggcggcggttctggactaggtgtttaaaacatcatttgggggaggaagtctgtatttatcatacaagttggcagatgaagggatgcaagttttgaggacagcaaataagaaggctggaataccccaagatcacaataggaagaagggatgggtttcaaggatacaggctgctaagtggggtgactctactgccaaaagccagggctcatctttcctccaatcgctctgtcttgttttagcacctccgcacctgttgccttcattagcagcttttcttcttcctccttccaatcctcagaaccaaagaatgtgaagggggtccatggaggtgagtgaagttctgtccttgacctgcaaagtgccttcagcgggacaccctctcctgcctccttttttgtttctttgttttttaaacttcgtattatagtagcatacgttattaacttggccccggtgtccaacttccactcatcccacagtttctggaggtgagaggtatcaaggtacctaggttaggtcccaatctcccaacctccatacacactcttcttactgttcttcgtgcctttgcatttttctacattctacagggtggtcttttccaccctgtcctctacgtgcatctttccccacagggctcacgtccccgcatcctggtcggccacctagagccttccccaccagccttcgacggcgagctggatctgcagcgctactccaacggaccaggtgtcagtgggactccaggaccc

SEQ ID NO: 22677 - DNA, 1298 bp, Mus musculus
ctctgttggaactcccttattgagagcaatttatgagctctggtgcccgagacctggtttgatgtagaaatgacggaagccatcttgactgggcctaggaggtctcggtggatttttactgattttaggccgccttctggggaacttcccctgaggagaaatccatttgtaccttctaatgcgtctctgctttccaccctggaaactgctacatgcagaagtgtgggggtccttgttctggtgaggaagacctgccttttttctcctctttttgcctcagatattaggccatttttctaggacacattttgcttagtgttttacaggcaattttagagacccgagaatcttctcagaatcagaatatgtgcccataggttagtcagctatgaccatgcagtattcacacacacacccctcccagccatctgcttcctctgaatataccagattggctgtacaccaggatgttccgggaatccccaggaaagcaacagaatgtgatggactccaatacgatgcctcagtaactcattccaggatgtacaaactgtaactgttatgacattctgtatagctaattaaaatttttctaggtgtgcgtattttctattttcaatgacatcaaaaaggccacagtaatccttctggtagatacccctccatagtttctctgaaacccctgcataggttccagatgtgaatatgaatatatatatatataatctccactagtttctgtgtcctctttctggttctaaaatggccaatgtggcctctctagcacttcctagctctatctgtggtactgaggtagccagagggccatctctagtagcccactgcactctccatggtactgaaggagtggccatttgttttagcatctcttgggggccagaagagtcctgagacttaaaaccacacaactttcaagttggcagggactacaaatgtaaattcagtacaactcgtttcacagaaggtgaacccacaggataactgattactggaggctgtaaggcctaggcttgcagtagcctctactccttagttctattctaactcctttatgcaattgtcagtgagcctgctaaggctgttggtcccagtaacagcctcatttggaggactcataggccaggaaaggatgcctgaatttggacccatagaagcacacacattaagcggcattggttttctactgatgtttgagcaggacatcttgcttattttgactctcaaaagtcagattccgcatgtgacaagggtttgccccttcataaagccttgccccc

SEQ ID NO: 22678 - DNA, 1162 bp, Mus musculus
aacattatggcctctgcgatgatgtcattcatatcttaggacacctttggattaatcatgaaaataactatcctctgagcagctgttggtagtttcagcctccttggttactactagctgctgtgatagttactagctgattgtgttagttactagctgctgtgttcacaggtcacctgccaagatggttcactattctcttgacccagaaaaccccacaaaatcatgcaaatcaagaggttcaaaccttcgtgttcactttaagaacacccgggaaactgtgcaggccatcaagggtatgcatatccacaaagccaccaagtatctgaaggacgtcactttaaagaagcaatgtgtgccattccggcggtataatggtggagtcggtaagtgcgcccaggccaaacagtggggctggacacagggtcggtggccaaaagagtgctgaatttttgctgcacatgcttaaaaatgcagagagtaatgctgaacttaagggtttagatgtagattctctagtcattgaacacatccaggtgaacaaggcacctaagatgcgccgacgaacccacagagctcatggccggattaacccatccatgagctccccctgccacagtgagatgatcctcattgagaaggaacagatcgttccaaagccagaagaggaggctgcacagaagaaaaagatatcccagaagaaactgaagaaataaaactcatggcccgggaataaattcagcataaataaatgcagataaagttaaaaaaaacattatggcctatgttaccagacagatatgagactacattgcattgatcttagctattgttttttgcctacataattaagagaggctgtgtaaccataccgttcatgaattgtgttaaaagtattctgaaactactaaacacaaactattgatcaagaggagaactgagaattgccaaaagttctaagaaaaatgggagaaacaagggtatggaagcaccaatgaagaggtcatgctgaagagtctgatagaccagaaagaaaaatgattgactccctggctgcaaatcctatcttgcagataggatgtggtttctcaagacccatggagatacagggaaaaggactgtggtttgcatgaagactgcaggcccctcggacaagggaagg

SEQ ID NO: 22679 - DNA, 2775 bp, Mus musculus
ttcttcctgtggttctgagacctaaggcacagcacctagaaagaacactttcagtaactggtaaatggtgctttattctagtctaacattgtagttctgttacagtgaaaggtgatgaccttcaggccattaaaaaggagctgactcagataaaacaaaaagtggattctcttctggaaagcctggaaaaaattgaaaaagaacaaagcaagcaagcaggtaatagtcttttaattttctaattgaatttgggttatcttcctaaggtggtttaatgtatatgcaaattgggctgtttggaaggggcattaatttatttggaaaactttacttttgttctttgatgattaatgggaattgtctatatcctgtgggcaacacttgcccctggacagacttgtccttctcatccccagtagagatgaagaatgaaaagtctgaagaagagcagagcagcgcctctgtgaagaaagatgagactaatgtgaagatggagtctgaggcaggtgcagatgactctgctgaggagggtgacctgctggatgatgacgataatgaagatcggggggatgaccaggtgattacctttggaaaaaagaaagttgggaggactggggtccagggatgagaagagtacctctaactctcccttatttgtgtctttctcacagctggagttgaaggatgatgaaaaagagcctgaggaaggagaagacgacagagacagcgccaatggggaggatgactcttaagcacatagtggagcttagaaatcttatcccattattcatttacctaggcgtttgtgggagatgaaagtaacaccaggtcatctcccctggggtcttctgcacattctcactgttgtcccgccttaccctccctgtgttcattaattcatgattgccctgcgcctagttacagttccacttcctttgatgctccgtagtactttcgttaagtctcaccctgtaagttttgctttaattttgatacctctttgacttaacaataaaaagttgtatggtttttatcaactgtctccaaaataatctcttgttatgcagggagtacagttcttcccattcatgacttcagtagttgcttccctaactgcagaggcatctcatttacttgtaaccccaagagcagctttgcattagaggtgtgtgttttccctcacgtgagtgggactgttacaacacgaatgtaaccatgtatttttgtgaatgggagttggcatgtcaaatgcatcttacaggaaaatagtgtaatagtcttaatatttgttttctaaagttataccatgggttatttttgtgaacagcctgatgtttgggatctttttctcaaaaataaacagttccttattaaaccaggaatttgaaggaaagacaatttttttttttccgagacaggatttttctatataggcctggctgtcctggaacccactttgtagaccaggctggcctggaactcagagatctgcctgcctctgcctcctgagtgctgggattaaagccgtgcgccaccacaccctgctggaaagaaagtttttcaattacattttttttttaatagcagcctccacaaatcgttaggttgtattaaatataatcttcatgcataccaatatatatgaataaaagtcattttgagagcattgttaactttaaatatttttgacacggagtgcttgaatgttcagttactgattaaaacccaggtttctttattgcattctcaacctgtgcctcaaaagtttcaaaataggaaagcatttgtctttcccgttttatatagcatttgccttcctaagaactgagtctataacgagagttataattacccatgtgaagtactcttaccccttttcttgatttgtttgagtcagcttggaacattttgctgtgtaagacctaacataaggtaaaggtataaacagatttgggggcttgtttgtttatttttgtatagcaggctattcaaatcttttatgcacacagactttctacttctcaaaaagaccctgttgtgtatatctagcatacagctgcaagtctatgctttcatgctatgcattgtaggcaaaagtaacccatgataaaactgaggagaggctgatctaggggcttcccttggctccagtgtgcaaatataaaaatggcttttattgtgacccccctctgccccttcccctaatcttgatattgtcttgggtttttgaggaattggctagatatcagaggttaaagatgctaataaataaaacctgtttaaatatgctgttagaagctggtgtgtacaaaatgctggggtgggttcaattagttcagtattgggtactttctgatattgggtattgtatttattcaggtgactcccccgccccctccccccaaaaaaagcagttgggaaatttgagaataaagactgtggttctgtcccttttcatagttggtatatacatcagcaaaagactcaggagcctgtgtcttcataggaacactaagtgccagcatgtgactaaaaaagggtgtcatccctggccctccctcaaactgctgttgctagtttattttggaaactatttagaactatttagatattgttagagaactatttaggatattttactggtggtattaaactaagttaatactaaaacttgtcaagttaaaatgttcacaggtttattccactatgagaatatcttaagtctttcaaagttgtgagattttgttcatttctagttttttaaaaaagattggg

SEQ ID NO: 22680 - DNA, 1099 bp, Mus musculus
atctccatactaaaatacaaatgctgaccagttcccaagataaaaccattatccactgctggtagagtacaaaaaatcaaagagaaaatgttatgttaggacattttggaatctgacagtccaaaaaggaaagctagctctgtaaagcttaaccttttctaagtgaggaggagagctaatattactaagattagtcattagataacaaaaggcctaggtttgctttgctggggaatgaaaatacatacatacatacatacatacatacatacatacatacatacgcacgtgggttttggttttgggcttcagagacatttcagatggttgtgagccaccatgtggttgctgggatttgaactcaggacctctagaaaagcaatcagtgctcttaactgctgagccatctctccagcctggtttttgtttcttttaactcctgttgggctttgttttccttttttccagatattaacctggctgcagagccaaaagtgaaccgaggaaaagcaggtgtgaaacgatctgcagcggagatgtacgggtcagtaccagaacacccttctccgtcccctctactcaggtccggaactttattatttataactgcattgtgtccatcagtgggcatcttctctgtgttttctggatgtggggagggttaatgcaatgtgctttctatgtgcaaaagtgtaattcttattaacttgtgttagcatacttccctttgggtctgttttcagatttttgttgtttaggaataattctatgtgtgtgtgtagtacaaaatgaggaattggttagtttctaggaagctagaaaataagggcattgtggtgtaacaactattgtattgcttcttcgctgttgctaaattaatcactgcatgtccagtggtcttaagattacatggagggcaaatgatttcgttgaatgaatggggattatttgttgctaatcttactgatctatttgttgtggtttgtttggcctgttttcaccccacctgcctgttgaattaacaacagcagctccaaaataatcttttgaaatttatctttcagttcctcatttgacttggactatgactttcaacggg

SEQ ID NO: 22681 - DNA, 1237 bp, Mus musculus
agtgttctatgttgtgctgtctggtttatcatcatcaccatccagtattaatattctagatgtaaaaattggttttagagtaattgtactcgatggatagatggctttatactttgtagcatatgctaagtccaagtgaatatcttgactagttggaaatatttgcctttgtatattgagtatagttgaaagatgaagaatgtttcagggtagaatttggggtggtctattttgagaaaacttaagactttatttaatattttagaattaactatagtattctaactaccaggaagaccaaaaaggctgaaaaggtagttaaaggttttaaggaattagaatttggaattagaaaaaaaaaacaaaagaaaaagaatttggaattaatatataggaggtttatattgcacgtaagatggataaaaggggtattaatatatttgctgtgagatctgttgagataaatgaaactccgagtagtcacagtggttcgaatgaaataccattaataacttctgttaatctgaatgcttctctttcattccagttttcagctttgtgagaaacctcatcatcaaaggagatggctagcaatgttaccaacaagacagatcctcggtccatgaattcccgtgtattcattgggaatctcaacactctggtggtcaagaagtctgatgtggaggccatcttttcaaagtatggcaaaattgtgggctgctctgtgcataaaggctttgcctttgtccagtatgttaatgaaagaaatgcccgagctgctgtagctggcgaggatggcagaatgattgctggccaggttttaggtgagtttgtttgtttgtttttaagttaaagatcctaaatattgtgttttattatggcattttgtgcatatatatcaaactgcttcttttacatataaacaagcagtatttctcaccttaaatttgtatatttgtttcaagtctgtaaaggtagtagccttcatacttgatgtgacagtgtctttgtattgagcctcccctccccccttttggtcggcctacattaatttcagcatgtgtatttaagttttttttttctttctttcttttttaagtagattttattcatcttttttttttttaagatttatttatttattatatgtaagtacactttagctgtcttcagacattccagaagagggagtcagatctcattacagatggttgtgagccaccatgtggttgctggg

SEQ ID NO: 22682 - DNA, 1103 bp, Mus musculus
atatatatttttttttctttttctttttttccccgagacagggtttttttatatagtcctggctgtcctggaactcactttgtagaccaggctggcctcgaactcagaaatctacctgcctctgccacccgagtgctgggattaaaggtgtgtgccaccacgatggacttgaacctacctttgttttaggggtggaggtagtgcttttaagacctatgagcctgtctcctattatttaaatgtactctcagccattagttttcagtgaagattaatcacaaatcaatgtgtttttcccattttgtagaagcaagatgttgctagggtgtcatcttcagcagcttacccccatagttttgaggcagtcttgaagtagacctggaactccaggactcaggccatcacatttttcgccccctttaatgtgaacagtggggattgaactttagtcctgataggtcttggttcttctatggtgaactgaaccccattgtccctaggtgactagcttttgtgaacttaatgtatatcctgttaattttttatgtactggtggctttatttactgttagagtactaatccaagggtttttttggggtggggcacaggtaagtgcttcaccacttaacatctccaggtcacattttatatgtattgcttaaatgtcttccaggacagccagggttatacagagaaaccctgtctggaataaccaaaaagaaaagaaaaagtcttcacatgcttatttattggcaagatctcattacatattcctgcctgacctagaacacagtgtttagaccaagctgaccttaagctcacagaattatttaatctgtctctgcctccaatttgctcagctattttgtaaacattattagtatcacttaaagttaccatatcttttttgtttttgttttccaggcagggtttctctgtcctggatttggctctgtagactagattggtctctgcaatttttttaaaagactgccatggctggagatttttatgggtgataataaaagatagaaaactttatttgacataacaaatctaaatgctgagggaccaggcactttagcacattttataagacccc

SEQ ID NO: 22683 - DNA, 1158 bp, Mus musculus
ggcctagagataactctcctcccttctcagaagcttgtttgcgtttcccttttcctaggcctggggctagggcaggccgtttgcacccgctaccagactccacccaggctctcccacccccgcgccgcggaaatgcggtgatctggccggacctgggagctctcagaagcactgataggacgatgcggccgtcagtcagatccgccggatacccggatgagaagctgtgcgcgatacaaaggcgaaaattccacccagctttccgtctggtacattgaccaataaccatccgtcagtcactaagtggcatgaagctgaaccaattactaactagcctctgttacgcatgtggaaattctcgcaattagcccaacccacctcggattatgattggacggaattgtgaggagcggtagcgctcgctaattaggagcgggagcgagaaaagtcacagccaataggaacgcctccaggaacgaggcgggggctggactttcgcctcggcggcagaggagctcgggggccattttgtgaggagacggagagcgaacggtcgtgtggttcttcgctgttgtagctccggcgtctcggcgtagactcgcagtaggagaggcggtctcttctctctctccttccttttggtaagcgaagggggcgagtgcaggggaggccctgggctgctgggccccgccagcgtgtgtaagggggaaaccggcctcgcggcagaagccgaggccgcgtttgttcccgtgcggtggggacttgggtctcatgcgggaggcaacagggcctcggccttggcgcggagtcaacctagtgacctccaggccacggtgcgtacgaaaataccctgtctgcgcgctcgggtttaacggctactttgattttctttgcccatcagggattccaaggggggaccaagaaagcgaagaacgaaatgcttgttgatgtaattgtcggggatatcttacggattccgttatcacttccgaagatagacgctgggtgggggtaggggagcgataacatggtggtgtcggactggaagcttctaaattccaggctggctacatggcatctgaacggcgttttaacaataggttgagtaatcattacttttttcctctaggggtaaaatggttaaaagtcggagtgctt

SEQ ID NO: 22684 - DNA, 1935 bp, Mus musculus
tgtctaggtcaggtaactgacaagatgaagattaacgtgacacattagctcatactgtccgttaacagtaggtgtcttaagctaatgaatcactctgccttctgcttagcggaccgggaaagccgttatgaggaggaagaagaacagagccgaagtatgagccggaagaggaaggcatctgtacatagttcaggccgtggctctaaccgtggttccagacacagctctgcacccccgaagaaaaagagaaagtaatatgaaccttgggtcctatgctccattctttatgcagacaactcctaaaatgacatgacatagaaactgtttttccttttggtttcgttgaagttttgccatttgtgtttatgggtttaggggccatttgtgcggaccaagctactcggggaattccaggcccaccaggacatgtgccagtggccccgatcagatggctggcaagggaggcggtgttgaagggcaggaggctcctcccactgttgatcccattgcctcttttcttctgacaacttacctttggtgtctgaaagctgaattcccaagacagtgagagactctgaccactaaccatttctaggattcttttttctttacttttttatttttcctgttttgagacagtcttgctatgcagccatggcttaccttgaagtcactgtaagccaggctagcctcaaatgtatgatcctctcgctctgcctcccaagtgctaaggctacaggcttgagtcactgtacttagacgaagcatagttctggcccagagtcagtcctccgtccgtccctttatcagttccagatctgcagttctcaagaacgtccttgggctctgctgatgactgtgacttggctgagctgggctggtgtctggtcttcagtggttctggtttcttgcctcatgcacattctggggttgtttttgctgcatcagaagacaaacactggcactcgtggctgttttttttttttttttttttttttttttcctccttacaagtccatatgtggtgcagtgctcaaacacaaattaccattgtctcttctgatacatctaaggaagaatggtcatgcttcgtatactacaggtgaaatctagagggaggcttaaaggagtcaacatggatctcaaagagtaagtcgtgtcttggcctagaatatcttgacaagaagagaagcgggaagaaggccacacccacaaggctgggcactgctgctcttccctttactttctctgcagtgtcctgtgttggttgcttccgatgatcagctttgaaatactggggggctctatcttgccatcctcccctgcaggttctctgcatccacctgtcccacttcgccgcctctgttctgtgactttatgagaaggggcttctcagattttatgtttgtttgtttgttttctccccttagcagtaggacttgatattttgaattttggaagaactaaaagataaataaactgggatttttttttgttttgttttgttttttttgtaaacttgtctcttatgaccatttctttgcagtttctgaagtcaagtcaagttcactgatggttgtaagccacgtcattagtttgaaaaacagatagcaagatagcacaggagaccaggtttatggcatgtcatgttattttataagacactttgactgtgatgccctcaaatcgttgagtggagtagaacttgtactttcatgaaaacagatcttcagtcatctccttataaatgccatggagggcagcagctgcttggagggaaaccttcagccttccaatttggatggcctggtttctagggctcacaactgtggacaagggtaaaaagacaattaggcaccagcagtgttccatttacgcacatttgtttgtgagggcatcattctggccgtggctggcccctcaacctcagagatc

SEQ ID NO: 22685 - DNA, 1224 bp, Mus musculus
tgcaagtagttgtaggttgcccagtatgtgtgtgctaggagctgagcacagttcttgcctctgtaataggaatgtgcgctctaagccactgagccacctctccaaccccagagctgctttatagtaatgttaaattgttccatgttcatattagaaaggtaaacacctatgtgtattgtcagatctttagaacttgacagtatctgtataaagaaagcagtttagtattcctatatacaaataaagaggcttctaaaaagtagaggtgccagagctaggtaaggccagatctcaagtaaagcattgcttaggtcatagttcctaaagagaagctaagagagtgaaaattatttgttcttcttaaaagattttatcatctagaaagttcttgatattgcctagccatgtgctaagttaaaagcaagagttcactttaaattggagctctaaattctccttttcttctaggatggtccagccactattcttacttctgtgaaaaagaaagtaaagaatgtggggattttcctgaaggtgagaaaatgataagtgattgttgcaggaacatcagtgcagtgaaaaagttaagcaacatagctctttaaaaaagtaaacagtatttttattataccttactcccatagaatgaggatgatgaagaggaggaggaagagaaagatgaggcagaggaccttttgggaagaggctctagggcggcattacttactgaaagaacaagggtaagtttgctgttcacatttaccatgtagctggatatgctggtgtacatctgtaaaatcccagctcgaagcaggctgaggcatgaagatcaccactttaagttcgcctggcaccacatatgcaaggttcaggccaaccgtgggggcattaggaaactggcaaaacactagtgtcctatcatgtgctccccatgttctggtgacttgattctcactttgctagaatgagatgactgcagaagagaagcgaagagcacatcagaaggaactggcagcacagctcaacgaggaagcgaagaggaggctgacagagcagaaaggggaacagcagattcagaagtaggagtccacactgagcaaggtgatagtctagagatgatgtgaccgtagggatttctcaattgtctttttgctttatttttaaccccactccagagctcgaaaatctaatgtgtcctataaaaacccatctctgatgcctaag

SEQ ID NO: 22686 - DNA, 1249 bp, Mus musculus
ggcaacatagagaacctatgttaaagtggggagaaaagaaaagttgtagttctaattacagagctctgtcttcagttgggtaggaaaataagagctctggagctgttagcttggtggtaatggagtatgaactgtgggctctggtaagcactactaatttactgaccatgttctcaggttgtaatttgtttccattgcaataactacttagagcacatagcctagaaatccttacaataacttagatatgcttatttctcagaatttttatttgagtttttttgtctcttcttaaaggaagagaatacccttgtcttgtcaaaatatgcaaaggaaatgtctgtcagctttcagtatgtgataatctgccatgaagaaatagataggaggctcagagaactcatcctccatggtttagattattactctctacttattagatagaaaataaaagtctaattcttgaagtaacatctccttttctgtggcaatgatagaatgaaagtaacaagagcagctttgacaaaatgattgacgctatcaaagaaagcaagagcggcaagaagatcggagtgttcagcaaagacaagttccctggagagttcatgaagagctggagtgattgtctcaacaaggagggctttgacaaagtaaggcttcatccggaagcagcacactgaaagggagacgggaggtggagtgggcttcccttggagcagaggattttcatttggggaaatccatgttcgttcatatttcatgtcttttggctaaataatattccagttagttttcagtcagaaaataagtgcgtcaaccacgttagacagcttatattgggtggttgagaagaatctcttgaccaaaatatattttggggtcatcttttccctgccttcctgcctgtctcccttcagcaatataattatgtctaaagagatgaatttgttgtaagtagtgcattagcttagtgtctcatagagcacatgttctgagagaggtgctctaagtgtagactcggtttgggaagagcctgagcattctgaggagatagtgttactggtggttctcaaggtgtgtgcaacagctctgtgtgtagtagaaatgcatcaccttgctacaggtagacatcagcgctgttgtggcatacaccattgctgtgaaagaggacggtgagctcaacctgatgaagaaagcagccagcatcacctctgaggtcttcaacaagttctttaaggaaagagtcatg

SEQ ID NO: 22687 - DNA, 1219 bp, Mus musculus
taattttataaagggaacaaaaaaaaaaacctgtatggaggctattagttaaaggcatgaaatctttcttaggaaaaggtttcattctatatctgatttctgttcttcagtcagacagccaaagttctcccagtctaatctttactggctataagaatgtttcatgtgatgtcttggctggttgcttgtcttcataggaagaaggattgaagttaacattccagaagcatagattgatggctaatggtgtaatgggagatggacatccactgtttcataagaagaaggggaacaggaaaaagctagtagaggtaagtggtagggaaccaactactcatgattaaattacctggtgactagataaggtctttttattatcagtaattgaaggcagttgggaagtttcctcatgactaccattggccctgcttccctctcctcctccttccaaacaagtgtatgtgctcatgggggtggattctgggttgcagctggaggtggagtgcatggaagagcctaatcaccttgatctggacctggagacccggatccctgtcatcaataaggtggatggtactttgctggtgggtgatgaggcccctcgccgggcggagctggagatgtggttacagggtcatccagagtttgctgttgatccccgatttctagcggtgagtggcagttccatccagcaagatttaaagtctcgcggtgtttaaggtgtgtgagatcaagaaagcatgctatatttttatacataccactgtttctgcatctgcaaaatcagaatggtaatactcagtcttacttcctataaatattcaaagatttaaaatactaaaatatccaggcacttcttcaactaagtgtttaggaaatcttactctcaaactattccagagattacccagtttggagaattagaaccctttaataacagttttccactcttgactaatctagctttatagaagacaggtttattgtcaaacagaaggcagtaatatctcaataattagtacagacattgccatttctctagggtaaccaattcttttctattgcagtatatggaggaacgtagaaaacagaagtggcagagatgtaaaaaaaataataaggcagaattgaactgtttgggaatggaaccagtacagccagcgaactctagaaatgggaaaaaggtgagaaaatagcacttttattatgctgtcttcat

SEQ ID NO: 22688 - DNA, 1225 bp, Mus musculus
taagattgcttgctgctctgcagaagtccgacattcagtttccagcaccacatggcgtggctcacagatgcctgaaactagagctccagcgcatcgaatgccatcttctggcctccatgaataagtacaaacaagtggcattctctctctctctctctctcacacacacacacacacacgcacaaatatagagattttaaagaatatctgcacaggcatcttcatattgtcttggctgttgaacctaaggaaattggttttttcgctgtaatatccctagcccacagcaaaggtcttaagtactaggtagagatgaaggtagtcaacatgttcctgctccatctgtgagaatttcaagaaaatcacccctcctatgctctctcactacaggacccagagcttatgacaaactccttgctgtaccacttaccgttgttgtttttcccgccttgcgatttctttgagcttaaaggctgcttcacatcgtcggcgtctccggtccccacgttccgcagcctccatcttcatttgttctctcttgtagctgcgttgataggctgttactaggcggcgaagcctagctgtgagggcggagcctggaggccagaataaatgccctggctgttgagttacctgggctgtggaaagaaagtagaatgaagaaggaagtatagaaagaagagtagagataatatttgtattttggctcatgaataggcaaagcttttagatatcccaggataggacatactttatagtcaatgacccccccaacctaacctttaaaaggtacactgtgtgatctagaatttaccttcctctccgtcgatgactgagatctcctcatccatcatcatcaagggatcaccctagagaaggagatccaccccacaggatggagggggggtgaaaggggagaagttggcactctgaaatcactttctgctgtatgtccttctggggcaccaagggataagaaaagtttctaatgaaaggaactctcaaaaacttagaaagcaactgaagaacagaacaagcagaacctgagcagtgagttcttagggattcgacagataacatctgctgacaacccgttccagtgcccctctcctccatcagccagcttagccatgccctaaggacagcaccataatgctggtcactaatactttacattcttttgttgtcttaagatgaatttattaagtgtatgggtgtttgtctg

SEQ ID NO: 22689 - DNA, 1182 bp, Mus musculus
tgactgagtttcatgcctgaacccatagtggaagaagagaattgacacctccccccattcttcccccaaccccaaagctgttctctgacacatacactataacagtcgtaaataaataagatataggaaagaaagaaaaccaactctttagctacagacacagtgtgcctgatgaactgctcctgccctgtcacaggtgtgcactgtgggtagacccccatgtgaacttcttagagcacccagcaggcactcccagggagggctcctgcttgctgtctgtgtgaacacatgactatgtcatggaggtaggaaagaagctcattaccactgtttggtttgtttttatgaggatgttggatctattagcataagcaaatactttttaaagttttccctttgaaaggttgtgtagtgtaataataccagtactttggagacagagaaagataagaggcttgagagttcagggcttgcctggagcacagatagacaattcactgtctcaaaaaaagttctcacttcgagagttttgagcaattaactgcatgtcctctacagaagagacgttcaaaccgccaagttaagcgaaaaaaatatacagaggacctggatataaagataacagacgatgaagaggaggaggaggtcgatgtaactggtccaataaaacccgagcccatcctcccagaaccagtgcaagagcctgatggcgagactcttccttccatgcagttctttgtggtaagctaacattagccatttaagagcctttgcgcgtgtgtgtgtctgtgtgtctgtgcctgtatctgcaggccaggcagcagtcctcttgcctctgcttcagtctctggagtgcagggattactggtatgagctaccacacccagttttgttttttcaacaattaattgattgacaacatcttttgctacaggagaatcctagtgaagaagatgcagctattgtggacaaagtgctttccatgcgagttgtgaagaaagaggtaaggcctttctgtcttcagtgcattcatagtatatttaatgttgaattcatatgttaatgaactatttttaaagaactattttttccaatgatgtagtctctactagtgagttacatttctagttcctaagctttatttaatgagtacctttgagtcacaaaatatattgctagtgt

SEQ ID NO: 22690 - DNA, 1219 bp, Mus musculus
tgtacagctgtgccagtgcacctttttctcctattctcagcaatactcctgtcctgtgcatcatagaaagctctgaataaaggatcagaagagttgggagcagttgtaagcattaagattaatggaactgatgtggaggcatatttcattttgctttatggatttttgttctaatttccaaacgttaaatgactgtcttagatagctatcaagttgtgtgtgtgtgtgtgtgtgtgtgtgtgagagagagagagagagagagagagagagagagagagagagagagagcgccttaatacccactgggtagagatgttacagaaaagatgctatagagacactggagggtaaagaataattgattttctgacattcagctttatgcgtcgaatgaagaaacctggtataagaagttctgtatataatattttctaatgttgctcttgtgtgatttcctttttcactgtagggtgaatcgaaacgcatcactttggtccttcaacagccacagtccggaggtccccaaggacatcggcatgttgtgttagggagtctaccaggcaagatagtgttacagggcaaccagctagcagccttgactcaagccaagaatgcccaggggcagcctgccaaagtagtaactattcagctgcaggtgcagcagccacagcagaaaatccagattgtacctcagcctccatcatcacaaccacagccacagccgcagccgccaccctcagcccagccgttgaccctgtcctctgtgcagcaggctcagataatggggccaggccaaaacccagggcagagactttctgtaccgctcaagatggtgctgcagccacaggtgagtgactagaaaaggaaaagaaagggtcttgtcactgccttcagtaaccggtgctgcttactgcattaagttctaacttcatacctcggaacttcacccatggaaaccttgttttgctaaaccatgcaaagatgaagaattattgttgaatttgaggtgataatttctgtaatatttgtctttaaaatgtttgttgtcttttctttattatgatattgtgggggtcaggtagggagcctgagcctgagctgtattctatagcaagactgtttcctcaagaaagaaagaggcaagcatggcgagcccttgcccttaatcttagccctcagtggggaggcataggcaggtgcatctctgagtttaggccag

SEQ ID NO: 22691 - DNA, 1503 bp, Mus musculus
tgagggataggtaagggggaaagtagcagagtaaatgctaagtgtagagaaggtgagtagtaagtgaaaactttgcccttctaccaaaatatcccagggaattacctatatccgtgaaagggcatatgtgtcctctacgaggtggattggcacagtctaccacatctgacttttaggctacttgatgatgttatactttggagatgtagggaaatatttgggtatggttttgctataataagtttgtatgtatctttctctcttagggatgtattcttggcctgggtggcctctagaaatccaaactctgtggtgtttgtgaagtagccttcgtcttctccaagccttgaagattcatctgctgaacacgagtccaaaagcctgtttttttgttttgttttgttggttttccagacagggtttctctatgtagccctggctgtcctggaactcattttgtagaccaggctggcctcgaactcagaaatccacctgctctgcctcccaagtgctgggattaaaggcgtgcgccaccaccgcccggccaaaagcctgttttttaaacacaaactgggcttctgtagtgcctgacctttacccatagtccttcatgcctccatctcccttttctttcttcagcagaggccagactatgtagcagggccagcaaattcactgtaatttagaattgctttttactctcaactgtaagcaaaattaccagcttactagcaagcacagggaagagtgatgggagcaaatcataggggtcattagaagaaacataccagtaaaacggtcagacaacttgcctagaatgtcattgggcgagtgctttgctttgttctcggcagaaaaagctctgggagaagagagacttagggtttcagctcagtggtaaagtgcactgggtttaaatcccaagtgaaggaggaatgaaaatactgatttaaaataaaatgtgtgatagccctttaaaagggaactattattgatatacacagtgctattaggaggaaggtttgaaggcctggggttatggcttagcactataaagctctgagttcagaccccaggctggaagatcaggagttcaaggtcatccttggcccactagtgagtttgagaacagtctaagatgcatgaggtaaaggttttacagaacatggtggcccgtgcctttaatcctaatactttggaagtagacaggaagatttttgatctgaacttaaatcagactttgtctcaaaaaatagaccgggtgtggtggcactcccctttaatcctacaacttaggaggcaagaggcaggttggatctctgagcttgaagttagccaggattacctagtgagatcctatcttaaggtccccctccctgctcctgacaaaaacacacaaattctgtttgtctcagtcttagcacattgggctagaggggaaacgacatcatccaaaacgatctttttctgtacaagtatttctttacctgacttggttaccag

SEQ ID NO: 22692 - DNA, 1223 bp, Mus musculus
tatagcatattaattgctaagcactgtgaacctgtgtagtcttttctaacacgctaggtagctaacattcttcttttacttataatgaatcacgctaaataagagtagcacaaggacacacactaagtggaaagccataatttcacttcagaaattccaattataatacaaacttttatttatttatatacagggtaggggacactattgcgtaaacagtcctcttaaggtgtggcctgtagcccatggctctgaacgcttagctttgtaaggaagtgcgtctataaattcttaggtttagagatgatgccgtccggatacctttgcttaaacctggcaaccacatctgggtctagtaggtgtatcccatccagttggtttccaagagtaatcctaaaacaagggggaaagaagaggcaaaccaaaaatcctgtaagggcttaatacttaaaatgttctactttctggtgatacctatctcaggctgtcctggaactaactctccatgtagaccaggctaaccttgaactcagagatctacttgcctctgcctcccaagtgctgaggctaaaggtgtgctctactatgcccagtccacgtcaatttttttggtttggtttggtttggtttttgagacagggtttctttgtatagccccggctgacctggaactcactttgtagaccaggctggcttcagaaatccacctgcctatgcctcctgagtgctgggattaaaggcatgcgccaccacgcccggcctacatcaacttttaaaaagatcagagcaaataatatggcagtgtcaatacaaaaactgattggattttaatttctttggtggtcctaagagttgaacctaggcaccttacatatacactcttaaactcttaacactaccagcccccctccccttttgagacctctaaataagcattggcaggccttaagcttgcaatcctcctgcttcagtctcatgccccaagatccagccggatctgtctatctaaggattagtaattgatggtagccaggcctacttcattcagtcactgctagtgaatagtccttggataattaaaatgctcaccattggcatcaaacattaaaactgacagattgaataaatacttagtagccactagggggcagatttaatatagcccacagaatagctgacgatccttgggcagttagagctttaagaacagccctttgggttct

SEQ ID NO: 22693 - DNA, 1192 bp, Mus musculus
ggagggagggagggagggagggagggagggagggagggagggagggaggaaggaaggaaggaaggaagataatatttaacttagaaaatctggggccttaagggcagaaatctatgatacagtgcttgaccgtatgtgcaaggaccagaatatacaatcaaccagactaacagtctgttcactccttcccgtccatccatctctccacgcatacacccacccgtcaaacactcacacttgttctagccctgctattttaaatgcgttgtcactaacgacttaaagaaacaacatggcgggtctgccagctaccaacatggcaaacacagcctcagcgctcccggaaacacgagagagaactaccgtgaggattacgtccggctggttcgccaaccggaagtggcttttcatcttggctctatccggctggccttcgggcgtcctcgtgagaattagatgtttcttagttctaggctggggaggtgctagtccgccgcgcctgattcgagccgagtccgcgctgggagctaggatgtcggacacgtggagctctatccaggcccataagaaacagctggactcgcttcgcgagagattgcagcggcgacggaagcaggactctgggcacttgggtgaggtgcggggtggtcggggcgggcctgggcggggcgagagactcctggagaggaagacagccccgggctctgcgccctttccggagcagccctttattggactcctcgattgttggttaccccatctttcccgagtagctgaaacgcatgcccacctgcgggaaagcttgcagtgcctcctcccgggcgtcggtttttcaagcgtaacaccacaccaacatgggtccactcctctccttgggtcccattccagtcctgtctaggagaatgttgcgtccgtgaagcctctcagtaccttattccgagagccagcaaaacccgttttgttgcttctgtgcctgttttaccttagttgtaacgtttgctttgtcactgtcttttctttcccatgtgggcggggagcaaggattgcttctgtatatctatccccagagcccggtttagcagccacaacagggtcctcactaggaccttctcactaggaccttaatgaatgagtagtgcaagtgtttacaaacgtagcaagaatctgaaaacacttgattttggtctttaaa

SEQ ID NO: 22694 - DNA, 1140 bp, Mus musculus
acgaagaccaaagtgtggacactttgctcattcttagaatttgaaaccatcacccatggacggagttacagagacaaagtttggagctgagacaaaaggatggtctgtctagagactgccatatccagggatccatcccataatcagcatccaagcgatgacaccattgcatacactagcaagcctttgttgcaaggatggtgatatagctgtcccttgtgacactaggccggggcctagcaaacacagaagtggatgctcacagtcaactattggaatggtcacagggcccccaatggaggagctagagaaagtatccaaggagctaaagagatctgcaaccctatcggtggaacaacattatgaactaaccagtaccccggagctcttgactctagctgcatatgtatcaaaagatggcctagtcggccatcaatggaaagagaggcccattggtcaggcaaacgttatatgccccagtacaggggaatgccagggccaaaaaatgggaatgggtgggtagaggagtgggggggggacttttgggatagcattggaaatgtaattgaggaaaatacataataaaaaaaacattctgtagaacaaaagtcactatcagcatggatatatggctgcctctgagttcttctgttctggcatggtctgaacttcaagcttcctatgactccagcagatacatctcaccggaacatctggctgacctatataagttcttcatctgtgagtatccagtgatgttcatggaagacctatttgaccaggaaaactgagaagcttggcagaagttcacagctagtgcaagtatacaggttgttggggatatctaaccaatcctaaatggattgcaaaggctgtgggaaagaagctctgcaactactcaaggtaaaccagatcagcaatatgatcaaatctctgcaggagtgtaagctagcagtccaatggttggcatgtcatggtgtcccacatcgctctaggtagactaaggatattttcatcactgatctgatggtagggctctgtactgggcagatcaagactggtgccccttgcagatctaagcaactgaccaagtacaatcaggtacttagaatcaaggaaaagctgaatgacaaggccaac

SEQ ID NO: 22695 - DNA, 1304 bp, Mus musculus
cctttctggtggactggccttggtgtgtaagggtcacatgttttagtatcagaatccaccctgctcttagcagcaacctggccccactgcaggcattgctcaccttacccaaagtaacttatgagaagtgagaactaaattacctcttcacagacctgactctttctgaggtttctgagaagttttatccacgctctttagtctgtcctcaaactggacattagtgctttgaggaatgtgagggccaggaaggtgagtggctggtggagagttaggattggtaagtcaagagctggctgccagtctccagcacctcaacggcctttttttccttttctttttgtgagcttggaatttctgtgtgagcatagtccttctagaggctactctcatacaacgcttgtgaaacattggccatgttctggttattgtagcctgggatgtaacactgagatgcacttaggagtgcggcagctgtcatgtgggttgagagtttagatggaaggatttgggacatgacacacctttgtgcttctttcaggctcactctttgacgtcccctggatcagcattcttgagctggcagcttgttgcacatggcttcttcagattcgtgcttgactacgagtctcactggttgtgaggtggcacgtccagagaactcccttcgctctatcggaccaactccacagtgtacggctgttaacacagaatctgcctcccctcactgtagcccttactttccatattaaaaacatttcagcctccaagtgccattcgttccttcatgtttgtgtgtccgtttccctccgctcagtgcgctctcatgacttgctcccagctgtgactcttcacctgtgacccttcacctttgttttcattaagtagttgtcattgctgacaacctggaaaatggcagtcctttgtcctttgctcggtcaggcaatcctttattaatccttcattgtctggaacggcaccagtgaacacttgtcagaaactgacctgtgtgttcttcctgttatgtccgtttccataagcttctgggagagtgaaatacatgtgtgtctcttgggcagtatagaacaagtgcaaagtgtgtgtgtgtgtgcgtgtgtgtgcgtgtgtgtgtgtgtgtgtgtggtgagagagaggtgtgactgtgactgcaggcaggtgtgtctgtgtattgcattctgtgtgactctgtgtgtacgagaggttgtctgtgctgcctgtggcatgtgactggcgtgtgtgcgcgtgcacgggtgttgatttctctcacattgtttcccaaagct

SEQ ID NO: 22696 - DNA, 1341 bp, Mus musculus
aaagggctgcctagtaccgcccgttccctccacgccaggtggagactacaaggagactgggcgaaccacaccgtctccctgcatggccttcccttcctctagacagaggagggctcccagcagcctttctagtttggcagtgcgactgagagaagattccacacaggaacatctttcttctccatcactccacgcctccatccaagctcagtttccactcgcccaccagaagcagctctagtcacctgcacaaccgcttccatgaccttggaggtatatcccaagctctcattggcagatgaggcaagagataagggcaggatatagcacatgatggcttccagcagaactgagtctatagcccaggtctgctggcttccagcacatgttgtacactaagatttcatgcagacaccattgctgtggagccgattgaaatttaaccctgctccatattctaacctgttatgcaggtacactgttatcttgccctgtgtctcaatcctggttgtctaagttgggacacctgagtctcttcctcttgttccttccactatgaggctctgagcctctctgtgccttgggccctaaagccccatgtgtagtatagagcaaaggtgattcctggtggagaaggggaaaagcccttctaccctagagtcatgcctggatccacaactccacaggtatctgcagcattttctacctggccctatcgctgagagcccctccccatggctcactgaggagcactcagccagcagttctctatccttatcagccacagaatgcttctcactgcccgaacctctatgctctcatctgtcaccatggcctccaactccttctgcttcaaaattatccatcagctctctccagtgaatctcattccaggtcctgctctaaggctctggggactaggctgggcctggccccagaagccgggcagttcctgcctccttctccacttttataaagccaagcctttccccagaatagtattaactcctggtgctttgtactactggttcagcggcctcgggcttcttttctatattaataaagaagagtaaaaactgtcagtgatgacactgtttaatattgatctcacaagagcactgagtggtactgcctcacagcagtccaggtagcccccatacaggagaacagaaccaattgaggtactacctgtgggccactccctctcccaggtagtgtccaggaaagcacagactatcctttcacccatggtggaagaggagttagtcaggagcacaggtgggttaaacctcaatcaaaagaaaatcctgtggtctgctctgccctgccctgcccagtcag

SEQ ID NO: 22697 - DNA, 1150 bp, Mus musculus
taacagcgcatcctgtctcttagtttcttttcttttttttttttttttttttttttttttttgattttcgagacagggtttctctgtatagtcctggctgttgtcctggaactcactttgtagaccaagctggcctcgaactcagaaatccgcctgcctctgtctcttagtttcaatctctgcggaatcttgacttttttaaaccacttcaaataccatcgcctgtcttcattctccctcactacctgatctgtgacgtcaggtctgactgcctgcccatttccaaaatggcctcccccgcagcgtcaaagttctgagtgcgcgtgcgcgagagtaagttccctcttcccggcaagatggcgaggaatttagtgtgcggtcgctggcagcttctgcgactcctacgaccccagcgttcggtaaggttccgtccaaagcgcggggatgctgccttgtccttgtcacctgagctgaggtcacgagcagatgctgacctggtcactgcgacctgcgagtcatgacctccggtcgcgtgagggcaccaccgggttacgtcccggggttggtggcctggtttctctgtagctgtttggaaactgcctgcgaccctgagccgtgacctctgggccccgtccccgggcttcggtaacaggatgcgggagaccctaaccggagctgcaccctgcacgctccagtgcatggcttcggggcctgtagtctgtgcgagcagagttgcagcgccccactgctgcaaccgcaggctgtctgcgggagaggcgggtcggctgggactcaaggccttcccttcctttcacatggtcagtaccatagcgtcgcagtgtccctgagaccgctggccgccgagctcctcgcagcccgccggggtaacgggcggccaccctgtgctcttctcgccgtcttcactcctcgctgcatcagtacatctgccaccctctttgcagaagcccaggtaagaggttcccgctgaggaaaggagcacgacttcttggcccctttcttttggttctgtgttgttttgtttgttttgttttgcgggagacagtgaatgtgtagcagagttctcacactcctcctaagttcctcctaatattaacctgtttggagtagaagtagattctcatctcaggca

SEQ ID NO: 22698 - DNA, 1779 bp, Mus musculus
cttgaaataacaagcaagaaacaaacccatgctgagctaactgtttcctctgtacccttagctcagccttttcttccccatcatcttctgcctctgcaccatcttcctggtggctgttccactttacagcgacaccatcaactccctcatcggcattggcattgcactctcaggcctgcccttctacttcttcatcatcagagtgccagagcacaaacgaccactgttcctccgcaggattgtaggtaagcttggcacaaccaagtgggtcagctacccgaatagattggtttttgcccttttctgcaaaccttaccatagctggctcctgccattaaccatatggcttaattgaatcactccttcctggagcccctttggtgccctgaactcagccccctgaacctgttcccagttttaactcctgaattaaattcaattctctttgtagcctctatcacacggtacctccagatcctctgtatgtcagttgctgcagaaatggacttggaagatggagagttgtccaaacaagatcccaagtctaaatagagcaagggattctgaggtgtggacagaacgggtgtttcgtatctcccattggccagaaccctggaggcacggtccaggagcccaagcttggcagcttcaactctgaacttgcttttgagggatgaagagtaatttatttgttttgctacatgtttcagacttcataaatggatgatgcagactgtggcaggaagtaggccattttggggcagtcctggcagcacctgggtgtggccacccactcctctttcctttacaagggccaacaatgctccaaacttgtctccttcagaggaacacaaaactgtcacagatgcaaaacaataaaaaagttatgttcctaaggtctgagtggctttattctacttagtgactggggtatttatgcagttcaaacagacatggaaactaaaagattcagttctccctctgaagccagctgccaacggcaatagaaccgatttctacaaatacagcacaactgttgtactaaaatgtcatgaatgggaaaagctagtgcataaacacttcagcttcttcttaaagtatggctggtgcatgcgcagaggccagaggagggtgtcaggcgtcgtgctctgtcacgtccacctttatacccagagaccggatctcacactgaacctggagctaggctgatggccagcaaaccaagcggcccccctgtctccacaccccacagcactggggtcacaggcgtaagagcagggccatgctcagctttctgcctgagtgccggggatttgaactcttatctgctgatccatttttccccagactcccttcattcttctaaaccattactaaggatttcagtatatctgcttcgtaaggaaattgcaaaagtaatcgtgttggggggtggggggtcagggctgtaggatcaatctccagccccacaagggcggctgtcacagtcttgcccatgacacctctaggatgcaaactcagatggaggtgcacagtgtgtgaggtagaggtctgagctgtgaagaccaggagaaaacatgaagctccttcccaggagctagggctggcaagggaaatcatctcccaccctgtcgtgttcagaagcacaacccccttccatacttaacaaacatcaagaagcccagacaagacaggggtttactagttctgtggatggaaggctgcttggctctccagggctcttttaatacacacaaataagagtctgtagtggaaaca

SEQ ID NO: 22699 - DNA, 1132 bp, Mus musculus
atgtagctgtcttcagacacacaccagaagagggcatcagaccccattacagatggttgtgagccaccgtgtggttgctgggatttgaactcaggacctctggaagagcaatcagtgctcttaacctctgagccatctctccagtcccttttctttctttcgatgaggcatgtagaccaggccagcctcaaactcacaagagatgggcctgccttcacctcccaagtactaggatcaaaggatgtatccccctacctggccaagctgatgttttactacgactgagaagggaagactggagcggggcactctgcagaaaccaacagctgaccttcctcagcttcacaccgtcagcgtgatgcatcagtatccagctgaacacttggctttggggggggagggggagacctgctcagtggtacatatgcctgagccccagatgtcacctactctcttcctgtctgtttcagagacgagttgtactgctgacacaggaaatggatgctggaatacaggcatggaagctcaggcagcagaaattgcaggaagaaaggaagaaggaacatgatctcaaacctaaagggactttactgagaagcccacttccgaatcaataaaaagcagctcctgccccactttcccagactctctctggctttcttttctatagtctgaatgctttatcaagtcattttccccaccacttgtattgatagcaaaagaccttaaaatcactgcctgccaggcttggcccagtgcccttagtcctccccattccagttcagccagatcttgctctgggatcattttgcccctagtgctgaagaacgtgcccagagccttaacaaaagctaagcacaccaccacctatcacttggcctgcttgggatttttaatcaaccacaagcaactgctttgtgagagaagaaaggggcagcagcagtttccctggttcaccctcatactcttgtcactaagagaccatgcacagctcagatgcatacagttggcatttaatgttttcttgaaaaggtctttccacctgaggatctttttcctttttaagacatggtctcacggtagcactggctgtcctgaaactggccaggtagaccaagttgtctggcaatca

SEQ ID NO: 22700 - DNA, 2025 bp, Mus musculus
ggtggatgaggagggcagtggagctgtgagtgcggccgccgtggtcctgccggtactactgctgctcctggtactggcagtgggcctcgctgtcttcttcttcagacgccatgggacgcccaagcgactgctttactgccagcgttcgctgctggacaaggtctgacccccaccactggcccacccgcttctaccacaaggactttgcctctgaaggccagtggctacaggtggtagcaggtgggctgctctcacccgtcctgggctccctccctccagcctcccttctcagtccctaattggcctctcccaccctcaccccagcattgcttcatccataagtgggtcccttgagggctgagcagaagacggttggcctctggccctcaagggaatctcacagctcggtgtgtgttcagccctagttgaatgttgtcaaggctctgcacttgaaggcaagaccctctgaccttataggcaacggccaaatggggccatctgcttcttttccatccccctaactacataccttaaatctctgaactctgacctcaggaggctctgggcatatgagccctatatgtaccaagtgtacctagttggctgcctcccgccactctgactaaaaggaatcttaagagtgtacgtttggaggtggaaagattgttcagtttaccctaaagactttgataagaaagagaaagaaagaaagaaagaaagaaagaaagaaagaaagaaagaaagaaagaaagaaagaaagaaagaaagaaagaaagaaagaaagaaagaaagaaagaaagaaaagctcacagagagtctggtggcttggacagccaagttcctctccacaaagatctgcctctatccaacccagtctggagaacttccaaaggagcctgagccattaaggactaaatgggtttgaggaaacccttggcaaacccgacccctgacccctgaatgttagccttgaatgtcaagttcaaggctggaagagctgaaaccagggggaaaggtcccgggtggagtgaggtcaaggggagacagcaggacctgaaggatgagcctcacagctcaaagcagacaaagaccttgttcaaatgcaagtcactggggctgggacccaaagagagcagtcagagagggcaggacacgaagggtagtggtggcagtgtatgcctgggagtctgcacagactgcagtgcacacacgggacactagtccccaggagtgggcacatcttattggatgtctcagaaagggccttaagggaagccacactggccactttctgtccccttgctcacagtgtagaaggcaagggtaggaattgatacaggagtgagaagaacatgcatacagggactcaatggagaccagagaaggctgtcagcagcctgggcttgcttagacttcctcactgccctagtgaggcaggtgtctgggtgctgttggttagggtggcctccctttcctgatgcaggcacccctcagcccattttacctatgtcctgcccttcctcttccccgcccagttgacccatttgaagtctccttcagccactgaaggcggtcatggtactggggacttgggagagtgagaccctgtggagggagaggcgaggagaggagagaaatgtctgggtgggggttggggataggggtgaacggtgctggaagcccagctaaatttctgtcttgtttgggttttttttttgttttgtttaatgtatatttttattataattattatatatgaatgccattcaaatcgttcctttttgttaacaaggggcatggggaggggtggggggtggaggggggctgaggcgactgaccccagaaacctgcagggcggggctgggtcagtgctctctaaggacattttttgaccttgttcaacctttccaagaagaataaactgtgtttcacattctttgtgtgactcgagctgggtgtaggggtggatacgatgcgatgtggccaagcagggctagggagggcagacactaagaacagcatttc

SEQ ID NO: 22701 - DNA, 1141 bp, Mus musculus
cagggacctgtcatcaagaggggaggcaggggtgggggtgggggagcaaatctccagagcatctcatgtcttgctcttctgtacctcataggttccagaagctgcatctggcctgtggctcagagcatttaatcctgcactcccctctacagccaccaatctccctgtgtgaggccccttctggccctttgcagctaccagggggcaatgtcaccattacatacagctatgctggggccagagcacccatgggccagggcttcttgctgacttacagtcaaggtaggctgaacagggtgtgtggtgggaccattggaggagaagtgggagtcccccaggaagaggcaaggatcctgggagttctggcacttccctgtctcttgatgcctctgcagattggctactgtgcctgcaagaagaattccagtgcctgaaccaccgctgcattccagctgctcagcgctgtgatgggattgatgcctgcggggatggctcagacgaggcaggctgcagctcagatccattccctaacctgaacccagcccccgcaccaactctggcctgcaatctcaccttggaggacttttatggggtcttttcttcccctggatattcacacctggcctcagtctcccacccccagtcctgcctgtggctgctggacccccatgatggccggaggctggcagtgcgcttcacagccctggacttgagttacggagatgcagtgcatgtgtatgatggtgctggaccccccgagacccctcgactgctacgtagcctcacccacttcagcaatggcaaggctgtcactgtggagaccctgtctggtcaggctgttgtgtcctaccacacagttgcttggagcagtggccggggctttaatgctacctaccatgtccggggctactgtttaccttgggacagaccctgtggcttgggctctggcctgggggctagtgagaacctaggtgagcgttgctatagcgaggcacagcgctgtgatggctcatgggactgtgccgatggcacagatgaggagggttgccctggctgcccaccagggcacttcccctgtggagctgcaggcacccctggtgccacagcctgctacctgcctgctgaccgctgcaactaccag

SEQ ID NO: 22702 - DNA, 1166 bp, Mus musculus
ttcagggggccgccgtcgccagcgtggacgctccatccgccgtctggttcgccgtctccgtcgttggggcctgcttcctcgaactaataccccagctcgggcccctgagaccagatcccaggtcacaccctctgttccctctgaggccctggatgacagcacaggccaagcctgtgagggtggggcagtaggggggcaagatggggagcaggctcctccactgcccatcaagacccccatcccaaccccaagcacacttcctgcccttgctactgtctctgagcccccagggccactaccctcagtgcctgtagaatcatcactgttgtctggagttgtccaggtcctacgaggccgcctcctacccagcctgtggtccccaggccccacttggacccaaactggaactcacacaacagtcctgtccccagaggatgaggacgatgtattgttattgccactggctgagccagaagtctgggtggtggaggcagaggatgaaccattgcttgcctgagggactctaggcacaatggtatgatccttggaagtggttcagcttccccactgatctatgtagcacagaaagttagtgtctctccagcagggagagcattcactgtacacaccttctggtatgacaagagacttcaccaccaccctctgcccagcctgctatccaggtggctgtgttacaaaaggtcccacaagggtcacaggcttggacactccgttctttccagctccccacccaaaagtggccttaactactagactggttggctggagacctagccaccaaggggaggatttggccagggtgatggttttgccagcctccatccctgtggtgcctggcccacttagaggacacaagtgcttttgccctgtagctgcatcattgtccaggaaatcaagatgacaaaaataaaggaatcataaacttcagcccttggtaaatcagctgtgagcctgcatcctgcatcctctctgtccatctctgccatgcagggaaccctgaggaatagccttctccatcttcattcaccaggccccaaccctgcactgactggcatcgggctcagtctgaactcagtgcagacccagttcagagccagctgagccctgaagtcaagaaagggtctgattatggaatgctctcacag

SEQ ID NO: 22703 - DNA, 1428 bp, Mus musculus
tttgagaaagggtttggaattatagctcaagctggctttgaaatcctgattctcctgcctcagcgtcctgggtgttgggttataggtttgtccctacacttggctgtttattgtctaatctctgtctgtcccaccatcattgccaagtacaattcctcattcaagccgcctgtgtctttcgtattacagcagcccatcacggtgcacgaaggccagaacatctgtgtgcgtttctggcgatgcagcaattccaagaaagtgtggtacgagtgggcggtgacggcccccgtctgttcttctattcacaaccctaccggccgctcctataccattggcctctagccctgcacacagtgtcaaaaccttggaagcagctctgagttctcttcctacagcacagaaggtgtagaacatctgctggttcagttcctcagtgagaccctcagccgccagagaggagcggttccggctgctttcctacctaatgtcatggtggccaacgggtaggcattcccggactgccaggcatggtggtgcatactctttatcccagcactccagaggcagaggcagaggcagatggatctctttaagttcaaggctagcccggtctacctagcaagtttcaggccacctagggctacatagtgagaccctgtctccaaaaaacgaaaaaaaaaaaaaaaaagaactagaggacacaagccagcagcagtcttcagagcctctggcttgggcatgagaactcagcagctctggatgaagcaacctcagcagatgctcagccgccagagctccccaggggtcaggagagaaagcgaaggctgtggaagagcccgggctgcgtgcatgaacacttgacctgcgctcttcttgccctactctgttgttgtttgggtggtttgtgtctgaaggaaacaaataaagtgaagttacggcctctgctgctttaccctgcttctttctgcctgcctgtttcctgcacctcactcaaatcccgcatgttgaggtctgtgctcttgtcttacctaagacccaaggagacccaagaagctgggaatggtcagtagtcgagcaggaagtactcagtggtaacctgtgaggttctgagtcctgctcatgctgcgttcgaccccatgtgtcaagcccttcagccccgccccgcccctaggacctctggttatatgctttttctgtatggtccattaagtccatttgttgatttctctaggaaagagacactgtggggatatgactaaagctcgctagcttctcccttccttagatggatcgcaggcgtctccagtaaaaccacagagtgattagaccattcctccattttgcagaagggaaatttgaagtctgtacagtgaaatgttactacctttccaaacatctctaacagccagtaactttttggaatagtgc

SEQ ID NO: 22704 - DNA, 1198 bp, Mus musculus
cttcggccctaagaacgagaggatgaaactctgggggcggggggagggggcgcgtgtggtcactgagttaaaaaatcaggggagttctagggtaaaaattaaaagggacgcacagtcattccttctctagggccttgaagactgggattatccgagagtagagaagtataaagaggcaatcgagagaagagtttaatctggcttggggaggcatgggcagtgttgggtcaagtctaactttgacagtcctggaaagccagtgaagtcagggaagaaagaagctacttggcttggatttccatttctcgtttatcttttcatgattgtgttttgggaagaaattggtgcacagtgtagtgaaagtgatgtgccccaatatgggctgaactccgtagcccgtgggggtgactggtggctttatggaactgtgcaaaatcaaaatattaaacctagttggttggatctctgggccctcactttacatgatgcttctgggtctgtcgcggttgtaggtttgatttcctctgcatgcctgtcttccacccgcgtttcaagagggagttcattcaggaacctgctaagaatcggcctggcccccagacacgatcagacctactgctgtcaggaaggggtagggaccatcccctgtgccccttaattattagaggcaggaatatcttctgctttataggacttaattctcctcctcctctgacttggttatctattggttagcccctatgacatagagaactcttttttttctttcctttctaaaagttgtagtcccctattcttcatcaggctatccctatatcagagacaaaaagtcttgtctttcatctctactctttattctctgctgagaactagaaattgatcaagaacatgccaactcccattgagtctttgtcttctcttgggttggggatgcagactggaatacgctaattgtgggaaagctttctccatggattcatccagactcaaaagtggagaagatccgaaggaactctgaagcggtaaggcagtttaatttcttcgtgggatccctttaaaggttaggcctggcctgggtgttggggcacctatctgcaatctcaagcgttgtgaggttattcccacatcaggaagataatgagggaggattgagattccatgccaggagaagaaaaggaaaaaattagttctgtcacta

SEQ ID NO: 22705 - DNA, 1143 bp, Mus musculus
cgcttgaggaccatggaatgtgtgagaagaaatgattggggtggaagacatggggatgaagttctttttttgttcttttgagagggtgtagccctgactggcctggaactggctttatagaccaggctgtcttcaaccttacagagatctgcctgcctctgccttctggtcactgagattaaaggccaagtcaaaaattttttgttgtttgtttgtttttatttcaagacagggtttctctgcgtggctgccctggaattcactctgtagaccaggctagcctggaactcacagagatcctcctgcctctgaatcccaagtgccaagattaaaggcatgcgataccacttcccagttaagtcaaaagtcttatagtcttttttttttttctttttcagtttcatgagacccttgaacagcggctgctcgtaactgagctgacgcagctctcaggtcccgggcaggagacagagttgcccccgctgctaggtctggagaggaccgaccttctggagctcatgccgccctcccaggttggaaacagacactgggtcaagtgtctgtctgtctgtctgtctgtctgcctgcctatctctcttttctttttcaataggacctcatgtttttatttcaggttggccttgaattttggatcttcctgcctacacctcctgagtgctgggattacaagtgtgcaccactgtgcttgatttatgaggtgctaggccaagacctttttttttgttttgttttgaaatagatttatttatttattatatgtaagtccactgtagctatcttcagacaccagaagagggcatcagatctcattacagatggtctcgagccaccatgtggttgctgggatttgaactcaagacctctggaagagcagtcagtgctcttaaccgttgagccatctctctagcccccagacccaaggcctcttgtgagccaacattttctctgttttttcctttttaaaaaaattatccagcactcgggaggcagaggcaggcggatttctgagttcgaggccagcctggtctacaaagtgagttccaggacagccagggctacacagagaaaccctgtctcggaaaaaaccaccccccccccaaaaaaaaaaaccaaaaaccaaaa

SEQ ID NO: 22706 - DNA, 2126 bp, Mus musculus
taggactgccgcatgcagctgagtgacgaggaaggttgctgctgtttccctcttgatggacatttgctctgccacggctgtcacatgcagcgcctcagtgcccggcagccctctaccaactatatctgagctgacgttactgctgccaccaccactgtggagaaactctctggccagcggaggcaaggagtgtattctgcaatccttgtgaagaggtctctggggaggccccgaaggccagagacccaaagatcctaacattccaaatgggctgcggaggaggaaccttctggttgccgggagagttgactggtgttcattgcgtgcagcctgtgctacagtagatgggatgtagcacacgcaggcgggtttcagtacttcctgaacgccagattataatgtatttttccagtgtatgtttctatatacgtcacacaatgttctggtgctggatcacatgagggcatcacagaaaccacccccagtctgttgtaccctatgcatggagtcagtggaacctttcccacgggatcctatctttgtctgcgctaagggctggaagccctggactttgtgatgagccatttcttggctctctccctaaggactagagagctccccgtgtctgtctgctgggactgggaccagctctgggggaccttgctgcctgtgttgcctgtttctcagggacctggggaggctaactggggcctgtccctggttgctgttttgctcttctgggggaagaaatgagcaggtttctggatgtgaaacttgccggtgagtaggatgtccctgaagcatcaggctagccccactccccctgtttaagtgcactgagcctgtagcccagcatatgtggatacattgtagccacgtgtgcctgtgcacctccctccctactcctcttttctcaggtgacttacgcttagttccctagcagtagcctatcttttgagacccctttttaaaagggatcctgcattggatctgacctgttacaaccccaccactcaaggcattggggaagctggagagaagaaaaataggttgacttggttctagccgcttggctgaaacttgaattccccttaagcaggatgtcttaaagccaggtcacttgctggctggaactcaagttcatttgatgaccaggttgccaagagtcctgtcccctactgagtgttcttatagctgcctacatgttttgttcttttcattgcactgagcattcagtgattcctgcctgttcatcaagagtatgtcagaggtttgtttggtttttggtttttcgagacagggtttctctgtatagctctggctgtcctggaactcactctgtagaccaggctggccttgaactcagaaatccgcctgcctctgcctcccaagcgtgggattaaaggcgtgcgccaccacgcctggcttacttcagagttattagcaacctacatttatcaactttgtggcactttgtgatacaaatgttccctgcctccttgggtgtcttcctactatgccattatttctctgacacttaagaaagaaaaagttgaaattctagcagtaaatacagttgatgcagacactttgtgagtgtattgtggttcttctttgctgttcactatggcttcaatccttgaagccttatgccttgaagatgtaaaggggctctatggattcgccttggtctggcttctccattcacattgttaaaatgtgattgtgtcataaacaagtgagtctggaaatgactgacctgaggacagaagacccacccttgagggttattctaaaactgtgccagccattctgggaattacatgggcagggtctcttgagtgcagaagcacacctttgatcccagcactcaagaggcagagacaggagaacttctgtgggttcaaggccagcctggcctacagaatgagctccagaacaacccaggctacacagagaaaccctgtctcaaaaacccaaatcaacagcaacaacccccaaagcagaaaacaaacaaacagaaaacaaaggaaaagaaaagaagctgggcagtggtggcacacacctttaagcccagcacttgggagacagaggcaagtgggtctctggattagaagctagcctgt

SEQ ID NO: 22707 - DNA, 1179 bp, Mus musculus
atcctccaggccatggggaagtcctatcacccgggctgcttccgatgcatcgtatgtaacaagtgcctggacggcgtccccttcactgtggacttctccaaccaggtgtactgtgttaccgactaccacaagtgagtctgacccctgggaggaaatgtgggcctgggcccagggagtcctcagcctcacttatcactgtcttcttttttagaaattacgccccgaaatgtgcagcctgcggacaacccatcctcccctcagaggtcagtgtatccagagttcctcggggcggccagcgctgccgcctctggggaggagatggggacatgcagcctggcccttgggaagtggcacttcgaaggaatgtgcattctgtgaaagattcccgtgtgactctgctcttggggtcaccaccctgacctaaacatccggacctagactagctgggcccaggctccatatcttctgtcccccgtacagagaacaaggctttctttggaagtcaaggtcaccagatacagggactgaaaaggggtgaaactgtccttaaactggtaaaaaaaaaagggacagggattatttgagctgtgtgtggagagggtatgtctagaggaaaagctacagcctcttccttatattggcttgtgctcagcctttgccttcccctgcccctccccctcccccctgcttctcagcaggaggaagctagcaagtaaggctgagcccctgtgtgtggaggggagctagaggcctggaggcatggacagtgccagggtagtgggtagcattctggtaggagttgcttaaaagatctcaaagctacatgttagctacgtggaatctaactgcgggaagaggcctttataaaccctcttgatggagcaggagggtttctgtggtatgggatggggatttggggacaccatgctctgcttatcccccatgggactctacgtgtttcagggctgtgaggacattgtgagggtgatatccatggaccgtgattatcactttgagtgctaccactgtgaggtaagtgttggggttcggggatgatgtggggaaatcggaatttggaagggggattcttggaatgactgggcatctgtgggagggatttaggatacagaaaaccaggacactgcagtgacctatgtccagtctctcttgtcctctagc

SEQ ID NO: 22708 - DNA, 1166 bp, Mus musculus
aacaggcggtggagtttttgttgttgacaaccaactattgcggctgaattaataccatgggaaaatggtctgaaaacaattatttgaaccaggattaggataggtggccttaaagaaaatggccacttcagtctctccttaacggggttttgaaaaataaagaaacagcttgcaatctgaacctgggcctgggcagtgaccaaacaccctagtccagttaggagtcttaagcagttacgcccttctcaaagatggccgaattcgcttccctcactcgagaagaacattccaaccactctctagaaattagaagttaatcttatccgtactacttcgatgccaaaataaaaatggcaatcttaaccactcagccatccttcctaggtgaacacagaccggcgctggtatttagaggtgtggttgcccggagtaaaaatggcgccgcctccgtctagacttagctggacgtgaagttgtgacgtcgcggcgttgccagtcggaggcagttcctgttgcccttgctaaacatggcgctggctagcgtgttgcagcggccgatgccggtgaatcagcacgggttttttgggctcggaggtggtgcagatctgctggacttgggtccggggagtcctggtgatgggctgagcctagccgcgccgagctggggcgtcccggaggagccgcgaatcgaaatgcttcacggaaccaccaccctggccttcaaggtgctcagacagctcgcgcttctccggcatcccagccggaaccgggtcgggcggaggttcggtcccctcctcccgacccttggcgggttcactgtctcgtagccttaagaaaggagaggtgggcggagatagggggcggtgagggaaggagacggacagcgtgggttggctcctaggcgaccccagtttgccccttttcaggagccctacctgggaacagcggaccgtggcggagggtgcgggggggaagccattgtcgccgttcaccaaagtttgtataaactgagcttgatgaagtccaggggctactgaagtgggtaccgaacagttagggtccctgttccagccctacaataactagctctggatcttaggctagtctttaaagatttattcttattttttgtatatacaccacgtgtgtagtgctcgcaggcgcca

SEQ ID NO: 22709 - DNA, 1119 bp, Mus musculus
ttctcctttctgtgcgcaaatagttcccagccataataaagatacaacatcagttttgttcactctttaagccttagtttcccaatctccactcccccaatcttttcttacgttaaccttttacttaaactgcagccaaaagcaacatatgagtgttacggtgtgagctagttaggaacctagaccatctaactgttgggtcctattttttggggacagcagctaccaagggggtgcaagctggaaacagtgacacagaggggggccagcctggccgaaaacgccgttggggagccagcactgccgcgacacagaagaaaccgtccatcagtatcaccactgagtcactcaaggtgaggtgggcggagccagggaagggagggtaagaaatgttcaggtgggagtagacatgggcccagtgtaacggggtagcgggggtgtctgtgtcccagagcctcatccccgacatcaaacccctggcggggcaggaggctgttgtggatcttcatgccgatgactcccgaatctctgaggatgagacagagcgtaatggcgacgatgggacccatgacaagggactgaagatatgccggacagtcactcaggtaaccccgtgtgctgtgcccagcatcgggtgaggcagtgggcaacggcggacagcggaggagctgaggtaatgttctggaagggaactcttatgccaagggccggattacgtcaaacactgctagttgcaaaagaggttttattagaaccaagctatagcaatttgtgtgctcttgtttcagcagcttgtaccacagaaccagaattgaaaactaaagttgataaagcctcatataacatcttgcctcatgcagaaaaatagttcaggccagcaagatggctccatgtgtaaagggccctgctgcagagcatgctgcccatcctcacggcccgtgtgagggagagagccagctcccaaagctgcccacacagaggtcactgcatatgctcatggcgcataagagcacacaaataagtaaatgcttggtttgttctcaatttaaaaaaatgtttagccaggcgtggtagcacatgcctttaatcccaaggaagcacaggcaagaggatctctgt

SEQ ID NO: 22710 - DNA, 1193 bp, Mus musculus
aagagatggagccagtggaaggcccagcaccccctgtcctcattcagttgtctcctcctaacacagatgctggagccagggagccactagcgtctcctcaccctgcgcagctgctaagaagcctgtctcctttgtcaggtactacagacaccaaagcagagtctccagcagggagagtgtcagatgagagtgtcctgcctctggctcagaaaagctcactgcctgaatgctccacccagaagggtgttgaaagtgagcgtgaaaagtctgctcccctccctctaacagtggaggagttcgcacctgccaaaggcatcactgaggaacctatgaagaaacagtctttggaacagaaggagggcagaagagcctcccatgctctcttcccagagcacagtgggaagcagtcagccgactcatcctctagcaggtcctcctccccttcatcctccagctctccatccagatctccatctcctgacagtgtggcttcccgcccacagtcgtctccaggatctaagcagagagatggagcccaagcacgagttcatgccaaccctcacgagagacccaagatgggctccaggtcaacttcagagtccaggtcacgttcccgatctcgttcccgttccgcgtcaagcagcagcagaaaagtgagtatggagaatcctgtctctggtcattttgaaactcagaataacctgtaatgatttctaacaggaatagaagagtcctgcagactccactgttacttttccttcattacagagtcagggcagtggtcactggggtccctgcccgttctgaacccctttgattgcaaagcatactgaatacatctttcatcagtacaagcttcttgagagtgtaagcctctggatgaaacttagtaaagttgttgaatatgtagttggagattattcacttaaatggcagtacacacacgagacaaagagatctagaggaagaccagctattcctaatcagcttgtacttgcagcgtttgggaggtagaggctatagatcaagtccaatacctgtttgtgctacttaaatctctttatcaagaagataaaaaaagacccagactggactgggtcaccaaaactggaaaaaatctagtggtctcctgtatatacaggatctactcatactaatctttccgaaatatttggagtataaaataatttccc

SEQ ID NO: 22711 - DNA, 1150 bp, Mus musculus
cattcggtttgagcaagtgctttactactcagccatctcactagcacataaagtagcagcttataacctgaaaggtgtttgcttgttttcttactctgcattaaaggtaaaacatgggctttgtttgtagtaacaatgtttttaaagtcttgttttgtctgttactagtgcagccactagggttttcttgtttgctttcttcatggaaggccctgtgtataatgggctggggattgaatctggggactcaagcatactcccactgagataaattcacagtctttttcttctttccttcctcccttctctctttccttgcttgctttctgctttccttcatttttttcttcttttcaatcagtgctggagatcaaatgcatactcagcaaatgtctaccactgtgctctattcccagcttgttttgattttatgtaaatttttcttctaacttagtatgtgtacacatgactgcataccaaaccatggcatctatgtggacgtaagaagacaactttgtggagctggttctcttcctcccttaggtggtttctaggggttggatctgggtctccagcttacgtagcattagctctgattttctgctttttaattggaaactttaacacatttataattgctctaattgctaataagaaaaaactgccattttgctatttcttttataaatgtcatcattttgttgttaattcctttattactgccttcctttgtgttaagttgattgttttctagtgtagcactttagatctcattatgtcctttaccatattcaaaactgttttgagattacagctaacataatttataaaaacctggtttaagttagtaccacatttaacatcaatacttaccaaaatgtcatagttttgttaaattatatactcagcaacacaaattttaagttactgcattatacaattgtcttttaaatctgatggggagaagctaccaagaaaaatgcacttaaactgtcttttgttgtatttacctatataattaccttttctgcatttgagttactaattagtgtcctttcatttcagcctgaaagactccatttagtatttcttataaggcaagtttgagagtgataagttcactgtctaaatttttgtttatataggaata

SEQ ID NO: 22712 - DNA, 2647 bp, Mus musculus
gtctctccactatcctttcctgatctccctttctcctttctctacttcccttctctcccacaggcggagttcacagctctatacggggacggggccctggaggaggcacggcgtctgcgggaggggaactgggcatcagtgaggacagtgctgacgggggccgtggcactgggggccctggtaactgtaggggccttttttgctagcaagtgagaaagtctagggccaggtggggctaggtgtggctaggggccaggagagctggaacaatagcgaatgcccttggaagaaactggatggtcacggaacagagaaaggcaggggaaggtagtgtgtgtgggagcccagcatgccaggcaggtggcagggagaatgagttggaaacattaaggaatgtttcaaggccaagaacccagagagtggagtcatcccacggcttggggggtgggggtggggaggtgggaggaatcatgcccatatcgcgggcacacaactacccggaacatggcttgtagctccaaggacggtgagcttacttcaaagatctgtgtctcgactagatgaatgggatttagggagcctagaattcacttccctttgggatggaagcttggtgatcaggtgactgggtgaaatggctgtggctgtgggctgcatgggcacacctgtgcatgtatgtgcacatgcaagcatgctcatgtgcatgctgggctgtctgtcgaatctggtggtggggtacttagagaaaacattccttcttgctatggcaagaacaagggccagttcactgcccttctcctctctgccccttcccttgaccttacgcctccaggctgagggaggaacactgtatctagactagggctctggtgctgccgagagttgttggcagggctttggagagaagagttctgcagctggccttgttcttcatcatccccctgttgtgtgcatctgtgcacctgggctgaaaaagggtaaggctgtggagcctgggtgggtagaagctttggtagttggacttgcctgtcaccttcccctccaacggtggcacaatggtgcctaaagtgttgcctgtttctagggtctctctatccagctgagtctaaattggggatctagttttcctttagaagatacgggcataaatgctgatctacaattcagtttagttcctgaactgtctcagtgagactgcggataccttgagaggaccattccagctctgagtcccttgggagtgatggggacaggtactccttgactggcctgttctgggtggtgggtttttggtgctgctgctctatcaggggccagggatatgggttctagagtacctgccatgacctaacgcgttttcttttgaagccatgctctttgcataggttgtcaacactcgagtctctgaagatggtcacattagaactcacagtccagtcccctagaacaaatccagactctagccttttcttttgagggaggaaatgattcactccaaatgcatgccctgagccagacctcactgctgcacttcccaaggtgctaacattgctgctctttaatgctgacttcgttcccagtgctctagaaccctacctgcctctcctgagcactgaccagcttggctagaccacagctgacccacctcttcacttggtcctagaatgtggcatcatatcgtgcttgctagaatgtgggaccaaattggcctcaggtgttttagtccagactttggcttttgagagaaggttgcactttttcatagtgtctatgggggatgtgggaggctgcatgtgccagttggtctgttttgagggtgatgatctaagagactcggagctgtctgtgacaagcagtcagagtgggaggctctgacttgctcaggacaaactaggccagtggttttcaaactgcttggcagagccccgaagtgtcctaggggttgcctcaggagtccttagggagatgagggagtggagggctgggcagtttgccctcaaacagaacagctcccccttgtagctgtcttatgtatcggggttcagggtaagattttatttgtggtaagggctttgctgctgaaaaaagttagaaaaccactgactagaccatcagctccatctggagcctgtgctcctccacgtccagggaagtctctgctctacccttcccatgggacacctacctaaggtagcattcctggggccctttagcaaacaggagcagcaggaaccagggtcaggttaccaacatgctctgctagcagaccttcagccaggtgggaggagaggctgtgctaggacaggctaaagggttggtcttggtctggattctcagaagcttagatgggaccacagtggagagttgtgacctgttctgcccttcgttttaagggccagtggaaacccagagactcttctgtcagggaaaaccagggactgtcttttagagccatatagttccttgggattagctcttggccaagaaggctgagtatggctcccaacttttaaatccatttcattttttttaaatgagggaaatggatataatttttcagatactaagtagctggagaggatgttcttgctctccaaagcccaaagggacaaatagggactttgcttaggccaaggcaagagcgcaa

SEQ ID NO: 22713 - DNA, 1160 bp, Mus musculus
tgcgggcgtattgttacctaaggactcaacaggaggtggggtgtgttgattgacaggcatatttcacctaccgggtttagagaatttggcacagtggcccgccttagaggtggggcctcgtttgattgccaagtagaattccccaatagtattcgagctcggggtaacgggcaggctgactgactaatgaatcctcggcgtggccggctcagttctccaatcgccgatcggcgggccccagtctgagcggcgatggcggcggcggcggcggcggcagcagcagcgggggctgcgggcggtcggggctccgggccggggcggcggcgccatcttgtgcccggggccggtggggaggccggggagggggacccggggggcgcaggggactacgggaacggcctggagtctgaggagctggagcctggggagctgctgccggagcccgagcccgaagaggagccgccccggccccgcgcccctccgggagctccgggtcctgggcccggctcgggagcccccggcagtcaggaggaggaggaagagccgggactggttgaggccgaccccggcgacggcgccattgaggacccggtgaggggaggagggcgagcgagcgggccgggtcatgggaggcccagagcacggacaggaggcaggcaggcggggggtggggttgggcggggaataacgtggctggtggcgggccgaggccgttcgtgagcggcctggtggggcatcatgggtgtctagggtggctctagagaaggtaaattgactcttttcattttttctgcgtgttttttttaaataatattttttatttcaatcacgaccctcgcacgaggcgagggaaatggccgagcacggctgtggccgggcccagacaaaatgtacggcacagcccctgcgtctggttaactgcatgccctgctcattcattgtaggagctagaagcgatcaaagctcgagtcagggagatggaggaagaggctgagaagctaaaggagctacaaaacgaggtagagaagcagatgaatatgagtccacccccaggcaatggtgagtagatcgcctcatgcacgcacagtccggatctttggttgatagggtagtgggggaagactgcagcgtggcagaagccggggaccttgaatgaagct

SEQ ID NO: 22714 - DNA, 1478 bp, Mus musculus
cttggttatttttcccatgtgtggaaggatccagctcctggctggtcctcccacagctgcgtgggaggactgttcccaaggtcagctgtctgatggggcctagtggctccagagtgtggctgggcttcatttacttctgtccttgcatttcagtcccacattaagataaaccctgcctttttagcagatagggtttaagtgctgtggagcactggacaaacaatggatcctttttcttgtccctcagtatcttagatggatatttccttgccctgtttcccatgtcaaggccccccagtttgccatttgtgttattcctggattgaggcctcacttttgaggtgctcccttcagtcactggggcagttgcgggcccatggggagggtcttgcactgaactctttagtaaccctgttaacacctaactctccttctttcttccaggggccgggctagagcgacatcatggtattccccttactaaaaaaagtgtgtattaggaggagagagaggaaaaaaagaggaaagaaggaaaaaaaaaagaattaaaaaaaaaaaagaaaaacagaagatgaccttgatggaaaaaaaatatttaaaaaaaaaaaaaagatatactgtggaaggggggagaatcctataactaactgaggagggacctgctctgggagtaggggaggcccagggcgcggggcaggggctacagagtccctctggggattcgccatggacacatctcaactgtgcaagctgctccctgtttccctgcccccctccatcctctctgggcctgctcaggggtaggtgggctcgggtggtaggagggcttttttttacccagggctctctggaaggacaccaaactgttcagcttgttcccttccctcgtcttctccctgccttttgcagtccccgcctgcctgctcctgtcctaccaggtctccgcccaccctacacctctttcctccggctccctgcccctccagtttgcctggtgatctattttgtttccttttgtgtttctttttctgttttgagtgtctttctttgcaggtttctgtagccggaagatctcgctcccagcggctccagtgtaaattccccttacccttggggaaatgcactactttgttttggggagtttgggggtgtttttgtttttcaggtggttttgttttgttttgtttttttctttaccttttttttcccttttatttggagggaatgggaggaagtgggaacagggtggtgggggtggcttttgtttttttgtttttttttaactcatttccaggggatgggatttttttttttaaataatgtgtcatgaataaagttgttttatgaaaaaattggccctttggatgttttttagtatggggggaggattggtgtttgagagagggttacatttgtacattaaggtagaaggtagagctaactataatgtattcagttgaggatgattgattgatctt

SEQ ID NO: 22715 - DNA, 1180 bp, Mus musculus
gggatcaagggggtctgaagatggctgacactaagtcagtagctttggatagtgaatggttggagctcagcatgaatagttctctctctctctctctctctctctctctctctctctctctctctctctctctctctctctctctctctctgtctcctgtagaaagctctaacctggccccagaagtcagcccagatcctcctcttgagcctcccctggcgccagtcgagggctccagggagccctcagaaagccctgatcagccgccttctccagccccatctccagcccctcggcttgatgcccaggttgaagaattggctcctctacccaccatgtctgaagaggaagagggagctatgggggagccccgctctgcagaaccaaccccagctgactcccgccaccctctaacctatcggaagaccacaaactttgccctggacaagtttcttgaccctgctcggccctataagtgcactgtgtgtaaggagtccttcacccagaagaacatcctgttggttcattacaactccgtctctcaccttcataagatgaagaaggcagccattgacccatcgggccctgcccgaggcgaggcgggcatcccaccgcccgccgccactgcgtcagacaagccctttaagtgcacagtctgccgagtgtcctataaccagagctccacactggagattcacatgcgatcagttctgcaccagacacgctcgaggggggccaagatcgacgccagggctgaaggagcagagcggggccaagaagagttcaaggaaggcgagactgagggcgaggcaggtactgagaagaaaggccctgaccctggtggcttcatgtctggactgcctttcttgtccccaccacctcctcccttggatctacaccgattctcagcccctctcttcaccccaccagtcctgcccccgttccccctggttccagaatcactactcaagctccagcaacaacagctgcttcttcccttctacctccatgacctcaaggtggggcccaagctggcactggctagccctacgcccatgctgtccctgcccgctgccaacccacctcctctccctgcaccccccaaggctgagctggctgagcaggaatgggaacggcccctcatggctgaagaggggactgaagcggggccttcttcacc

SEQ ID NO: 22716 - DNA, 1697 bp, Mus musculus
cccaccaaaggagattggagagccccaagaagagcctggctgtggccacatcccaccaaaggaccttggggtggcaaaggaggaggaagagatccttcctttggacctcagcagccacttattcttcgcagctggaggccaggcctacctactggccaacctgcccctgcctaggggcagtgaactctcgttaccaaagggcttcccctgggatgaggcaagcgccaaggaagagcccagcctgcccctcctcacccacttcccctcctcacaccttaccacccttcacatccaacatggcttcgacccaatccaaggctttagctcttctgaccaaatgttgtcccacgatacctcagcgccgtctctggctgcctgtgagagaagggatggatccttctggagctaccagctggttccaaacccaaccgaagatcccaaagatggccccctggggagccgacgggaagaccacagggcgatgttttggatctgccttctctgccgcctgggtttcggcaggctccagaccttcataggtcacacactttctcatggagtgaagctgagccctgcccaccaccagggcctgctgggcagcccagccgtacttcaggagggtcatgatggcggcatggccctcctaagctttctggaaccaaaatttcttacccgtccttctcccgaagtaccggacaccagcacagtgactgtgaagacaaatggagcccaggctgaggacggccccccagaggcagatggtcaagcccttgttctccccgctgaagaggttatagccctcagcccaccatccccacccacagccctagccacctgggaccccagcccaacccaagccaaagattcgccagtaccaagaggcgaggcggggccagactggttccctgaggggcaggaagaggatggagggctctgcctcccgctcaaccaaagctcacccacctctaaggaggtggccgtgctcccagctccagcaggctctcccgaagataccagtgacccacctccgtcctgtcgcctggccgatgactacactccagcccctgccgccttccagggcctcagcctgtccagtcacatgtccctgctacactcacgcaattcctgcaagactctcaagtgtcccaagtgcaactggcactacaagtaccagcagaccctggacgtgcacatgcgggagaagcaccccgagagcaacagccactgcagctactgtagcgccgggggcgcccacccccgcctggcccgcggagagagctacaactgcggctacaagccctaccgctgcgatgtctgcaactactccaccaccaccaaaggcaacctcagcatccacatgcagtccgacaagcacctggccaacctgcagggcttccaggcagggcctggcgggcaggcgagtcccccggaggcatccctcccacccacctctgtcggggataaagagcccaagaccaagtcatcctggcagtgcaaagtgtgcagctacgaaaccaacatctcccgaaacctgcgcatccacatgacttctgagaaacacatgcagaacgtcctgatgttgcaccaggggctgccacttggcctgccaccagggctggtggggccaggacctcctcccccaccaggggctgcccccaccaaccctcctgaactcttccagtactttgggccccagg

SEQ ID NO: 22717 - DNA, 1169 bp, Mus musculus
ggtggggaaaaggttaggaactccttaagggatctagaaattcagggcctgctgctgtgccgggagggtagagtgctcagtgtggcagtttagagagaacatttgctctccaacccagagaggggtagaaagaaaatggtcattgttgagaccggttcctagggtttcaggaagtcatacttcctgtggagaaggcaccacccttgctcttaacacatttttttttctctcaactaggtcaaaacaggcctctcttcccttctcacgcttcatagactttatttgttggggaggaggcaggctctctatattgccttgacaaatatagggtctgagtgccacctgctggtggccctcagggttgtgtcccaagctgagggtgcagaaagatttgagaggagccgaggcagttatgaggcaggcaagcttagggaacaggttagcagcctggaactccacttggtttgagctatgcacacctctcatctcactgccacttggcatcttaggaccctcagctgcacgcaccatgcacacacattcttctaacagtgcagccaggaccccgcctgtatcgagtagcacttagagcccacttcagacagtaaatctctctttccccagcagccatcaaaactccccttctgtggacagttttattcaaacactttaggacataccccaaagtagggagctgattaggcctaaacgggtttggggtaacctgtgatctttgggtgaccttttgaggagaactccctatggaccgtcctatgcctgtgcagaatgagttagcttatgattaaagtcagctgcatcatgggaagggttacgcacagagaagaaaggctgacagaatccaagcctgtcaatgaaaacagagaatcactcaaattatgccacttcacagctaacaccttcgttccctgagactttattaaaggaacaccgggtgactgccctgggctcttaagactgtggtcatcacccgtttacagagcacttctaatttgtacgctcagtttgcctttaaataaagtttacttcgccatttacgtgggtctttatttccgttccttgaacaccaggagcctggagacacccaggccagacactgaccacagtcggttactgccacgtctccacaggcaagttatccacctcaaaga

SEQ ID NO: 22718 - DNA, 1326 bp, Mus musculus
acctaagttcttgcctactttgatcttccctgagggagaaaaggggagcgaacaacaggaaactccccgtgctccctctcctgccctcctcaaccagtccctctcccaaccaccaaggatggcacgccaagccaagagtattgagaaaagcaacgaaaaaccatctggtgcaaccaagcccgcccctcttcagattctgccactcacctctctacccttctctgcccccctgaaaatttatttggttggtctggactcacttgtggcctttgattaaattcctaaggggactgaagaagacatttctgcagagggttagaggcgctgcagcaagcgaggaccccagtcctcagctctgacagttgtggggcgaacacgttgagggctgaagggcagcagatgctgtcacaagtctagtttctaacccctcgcgtagactcctgcgagatgggagctaacggggaatcagaggaagccgctgccccacacagggcagggcagaggtgggtgtcaaccccggacgagagttggggggagagcctgtttgagattatggctgatccctgggactaactttccctctggggacagaaagctgtacaagaggggactgtggaaccccgggggactttcctaccctgcatgaggcagaggcaagctgcctgccaatcaatcccttcctcaaggaatggccttgcccaggaatgcccaccacacacacactcttcttatttttctagtcaacctctgtttactccctggcctgccttcctcctgcctcccttccttccttccttctcaatctttacttctgatttctatttcatggaatttgggattgaagttatacaacagtgccgccaacatcaagtcttgcaggaaaaaaaaaataacaaagaaatttaacaaaaaaaagtatattaataaaaaagttccaaaaagggggggactgtcatctcctttggggtgcgatggcttctgactcaagctctctgagtgccacctggtggggtggatgaaaagtgaggcccctgggggagccacaatcatggaacaattctaggctcctttaccaaagtgccagagacaggccagaggtcagaaatgtcaagacgactcagcagggaggccctagaggggcggggtcccgtgatagaggcggggaagagggaagggccccgaaccgagcaccaaccccagctctgtcccataccaggaagtgctgggtggggggtagaggagcaaagttgacaccgaagccaggtgagcttgggactgggaaactagtgccttctgaagtgggaatgggggcaagaaatctcgcga

SEQ ID NO: 22719 - DNA, 1326 bp, Mus musculus; identical to SEQ ID NO: 22718

SEQ ID NO: 22720 - DNA, 1230 bp, Mus musculus
tagagcagggtaacagccaatggctcactgatgctcgtggtccggcaccttctgcattcattgtcactacttccagattgtcctttgaaaggtcagtttttgcaaggtgtccttaggctgtggaaaaaacagggatgaggaggaacgactttcagctcctattttagccacaaatcgtggtgttactaatgacataattcttgcctaggtcttgctaaatctgaggttgataattctcctttaggagctgcacagcactcagaactgtgcatactggtttgtgattgtacaaattcagtatgggcatcgcttggtgcagaggcactgcaggggaaggtccagcttgaccatttctgagtttcctgtgagataaacccggtttgaaagaggttggtaccaaattttggctaaaaatgaaaaatatttttcggctctgcctcacctccccaaaaggtacccagagccacaggtgtgggtcttatcagtacccacgggaggaatcgggtccatgtccacccaagccaaggttaaaagcccactcatctacggatgagaaaaatcatttgatcacctcagttaagcgttgccttatttaacttaattaataggggggagagagattggaggcgtactattgaaagggcaagcccttcactgcctcccacccaaataaaaaagccaattggccttgtactacaagagccggtcaaactccttctccctgtttcccacctatcatccaaaaatgcggaggaatatcaacttagtgttattcttattatagtgtatttcacatttgttcagtcaaacttagccagagttccaacgccctacttaaaattcaactagaaagttacctaccaagtactaattagcattataaagtcagagcctacaactccaggcttttcagttagttgtttactaagataagaaaggacagtcttagccagatacagtttaccataagaaaagttaaggaatcccacgaaagcaggttttttctttagccctagattccaggcagaactattgagcatagataatttttcccccctcaggccagctttttctttttttaaattttgttaataaaagggaggaaatgtagtctcccctcccccagcctgaaacctgcttgctcaggggtggagcttcctgctcattcgttctgccacgcccactgctggaacctgcggagccacacacgtgcacctttctactggacca

SEQ ID NO: 22721 - DNA, 1122 bp, Mus musculus
agagggctttaccatctggagctatgccttctgttggaggcatttacaccgaaggagacagataatagtagctgccatttgaacatcaaaactgattgaaaaggccatggaagagcttctttaagattgctcatgaagctctcatctgggcaattttcttcactcttggaccagaggcttgactgcctctcctccccgatgggagacacaaacctcataaaagccacagatacaggtagtctgaactcactccacatacccaccacaacccagaacctggtcttatggtgcctgcaaccagacacactttggtactccccagaggtacggctttctgccccactcaccaatgcttgtctcccatgatagccactggatggttgactctctgttttgactctgataggcttagccggcacgggctaaggccctggtgctggtcaccgtgccgtagcatccaaaccctgcatgtgctcagtggagatatgagtcagctgccggctggagttcgagactttgtggcgcgcagtgcgcatctgtgccaaccagagggcatccacatctgtgatgggaccgaggctgagaacactgccatactggccctgctggaagaacagggtcttatccgcaaactccccaagtataagaactggtaagccttgaaactagcaacccccaagatgaaggttactgcttagactgaggtccctctgggttccccaagacagatatttctagaccacatcagtggaatgagccagaatgggagcttcaagggaaagtggaacgggaaagtgaacgttttttacattaaatgaaaaagttgatacgaatttacaaattggagctcttactttggagggggcctacttactgcctgtctcctccttcatgaaacatttgccaggggtagaggctccaaggctgtgccttggggaaaacccctcttaatgagacaaagcctaaagggactaaactggaactggataagaaaaaataatgctgacagacctagagtcaaagttaaacttaaaaagtggccgctgggcggtggtggcacacgtctttagtcccagcacttcggaggcagaggcaggtggatttctgagttcgaggccagcc

SEQ ID NO: 22722 - DNA, 1187 bp, Mus musculus
ctttgaagaaaagattgtcagcagttcggtgaggttgcaggggttggaggtgggaggacggcttgtgtctagagctgggactgggaggggcatccccctgacttcgtgccactttctgctctgcagtgggatgggaacctacgtctgtggcagtaccgccaagctgagtacttccaggatgacatgccagagtctgacatgaacagagtctgttccagtggccctactccagtgccctgcccatctgtggccttttcctcacctcagtagatctgacctccagttctgtgtagggtgaattctcagcatattctctgcctcctcctccctttccccttctggggagtacgtggaggaactgctcacactgggtgagaaacagaaacccagggtctgggcccaggctgagcctggactgaccacccccaaactgggccaagtggtttcctcgtgcattcatacccagtctgcttggatttcgatctctagccagagtgtggcagggcatccattatctggggtgccgcttctggctacaagagtcttgagtgtgtttaatcatgttctgatgttagatattggctcatagtgtagacacttgaggtctgaatggacccattagcagtaccctttgcccaggtcttcacactgagagttagattggtggccatcagggccaagtataccgagacctttctttctgaggtcttcgagggtggacaggatgggtagggaggtgtttgcctcagcaacctcctggggtgagaactatgtctgctctcatacttggactttgaagtgaaaagactggtctgagaggtatgggtctcagatacggcccaactcgccattggatcctatcattgctggtggccagcagcttcaacaaaagaggataaaacaggacttctttcaccttctcactggctgtggctctcccaataaactgtctgtgggaaactggctctgtgtctgtgtcactttccctttcttctatgtggggtctgttgtcttctcacttcagggaagcaggttcaaactggctgaggctgtgcatgctgtaatcttcttgcttggaactaaggacaaaagggtcagaagctgaaggtcaccctcagctccatcatcagtgtgaggctccaccaggttacctgagagcccatctcagaaagccaaataatacagct

SEQ ID NO: 22723 - DNA, 1183 bp, Mus musculus
gaacctgggagtcggggtatgtatatggaggggaaggaaggatgtggtgataaagccaagacgcgttctttgctccaaggtcactacctggttgcagctacagatacctcggatagaggatgggaataattttggcgtggctgtccaggtaagagcactgtcccctcaatctacagccctactgtgcaaccagcctgagcttccccagctctccactttcttcctcaggaaaaggtgtttgagctgatgaccaaccttcacaccaagctggaaggcttccacacgcagatctccaagtgagtggcctcatcacaacaccctcagcgcactctgctttggggacaggcccggggcgcccgccttctctttccactctctacatactacttccactttccacaggtacttctccgagaggggtgacgccgtggccaaagcagccaagcagccccacgtggtaggtgaggcccaggtcaggctgctcccggggaagacagatttcaagtcagggctaactgttgagtttctaactgcagggtgactatcggcagctggtgcacgagctggacgaggcggagtaccaggagatccgtctgatggtcatggagatccgaaatgcttatgtgaggaagggggaggagggcgggggtggacagaagcaccttccccagaccatcaaatttctgaccaagcagtcttggggtggaggatgacaacagctaaaaatgggatacagaactaccggggggcccgtggctgacctccaccactctgtgctccgataggctgtgttatatgacatcatcctgaagaactttgagaagctcaagaagccccgtggagaaaccaagggaatgatctattgagccccctctctcattctgtgatgggtatagcagaaaccttcctgcttttcaccaggaactctagactggacgcagtcttcttcctactggctggggtttctccctcactctgcctcccaaacacaataaatacatagttgcccaccagcccatgtctttattgtatgtggacccttctgacttaggcatttccatctgtggaaccactccattgagtgatttgagtgttaagccgctggttggtccagtcctgccgaatgtcatcaagatggcagtcaaagtccacaagatgctggtgagcccggccctccaacagc

SEQ ID NO: 22724 - DNA, 1173 bp, Mus musculus
actggagaagattccagaagaggagaaagctgccttgttcctgttacagcacacagagcagtcaccctctgctctgggacactgatcgtcgcgtctccatggaaatagacttgttctccacactcttggtcggcctgcttctgtgatggttcttatcaccgtgtgttatccagcatggccaagagaaagtgcaagggtgatgtttctccttacaaattgagtttgcgaggcagacttgttgaggatacttgtaatctcagcacttggaagacagaccaaatggttatgagctcaaagacaacctggaagagacttttatctccttttttttaaagctatattctctctcagctccaaggaactggaaagttccaaagggtgtgatctcagagggaattgtatgctcctcccagtcccaaactctaaatctaagcactttatatattttatctcccagtcctcactagactgaaataaaatttagctgggtgaggtattacatagttggcacatgtgagacaagaggcaagaagactgtgagttcaaattcaaggccagtcttggtgacactgtctccaaaaaaaataaataaaaagcttcctaagagcggctggagagatggctcggtgattaagagcactgactgcccttctgaagatcctgagttcaaatcccagcaaccacatggttgctcacacctgtcttcagacaccctcttctggtgtgtctgaagacagctacagtatacttacatataataataaataactctttgggccagagatcagcctccatccgctcacatgttgactacttggtcctcagtggaaccacttgggatgactagaggtgtggggttgttggttgagttgtgtcactggccatgggctttaaggtttccaaagacccttgccattcctagctagcacactctctctgtgtctcatgcttataagtcagatgtaaactctcaacctcagctccatgcttgcctgcctcctgctttgttctctgttgtgatggtcatggaccctaaacctttagaaatgtgagctccaaattaaattttgccttttctaagttaccttggtcatgtggtgtctactatagcattaaaaaggtagcaaagagagctgacgacttcatgcaggagaatcttggctccacagtttt

SEQ ID NO: 22725 - DNA, 1185 bp, Mus musculus
ccaccgtatgggttgtttccatttttcttttctttttcacaaagatttatttatgtatatgatactgtcattgtcttcagacacaccagaagagggtatcgtatcagatcccattacagatggctgtgagttaccatgtggttgctgggaattgacctcaggacctctggaagagcaggcagtgctcttaaccactgagccatctctccagtctgtttccatttttctaacatgtaaactgaagttgtgtcctgattagagtgcaccaggttgttgtttccttgtgttggaacccaccctgagacctcctccaacggtttcaaatagtggggtgccataacgctgtgcatttctttgtagggactaaaagttaatactgtttggaaataaggttggggccggccggccttttctggtagtagggagtagctcaggaatgagccaaccatagcacgaggctttgtccctccaaggttttaattgcgctatatcctgattgatgatgtcatggctatctatatcctggagggattggccaaggcccttctcagaatggtgatagtctagaggaaggcaggcaagccgagggatagaggcgggagagagagagcaatgaatggactctggactcggcagactctttaggaggtgtgaccctgggagacattgggcctcctgggaggtgctggccagaagggaatgggaacaacaagagccaggcaagaagaggcccaggagacaggctggcctgaaaaccttgacccagcctggcaccctgttgccagaggccaaccttatccaaccgccttgtcccagtcagccttgagctggactgagtcagggggtgtgaatggatggtggtgagacaattgttaactcctgtggcatgcatgggcttgaggggactgctttccaggtggctgtatccagtcgtttctaaaatgttgttgcttacttcatttgaataaaagagatccaaagtgaaaaggaaagacaattttctttaagctgtatctgctgatatgggtgtgtctagaaaaactcattggcagtataatgtgcaactcagcaatacagatgatcccaaaaaaccaaggcagcatagatgtaggctctggataccatgttcaaaaaggcttaccgttttcccggtgtgacactgaggtaaccctgggaggagccttc

SEQ ID NO: 22726 - DNA, 1162 bp, Mus musculus
ctctgcaagagaagcaatttgagcttttaacttctgagccatctttccagccctccttattaacatcttattagaaggtctaatgattagtctgataattgcttttttcttgtttttacattttcaagatacttgcaaatagtcataatgtgatatcatctaatttctattgtgtaagctatcatattgttaacactgtgggtctctgtattcaaaattaaatactaattacccttagaggttagtaaaagaatatttttctcatacagtttcataggcctctcagagatccaccaaactcaggttacaaatgcccattttagatggatttctaatgctttttcttctctgtaggaatgatgagaagacagcagctgattacaagattctaggtggttccgtcctccacctggtgttggctcttagaggaggaggtggtcttgggcagtgaagaaacttggttccgtttacctccttgccctgccaatcataatgtggcatcacatatcctctcactctctgggacaccagagccactgccccctctcttggatgcccaatcttgtgtgtctactggtgggagaatgtgaggaccccagggtgcagtgttcctggcccagatggcccctgctggctattgggttttagtttgcagtcatgtgtgcttccctgtcttatggctgtatccttggttatcaataaaatatttcctggccatctggactctttcttcttgacacaaataactgaaatccaagtggctataaccagtagaagtagaacggtggaaggaaaggtgctgctcttaggttagttttgagaaggtgtgggtgggatagggtggaaggtgtctgactttgtagtgccagctggcctagaactatgtagacagactatatagacagactggcctcaaattcacatggatttgtctgctgggattaaaggcatgtgccatcagcctggaatattctttcttttttttttttttttaatttggtttttcgagacagggtttctctgtgtagcctcggctgtcctggaactcactcggtagaccaggctggcctcgaactcagaaacccacctgcctctgcctcccgagtgctgggattaaaggcgtgcgccaccacgtccagcttggaatattctttattttaaa

SEQ ID NO: 22727 - DNA, 1185 bp, Mus musculus
acaggttttttctacataaccctggctgtcctggaaattgatatgtagaccaggctggccttgaactcagagatccccctgcctcagcctccagagtgctgggataaaaggtgtgggccaccaagctaggctaagaaagaggttttaattgtggtttctttcctgcagtgctgtccccaaccccgtgtagctctgttattaccataggggacttggttttggactctgatgaggaagaaaataaccagaaggaagggaaggtgagtgggaagaagcagaaagccaagccagagggcgggcagaacaaggcagggatacatgtgaagtgttcccagttataggaattatgctttcttctctataggagtttttgaaaaactaccagaagacgaagtttgacacctatatccccatgttttgtgactacatcccgtagtgtcctgcctattcctttctggctacctaaacggttctcactcaggtcctctggaatattctctgcactctgtccatcttctgctgcagctctgcatgcaatttagtggaaaagaagaggaagtccagacttgagttgcctggctacattgctgaaagctttgtagcacttgaaaattaaatattgatttgtttcactattgatgggaagaaggggaataaagacttgcataggtctgtgtaggtcattcctccgaaacataacaggcttctcttagctggttgaggcccttctcatatttactcctttggcaagagtttagatttacatagaagggttgagagagcctggaagggaaactgtccttatgccatcctaacagtcatccctaaggccagaatacactttgtaaacttgcttgctaccaagttagcttaggctggcgtcgctgcttcctgagaataacattcatttccctggatcctactgggtcagggtcaatcccaggaggagcatctagatgccagcctgtgctggaagcccagcatccatctgtatgagagtgtttcaagtatagaagaacgtctaagctgtttagacacgtgatgatgtcatttaatgaagctgcttaacatgattcccgcagccttccctttccagaccaagggctgccatttctgtgtggattagcatcttcctaatcttcgggggctgtccccagggtctcatttgttgatctcacgtctcct

SEQ ID NO: 22728 - DNA, 1124 bp, Mus musculus
ttaagtttagtgatctggacaggttgatacacttaagtcaccgcctgagaggagactgcggggttcccgtggctccgcgaaatgggcccagctggtccgccgaccttccggtgcagatgagagaagcggggctccgcctacgggagcgtccgggaagcctgggttgaacgaaaggaggaaagggcgcccgcgggccatggccccacctccaggggtaggtcccgcgtctctgcggtttgctgccgccgccagctggctggtagtccgccgtcgccgcgtagagcacttcccgaaagtggtggagtttctgcagtccttgcgcgctgctgcccccggcttggtttgctaccggcaccatgaacgcctgtgtatgagcctaaaggccaaggtactagagagaaggacgtctggttgggactaagatcggctggaaaagggtaggtgttctgagccctgtaccgtgcaggtggtggtggagctgatcctgcaggcgcgaccctgggaccaggtcctgaatgccctgaagcatcacttcccagcagagtccagaacagtaagtaccactggaccccgaagctgtgagtgctatcttgggcagaccaaactcaggcctgatgcaaccaagttgcccctgggtcctagcgacacctcctcacccaaattttcctgtcttcaatatcctcaacagacaaaagaagacaggaagcttttggaggcacgggaaaatttttgcttgcttgtgaagcacctgtcagaggacccgccttcgagcctgcaggtgagaatggttggtttggaggatgttatgggattcctgttttgttttgttttgttttctaaaattcatctgacctgcttcactttcccacatacaggaactagaacaagactatggggaatcctttctagttgccatggaaaagctgttgtttgaatacttgtgtcagctagagaaagcactgcctccagtcagagcacaagaggttgttgagaaagaaacactttaagggcggaaggctgggtggcttccccgagaactatgatcttcctatctgtcgccttgcccacagcttcaggatgctctaagttggagtcagccgggctcgttcatcacttcttcggtt

SEQ ID NO: 22729 - DNA, 1197 bp, Mus musculus
tcttagtcccaaccagacgtccttctctctagtaccttggcctttaggctcatacacaggcgttcatggtgccggtagcaaaccaagccgggggcagcagcgcgcaaggactgcagaaactccaccactttcgggaagtgctctacgcggcgacggcggactaccagccagctggcggcggcagcaaaccgcagagacgcgggacctacccctggaggtggggccatggcccgcgggcgccctttcctcctttcgttcaacccaggcttcccggacgctcccgtaggcggagccccgcttctctcatctgcaccggaaggtcggcggaccagctgggcccatttcgcggagccacgggaaccccgcagtctcctctcaggcggtgacttaagtgtatcaacctgtccagatcactaaacttaaaatgccgccactgagggaaacgcaggagtacgtcacttccgcctgggcgcgcggcttccctccccggaagaggccgcggagggagctgtgacgtcacgaggtcccctgcactgtgaaagtgacgtacgacctagcgtcactctccatcacccctgcaagctgtaaacctaggtgtctgaatcagcgtctgccaagcccttcccgggccgccagccgctcccaggaaaaattctgccattcctctcgcgaaacagaagagggcgctcgctcgtttcaaaaaaccaaacacaggcctgagtggtaactccgccctcctgtcctgactcgccggtgcctaaacgaatatagtttgaaatatcctagggctagtcagggttctcctggacagtaggatgacagccgttttatgcttttctgtgccacatctttgctgtttcgtgtagtttataatatttaagggcttccttttccaagtttcttttgagcactaacttgatggagtcctttagtgggttgactcttcttgctctccccaaggacagaaccgggcacactgtgtacagctttactttgttgcttaaattaattatctgccttgcccaccttgcaggaattttatgaaacctgcccattatttgaatggtttcctccattcccagactcatggctcacactttgccttggttctccagatcagtattcagagcctttccagacccagtaccaaagtactacactggatgttaatgttgaagtgggttttcttcatatttt

SEQ ID NO: 22730 - DNA, 1184 bp, Mus musculus
tcccacacttgaggtttcctctccccatctcctctcactaaccacccttccataaccatctgtctcctgtccctgacatagcacatactcctatacaccgggctgtttgtttcttgcacacggttagcctccaacaggggtcttgtaagatccgtgtggaacacagaacaggtggttgaagatgtcctagcacctgctgagtgttttgcccctctcctcccaacaccccccaggatctcacagtgctctgccatttggaacaactgctcttggtcactcatcttgacctgtcccataatcgtctccgagccttgcccccagccctggctgctctgcgctgtctcgaggtaaagtatcgattccctcccattctgtctggagtgtcccttttccactcagaagtttgcctgtgttatagcaggaccttctgacctctgactactgcaggtaaccgctttgccacccccctgactacccaggctggccctgtgagctttttcacacacctaagctggtcattccgggctgtccatggcttgtactagttccaggctgtgtgtttgaccttatgctccctcaacttcctgctcctcaggtgttgcaggccagtgataatgtcctggagaacttggacggcgtggctaaccttccccggctgcgggagctgttactatgtaataaccgtatccttccttcagtctactgtgcagacagtttctagggcaaggagcaggctgcaggggggcaaaccgcagaggcagagagcagacagctcatagggcaaggagcagcctgcagggggacaaaccacacacagagacagggtcatctcaaggcaggacaggaaacagggcttgggcagggtgagctgaagggagatgattgcctgaggctgtctgtgactatgattaacttcgactctggagttctgtagcgtgtgacttcacaagccagagttcacaggcaggcagcctgtggagatccttaggaaccacagagtagtctaaagatcaggaaggtccatattttaaagaattctttgatccctcttgaaatcggagggttagagcatctttgacccacatttccacatatccacttataaatactaagagccactttgagagccctctccacctctatgcccgcacaaggtcctgcttcccacagtcccctcttcagct

SEQ ID NO: 22731 - DNA, 1141 bp, Mus musculus
tccgtttccagaacacacctgtgtacttccctggagggactttaccttccttgtctctattcagggacagtatgtggctcttgcctgtagccgccatggcagccgtgtattagatgccatctggagtggagcagctttgggggctcggaaggaaattgctgctgaattgggtgagtaccactgccaattgggtgagtggtttctaggctccttctgtacccggtagctgattggttcagcagatttcaaaagtgcagtctggttctgcattctgcagagatgttgtgtagtctcttactcctcccctttatccggctttaatgggtgaggtgttctgtaattcctgtttcaggccagtgttgattgaaaatggatggccctttacctcaagtagagtttgtctttaaacatgggtgatgctaagtaggagtggttttctttgcaggagaaaagaaccaggagttgattcaagatccttttggccaccatgtggctcgaaatgtggcccttactaccttcttgaagaggcgagaggcttgggaacaacagcaaagtactgtggccaagcggaggcgggcattgagctctatacttgaagactgagacttgcaacgggactcggtcttgatggggaggggaacatgcttacccttcctgtttacattggatccaaaagtcttactgcagccagatgtagtaacatgcacaaaactgtaaacctactattccagagggtaaaacaagaatatcaagaattcaaggctagcctgctctgtggcagctagatcttgttaatctctatgtccatctgctattctctcccctctcccaagacatactggtaaagacttttgtatttttcttggaaatatttttattttattttttaggggaaagttatcttgtagtaaagctagggacagtggccgttggtatgcaggatcttaggggtaggcgtcagtaagaacctagatgaagcagcgattacggtgggatcaggatgcaggggacaaggctgtggttctgcagggtatgtggaaggcaggagtggagggaagacaggtagcattcttcaggaagatgtacaggccagaggaacaaggcagtgtgcagatctgttaggatggagtcagcttggtta

SEQ ID NO: 22732 - DNA, 1386 bp, Mus musculus
accctgggaaccaccactaatcctgtcagtgccggatctgtcttcccaatgtcatctaatggttgatgtccttcacagctccccagagcctgtgcccccacaggtcagtggtaggccagggaagaagccagggaggaccagaaaggagtggagacctaagcagccccactgtggggctctcaccttggggctccagctctggccctgctcaagcaccatcaagcacgtgtcgtcctccagcagctggaagaagtcctcactgtccacagcagtcccatcctcctccaggaccagtgttagcactccacgtagcagcaaggtctccaggacctgtcagtgacaagaggcaggaagggaggccccgtcagcctcacgctggttggcatatcagctctacctccaggtgttttgccatcttccctgtaggggttttgtttgtttatttctttttttgagacagggtgttggtgtagtgcagcctgctcccaaacttagcaattctgtgttagtttgctgggtcctgggattgtagacatgaacacttcatctcatccttcctaaaagttgcagttctttctttgtgtagctttggctgtcctggaacttggtctgtagaccaggctggcctcaaactcaagagagtcactggcctctgcctcccatgttctgggattaaaagtatgtgagaccatgaccacccaacagaaatggtagctgttgatagaccttcacagagcagacctacctatctaccctccttccctccttccctccctccgtacctactcttgctcctctctgagccactcctactggaactgaatgacaaatcagtcatagccgggtgtggtagtacgcctacagtcctggctgctcaggaggcagaggcagggggatcactggagtccagaagtttaaaaccagacttcaacagttttggaccctgactccaagtctgtccagatgaaacctgtctgatctatcttatctgcagtgtcgtcctatgctttcctgttctctacaattgttttctaagttagcaccatttaaccttcctgaggccaagtgaaactgtttgccaagtgcaaacgtgtgagccatagaaggaacgtcagggttaaggtagtgaggctaggaacaattgggtgagaaagaaaaggctttggctgggtagaaacagtcaaggtgaccaggaggagcggggctctcactgactcctgtaaggccctctcaaggagcaagcacgaggtgctggtctaaaacatgtgattggttggccagctctacttcagttttaaggatagctcctaaaacctgcacctctcccaggaatcagattccgcaggaccaccctgtagggaaggagctgggcggaggtaaccatac

SEQ ID NO: 22733 - DNA, 1148 bp, Mus musculus
ggggagggagggagggtgaaaggtgtgaaccggtggccagaacctcaccagcctccttcctgcctcctcatcttcctagtggtcttcaaggaggagcccctaccagactcatctctccggggcttcccttccacatcgggtcccccctttggccctgacgtggacttctcaccgcccaggcccccttacccctcctatccccatgaagaccctgcttatgagactccttatctgtcagaaggctttggttatagcacacccgctctgtacccccagacggggcccccaccgtcctatagatctggcctgcggatgttccctgagactgggggtaccacaggttgtgcccgcctaccttcagtctctttccttccgcgcccctttcctggtgatcaatatggaggacagggctcctcttttgccctggggcttccattctcccctccagccccctttaggccgccactgccttcctccccaccactcgaagaccccttccatccccagagtgccatccaccccttacctcctgagggctacaatgaggtggggccaggctatacccctggggagggggcttcggagcaggagaaagccaggggtggctacagcagcggcttcagagacagtgtacctatccagggtatcaccctggaggaaggtgggtgtgggactgggggctgcgagtgtaagtgagtgcgagagatcagtttgcatgtttgctgaaggctggagcttggctgtcagggacttggcattcttagtctcccagggctagtcagtggtctcggaagcaagttcttggtgtgtgagtgtgtgtgtgtgtgtgtgtgtgtgtgtgtgtgtgtgtgtgtgtgtgtgtccacctgaatttagtaatttaattctgaagggcacacaaaatacctgttccatccttttttctgtctctgccctaatcacagaatttcagccctagaagtatttcaagaccattcatttcttctggtcccctgacttgtagatccaggcagtgagtttcagggagggacataacttgtggaaagccaggctgagtctcgccccctcactttatctttccctggtgactatagtccacattggtgaagaagatcttcccggttttgtctctttctcccaactgacca

SEQ ID NO: 22734 - DNA, 1195 bp, Mus musculus
ggagattcaagacctcctcaggcttctttactatccctggaggttcaggttccttatattggggctgaggccctcagaatctttgagttctcaggttcctgtgtcttgccaccccacggatgattctgatttatagtcaaggtgagaaaacgacagtctagtttctctctcacatttagagaaagaggaatctgaggttccaagagaggacagggcttgcctaaaaatcacacagctccacaagcggcacgatgcacactgcacactggatgcctaaaatcacacagcttcacaagcggcacgatgcacattggattcctgtcccactgcatacttggccatgctgatccaaattctctgaagtggaggtggggggcgggggacaaggaagcgttggcatggcctacccacaggaccccctacccctgacatttatgtggtcagtctggaaacactgtacattagtagtaggctgcaggaagctgagcagttttcctaacagctctgaattccttggggcttaaggcaggcatgaagcgctaggcttatcttgcagatgtgtccatgctggcctcctacatagatgctacatccattgtcatcaatagatccaggcaggaagcctgctctgtgtcctctctgggctctgtgtcctatctgggccgtctatgagactggggtgcaatgagccagggaaaggcaaaccatcttacctgcttacctagagcctggcagacatgggtagacatagtatccaaccagcttgatggactccattcaccttgagagtgtacacccaagccattcagagagccggtccttggcaacgtagcctcacctccaggcctccggggagcttcatgcccattgaatgctgatggccctgggacttttcctgaactcctggaaaacagggagactccggatagccctgggaagtccctggaaagccacagaaactggctcaggattggaagactgaggagtccaagtgacctctaacctcggcccactgctgctttgtaatcattttcctttaccccctagagcaagctgctgcaaaccaaatcaacatcaactgctcagctcactaggcctgtgtgtgtgtgtgtgtgtgtgtgtgtgtgtgtgtgtgtgtgtgtgtgtgtgtgtgtctaagaatcccttctaaccatccccaatccagagtcattat

SEQ ID NO: 22735 - DNA, 1196 bp, Mus musculus
gctcctccagcatgtgtttgcaaggtggggcgttcccatcagactggaggccgcccaaggcccccagtttgcccgccatgttctggtgagctgtgggctggccctgggagcccaagtgactacactgagtagggccctccagttcccctgcctgatgagttcagaggcctactgggaattcaagagggccctgaaggagttcatctttctgtatggcaagaagtgggcggcctctctgcccttgctgcacctggcttttagggcctccaccacagaggccacaccgttccaggtgctgaccgggggcgagatgaagctgatggagcccgtgtggtgggagatgagccgggcgaacattgaagggctcaagatggacgctttcttgctgcagctgatgcgggagctgttggacctccactggagagtggccgagaaggccagcgagaaggccgagaacaggcgtttcaagagggagagccaggagaacgagtggagtgtgggcgaccaggtcctcttgttgtctctccccaggaatggcagcagtgccaaatggatgggtcctttctatattggggaccggttgagcctatcactctatagggtgtggggcttcccagtcccagacaagctgggctgtgtctatcctagcagtctgatgaaggcctttcccaagcatgacacgcccctgtccctcgacgtggagcagtgagtcagagcagccagggatctgcccgctcgggtccccgcatttctgctgctagtcctcccttctgatctgagcagtgctctcagctcttcgggggcccccctcagttgtgccttgtgcggagaagttccctttgtaaagctttgctgaattgccttgagctaggggtggatgtccctataacacatccccaggtaggggtacttggagaatgtgccaaaggttgtcctgtgggggctctgggctctggcagttctacccttgggagcaaaggagtctccttaacaaagttggccgggctcacgatcttccccaagtgccacctttcccctcttacacgctcaggtgtagattggtgtgtgcacccctctccagtgtctttcacccaacacactacacttcacagtgtggatttggacctccgggtgggtatcacagctctccccctatgctagtgcctccccgtacattctgcatctggcaagcctct

SEQ ID NO: 22736 - DNA, 1197 bp, Mus musculus
tctgtactggaagagctgcttctattaggttcagtggtgttcacgctctgctttaaggggagggcatctgatgtgtgtagtttgacacgcggccgggcactgggtggcttttcctcttgttcctctgactcctctcacccactgccaaagctcacaaccctctactgcgtgcagtttacccatctccttcgatgggactgctttgttctggtcagctgcagtaccctgaatctgcctctgtgtggcgctccctcacagccggtgtgcccagctcattgtcgcagcaggagtgggcttttcattatcatgagggctgattctcaccgctctgcatttccacacagctgagctcgcgatctggagagaaaggtcagcaccaggccgttctggctccgattcctagtagctcatttctcgaggagccgatccggttatctggctgagctcaggttgccagacaggacgctgcagaatgctgggtcctgaggctaggttggcgttgagcccagctttcacaacagagcaaagagggaaatgacttgcccgcagtcacacagctagttggtggctgagctgggacccggatgaaccttcgtgacttcaggttcaccacgataggggttctagcaacatgtttaagcatgagaatcctttcagattttgtacctctgttccctttgatgccgtttcgtttcctaacccttctagataaactacctgaatgctgttcttcagccaatccagctggcaaaccctgcccagaaatagatgctgggagctccccggggtgctgaaaggttagctgtagaatttttagcaggtactgtttcttcccaccaccttagctttgcctcccctcccccgcccccctttcctacgttagtcagcctcactctccagccccagggctatattcaaacacctctttctgttaagtacaattcccatcatatgctttcaagtgatttttatttttcaataaatcagttaaaatggagccaatgtttaatttttttttccgaattgggggggggggataaagggggggtggtgccaggcggtggtggtgcacgcctttaatcccagcacttgggagtcagaggcaggcgaatttctgagttcgaggccagcctggtctacagagtgagttccaggaccgccagggctacacagagaaaccctgtctggggggggggg

SEQ ID NO: 22737 - DNA, 1145 bp, Mus musculus
gcctcggggaaacaggaggttcctcagcaaagaggagggttcagtgtgcagggtgaaccttcaggtgcgcatgtgccctgtcagagggcagctccaatccggggagcctctctcctccagcggctccacaatgggagcgcctcacctccgagagtgcctagccctccgcccgcgccggaacccccatggccctgtggagaccgagaccgagatcgagatcggggagacaggggagacaagcagcaggctggagctcgaggccgagggtctccgtggaagcgaggcactcgtgggggcaacttggtgactggcacgcagcgtttccaggaagccttacaggatcctttcaccctgtgccttgccaatgtgcctggccagccagatctccgtcacattgtcattgatggcagcaacgtggccatggtgtaagtagctggtgggactgagttctggagacagcctctgaggggcttgtgccgcagccttctctgggtcctgacgtcgacgctctccgtaacaggcacggactccagcattacttttccagtcggggtattgctctcgctgtacagtacttctgggaccgtggccaccgtgacataaccgtctttgtgcctcagtggcgcttcagtaaagattccaaggtcagaggtaagttgggtctggtcatctgtgtcctggtgaggctgggtccaccttgagaaccctgttgcactttgttctacagagagtcacttcctgcagaagttgtattccctgagtctgctttccctgacaccctcacgagtcatggatggcaagaggatttcttcttatgatgacaggtaattgttcctctcctggccccgagtttgctatctaaggaatctagtgggatttggagtaggacagagatgctcccgacctctgtcttctagcctcagtagtagagctagtttcagtgggacaaatgatgggtagctcagctctgcaggtgagaggagacgggctgtagacagtgatggtttgcctgctcgctattcacctcgtatttatatagagtgctttattgtctaggaaatactgtgcaattgagatctgcaaaagctggtggcatatagagctgacagaattcccaaatgtagagaaattgtttgaacattctg

SEQ ID NO: 22738 - DNA, 2531 bp, Mus musculus
accgtactgccgggatattaaccagctttctgaggccctgctgagtctcaacttctgagcctttctgccctgcatagctgctgccctattagagtcagcctcccccagccccgccccttctcttacagtccctctgccgctcagaccatgacctagacccactctaagatggtgctttggccagaggaagcaccagagaagagaatttgagtgtgggaatactctttgcctggggtagtttgaggtcaggtccttaaaatgactcaacctgaggaaggaccacgaagccagctcttaggaggttttgatcagactcagcgcctcaactctgtctttagagagggcttctgtaagatgtagaagctgttccaggagactgcgcctgtggctttactaccaagttccttagttggaggatagggtaggctggaggcgacaaaaaggctaagctgagaaagaaagcaccctctggctgctcctctgagtggtaggataggctgagctctaccctggcgtgtccggaggaatactgactcccagaggggtcatagcgctacgtgggctgttgcagtgggctagttgagaaccagaaggcagaggtgggcaggcttccagtctcagctgtgcctgcctgtgaccttgacagagttgcttggcctttacttatgtctacacatcaggcataaagataaccgttgagggaaatgagaacagagaaggctcccatgaggacctgtacttgggtcatggctcaggcgtgtctgcctgtggctggctgttcaggctccctagccagaacttcacattcagagatgtccactgtccactccctcgatgttaacgctgggctttcagtagaacatgccctgtaaatggctgcatcccttttcagcaaccttcgaaactcacgttatcaaaataggcaagttagggtggatggctgcattacttaaatactctcagggctcctataaatggcagctgctcagttgcatttcaagtgtttgtttacagattgacaaggccctggttaaattttctttctggtgttgagcctattcaccaaactcacgatgtcatgtttggcagtgacagtgttagtgggatctatctaatatttcctttatggaagacaggtttctttcggcaagacacactgctaccttctgtgtatgggaagcggaagctgaagcatcaggatcgagatacctgattggttacagacggactccattgacctgtcatgacaagctgtttacattctaactcccacaagtcattgctctgtatctgtttgaactctgtctgtgccggggaatgtactgtctgcaaggtggcacactccttacttgattgtgttaagcagtttttcctctagtgtagtctaacctgcttctctgtgactttcactttccccaggagtaatttagggctagtcaacttcttagaggccagagtcgggtagaggtataaaaaggtaaggcaggtgccactgggttcatgtagcaagtccctgaattagatgcctttctagctctgacttagtccaagtgacatggagttaactatgtggctctctgggtcccagtgtctttgtctgtttccttgggtgattttcatttcacaccagattgattaggtgttggggacaagttgattaggggaatgacaagggagaagaagagaatggtctggactgggggctggtagagctgccttttaagcttaggattggtgtcttctcttttctcttgccatgatggtgggtatgcagaaggctggggttatcttcccttccctgagtgccctggaaggctgagtgttcctgagaagatgagagaccaagcttatagagggacactgacatcttactgcagtatgacgagccgggacctgtacacgtttactatattaactcatggctgtttggtaaatgctgaaggctagcccacagggcccttttcccacttttgctggcatcctctgaacaggtgtcagggtgacaccagagctcactggagacagatctttatatgtatcgcctttaatctgtcataacctcatgtctcaccagctcatttggaaagagagactgagaaaggaaaagatgaggagagattgcatgttaaaacgttaagaacccagcttaggagaagagccatgtagggtaatagttcttcagataattctaggggaatataagccaaagagacagcggaagccagtgatctagcgatgtaatctatctttattgccataactgtagaacattgtctacacagcatatatgagaaccagggcaacaatgtaacacagaagccacagaagaagttgaagaggtgaaggttagaatgagattatattcttgaggctggagtttctcagataggggtggatcaacgaacatgggaagagagtggggtgagggggggcagagtctaagaccctgatggattctgatctcaatcaagtgcagggatcatcacctgacccacttctcagagtgcgggagcaggccccagcttctgcct

SEQ ID NO: 22739 - DNA, 1238 bp, Mus musculus
cagatggaacccttgaattaaccccaccaacaactgaatgttttgaccaagctgctacaatggaagaaattggagcaattggtggaattcctcctgctttcaaccatctagctccgggagctgaatttgctccaaataaacaggccactattagataaagttgtattgtctagtttcctgcagcccttaaaagaagggccctttttgcactagccagatctctaccctgaaaaactgttgggggttcttcccaatatatatttcttccctgcttgtactactctagggagtatgtttgaaggaagaggacaaggggggggtggtatttaacaaatcaaagtctgtggtatagtgctttatcaagtctgcctggtacattcctgaactatattgatattgattgttgagagcctggagaaccataaaaaatggactcagcttcattgcttcattaatcttgataattctctctctctctctctctaactctctctctctctaactctctctctctctgcctcccctgcccgagtcgtgttttaattactttctcaactttattcccctcaaccccagagacactgccatatataccacaaaacataaacatcctccaatgacctagccccattcctccattcatttccaggtaagaattcagacaaatgtccacagaggttacagcataaatacagttctgttatatctcatatatgaccactttgtgtcctaaagaagacactttctcttagagttttttaattttagtatatcttaaaagatcttgtgataacttgcctccattttttgtgtctctgatgttgctgttcacagcttttcttgacaggactagtacaatctctgcaacagtagccttagtcttgcctgtcttgggtagctgcactgtgaatttttattagtgtactatgatttgttcctgatactttcaatttgaaatttttttctgagaaatggagcagtaatgtagcatcatcttattaaaatacatttgatgcctttaaaaagaaaagccatgctgaatttacaaccagagtcatgcttttatgataaaagaaaaccagagcaaattttattactttcatgtgtacaatttactcattagatatcacaagcatgaattctccatcataattttaaatttctttttatgtggtcacccatatgattaagattattctgttctgtaaggctttggttgcttatctgtatgtgcagat

SEQ ID NO: 22740 - DNA, 1113 bp, Mus musculus
cctgggtttattttccagtacctacatggtagctcacaaccatctgaaacaccaattgcaggagaatctaatgcactcttctggcctcatgggtatcatgcatgcacatggtgcacatacatacatacatacaagcaacatacccatacacataaaataaaaactataaattttatgtacagtatgactaagttttgttaaaaacaaaagtttgagtatatgtgtatggacacagacataatctagatgaacatacagtaagttactttgttgaatgggatcttagttttgtttatatctacacatagtaattttatactggttctgaataaaataggttcaaaataaattatataacaccacattgatctatatctaatgtcagttaatgtttatgaatttctgagcagtacttgtaataaattcaacatttgagcttccattttctattaagctgcagtgtcatatccctttctcctcagatggagaacctggactttttatctcttttaaaaacaattgaggaattctataaaggtgaagatggagaaaatctggaaatcctttgtcctcttcagaatcaagcctgtgtagctaaatttgaagatggaatctggtatcgtgcaaaagtgatcggtaggaaagtgcttgttatttccacagggaaatgtacaccagagcaagcatcacctgaagtgttagaaagcaaatcacggaggtgttatctgctcccaacatgtgccctgtcatacgtctttagaaggcatgataacttcagaaggtcgatctctggctactagagtttgatttgcttgattagaaattaaccgttgggaatctggcgagaaaaccagtagatggtgcagagcatcaaaacccattctttgaaccttggctgccttcatctgtttcttgctggtttttgtttgcttgcttgttaagatgcaaatctcttagcttcctttctgaattactgtattcctctctcttagggaattactttgttatttaaatttccctatcttactgaactctttctctctctctctctctctctctctctctctctctctctctctctctctctctttcttcctttcgtttttcgagaca

SEQ ID NO: 22741 - DNA, 1192 bp, Mus musculus
gccattccgcacaggcgggtctcgctaacactgggggtccctttcccagaatcctcatggtctccttccgacaatccaaacaacaggtctcctcaggcagcgggcgtcaccggagtttgggaggtgaggtgctaggaccgcccctcgcagtctccccaggggagcccttccgctcttccctgaggcagcgttcttcctcagagtccgtcgacccgcccatccacttcccgtgaactccccagggagccggggagcgcgcctttgcgtgattggccgttctgtgtgtcaatccagagctcggcgcccacaattggctggcttgcctcacggtcgagtcacgccgctggagcggattagggcggagcggcaggcgcgcggtgctgtcccgctgtgggtcgccggcggtttttcgcgttggttttgcactgcgtctgtgatggcggcggcggctgaggagggcatgagtgcggccgctctagttatgtcagttcccgacagcattggccgttctcccgagtccgaaggagttggagcaggggacgaagagaaggacgcagccaccaaaggaacggtggccgttggggacagcgaggaggatggggaggacgttttcgaggtggagaggatcctggacatgaagtgcgagggagtatgtgggggctgagcggccggacagggagtctccggggcggggacggcgggttgggagaatccgagtgggacgccgaacagcctggaacagcttgggaggacggtggcggtccgtaggcgcagactgacatcctggagaggaccctggccgcagtcggtggaggatggatgcttagggaagttctaagtgttgttttggcagaagagacgaagcggtgacatggaatgttgagaatcgtaggatgcaaggcagctggtgggagacttctgtggccttcagcattcgggtatacggttagggccatggctttccgttaggaaagactggaggattctctacaccgttgtcccaatgttttctaaaagtagaaaatgctccttggcttaaattcaggaaatcccattcacaccgagtgcccgggacagtaaaggtttcccaacccaaagtgtcccttttctgcgcgttttatgagtgtaactcaagagatttagagtaagcttgaaaggacaatcttcgcacatcgtgcttgaacacttaaca

SEQ ID NO: 22742 - DNA, 1163 bp, Mus musculus
tgttccagtgtttttgagtcttgcattaagagtaaaattttcttcttaataccttcatactggcttaagtttaattttggggcatttcagagttctctcgtgtttcagtgcatatgtgtggtatatgcagatgtgtatgtgcatttgcccagtgcactcagaaggccggaggaggacatgggattccctgctcagttactcttcacttagccactgcatctgaaggtatgctgacagttagcaagcccaagcaatccacttgtccacaccccacatagttctagagtttcagatacttaacatttctagctttttatatttggggtatctgaactcaggtctcatgattgcacaaggcttcttacacgttatgccatttcttcagctttcctgactttaggtattttgttgttttgttttttcaaggctggccttaaacttccagagccccacctgcctgcctttgcatctgagattaatgaggtgcactatcatacctggccagccatgcacatttttttaatacttttttcctcaccatgttagaggtggaactcagggtcttttttatgctaagtgaatgcttagctgcatctaaagttgtaaaagtagattttgttttaggtctagacttggacatggcagtagtaatgcctatctcagtggctcatacataaagtgctataagaactgcatctatttgaacagtacagaaagcacttattacatttcagagatttgttagagatctaaaatactgtcaaattaatatctgggcaagatgttcagggtgaacactgctgttactgaactactgtggttgtgacaaaggactactaaaagagggactcactctcagtgatccttgtcacaccttaccttagaaagacacactagagcttgtgcagaagttgtttctgatgctgaatggggaaaagagcatggtgtaagagcactgcccatgtccctgataaagctacaaaattcccccagcttttaactacgaatggaatgcaagaaaaactaggtatatagattaataataacatgtgtgcttaccatacaagggcctacctaggttctatcttgagcaccaaaaagctagagtgaggaagtaggaaaaatatgtaataagttttagagaatttggaagaacttttgtt

SEQ ID NO: 22743 - DNA, 1889 bp, Mus musculus
ttaaatccctgaattttgtgttgtttcttaatgctttgtttcttaaaagcattgatcattgagtttgtagaatgtttacttttaaaacagtacgatgcagctcctcagtgtacatctctgatttctttttaaaaagtttctttcttaccaggcctgatgagacatgtttatattatagtcccagcacctgggggcaaacgcagagacagaagaaccctgagttagaggtcagcctgggctgagtagatagagactccaactcagaaacaaaaacacattatttgttactttccatcctagtttcatgcagtgtaaactttttaaaaagggatcagagtggtattctatgctgatctggcataaggaggcatttgcttatgtcagaatcagttctttccatgaaatggagcgtagcatttgcaatttgtaaatcttcagatgctgcttattattattattactactactactactattttttaaaaacaggaactaattaacttgctcctttcttccttctatgtttgatcctgactctgctggactttctgctgaacttcctgacaccaccacttgggattttgccaatttttcttgtcacttttattttggcgtgttccaaatggactttattatatgtgattatagcacaatgataggtttccccaaggacctccatcccagatgggttcacccatgggaaatagaacaggttctgaaactccccaggcaccgatgagtggtgtagggcctgtaagtggtggtcctggcggctttggtagagggagtcaagggggcaattttgaaggccctaataagcgtcggagatattaaataatggttcattcctgactgtttagaaaaacattcaatggtatgtctttacaccatgtctgttactagggagaaatggttttactgttaatgtatgtagactaaagtttttcttttgtaaaacttgagttttttttgtattttctttattcataagctttgtagattagcttggtgaaaaagatgcccatcattgtgaatgttgaaaagtgtttgtgaccttagctaacgatagctatgtggcattattattaagtctgtgtagttacttaatctcaataaagaaatgattttgcctaatttaaaatgttcttagtggtattccctcatgaccttacaaaacttgctatggttgctttagctaatcctacctatttaaacgtgaagatgactttgtttttctgtttgttcctgtagcccttaagtcagactgttagtgaaagctgatgtcaataagggacacatactgtagtatactagtgggtgggaggcatgggggttaagattgtataaaccatagatcctgtgtaagttagagttgttgcttacatttcatatagagtctcactattcatatattctgagaaaagttattgaggctatctttgttctgtgctgatttttccaaataaaccttttgaatcttaaaaaaaatgtttgaaagtaaatctcttttgcttataaaataactcctggttttaatcttttgccatcattcatttacatttcccccagttatcactttaagagttagtgttaagctttaacccaaccagccataccgacagagtgttggcagcgaaaggaaggcgtgacctcttattcctaaatactaggtcagccacttagcatttcctgttgtttttaagaagtgttttaaaaggtagtgtaactgatgtattggaatatttccattttgttaagtctgtccagtaactcccatgtaatgttagtactgttcgtttttgaggaatatccgttcaaacgctcattctccctttttcctcagcctggtaaggtctgtgacacatccttcttggaaatacagttttgaa

SEQ ID NO: 22744 - DNA, 1368 bp, Mus musculus
gattctttcacaactaaaacttaatacatttctgaggctgaaagtattaagtctttggtgctagctacttatttatttatttcaaattccctttctcatttttttgtatttggaaatgttagttttgtttttaactagaacttataaacatagtgaaaccttaactgataataacagggaaaatgtttatcctattatcaactaaatatttttggttggaaaatatctggcatttaaatttagttgaagaaatgttcataattattctatcaacaaattaactgctgaagaaattttaagtcctattgaaatttctatttatttaatttctttctttctttctttccttctttctttcttctttcttctttttttttttctgagacagggtttctttgttttgccctggttattctggaactcactctgtagaccagactggcctcgaactcagaaatccgcctgcttctgcctcccgagtgcggggagtaaaggcgtgcgccaccactgccgggctagctttacttttctgttgtcttttcttccttgatattaagtatttaacaacttattttaaactacagtttcgattttgaacataaatctgttggaattatcaatgtaaagatactgtttaaaaggaagtggaagttaacattttcaggctaatactgctttttagtctttaataatcatatgtaagccatatgtgatatatttcttacagaatttccattgagaattaagaaataatacctattatttttatttatctgaatatttacaaaaagattttctcatagtaaaataggtaaatattaacttccttggtatttttcctgacatgagctgtacatgttttataatgaacatagttatttgtagtattattaatactgtcattgcagtggactagaaaggaaagatttagtaaagtattccatttctaaacttgtaaagaatctttttatttataaatattagtttatcataccataaatgcagttgtagaatgtttttgaaataatgccattttttgctttgtggaaattaacatagatattaatatgcctgtagatataatcatgaatggctggttttaattttacttttctaccatacaacgtaatgttatatgttctgtggctgggaaacattttagtttaaaattgagttatgaactccttaaatttgctaaggtaaaattggcgcgtgtgagtagggtggttgtgaatggatgaggtagccaggtgtggagttcagaggacagcttttgggagttggctttttcttttcattatgggttccaaggatggaacttcaggtctccttgttgagacatgtttctggccctgaaagattttgttt

SEQ ID NO: 22745 - DNA, 1097 bp, Mus musculus
ggtcacaataatatgaggaactgaattaaaggatcgtggcactaggaaggttgagagcctctgctttagagctacattttaatattttttattattattttatgtatatgagtacaccattgctctcttcagacacaccagaagaggatatcagatcccattacagatggttgtgagccaccatgtggttgctgggaattgaactcaggacctctggaagagcagtcagtgctcttaaccgccatttctccagcccacattttaatttttttatagtgattttcaaagaacagcagtagctggagttactggtacttctgaacacctgatgtgggtgctgggacttgaactagggtcctctggaagagcagcattgcacttactgctgagtcctctctaccctcagggacctagaggcatctcacttactggtcaactgctactgacaggtgaggtgcataaaagcactgcccaccctaacccccattccctacttgtcctgctcagtcccttgcctgtgttctcctctccttctccctctctccccacttccctcatctctctcctccctccttcactccctccctccccttcctttctgcccccttcctttttctctccttccctcctagcctccctccttgtcttctttttctgcccctctctcccatgctcatactccaagatggccttttgctatccccttcttccttaagtaaacctcctgcactagatctctctgtgtggcttcatttcttagcagcacaacttggcacaggcctgcaaagataccttacccttcgctgctttgtcctatcgcctgatgacttatagaatatctctcaagttgctaaacaatgtattaggtgggaaaatgggataggagacatctttcaaaattgaaacttcaggtttttttttttttgtctttgttttttgtttgtcttagtgtgtgtctatatgaatatcatcaagggccagagataaatgttggttgttgtcttctagaatgggtcaccttgtatttgagacaaggtcttactaagacctgagacccactgatatgattagctatgcttgctggctagtgagctcca

SEQ ID NO: 22746 - DNA, 1169 bp, Mus musculus
gagtacccgcgcccgccggcccggtttgccctcttcggcccggccctggtcgcgcgcgccccgccgcagcgcgcagaggatcatgagatgataatgggcccccggatgaccccgcgacaccactgtgaggcctacagctctgccggggaggaggaggaagaggaggagaagaagaaggtagctacatcaagctgggtggcaggcagatccaaagggataccatgaagtttccaggacctttggaaaaccagagattgtcttctctgttggaaagggcaatctccagggaagcccagatgtggaaggtgaatgtgccgaaaatacctacaaatcagaatgtttctccatcccagagagatgaagtaattcaatggttggccaaactcaaataccagttcaacctctatccagaaacatttgctctatcaagcagtcttttggataggtttttagctacagtaaaagcccatccaaaatatttgaattgtattgcaatcagctgttttttttttctggctgctaagactgttgaggaagatgagaaaattccagtgctaaaggtattggcaagagacagtttctgtggatgttcctcatctgagattttgagaatggagagaattattctggataaattgaattgggatcttcacacggccacaccattggattttcttcacatttttcatgccatttcggtgtcaactaggcctcagttacttttcagtttgcccaaattgagcccatctcaacatttggcagtcctgactaagcagcatgcttcactgtatggactgcaaccaacttctgcagttcaaagggtccatgctggctctggccatggttagtctggaaatggagaaactcattcctgattggcttcctcttaagattgaactgcgtcagggagcacagatgggcagctcccagttgatccactgtcgggagctggtggcatatcaccgttctgctctgcagtctgccctgcctctaaattccgtttttgtctaccgtcccctcaagcacaccctggtaacctgtgacaaaggagcactcaaattacatccctcctctgtctcaggcccagatttctccaaggacaacagcaagtcagaagtaccagtccgaggtccagcagccttccacctgcatctccccgcagccaaacg

SEQ ID NO: 22747 - DNA, 1194 bp, Mus musculus
tgcaaggaggaatttcattttggtttatggttaagaacttccaaagaggttctaccttctaatggttccacagcctttcaaaacagcaccagcagctggggaccaaatgttcaaatacacaagcctatgaggtgttgttgacatttatacccagtagaagccatttgtccttttcttccatggttagatttttgtcagcttcctgctatgttgatgctttttatatttgtttgggcattgcagagtgttaagttgacggggatgggtatatctgctgtggcaatactatctcttctcttctcttctcttctcttctcttctcttctcttctcttctcttctcttctcttcttctcttctcttttcttctcttcttttcctttgttttttttttttttttaaagtatctgtattctggaattttcttgtcatggtaaacttcttagttttgatgtttagtcttgctaaagactttctttgataatgtatttatatagtagtaggtcatgcatttaatttgagaaaatagcttgtattgtttagtacacctaacagtaaatgctttcgttaggtgcccgttcctgtgtttctgcctgctccattggacagcagtgagaagattcctgccacagttgaggacctcaaaagcaaagtttcttcagatcctcttgattcagaattgcttacgatgacagatatgatgactgaagaggaggggaaagcagaggcatccaacatcaatagtgagctatactattcagtttgtcgctaagaggtgtggggggatgggtcctatgtattgtcattattatggtacttaaaggcatatcctgtagcaatacttaataagatggtaggagaaaggattatagcagaaatattttatattaataaatacacactttggctcagggttaagagtacttgatcttgcagaagacctaggtttggcttccaacacccacaagtttatatcttcctttaattccagttccagaggctccagtgtcctcttctggcattcacaggcatgagacatgcaagtggtgcacaaatatacatatatgtacaactcttgtacacataaaacaacaaaaaatttttataaagagaaatataaactccactttgaactatgtatgctctaatgctaagcttgatctctagtggaataatttgttttattttgaggtgg

SEQ ID NO: 22748 - DNA, 1866 bp, Mus musculus
attgaccttttttctttttctttttcctccaaagtccacagaaccttaatcagagaatggatgttttttatttacaaccagaatgttctagttctacagatagccctgtctggtacacatctacttccctggaccggaacaccttggaaaatatgcttgtacgggttcttctagtaaaagatatttatgataaagacaattatgaactggatgaagacacagactaaaaaggaccatttcagaagcaatgggataacacagcattagatagtcatgctgctagatctttacaggaaaacattttaagtttactccttctgttctgagttttgtagcaatgtacccacactgggtattaccatgtaaataatctgtgtgtgaaagttgccattattctatgtagtggttttaggatacttaacaaatacatcaaattcttttttattattatttatttgattaggtatgtttgtaactttttacattacaaataagaagagaatgtgccatgtataagtttttcttgttgcactgctctgctgttgcaaagctccctgcagagggcgggctttatgcgttcctgaccagatggttgtgtatgggtagcactactcaagtttagaacttgcggtgtctttcagaatttttaaaataaactgtaaactaataggctgggttttttgtttgtttgttttatgttttagttactgaagccttagcaggttatgtagagagataccatcttctgtaccaaaaatagacaagagaatgctgttgatactggtgttctgtaatgtgaacttatgctggtgaaaacaactttatgttccccttattaaaacttagtgtccttttctcacttgtgactttctgcatcaccccatcaatttaaggaaaaaaagtatgtatatatgtgtaagtagagagagagagtgagagagagagagtgactataacttgaaaacaagattaagacatttttctttgtaaaatgtccggcgacagtgtaagactcttgtttttctttcccacggcagccatcagcatctgaggccctcacctgccaggtgtattacagcttgcatagcactctcgagtgtcaccactctcgctggaggtcttgtgctgcttccagaagtgacatgcatatgtggggcagaattatttttagaaatgccactcttgaaatattcattttagaaagtcaggctacttgaagggagacagtgtcacattgttctatggctattaccaatggagaatgctgactagtccaggagactgaagaaacagaagctggtggatggtgccagtgccagtgtcagaggaaatcttgcttgctactaggttgtttggctttgaaatttaattacttcttatagaagattacatttaaaatacttttgtgcttctgcatagcagtttatctgttcataacttttagattaaggaaatctacttcaaattatactttctaaagactgagtaaagtggtatctgaaaattatcagttatttagctgactttgtatatagcatgtgtgatgtttccttcttatttctgaatcctgaaatcaccatggtgatactagttttcaaaatagttctgagggaaattgttttccatagtgactagacagtatatagcccttatcaatttctctcttctttagcataaattttagcaagtaaagaaattttctcaatcatgattttgaaaatttcacaggtatagctactgctcgtttaagcaataactatctgaaatgtttttggcatgaaaatttatagtgttctaaatttttataagtttgaataacttcagtcccttggttttctatttgaatcatcagactgatagtggcag

SEQ ID NO: 22749 - DNA, 1190 bp, Mus musculus
atacctgtaagagcctctgtcgggtgctgggtttatgagttcccagagatcttagaagctgccatttactgcatgaccttaaccaagttatgtgacctctctatgccccagagagccattgtgaattgagtgatgtagcgcacataaagtgtttaacatggtctgacctgtgcacatgtggatacatgttagatattacttttgtctagccaccactgtgatgggcacatacacgcaacatctgtgcaccccacaacacacacatacccaccatggaagaaagtggggaaagtacacactttgcaaacatgttagaggaaataaagaggaatataaagtaccccgtgtacagtggggttgtcccccagttattccaggggtttcatctaaggcccacccactcacagctcagatcagccgtgcttagggtcccttctgactcttagctcacttggtctgttctttaggagccatcatggaagagcaggcagctcagctcctgggtgtgaagatgtgcaagtttattccggaacactcccgaaacttggccaatgagttccgctgttacacgaactatgactctgggctggactgtgaagcctaaattcacatggcagcagttccatagaggactccacattcatttcccagttctcgttctgtggaaacattgtgacctccccctttctctgccctggctgggactcccctggcttatttttcaaaataaaataaaacttctccatgctgattctgtcatgaggttgagattcttacaccaacccaggtctgtggacttagagtgaagagaaatgttgttcagcgtgtgagaacagaatggcagacttttgctgtccagtgggctgagagctctggtggctaggctctggctgcttcttggagacctgacctacctccatgaagcaggttggtccacggccagcgttccgtccgactcctcctgcatcccgcctcccctttggctccgagggctctggtgaacacagcactggtatcccagcacgcggtacctcactccagactgggaaaggatggcagtgtcaagccaaacatcctaaccaagcagcagagctgggtgtgctggagcccggctgtcacagctatttacgtccttccgtgctccaggagagtacacaggagccgaggaacaactgtgcaatcccagcact

SEQ ID NO: 22750 - DNA, 2589 bp, Mus musculus
accagaatgttgattagtggcaagatgagggaaaaagaccccactgtattttagataatgagaatgccacttaattgtcccactcagatcttacagggcatttgtgtgtttgttcactttactgagtgttaagtttgatctttggcccagttttgttttctgctttgtttcctagcgctccttggacttctgaactgtattagtgtcccacttcttttttcttgatgctcttgcccaagtgggtattgaggccactgacttcatgctcatgaactagtttttccaattcaaactgactgttaagttactggaaaatgtttttaaaacaaaaaattatgtgccctttttaaaaatacatgttaaatggacactgtcaagtatttgattttttcaagttttttgttcatacagtaccttttagcctttatttttccacacttttgttcaccttatcccagtttatgattttggtcatttgtttcccagggcacaatcaatcactgaatcatctgcacagtcacaggaggttgtctgttaacactggtgctaatgtagcagctcctgcgatcgcccctttaggtctctggaaagaaagggtaatttgacaatgtccttgtgttgagttggtggctctttggatatttgacagtgtccttttcgaactctgattctggtggaagactgcgttatgtcaacctgactgtattgcttttgttggatagaaatgacattttgtaattctttccctaaatttaacttaaaattttcaaatttattgtatggaaaatatctaatgataatcattttagtctgttcagatgagaggttgctactctttgtcacaatttcacttaaaaacagatctataatttttccccactcaacactctttttgaagtcaagtctatatactcagctgtcaattatttctgttaatacttgtatgaatccctcaaatactgaaggaaagctagctcttagttttgataatttcagcttggagcttcctaagggataggtagtgttgattgaaccctaaaaatatttttctttgttatatttttacatatattttgtttgccatctctgttgtcagaggtgattgtcattggcccttcctagctctgtcttgcaagtcattatcaatattgttttctgagtaaaacatttagcatttcaagtctgaaggaactgcagtgttgtacagagggactctttctttctaagaaagagtatggaactcattcggatatgagggaggtttggtttggttggttttcgagacagggtttctctgtgtaaccctggctgtcctagaactcagtctattgatcaaactggcctcaaactcagaggtccacctgcctcctgaatgctgggattaaaggtgtgtgccaccatactgctagatatgtttttaatattataattttctaccaaataccatagatgactgggtatgtaatagtattttaaattatttgaaaatataagtggatgttctctgactttttctaaaaacactgcatttctttaaaacttggcttcctagaattagaaaggaaaatgtccaattttaacatcttgttgaattcaagttgatttaaaggcccatggctcaagttgaacttcattttaccttaagcataaaaattgtgaagtgttcctggttgattataatgggaaaccatgacctatgtagccaaagaatatatttggttcaggtaaaactagacgattaataatggacattcatttttgctagttttgaagatggatgaagtttctgtcctatagatgtgtatgtggaagtctctgtaaagactgagatattcagctgtggtgatgattccctcctgagtgggagttgtgtgactggcgctagtcagctccctgtacccactgtggcctgctcttcacctgttcccagaacttcccggttgtgggaaggtttggatctctggtcctgtttgcatctttaggcctcttatctattaggagctgtcaggtgtgttctggcggctgatttccctagcctgaagaaatttacgatatctgcactatgtacctactggggggggtgggggtggggtatctgacctcaagtgtgctctgagcccaggttttctcgtgtggtgtcttttaccacgaaattatgacacattgcaaatcctggtattgtgatcttattctctgtacaaagaaagaagctctatgccgtgagctgtggtttaatggtcacagaatgtcagcactgctatcattcagcacgtgtaacatttttaaatttataaatattaaaattttaaacttacactaagacttttaagttttttttgttaaaagagacccagggagtgtatactgtttaaatatttacctctattaatataactaatgaaggcatttaatttttcaaaagataactgcagtatgattttagggaataaaccaaggctgtgtgtagagccagttataacctgaatatcaaaatgataaaactttatttgtattttttaatccatctatgggcgttaaaatatgttttcactaaatatttttattacatttttggtttgaccatgtgtg

SEQ ID NO: 22751 - DNA, 1905 bp, Mus musculus
catagataaggtgagaacaagacctaaacactgaactgttggaaagagtttttgtctgccctgcctcagcaccaaccccacattcctgctaggatccgccaaagaaaacattgttatggctgccttgtttcttctgcaggctgaatattctgaactggttgagacattactgtcaagtcaacaagacccagtcatttaccagagattagcagatgccttcaacaagctcacagcgagcagcactcctcctgccctggaccggaagcagaagatggccttcctaaagagtttagaagaatttatggcaaatgttggtggtctcctttgtgtaaaataaacaaacagagctataagcttaacttagatcctttctgcaaagtgcactgaattgctgaaagttgacttgagtcttgtcctgttcctcagttcgtttgaccattttggatttggaaagcctgagactttgatgtggagttccgtgaaacaggagaggtcaacttgaaatcagcttcgtcattaggtgttagccatcatctgccgtatacttgtcttctagattctgaatggtgatttatatttttcaaaatgcaattccatatatgtgcaaacagatatgggcaccatgaaattcatattcagtgccttttccccttttgtcaaagcataggtggctatccaaagttggtatgttctcggcattagttttcaaaatgtccatggatccctcgtcatctgaggagctgattgtaggagggattcttgggccctactgtgcatcattagcatatttggttgttggactctagagtaaccattttaataagctccttcctttcattaccctaaaagttttaattcaatacaagagatgctgaaaccatgtaacaggttttgtgctttccaacatttccccccttcggtgattataattacgcaggaagaagatccttacaagtgtttgttggtttcatagtcctccctctccccacttcctccctttccttccctttcagcctcactgttgcaggttttgtgtaattatttcaggtttctaatcagactgtgatgcctgaacttgaggaaaatacgtgtatattttcgttccgtaaagatgactttaggaactgtagccatttcattgccttaattttaagaggaaaagacaaaccagatttgttttagagagaaattaagtcttgacacttaagagttggctttgggtattagctgctatgatcctcttgcccctttgattatgtatttatgtttatcagtgagtggaagagcatcccagcgtggttgtctttctcagtgtgtttctgtccagccacacagcctgtatctactctgaatggcttgcttaagcaataactttttaatgggtgtgaatgactaattcacacagactattgcacattggggcatcaggggcaataattatgctgaagtgggcgctatcctcgtgtcacaggagccacactaactcaatctcaaagacttaaacatttaactttagctaggcatggtggtgcatgcctgtattcctggcatttaggaagctgagtatgaaggtcaggctagtctgggttacaatgtatgatctatctttaaaaaaagaaaaagaaaaattctctttagatcctctggcttttctaatcaggatttttatatgctcccgtgctcctcttaatttttgtgtcagctttaattatgaaaatgaaagctcatttataaacagcaggcctctgacacagtcacacagtgcagtggcagctcgaggcctctgacctaggtgcatctgagactgccatgcaagggcaggctcctctgctgttcttgacgactccctgctaaaccatctgtcaagtactgtcctcctacctgaactgcacagcacgtgcatct

SEQ ID NO: 22752 - DNA, 1099 bp, Mus musculus
ttttttttttttttttttctcttctttttttaaattttttttatttttgagtcaggctttctctgtgtagcttggttgtcctgaaattcactctgtaaattagactggtcctaagcctacctggtgctgtttcttttcatacatctagtacctggccctctggtcattccttcgttaggtcgtgtgatgcattgcagttggttctctattcttaacttgctgacattataatgtcatcatttgtataatctcatctgcagaaacaagctagttattactggacctgcaaactctcagaggccatcttgtgtggaaatacttcttttctaactcagtggagacactgcaatctggcctaccccctatcatctgtattcctagctacaaaaagtcctatgtataatatagctgtcattttttttttttttttttttggtattctttaaagtcaggtatatgtgatatagttcgatctttgaccattgtgttcagaatgagttcagaagtatgccagctttgtctcgaggccttgacaccattagctgaacaatgtgctaaagcacaagaaacggattcaccactttttctagcaacacgacacttccttaaggtaagatgcttggtggataagtgggagatttgtctacttaaccaggctgagttaagtacttgcctgcatgccaactaaccaggaagctgcggctcagtctaggctcagttatagaatacgagggagctttttaatttatcggtatatgggtgtttgtctggatgcgtgtctttgtatcacatgagtgtctgatgcctgtggaaatcagaaaaggtcattagacccaccctggatctggatttacagacagttgtgaactactgtgtggatgctggagatagaatcaggtcctttggaagggcagccagtgcttttagcccctgagctatcttgccaaacccatgaaactcttgagtcaaatgaaaatgtacttgcattctgttagagaagagaaaatactttattcactgttttttgtagttgtgtgtggctttttgaggcagggtttctcggtgcatctttgcctgttatgggacttgctttgtggac

SEQ ID NO: 22753 - DNA, 1187 bp, Mus musculus
ctaacatgggaataggcaatatgttattacctacttaggtaggtaatcattctaggaaggtttttgttttaagatgccattaagaatcaagattatgagacaatatgcaggaccatgagatttggagacaaggcttagtacttacaacattctaataagtcaattctccagtcttaaggcataacaggacttgtcttttgtgacacaaaaactgtaaactgtctactggaggagtgatggaaaatttggcttatactctgaacatttggttgtatgtgttcctccattctgaatgggagactcctctgtagacagtgatgctgaggtttacatctgcagctacagcctgagcagagggtgcttctcatcctcctgtgtcgttgtcttgactctacaagatcagaaatgatgtggggacaaccccactgatgaaattttcacacagcctggtataaagaaacaaaagggatttttataggggaaaagaatagggttagcaacttctgttttctccccacaggctgttgtctgctgtgctaagagtctcagaagttgaatctcgagcaataagagcagatctcactcatctactaagccctcagatgggcaaagatattgtttggtttctaaaacgctgggccaagacttacctcctggtagatgaaaaactgtatgatcaggtgaggacataaaaccagtagtctttttgggtttatgatgatggcaagtttagaggtaggatgattttgtctgtctgtctgtctgtctgtctgtctgtctcacatatgaaagcaaacctgttagctggatttgctgacatgcctttagtcccagcgcttgggaggcagagttaagtagatcattgagttctaggacagccatagctacacagagaaactgtcttaaaagaaaactagagaaagaagaggaggaacaggaacaagaggaggaagaagaggaagaaggagaagaagaaaagaagaagacgacagaacctgtttaagagagacagctctgatataaagaagtgaaaaggattaagggcctcacatgctggtgctttactttttcagagtatgatgtttgattctattgattttagccagtattaagatactttaccgttagaatagtatgtttttatattgtctttgagatgtgcacgtctatttatttcaactatgtca

SEQ ID NO: 22754 - DNA, 1117 bp, Mus musculus
tgaggtttgtcatcctgctggatgcttacttatttaaaagctccaatattttagcagcatggctcatcacaaatagtaatgttcaaagatcagtttaataagatttttccaataaaaaattcccgttttgcacagtgtgagaatctcttagtccactttctgattgcttcatatttttatttttactttttaaagctgtgttattttttagttcttcatgctttggaagtaacagttgaagagaggtgaggaaagtttgtgaaaattgtgatcggtgattagctgccacctgcctgaggtgtcttctgagaggaactaacctctttgtggtgctagagcaaggtcactggattaaaaccagatcaggtaaccatcttattccttgtctgaaaagttctgtcttaaaatttaataaatgcaaagtacacatggtaacatgaactactgcttaaagagagtttttaattttctccccagaaaccagtaaagtggactatgtcctttttcaagctgccacagctataatggaagcggttgtccgagagtgggttctcttggaaaagggcagcatcgagtcactgagaacattcctcctcacctatgtcttgcaaaggcctaagtgagtacctggggtggcaccgctaaaatacaggaggccctctgatctgtcctttgagacaccccttcttttcagtggtgatggttatgggcaagctctgtgctggagctagtagtttgaaaatctatgcacaattgtagcttgctttcatactcgataaaaatcataccttttacttacatttctaatcctaaagaaatacgtgatactgttcttgttgaactttcaagaatttgattataaattaaagttaacttttgactgtcaaaacttacattttcttgctcttagatgattggtaggatagttttttcttttaatatgtttagaggaagtttagcatgggctgagtattataagatgtagctgcgtagccccagaaaggaagaggaagaaactaaaccaccaataagccaaatgttacatagaaatgttgcatacatctatgcatagaaacgtcacatacatctgtgcatagaaatgttgcatctatgcata

SEQ ID NO: 22755 - DNA, 1211 bp, Mus musculus
tactctgggaatcaacctgcaagtagcagcccaccatgtgctctgaggctgacttctcactctttcctctctaggaaagggcctggcgcccaccccggtgactcggcggcccagtttcgagggcacaggggaagcactcccatcctaccaccagctgggtggtgcaaactacgagggccccgccgcactggaggagatgccgcggcaatatttagactttctcttccctggagccggagccggcacccacggtgcccaggctcaccagcatcctcccaaagggtacagcacagcagtagagccaagtgcgcactttccgggcacacactatggtcgtggtcatctactatcggagcagcctgggtatggggtgcagcgcagttcctccttccagaacaagacgccaccagatgcctattccagcatggccaaggcccagggtggccctcccgccagcctcacctttcctgcccatgctgggctgtacactgcctcgcaccacaagccggcggctaccccacctggggcccacccattacatgtgttgggcacccggggtcccacgtttactggcgaaagctctgcacaggctgtgctggcaccgtccaggaacagcctcaatgctgacttgtacgagctgggctccacggtgccctggtctgcagctccactggcacgccgcgactcgctgcagaagcagggtctagaagcctcgcggccgcatgtggcttttcgggctggccccagcaggaccaactccttcaacaacccacaacctgagccctcactgcccgcccccaacacggtcaccgccgtgacggccgcacacatccttcaccctgtgaagagcgtgcgtgtgctgcggcccgagccccagacagccgtggggccctcgcaccccgcctgggtggctgcgcccacagcacctgccactgagagcctggagacgaaggagggcagcgcaggcccacacccgctggatgtggactatggcggctccgagcgcaggtgcccaccgcctccgtacccaaagcacttgctgctgcccagtaagtctgagcagtacagcgtggacctggacagcctgtgcaccagtgtgcagcagagtctgcgagggggcactgagcaagacaggagtgacaagagccacaaaggtgcgaagggagacaaagctggcagagacaaaaagcagattcagacctccccggtgc

SEQ ID NO: 22756 - DNA, 1164 bp, Mus musculus
gcctgttgagtgctggagacctcactggagaactatgaaagctaaacatttgcagtagactttagagtagtagttacagagtaaatgggatggctgagcccgaagtcattgtttcctattagatgtgtaatgtgcatgctggcacatgcacctgaagggagggcgagtgagagggaaaagctactaagtagttactctttgatacgcatttctattcctagcttatgtgggacagctgagccacactgctaagcatgtctcacaaaacctgcacaactgagctgcagtgactgattcctgtggctgctaaaggtgtggctgcttggttagctcatgatgggcattaggaacaactggccctgctttattgaattctatacgattgcaaaccccaatcttaatacatgactatagtttccaccacgaaggtggttaagaacagcagagtgggggctggtgagatggctcagtgggtaagagcacccgattgctcttccgtaggtccagagttcaaatcccaagaaccacatggcagttcacaaccatccgcaacaagatctgactccctcttctggagtgtctgaagacagctacagtgtacttacatatattaataaaataaatcttaaaaaaaaaaaaacagcagagtgactgcctatctggtctgttggcttaaacacttgccaatggctatgatttcctagagttgacaagtaaatttctaaaagtattctagtaggcttaatcttgaccaggtaaccagtctcagaacaaaatcatgaattctttttttctcccaaagaaggaaattcctagggccagtaagcaaaaacccaagaataatcaaagtaaaattacatttattttgggggaaggggtgtgtggaagtcaggacaagttttagaagttggttctctggatccactattgagtcccgaggatgaaattcaggttgtcatgcttgatagagtagactccttcactgagccatctcagtggcccagagagcatctttacattctgggtttttccgattgtcactttataagtttgcctgtgtatatgtgcactatgtctgtacagacctttcagaggtcagaagctgtcagacccccgaactagcattacaactggttgtaagtctctctgtggcttcagggaact

SEQ ID NO: 22757 - DNA, 1490 bp, Mus musculus
caggtcccattcccttcacagtgccataaaccgaccctgggatcccacattcccagataattataagtctgcttgtgcaataatgaacccaccactcctaacaccctccatttgaaatttaactttcattatcagttcttgaagtagtcttagtgtataactttggctggcctggaacttgctacatagaccaggctggcctaaaatcacagagatctgcctgcctgctttggcaaatgtcgccacatagctttttttcttttatagtgtgtgggtgtgtaaagtataaaatacttagctacgatgttgccttctgttctgatgtctcttaattgtccttacttgattttgtttctgtttgtaggaattctacagtggatacatccaatacagaagctagacagaacaggaaagtgagctggactaaggttctcaggattataactggttagcacagaccagtagaagtggagagagggctcctgctggcagtcagtcttctttctcccagtctctcttatttcattcttacgggaatgtttccgtttcaccgcactgtggtggcctttccagcttgaccacccagcagatcccgattctacctggaagattctgaacacctactctgagccagaagccttgggaacgtcttgattctggaactatctaatggcctttgagcccaagatccttctgatccaagaacagttagaaagtaattctccaagttcatgacagtgctacttgggagagctttgtgctgcagccaggtagggaatgaggagctggtgttctgaagagtccagctacaattttgagaaataattggcaaataccagttgactgactagttttgggaatttctttctcccaatacagggtttctctgtgtagctgtggcagtcctgaaacttactctgtagaccaggctagatcctcctgtctctgcctcttgagtagaaattaaagatgtgtaccaccaccgtctggcagctttaggaaattttgtgtggcataaagattattctaattgtgcattgaaaatcaagtggagagctagagagatggctcagtggttaagagcactgactgttcttccagaggtcctgagttcaattcccagcaaccacatggtggtaacaaccatctgtaatgggatccgttgccctcttctggcgtgtctaaagaccgctacaatgtactcatctacataaataattctgtttaaaaaaaaatcaagtggaaaaattccaggataatactaataagtgcttgtattttttgttgttgttgttattgtacataatgtaaaataaatgattttctgagtagcccaccttttatgttgccaactctgaaatttctttcagcccttactacatggcatttgtagtgaagagtccccatagctgaatggttctgctgttgtagagagagggtctggggagatggctcaggggttaaaagcacttgctcttgcagagagccca

SEQ ID NO: 22758 - DNA, 1227 bp, Mus musculus
tttagagtttaataacttccagactccccaaaactttattacagaagccttgtgtctgtctttatgggtgttgtttttctctccctctctccccctccccctctctcttcctctctctttttgttttatgtttgttgttgtttttatttttgtttttcaagatagaatttttctgtatagccctggctctcctggaactcaccctgtggaccaggctggccttgaattcagagttcctcctacctttgcctcctgaatgctgtgattaaaagcatgccccactgccacctgtcatgtgtttctctgttatcgtcagtaaacccaaactctgattcattaagaaagaaaacaactctttgccagtagacagttgtcccccataatcctattacagtccatgctacaggctttaggcaaccttgtgtctacttctgtgcagtggacctgactcttctggacctttcctgtaataggagccctagaatattgtcctttagcctcgttctcaccgtcatccacattgtggagtaaagcccgagtcaagtcttattccattgcatcatttgctacatggtgtgtttatgtgcttatacttggtgctaggtgtgctttatcttggtgagttgactatgtagttcttgccttgttgatcagagtctagtctggccttgaagccatgcagatccatctacctttgcctccctcttctggatcaaaggcatgggttgctgtacctggagagttatgtaatttatgtgtgctgtagttccttgaaggcttttattctttgtttctatttttgtttttcaagacagcttctctgtatccctggctatcctggaactccgcatgcttctgcctctccaagtgctggtgttaaaggtgtgcatcaccactgcccagcaggatttttctggttaagaaactgcattgatatgttgttgttttgttttgttttcctcgtatttatttaacattttttccttgcttgaagactttgaagattctccagggagaattttgcatgaccttcattcagaagtccagactctaaaggtactattaacttaaactttttctatgtgggtacttttctctagccttagttgggatgggtctagggtcacccagaggtcaccaacctaacagagaataagattttaataagaagagcttatttggatactggtacctgaactgattggcgccagggctgcatctgagagt

SEQ ID NO: 22759 - DNA, 1470 bp, Mus musculus
tacttttaaaagccaagtggcacatgcctataatcccagcattcagaaggctgaggtaatattctgtgattttgagtctagcattggttgcatagagaccgtatctaaaacacagaataatacagccatgtggtgtagtgtgagcccaaggctcaaaggaaacatggtaggaaacaactacacgttggtattctctgctctttaattactagttgttgagtgttcaagggaagtttttatgggcagggaagcacagaggttcacgtgctatccaaagacctaacacatatatgaataggtgggagtgactagaaaaaaagagaatgaaagaaggagtattataaacaagtaaacaaattttcatccctaaaagtatatagactacaacatgctattaaataggatttcatttaggcaatgtctaaaaattactgtggtcgtttacaggaatcctgtagccgagtcaacagcaactcaaatgcagttcagataaggatgaaatatgtaaaacaaaaccacgacgtcccaggcttgggctggagaaatgtctcagtagataaaggcccttgccctcagacctacaacctgacatcagccacattctggaagaagatacctaactcccacacattgtcctctggcatttacatgtgcactatggtgcacatagactctttaaaagatagtacgtttttagcgtctagtggctttaatagaaatggctgtattgaggagattagtccactggtctgtcaaaaggcaatgtagagatgctatttttggtttataccgtttatcaaagaaacaaacgccaggcgtggtggcgcacgcctttaatcccagcacttgggaggcagaggcaggtggatttctgagttcgaggccggcctggtctacagagtgagttccaggacagccagggctacacagagaaacccagtcttgaaaaaccaaaaaaaaaagaaagaaaaaaagaaagaaagaaagaaagaaagaaagaaagaaagaaagaaagaaatgaaacaatcccaaatgattgcttgaggtggaccagcagagagacgtctctgatgtgctgctgtctaggatgtggctatgcagtgtctgtgtgcacaataggactgtggagaaggcatcctgcaggagttggactataggactcccaacattacccagtgctgaagtttgcagataaccttgctttttatttacccaccaagtagctgtcaagtcctctgaatatcaaatattatactaaagatagcgctgtgatttccaaatcctgcataaatcaagatcgctgctgttctaactttgcgatttgggaagtttactgaattcccattgactgcactaattatgaatcttaagtaactttccctttggaccaaaggagtgagtcagctttggcaccatggtttaaagttgtatgtagtatgaattcctcttcatttcagctcttttgacttt

SEQ ID NO: 22760 - DNA, 1193 bp, Mus musculus
atatgtatttgaaagagtcacttagtactttttataagtagatcagattagattttataatggtgcagtcaggactatactttccttcatataaattgcatgtgtacttgtaaatacgtgtttatttcatagactacaggtgtctctgtgatgcagattgccaaaagagctgttttaaagaggtcactactttcacttgacttgataaggctcagaatgatatccttgggccagactaatacttgcttcctgtttgcatactttttaaaaaagatttatttatttatttatttattataagtactaagtacactgtagctatcttcagactcaccagaagagggcatcagatctcattacagatggttgtgagccaccatgtggttgctgggatttgaactcaggaccttcagaagaatagtcagtgctcttagctgctgagccatctctccagccctttttctcagaatttaaaaaaagatttatttttattttgtgcatttggatgctttgccatatacatagatgcaccaggtatgtgcctgattccagcagaggccagagcagggtgtcagatcctctggaagtagagttacaggagattgtgagctgacatgtatgttctgggagttaaacctgggtcctcttcaggagcagccaggctcttaaacagctgaaatgtctctccaaccccaacttctcagattttttaaaaatagcaagtagttgaaaataatcaaatgttttaacaacaagggactaaagtttgatttatctgtgagaggaaagcatacagaaacaagcacccagtagggcggtaaccgggagtgacctctggactatgctgtgaacaaggaacaaggcatacgggagtgcaaatagtatgtgatggtgtctggggaaaagtaacctgtgagtgtgtcctggcctctctggaaatgttagagagctgctgacagtgctctctgctcagaagggccgacaggagaagagacctgctgattcttgttctcttaggagtgttaggtaccattgcaaatgcttatctattcagaatatgtgatcaagttaaaacctttttaatttgtaaatttatattcttgaggggaaaataactacaaaagtgtaaaaagaactctatcttagaagtagttattaataacattttcttggtatttgatttttatatgttt

SEQ ID NO: 22761 - DNA, 1217 bp, Mus musculus
caaatctgttaatacttgtgtttcttgtttagaccagcctaactcctactgctctttatatgataaacagtgatactgttagccaggccttcttcccgactggccagtgttagcgctgactctcatgtactcacgaatcccccacagcatcttcctcacatctcgaacatgaattacattcttttagagctggaacagatttttgagaaatcaaggctcggaaaagataaaagcttgccacactgactggctgaaagtagatgtggcctgaagcaccatactctctcagagactgtccctgctgctacgccaaggtactttttcttgtgtgatgggccatacctgtggagatgtctgagcaggctcttacattgactcttaaattaacagcctttgaataaatgccttgtaaaataaagtgtctcataatttagccacattcaaactcagctcataaaattaaccctcatttagaaggtgagcttgatcttgaaagaaattgccaggccctgagggcagagttaagtttatggttttgaatagtagtatcactttgtgtttggaatcaatctctaactccacttggcatacctgctgtgtgtgtgtgtgtgtgtgtgtgtctgtctgtctgtctgtctgtctgtctctaccctacctcccacccccacctgtctctctgtctgtctatctgtttgcctgtttctctcaggtatccatcccaggctggtctcaaaatcatcgcataagtaaggatgactttgaatgattctgcctccatttctatagtgcaggtattacagggactgagcctagggctttgtgcatggtaagagaacactgtatgaactgagctatagtcctcagcctattaatcttacacttaaatctttttaaatttttatttattttgtatgatgctctattgtatgttgatgtgaatatgctatggtgtggatgacataagacagtttctagaagttagttctgtccttctactatttgggtcttgtgaattaagttcaggtcctcaggcttggcaagagatgaccatttttgaccagtcattggccaattttgctggccttgaatcttatgttttcaaagaattctatactgtaaaaatttgaatgtttaagactaattctgtatgatttatgttataaaaggaaaagatgcttctgaaaacagcatcctgcttagcatttacatcacgcatg

SEQ ID NO: 22762 - DNA, 2124 bp, Mus musculus
tcatcaagcgaggaattactgtggagaacgccttttcattgttctctgctgcagtcagatatgacgcagaggtaacacagaagtgccccggctccctcgccgtcagcccacttcccgctcttctgtgacacagcatggctagtgtcacctcctttagtgactcagtgacaagcctcaaatgaaatctgcctttgcttctttacatctcgttcacagtcagaatcattgtttgtctgctttgcttctaaggaactggcagaaggctgcacagtgggcgtgtacagtgctggactcagccgggctgacgggcagcatgctttactttcagtctgctaatgagtgcatctgcctgtcccagacccactctaccgagtccaccgtcagaagccccgggtgctgtgggctttacatccgtgtgggtctggacttttgtccctgtgctgtagctcagttcctctctgaagaacttactgtatactacctcttttttttaacttaacagtttttagtgcacatgcattgtgtgtgtgtgtgtgtgtgtgtgtgtgtgtgtgtgtgtgtgtacatgtctggataactctggggagtcagttttcttcttccacctttacatggattccaaggatcaaagtcagttgccaggcttatgcagcagttgtccttacccactgagccatctcagcagttcccattttgttagttttaaacttagttggatttcagagctgcatttctcagatttctagagtctgatgagtgttctggagtatgtttgccattgaacttttctgactgagccgagccacagactctgagcagaagctggccctggttgacggtatgctacagcacccagtccacgtgctgatgcatggcagctgaggctgttgaaccgtggagacagtgccacaaaaggctgcaggagacattgttaatgaactcagagctgacctggttggtgttacagattcataaaaagtagaaggctggctttgctaaggatatcagaagtctgtattttagaggcgttttgtcatttgacaatgcagtctccaataactgggaatttatcaaaaactcacattctggcccttgaggtgtagcagaggacagacagacttagggattgagttagccattatgtcttttattttcaaaatggatcctatttttgtttgaggttcttttatggtaataaatatttcacaaggtcaaatgcagctgactgtggagtctgacaccaaatggaaatgtggttagcgtgaattgtagctaatgaaagatggagaggggttagcttccccgcttcctataccactaggagcctgtgctagactcattcttatacaacaggagaattttaaattgcattgactgtaacttgaattgttttcaattactacttttaatgatggttcttaaacactttaacctcccttttagcccaccacccaccaaaggtaggggggatgtggacctgtttagaaaggttctttggagcaactccagtcagtgttgtttggaaatcagcagtgcagttcacaggtcaacagtggcagctcgagccactggcaaagacttcaaagacatcagcaatccagttgggtagagtcgagatagcaaacaggaatcagcagcggtggcaccacctagtgggacagccaggcctcagcctcaggatgaatcagcaggagggaccagggccaacaggaactccagaaaaagttctcagctgtgcctctcagtgaaatgaagatactgagacaacaggcattgcacagctagctgtataagcaagcctagctcagccccacctactgtccttcaagtccttttttatcccttcaaacatcatgtgtcctccactaatcttgccttagcacgtgtgtctgtctcagctgccatcactctgccgcagaagcagctagatgccatggcacacctccagaaggtttttggtgcagtttctctctatggagtcctgacaactggagctcaactccacagtgtaaagagaccagtacatgcatgtagttagcaaagaatctcttatcacatgtcctttcatgtgcttactttagcagaacatctttttgctttatgtctacttcaggaaatattcct

SEQ ID NO: 22763 - DNA, 1830 bp, Mus musculus
atcttttaaagaatgggtagtgtttcactattaccactgtgaagttttgtgaagtaagaacaccactgactaaataagaatttagtgattgctattttagcattttaaaccagagttttggggtcactagtccactgttttaagaaaattggaagaaagaaaaaacaacttggttttcagattgatgactggaatgccttcatcatgaaagctttggagtgggagcccatgagggttcgtgggctcccttccatgcagcccagcagggacccattcctgagatggagaggaccagctccacaaggggttcctggaacctccgtgctcctgcctcacatacacacagaacatacacatagaacatacacacacacagaacatacagaacatacacacaatattcttgtttttattttggatttttttcaaattagcgattttaaaatttgttgtttccttctaattccagtaaatctgacactggatctaccctagatccactttgtaatttctcacagacttataagttgtagtttctcgtgtgaagactctgagctttatttacatgctctcctcccacaggaaggcacggcccctcatctaaaggttggagagttccttacagcttaccagtcagagttttggttgaaaagcttttatttagtgttgtttgcattcatacattggagtgccctagatgattttgtggctgtgtgtggctgtgtgtgtctgcgtgtgtgtctgccacacttgacttagggaaaccttgcttttactctgctctgagtagaaggcaggtggttttctgatgacacggtttgaggtatctggtctccagtatctcttctgggaagggtaagagagttgggatgagggactagctgagaaacagttcccagttaataaacaaaggcctctccctgttcttgtttttgttgtatgtgtccaggatttagaagaattctgctttaagttttgcatcaatcatttgacagaagttacccagacggctgcgttctggcaaatggatggtcccctgctaaaggagttcattgctaaagccagtaaatgtggagcctttaagaactgaagccaaggctgctgggctaggtgtgagagctctggggcactgtgggtgcggtgatctgcaggtaaagccccacaccatagacagtgctctgtaggaatatatgaaggatatttgcttcttgtgagtccatttcttacaactctgtgtctagatatgtatgttttacatgtatgttttacatgtgtttttcttacatttgactgagctttgggaaaggatgaaagtttacatgcttttgttcttttaattttgatgagaggatgttttgagcttgtattaagaaagccaggaaaatatccctagacctttggccacaagcctttccacatggtctgtggcagacaggccctgcccagtgctccctgagtgctgctcactgtcaccaacctcctgtgggggcatcagcactgtgggggtctcttaagaaatagtcttaatatgcattaaacccacttaagcagtcaagaaatactaggtttgctgagatgctcttaagggacaggcacctagggctggaaagatggctcagcaggtaaaggctcttattactaagcctgatgacttaacttgaatccccagaatccacatggtggagagagctgacttataagttgtcccttactgctacacatgtaccatgtctgcacaaagacacaataaaggagaaagaagaagaactaaaagatttaggtccctatagagaagtgacaagaagtacctatgagaagctgatggtaaaa

SEQ ID NO: 22764 - DNA, 1086 bp, Mus musculus
tgtgtttgagaccagcgtgcacactaccatccccctctccctataattactcacaaacacattctacatggctgctcttttctgacttgatgtgattgttaaagccacccttcttacaggactccatagaatgctcactgttttcggtggtgggaggagtccaggccaaaatccatcaaaacttaattgaaacttcaccttaacctctccagttttggttgattttttttttctttctataattgtgttaggaatacatttgtcatacgttcagctagggctccctattcatgcctttcccgaaaaggtcatttgtaaaatactaggccagggtggatggtgactgaggcaccaaagacaggcaggcatgtgtgttgacaaacaagataaataggaacaagagctcaaagcccctcttcctgatcatgttacagctgttgcctggtgcatgggtaagtgacaactgcctcctaggtggcagttttcctggccaagatgatgagtgcacattaatctgaactgctgtagtgaatggaccttctgtagaacctcagtcctgtagacttagggcctcaaagcagaaactttagaacatttactggtggtcttacttgaaaaacttacccacgaaaaagcacaaattacacctgcaaatccacacccgtagacagttcacctgacaaaaacgtgctgagttcctgatccagctgaagacacacttttagcttgctgaacagctagggtgtttttgtgtgtgtgtgtgtgtgtgtgtgtgtgtgtgtgtgtgtgtgtgtgtgtgtgtgtgtgttagtgaaagaaaagtcctttaaaaagggtttgcaaattttttttaaatgcaatctttttatttttctacttggttttggttataatcatagaaagcaagaaactattattgaaattaatgttttcttctgatataataatggaagccagagaagtcacatttcttaaaagatcccaaactgtatccttgaagttactggaaccagttttatacttcagtaattaggatgcatttatgtaatttcttgattgacatgctaataaacaacctctgaaggc

SEQ ID NO: 22765 - DNA, 1169 bp, Mus musculus
aagcctcttagacagtcacagctataattagacttcctagaattgtcttaattacatctcacctttaaatgcctccagagtatataaagtgtttcagagtctaggttatcttactactgtccaagaaaatacagtaattgtcaccttagtgtgcagtgtttttaaaaatgaagttaacctataaatttgagttataataattattttattctaatagatctccaggaaaaaaagtattcctccctgtgaagaataaagctgacaatttagtgaaaaaggaagccccactgcatatatctttccatcgccatatctgctccaggacttgtctaatggaaaccccactgtccttgaagggagaaaaccccctgcagctaccaatcagatgtcacttccaaagacgacatgcaaagacaaactctcattcttctgccctccatgtgaattataaaacgccctgtggacggaatctacgaaacatggaggaagttttccattacctgcttgaaacagagtgtaactttttattcacagacaacttctctttcaatacttatgtccagttgactcggaatcacccaaagcaaaatgaagttgtttctgacgtggatattagtaatggagtggaatcagtgtcgattcctttctgtaatgaaattgacaacagtaaacttccacggtttaagtatagaaatacagtatggccccgaatatatcatctgaacttttccaacatgttttctgattcatgtgactgttctgagggctgcatagacatgtgagtagaaaaacatggcgtctcaagcaatcttttgcatgtagacatatttgcttcgtcctactgtgttccatttgccattctgtctgtctaaataaaacagtggacaaattgtctaaaatagatgaaaaaagataccctgtttcataactccccaaagtggctatttgcaatttattttctctaaggatgagcaaatttattgccatagttataacagcaattacagtaccattgatgagtgtcatgtatgcccaaatactttaaatacattctcttcattgtcacagactcctgttttaggtagtatatttctgtcatacaagtaaagaagaaataaagaaataaagtctgtctgtctgtactttccccacatactctaaagcatgac

SEQ ID NO: 22766 - DNA, 1154 bp, Mus musculus
ctctgagacctcaggctctgtcagaaagctagtgtcctgtccctttgggcctatcttgccttttctgtgactaacagattgtcttcttcctacccatatctccattgtctcttctctagctggtgttgtccccaccttatcctttttccctcttcatattttaatatggttccaacagagctttactgtggtaagaattactggcttttttatttgtttatttttgtagtactggggatggaacccaaggggctcagtcactgtgctgggcatagtcctgcccagaactatgaactataggtatttgttcagtgaatcaaacgaagttcttcaaatgaatattgctagtcactaatcctccaatttgccttccccagagttcagtctctggaaaggatccacattctttaggtgagcctggatctagtgggctgataaaactggtgccaggaggacacatctgtgtccaagaggggaacctatccatccagccttgagctggatagcataagtgggcaagaagttctctgtcctcattgtcccagtgcccttctgctcagagactctccacttggggcctggagcagacctttgtacctagttcagaaacacctgccacttccctctcctgcttatttacaaatgcttctgttcccctgaggcttgtttgctgttctgcattgatctactgagacctgcttttcttgtttaaactcctttctagtctgagtatgtaaagaagagcattgcgagcagagaggaacagactaaagtatgtgtcaacatgcagaactatgaaaggtgcttcagggaaagttagcttttaagtgctgggttataaggcagagatgctgctgaaatggtgctgcatccatcacctgatgcagggatcctaaatggtgaatgattagactggttcacatatcaacatcaggcttattcaacatggctccttctctgaaagaaaagagttactctagggaactctgctgatgcaagcttggtttttacttaggtctgtgtcactgtagctactgtcctaataactgcttttgctaatttggatcctgtgaggttttgccagtgatatcccataattgtagaaatgagaagttagactgttgcagtggcaaacagcttcatcagtataaact

SEQ ID NO: 22767 - DNA, 1150 bp, Mus musculus
ggcccattggacacacaaactttatatgccccagaacaggggaacgccagggccaaaaagggggagtgggcgggtaggggagtgggggtgggtgggtatgggggacttttggtatagcattggaaatgtaaatgagctaaatacctaataaaaaatgaaaaaaaaaaaaaaaagaactgacattaacaaaaacatgtgaaagcttaaagaaatacggcaaacaccatgttcaggcctgctggctggttgctgtttgtttgagatggggtctcactgtgctctctggtctgcagctcatgggctcctatgatcctcctccctccacctgctgaggagctgggcctatggcagctccactgtgcctggtgtccacctattaagtacctcatagttcttcacttcttacccagccttaggtttccattcagcttaggtgagatatatttgaagactcaaataatggctttggatttgtgtcttcttgcagttgctaggtgagctgatcctggaccgccacaatttcaccattatgaccaagtatatcagcaagccagagaacctgaaactgatgatgaacctgcttcgagacaaaagtcccaacatccaattcgaagccttccatgtctttaaggtaaagagctgatacctgggtatggttttctctaactttgaaatggcaagacctctgccttccgctttcctttccttgagagaaaattaaacaatctttttgttttgcaaacttactctcccactaatcgattgcagaaaaccataacttgcgtgctagctacagctgggcaagtttgcctctgacctttacatatagacttatagatttcaagaaccctcacatctgggctaaactgacctccctgacttcatagagcctacagcaccttgcagtaagataaagagtcatttccaaatttaaaacccattgaaaaaataaatgatacttgaccctcctggtaaatgccacattagtattccctagaggccaagaggatagggatgcagtgaggcaaagcttcatccaggttctgccactacactttagcagctcaattctttttctcttcaaagaaggcttcatggggcacaatgggtaagagcacttgctgcatttccagggcacccagggacacat

SEQ ID NO: 22768 - DNA, 1252 bp, Mus musculus
tggttccaagtactctctttcatgctagaataactaaggtgttcatttgtgtccccttaacagggacaggaagaaaaattatttttttaaaggccatggtttgtttttagacttcatacctctaaaatggacttttaaagagacatttcccaggcactgaagctacaattgcttgtcagctcttcatgccctgaattcccatggcactggactgctgtcttccttgcctttgggcacatatgtccccatccagagacaggaatggaagtgtgtcctccagtacacaccttgcttcttgactggggttcaagtgttttacttccatgttacccccccccccgagtcctgtattcttcagttataaaagtcagatttttttttataatattccctggtagtatagagccccttagaccttgacctttctagatttgcttatttgattaagagatgaaaaaaacaaaacctttaaatgtgtttccatagcatcatgggacacaggcaaggccatgttttaatttaatttcagttaaaaacacttcttttctctgggtttgaattggctctttgccagcatccttttatcctagctgtgtactttctggacagaaagctacagagtctgagatgcagtgactgaggtagctggggtgctgctacgagtttctgagttagtcacttagaaggggcacatggggctcaccaccacggtgtgtttacacagagatcactgtaagtactgtgagacttgaatgtggaaaggtcatagttaataagaagcacagtttaaagaccaaataaaaagtaccacatacttttggtctcattcctcttcctttacttgtgcagttgggttcttgttctgaaataggaaaggccacactgagaccccagtgcactgcagcaggaggccctgtctatgtcccaggatcaagcaccagccagcaggcactaagtcccactgttgctgcctcttcagtcaggaggcattcccataaacatagacatggaggttataagaagaatgccccagatctagggtgggacacaccaggttgacacccagagtgacctgaggcccagtctgtcttctgtcctgtgcattctcagggctgtggcctgagaaaggccatggcgttgggagctctgtgatgttgtactgagacccgggaggctcccagtggcagggcctggagtgcggccagtaggggatcactgagatcacagtgttcttggatgacgatgaggctcc

SEQ ID NO: 22769 - DNA, 1175 bp, Mus musculus
actcagataatcctggttcttattaagttttgttgttgctaccacttgtatacttagtgagatctgtagcatattataaataattatatagacacttgcttggagagaactgcgtggatcaagtaaaaaggtttataacttaaagacaatgatgttaactgctaacatcaaaggcaaccttgaggtcctctctgaggaaggtggccataaagtgatcagatgctctgtttgtgttttaacttttaagtttcatttatttccttgtgctaggggatgtatgtgtgtcaggatgcacaccatgttcttcctctgctgtgctgattcccggggtcagacgcagcccgccaggcttggtggcgcgtgcctttaaaagcacagccatttctccagttcagaccttgtatttctctatgggtccatttgttacagaaatggagggagggagccttctttacatgaggtatgagggaatgctgagactcactgtgcttctgctggccccacagagaagctgcgatgggactggagccatgtacttcatagggtgcgggtacaatgcctttcccgtgggctctgagtatgccgacttcccgcacatggatgacaagcataaggacagagaaatacggaagttcagatacatcatacatgcggagcagaacgctttgacatttaggtaagagctgtttttagcctctgtcctttaaaagacaacagaggatggttgagcctagttctctgttgttatctgttttcctttaaaagccctaagagatactttcagaaatagcatcttgataaagcatggtcctgctcctggactggagcctatgtatgggcacagagtccccagctctttccatttcttcagaaattctttccttttactctctccagtatgaatctatttgatgcttgtccttagggacttgcccagctatttctatttttggatgttagtatcccctttgttttctaaatttagagaacatctgttctgtttaggaaacactcccttggctagggttactattgctgtgacgaagcatcatgaccagaatcaagttgaagaggaaagggttatttgacctatatttctacagtgcagtccatcactgaaagaagtcaggacaaaaactcaatcagggcaacaacttagaggcaggagttgatgc

SEQ ID NO: 22770 - DNA, 1551 bp, Mus musculus
ttcttctttcttttcttcttctttcttttcttcttcttcttcttcttcttcttcttcttctttcttttcttcttcttcttctttcttttcttcttcttcttcttcttcttcttcttcttcttcttcttcttcttcttcttcttcttcttctttttcctcctcctcctcctcctcctcctcctcctcctcctcctcctcctcctcctcctccttcttctttcttttcttcttcttgcaaacaccaaatggcggatgacgcaggtgcagcgggagggcccgaaggacccgggggcccaggattaggaggccagggcggcttccgcggaggattcggtagcggtcttaggggccgcggtcatggccgaggctgtgtctgtggttgaggtcacggggctcgtggaggtaaagctgaagacaaggagtggatccccatcaccaagctgggccgcctggttaaggacatgaagatcaagtccttggaggagatctacctgttctccctgcccattaaggagtctgagatcattgacttcttcctgggtgcgtctctaaaggatgaggttctgaaaatcatgccagtgcagaagcagactcgggctggccagcggaccaggttcaaggctttcgtcgctactggggactacaatggtcacattggtcttggtgttaagtgctccaaggaggttgccactgccatcagaggggccatcatcttggccaagctttccatcgtccctgtgcggagaggcaactgggggaacaagattggcaagccccacactgttccatgcaaggtgacaggccgctgtggctctgtgctgttgcgtctcatccctgcccccagaggcactggcattgtctctgctcctgtgcccaagaagctcctgatggtggccggtatagatgactgctacacttcagccagaggctgcactgccaccctgggcaactttgctaaggccacctttgatgccatctccaagacttacagctacctgacctccaacctctggaaagagactgtcttcaccaagtctccttatcaggaattcactgatcatcttgtgaaaacccacaccagagtctctgttcagaggacccaggctccagctgtggctactacataaggattttgtaaaagaaaaataaaagaattaaggaattaagtctgctaaaaaaaattaaaaatgcagtgtggtcatctctcagtttctataagaactagtcccaggttgataacaacagatgtcaaagtgtataaatgtttaagtcccttatataaaacagagaagcatttatatagaacaagtgtgtatcctcccacgaatgtaaaatctctggattacaggaaacccagtgcaatgtgaacaccatggaaacggtattatggtgtgtaacttaggggacaatggcagggaaatagtttgtgatgcccagcccagaggcagcttttgacatctgggttatggattcttctctttgcaaatagtttgcctttgcagttggttgaacccacagatgtggggcttgtgggtatggagggccagctgt

SEQ ID NO: 22771 - DNA, 1507 bp, Mus musculus
gggaaaaaaatccatcaacctaagcctatgatctatcctagtactaatagcaatgtttctgttgctgaggtttatgctgtgaatacatgcacattggtttcttatgcagatggtataaactctagggcctgtgctagaagtagtttgttccttgacaaggccttttgaactgtgctgcagggcatcttgtggatatgtatgtaattatatagagagtaatgcacacaatgtgtgcacataaaatatatatttacacacctacaactcctgcctcagactgttatcctttttagtgtatttagttattcactctttatgatttagatcctcagcgcttataaaaggagtaacttggggtgcctggtcacttcatttgtttattagacagaagtgattcttgatataagtatttaacccattcaacttcattgaccccactcttctgtttttatttataccttgacccttaggagctactttaactgaggaatgctctaaggctcatcaaacagattttagaaacctttactaccctatatatattctcatgctaccattatgagaatcttttttgtaaaggagatggacttttaggagtgtatgtgaactccagagtgatgttctggggcaaagagctactaagccaaattgaatctatgcaggtggaggatgcaatgttaattcagtaacaacttgcttagctgtttcaatacagaattcttcttatagggctattgagaaaccaaatgaagtggcttctgagcctcttaatgtgctgagtcttaatctggactagagaaactacattttagggaaactctttgtacccactataaacgtgctggtttgaagagtggtggagctccagggagtgctcagaggtgtgtcaggttgtctgtgtgacctctgtctgtactgccgatcctggtgttgagtgagtaaacaccactgtgaagagaattcattgccttaggaccgtgacagcgtgaaagtagttttcaggtggaatgaacacatggaattgcacggaaatagtttaatttttttacatagaaggttttgtatataatgtttatcagtgaatactttcaggatcattttcactaaggcaccttttttttattttattcaaaacaggtctggtgtacatacatacgaacatacatacatacatattttagtataatgttacttgggtttgattataaaaattgttggtctgttttatttatctgcatataacagtgattggcattcctgaatttaatatttgcatcttgacgcattaaaataaggagagttatttgtctctgagcactaaacatttgtatatttttgtaattctgcaaccctcagtccagactatgggggaggataggaaaaaggtgtgctttggcattttaaattaccatcagagttacatatacaattacaaaaatactgctttgttcgttttttaagtacattgtattatgctgcaaatatctgaatatttatatttctctgg

SEQ ID NO: 22772 - DNA, 1127 bp, Mus musculus
gaatttaaaaatattttttaatttatttttttaatagtagtataagaactctggctgctatttagttgttattctgttttctggatagaagctattttaaaaagtccagtttctgtcccagggtagcaaaatgtacttcctcattttgttgttttgtgctttataaatttacactaccttttgaatatacaaacctcattcttcattagacaacgtgaaggctttgggttttttgaagttaaatttgaaggtgcagtttgctttggcattccctcagctccagatgtattaactactgtgcttgcagaggccaggactaagattgtactatgaaacttactgagtagttttcataaattattatcaaatgagagatttttagatttttgtattctgcttagtttaaaaaaacaaaacaacaaagagtagttaccatgaggggctggtacgttgatgctgttgttgccaaacaaacttaggcgaatccctaacatagcaggtgtggagaggatgacgcgtggctttgatgaatgttggaaaggagcttctgcagccttgactgtactgggtctgtgaaggcgcacacgtgcctttgtaaatgttcattctcggcctcatgaaccaggtgatgagtgctaaaatggagccgagctgaagaatagaactcaatatcacttctgtgaacaagttgcaattgtcatgttactgtgtaattggtttgcttttaagatgaacaataaattaaataaaataaaacattgtcttgttttttatctatttattatatataccatttcagtactataagaagtcatacctaattttttgggtactttatgaagtaacatgatagttttgctatgttagtgtcagtctcttggacattggagcttgactctaatactgggagcttgttttttttttttaaagaaaagcaaaaccttatttattacaccaaatagttgtgtcagaaaataagtagaactaaaacgattctagaaatataaaaactataacttgtgaggcattaaatatttcaaattatcagtacattaaacttttgaacatttttcattgtgataaacctcttttaactgtttagttataagcaggttaattaaaaaatt

SEQ ID NO: 22773 - DNA, 1304 bp, Mus musculus
ttcaagttatagcttcttactgttcaaatgcagaaaacatgtgcatttttataagtcttccttttgtgtgagcactgacaaaatttctatgaatagctgttccaatctaaaaaatgtgatagacacaattataaacatacctgaaacaaaaggcagggtagtttagcaataactatacatccgatgttgaatattgtgaatttacttactgttatttgctgtattgctatagatgccctttagaatatagtgtttcactactgaattacacttaagaaaaaacattagattccaagttgtgatcgtgccctttattgttttaaagtcagaggtaatccacctgtaccatatgttgcattttttagataggataataattgatggtgcatcctcagtctcgtacacaatgatttcagagtacttgtgatctggatgcagttatatttctattgaagatgtgtgttgaaggttaataggttcatctggatgtactttgactggaaacaaaataacagttcctgtaagagtcaagtttgaagaagatgcatgctgggggttttaactccatagtggcctgagtactagtcagctcaggaaggtttgagatcggattgtacactctgtaggaccttagtccccggttggataccgcttgcagtgttgttgtgatgtggttcttcagtgattcgtttggaattttggaagttgattagttgtcttattcctggtagtttttatcgggtttgaagtttgacatagaaaaatgcagttttaatagtttgccttttcgaaaacccttgatgatttatacatttgtgagtgagccttattctgtagtgtatgtctttttcacagtttcatataatccagtagtaaactgcaatattaaaacgtgaaaaccaaacaaaatagatgtttgggttgcattcaggccacctgtactatggagcatgctctagtcactcttcacatttgaatgacagcattgatctgccatcaagtaaaaagttgttgatggaattaggccaaatcctctacattccatggctggatctgtgtgaatggtggttcccataagctctgtctagtagctctctagctggctagagtgtagacttctgtagacatactatgatttggaataatgggatatcaatcccagcagtatcattttcagttctcaatatttagtagctaatcagtcactgttcatcatccctaaggtaagatggagaaatgtggttggatacgtgtcaataaagtaaactttattttcaagagaataagtaaagcttgagaaaaga

SEQ ID NO: 22774 - DNA, 2470 bp, Mus musculus
gttagctgtagttactaatgttttttcaacgttttgttttgctttagaaaattaagcaatgcaaaaatggcatcctaacgaaggagttgctgcatgctgtccaccctgaatcacctgccctgaaaacctcgctgtgtctcaaagagccgagtctgcttcccgtgaaggacacactccgagctatagagggcagcagcccagcagataatcgctactgtgactatgccgaggaattttctaagtcggagcctaccgtggtcagcttggagtacggggtggccagaatgacttgttagcctccttccgtgatccctggatgactgtagtgtaagaaatgtatagttgtgaggatggtctgtacacatgggcaggaggggttgttgagtgactttggggcttagcagtaagtgagaaagtaggtagctgagaaaaggatcatagcaactcttgagaggagtgagtcagctaagtgccatttgtaacaagaacatactcatttctgtaggaagtgagtgctagtgtgtgtatgtactggaaaggggttacacaggactggtgagctgacagtctgttgattcagatgttaattccagccacgctcagtagctttcctctaactctgagaaaacagacctgacaacctgaaccctcagtgactgatgtggcatgtgctttcagttctggagctgtgtgactgtggattttgcagtcacaaaaatccaaatatatagtcaaaaatatagtgacgttttaacattaaagtgccatgaaaagtacttatgggacagccttaaagtagactctcagtttattctgtgggttttatagccgaggacaggatgtttgatctctcctttaatcagccttatttcatatgaagaactaactgcactctgattacttgggggccgcacactgcagtgctccaccatggaaagttgtagacatactctgctagtttgtaattagccagctccacccgtatttaaaatcagtgttaccgaaggctttgttctcgttgtcatttgttccaagctgcagctgacagttcattattcacagcttagaggactcatttcttaggctagtataagcacatttggcatttactttcggcttactgcagtctattaattcttactctgtggttggctttaatcctttgataactgtacatttaaagtggcaaagctctaaagcgttctgagtactaaatacatttttaacttgactgtagctgcctataaactttcaggtaaaggaaaaagggaagtgcgggtagtggagattttgcttggttacgaattctaaagcaatcatttttgtgtggagcatatttccttactcttaatataggaggggcagagaagggagcactgggggagccagctaatgtccaacagaagcagctttgacgcaggaaaaggtttattttgctttataggctcattgttattctgtgcactggggcatacatatcttttctaaaaaatcacttacaactgtcagtattaccagctggctctcaaagtttaatatcattgatggtgtgtgaggtacagttcaggggcactacaaaatctgtgtacattgtcttatatacctcctgaccacacctatatctgtagtatttcttgtgttagttttgaacatatgtatcttttttttttttttgggaaaaaaaaggaaagctttatcgtatatgattttatctagtccttatttttccaattcacttctgtaagaccttatgtaataaaaacactgcattttaaaaagtaacagaaatatactaaaaattacaatgtataatgaacagtgtttagacattgagaaaggaaacttaatctctgtgtccacaacaggagggttttgtgccttggttccagtcaagttgtggttttagacttctgtggcagacttcctagtcatcttctgggttccttatgctaattttcaacttcacatgtatatatgtgtttacatgctcacacagaaaacatcctgagtgacgtacaggacatacgttggcaaaagtctgtgtaaatgtctcataaaattagatttatgttcattgtgttttgggatgtatagcatgtaaattatttcatgtattatttaaaggcaattaaatgttcatgctttactttgagtgtttttcttttgggataaaaaacaaatgaggaaggatcctagaggagaacctgtcactgtcactttactgaactggcatgattcctaactgcatgctaaatccagttgtggatccatgagtggagctctcatccctcgttagaggaacttctttttgtagcagatggagaccataacagaaatccacaagtgcccaaaatgctgagagcagctgaccacagagtgcccgatgccagctgacacagctacagcacagtcctgcacaggaggctcaggggacacagcaggagggtgcacagaaagattaggcaagctg

SEQ ID NO: 22775 - DNA, 1171 bp, Mus musculus
ccatgggcaaggtgccacagccacttgttcagcctccaacccaaaggccccgaaaatggtgacatcctcagcatgtcagaatggaggctgcaaaagcagccccagcagtgatcccgaagccggggaaaccaggctcagcccatcgaagctggtacgtctcttctctggtagtcggaagaggatgaattcgaactctgagagacctcgctcagtcgtccttgtggggaattcctccacgtggaatgccctggcctccttccgtaaaatgggctcctttaaaagactaaaatcttctgtccttcaaggaattcagaaccgggagggggcagaagtttccaaggaggagcctacaggagacccaggaagggctgctcccaatggcaccgttgccatcctgggaaagggcctgggcaggtgtacatccttgggccctgtaggagatggcgccgggtctgactgctcagaccccgaggacacggaggacgccttccagaggagcacacaccgttctcgcagcatccgcagggcctatggcctgggccgcatcagcctgctggacctggggcggcagccagtgccggagcccgccgtgtgtgagatccaagttcgagaccctgaacccagcagggctgtgcctctgccacgcagaagcaagagcatcgacagcttgagcgtcctgaagagctccttcaagcgcaagtctgcatccaacctcacggaactgcagggtgacaggcaggttccctccagaaccttgagcagcttcttcacagacccggagaagccgggtggctcagagagaagaaccagacgctggaggagccccatccgggccaaggacttcgacagagtcctgagactggtgagcaatgtcaaggatgcggcttggaagagggaggcccccaggagtgcagcccctggccctggtcccggtctcggggatgagaacccactacttgcgccacgaagcaagctacacgatgactactcgcgtcgtactagcagcagcgtggagccagatgccaggcgtggcggctcaccctgtatccctgcaccatgcaccactgcgccctacgcagctccagagccccacttagatgtggatactgcagtattccccctggaaactaaaagtgctcagccactgggaaatgatggacctcgtgccagc

SEQ ID NO: 22776 - DNA, 1097 bp, Mus musculus
ttataaggccagtgtggtggcacacagctgtgaccccagctcttgtgagaaggaagtgggggggggggtgaggaattcaagtccgttcagccaagggagactattgtgggttatgagaccatgcctcagagacaagcaaaagacacaagcaaaagtgaagttaaagatatgacaaggtctttaagatccttttgttttcaggtgctccacttgttgggaaatatttctaactaaactaaagcaaactgtaatgtatctaaatgcaaggcacagttgaggcaaggatagtcagagatacttagaacacactttgtttcggatcgtcaaaatagtattgtgccccagacatggtgcttgtgcctataattctagaattcaggatgctgaggcagagaacttgggggattgaggccagcctggtctacaaagtgagaccctagtatacaccctaaaaagcccaggaggggagacagctcattagtaggggagacagttcttattcctcttatagaacacccatatgaagcagctcacttacacctttaactgcagtacaaagggatcagacaccctctttgggcctctgcaggtacccactcatatgtctgtctgtctctgtctctctgtctctctctccccctctctctcatacacccaaactatgtaagataaaaaacaattttagtgaattatttattttaactttatgagcattggtgttttgcttgcatgtatgccagtgtgagggtgtcagatcccctgggactggagttacaaatagttgtgagctgccatgtaggtgctaggaattaaatccaggtcctctggtagaacagctagcactcttaatcctgagcctcctctccagcctcctaaataagttctttttaaataaaagctgtcactggagatctgtgaccatgcctgtgtgctgtggtcctgcccttgcatcctcggatgctgctatggtcaccgtgctttcctaactgtcgctcacagctctgctgctgcctcagccttcctctccctcagaggcctctctttctctccctgttccccaccggcatgtctctcacaagtaggaagaagtgtgacag

SEQ ID NO: 22777 - DNA, 2042 bp, Mus musculus
ccacagagccccctaacaatcccggatatcaggacgtgtttatattgagtcacattcaagacctgggctggccccgggtgattttatacagcctgagaagtgcttgatcaaataaagtctgacccaggtgacttacttgggatttctgggtgattttgaaaactaatgtgtttttaaaagatgtaatagcctttgactttgtaaaactctgtatgtcagtatgcattttattaccaaatacagaatgtggaggacctttagtagtttttattttcagttcgccaaacttcctttttgatgtaaggcatgtgctctactttggaaggaaatagaaacaacaaagaacctcctgcccagacggctcacgaacatcccctccctctccctcaatgggccaaataatattggtgatttaaaatgttgatgaattcatttgttctatttttagcgtatttttagcattccagaatttgccagctctgttcacgtgatagagaaggcctccctggcttagattgtacctataacgtgtaggcgtcgtgtggtaggtaaaaagtgatcacaacacttgaaggtgtagagaaagaaagaacattccagcagctgattgggcttgtgtgagcgtttgatgccggcccctagctcctgtcacctgctctggtcttccttgcctctcgcgcgtggtagatccacccctgcaggtgagagccaccaccgccactgtttctaactactgtgccttttactgtccaatctattgaagactgattcctcatcctgcgtcgctgttattacatgcaaagcataaagtgtatttaatttgaaacctggttcaaagcgcaagtctttttttttttttttttaagcaccagcgctccagcattgtgtgcttgtggggatctgtaactggattgctgatgtttctcaggacaaattagtccttttttccagccagagtttcctggagccagggcatggtttctgcattacggcttcatcacagataggaaaagcagaagtgtcctcaggccagtgccaagaaatataagtcagtgcctttcagctgacaggcaggatgctgggcacattgtgcccacagattgttccttctcaggacccggggaaaggggcgcttgaaagatttaggacaaagtaagtggaaacctctagccagtcttagagaggggaaagaaacatcagcttatataatgtatgtaaatttgctaagccaccccatgtacctaccacattattgcctttactgttctcctgggcattgccaattgtatttagaaagtactttgagccaattctataatttaattggtcctcttttggggtacatattggtgcccactgtgcatgacttgccgatcttggctatgcttttgatgataacaaatccaggctgcggtgctgtggtctgtaagagtcaagctgctgagctggtgggctgcctttgaccctgaaataggacccgcgtgctagacgtgcatcttggctgaatgaagggtttattggtttttagtgtctttttgttcttaaaaaaatactgttatttgatttcttgtaaatgctgtgaatctctatttgtcattttgtatttgtatattaaaattaatttgccaagctggttctagtgatgcatctccatagtaaaagaagatagacacattatacagaaagcggccggctggggcaggcacaaagccctgggtttgattgtcagcactgcataaaactgggtgtgatagcacatacctctaattccagcgcttgggaggtggaaggaggaggttttctctggcttcgataaggggttcaaggtcaacctaagccatatgagactctgtctcaagaaaacacttttaaaaggcagcagatgctggaatttacagatcctttcttgccttgagcttggtgcttcttcctaaagactcattcctgatgggtgggagggaatcactgggagttgttggagaaaggctcttgaggggaggtggagaggggccattagagtagtctatgagtcagagaggaca

SEQ ID NO: 22778 - DNA, 1187 bp, Mus musculus
attccccagtgctgggcttatatgtgtgtatcaccatacctggtttattttagcacattttactttttgagacagggtctcatgtagcccaggatggcatggactctttacattgctgaggtcaagcctgcttccattgcctaagtgctggattgcacacatccagtttgtacagtgccgaaggccaagttcagggttttgtgcatggtagccaagtactcagctgagctacaccaccccagtccttctcagcttctcgttaagtacacatttacatcttatatatttgtctgaaaaaaaaagtgttgcttaataatttttttcttggatattttctttatttacatttcaaatgttttcccttttctaggtctccccttcagaactcccctatcccataccccctccccctgcctctgtgagggtgctcccccaccttcccacttccatcctcctgccctggcagtcccctacactggggcattgaacaccctcaggcctgagggcctcttctcccactgatgtccagcaaggccatcttctgccacatatgtggccagtgccatcggtcactctaagtaatacactttgtttggtggtccagtccagtctggcctgttgacactgctgcttcctccatggggttgcaacccccctcagctccttcagtcccttctctgtctcctccatcaggtaccccagagctcagtccagtggttggctgtgagcttcctcctctgtatttgtcaggctctggcagagcctctcaggaatcagctatatcaggtttttatcagcaagccctccccagcatccacaatagcttctgggtttggtgactgtatatgggatggatccccaagttgggcagtctctggatggcctttccttcagtctctgctccacactttgtctccatatttcttcctgtgagtactttgttcacccttctaaaaagcactgatcacattttggtcttccttcttcttaggcttcagtgcttaataattttttaaaggcgggtcacatgactcacctgaagcccatcataagccctgtatgaagcctggcttgtttcttcctgatagataaccgaaagatcgtacctgggcactttctgattggcctcagagattacatggatacagtttatattttgtcctaaaatatttgtggtgtatgctggg

SEQ ID NO: 22779 - DNA, 1104 bp, Mus musculus
actgaggctcaatgactgaggagaggcaatgttcactggccacctctgtttcaggcggccgtgaatgacttagctacgaatgctttaggacgccccacactgaagcagtgtcttcaaatggtcctataaggccaataaacaaaagaatcattttttaagtcattgtgataattatgggttacattctcatttctcaagtactcagtaaaatttgtattactttcccagaggacatagtatgggatgctggggtttgtgacactattctcagtagctatttatgaacaatcagtttgagaatgacccagtggcgggtttaacgtagaagacatcattttttaagcttttcctctgttgctgttttaggatgcctgaaggccatcttcctgacgtggaggtgtgggtctggacaagcctgtgatgaggcctacagactgagcagtcttggtgtctggaagcaaaaataaatctgaaccaaactgacaacatttccatcctttcagccactagcttctgagccagaccagctgtaagctgaaaccccagcaagaagcaaggagagactgactgtaggcggccttgggacatgtgcttcttccctaagcgagaaccttagctggggccaatttgaaggacccatgggtggaatgtgctgcctgtgagcttgtgggcacagcaggacccagcctggctccttcttatgtccacggtgaatgtggtttcacaagacccagagtataaactttcatagacattctcttttagaaataatccattaccctgtgaaaaagccttagcagattcctttcttagattttaggcagagctctggcggtttctgttgaagaaaggcactttctaatcagcagaatgctatacttcagtggtttaaaggggcttcgtagccctgcctgagtcgtagtttggtgaagtcgactggcctatctgttatgagcagttctggcctcttccccacgaaggtacaacagcactggcaggagaggaggcctgagttattgaaagtggcggtgaatgtggttaagaatttagcaggttggggggagggaagatagaaaaggagagggcaatgctttaaagttaaaa

SEQ ID NO: 22780 - DNA, 1140 bp, Mus musculus
ggcacctgcgacagagataggtatatgcaagcactgtcccaggagaagccaactcttgaattaccgtatccctaattgcatggtcacggcaggagaggtaatgggacagaaaacaggtgaaattttagcctgagcaaggcagaccagcacaggggtggaggtcctgagttgtatctggggcttacagtgacatattgggcactcattcgcttagttatatcccaaacctatcaccacctggatattattattattattcctgttggctggggaataaaacagagtcaaagagaagatggaagttatgtcagtgttttatatttgggaaccaccactcataatttacttccattgcacttaataactaattttgctatggagtcatgtctcagtccttaagaccactggaaatatgtgtttcctggtgcaacccatgggttgggaactgttgttctaggcacacttgtgagcgattatttcccttaggttagactctggacgtgcccgtggggaatgttcttgatgtagttaactgaagtgggaatacagagtgagcaccatcgttcacccgcccatgtgcctagcgtgacctctgctgtctcaggctcctgccaccctatgtctgccaccatctttaagatgctttttagcagggagggtgttttatcacagcaacagagaagtaactatggcaacaggggaccagaggttctttcttgtgtttaaatcactttgcggcggcagggccataagcttaccctgtaaagaaagaagttttctatttagacaatgtctatttatgaatttatgtcacagtgctggctccaagcctcgtgatgctaggcagtgctgcccaccaagctgttctttcaggccacctcttattctggctgcagtctcactatgatgtccaagctagtgattctctgtctcagcctcctgagtagctgggcacatgtaagctgtggagagatttgttctctgatgtcccgaatctcctccatctcccattgggcatttcctaacgtacaaagctattcccaggccacactaattttactagcgttcttggaacccctgcctgcactgaccaccacactggttggatcgtgcctgattccctataaggcagcagctctc

SEQ ID NO: 22781 - DNA, 1147 bp, Mus musculus
tttatgtcaagttttgttactttatgttgatcaggcttgggagaacttggcagcattcactgtatatccattgagttggttctaatttgcatagttacaccaaggcaggctacttaacagtatcactgtaataacatattgtaggcattcctatgaggaccagatcatatagacagaaatgatagtccagtctagtgcctaacacataacttcctgcatgtggaagctgttgtgatcactttcgttggagatccataggtattttaacattggaatgtcagccacagacctccccttttctcttgtttccctcttgtgtgacccctttataaatgctgtttctctccttgaagcttactccacagtgaaacattgggttatcatctttgttctgcaactgtaggttctgtccaacaattcgtagaaactttctgtttgtccttctgactatggatctgctactgttgtactttcttgtgatgttacttcacttgtggaattaactgttgctgtggcactctctcttcatatgactgtgacacttagctgctgtgggcttgtagtatgagttagatggctttccatgactgaacttgccatgatagtggtcagctgtgattccaaacatgtgtgattatgagctgctgtttcagtggcttccatccatttagggcccctctctgttctagtcttggaagagcacaaacttgtgaacctgaacgcttcctagtttcaggagagcaatgagactggtcagacttgtctccactgtatcccacactgtagaacacactatataacactttaaggttcatgctcagttattgttttaaacctacgagaacactttctcaatctgtacttatctacccagcatttatcttgctgggaagacttatttccatcctgtgctttgtccgttaatttctttgtctgttcttggtgattgaactcaaggcttcatgcagctaggcaagtgctttaccactgagcaacatctacagctcctaactcactttgaatccatcttttaagtgatacagaaaaaggaaaaattgcatgattatatggtatgtgatatacacattatataatattcaaatcaagttaaccacacctgtcttttaaaatattttccacttcttga

SEQ ID NO: 22782 - DNA, 1100 bp, Mus musculus
ctctgcagtcataattacttggatcaatatgtctacttcaaataaaactagaccattttttgataacttactacaggatgaattacagcaccttaaaaatgcagattataacatcacaactcgaaaaacagtcgcagagaatgtctacagactgaagcacctgctcttagaaattggtttcaacttggtttataactgtgatgaaactgctaacctttaccattgccttgtagatgcagatatccctgtcagctatgtgactcctgctgatgttaggtccttcttaatgactttctcttctcctgacactaattgccatattgggaagctgccttgtcgtcttcagcagactaacctaaaactttttcacagtttaaaacttttagttgattactgttttaaagatgctgaagaaagtgagtttgaagttgagggactgcccctactcattacactggacagtgtcttgcagatttttgatggtaaacgacccaagtttctaacaacataccatgaattaattccatcgcgtaaagacttgtttatgaacaccttatacttgaaatacagtagtgttttgttgaactgcaaagttgcaaaagtgtttgacatttccagctttgctgacttactctcttctgtgttgcctcgtgagtacaagaccaaaaactgtgcaaagtggaaagacaattttgccagtgaatcttggcttaagaacgcatggcattttatcagtgaatcagtaagtgtaacggatgatcaggaagaaccaaagccagcatttgatgtcattgttgacatccttaaagactgggcattgcttccaggaacaaagttcactgtgtcaaccagtcagcttgtggttcctgagggagacgtgttgattcccctgagcctcatgcacattgctgtgttcccaaatgctcagagtgataaggtttttcacgctctgatgaaagctggctgtattcagctggctttgaacaaaatctgctctaaagacagcgcattagttcctctgttgtcatgccacacagcaaacatagatagccctgcaagcatcttgaaggctgtgcattatatggttcagacgtcaacat

SEQ ID NO: 22783 - DNA, 1319 bp, Mus musculus
tgacaaacgatgtgcacacattggaagcttatggtgtagacagcttgaaaacaaggtaccctgatttgcttccttttccgcagattcccaatgacaggttcacatctgaggttgccatgagggtgatggaatgcactgcctgtatcatcataaaacttgaaaattttatacaacagaaggtgtgaacgtaaagaaaacagcagagccagctcttgaatgtgttatagcacaaacacgaatcgctacactccattcagcttcattcccagtatctaggaattgtgaagcacacagcagagtgttctggaagcatttggaagctgtatgactcttaacagaaaccgtaacacaaatgaaacctgattttgaagttaacagtgagctgcagagtttctaggtgtgtttaaacaattgggtggcacattattgaactgcactttatgtaaccaaagcttagcagtttgttagataagattctgcacatgtctctggttaggagggagttaattttatgtttttaaacatgtttttgaagtagttaaaggaacactggacagactgatttatttggacatgtgaggggaatttttaagtggacacttttagatacgttattttcttatcagctggatctgattatggatttgttcagtttcccatctttcgttggacatttaaagtggtacagtattcaaccctgactattacttgactacgagtgtgaagatgggccttggagcgcgctggacgcactttccatccttgttttgagtttttagaccttgtgtttgtgggcttcctgactcgtgaagataaccgatggaagtctcagagtgctgcctcacactaccagatattgcttctaaaaatgcttcccaacatgatatttagcaaaagagcattggagtttgtgtacatattttccacagatgacataatttgtatagtgtggctgaacaggatgcaatcttttgtctaaaggtgctgcagtgaaaaaaaaaaaaccaaactgtctttcaatatggcacttagtgggaatttaaacatttttaccttatgcacattaaaattgctcaaattgttgaggtgatagacagaagtttacaaagggaattatcagcttgtactgtcccccacgaatgattgagaactgacatttaattttcataatgttcaaaagatctaacatacataatttaacatattcttttgcataaagtcaaagaaaggaaataatagcttatgtaagtacactggctgtaaatgatgctaaatatattttatgcagttaagggcttacatacagaacatgatttttt

SEQ ID NO: 22784 - DNA, 1217 bp, Mus musculus
tgaggagggaactttagtggtcgtggtggctttggtggcagccatggtggtggtggatatggtggcagtggggatggctataatagatttggcaatgatggaagcagttttggaggtgatagaagctacaatgattttggcaattacaacaatcagtcttcaaattttgggccgatgaagggaggaaactttggaggcaggagctctggcccttatggtggtggaggtcagtactttgctaaaccatggaaccaaggtggctatggaggttccagcagcagcagtagctatggcagtggcaggaggttccaattacatacagccaggaaacaaagcttagcaggagaggagagccagagaagtgacagggaagctacaggttacaacagatttgtgacctcagccaagcacagtggtggcagggcctagctgctacaaagaagacatgttttagacaatactcatgtgtgtgggcaaaaactccagtcactatttgtgactaattgcataacaggttcttttactttctgttctgtggaaagtgtaaagcattccaacaaaaggttttactgtagacctttttcacccatgctgttgattgctaaatgtaatagtctgatcatgacgctgaataaatgaataaatgtgtctttaaaaaaaaaaagatggaggcaggctgaccgttcacatctgaaaacgatcactgttctgtcaccaaagtgggtttatagtttgattggatatgagattgttgtttggaaataattctccttaggctgtgtatatgtgttcttgggtgtgttcttattttgaagtgattttagactcacagaggaggagtcaagccatgtagagttctaccctatggctttacccttttccgctccatgttggcatctcatataggcacatattgtccaaaggaggaaattaactttcatgtgctgtgcttttctgcactgcaaactaggtttcaccagtgtctccaaaaaaatgtcatcctgtttttccaggattctacactgcatgttgggtgttctaatctgggctgggtcctgggtctttcttggtttctcatgacattgacattctgcagaatgttgtcgagtttggatttgtctgaggctttccttgtgatcacagtgagtcagatttagggaaaggacattgccaaggcctttgtctgtgcatcaaaccagggagatatgaagcctata

SEQ ID NO: 22785 - DNA, 1230 bp, Mus musculus
ctctttgaaggtccgaggtgacctcactaggtcctcttgagaacagtgcaggggacagagcagtgttgcttccccaaggaaagatagcgccttcactgtctaagctgacatggcccatcaaagaggcaccacgccggagcctacaaacttctgttgtaagactgttggtgctgctctagagaaaagctgctgtaactccgagttccaagctgtgcctgtttcatctcatgtctcctccccgcaggcactttgtacagattgtcctgtgcgtgtgtgagctctatggctgctggatgaccttcttccccgagtggctcgtcggaagccccagcctcaacaccagcagctggctctacctctgggtctatttggtgttttttaatggcctgtgggttctgatcccaggcctgctgctgtggcagtcatgggtagaactgaagaagagagattcccaagaggctaatttagcgaagaagcataaataagttctcagggcaacccattctgacgatctgctttccgagtcagaattgaccagacattccgatctgtgctccttttttacagtgttttgaagcggccattacagatgggctggaagggggcaaacttggctgtttgtttttggttctttgattaaatgatgatatgaagagaacttggggtgtgacttagtagtgttgtgcttgtctagcattcacaaggccctgaattgttcccttaacacgactagggggtgctgagtacgttctcacctgtcacagatcatatttaatgagacgctcagtcatggctggcaggctagttatgccgtgttaataagtgagtgtcaaagatactgtaaggagtagcatcaatgtttactccaaaaaaaaaaaacccaaaaaacaacaaaaatcaaaaccctttttgcttcagcttttattcttctctgtggtctcggggttagtgacggaaaccaaaagcaaaaggagttggttctgtgttatgcctacaaacttcaaattgcttcaaatttgtgtgcccaacagagaacgatagtggtaatctggagtagtggcgtccaggtgtacttgggaagctgaggccggtggggggcttgaggctccttggggcgatattgtaatattcatttgaaagaaagaggcagaggagggagactcgatgtaaggggcagagggtgggactgtggcaacacacaagaaccaaaaaaatgtggtaaatcttaac

SEQ ID NO: 22786 - DNA, 3038 bp, Mus musculus
taaaattcattcagagtttctcctttgttttcatagattgatgaagatcctagcctcattccagaagcaacacaaggaggtacttacaattttgacccaacagccaaccttcaaacaaaagaatttaatttctaaggtcaattaagtgcagcatctttcattcaatatgaaacaccaccagatggccaccaagcgataagacagcaagcaacagaaggctcccagcactcttgcctcttcattttgatgcttctaaagcaagccatgtctcagtcactttgcagttgccaaaagtcactctcacatggactgtaaatgcatatgcatgatttcctaaactgttttagaattctccttaaccatctcaactcccctatattttccatgttccctggtgccacatgctgacaactgcagtctccagttagaatattccatagtggtggtatatcagctgcccactgatacgcctttggaaaaaggtgcgctgtggatcaagacactttggtatgatgtatattcatgttggaagactacagaggtgcagtgtgatctgagcctccatcattgtcctccacaaacatattttcatattcttatgtggaagaattaaaagtacaagccaaatgattttcattggtgaaactgacacaaaagtaacttaaaaacaagaaacttggttgttgattaaaaagataagttttttaaaactgtacttcacctaccattaattgatgtgtttattatctgcctcagaagccagggttggaggaagagctttagatatcaatggtaatgctttcgccattatacctaattttttgagaacagcaaatcctatttgaccactcacttcagcctgtgtgttcctgctgttttgaataatcaaatgctgtgcatggtctctacctgagctgcaacctgttacagacttgaacttctgttaagttgaaagcaagagtccttgactacaaaaatacacaaataaataagtcaaaacaagaatggaaaaggtttaaatactgattggtaaggttttaagacaaagtcttgctttcagcttccaggggttaattttatttttgttttaatttgataattggatatggttgatttatattgggtttaaactgtggagctttcatgtttactgtaatttagtcttaaaatattttttacttagtaaccagtacttttgataatgtggtggcaacaaaccagcaactatctagaagtgttacaagacttcattcttgagtattggagttcattcagatctcactcaaagcatctgcacacattaaaagataaaccaaggatctgtgtagaggaatggtctgcagttatttaactcagcctgatttgcagtgatcttaagctctgcaaaatctggccttactatgtaaagtcattgcttatggcaaatggtctgacccagttattaatgaatgaatagggatttgaaattttttaaactaaataatttgtgctgtcacagaaatggttttgttgctcttgttcactgggtataatttcccaatgcattgatgtgaagggatagaaatctaaactaagatagttttcagatggggggtgtatttactgtgatgaagaagagacagatgccatcagagctttgtgaaacagctggggtgttttcactgataaacaacacatagcaggtgtgcttcattacaaatatatgtatctgccaaggtggagccactttaaagagtgagttttgtcttgtatctaaaatggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgccttttttctttacccaaattttgagttaaagcttcatatggtaactgcatcctgttcaaacacttgtctaaattttgaaactgtgtagtgttcactaaaagtaggagtaacaaagtcagaatgaattaaggtcacacactctggtgaaacccttaaagtcacaaccttcttgatagtgtgaattgtccccttccagttacttccttctggtctctccctacttaactgacagttaccttttaaattttgcacacattgagattaaaattgggcttctactgtgatgattcctatttcctctcgcgtcttaagtgcaaactaaccgttaagtaacgttggcatcaagtagtgcagactccgtgcctctgcttgagcggtttgccgtgacctgaccagttttgagttggaatcacaccatttcgtagataaggaaactgagtgtattgctgcacttttaagttttcaaaacagtgttttaaaattgcattgttttttttttttaaactcagtttaaaaaaagactaaaatgttctttcaaaagaggcatctaaacgtgttcctaattttgtatatgggcttaggttttgtaaccaataaaaaagctgctatcaaatatgataaaacattgaaagacttatttctggaaataattgtttagctttgttttctgtgtggttacatttaagttttgtttatcttcaaatgccagccacagtggtggtgaagcatgagtgactgtattttgatgtttcctttctaccataacactgaccaaccagtagctactgtagagagtatgttttgacaaatcagaagtaccaacatgtgtgtaatttcctaagctgccataacacagaaccagtgaactaggggcttcaaaccacaaaaactgtggtgcagttctggcagcaagagaagtcaggtcgagctgctggctctgcagggctcccgtcctggctcagcctggaaaggattccttcctggcttctggtggagactggcaatcctcagctcatagttcatcacaccgctctctgccaatttgtgtattgaaatgctgtaacttagaagaaaaccccagttattttgaaaagatggtgtg

SEQ ID NO: 22787 - DNA, 1114 bp, Mus musculus
taagctttcattgattgtctttcagaacaaaagagacgaacacttactgaaaaagagaaatgttccccaagaagaaagcttagaagattcagatgttgatgctgattttaaagcagtaagttgcctgtgtgtttataatgtacctctaaatatttttgttataaaaaggggagcattagtttaaatttaagaaaaaaaagataatagtgataacaaggcatgttaaatcattacctgatagactaatagttttgttaatattctctgctgaactatctttctttctttttaagcaaaatgtaacactagaagctatattacaggtatgttattaatttaatactgtcattctgaaatgttttgaaatagtttctttttttcttcttttaaatgtctgaaatatacacttgttgttgcagaatgccacaagtgataatcctgtagtccagttgagtgctgtgcaggcagcaaggtaagagaaagctgcacctccctgggatggcacagcttgctgcgcggaagtgggtagtgtgctttgtttacggtcatagtctgggagacatagcgattaatttcttttcttttcttttcttttcttttttttttaataggaaactattatccagtgacagaaatccaccaattgatgacctaataaaatctgggattttaccaattctagtcaaatgtctagaaagagatgataagtaagtttgaatttgcctactcactttcttcagttaacttaaaatttaaaattgatatttttaccaaagggtttgatgatgttttgcatttagtaagtttggatttgttttatttttgaggtgctgtaggccaaactcgtcccttgagcattcaaagcaggttcactgcactgagctatatatctttagccctctgttttttaaattgtcttatatttcaatgcagttttcttcccttgtgatggtatttaaacatcacaaatagtatttgagtcaccatttgcctatgagtctatatatagattagcctcatggctagtcagcatgaatggtttccagaaccatgtggcttgtccttaccctgggaatagtccagctgatctctgaccctttggctagtcttgaat

SEQ ID NO: 22788 - DNA, 1233 bp, Mus musculus
ccgagtgctgggaagtagtgcctttctataaagttgggtcaatggttttctacccagagatcgccgagcccgctgggtcctgaaaagtaggcaaagtggtgtgaagggttgggctgtgtttttgtttttgttgttcttgaaaaatgcaagtaacaacaacaacaaaaatacagcaatccaaactcggcgcgtgggcgtcaccagagcacttatccagaggctgggcgacctaggtggtgcgcaggcgcgggacagcgggaagcagagggcgtggtcgccgtgtccattttgcaccggcgcagcccggccccagttggctggtggaggtgagcagtgtgctccgagtagggaccgggggccgggagtcgctggccccgctgccgcggccgggggacacctgcgtgggcggtgacgggcggcacggcctggcggcagcggtgctactgtcgcggtcgggaaggtcagcgcgccgctggggaggccccctggctaggagggggccaagaatgcagatctgtgcctgtgacactctttctcctttctctacagtgttctccagttttaccgtcaaaacgtgagggaaaacgaactggctctctccacagaaaatatagtaagcttgccaaaagcatatacttgcctggaacaaaggtaaaccgtattatttttctttatgttctggtatttatgaaggggaaaaatacccgattttattagtcctaggaccattccagatggaaataaaaagaataagtatatcttcaccacctcctttaataatagggcctttgttcttttcatatttcaaaactcatggattcaaaaatccatgcttgccattcatttttttggtaattactatatataatttaaaaaaagtatgctctaaaggaaacaaatccagcaacatttcttctgtgtggtttgtcttagttgtccagctactggggctgtagagcagggctttagattcctgcagctttctagacatttgtatgaggagtgcttttaaaacagaatgtcaatatataggcattctttgtgctaggactcaatggggctattaatcaattatgccccccccccctttttttttgctttaaattacaccttggagtatgctatcacagtctacccgggaactacacctctgccctatttaatgctaagcatcagtttcacacagcctaatatcacctgaaaacaatctgaactgagtaattgtttttcaga

SEQ ID NO: 22789 - DNA, 1144 bp, Mus musculus
agttggcaattacttattttagctagtttttggtcttaatttgtctgttcagatgtttttagatggtggatatgatagaataagtctggctggcttcaatgtgtttgtagttctctctcaggttcttggtttgtatctttagatgtccatccatgtgacaatatactttagttcaagttatggcctcaggattctagagtctcttctgtagccattttctgatctctccttttttaaactagatgaaaaagcatagttgcccttaaattaaaaaaaaaaaaaaaaaggtgtgggggagaggcgggggggtggggggggggaggtgtggtgatggtgcttagtgggagagtccctgcctggggtgcactgcgaggccctgggctctatctgcagcactagaaatgcaagctcacattctccttttctttagttcatccactttttatatgtatgaaatccttttcaatttgatctcagagggaatcagatacaatagttttagctcaatgagttattgtaagaacattctactttttgtaagtacctactacttgctatttgtatcctagtacttttatgatattctgtgactttctgacaaataatttagatctgaacttggaagatgaagtgctttactactgttaaaattttgtaccaaacacaataaacctttcttgaaatgtgttttgtagcttgataatttttagctggttgttgttttctttgccagtaaaaagtttctgaacttggcatccagtagtcaccatttcagccatgccctcagttcatgactagggctgtgctcaaacattgttttacccccaagaaactatagagtgtctacctgacactaacctaagcctcatgtcacagttttagaacaatgggaagtcacaaaaatatccttgttgacagatattttctgtgctataatgccatcattaaagcaaacatgggtatatgtgctgacattgtagaatacttagtgggtgggtaaagggttttgcattttcaatcagattttgactactatattttctcttcaataacaggtagctattgatgaaaagatagcaataaattggagtcttagcattttgtaccttcaaattttaacctgaaaaggctggttgacaggaat

SEQ ID NO: 22790 - DNA, 1164 bp, Mus musculus
taaatagccttggctaagctgtaaagaaaactaaaagggtcatgttatacaaccacagaatggcctagaaccttgcctctaaaagtccagcttggaacacagcagggatggggagtggggctgtttctatgtgcctagaggattaaaagccactgggggagggaaagatgatggggggggggaactctacctaaaatatcatgtttacactgagactgaaaaaactgcgtcatcattatatttaaaacaatggggcatttacactaaatttagaacaaaacataatgctaaagaaacttagttcggggtcagtttttaaggcacttgttcactcttctagtaaccatatttttggcggggggtgggagatggagaagaggttcagtagtcttaatgacttccaaaatttgctagatgaagacagatagcaatggtggttatttacattatggatatatttagtaccacaaagttgaaaacttaagatttaccacaatttaaaacctaagaggaaaaaaaaaacccttactcaaattgaatgttaacacatgtgaaagttttgatttagtatgcagttttaaattggccagtattattttagctcatgaatcacctcttactctgcctgtgaagtgtgtgtgtgtgtgtgtgtgtgtgtttatgtgcatagaataggtggttatgacctgtccgacatagatgctaagaagctagtaagtactcataaccactgagttatctctctggacccgattccacatttttaaagcatacatcatcaaatgcccttgtgaagaacattgactttgccatcttcactcctggggctgtcagcatgcatgcatgtatgagtactcactattctgtccaagttcccaattccaatcagagatggaataaaaatgcacaattaaaacactataacagttgagataaagaaaaatagtttctctctgaaactattccctaccaaaacatttatttttaagatatccttactagaggctggtgagatggctcagtggttaagagcgccgactgctcttccaaaggtcctgagttcaaatcccagcaaccacatggtggctcacaactatctgtaactagatctgacgccctcttcttgagtgtctgaagacagctacagtgtacttatatataata

SEQ ID NO: 22791 - DNA, 1144 bp, Mus musculus
acggaaaatagactcgataaaggcagagtgcaccctggcgcagcctctctgctccttcaaggaggccccgagtcttttcatgaccattaattattcacattttctcttccttccctcaaatacttggtttcctgctcagtgctacagagatgcgtatgtaaccctagtgcccaacaactgttttagagctgtgttcagggtcactctcagagaacatcagcaagcacccatatgttccccagagctgggctgctggggctgaacttcagcctctcctgggtctgggttcatacaacctaaaggcaaggccttgtcttccacctgcttgatcttggctgcaatgcttttcagcccagctctctctcccaggccaggcagcctgccctttgcagagctgcaaacactccaccatccaggcaggcttcagcctttgttcctgctctctgggaaacctttatgcatgctgcagcaggagatggcataaggctgagggccctgacaactccaggactctttgggaaatttagcttccactccctgtcttcctcacacccagactctcctgtctacctgtgggcttcctagaaatttctgttctgtttttatctcctgggtatactacctgtggctctggcctgtggtgccctccagtcactttaaggtgacttaagtgtgagccaagagggcttctggcatgcttgtcctcagaaggaatctggagccagaggaaagaaatgcaaataagtatctgagacacaaagctggtggcttggaatgggtcatggagaggaggaggagaagatggtgtcagtgtgtccagacatgtgctgagcatacagttaggatataggtagagcagagagaggagtttcagatgctcacaggtctctgccagatctgcctctgcctctctgcctctctgcctctctgcctctctgcctctctgcctctctgcctctctgcctctctgcctctctgcctctctgcctctctgcctctctgcctctacctctgccactcttggcagggaactggctctcatgtcttgatttcctttttaaaattcaggccacgatctcagccacttcaagggttgaactgggactaaatgagcttgtgtactcaaatctttacaaactaactc

SEQ ID NO: 22792 - DNA, 1794 bp, Mus musculus
agtccccctcctcaaactacataagcagctaagggccagagcatcatagcccctttgctcctctgtggcctgaggtgtggacctgactacctaaatgtatagatcctttggtctagaaccatctgtgagtcccagagctccatcacatgagcagcatgtgacgagaactgatagtttcagatgatgctgggtgtcaggtagctcaccctggctcctgtggtcccagcacttaggatgctgaggctaagggtggagtgtgtggccaacctgggttacagagtggggcatcctatgaacatagtaagggttaggccaagctcagagcatactttgaaagcatctactttttctccatcccaggcttctttaaaatcctcagaggagagaaccactgtggcattgaatcagaaattgtggctggaatcccacgcactgaccagtactggggaagattctaatctgctttgacttcattgtccagtccttaggggctttttccaaaatttagcggccctggcagggaatgaggtagacaggggagtctttgattctttgagttcatctaacatgcatgaagcttttggcaagatttggacgactggaccagagctgcctgccatcagagctaccctccaaacactgtccttacctggcctcctcctagcccatcccacgacagtgatcacagtctgcatcctagcctctccctagactagtgcggtttgtagtgcctgctgttgtggctctgcctgccatacctcccacccccatccccatcccagcatccgaggacccaagggctttgactgcaggacttccaaaagaacgaacacttcacgagaggacaaatgccacctctcagctgcatcttgaagctggtcacttctgggtctgtggcaggcattcgtcaatggcccagtgcagttctctggagaaagctaccttttcccaaggcatctgcatccatcgacattggtaatgtggccagctctccttggtcctgtcctcagccgatgctttttcaataggatttttatgctttgtgtacctcaaccaagtatgaagagctgtactggttttatagatcacccccaattgtatggcttaaaacaagctacatggtcatggtttgctgtgtgaccgacagataaccacaatgaaactagtctggaaaaaaaaacttgctttttgttgtagttaccacttaaccctgtagtttaacaaggaatgtctgtgccaataaaccaattctccctctgcttgacattggcagggtgcacggttctgtgctgcagtttcaaggcttttgtctctccccctggtttcctgtcaccctcagaaatggttctcaaaaccgtacctgtaactgctcacacctcggagcacttcctcctgcttagagataagggagctacacttgtttaattaaccaaggcgggcactcacatacatatgacccggactgccatcttcttagaggtcatttccctggagtgggggccaaagcttgcgcaccatgtttaagttttctgggttactggatttcatggattttacaaaaatcatagtgaagtacagttcaaagggaacagggagcctcactcatcagcgttgtcctatggatctgttacttcctgctaagtgagagggaggggctggtttctctggaagcccgccttcccatgtcggcaatcagaactatatcaaagaagctctggatgcctggcgagtgctagaagtgtaactcggtttgaggcaacctggcttgggtactggggctttagtactgcaaga

SEQ ID NO: 22793 - DNA, 1119 bp, Mus musculus
tcaccataatgtgcctgcatgttcttggaatggccagcaagtgatacagggagtgtgcctttcttgtggcttgatcccccaagggtgggagaagcccttgtggtctgtgtcccactgcagagcctgaaggaaaaagtcgtttccctcagggttccagcaggacagagttcctgtttcactgggtacttcttgttctcatttgcttcagttctataattatatttaaaattttgaaattctaaaggccactaaggataatcaggtgccctgtttgaggtgtttgttttcctgtcctcactgacctgtccccttataaacagaactgcccttgccacagcagtgtggctagaaacatttttgaggaggcacagggacttgactcccgggagagtgttaaatggttccagtctttggctccaacttggatcagctgtcctagaaagaagagagttctgaaagaccaggctgatttttatgtaatttgaggagggaggagttagtagtcgatgtttatcagagatgacatggctgctctgtggccagctggtatgcccttgtcccttcctgagaagtgtgtctggcttctcttacacagctctctcacatgaggtcttaacatcacctgttcacagttcagcttcgtgataacagctcagctgttctttataaactttcatggaggggccagctgtggtggagcacacctgaagagagcctgaggcaggggcattgtgagttggatgtcaactggggcaacatagtgagactttgcctcaaaaataaataaagttttgctgtgtttatgttgtatgttgataacttttaaatgctcttctgagcttgagataattgtgtagtagtaatgtatttccaaaccagtcagtactgcgtttttctatggatctcgggcttacaaggaagacggcgctgggcagcagacatagagttaaactgaccttcttggagtgagaaagacactggcttcatgggtccttggggaacctgactatccagggaagcggctgtccatccctggcctgtgagttctatagggtcatgcatttctctctggaaccatgaagtgtgtcatccggtgtgtctggttgattgtttttgtgg

SEQ ID NO: 22794 - DNA, 1174 bp, Mus musculus
tctgtgtttcttgatcatctgtaagatagtacagagctacggggccttagtcaaaacctgccagctccaggctgggaatgaaaggggttttgtttctttttgttggtttcctttatgctagaaggccttggagtttagcctagatcgcttctctaacttcttcatctttcacctcagcttcccaagtattggtagctaactgaacattatttggcagcagagcctgatttgattgagagcgaggcttcatttgcctcatttggtttatatattcattcggctgtgttgcttaagaatagttgctaaggaatcctggggtcctaatccaggcttgtggtttttgttttctaaaacactaaaaagtatgatccctgctccctgtgtgacagcatggactgtagcctgtataccatccttaaacatttagaaaaggttaaaggtaatgtttgtgttgtgtttggcatgcagtgcctaatacgttaatagttattaacgttaaccttctcaatgtccaagtctgaggttcatgggttctgaggttctgagttacccatcttaaacaaacctggcttattaagaacaagggcaggactggcaggggtggacctggtagctgtcagctggagcctggagccccagtctgggtgggagtcgtctgtacccttgccctgaattcagccctttgagccctgttgccctcactggagagttaagggtgtgtacatagcttcaggcagcagtgaaaagctgggagactctagggacagtagctgtgacatactgggagtccccggccatgagaactttccactcagagagcagtcctgtcctcattaggattcttcttggtcattctagggacctgttgtttaaggtgacatgctgaaacagaaacgaaacagaagtgctgcggacaagacctgctgcttgtctgtttcgggtgttggggtggagagtgctcccctaagcctgttcttcaaacccagggccattgtccctttgcataccttgagagcagacgctagaccagtgggtcccgaccttcctaatgttgtgaccctttaatacagctcctcatgttgtgctgacccccaaccataacattatttcgctatttcataactgtaatttttctacggttaggaattgtaaatgtaaatctctgctttttcaa

SEQ ID NO: 22795 - DNA, 1326 bp, Mus musculus
atgtgagaccgtggggggttggggggggagacactggcgtcctctgtcgcctccccccccccagttggcagctgtgagagctgccttcccttccctgccccacgtgttttctcttctagggcagccccgccctaagctgctaaccagcgagggagacatctgcccacttaaaacttctgtcccaggtaaggagcacctacgagtataatcaccaggctctgacaaatgtgtatagaggtccagaaaaaggtgagcttagactgtaaggaagagcaaagcttcagcagactcaggagagatagatgacagtgaaagtagagatgaaagagattagagaggtccgagatgataccccgaatgagaaatatttagagtagaacgagtaagaggcagagaaggcgtattacaagagaagagagaggggggggggcaagaggcagaataaagagaaagccggagggatcgtagacaagaaagaaatttgactagaaacttggccacagtggtaggagagaaagaaaagacaggatctagacaggaaacctgggcaactgaagaccgagcctcagctaaagaggctcagctgtgtcagactgaagttacttatttgggatatacccttcgagatgggaagcagtggctaaagaaagccagaaaaaagactgtaactcagatccccaacccaactacaccaaggcaagtaaaagaattcttgggcacctctggcttctacagactctagatacctgggttggtgaccttagctgccctgttgtaccccctaaccaaggaagggaaggtgtttgtgtggaccccagatcaccagaaagcctttgaagaaattaaaaaggccctactgacggccagtcttggtctttgcctgacccaaccaagcccttcactctttatgtggaagagagagcaggggtcgccagaggagtccttgctcagactttgggaccttaaaaaaggccagtggctgggctggtgagatggctcagtgggtaagagcacccgactgcttttccaaaggtccagaattcaaatcccagcaaccacatggtggctcacaaccatctgtaacaagatctgacgccctcttctggagtgtctgaagacagctacagtgtacttacatataataataaataaaaatctttaaaaaaaaaaaaaggccagtggcttacctatccaagaagttacaccctgtggttttcttgcctgaaagctattgctgccataactctgcttgtcaaggatgctgataagctcactctgggacagcaaataactgtagtggcaccccacgctcttaaaagcattatc

SEQ ID NO: 22796 - DNA, 1470 bp, Mus musculus
aggagaggaaggtggctctctgaaagtttgtggtcagcctggtctacatattgagttaagggctagccatagatatgtaatgagaccctgttttcaaacaacagaccaaaaaaaaaaaaaaaaaaagtattgctctgacgctgtgccttttcttttgattttattttgtatttttttgagacagggtttctctgtgtagccctggctgtcctggaactcactctgtagaccagactggcctcgaactcagaaatctgcctgcctctgcctcccaagtgctgggattaaaggcgcctgcctttgccttccaagtgctgggattaaagatgtgtgccaccaccgcccggctgtacctttcctttggttattttcctgtggtactcttccaagccgtgtgcctgctcctcctttttctttaaaggttggtttctgtaattgcacaatacttggcaattttagcctggttacttcagaaatttacatttcttattgatgtctttatttctaattcccatactttaagatgggcattaacttaaaacgctctttgggcgttttggtttctggaactcgatttgtgattcagactggctttgaatgctgagcctcctggctgctgggattgcaggtgtgagcctccaagcccaattaaaatgcattttcattacaaaatactttatgcagacaagtatcgaaagttacatataacaggccactgcatcagtaatctgtcatatttacttcattctcttcatatatatttaagaagttaaatattcataaacacctaaaacagtagactccctgcatctgacattggcctgcctgccccattctcttgttcacctggctttttcaggctgtctcctcacactgtgggcttagaactgtggacacctgtctgggatctttttctccgtctttatgtcttgctgaaagcctctagaaactgggattgtgtgccttcccttagctaatgtttattagttcttggtgtgtgccaagcactattttacatacctcccatctgttatgtaaacacccagtaaccctttgaggatctgttttcctgttttgtagctagggcttagaggttagtgagttacttaacatcccatagctatggtgtggcgccctggaatttgactctcacaatctgactacagagcttgttcagtctatcttttttaaaaagattcaattttttaaaatttttttaaaaaattttctaagtgtgttatgtgttacagttgtctgtgagtttgtggcagtgagtgcagtaccttgttgaggccagaagaggccatcagatgcccctggagctggagttataggtgattgtgaactgcagacgctgggaactgaactccagtcctcagtaagagcagtacttgctcttaagcactgagccatctccccggcccctcctgagctctctatcccagtatgctgtccatccttaaggtagtg

SEQ ID NO: 22797 - DNA, 1200 bp, Mus musculus
taagctttttaatggccactatgccttaagatctccatgttgagatccaggtcagaaacctgtatcttccaggctcaagatcacaagtgtgccctccatttctggattgtagtaatcccagatgtggtcaagttgataactaggaatagccatcacagatctatatatacagcctggtggtggtggagcacgcctttaatctcagcacttgggaggcagaagcaggtggatttctgagttcaaggccagcctggtctaagggagtgagttccaggatagctagggctacacagagaaaccctgtctcgaaaaaaccaaaaccaaaaccaaaaataaaaaaaaaacccacaaatctattaatacataacagccagttgtgtgaacaacaaagtaaactctcccctatctgatatacctgggaagagcatgaaaacatattccaagaataataccacgttttgaagaaactgaggtcacaagactcttgtctggttttcttggagttttctcacaagcactcagaattgtcctcgaatgattccattcttggaccatgttctgacatgataggactgtcacaggccttctgatgtgatatcagtatgacctcctgacagagggatcacgttgtgtacctggcacactctaaagcctacagagcatctagaaggttctgggttaagtcatgctgggaatggttgtcctgcaggccattggaagagagggaggagaatgcccactaataggtactgctcttgggcactggggcttctgatatcgaagcagagtcaggtatcaggtcagctccaggctcttagaagccaagagaaagaagcaggtctctgctctggagaatagattagtgaaactgtgagcatttccagctgagacagggaatgctatagttcttagtacggggagggttattttctgcccacaggagagcaataaggggcaccacaactggctgttaaagcagttgctattggcaaagctgtgtgcatatacaaagtgtgacttgcctgccgtgagtatagttcatgctgaaaagatgtgaaagtgctgtgctctcatgggagaaccagtggagtctgtttctgtgccagaaggatgaacaaggtttccagcagtggcttttggatgtgcgcagagacctgactacacaatgatactggtgagagccagtgtgagtcaataact

SEQ ID NO: 22798 - DNA, 3167 bp, Mus musculus
tttttcttagtactattattaccggtacgggttagattttcggtgcctgcgttatcctggaatcatttctgcagattcccagcctggaggaggaacaactggtaggtgaaatctccagtctccttcatctttaatttctcttgtttcagggaggccctgcttagtccacaaactggcttagcttccttgtatttcaagagagacgggaaagttgggagtgtttttatctccctgccccccaaaatgcagcaactaaaaaattttctcatttacctgtacataacagtaaatcttaatgtagcctatctattcagatctttcttgggaacttaacatttttagtagtctaaagaggttctgtattaagaggacgggagaactggcatctcagtcctgacccacctccctcctgctgagaaaacccacgggccgggattctcttttagactacgccgtccagattttccacgctgcagcaaagaacggcacattcgagtgcaacctcgaggctggcaccaggctcccaatgatgtacatcagtgactgcctcagggccaccctggaggtcatggaagcccctgccgagcgcctgtccatgagaacctacaacatcagcgccatgagcttcacccccgaagagctggcccaggcgctccgcaagcacgcgcctgacttccagatcacctactgcgtggatcccctccgacaggccataggtgagcccgcacgccagtccactccagctccaaatcgccagcctagtggggaggctttaaggctgaggagctgcggtggtccatccgcggatgcttccgtgtgggaaacaggtcctcgggagaaaggttccagctcaggagagagtccgacccatttcaccattacctatggtctgcaacacccttctggataaagaatgtcccttttcaaagctctggggtgggggaggggggttaataaccccagtgcaggtgcccagtgaaagggaaagaatcagctcaggacccccaagaccaagttctccgcacaaaggagatttgccctagaaggacagagggcagggataagggacagagacaggagatagaaggagaaggtgaatggaacaagggagaagagagaaaatgagcaagggagagttataaaaggtgtttgctccagaggacaaaggtttgcctctggataaagaggagacacacatggcacattggaagatggcggtttataagggtaaaacgggaaactccgtattagggttgacgtgtttaactttaattgggtgagctaagggtggcttctgattgctggacttctgaactttgatagctggacctcggtaatcagccttaacaaggaggaattggccaaataagggaatagatcttggtgactagctttagtaacatagagagaagggcaaggcctgccagagccatgctcaccaggccagagttccttcaccccgtgtcttcagaagaggtggccttgtgtgtactagttctgctccagtccaagacgagagaagtccctctctcccttcacataaaatttgcctacccattcacaaatccagagtctggataagccagtgttctcccccatgtctttccccagcggagagctggcccatgattctagatgacagcaatgctcggaaggactggggctggaagcatgactttgatcttccagagttggtggctacgatgctcaacttccacggcgtcagcaccagagttgcccaagtgaactaaagaagaggagcggcccctgtgtcctcaaagtgcagggcgcacggcagtctctaagttggagagccagactgaattctagcctctcccaggggacagcttgcgtggggttggagttcctttacacactgcctttgtcctgtgcctaaattggtccaagcacaaaggccagagaaatgaagtcctgagtggtggtggctatctctcgggatctgcagcatttgtatttaattaaattcaatttaagtatcactcctgagacttattctcttgcccagagaccaaagattacatgttagggttttcaaagctgttcttcatgtttaagcctggaatactaattaaaaaaacgatcgcttgcaacttgctttttacttaggatttatctaggtgtttacgaatgtgaaaggtgatgcagttgttaaaggggaaggggctctaatggattctggttccatttggggactgctagaaatctcagtgatgtctatgggactttaattccctggcctggtgatatcggtaacctcaggttgtttgaagacgcaagtttctgggcttcacccccttcagactgacacggcaaagtggaataagctgactaaggttcagcccttttagggcccaagtgcagtttctaaagagtgctctcctgtggtaggagtgtactcaccaacagtagagaggttgctcaaaccctggtggctacgccttactaccttcagaaatcaccaataaggggaactaatgttctacagctataacaaaaaatagctgggcttctgctctaggttagtgatggtaaattgttatccatttttgttttaaactcctagtgagtggcatgaattttttttctttcagtcttaactggatttgaattttttttaaacaagagaacttttagataatagaatacaataatggctacaattgtataacttatttttcatacgcttagtataattaagcttacattgtggattttgtttcctaaaaccttttttaaatagatttattgagacagtatatataccttaaaattcttgatttggggtctggagaaaaggctcagcacttaggaaccttgctgctcttagagaagacctgagttcagttcgcagcatctgattggtggcttataaccttctgtagctccagtcccagggaacatgacacccttttctgatctctgtaagcactagtacatgcttacatgtacatgatacatacattttacacacaggcaaatactcatacatgtgaaaataaataaaaccaaaaattaatttatgttgttttccagtatattaaagttgcagtctttttttttttttttttttttttgagacagggtttctctgtttagtcctggaactcactctgtagaccagcctggcttcgaactcagaaatctgc

SEQ ID NO: 22799 - DNA, 1212 bp, Mus musculus
tgtaccacagctagactttgatgtcagagtgagccatttgcaaatctgtcctgtgttaggcaaacaggattgcgctggagtggggagctaggaaagtggcacagctgcttgagaccgtgctgtgtcagcagcagggctgcagtggctgcagtggtgcagtcagctctgggtgctgcacccttgcatgcctgtgggttggtgctttccagctgcttgctgttgcaaatgctgtcatttctagaaaagcatacttgcagagtaatttttaaaaccatgtcaacttcatctatatataataattttcctggcccctctttgaattgtgtatcaaggcaaaaatagaacctctgtgggtggcacccctctaatcccagcacttggaaggctgaggcaggaggatttaagtttgaggccattctgagctatgatatatagtaggttcctggcagcctacctacagagtgaggctaacacagagtgtgtgggccctgctgaagcactggaaggtgaccactgttttccatctccagttgccctgcctcctcttccttcctctttcctttgacctgtggcagaaggccaggcaccagtcagcagtcccgaatctgctcgtgggtttgcccactggtacttctaagctcagctctactcttgacctattatttggctcgttgaggagtgaagcacatgcaaggctgtctttctgaaggcctagtttatgtgaatttcaaagaagaaattgcctggattccttggggctgctcagtcaccagccccatctatcactctgccactgcccaggtttgtttctctctctctctctctctctctctctctctctctctctctctctctctctctctctctctttctctctctctctctccctccttccctccctccctccctcctttttttttttctgagccatgtgtgaagtcctcaacttctcagctgatccataagaaaaaccatctagagatttttttttcctttgtagttcttaaaaagtgattcccactgcaatggaccagtcttaaggcttctgtgcacagagatgtgggaaaattattatgtttggtcagggagagctctgttgcaccctcgttgtgcttgtcttcttgatgaacactcgctgtgcattcctgagtcataactcctgtattccagaacctttgccgttttctgtctcccatgaaaacagcagtcatc

SEQ ID NO: 22800 - DNA, 1168 bp, Mus musculus
cccaggaaattcaaaccctggctcccttcttattttagacacatccttcaggagcctatggttcccccttaccccatgcttttcataacatgcagtttgattcctgccaactttttgtctttaatacacatctctcaaacaagctctagactaaactacattttcaccattttcaatggtatttatcataccataaaacttccttcttccctctgctaccacgggcatcttcattcttcaaatgccatggatccctaacctctacttcttgatttccaagtgaccatttataaaagtaagaaaaagaagccaaacagtcaggaaggaaaacctggttcctgcaggtggcctcagagaccaggccaggcgttaacccagagcagtgcacaagccaggtgaggagttccccagcactatcttaggcacacagtgcccaaatctattatatattaagtcgttagtcaggagatacctattaattaatgcacagtcgccaaggtgagctttaagcaaatcagtgctttatttttatttattcttttaagatttatttgctgggcgtggtggcgcatgcctttaatcccagcacctgggaggcagaggcaggtggatttctgagtttgaggccagcctggtctacagagtgagttccaggacagccagagctacacagaaaaaccctgtctcgaaaaaccaaaaaaaaaaaaaaaaaaagatttatttatttcatgtatgtgagtacattgatcctatcttcagacacaccagaaaaaggcatcagatcccattacagatggttgtgagccaccatgtggttgctgggaattgaactcagacctctggaagaacagctagtgctcttaaccgctgagccatctccccagaccattatttttattttttaaaacaatatttataaatataatttaaaaaaaaaattaaaacacctagactatgttaatctactagaaggaaaagcattgccagctgcagacattatactaacacacggacaaaataaccagctcagaacaaaaggagctgaaccaacagccagtgcacactcttaacttgaggcacgaataacccaactccacctcactcatcttcaaagggaagagaggattttcacaagtaaaataaagggttgtgtcagttcttatcaccc

SEQ ID NO: 22801 - DNA, 1102 bp, Mus musculus
aaagtctaggtttccagcaagttccctgagctgtcctttgggtggaagggagtgagaagataattgtatcatctgattcatacagtatttacagagtagtttttaagagaaaggggtacattctaggtaacttaaggttgtttttataaacttaagccctgtgcaaatttttatttttaaaataaaatttttatttttaaaataaaatttttattttattttattgaggtagcatcattgataggggctctgtggatggttttagcaggttttacaaagatttattaatatgtattgtgttttaatgtttaccctgtgttctgtgtgtgtactgtgtgcttgtacagaggccagaagagctggaactggagttacagaaggttctaagtcactatgtggtgctgggaactgaaggtcttcagcaagagaagtcagtgctcttaagcctctgtaggagatttataatggaactttatttaaacagcagttggctagggttttttaaaaccttaaatggggttggtgaaaatgttagttatgtagtaatgaaatattgctggggccttatagtgtgcttaagattctgaacgttgttgtggggacatttgacactcacatgcagaaacattactctgctgacttagaattttctttggagttttgaaataagtcaggatctttatttaaacactatggcgattctcattctggaaaaccacaagctacaaatatcaggactgtggggggaaaagagcaagcagatgagctaaaactgtcaggtgtctaactagaccagtaataaaagtcatgaagctcagatacgtagcgtagtaaggctaactttccatagacctttctttgggctgcatgccttggtgattctaggtttcattaattctcgtatgtggaacccttttttaaaaaaatcaaaactgtgtgtgtgttcatgttctcacatgatgtgtgggaagaggtgcacattgctatagcatgcacacagaggtcaggcaataaatgttgggacttggttcccttccatcatcatttgaattctggggattgagcacaggttgaaagacttgtcagccgataaaggggtaat

SEQ ID NO: 22802 - DNA, 1165 bp, Mus musculus
ccttgcaagagtgctgtctggcagcagctgattattctggagccctgggtgcgtttccctctatgccccagcctcctgggagtatatctgctccgcagatacagtatctgcttagctacaactctgagtgggatgggtaatctagcaacacacctgggtattatttggaatcagagatggggagacctttcggtgtttcagggcagaccattgtctttaaattttctaaagctccttagctgatagcaccagtttatttcaatattatattggtagacatttttcttaagatcttatatggattctttacactttggcagaatcgcatagattccctttatgtacatagaagaagaaagatcttgctaaatgcggcagcccatgtttgtaatcccaccacctaggaagctgaataggaagatggtgagttcaaggtcagtatgggctacagagtgagatgccatcttaaacaaggactgagtgtagttcagtggtggatcctgagtttgacctgcctgatggaggttgtgtgtgtgtttcattttaatagtaatgtgttaatatatttgatgactactgctgtcatttgcccctataatcctgacctctgattgtcagttatacccccttctgtttagtgtttttgagtatggtctgtgctctcctttccagtcaggcttctgcacagccagacttgtagatttaagccagccttattagtcattatttctttggctgatgggagctatcaagaactttgaaaggctaacttgtgtttttttaaggtaaggacaaatgtgtatataaatggagtatgagcaagcttaaaaatagaaataaaataaacttcttgctgggagattatcaaacagctcttaggtcaacagctttgaaatgaggttgtctgattaggattcactttccagctgttccattgtgcttgccctctgtgcttcctggtgtagcatgggctttcagggaacattgtgtttacatgggtggaatgaaattagattgttctctggatgatcatgtactgagttaaactattgtcactcttaaatgactaaaaagtaagaaatcacagaaaattatgttcaaggttgcttcttttacacagctaatatgtagccttagaaaatacatttctaaagtaaatgtaaat

SEQ ID NO: 22803 - DNA, 1218 bp, Mus musculus
gggtttaggtttctcactccaaaagctgcatctgttgttcctggctaaatatcaaaagatatgaacctgacctagtcccagctttctcccctgcccacatgggtctttccgctttactcaactcccaggcatcatctacttctttctctctgtacctttctttgtggtaactggcaggacacagcaggagtgttctagagccaaaggtcatgagtgctattaatgatggctccagagagcagcagacagactgtctctgcaggagattccccttcttcaggccagcacctgtgtcaagggctaagaataggagcaggagcaggcaaggacctagagacacttgccctgggatgcccctgctgcatggagaaaatgtgtatgtccaggtaggagatgctgccctggctggtctccagcaagaatccctagccccctcctcaaactaaagtcagtcagcaatctctgttcctgccttcagggaggatggcttctagaacatcaccctcaaatcaaggagggaagatagatatgacttccctcttggtgactgggaaagcacctatctctctgtaacctttggccatttgtcactatggatacagatgagcagttggacatctgactctaatccatcctcaatgtagacctggggtcctcaggcttggaggcctgttttaccttcacacttcctaggtgctctgcctaaagccagaaagaccaggaagggccacaggctgatgcagggctccactgtgattatgaataactcacctcttggtgccttggtttctccatcagtaaagtgggcagatcacggctgctttccatcctgctcagaggtgctccagtgattcagtccgttgcctgtactgaaggagtctcataggaataagggtgaccctgtttctcgggaactagaagtatggaaaaggaggagattgcagatacacttgacacccaggagcccagggagtgagcagggaggacatgtcgacggagatagagccttggatgctcacatgtgccacagcaccgttaactcagtatagtagcatccgaccagggacatctggccacctggcacctgctgggcatctgtcacttcttaagtcccttgatgttagtttttcctgaatgaccagataaaatacaggggaatgtgcttctggaaatggctagtcacagcatgtctgacagacatcagatgggattggcaaa

SEQ ID NO: 22804 - DNA, 1403 bp, Mus musculus
tagcagctaaaggtgcggcggtggtccatttcccgtaggaagtcttggtagggaagagtgactgaaaggcccgtgagccttcagtccttaacttggattctggaggatgagcctgtggggtcacctgcatgacttgctgctggaatccacggcacatcgtgttttattgagctaccagccgtcatttattacttaagttttcttttcttgtttctcatagtggacaactgggctttgtccacttgtattctttatccaagaggtggatatgaagatcttgaagcggttgttcaagagagtgatggcaagggtagggtggatattcctcggatattggatattccttgtttatctgtaaactctgaattctatgtcctggtagcagattccgttttccaccgagggcctaggcaatgcatcccattccacatgctcttacaggttccttatgacctcttctcctccacctgcccgtccccaaccttgggtggctttgattttcttgcagccaatagactagctgtggggatgctgtggagctctggaagctgtatgagctagagcatttgcttggagccttgaggtgagcagtcatctgccttgaactgctcagtactgagaaatccaacacccacatggagagcccttgactttgctaatggcaggcaaggccacagggaactaggaatagagacaggctttgaaggagtctgtgcttctagtgcacaaaagatgtcaaattcctgtgccactgggatccctacttgccagtgcaactgagtgagtagtctttaagtcggggactaaaggaaactgtgatgaagatgctaagatgcatgctgagggaatggctgtaactactctctaaacaggcaaagcatctatctgtccgctgtagtagatgtgtgtctttggctttccttggtaggcagaaaggctggtagttttccatgtttgtgtgtggaattgcatagcctgatgcttcttccatttctcaatgtactgagtatgctgtctcctggatatgagcaactctatctgcacacttttgcatttggacttgcttccttgtgcttcagtgcctgccaacggcctgaggatggaggagacacctggaccttgtggctccggggagcttgtatggcaagagtagaatgtgggggtggaattggccatgggggtacttgcttgctctgggttcagtgcgcaggagaaaccattgcagtgagcaagaagcattgcagagccgcttttcctatcgagcccagcctttgataaaaggacgaagagcaagctattgacttttaggtgtccgttctatcagtggtctgttaatcatagaggataaattattgttcctcagaaacgggaaggactaccttggcttgaaggcagttgtgcct

SEQ ID NO: 22805 - DNA, 1200 bp, Mus musculus
gtttttaatatccacaaactgcaggcaacccaaatgcccatcactggggaaatgcctaaccgaatggtgacacagccatactcagccacaaatagcatgcaccatggaatcaaggaacaatatagataaaatccaaatcttaggttgagtttagaagtcaaaaaaaccaacaacaacaaaaagactacatactgcactcatttggctagagatcatagattgttttgctgagggttgaattaacatgggatggcctggggattcaagggatctctgtgagtagttgattatgatattttcattggtgcatatattcttaaactcataaaaatgaatatcttaactatgggtagttcattgtgtatcaactatacctcaaatacacacacacacacatgtatatacacatgtgtgtgtgttgaaagctcaaatcagacatgaattgtaaaaattattgcagcaagccaataaagtgtatgatgtatgagatcataagaaaacaagaaaaaacacaaataagccagttaaaaaataggcacagagaggtagcacatgatacaaatgacaaacaagcttgtctacggccatactaccctgaacgtgcctgatctaggaagctggttagtacttggatgagagacaaagaggcttgactacaggttattccgcctcaacaaaatgtaaacacacattctgttcattctattcactgaaaagctacatctatagatcatccactgggcatcattcttcagaccagggatgctctcccaaacatacgaaccacaccccagcatcctagtcacaccttagcaccctaaccacactcagcacttagcccctcattcttctgacttcagcatcccaggtggtacctggcatgtcacggcatcagagatatctgtacaactaaagccccattccacacatcagcatgtccttgaactgtatcctctctcctccatcatttactagaatatttgcatatctcatccattacatttaaattactctagtccaggcaaagaaagcgtttttctaacgttgttcctggcccagaacagagctccacattccttatgtaagcagcatacctggctttctccccccagtgcacatccctgcagacttgcaggctgctgtttgccttctcagtcaaaccacggactctccatcctgctcccagaaccatattccact

SEQ ID NO: 22806 - DNA, 1176 bp, Mus musculus
gagagatggacagggctggtgagatggctcagcagttaggagcactgactgctcttccaaaggtcctgagttcaaatcccagcaaccacatggtggctcacaaccatccgtaatgagatctgatgccctcttctggagtgtctgaagacagctacagtgtacttacatataataaataaataaataaataaatattagaaaacatacctttaaaaaaaaaagagatggacagttgtctccatattcaaacacaatgaagttgggtatgaaggctcatacctggagtcacagcattcaggaggattgtcacaagttagagcccagagtaggattgtgggggtgggaaaacctgataagctcagttggtaagacacttccctagcatgcctgaaaccctggatctggttcccagagtgtgcagtcatagccgatgataggctctctgttggagaggtggaggtcagaaggtcagaaattcaaggccatccttgggcacacagctagtttgaggccagcctgaactactgagaccctgctttaaatacatcaccaccgggctggagagatggctcagcagttaagagcactgaccgctcttccagaggtcctgagttcaattcccagtgaccacatggtggctcacaaccctctataatggggtccgatgcactcttctgatgtgtctgaagacagctacagtgtacgcatataaataaataaatcttttaaaaaaatacatcaccaccaaaacaaatccccaaaaccctggtggctcatgcctttaatctcagcactcaggagacagagacagaggatctcaataaatttgaggccagactccagagtgagttccaagacagccaaggctacacagagaaatcctatccagaaaaaccaaaaaggtaaaaaagaaaaagaaaatgaaagaaaaagagagagagagagagagagagagaaagagagaaaccctaaggttaatgaatgccgagagaaagtttcacctgtgctcatggacacaccttgtcttcctctctgctcttcacctggaatgctgcccttgtgccttcctgcctcacctgagggcagaagagaatggaaaatgttcacatggctgggttctcaactgacaccggcctcggaagtaattttccttcccaaactgggatttgtttccgt

SEQ ID NO: 22807 - DNA, 1103 bp, Mus musculus
gctgcatccgtttctatgagaaggtcttgagaagtggcagtgtaactctgctcatctgggttcacagagcatctccttcagtttctgtgctaaagaatccctgctctagagtgggcctccttggttggtattttagatcacaagtcagccattatctctgggttgttcaaatggctgactgtgttcctattactttatatgcgatgagggtgctgtgcttagggttcagaggccaaggcctttaggatatagaggacagcatgaccttggggtagaaggagagaagctcgagaatgaaccccatgtgagtaatacaaagtcagaagcctggttggctatgagcatttcccatgtattgacctttctaatctccattattatttatcttttgtagatgagaaacaggcacggaaagattaagtaacttgcccaaagtaaaaactagatctgtcctgctctgtgattccagactactcactcagcacaagagcaccctaatgacaccgtgaggacagttagtgtgtaactgtagatgggacagtgggtcagaggctgctaacacgatactggccaaagatggaaaggctctctgaatgccaagctttaagaataggtgaaggattttccagcccagaaatctatacatctcagttttcaacttagacaaaattcatgtaataaataaagtctgatgtttctgagtagattttttttttctagcagtttctgttctctttgtgcctgttatcatctgtttctgttatgacttcctccctggccaaagaatgctttttgggggtaggattttattattctttccaactagtgtttgtgcttacaccaccattgtcacctgattggatagggactggtgcatttcctaaatgtgcagtctggtgactctgtcacggccatctgatgcttgtacaacatgaagcaaaggagccttttgagatctggtttattttctggccttgtgtatgagaatgcatgccagtgtaagatgggagaggctgtgtgaggtcaggggtgcactaatatgcagacagcatcccagctacattgcattgactccactcctcactcctcactcccatgtaaat

SEQ ID NO: 22808 - DNA, 1116 bp, Mus musculus
ccaagcatattcagaccaccgcaggtgtatacaaggatgagcaaaaaagcagaggcagagccattaggggtcctaagttctcagaactcaagtccttcctttttcctgttggggagagtcacaggttagtcaggttaacctgttccctcccttccttcgtattaatttacctttcatttactatttgatttcaaaagtagtattttctctttttcttttttatcccctttttcttttaccttccctttctacctcttctcgctccccttcctctttgagacagaatcttatgtagccaagactgatactgaacatgctatgaggctcagactgaccttaaactcctaatcctccgtcctccactgctgagtatgggttataggtgtgctggcctgctggtatttgttttcttattgcaaagtttacattcattatcttttgctgttcaaaaagaattttctaaactacacttttttttgctaactctcattccttttttttttttcatgtgcatggcaacattgctgtctggaactcaggggccagccaaaggtaagagttctacacatgatgcttgtagaaagagattcctgtgcttattcctgaagtactggacattttcttatcaaaactgaaaattccttcttcctgccggtttataaaagcaataagctgtcatctgtctcacaactccagagctgcttattggcacagtgtgttctggccagctctgcccagtctcctagcagcctaacatgggttccttgtgtgctgtggattagcatgaaactgattgttccagactggtcactctgtgccagtccagctcatcttactcctaggcagttggggtactttgccagacccatgggctcccgatggagccctgatgacctgatgatgggctcctgctgcttctagagactgtgcttgcaacttacattggagccaaaatctgagactttaaaaaaatttttaattacatttttttttttttttaaaaagagtcaagtccttatttttctgttactatagtgaaatacctagagctgggttctgacttccttcttttctttaatttatatgagtactctgcagctgtcttcagccacacca

SEQ ID NO: 22809 - DNA, 1239 bp, Mus musculus
agtggtggcatacagccttatcccaggatttgggaggcagaggctggtggatctcagagtttgatgccagcctggtctacagagtgagttttagggcagccagagctatgtggagctaccctgtcgcaaaaaagaggaagaatggaaatttgtcactgaaaaaaatgtgtgtctgagataacatggctatttttaacaaatgttaagatttaatggaaaataggaagcatgaaagcaggaaggaaagtggtgcttccctgcccacctgctccacagtgtccagccgcttagcgtggctcggtcatgcatgctaccccaccctgacccctaccccaggagcaccttgatgccaccctcgtatcagacttcacctggaagcagcatgtggcttcaaaatatgggtacttaaagaaagaggatcatctgggtgtggtgacacacgctttgatcccagcacgggaggcagaagcaggcagatcttcgtgatttctagggcagccagggctacacagagaaaccctgtcttccccagagtgttgagttcagttcggggcaccttccctgttctgttaattaagctttgggacattgacactggctgaggaaaaaaaagattgaatagagagtattactctattcatatacttcctagcctacacccagagagagagaggggagagggaaggagggagggagggagggagagagagagagagagagagagagagagagagagaagccctgtcttgaaaaaccaaagaaataaaaaataggaaaaaaatttaaaaatcagtcaatcaaaatagtaattcctttaaggccataagccgtgtagtcagcgttcttaagtgtctttggtgggattacccaggtttcttttatgtccagattctctctctcaccttgagatctgcttgtcgtgcctgtgctgtcctgttgttctgttcattgtcattgcatgtcatgctcagcggtgctaggcccaggttgggagtagcaaggcataatgtaccatagagtaggaaagcaagagtgtgatatgggtggtggtgtgtttttatttcaaaattactggtttgtaaagttgtcttcatgtcataatgaactcttagatttaagactttgactcctgggtattcattacttttatcaaagctccaatgttcctaaatttgagtggtggcagtcccttccgttgccccacgaacagtagacattttgcctcatcttgtccacatt

SEQ ID NO: 22810 - DNA, 3559 bp, Mus musculus
ggaagctggaagctggatttccttcctctgcttggcagtggcagaggccccttagctatgctcccctggttaggggtggaaggttccaggagcccagagactcgtgggatggagccagcccagctcctccctgcctgcttgaggatgggggagggggttcccagccagatgtgttgggctcccctttccttattctgctgacttcactaatgtcttaatttaagcaatgatcctaactggtgacttgccctcacagactggacttcccctgcctgggcccagcacgcacactaccctctccgtgcaccggagattatcagcctcccctgggccacacctcatcctgctgcacggctggctcacagggtttctaagaggcatctttgtgggtgtcccggtgtctttacattcaaaatcttttctgctggccattcatttcctaacaggatgcttgaactatatttatttaatttatttttccaaaagttaaaatacttcacaatccacaatcgctgtctatcccaacatgcctgcctgtgctttctggcctctggctggccagagctgcagcctctatcttggatggtggttgctggaagtggcagccatcaaatgaaaccagctgcccttgtgttacttgattggagacaccatggctttactgaccctggtgggaaggctgacccagggttggcacggatcgagccttcagtaccttgtctggatctgccaggcttcagggagctggaaaatgttttgactctgcctgtgcctggggccagcagctggccaggcaggtagtgagggcagaaccatctccatttccttctgtggatctgggctggagtcatggtatatcccagggcattaccaaccacctgtttgctgagacgtgcatggcctttgagtcccagagtgttggtggagggctcagtgggtagatcagagtcacctagtccctgttgtcccaggccctgccctgccttccacctcaggctgtatcagtacacaggttatccttggcagtttgtttgaagtttgactctcagattctcgaagaaccacagctaacaggtgtctgtagaggaattggttctgtgaggacttaagccttttaaaggaagtagctcctgccaggtagcttctcagaacccctcagcctcctctggccattgtggcctgtgctagtattgctgacactcagtctggactgtctgcattgtctgattagcccagtataaacttcactaccatctgcttgcccaaaccctgaccagaggctgcttagagcgctaggaggatgggtggccttcctggcacaggtgcagactctgcctgcaccccagcctgggagtcaagtgtcactccacttgtcaccacaatctgccaggagagacctgcctctgttccattcttgaatagcacagatttctggagctgccagctagaggcaggcaccaattcagtaactcctctccctcagctggcatcttgggatacgcaccaggtgagttagcagtgccagtcctgcctggccactctatggaagcccacagtgcttctgactgtgttctagtgagagcttttctcctgtcagcatccacagtgtcccctagagagcagtgtcccggagtcccatcctctaggatggccatgcaatggctgctagggagagaagtccctgaggatgtaatgccagtcgtgttaatgctgtgggaagggacattgtgccacctgtcactcggatggtgtaaaacgggagaaagttactattgacttcatctcgctatccggagttctcaggaagtcctgaggatctcacttggccagctgtcatcccgtggttctgggaccactgtctctctcccagcacccccttcccttccctccctgctcattggatctgaggttccctagcctttctatttccaggctgcctaagaaatccccctgcctctgaaagtaataccatttccacagagccttgcaggatactcttcatgtgaagcgctccagcttcacaggcaactggccaaagcacatgggtcctccagtggctggagggtgttttgtgagggcagtctgtctgtctgcacagaaggctctgctctcatgcacttggtgctcaatgtggatgggatcttttgggatctcatggcacacatagcaagtgtgctagaagtttatcctcatgggtgttccttatgagttgttcctgtggccgagaggaccctgtgttcctgtctgctttgagggcagggaggtgaccttgggaaagctggcactttcgggtgggtccgaagagatggggctcaggtgcttgctggtcttctgggtttgctgagcacatattgcactctgaccttcatgttgcctgtgggccggatgaagacagtgagctgtgttcttcctgggctctcatgccagaagaggctagacaggccagctgtagcttcagctctccactgactgccttttggagcagactaacactaacttgcagctggaaacgtgatgtataggggctgtggttgttaaaatgtcaggtagtggagggtaggtggtgggtgtggggttaggtgcccatgtataagggcagagggccagtgtttctgggctgtgtttagtggcatgtcccctgaggagttgcacatggtgtttccatgttttcagttttctcaaccacttatcatgccttaggggttctgtgtgggaagcaggtgagtgacccatgtagcatttacctgtctgtccaagctgcctttgctacgtgttgcccatggatggtgacttgaagcttctagtgcctcaaggcccaggccacctcaggtcagagaccatagggccatctctagtgccttccttgggaccagtgtctagcctgtgcttctagtcccagacactgcccaaaacatcttagtctatatgctgccttccttttgtgctgtggacaaaaattgggaaaagcacggctgtgtggattgtgtaaatatgagctcatatctgtgatgttgattccaggaatccagtgatttggtacatgttaaatgggaattaaaaatccaaagaccctgtaatgaatagtaaagatgatgatttatgttgtatgaggaaccaaactattgtaattttgtaccatacatacctttccatcaagtgaccaacagcttctaaataaatccaggtgatttcttgcttatgtccgaggtcaagcataactgttcttgcctatcctcaccctgggcttcagctgactacactgtcccttggtggtggtcctggggtttccagagagcagcaagccccagggcacaaacttctgtgacccccctagatgtggatcaaagaccctggaagtccccattggcatcttggtccctgtctccagtccctcactcatttcagccccttatagaagccaggcagcatcagaaactcctgggggactgagactaaaaggaagtggagcttcagggctaagaataggtggctctgtgtgtgtgtgtgtgcgtgtgtgtaggttccctgatttcagacagggatttcaccatctgctttg

SEQ ID NO: 22811 - DNA, 2760 bp, Mus musculus
gaggtgagcacttgtggctgctttcagaaagcatccccttatcatttgccttgatgcctacattgactctactgaaagcagtggggatctcatcactcatctctgaaaatgggcaccagaaaaacaaaaccaaagttctcagggtgggtagagctctttctttccaagcactggccattctggcaagctttctcctttatgctctttggttctaccacagttccactctgaaagctctcttctttcttagtggttcctcacaatgaccctaaacagtgtgtcagggcagtctgtacctcactaggtgcagatcagggaccacggatgccaaactggctcctgagccaccacataagttcactggctgcaaggtgccaacactgtggcagttgtctgccctggaagagcctacagccttctccaatctccccatgggctcagcctctcctccatggccatggttaggttgggtctgcagtactttctagagcaaacttctcatttatgtttaagtgcctaagcaagttatagacctctgggacctgcctgagagtcggcctgtgccctgtccttcccaccatgcacctcgcctcaggacaggtgtgatgcacatccctgctccccaacccagtgtccctgccattctgcaggcagagtggtcaccagggcaggcaaggggagagggctggctttgtcactgtttcctttgttccttctgttgatgtgactatgaccttgggtcagaggaagttttaaggaatctacttagctagggctcggtggctactgagtgaagaacaggagtgagtcgcctctgagcagagttctaagagagccagcaggcagggatcatgactgaaaaacctgtgcgtactggagccctgaccgcatccacagcccagatgacgaggagccggaggccatcagcagtagagtcgtagtaagatccaatgtgcattctttaaaatgagtgagagactgtttcttttgaggaataattaaagtgtgagctagatctgggccttttatttgcatgaggtatagaacaggtcatggactgctgtgctcagttggtacaacagtgacaagtagaaaggaacaatctattacgcaggcaccttattttcattgatccaggatttttgttcagacagtggagtaatgcaaacactgggtgcttgcatgtaacaggtgcagatgaccctgcctcacctagagaggggaacacagtagggtgaatggccaagtagtggcaaaagggaggcagtggcacatgcaaaacccatgctgcccctgaggaatgtgtcaccctctagatgcagtgtccatggtctacctaccaagcacctctccggcccggtgtaattgaggaatgtcaaccggatgcaaattgagggacgacagctttgagtcagagcatcggggaggccaggatgctgggccctagctggacttggacatcctaacaagagccaaatgcacgcctgttgagggcagcatgtgtatagttcaccgtgggtctgggagcaagctggcatggccagctgggaagtggaaagcaggcttacgtgttctgaccagacaccagggaccagatgtcttgaagttgcctgcaggtattcagcctaatggctgtgtaggatcctgccagatgagtcggagagggggcagggcgccctcctggccttggccgttgtgtgtcttagtctctgtgttcccctttggtgtcttctctggtctctgtccccatcttgtgtgccatgtgtccctgagggtgaatcacacctgtgtctgagtctgctgtaaggtgttcagtctacctcaaggggtcgtcatggcaagctctgtccacatggaatcctccttacatgccacacacactggaatgtataccaccccacccccataaccgctaaccccatctttccccataatcaccagactcctagtgcaaattggatgctgctttaaatgtgaaaaatctgttcaaaagctataaaatctgaatgaaagctaaagctgaacttataagccttgttgcatatgagccaaaagtgcaaaaagctctatataatgaactaacctgccactcgtataaatataaatatatataaatatattaaaaatcagactgttctacaaaattgtgtatttgtatttttgtgtacgtacaattttctgctaagcagaaggagggtgtagtatagggcgctgtgagaagagatttggtttaaccccatttctttgtgacttatttttgttaacatcagatgcctgtcttcgtcttctctgtgtgacactgtttggaaagctgcagtatccttcttccttaggccagagtctgggctcagggagctgtgtggccacctaacagacagggccaggcttgcacccccaaggccaggcatgggatggcagtctgactcggctctgggaagcaaactccctctttagaaaccaatttcccagacaagatcgttggatactcacagacccagggagcaaggggagacttctttccattgcccaggtagctttgcctggtgtagctcccggtcccctggctgccactgggccatgtctcccaggtagctgctgccctttcagacagggtcaccagatgcctcccctatcggagctgtcaccagaggtccaattcattacctggagcatctcagaacccactttgccggtgctaaacaggagaggggttagagtagctgccaatcatggccagaccaacccaccagaggccaagac

SEQ ID NO: 22812 - DNA, 1100 bp, Mus musculus
ccatggtaattgaggggggtggcatagaatgaatatataaaagtataatggcaattgttccgaatgactgagtgtcctcctgacatgtaattagctgttttagcagggtgtagattggcatggtcataattaagaggatttctgtcctttatgtgattgagaatagcagagcccatcctcgttccctttgagcactaatgctcctgagaacatttggaacaacagctcagtaaaccaaaataatgatatgggattcatctcccacccgagtgagagagcactgggaagcatttcaggtccagaatggaaggctttgcttattgctggatctgacttccaaattctcttaaacctcttgtgtccagtttcatcttattctactttgaccagaaactagtcaatatctcaaactgaggcagcctctggcagagcctcctgacccccatcctttcctggggacacttgctgcttaactgggctacctgggattttcagacttctccttggtaacttgattatttccactgccgtgaccatcagacagtatttgccacacggaagtctgcagttgagtagggttttcctcgtgggacatgacgagatcaggcacacatcgacctcctacaggaatgcgtggacttgggctccagggtgtgcaccccagcttgctcacatctaccatgttcagccatcacaagtccctagagctattctgctgtcaggatgggttcctggttcttctgaagtcatgtactctgtcccccacttcatttttctttatgcatctgtgccttcaggcaggtgtcatataatcttcacagcctgtagagtcctcctaactaggagctgcagaactcactagccactctccagcggatgcttagtttggactttttcttttttttctagtcatcctttgcaggagccttgattcaattagagcgtcagaagggtccaccgggatgccagcagctaccagtgctaagtggccttttataagttcttctgcccatgaggctcaagactcaggtgaggttaacttgagttcaagagccctgtctttttcaggctggacactgtgggattagttagtagccaaa

SEQ ID NO: 22813 - DNA, 2637 bp, Mus musculus
aacttgactgtcacacatggaggtccttgcctagctaggggcagaaaaagcaggggacatttaccacctacagcaggatgtctttgctgtcttctctttatctgtccttgtggaggtgtgaaagctatattgctacaggcaatttatttaataattggaagccatattgataatggatgtggtgatatttgtagtttaatctactttaagtggcagtaactaatggaatttttttccttgatcatatatgtagcacttttgttactttttaaagatatttatatttgataaatctttttttcattttgagaactcaaaataccaaacagtgaacttgcgttatagagtcaccctgtggtcaccttgtcatctagtagcaaaatgatgaactattcatgcatcaaagaaaattacatctgctggccttgtgtgaaaatgatctcctggagccctgattaaatagcacactgtcactgtgggtaagaagaaccagccttcagtgaattggtgcagtgtgtgctgagaggctgagcgttccctgcctcctcccattttccctctgttgcgtctgaagaagccttgcgtagagggcggtgtggggtgagcctgcgagcgggcttccatctttttgtccatgcctgacccaatctctaagatagaaagtagatgccatctcctcacccctgcttcctcaccaagtgtgtccgaccctcctcgcttcccctgtgcgctgaccagatactcgatatccgcagggcttagctggtcttgctgaggcactgaccagatactcgatatccgcagggcttagctggtcttgctgaggcacacgctgtctggactaccccttaggtataagtcttggttacaggggtgtgaggaatcacctcatctttgaggagctgaggatgctaccccaccttcgtctgtgaccttgaaggacactaggtagggcttggccctgttcctatcagtagatttcagggggaaatgtatgcattttttcccagctctgagacgtgaagtaaaatggagccatcttctcttactgtattacttgaaccacaaatttaagagtagcatttcttattctcaggaacgagtcccccgcacctacttagaatctcgcatggtttctttgattcgtttgtctgtctgtttcacttaagagattgcattacctttctttctctccttccttttgtttacttagaaggaatattcctattatgtctatccattttggttgagttttgtctgcttattctcagttgaatcagaaagaacaggaggggggggggaacgtatttttctgacaagccacatccatgatttatcatgagattatgatgattgacagcttctttagggtgcggctgctcctgtctctcttgttctctcttgccgtcttaaaggaacaggctccagctgttaagacagctccagtctctaagggaactctgactacagccgaagagcagagtgttctgtcatcctagggccttttagagaaagcagtgcaacaggataccaagccctggctggtacaggcagtgccagccctgtgtggcagtgtggtggtactggaaaagtacaggtaccatggaggctggctctgtgctgagctagctagaaagtctgtcacatgcccacagactcacagccttacagggaacctgcgctgtctcacctacagcaggagtttgcttctttgggatcaaggttcaaaaactaccatcagtcggttttccctggggtcaccaggtttgattctacttttgagtcctgttccctcaactcttggaatggccacagaacatccgcagtcagactcatccatcctttgtgcttcttgctcaccctgtctgctctcatctccttctgtatttcttgtggtcccggagctcttttagattgtatcttctcgaccagtgactactggaagcaggagaggaggggagcaggcgctcatacatggactgtggtgatgtttatttaagaattactgttgctggataggaaggaaggggagcaggcatttgtagactgtgtgatggtgtttatttaagaattactgttgctggataagaagagaggggagcaggtgttcatagaatgtgctgtgacgtttatttaagaattactgttgctggataggaaggtaatttcccaccttctggttccttacatggcgggcggcctgttaacaaaggaccatcttaagatattcctgcctacctgagacagtcgccaggaagggcagtgcattgctctcctgtgtgactatccagggccctcagacccaggagacagtcattcacagcaggcatgtttatgtttgtgttgaacgccccatagggcaggttacaggaggagaaaacctgggctgggaaggcagacagcccgtgttcctttcgctccagctcactaggtgaccttagaaagacgagggcattggaagcctgctccagagctctggttcctaggatgtttgtcactctcagccacacccattatttttggatcagacatctgggaatgtttttactttatgggaacggcacatggaaagctgatatagtggtctgcgttctctctggctttaggaactcttgctttaaactccttggagatgag

SEQ ID NO: 22814 - DNA, 1216 bp, Mus musculus
tcttgagtaaacagatacacacttgttagtctctaccatgaccagccagactccttctgtgaataactggaaaactggccattttttttctttgacacttccctttctctaagcagcattccctctcaccaagcgcataaggcttttgttgcactagtcactatggtgcgatcctaggcaggtcctgaagttttggacatctatcctttgtcagatgttttctctgattctctccactctattgccacctagctgtctttttgttttctgttgtgcatccaattagatgaccatacagttttgtccttcacactatgggaggaaggttttaatttgttttgtttttcttatatctgtggtcaccagagtgtcggacaatgcaggtctgataaaatgagttagagaagcttcttcctcctgagcttttggggtaatttcagaagaactcgtgttaattctttaaacgttagctagagctcagcagtgaggctgagcggaacagttcttaatcataaaacagtaggggctggtctgcactggctgctcctctagggggcccaggttcatttcctagcgcccacctgaccactcacaaccatctgtaactctagttccaggggtccacggccctcttctgacttctgcaggcactgcacacatgtgagtcacaaacacacccgtaggcaaacattcatggatataattttatttaaaaaaaccaaaaaaaaaaaacagattttttttttaaacagaaaaaaaaatcactttcaccgggtgtggtggcacacacctttaatcccagcacttggaaggcagaggcaaaaaaaaaaaaaaaaaaaaaaaaaaaaaaaagactaaatactcttgatttgggagaagttcctggggtcttctttactccgaccttcattgtataaaagtaaagcctggaaatacagagtaagtgtaaacactaaaacttggactcaaaagaagacattatgctatgaataactgaaaattttcaatttagcatccaaagccagtatggctttttcctattagtcactgcagtcacaacagtaatgccttctacctggtcccaatccactttagaacataaattgtttgcagatttatattaatcgtcaaactagttcttaattatttcagtgtttccctaaggtctttttattataaaaatgatgtctgttcatttcaaaaactctgtggagac

SEQ ID NO: 22815 - DNA, 1136 bp, Mus musculus
agaggctcaaaagcattgcattaccattgcatcgtgagagaagtgacttgcctgtgtatgtgggagtgtttcattaaaggggagtggtgagtgagagacagtgacattgtaagtgttcagaatggcaaatgtgtctcctgcagacctcagagactttatcatcctaggataagccccagtgcatggcactgtgaggaggaagaccacagtgccctattaagggcaaggcaaggattggaaccgcccgtggtggctcattcttagcctcatcttgaaggagctggaagtcatctccctttaagcataattgctcatttgtttttagctagcgggttcatgtaattaagaattgttcatctctctctgtctctctctcctctctctctctcagctcatcctatcagtagttacacagtactcatgtgacatgatactcacaagagcagcattcaagaggaagaagccttaaagaccccagtaaattcctgaggatagtaatatagttgacaccctgttttcatagactaaataaagacagagtaattctgattgtggtaaatttagatgcatgtgtgtgaccatgtagaaatatttgttggatgaactaaagttgtatatctccctttctgaaaagagcagaggacactgccaagccccgctggtttgactatgaagctatagacctctggttgtgatgatctagaaactctaccatgtgtttgcaagtgccagtggctttctggggcctttgcagcctacctgttagtggccctcctgggtccctagcctttccacttcagtgtgctctgatataagtgctagcactcttatgtgcatggctttgtctaggagttttccctacatgggaactggcaaattgaggttctagacctctttcttctcagtggactcgggactcttcgctatgcttctgagttgccacatggaagtgcttgcagctgctctaatgcagcctggctccatagcatgtcaatctctagacaccttgccttctgtttactgcccactcccaattcagggaagaagaaccaataaaacagcaccctgtctgagcatctgatctcagccttctttctcatagccagccattgctggctttatataaatgtgggccc

SEQ ID NO: 22816 - DNA, 1149 bp, Mus musculus
gatccaatatacagggttgattgtactataaactgttagattgtactctagtgtcttacagatacccaacaagatgagctagtgattagaaataaaacagaacctttagtgtgaaaacgtgacctacagcttatacaaaaacaggaagggattccagggacccgaaattgccattataggaaaacaagacagcagcctggttgagagaaagcattacaagtcccgtagtctgcaaacaatggcaatcaaggagcatgaacctgggcctcaaatcttggggtgctggagccaggactgctgcctcgagaaggagacagtagttagggaaacagatggatgtgaagtgtacgtgtttgggtttgccagtaaacttacttgttgctgttgtctctaaattgatacagagaggatattaccctgtgttctgtattagcatgaactggattcagatattgaaaatgtatttctaggtgggtaggaaggtggatatattgtttttttggaggacagtctcattctgaaacccaggctagcctagaactcactatgtagcctaggctactctagaactcatggcaatcttcctgcctcagcctcccaagtggtaagattacagagatgagctgccaggtctggctctacttctagctgtttgattatcatctagttttcagggtgctgtcaatgtctgtgtagccgtgagccagctgagtacagtgctccttgggctcccttagctgtatttgggtattccatctcagaatggcagaggtctgtctcactgcagatcttttgggcagctttcaaattagttcttgatgtctccctctatgctagtggttctcaaccttcctaatgctgcaatcttttaatacagatcctcacgttgtggtgacacccccccagccctaaagttatttttgttgctacttaatataactgtaattttgctactgttatgagttgtaatgtaaatatatgacatgtaggctagctgatgtatgacctctgtgaaggggtcattctcatgccccctctcccgtccccaaacaggtcaagacccacaagttgagaaccacggctctaactggagcatttttgattcccaaactatgtgtcagcttcttacatcagttgaaacgcctatct

SEQ ID NO: 22817 - DNA, 2292 bp, Mus musculus
acacatacacacacattcatacatacattcatacatacatacatacatacacatatatatattttggtgggtcggggtgcacctgaaatttctgccaatctctccaagggagggtcctacccagctatgtatttagtggagagggccctggccctgcgttacctggacattcatttgcggtcccccccgtcccagggacactggctgcagaaataagcaggatgggcctgacctaggcagggtctcctgacctctcctggccccgttccaatgccacagtgctgctcccacagcttgccccgctgtaggctgcacagtggggacgacacaccccggacgctttgaagggttgggccaggccgcactcaggcatcacctggctttccattctttcttgtgtttgagagagaaggaggcggcagacagtgaggcagagatgagacctgtacgtagctccccccctccccccccccccggggtgacactggtgcagggtgctggtggccagttccgtggtacttgtttctcacagaggagacaacaggaacttggcaggctggctgggagctcggcgggtgtagagccagcctgggtccttccgggattctgtagtcttactgcaaggctttggaaggaacaccgaagtgaaattcaccttccctcttgtgtctagaagtccatcctgtagctgtgggctttagacccctgatgccacgttggctgtacgagccccccctccccccaaccttcaaagtctagggtgggctagaacccggaggctgtgatttgctaggtaagtcctagtcttgtcgtagacgttaacaggaattcaccccacgttaccactttccatgtcctgttgatggttttcttcccagggctgaaaatgaaataaactaacttggggtatggtggcagtgggaaacttaggtcagggatttggcctgtgacttgtctccccagccccagcagctgacgcagagctcagtctgtcttggtcatgcacctgccttaagccagttccgtcttcctaggccctgacacgtgtgctgctgcttgctgtcctctgcctgctgtcctgacttctctctagatccctcctgccgtagggctggcatggcccccgggagaccctcaggccagcaggaccaggctgctgcagaacttcactgggtcttctggaacctgacaccaagggctgcctgggacatctggttcttggcaactcagtgaaggggtcaagactgtttcccaaccttctgtcctctcatcagcccttgtagcagtagccctcttcccccgggggagccaaagagtgtggtgttttgcgctaaatatgtggctgctattttatcttttttttttcctctcccagtattggggatggacgccagagctgtgggtggacatcccgacaatcgctctgccctgagccctgtccctattgtctcgtttcttttcattgagaggttgtaaatggtgctgtggtacctgataagaaagtcagtctctgtggtaggaccccctctgtgggtcactcatgggtatcattgatctgtgtttgagggatagtgatgtcaagagtgtcctaggggatagccctctgggcctggtgggaacgctcactgaaggaccccagcagcaaacattggcagtgactgtacctgagggactcttgtcagaggcaagaggcagagacaaagcagttggaccctgcttgtgatttgggttttggggttagggacatgcttggaaatgattgtgccactacacgtccgtggagcctgcctggtgtttgacgttgtttaccatgggtcacctcctagagcagattgctaacacaggtcacactcagctacctagtctcagctccagggccaggacagctttgttttccagttgctcttcatcttaaggtcaaaggccacccacagagtgacagccccccgggatgcctcaggccaccacctaatgctcctgtcaggggtggccttgttagtgaacatggagctggagggtggggccgcctggggtggctttgatgacttgtccatctgtctgcccctttcaaaccatgagcacaaaggtcttacgttggatttttgtaaaaaacaaaaaacaaaaaacaaaataaatggagactttaactcatgcagtttggaggtgttttgttattgagctaggaagaaagacttagctatgtcaaggtgcctgcctgatgtggtagcttctatatggcccaatgggagcactccagctccggtcagaggataagggagctgggcaagcaca

SEQ ID NO: 22818 - DNA, 1099 bp, Mus musculus
agaggtccacttcctgttacgaagtctttcagacagtgatctgttggccatgaggcggcaaggccgctttctctgggagacctacttctccaccgcagacagtatttttaataccgtgctggccatgattaggactcgaattcagatcccagctgctcccatccgggaagaggtagcggctgagatcccccatcgttcaggcaaagcagctggaactgaccccaacatggctgacaatggggacctggacctggggccggtagagacagaaccaccctatgcctcacctaaatacctccgcaatttcactctgactgtcacagactgttaccgtggctggaactctgccccgggacccttccatctttttccccacacaccctttgatcctgtgttgccctctgaggccaaattcctgggctcagggactggatttcggcccatcggtggcggggctgggggctctggcaaggagttccaggcagcgctcggaggcaatgtccagcgggagcagttcacagttgtgatgctgacctacgagcgggaggaagtgctcatgaactccctggagagactcaacggcctcccctacctgaacaaggtagtggtggtgtggaactctcccaagctgccctcggaggaccttttgtggccagacattggtgtccccatcatggtaataaaatgggcagtgtgttttactatgcggaataagtaccccacacttaatgccgcctctagtttttatcatttttgttcccttgtagtagaggtgaatgtatgtgtacctctgtgtgtgtgtgcgcgcgcacgtgtacatgtgtgtgcatgtatgcactcctggtgctggggattgagcccagggccttttacatgctggtatagcacatttatctagttatttataaacccatataggctgtgccttcccatgtgtgccaattgtttggagaggattaggagtgaagccttagtggaggagatgtatcactggggttgggctttgaggtttcaaacacctataccaggtccatctatgctctctgcatagctctcagctacttatccaggaccgtgcctgcctgcctgcctgtgctcc

SEQ ID NO: 22819 - DNA, 2177 bp, Mus musculus
atgtctgctaatggaagataaatagaggcaagctggaaaataccttttatctactcctgggtgaagttcaaaagagttctcttaactcttttcaactctaaatttaacaaattgggcttcttggagttgtttttgcttagtagttcaaaaggagactttcatgttcgggaggatggagggttggtgcgtgttgcctctcttcacctcatgtggtgcccagctctcaggtagaaccagctgtgctgggttggggaggcggtggagctttgaacggaagtttcttgaaactgacaagactctccttctcttgcaggcctgatcgttggtagtggcatggaggacggggctggcatttcagactgccagctgtttttaccagccgctgcatcacttgaatagaagctatgcatattggctggccgacaaagccaagggacaaaagctatggccgttaaaatggtccctctgagtccagggctctttccctggcttttagcaccatggatctcttccttttcatcccatcagcaatgtggtaccttcttctacttgatgatgacagctgatacttcagatttgcctgactaaggttagaaacctgaattgccgtgaggaagatgaaatttccattttacttggtgccttgtgcagggagcacactgatccttccagaaacttgtgtgtgaaaagaggttgcgttttgtcagacagactcatggttatggcgagcgatccgacgtgatcagagtgggcaagaggcacagcgaactcatgacaggctataccatgttgcggaatgggggagtggggaacggtggtcagacctgtatgctgcgctggtccaatcgcatccggctgacatggctgagtttcacgctgttcatcatcctcgtcttcttccccctcattgctcactattacctcaccactctggacgaggcagacgaggctggcaagcgcatcttcggccctcgggctggcagtgagctctgtgaggtaaagcacgtcctcgatctctgtcggattcgtgagtctgtgagcgaagagcttctacagctcgaagccaagcggcaggagctgaacagcgagattgccaagctgaacctcaagattgaagcctgtaagaagagcatagagaatgccaagcaggacctgctgcagctcaagaatgtcattagccagacagagcactcctacaaggagctgatggcccagaaccagcccaaactgtccctgcccatccgactgctccccgagaaggacgatgccggccttccaccccccaaggtcactcggggttgccgccttcacaactgctttgattactctcgttgtcctctgacgtctggctttcccgtctacgtctatgacagtgaccagtttgcctttgggagctacctggaccctttggtcaagcaggcttttcaggctacagtgagagccaacgtttatgttacagaaaatgcggccatcgcctgcctgtatgtggtgttagtgggagaaatgcaagagcccactgtgctgcggcctgccgaccttgaaaagcagctgttttctctgccacactggaggacagatgggcacaaccacgtcattatcaacctgtcccggaagtcagacacacagaatctactgtacaacgtcagtacaggccgggccatggtggcccagtccaccttctatgctgcccagtacagagctggctttgacctggtcgtgtcaccccttgtccatgctatgtctgaacccaacttcatggaaatcccaccgcaggtgccagttaagcggaaatatctcttcactttccagggcgagaagatcgagtctctgagatctagccttcaggaggcccgttccttcgaggaagagatggagggcgaccctccggccgactatgacgatcgcatcattgccaccctaaaggccgtacaggacagcaagctggatcaggtgctggtagaattcacttgcaaaaaccagccgaagcccagcctgccgactgagtgggcactgtgtggggagcgggaagaccgcctggagttactgaagctctccaccttcgccctcatcatcactcccggggacccgcacctgctcatttcatctgggtgtgccacgcggctcttcgaggccctggaggtgggggccgtgccggtggtgctcggggagcaggtgca

SEQ ID NO: 22820 - DNA, 1395 bp, Mus musculus
ttttattcaataattaggcaaaaagatccaaggcagtattaagctcaaaacagtaatttgtttcagagagcagttgatgaataacaattagcacagggcttagtacagagtaagctttccagtaaatgtttagcgactagctaactacatggcactcagaccatgagaattgtttttatacacacacacccccattgtgaatttgttaaaaatctgtgtaaagtaagaatcttttcagtttcacacaaaaaagatgcaagagataggaggtttatagaacctaggttcataagtaaactcaggattcgtttaagcttcttttatgcctttttgtgacagctaggatgagaaaagcttgggattgcagaaacaggtcagtgggtaagtggacctgctgctcttccaaaggacccaagttcagttcctccctcccttgtgctcacagtgcctactgtagctccagctctggggatctaacattcccttctggcctcctgacaccaacacacttgtaacacacacacataaatacaaaatatgaaaaatgttcatttaattcaactatgtataatgtatatacatttacataaatttgattactgtatatggaaatgcattggcatttgtacatctcttctggctttccttccttttcattttttgttgttacagccacatgagtactgggacaggcataggaagagtaggcatgcctccccatgcgctagactacaattgctttctctaatctaattctaatcctatttatctttagtaattatactgatacagaataatgcttatctttcaagatccaaatctgagagagaaaaaacaatattaaaagtctgttcagaccgccattttagtagacataggagtttagttaacttatagtcagcacatagtagtaagtatgtttatccctgtgttctctaactaggaagtctggctttaaaggttttttaaagtttcctctaatattttgatcaaaggtcgagggagtacaaaatgcattaagttcaatatatttaactatgttgaatgataagttatatttacctttttacctaaatagtcaccagaaacctatcttgcccttttcggggatttttggggggatggtagaattgtttataattgactctagttttattagcaccacttcccatagttaaaaatgttttctactgtctaataattcaaaagtttaaaatttgccaggggtagtgacacacatcttagcactccggaggccgaggcaggagaatctcttgtgaggtcatcctgatcttcatagtgagttccagggcagttaggactatatagaagaccttgtctcaaaaaagaaataaagattaagaaatcttaaggtaaagataattaaaaattagt

SEQ ID NO: 22821 - DNA, 1294 bp, Mus musculus
ttcttgggcagagtgtgcccactgggaaagtagatctttgctctttgtatcacatcaaccctggggtgtgaacacatcccaaaccctaaggatcatgtcatcacaaaagtaattctttctaggctgtgaagagatgattgtctggtgagcatttttataaacatgcttattttatatctagaaaaatcctctatgtgtggtgactgctttgtagtgaattttcatataatatgaactagttgtgaaatgacattctggtagctctgttaataaaacaaagtttcagaattaaagaaaatttctatgcaaggtttatttctcagatgaatactaggtctttgtaggtttatttccacagagtgaaaaaaggaaccgtttttaaactgtagaagactttgataagccagcaagagtattttagctaagataacagtgccatggaagatctggttggcctgtgggaggttgtctcaaagtctgtcagtcttcccccaagatatgcaggctgtggatgagcactggagtagaggcagagatgagcattcccctgtaattggattgggttttgttttgtaaatattacttttatgggctatgcttttataatatccatatgcatgatagaaacattttaatttgtggccatttttcccaggaaatagtagacaacttcatgttcatatatgttctgtggaggcatgcagtaaaataagcatcacacattataaggggttttagtggtaaaaaaaaaagttacaaatggcaaaatattttctgtgtattcattgtcgtatttttctacagtgagatgtgatcttgccaaagccattagaccttggtacccaggccctcctataatgagctgattgtctgccccagattccccagtagccagttggctacagcttttgcccacatccctattttctgaattactctggtttacagctgaaatatatactcttaagtccaaaatggtgatcgacctgggttcttgaaaatcattttaactaagtggagcatggttactctttctgtgaatatcgtttaatcttaaaaatatcaagtaaaaacctcttgacattttattttgtaaagcttaaatgatttaggttatgaactgtgaactttatttgtatgaaattgatcagaaagaaaaattcttgaaaatgctaatatgtgattcagaaaatataagtgatcctcagccctgattgcgggtacagatcactctggaactctcagtagccaacatctttctgtcaggtctgagttgatgctttaaaaacaacca

SEQ ID NO: 22822 - DNA, 1181 bp, Mus musculus
aaacacttttctcccccttgttgggagtgctttattttttaaaagcaaacctaaatgaaactatttttccccttaaaataggagagagccaaaattgaccaagggtattctgcagcgaaccggagaccaaagagttacccctacccctaccccattccaccctctctgggactacatatgcatcaagagtaggacaggatgctgccttgcctggttttgttctgagctggtgaatcctttgctctttcagctattctagagtggcctgtgagcaaatgaacttctctctctctctctctctctctctctttctttctctctctctctcccttccttccttccttccttccttcccccctctttctctctctccctccctccctccctctccctctcccccccctctttctctctctctctttctttctttctttctttctttctttctttctttctttctttctttctttctttctttcttttctttcaaaaaaaaaaaagaagaactttctggcaggtagatggccacccagggaatgtggcaggaccctaagaagagcaggcagctgtgcttgttgagatatgaggacagaaaagggacacccttttatggtgtcaacttttggatctgggtttcccccagatgttgggttgcatgccaataaacatgtggcttcttctcaaagcctgtcttcaaaaaagctgaggcaaaatgctaatattaattcagcctggcctcgaaacactgtcctgagcacccgtcaactctgagaggaagtgtggagagtctccatccaactctgctcctactgagtaaagtccccttccctccagagtgtcacagagacactagaatgtcaggtgctcttgtctgatgtagaagtctttgatgaggaagccttctttcccttggggtctctggaagatcctagcagactttgcctgtgggcctgctcagcatgacttccaggaccccactgttctggactgacatcccaggtgtcacaggctcagggagtggcaccaggtcacctctccagggactgagcatcattggctcattgtcatggggagctccctcctgaccacggaggctccactggtggtgccacatgggaaacatctacttctcagtctaaggcacactaagtactagtagcaagcctgtgagcctaggagac

SEQ ID NO: 22823 - DNA, 1138 bp, Mus musculus
atggtgttggcctcctgcctgctgtcatgtgtccccccttttgctccccctccccatcctgatgctttcatgttggttcctgacacatggtctggctttgggtttgaagggcaagggtggctgtgaaccacccccacccagccgtcaggcccgcttcgtcgtcatctctatctccctgctccctggccctgagggtttggaatctgaccgggtgaaggcaccaccggcgagcttttgaaagcaacagggcctagcctgcaaacagttatcttgggaaactgtccagccacgtttccattactcggagctctcggttaccttcagacatggtgccgtgttgggagcaacctcagtgggtttgcactacactcactccgtgctgcaagtccagggatactgtctgtggccactgaagtctcaggtgcagatgggttctcccgggaacccagggttggatccataaggctttaatctggccctgaaagcagtgttgccgcttcagacagtactgcgagcaatggctgccttgtcggagtgagtgtgtagctggacaccttagaggaccctatgaaattggatatggagactgatttggtgggaaaaaacctgttactttccagtcaccccaggttctgactttacctggggcaaaaacaaaccacaaaaagggagaatctcatctgtgaatttgtcttatcggcgcttctccccagccccgcccctgccccgccccgccccagccccgctgtcttccaagtattatttttactgttaagattttttttaaatgtgaaatgaaatgtaatgtttttacagcaatgatatgaaatatattttataaggaataaaatggtacattgtctgacttagtgtgtgcctctctactgattactgtcctgttcctaccataagtagcaagtgatagcatgtggcactgtaggcaaggggactcacttgcttataatatcaggttgcttagggaatgtggcaatgaaggagcacatgtccagctctaggttcagtgtcctaaaacaaattcaagttggtagatacacttaccaggtaagtaggcagagtgtttatcgtgactttggaaggaagttaggtggtttttttttttgtttgtttttatttgttt

SEQ ID NO: 22824 - DNA, 1857 bp, Mus musculus
tcttgtgctgtgttccctactgcagtgctgaacaatattggtgcatctgttgtgcctacacatatgtgctgccatataccctggtcctgtgccagctgttaggaaagggcatttctcccacagcagcgtctatgttcatggaagccagcataatagaaatagggcaagtttctatatgagattcggtttgggcagtagtgcagtctgaataagagacagggcacaaggccgaggggttcacggctgacttctgagagctgctaaaattaggctgactagagctctggtactttgttttccctgcaggggtcggcacaagaaattattaccgaaagattggctacagattacaaggcccctacatggtaaagatgctaaaataatgaccacccagtctaccttcttgcagcatcctccctgacagaagattcaagtgcagtctcagcagaggctgaggaggtaaacggcctgcacactcctggacggtcctctgccctccccctgtggtggctgccgctcactactctgacccctgtgacagaggccaaacccacctctttatgtgcccatggggcctcttctggctttaaggcttaaacgatttttccagtttctaaattctgcatgaaggctgcaggtgacccattttggctcagacgctgtgaccagagcaaatcaactcctttggccatcgtcactcgtgattgtcatctgaggggcagcctcgggagaagattatttatatatccaaagacgaaagccagactgcagcacagacaagctgtcagacatgactccctgccctttaactacatgcacattcaccctggaatttagaaaatgagctttgcactggaaatctcagtggctgtgccgtgtcttgaaatgtgctgtgtttggagaaagaagagctgaggtagtgggttgtgttaatatgcttgatgccggccgtctctagcccaatcctgtcagaagcttgccctgaccagggccatcttggaagcctttcctttgtctcacgtctgtgaaagtctgtatgtccatacccctgacacctgcaggacagtgtgaactaccttcagcatgctgggctagcttgtgccagccagttcatctgtcctgagcagacatggtccagaatccacagctagagccggaggccctggtcaggaccaggccatgctcagaagcttctctgcatgttagttctgtaaagtagatagtgttgatggtgctgcatgaagaaggtaggagttaggctagtgtgtggaaggaggcctgtctgacctgcatggagggacatgggctttccagagccttcatcaccattcagtttgtcccctgaggaggccaggctctgagtgacagcccatctcgcctgggcatctgtcctttccagcagtgtttagtgaaaactgttccctaaaaggtctgaaaaataaagtctttaacataaaagagtcgtcgtgtggtgctttttccctcgtcctgtaaatgtgatggcatttatcaggaatttacaggttttgctcccggcctgtgacactggctgtctcccccgggtgccatttcccatctcattacactgctgaaggcgagtgacagcagcttcttggagggcgcactgtggcactccagccacgctccaaaaacgtagtgcagggaacttagctatttcttagttatcaatttcccccataaaatataaaagtattaagctaatgaagcgcgcaccacagccttcgcactcgttgttactggagtcggcgcatgctgggccagcgcagggctaggactcccttcctgccgcgtgcctagcacacatgtgttcctgggtctcccttgctcatctctcgc

SEQ ID NO: 22825 - DNA, 1189 bp, Mus musculus
ctgtactggagaagcaagccttctctaagtacagcctcactgtactggggaagcaagctttctctaagtacagcctcactgtactggggaagcaagccttctctaagtacagcctcactgtactggagaagcaagccttctctaagtacagcctcactgtactggggaagcaagccttctctaagacagcctttggtcttttttggtttttttgtttgtttggctggttggttggtttttggttttttttgagttttttgttttgatattttatgtatttacatttctcctttttaaatgttttattgcaatattgatcatgaaataatatcttttttaatgttttattgcaatcttaactcattaactctcctaggaagacagttaggttttttttctatgtaaacatttgacattgtcttaactcatttaatttaataagtccttatttttatatctattacagacaggattcttccccttaattaaggtgactagatattgctaaatattgctgcagccctgcaagccaagcgttctcggggcctttcggttgggggatttttgcttccatcacatcacagagcacattttcactcttctggaatcctggcctgagctctggactctgacagccgttctcctctctctgagaggagagttgggttttaggatttaaggtggtggttgtggaatacattctgcctccttgagctttgaaatgggtgtgtagttgcacatccccttaggaatgtttggcataccagtctagacccctagagctgcacctgtgagggccgttcctgtttcctgtgactcatacaggttactggtttgaatcatttgacaaaccaacccttcccttgcttcaaatctagtggtttaaaacagaaataaattatttgcttcatggtgctttgtaagaacttcagcaggatatagagatggctttcctctggcctgtgctgtgatagacattagctggaatggctccagagcctgggtgtcctggataggactgtcagcatgagcacctcggctctgacactggagagaagagtccttctccattgtctgaaagtacttgggaagaattgatactaattcttttcaaatgcttgatagaatttacctaaagccatttgatcctgacttcgcagccatacatttatgtaaggaatagagagcg

SEQ ID NO: 22826 - DNA, 1208 bp, Mus musculus
tggtaccagctgtgtcagaaaactttgtgtgttcgaggtgttctgggtagcttgcagaagctgtatgagtggtgacaaacactgctgctgtccccttgtgtctttgtcttctgacttctataacctgttgctttatacttaccaggcagcgtctctctcttgaccgtaagagaaggaaggaagctattaatttaacagtcttgggaggtagtagtgagtctgaaatgaagcattctagaaacttcttggaacttctgaagagataagctggaagcagtgtctggccagggcaccaggggttagactctgccttcagaaaccagtgcagtggatcaggagagagcaggggatctgttggctgttttcaagcatggacccatgacttactttacacttcctcaaattatcatggaggaaaacatgttagaacattgtccaaaatgaaatgtttgaatactattgaattatttgaatattcaacaaaataatataataattagatataatagacgtttagaaataagcaagtgcatgaggctggtcaccagcatcacacagtactgtgcctactctgctcgtcacttgccagctggcctccatctctggcctcctaaggatccgcttctaggggtccaacagacctggttaccagcagtctccttgtgtattggccatctttaccctgcccccgtctaacccttgctagcctctgctaaggggcccaggaatcaatccaaagagcagagtctcttaggctttcctttccagaaagtaagtagatgtcatctctgcctttgaaaaatcatactccaagaaagaacaaagaggaagcagggtgcctgctgattgagaccaatgacctctagccacatacacctagtctcctatagagagctggtcagctgtagaaacccatggcccttatttgctgttcaggccacatcagcagagtatcttgctgggtgggtttcctgaaacaagaaaataactttgttttttgcaaaactgaataacgaactcttatagatacattgttagtgatattgcttgcatgattctgtctcactggtagatacatgtatgtttattctgtagaggaggactaagcagggggacatatcattggataatgcagggattctgtaatgctaagtgtcaggctgtatgggatggacaccgggctgagtagtaggagcgagtgctgttag

SEQ ID NO: 22827 - DNA, 1145 bp, Mus musculus
ttagtatgttaatgaggatagccatatatcagattactataaaatattccaacatttaaaagggggcactgtgaagacttagatttggcttatagaaccagaaagatttaagcaatgtgtgtatatatatatatatatatatatatatatatatatatatattcctttctaaataatttttactttaataaccattgtgtgatttttacctgattattaactttgaagcatatattgattttaaaagactaaatttcgaaagttaggaatcattatactaaaacaacctctatgtaagccgtgtatgctaccgtgttaagacatagtcacaaggtgaagcaaatgtcttagggcactgtcactttaagcctcctagtgtgcttctctttatagtatcgccatggaaacagttgggttccagagcctggtagattcatgaaatgttctttgtgctcactgatcagccttcaggagtaagtgcagtacaaccctgacttcggcttttgactggcctctccttgatgtcgggcactctgcactatcccagtgcagaggacaaatctcatttccccatccttaggcctgctgaaatggggaagggtctgtgggagcagttaaaccaggcttttgaccttccttgttggtgactttcagctgctgtgtagaagggaaagtgtttgccaagtggtttctgattcacaattggtttttttctctccattgagttgaggtttatttgttttaatccttgtttcatttagtgcagtgtctcatgaaccccagatttttcctaatggctcccagcatttgggcagattctgtgctttgttctctactgtgatttccattatatgtgcttcatacccccctgagagatgggaagaagggagcttacagatgggtaatctagggtacagggatgctctctaccttgcctcctctcatccctagcatcctctgccttctgctccgcagctttgtggtctctcattgttttttatttttaaaatctcactgccggactactatggaaaatagtttacatttccccacagttggtgtttttctcctacagagacatcccaatgccccttgtcagctcaggagtggagcatggcaacctgcgcgagctggcatttgcaaga

SEQ ID NO: 22828 - DNA, 1118 bp, Mus musculus
ctcagggcaggactctgcctcctgggagtgctcacctgacccgttcatctggcttccaagttagaagaccaagaatgagcaagactgagaccaggttcccatgtgaatcttagcgtgctcttgttaggcctgcctgagcaacaaacttgggctgtagacattccttcttagaaggttgtatgtcccaaatcctacagcaagcacatgtaagatcagacataatgggtttctaagtacacgcaggagggctgatttgaaaggtgacatgggagctatccacattaacctgagtccatcagtcgttagactgtgtctcagggttcttggtgacattgtaccttccaggcctctctaaatagaatcctgtgatccaaggaatgcaatcctggtaaacccctaaagggtagaaagaagtatgaaattcctataaccttcccatgggaaatgagaggcctcggaactcctcaagcctttagttgcacttccccctgcttacaaagagaacataatttgctcttgacccagggaggaggttgaactagattgtacatgtgttctagaaccggggagctgcagggcagcaactgagtgcagacctgtctggctaaaatagagtcacagacacaatcacatatcctatgaagtgagcattatcctgctcacagtcaagaaaaactatgtacatccaggtatagttgccccaaagatcctgactggccactcagccaatatttgatcttggtcattcttgcttgcaatatgtgttattcactactgttctcatgatctgaccaactgttatgtttacataacatgcatgtgctcatgcactttcttccagagccgatgtatgtatccctgtacaagcgtagcactcctattacattgcccattgctcagcacgtcataatggttacattttaaaagataggctaacggcggtattttttagaaaggtgttttaaaggtgcctaaacatcactttgaaaattatgggaaaaaatccagttaccccagtgatgaagactcagcaactttctcacttggtctttacatggaggaaacacaagtttggctttatgtctataaaagcaatgttaaaagtattttaagcataa

SEQ ID NO: 22829 - DNA, 1489 bp, Mus musculus
tttgagtttctcacctgagatgatgtcatgagacatcatcatctctaaacccaaggcattttgttatcagaaataatagttttagttaattacttatattgttgtattgatgtttgattgaaatctaaattttagtttataaatggtcttttcccttttttttcctgtaggaattgcttcatgtttggctgtttcctcagcactaatgaaattgcattttctgacccaacaccagatggcaaattatttgcaaccaagtactgcaacaccccaaatttccttgtatataattttcataactaaagccaattgtaaccacaaatctggtactatgtgggaaagttcagctagatagaaactgattaatcgtagcagaatgaacatactaagactgtgcacatgtacatactagtttttttttctttatatgttaatttgctgaggattgtttgggattcaaagaaaaaaagatctttgtatactttctaaattcttaattttgaaaaacttcacagcaagatggcttttgcagaaactgggctcctttataaggaatacatgaacacacttttagaccatggttgtctcatgctccatcagtagactctaaacaccggctatgagctaactcctgaattccttatgtagcaaccactttacaagcatattgtagcagtcaagttgaaaatacttaaaaagtattttgaatttctgatgtgttaataagataggaattatctcatatccatttatataaaataattccataatcccttagaaaattaatcaaaagcatacttataaagtttaaggctatttgccactgttatctgattttttaaaaaattattacatgaaaatgctggtaggtaattgaagtcatgaatcagactaatggacctaagaacataatgaccttatggaatatttgtacacctaaatgcactcagattttctgaaattggatactagtttgtaaaacagaaaattcaggttgttctaatccttagaggtcattaaactgatacctggcatgagacataaaggaagaggggtttttttttgttttgttttttgtattatagtttgttgtaaaattggttcatctttaatttgcctgtaatacttccaaaaatagtgaggaagtatttaaattataattatgcaagcattttaatgctattttctgtacaaaatctctttaagtgttttattaaaagttttactagcatttcattgttcagtggcttgtgagaaatcaattataattgttactagtgtatgtgtgtgtgcatgtatgcactttaaggtgcctccatggtggttagaaacacttctctcctgccatagcttccgagggtccaagtcaggtagccaggcttctgcaagaaccacatgaagtgataatttgagtccatactaaaaagtgaattatggacaacaataaatccacataccctaaggcagaccgcacattagagaacagcaa

SEQ ID NO: 22830 - DNA, 1202 bp, Mus musculus
tgagtaaaataattgttacattattatacagtatctagcttgtagtaattagtttattatttcacttaaagatcctcagacaatctagaaggtaaacacaattagaattgttataactgtaatcatctcatctgaggaaacagaaatttagccaccattgcacaggtcctcagtgctgaggccaagaatagaattcacgtttgaatcaaaagcccattgggttatatttcctcccctacatgacactaggttaacaataactaaattttaacaaacatttataatcatgatataggtactagtagcttccattttacagatgggagaaattgtggcagagaagtaagtaataatagtttagtgctgttaagtcacggctgaatactgtgatggggaggtggtgtgtgaagggagagaccatgacaagtagaaggtctaagttttgtattgtctgaacatcttgctaaaaaaaaaaaaaaaaaacaaaaaaacattgatttttttttttttttcttcacccatttattgttgaatgtctaggtattcagaaaagaaatttttggcctagtcccgtgtgtgtgtgtgtgtgtgtgtgtgtgtgtgtgtaatattcctatggagctgccactgtactttgagtcaggatttctcactcaagtggccaagcaaagtgttgctgaatcctatcatgctggtgactatggttcctgggttgtaagagtcaacattagcatctgcctaggaatttctctacacttgagtgggtagatattgtcctaagatctgacagagaaagaaaagtccatttttaaagtgcagttagcttctacagcaattctctctatgtgtctctaatactccagaggaaagttctttggctgtcagtcagctctggatttgagatttggcactgaatttactcattgtgttcctttgcgtaggcgattacttctggacctgggctttctaactgttccatacttacttttctcttttaagacctgaagaacagtcttctgtgggatccactgcatgtactaacttcttgaaacagacaaatgtaccgaaaaatattaattccagagatacaaataaaggaggaaaagaccagctcgtcattgtgagtcaatttagagcaaaggtctttccacgcatggcgcgtgcagtcaacctttcacagtggttatctcgggttgtagatt

SEQ ID NO: 22831 - DNA, 1190 bp, Mus musculus
attggttccaaggccctaggaatactaaaatctgaaatatgtagatgatcaaaaccctctttttgtttgtttgtttttttgttttttttgttttttggtttttcgagacagggtttctctgtgtagccctggctgtcctggaactcactctgtagaccaggctggcctcaaactcagaaatccatttgcctctgcctcccaagtgctgggattaaaggcatgcgccaccactgcccagccaaaaccctcatgaaatagaaaattattctcatgtaactcatgttttatctccccatgtgatttattctgactattatcaccaaatacagtataaatgcaggcgcagatagttgtcacactgtagtgcttacaaaatgctgacaagaaagagtgtttgtgggattcctaagtgctctttgtgcttggttggatctgcagaaatagaccccacagatgcaaaggaccagccatgcatgggtgtgcacagatactgtaattaagagtctcaagactacagtgttcagtgtgagaaaaatgctcctcctcccccctgctctgttacttgctgccctgtgtgaggtgctccaatgaaaaagcttcagtctccttagaacattttctgctctgttaccatcttgtgttgtacaacctgatttgtagtgtgcacccctgatcttcatccagaggctgagacttgtgtgagataggactgtacaagctcatcaggaagggtactggtctctgtctgagacgagctagatgctcatcagaatgcttagttttccattgcataactgctttgatctgtaatttttagtcctttttttatgtgtgcttggaggcatatatcattgctcttgcattcttcttgctcatcagttagcactgggcaacaagaggcctgtctaagctgattagtagaggactgggaatctgaaatgtgatagttgtccaaggacagtcccagaccgcagacacacagttaaacattcctgtggtgccagatcacctgcccacacatccagtgagtggcccctgtatggagagtgcactgtcccttttaccagctgggtggccttactgttgtctgtcctcactgaccgtgtacagaagctgacatcggatgtttctgatgctgttcctaaagtttaggactctgatgcagtcctactagcacatttcccattgtc

SEQ ID NO: 22832 - DNA, 1805 bp, Mus musculus
tacattattacttggaagttaaagtaactggagggacttggaggttgtgtccactctcctgggtcatataagagctaatggcagcaggctgtggcgagctcagtcatcttcctgctgctttctgcagccctgctgctttctgcagccctgctgctttctgcagccctgcaccctgagagtcggactgagaaagggcagcgggtcgcatgatgattatgactgtctgtcgggctcaaggcctcacggtctcttttgtctcctgcaggatggtaacgattccgatgagttcatgtgagctgagcaacggaccctgggaagacatgaatgtgcagaccattgcagagcttttgatttcatctaggttctgaattacagaaaccaaccaaccaaaattctaccttcattctacatagacatcattggttttggagtttaaaaaaaaaagtcacctttttgctgatgaaaagaacatatgtataatatagttgaactcgaagacaacttaaagtttagggaaaggagaatatttttggcagaacatccgtcagtacctcatgaaggctggctgcctttgtctttgagatagacattggagcagacggactctggaaagtgcttctgtggctgtggtctgtcctgggaacagacgtggtaaaatgcgtttcctatctctaaaatatctacttctgtgaagaagactggcttactcaggccagggccctcctgacgacggtttcctgactagaagaaagggacgtgggtttgaaggcagcagcagtgcttacttaacctgcatttcagcatttggcaagttctctcttgctggcgtcagagtagctggcccagctcttagcttgttctgagggttctgctgtgaggtgagggccccatctcagcatcgtagttacatagttgatcttaactaagcttgggaatacgtcacctgagatcacaggtgatccaagccgcagatgtgacagctgggctctgaagctatttctgtgtgtggagggagacaggaaagggtgctgtgctagtagtgagagtgacacagattgcctcatgattgtctggagtgtatcatgaaacaaaagtccaccatggattgcaagctttagaacgaatcaagcattttccctagccaggcaaggcattcgtttccttactttggaatagtatttatgttgaattgtaaacccacagttgtaagcttagtgacttcacatgtatgtagcattggtactggtctgagccacctgctacccagtagatagataacctttttgttagtgtttaagggagcccctgaagagactcaacagaacagtgagaggagagagagaaaagctggcagggttgtgactggcatgcaaatccatattctagcacaccacacagtgcccacagctctgcggtgctgagccagcagaaatgatttcttcagcagatgtaccagctgtcatcactgacgtatgcacaaaaccagaccgttgatccctggtattccaagttgagtatgggttgaactggaaaattccctgaggcataacttgttagccaatttgaggagagccagtttgagggttatgaaagtcagcaccagagatcagtgagtgtgagtgtgtgtgtgtgtgtgtgtgtgtgtgtgtgtgtgtgtgtgtgtgtgtgtgtatgtgtgtgatagttagactggagttctgtgatttaaaaaaaattataataaagtatcatttttgtcagaaagggcattgatatctgaattcttagaacttgttttctataaaagagagcagcccccacctcca

SEQ ID NO: 22833 - DNA, 1173 bp, Mus musculus
ccacacagggcaagagaagtctgcctggctggcattcccaggccttatgcatggatactgaccctgacaagttcagagagtttttattcacatgtccagaaaattcctcttttcagtcttacctctgcatctcaagagtggcctggaagaaacccaagcagagtttcatcggcaggtcaagaacctacaggtcccagagcactctgcttgacttctatccagctcccaggaagaccacagggctggaggtgggaggacatatcaggggaaaactcccctctccaaagccaccacttgttcaacctactctgccttgtcttactcccagtaatagccaaggaggaagaagctggtaacacggcagctcttgcctcctcctcttggttgacctgagacagatgcacaatgacctcaccccacaatgacctaagatggctggagttctttcccacatgaacagcaagctggaccaggcatgcgaaaggctgaacgtgcacaaggaaccttagatgttacttctcgtctttcatgaacttcttgaatacactggcagaaagggatgctgggaaaggcctgcatttccttgactcattttgtagagctgccctgatccttcatactccagcagactcaaacactcctgggcagaggctagagctgtgtcctctcttgccctgcctcagagacctgtcttcttcttcctgttcaaaggctctgtgctaccttcttcatcaatatcagtgtgcaactggcttgcacgacccatctacccctgctgtataattgtcctgtctacatatgaaaatatcatgcaacacaatatcgctgacccagtaaagagctgtttccagtagggatgtgtcttctagtgtttatatccaaccggaggatgtgacctcttcagggagccatttcatattgaccttcagagatgtatccctgtcaagggttctattgcagaatctgagaattgagaggtcttcttggagttcctagtggttggcagtgaagcccaaagaaaagtctgaggaattaccctaatggcaaggccaagctggaaaagccacagctggaccctgtagctattggctaaaatgaaagtggaaaatagaacaggcccagaccctagagggatgcttcctgattctacttgtgctctttaagtcaaagaaa

SEQ ID NO: 22834 - DNA, 2321 bp, Mus musculus
ggtgtagactatttttagagatgatgaagccagcctatcaggagatgcctcttattgagtctatttgtcatttatgtttcccaggaagaggtccttgtcaggccacacagggaagccccaggatggtttgagacaagagtgggcaaagccttcacctaggctctcccaccccagtaggacaagttaggtattggccagcctcactgagcatgcatggctttagcatctggtctgaaccaggagtccccgtgttggttcctaggacaggattgtccttgactctctctgtgggaacactgtagggtgtgaggtactctggaatacagctcagagttgtgggtgtctcaggaaaggcagctccagggcctttggcagtggttaaggactgaccagcctcaagttagtgccatagaggccaaagcaccagaatgcagtgagtgagaagacagctagtgctgggttggaacatgagccccactctgttactcagtctttcggcacggaatcgacactggttggtcacctcatgctttgaacgtttcctctggaattgtccagttttctagaacactttttaaacctgtgtttccacatctgtgatttgacactagtccttggaaatcactggaggaaggtatgagaaggagcctcagagaatgctgcttcagtcagtgactgttggtctgggagacgagtcctggccttgctggccttgtcttcattggcttccacctgcctgtccttgctctgctctctgcagattccacccctttcctttatgtgtccctctgccttttctttctcagtcatgcctgtagatggagtctaattgccaactaaccaaatcccaagagatgttgtaaggaaaaaataccatctcaggggtgccctgtcatcgtcaagacctaggacctagcatcccaatttcagcctgcacccctcattacataagacttgttttaaaccacgccgattacccactaattggctctaaatgggtcatgtgcacttgtggattatctaacaagtggagacacagaagaaaccctggtgcaggccaggccgggagcagggacagtgttggcaagccagcttgtgagtgtcagatgcttgggcaccacggatgtgaaaggtgcgcctggtgcaatgtatgtgtttggttaaagaaactctctgaaattactgttataataagtttttaaaagttttttctttctttttaattttcaccttaactcttaaatagggtaatttcaatgacctagactcttagaaaaatttgacttaccccacaactgacatgtttctttcagagcttttgtaaacacaaattcctagtgtaacttgtacctgatctgtccttcccattgtaagattccatcgtgtgcagtgaatgtgctgtgcaacttgttagttgatggacatttggcttgttgcagtgtgtttagctgttatgagttctgctgctatgaaatttgtgtgcaagttttgtgtggctgtgtctcttgattttctgtcatataccttggagtctgttttccaggtcatatgataattattttaagccctttggggacttgccaagctgtttctaagagagccgtcccattttctactcccaccggcagcaggtgagggctggtttgtaacgaattctctctgccctcttaagctgaggaagctggagtaggtctcatttgccctgtagttgcgatctctgatggctggggagcatctttcctcatgtttgctgtgtatctgcttcagagacttcagggtgtttgcccattgggttgtctgaccttttattatgaaggtttacaagtttgttatgcattctagataaaagttcctttgtgtcagatgaatcacataaaaattttcctcctaattcagtgagttgttttttattgtctttacattttttatttttattttattttattttattttattttattttattttattttatttttttagggagtgagagatgtctcattggttgagatcacttctgctcttccagaggtcctgaattcaattcccagcacctctattggatggctgacaaacacttgtaattacagctctaggagatctaacacctggtgccttcatgcatgcatatacatacatccatacagatatgagaagtaatctttttaaatgtatttatatgcacgtgtatgtgtacaagtgcctatagaggccagaagaggccaccaggttccttggagctagaattacaggctattgtgagctacctggtatgggtgctgggaaatgaaccaggttcctttggaaaaacagcaaatggt

SEQ ID NO: 22835 - DNA, 2797 bp, Mus musculus
gacttcctttcttccattttttttttttttaaagagcctgtgatagttgctgtgggcagccagttcctggggcttcctcttgggccccctgcactcggtctcccctggagtttctgaattctctcacccaagtccctacacagtcatgaacaccacacccaagcctagccatccaccccacacggagctgcatccaacatgcagacatgcgccaccaagcagatcccagcaagggtgccccagtcacatccttggccatgcagttagcaccttcctgtcatggggaagatatagtgaattgccctgagctgccttcttttctttttaaaaatttttaaataaggttttctttgtgggactggggaggggtggggagggtgggagagattttttttttttttaatactaaattgaaagcctgattcaatattaatcctcgggtcttgaactggacatcctaatgatgcaattatgtaaccattaagctgattccgaggctggcaggctagggccgcccctctggaaaggttccatgtgtctccatccccatcccttactcttcgggtcagctgttgagaagaggcgggttttcttcattggcctagattttgcggcagattagaccttttgaaggttctccaccattttcgtacgtctcctgtcctggttttttcttctgcactcttggagagatttagatgttggtctcctggtttgtgtttctccgagacaatgctctttttttttttttttttttttttttttttttttcctcttaactctgtctgctcttaaagccaggcaacccagtttggtctcaggcatagcctgagcagatcttagttttgcccccaccaccatagttttgtgctatcctagtttctgttaagattggtgctatccaattcccatcactaggaggtggctgagcttgaggcttgccagacacaggaatggccccgattatgtcaccaatattgtcacatgtgggccaagaatagagtcacatgtggtggaaagatgaggagttaggctgtagaagtgacagtttccagtcaaatctgtaaacccagcccccaagctgagaccagtctccctgtggcggagccagccaagatggggccattctctctgtggaggagccccttccagcctttgtcaggaagtgtctttggggattctagaatgttgggacttctcagtgtgtgtgttgtggtgggggaactttttttttttttctgtacagttttttttttttttttttttctcaaaaggtctaacatggtggtggaaggtagaaatctttgggatacttagacttcaagtcttttacaagagggacaaccctattttgggaaacaatatctcatgggaagaaaactgtacacactgaacgcatagcccgcttagagatcacatcgcctcttagagaccatgtcacctcctatctgtcacccttcctcttcctgtcacagtgacaggtcttcactagctggcttctttctgtacttgctgacttctgtcatatttctttccagatgtgtttacaggtccctgtaagcagtgttaggtccataggcttttatgactccagtctgcaagcagtgttaggttgacctcataggcttttatgattccagtctgctggtatgaagcagagcatcaaaaaaaattcgtgattccttgagtgtccacacgttttgtctttgggggttaagggttgggattttgggtttgttgttaattttgttgttttaaaggtaaattgcacttttaaaaattggttgacttaatatatttgctctttttttttttttacctgcacttagagaggaaatttgaacaccagaaaccactttttttttctccctgtttatttgtttggattctgagaaacttgcagctcttcaccatttactcctgatgtttcttgtatggggccgtggcccttttggttgtttttggtcattttcttaaaaacacaacacaacacaatacaacacaacagttttaaacctgaagatttccgcagtccgtgtaagcatgtttacccgttggctcgctttctgtgtctgttaaatgaatgtcatatgtaaatgctaaactaagtcaacagtgtctcagaactgaataactgcagtgacttgatgctctaaatcattgtaggatttaccgctagatggttttgaacccttgaacctgtgattgtgacccatgaggggggacctttcagtgctaaagctgatcatgtgtgtagccagaaaggtactttttttcttttaatttttgttttattttttgtaaccactgtcttaatggcaaaataattatggtaaaatacaagtctcgtgtttattattccttaagaagtctgtgttatattaccacggaacacccaataaagcaaaatgtggttgtttcagaggtgtgtctgtattgagactcccacagtgtgtcggcctctcctctgacgtgatgcatggggaagccctggcctggcttagccttgggcttggtccagcccatgagtgctcacccccatgctcatcccaggttcctgtgagtatcctggctacaggatgaattctcaacccatgtagtgccattcctgggggatgaggaccacggaggctgaggatcatcagtgtcttaaaaccccatcccggaaaggcagtgagcatcccggagtgccaagccaaatttgaacctggggttcaagtggggccacagaaggcgaggtggggttttagtcgaggtgctgggcttgcttctcatgtgtttactctgggaaatcttc

SEQ ID NO: 22836 - DNA, 1427 bp, Mus musculus
tcaaaagaaagcgtggctttctctcttctttttctctatatccctcttccaggtatgtttgatccccataagccatagggtagaaggagagaaccaattcctgcaagctgtcattttacacacacacacatgtacaaataatgtaatttttaaaaccacaacaagtagaccaatgtttactcatacctttgaaaaatggactgaccttatttaaaaaaaaaattatacaaaacacatatatcctacttaatgtgtgcaacaacctactctttatagggtgtgtgtgtgtgtgcgcttgcatgcatgtatgtgtgtgtggaggaggggtggggcttgtggtacacttcataaagggaaagatgcaaaggtcaactaagttaaatggcctcagcaccaaaatgctcagaagtgaaaccagagcagaggcccagaacaagactttagggatccaccctctgtgcgtcgctcaaatgtgttttcttagttctgtagaggactgattttaagcactagtgttttaaactccttacatctcagacacccagcaggtagtatcaagtgtgctaatgaccaagtctcagtatctccgtgttcaccaagcttgcttttgtttccaaactgacccaggactgcagaacaaagctccctgctggcaatggtgagcctattccaaaagccctgtaattgtgcacagacttgaaaagccatagcgccttgtgagtatgtgtgccaggtcaagagtactagggcaccataaacaaacactgcttagttgcctgccaggcagagctcgggcacagttagtgtgcagcctgtggtagatccctgtgtggttagcaagctgcttggtttctctgaacatccgtttccttatctaaaaatgggctgccattaggatcaagtggcacaatgctttttaagggcttggagtaacgtttggaacttagaagcccctccatatactgaggatctttgtatttttgtgatagttgtcagctcaatgcatgttctcttgattgtttccattgtatggaaacaagtcacaaagtaacagacttacattccagtcgggatgctcctgcagtgaggaagaactttggcttggaagtaagtgtgcactagctggccgtccacatttgtggtaagtattccagaagtagttggtgactgttaatcgacttgactttggaatgatgacctgttcttccgggttgtgggttagtttaactgaagaataagaagttctaagaaaggtggtttgtttgtttatttaagtcatcatctgtgatggtttatctttcggaaatatatttctcaacactgtccagccacagtgatgtcagtgatgggattgtccttgaccactctagcctgactccacgtggcattatgttcctgggaatagctttgccgttgtacttaccaac

SEQ ID NO: 22837 - DNA, 2902 bp, Mus musculus
tggcaacctccaggacttaaaagtagatgatgttgaatttgaagtatcatctgaccagaggactgggaaacctattgctattaagttggtgaagataaaaacaaaaacaaaacaaaaatacatcctgaagaacgaatgaacggacacgttgtgtgtgctgttcctcacaacttagagtaaatctccagctgccccaagttagagtccaacagggagtgtatggtaccaacgtaatggggacgtattttatctgacttacacctctgaagatgtggaagggaatgttcagctggaaactggagataaaattaactttgtaatcaataacaataaacacacagatgctgtaagtgctcgtcacattatgctgttgaaaaagaaacaagctcgctgccaaggagtagtgtgtgccatgaggaggtgtttggctttatcgaaagaggtgatgttgtaaaagagatactctttcactatagtgaatctaaaggtgacctagaaaccctgcagcctggagatgacatggaattcacaatcaaggacagaaatggtaaagaagttgcaacagatgtcagactattatgcctcaaggaacagtcattttcgaagatatcagcattgaacattttgaaggaactgtaaccaaagttattccaaaagtactcagtgaaaaccagaatgacccatagccaggacgaatcaaagttgactttgtgagtcctaaagaacttccctttggagacaaagacacaaaatccaaagtgaccctgctggaaggtgaccatgttaggtttaactttccaacagactgacatgacaaattagtatgagcaaccaacctagaggctctatcaaatccatttcaggtcactaatgaagccagagagatgggtgtgattgctgctgtgagagatggttttggtttcatcaagtgtgtggatcgtgatgctcgtgtgttcttccacttcagtgacattctagacgggaaccagctccacactgcagatgaagcagagttcactgtggttccgaatatgctctctgcccaaagaaatcatgctgtcaggattaagaaacttcccaagggggctggagagatggctcagtggttaagagcaccgactgctcttctgaaggtcctgagttcaaatcccagcaaccacatggtgactcacaaccacccataatgagatctgacaccctcttctggtgtgtctgaagacagctacagtgtacttatgtataataatagataaatctttgggcctgagcaagcagggactggagtgagcagaggtcctaaatacaattcccaacaatcacatgaaggctcacaaccatctgtacagctacagtgtactcatatacataaaaataaataaataaataaatcttttttaaaaaacttcccaagggcacggttttagtcccttcccattcagatcgtcgttttctgggcaccgtaggaaaagaagccacgttttccaatcctaaaactacaagcccaaatagaggcaaagacaaggaggcagaagatgacgactgtggggtggaactgaccattgcttgtcaagcccaggatgtggaaggccctacttctcctcaaataggagagaaggttgaatttaggattagtgacaaacagaggcctggacagcagttgcaacttgtgtgagactgttaggtcataattctaactccaaacggctctcgggttatgtggcatctctgaaagataattttggattttttgaaacagttaatcacaataaggaaatgttcttccattatagtgagttctctggtgctgttgattgccttgaactgggagacgtggctgaatacagcttgtccaaaggcaagaaagtcagtgctgaaagtaaacaaacctcactccgtgaatggcattactgaggaagccaatcccaccatctactctggtaaagccattcgtcctctgagaggtgttgatccaacgcagattgagtaccaaggactgaccgagactgtggaggagggggatatgaaaggtgaagtgtatccttttggcacagttgggatggccaacaaaagggattgcctacagaaaggggagagtgtcaagttccagttgtgtgtacctggccaaaatgcacaaacaacatcacaccccttcataaggccactgtgtggaagatcagtttggctttattaactatgaagtaggagatagcaagaagctctttgtccatgagaaagaagttcaggatggcactgagctacaggcaggagatgagttctcaatgagctttaattggcgcactggaaagtgcagtgcctgtaatgtctggcgagtctgtgaaggccccaaagctgttgtagctcctccacctgaccgacctgaccggctggtcatcgctttaagaacatcaccctgaaagacgccagtgctccacatctaatggttcttcatcagccaagaggaccagataactcaatgggatttagcgcacaaagaaagacctgtcaagctggtgtcactgactaaccacgtccacaaagcacatcattaatccgccatggtcaagttggggaggttcttgtgaagggttctgagtatcttcctcttcatctctcccaaaatctggagtacttatcctattgagctattacaccagttttaacacattccttgtgttatgtgtaaataaataaataaataaatttaagaaaccattttaaaattatgcaccgttgcagcccggaaaacttaaggtggcacccgccttatagtgtcaatttaggagctttatttggtgcatttaatgcaactggtaattgcaaattccacttggcctgtgtaagtgaacaatacagactgctactctgttggccctatgaaattctgcactgcagtcagtataca

SEQ ID NO: 22838 - DNA, 2394 bp, Mus musculus
gtctttgttttgttttccaggacaaaaacaagcttccctaagcttgaatttatagttataaaatgaaaacaaaaccaaaaaaagaaaaaaaaaaaagcaagacacaagaaaaaaaaatatcctgggcaataaaaattactttaaaccagctccagagccgctcttttcctaagcctcctgtgccgccttcagtttgtaggaggcagcctgtgtgagtgacagacaggaaacagaagagtagaacatactggcagagttttacattaggatattgctgtcttttctacgatagagaatctttatttgtaaggaatgtttcaggcctagacatacatgaaacttatttttgaggtttttgtgcttttggtattttcatgtgttacctgcatgtgaatttctcatgactttgtttttctagtttcttttttttttctaagaagagacttggaacgagtctgattcatggtgttaatagaggcttcttgttttaggaagctttgcttacactctggagcctttacactctgaaggagaacttcagggttattccaagtacttgtgtgacttggaaaagtagacttgggttgtgggaacagttgataaagttctggaaagatgccattcattctacagtcttcccaaggtgtcctagtctctcccaggcccctgtgattttctcacataggtgtcttctcagttctgtcaaattcctgatgttctgcaatactcagaaaattctttgaatggcagactttcttttgtctgtttctaaaatgtgaagctttaggaccaaattgttagacagcatcaggattgcggattatctcaagtagattttgttagagttcagagcacagcatcactctgaaggagtctgtcttataaatacataattactgtttaagatgtacactttgctatagttacagaaccattgtgaatttcaaagctagcaacctacacggtgcaccaggttgacttgaataaatttggcaaccaggtttgcaagcgtgcagaaactaactcctctctcacaaaggcttataaaattggtgtgtcctatggaaatggaaagaaagatagataagacatttctgtcaattttcaagaacttggctgtttatctttaagaaagataaaatatatatccaaaataattttgtgagttattttccttctggcatttaatacctacatgatttgtgagctacttctgccttctccttctctgctcttaaacctggagacgcttgctctgccttctcccctatcacttcaagtgtttatacctgagtttcttaggaagaaagtaagtctgatggcttgttgttttgctgtagttgttttgaaaagccgaaatcaaatggtcaaggctgctgaggctaaactccagcagagtttgcagcgctgatgtgtgagctggcagagcagaatcactcttcaagcgcttgctcttacaggcagacatcgttttctctctaaattcagtagcagtttcatcgacagtgccattgaactatgggaacatttatgattttctttcaacattaaaactgaagttagttttgccatttttgaaagtattagtaaaatcatggaatacatcacagaacagctgtccatcagtgagcttgtacagtgctgatttgcagctccaacatgcgggatgttcatcctcctacacagattcttgttgggtgaaacagattgtcctatcacaaagcagaattcaacaaagttaaaatttaagataaggtttaaaaagctttattcctgtttacaatttgggatgagaagcaggcttcgttttaagtttattgaaaactggctcagatgtttataagtcaagaggaaagcggcacagagaacagcacagtgaagagtgaaatggagaaaactctcacggtgaagcagctgttggaactcctggtattaatggagccagagtgacatgcatccttcgtctgtctcatcagcactggcgtcattccttacagtttacagaactcatgtaacttgtagctataaacattttgtgccattaaagctctcacaaaacctgcctgtccatatatcattttgacttcactcttgttgacaaaaagcctttccgtgcctacatgcaacccttcccatggagagctcaccaggaccggaggacctaactgtcccaagtggtgctgcacaagcctttcttttgagagtagtagtaagtgaaatggtattgttgaatcagttggagtttgtagtagtctgggctggcctgacattaaacttggttactgtggaacgatacatgtagctcactaggagagtgtttgcctgccctgtgaagctgtggattcaacccacagcactccttcgtccccatgtaagtagggactaaggattaaa

SEQ ID NO: 22839 - DNA, 1798 bp, Mus musculus
catcatgaaactttgcttccttagaaacaggtaactcagacgaagaagaaaaatgtgcttaggtgctgtcaactttgttcagttttttagatttgttttttggaaggagggtttgaatgtttgtggtttaatatcaacagcttctatgtcctaactcaaataaactgaagagaagttgcttcctataaagtgctgggccaggatggtcactgacttcttacagtaaacacagtctctctcttgttaacatgtttgactgggtgttctgcctttacagtgttgtcatgactggatcctacaataatttcttcagaatgttcgacaggaacacaaagcgggatataaccctagaagcatcacgagagaacaataagcctcgcacggttttgaagccacgcaaagtctgtgcaagtggcaagcgaaagaaagatgaaataagtgttgacagcctagacttcaacaagaaaatccttcatacagcctggcatcccaaggaaaacatcattgctgtagcaactacaaacaatctgtatatatttcaagacaaagtgaattaggctggcattctctgcagaggagccacttcctgcttagtgagatagttgaatctagcattcatacctataagagagcggtccattgtggcgcccctttccagtgtttgacagtgtgccattcaacaacacatttgatagcctcatggagaaagctgtgtggatgcatcccaggctgttttccatgtctgctagccatttagggaagggaagggcacttttaatttaatgacttcttgcaccatcttgcctggtggactggactggactgtgtcagcattgatgtactccactttttatgccttccattgtgatgacgtcaaacacagtgaacgccttcagtcatgctatggaatttgtgtatcctcattactgtatcatttgtggggtacacccctcccctcttttttaaattaaatacagctcattcttactgtggcttgtagcattcctcctctctggcctcctggactcttccctccatctctcacccttgccctttccaccttgtctcggtggtggcgtattcaaaaaaggaagaacgaaagcacacaaaatgggtcaggttggggtcagtggtaatgggggaatatgttacgaacaaatgttttaataacagttggctgtaatcactccttgccatgtctggcactgaaaataaggaaaaaaaaaaaaactactactgaataaaagtgacaaagaatggagaatctggttttctttttctttttcatctacctctttaaaccaatgttttgtgtcatatccttgggcgcaatgaaatgaagtgggtttctattgtctccttggttttttttgtgaactatttttaacgagtgttcttttccatggagcctgggagaggatcatggttctgtgcgtccatgtgtttgaatatacatgactgttaagagttcacagtctagaaatggctagaaggttctggggtttttgttttgtttttgtttttatgtgtctgtgcttgatttatctgttaacaaagttgctgtcaatgagaaccacagttgaggagcttcactctgaagtcttcttccagtgcttcatttctttgccttaggaaataccaagtagacaagttgacttttctcgctgttcaggcacagtagactggaattccgtctggaagtaacgtggtagatgaaaccggatgctgcactaaagagctgttttgtactaattgctgtggaatcactgaattgtactttgccatagatacgtctttt

SEQ ID NO: 22840 - DNA, 1137 bp, Mus musculus
ctccacagtgctgggattaaaggtgtggtggctaccatgcccagctgcattaacttcttaaatagggaccactttcttcctgtgttgtacttctaattttaaatacaatcctggtttgtcttctttcttggaaattttcagtggatcattggatccactggattagaaactagatttcagcaggcaaactatgacatttctttagtatgttcctcttaagctattaaggggctactaaactgatactgtacaagcaaacactatgcattctactttggaatgtttttgctattcttgggattgaaccctagccttgtgcatgctaggcagatgctacaccacttagctacatccccagtctgttaatcccattgatatgtcagacatcctcctacaattgttccttagtcagaatcccactcaccctcagtcacactataaccttctaattacctcctgtggaaatcatttttaaaatctattttacattactttgttaaataagtatatttagtaccttgagtctccactgttacactttaagcctagtgacaaagatctttgtttctccgaaaatgtcatatgtaaactgcttggcctagaacaacacctggcatacagtaggcattggatatcttgagtgtcagtgttcctgttgctagggtttttaaaggggaagcagagagatagaaggtctaggatagtagaggtgaacttctgaagaggtctttctgtttcttgtttgcagctttataatgcagagaagggtccaacaatttagagtctgttgctctgccttgagcctttctgggttcctgtacttagccataaaatgaatgggactggatgaagtgatttctgctgtttctttctgcttttgttagttctcagatgtcagaaggaggtagcgccatattcttactactgatagttgttttaagatggttactcagtagggaccttaattaagaataatgtctttactggactgacttttcaaggcttaggagttttattaggtatacaaaacagagtttgacactcagctacaggctcttgctatctttgcctttttggtctttaaggcaaggcaggacacttatatgctaagttactgtttcatctacacaggtctgc

SEQ ID NO: 22841 - DNA, 1162 bp, Mus musculus
tagacatttgtgatgagtgtgtctctaagctgaaatgaggaaaagtggttcttgtgttacttacggggactgtaagtgtttgagggtcactgctgactgtcctttagttttactgctatcacaaagtatgagttgggttagatggcttggagaaggtgcctctgccaacctgacaactgagttcagtcctgctttagcccattaacgtttcaagtaactattaatatggcttgatttacatctactattttgccatatgctttgttttcatttcctttgtattaaaagttctgtgttaatgtattagtatttactatcttttgagctatacttcattctgtcttattctcttgctctgggattccaacgcacattcttataggtccttttggccatatgcatagctgtacataaaacacacaagtttatacaccctgtgtcttgctgatatacccttccttcctccttccttcctgtgacttatagtcctttttacacatacacatttacttggttgtgacgcatgcatgttgtcgtttttgctttaaaccatcaatgtctcatgtaaggtaagaggaaatagggggttttctgtgtttactgaacttcgatacctatttctgttccacttgtccccattttgtttgtttgtttatattaatccttaatgattaaatttcttcctggagctttctttcagcttcaaactgaatttctttcacctttcttgcagtgaatatctgctcaggcttttgattttaattctaaggtagatgggtgggtttcttcctgcgcagataaggcacaaggccaggttatgtttgtcacctagatgaaataaggtactgccaccttcttggcagttctttttcatcctcatgagacttactgtcattgtacttgatacccagttctacaatccgtcagagtggtaacatcataacaagggccgatgtgcctttaagtactccacttaatcccacccagaacaggggaagaagcgatgctgtgagcagtggggttttgttaatgtagtctaatatttcagactgcctggttatttgatgaacctggccatgagtcagacaggttagaaagttctttgttagtctaggagatggctcagccattccgagtgcctgctgacctagaggctcctagc

SEQ ID NO: 22842 - DNA, 1103 bp, Mus musculus
atacacacacacacacactcacctcattttgcaggtaaagacattgaggcttcacacaaaaagtggactataggcttttactaacaagcccagcttgctcacatatgacataccccaagataacatctctaacaaggtcttgactgcctagccccagtgaagatggtatttgaaaagtcccagatagttcttttttttttccattttttattaggtatttagctcatttactgtcccagatagttctaacagacttgagtgttattggcaaaactgaaagctttctggctatgacttggatatgccctgggcattctcgaatctctccaatggccttgccctgagtcttttcttccaagttcaagtgaacaggaggattcaagcatttgcatacccgcctcttcacgtctttgctaagggggatgcaagatgcccctggttcatcacagccatcagaggagcaaaatacagaggcatgcctggcacagcactagaaaagttagtatacacaccccagaaagccacaagagtctctttacttccatgatggagcacccaatgcagccatggaaagcacacgggctctgaaatggtctcaaagctcccgtgtcaccataagatttgcacttgaaaatctgagtgtttgttttctcacttttcaaagtgggggatagtccctcccacatgggtggttgtggggtgcaattaaggtttggaacggggtgtgcatcagtgactttcttctctctgctaaggtaaggtctgatacggtttggtttttcttcagggtatatgaggttgaattcagatatgcatcttccctaaaaaaaagaaggcagcctggggcaccatttgcacggaagggttaataagagttgaagattattttaagtacaaagaaccaggccctggtgtgaagaaggagggaaggaaccagaagggtgctagagggtttccagggagcttgggacttctgagaagaccctagcaggctggtgaaaaaggactcgaagatgtcaccttgctttgcaggccgccattgaaaacctgggtgggaaaagaaccaaatcctctgcctcttcttgcagtgacagtagcagggg

SEQ ID NO: 22843 - DNA, 1183 bp, Mus musculus
gcttcatcgagcgcgtgcacgagctggagcagcagaacaaggtcctggaagccgagctgttggtgctgcgccagaaacactctgagccttcccgcttccgcgccctgtacgagcaggagatccgcgatctgcggctggcagcggaagacgccactaacgagaagcaggcgctgcagggcgagcgcgaggggctggaggagactctgcgcaacctgcaggctcgctatgaggaagaagtgctgagccgcgaggacgccgagggccggctgatggaagcgcgcaaaggtgcggatgaggccgcgctcgcccgcgccgagctggagaagcgcatcgacagcctgatggacgagatagctttcctgaagaaggtgcacgaggaagagatcgccgagctgcaggctcagatccagtatgctcagatctccgtggagatggacgtgtcctccaagcccgacctctccgccgctctcaaggacatccgcgctcagtacgagaagctggccgccaagaacatgcagaacgccgaagagtggttcaagagccgcttcaccgtgctaaccgagagcgccgccaagaacaccgacgctgtgcgcgctgccaaggacgaggtgtcggaaagccgccgcctgctcaaggctaagaccctggagatcgaagcctgccggggtatgaacgaagctctggagaagcagctgcaggagctagaggacaagcagaatgcagacattagcgccatgcaggtatagtacggtttaagctcagtgggggtggggaggtccacggtaggggcggcggcggggggggggggagtcagggtgtacccagagagtgaacgctagggggttctagagcacagagcagctatcagagggcttggcttccgagaggttgtggaaaggatggggcatttggagggggcggggcgcgactgctgcctggggattgcttgttctggttgaatcagggttgttaggggtgagttgggaggaaggggcggagggagtcggagttgggcgttgccaagtaatgccttctctttactgacaacccttaactcccaagttaccctcagtacttcctggatctcctggttaataaatatgcctgctagctctcactagttttgggccacccagccttgggatagtttttttttttaatagggacacaagaatacagtcac

SEQ ID NO: 22844 - DNA, 1163 bp, Mus musculus
gcgtacagagggggaaactcagaggatagtgatgacctcaaggcacacaactgtactgttcccgagggtgttcaaactctaattcaactctgttgtcaatctgcacttgtaaagagggagggatgtgggaaatggaagaatcactgtgcatttttgtaattgatgacgtaaatgatgctgaaagtataacaacgtaaaaacagaattctaggcctttaggcccaggcttgggaatgtggcctttgtaaaggtatgctaatcataaaagagatagcgacattcctctacccacccgcttcctgggttcaaagagtgctcattcaaagaaagtcaccctggccattaccagaacctgcaatgcaaatgtgctattgttaggggctctttgaagctgtcttgagagttaacaattaccaggtattccttgtgactcttgtaactttacacttccttgtgactcttaactggtatctttggtatcttccaacaaagccctccccacttccttgagttccggtttcttcctttaaatacccccttacccagctactcggggcgccacggtcctctacccctgcgtggtgtatgaccgtgggcccgagagcgctcttgaataaaaatcctcttgcaatttgcaacaagaccgttttctcgttggtgattttggggtgtcgcctctcctgagtcagaacgtgggagagtcctcacgttgtgggtctttcaatgccctagagataaggatgctaaatgaaagacccatggcatggctcctccgaagagaaacagagggattagatggacatctgtatgagttgtccgccgtgggtgaatctgagagttggtgtgttgtaggggctccactctgcactctggagctagattccctgttaactctcagctcagtgatctaacttctgacttagtgtccctgcagccagagacagacttagagagataccagattctagcttcctgaactcttggaggtttagatacactgcctcactgtcactgaatgtatttggatgcatgaatttcagattgttttcttttaaattccaggggtgaagcccagtgtctccaggggtccttaataattattctgtttgtttaattgctgagtcagcaaggccatttattgatttagaaaagttcacatggat

SEQ ID NO: 22845 - DNA, 1512 bp, Mus musculus
gatttataaggatatccaaagataaggagtcgtatagacacaggaaaataaaaagtaactggtcaacataaaagtattgactgttattaataatcactcctttgttcaaagtgggaaaggaatgttgtgattccaaatgaatggcttgttattaagtcaaccatatttatacacagctacttggcaggaagtcagctagtaggaagaaaatgtcctttgctggaatccccagaggcaacagtacaggtataagaaagaggatcctaagtcctcatccaagcagaagccctggcctccaacttctaagactgttctcagccctatttgatctccctgggcctgtctcttatacttattttaattaagcacagtttcagcatccccccccccccaacccttctttctgttccagacacacagagagactgagaggagatcccaagtaaaaattttaaagtctgaataattaagaattgcctgattagcttcttcttcttcgggaaaacaccaaatggcgatgacaccggtgcgggagggggtggggcggaggggggagcggagggggggggcggagggggggcggcggaggacccggggggcccaggattaggaggccgcagtggcttccgcggaggaggaggtcttaggggccgcgtgcgtcgtggccgaggccgtggctgtgatcgaggccgcggggctcctggaggttaagctaaagacaaggagtggatccccatcaccaagctgggctgcctggcatgaagatcaagtccttggaggagatctacctgttctccctgcccgttaaggagtctgagatcattgacttcttcctgggtgcttccctaaaggatgaggttctgaaaatcatgccagtgcagaagcagactcgggctgtccagcggaccaggttcagggctttcgtcgctattggggactacaatggtcacgttggtcttggtgttaagtgctccaaggaggttgccactgccatccgaggggccatcatcttggccaagctttccattgtccctgtgcggagaggctactgggggaacaagattggcaagccccacactgttccatgcaaggtgacaggccactgtggctctgtgctggtgcgtctcatccctgcccccagaggcactggcattgtctctgctcctgtgcccaagaagctcctgatgatggccggtatagatgactgctacacttcagccagaggctgcactgtcaccctgggcaactttgctaaggccacctttgatgccatctccaagacttacagctacctgacccccgacctctggaaagagactgtcttcaccaagtctccttatcaggaattcactgatcatcttgtgaaaactcacaccagagtctctgttcagaggacccaggctccagctgtggctactacataaggattttgtacaagaaaaataaaagaattaagtctgctaaaaaaaaaaaaaaaaaaaaaaattgcctgattaatcagagccaagcatc

SEQ ID NO: 22846 - DNA, 1185 bp, Mus musculus
agataggaaaaggctcagtgaccagtttaggatagccataacctatctcggtcattggcatctttggagtgacatccaaggatggaccatcccacctgtgtacaatgataatactttagctgtgtgtgtgtgtgtgtgtgtgtgtgttcaggccatgtgacagtcaaccatttaatagatgagtgttaatttattatagataaatattgatctttaaaaatgggatgctcttaattcatgactttttaaagaattggattaaatatagctacttttatgtgagctttcccctctgtccccctgccccttctctctgtctcatttctcacaaccatcaccctccagtgtcacccccaaggctatatctccaacatactgctatgccattaaggttttatttaactttatttatggataattatgtctatgaacaacaaatgtgccgttaccggtcacacagtgtgtgggataagagtggcctagtgttgctttccgaatgtcttaaaatacctgtggtcaagattgtttttgcctttgtggcctttgggtttggagagcagcattgtgttcacatgtgtggatgtctgtcgtgctgctacagttgtaacactggagctggaaaaaataaagcattgatcttgaaaccattgtggggtctttgtggggatgcagaagggtccggagaatgggttcagaggagacttgatgcgctgggaactagctgaataggaagcagatcatcttgccagcagagggcgctcatgtacatcacacggcctagaggcctcctgcttgaacatcaggaggatggctccctcaccccatccccaccccgcccccgcacatacctctgtgcagagtccgtcaggaacctcttacagagaaagtctcagatgaccagagtccacagtctcaaaatatcacagccaaagccagagagtagaactttcccaagaggtacaggtgaggaagcctgaaaggaaaacgtttgctttgagaacgctggactctatccccagaaccaaggccaaagatctgctcagtatgactgccgagtctctcccaaaaaggtacaaagttagaacggaggctaagcctggaatccagccatggacacaggtgccaggtgggcaaaggtgcagagcggagagtgccacggagcaactgtctgacttgtctcctcct

SEQ ID NO: 22847 - DNA, 1361 bp, Mus musculus
tacaggagttacaccacacagctgaccatgaatatccccttccagtcaattcacttcatcacctatgagtttctgcaggagcaagtcaaccctcgccgggactacaacccacagtctcacatcatctcaggaggcctggccggggcactggccgcagctgccaccaccccgctggacgtctgcaaaaccctcctcaacacgcaggagaacatggctctctccctggccaacgtcagcggccggctgtcgggcatggccaatgccttccggacggtgtaccagctcaacggccttgccggctatttcaaaggcatccaggctcgagtcatctaccagatgccttccaccgccatctcctggtccgtttatgagttcttcaagtacatccttacaaagaggcagctggagaatcgaactctgtactaaaggaatggggcagtgggaagtggttctgacatcctttgttccagcttcatcctcttgttctcgcacccagggcttgtcctgaagggtgcttgcgccaggcccttcgttccctggtgccgtagagagggaggaccggcctccactgaccagcatgctgtctgtggggacatccgaggtggtggtaggcgggagaaacttggggagagggagaagttgcttttctcctccttcctccagaggaatgtagcttttctgcctcactgtggccttctccctagatctttagatcacaccgcagaggcaaacagtgacacagcaaagaaaaagtttatgtacataaaagtaccattaccccagtctgaaataggtggataatgtttatcctttatttttctacatagagatttttgaaattgtgtgtgcttgtgtgtgtctataaataatattagagttgggaatgatggacctgttttgtttttttgttttttaaataagagagttccattcttccatcatgagaagtaaaacaaacaacaacaacaacaaacaaggggaaaaaggcaccaaagtaataaatggctttatgtggcctgaaattgtgtgtagcgcccctcccatgggagtttaacttgaatgtaaaataataaatataaagtttatattttgaatttctcttttcatggggaaaaaggtacgttgaaaacaaatcaaaatagtctatcacttggagcttttttttgttttgtttttaattttaattttaaatacagttaccctgcgtgcctttctgtcttttctaagacttccaggaccaaaattagggtcctggagcattttctccctctgtagacacccccgtacagtcctcagcaccatggctgtctcagtagaataagaatggctggccttaaccttccgtgtgagtgatgtgagcg

SEQ ID NO: 22848 - DNA, 1150 bp, Mus musculus
gttaagaaaatctcgcttctcctaagccgttgactcattaatgcaccatgtttggtccattaagctgccgccgtttatggggtcgcttacagaatgtcgtttctgtatcttcagttcccctttggggccattatccttaaattggatttcattttagatttatgtgtttatctggctaaacttatgaactgggattcccttttgggaaaaggcgggtgtttttgtaatactcttaagaaaggggggagatgtgtgtatattataatacaggagtatcataaccagcagggcttcattctcatcaagtcatttaatagtgatgcactgcataaccaaacagcaacctgccgcatgctcagcagagccaccagcagccaggaagcagggggagagcatgctgaactctggtcaggtgaggccaggtctcatccaagcgtgttactttaaaatctgtttctttggaatttcaggattggcatttcctgtctctttcctgcctcttggcattttagcatctctccagtgggctgtcctcgaattctgaacaccaatttacgacaaatcgttgtcattagcatcctggctgcagctgtctcccttttatacttctctgttgtcataatccgcagcaagtatgggtggctgtcaaaggacaagaaatttcaaaggtaagagataaatactttgtgttccaggaggaacgtcataccttctggctgactttgttccagacagagcactgggtagcttacagagttcaagaggtgtatttctcacagttctaaaatggtgttctcaacctgtggttcataaccccttggaaagtcgaatgaccctttacaggggtcgcctgagaccattggaaaacatagatatttatattacagttcataacagtagtaacattacagtatgaagtagcaatgaaataacccttatggtatcaccccaacatgaagaactgcattgaagcatcacagcatgagcaaggttgggaacccctgttctagaagctgggggctccgagagcaaaacgccagcagagtttgtatccggtgagggccttgtcccagttgccacagcaagaaggggtgggggtcactctgatgtctcctttctcccgatctgttcacctcccagaggtaactca

SEQ ID NO: 22849 - DNA, 1461 bp, Mus musculus
cttctctacctgctgcggctgcggcgcatccaccgcagggcgccccgcactggctctctgtggatggaggaaggcctgccctcccagaagggccctgggcccttgtgacagacactgcgtcagcctgaagaagactctacaggaaaagccattttcacctcagggtttcttgtatgctcagacggttttgtttgcccctttcctttctgttacaaaaaccctctgattgtaagccctgctgtctggagggactaccattgtgaacacagctttaacaggaggggtgggaataggaagttcactctgccacacatcagcactttcagcacacgcacttgaatgcagtgccaaggggacagtggcaggttcccatcagcatgggtggcacttcagagtgtcctgggacagaaccaagccgtgagttagaccctctttcctctccaaacacctcaacctagaagggaggcgtttggttttatttgctgctcaggtccatcaccatcggtgttttcttgacagatgtaagactttagtctttcataggaaaaatcaacaagatggtggcacagggaggtgacactgaagagtggtcagtgatgagagctccagaggcgagccacgctctgccgcagacaagcacacacctgcaaagcagccgcgcttgtcctgtgctgagaatctctgtggccctctcagagcagccttggggtttgtttgagtgctcatttgttttgtttgtttgtttttaaaccagaaagttcttaaagttcccctggtccagtggtctgagagagagctgagtgtgccctacaggtgcccagcgcctctgagccgaaggtctgtgctgttgagctagctgctccaggctcttcctcttctgagctgtcgtcccactgttcagatctcttcactgtttttcttcaggacaccccacacattgcttgacagtccttgttgtcacgctgtggttgcagctgtcgttggcaatgccactgtaagcccacaccgtggaagagcctgaatttaaaataagaaataaatgcacacgttgaaaacagacttgacattttaaacagaaacctgaaaaggacaaccagggacatgcgaggctagtgggagctacgctcattcattcgttcattcgtccacttgctcgtttgttcttatgctgttgatttatgtcagaaatgtggggatccctgcacatgggggtcgttttgtcttggtagtgatggtgacgcacatacttcctacctccatagcacgtaagttgaagtagttggcagtagacgggtatttggagaaccttcagctgcttattcaaaactgagagagaagaactgcgactccaaagccctgtcacccttagagagagaagatgtggcgcatgtcacattggccacttaagacttcacatttatgaaagaaacccaagttcctcatctcttcaacatgaccatt

SEQ ID NO: 22850 - DNA, 2044 bp, Mus musculus
ccagattttgacagtgaggaactggagaaggagttggacatcctccttcaggacaccaccacagaacctttgagcctgctcgaaaccccccaggagacaacgctttataccaacagtgtgcctaagcctaggatcttggatgctgaacttgaagctgaacttgagaaattgtcattatcagaaggaggtatggagttgtttctcatatcctagatgtgtgactctggctgacagaggagccaggcatagaactgacaggttctatcccaagaactcaggttgcctgcctcctaaaaccctgcaagggagaggtggttatatacacggagaagcagatgttcaagctctgagatgctttgcttgtaggacttcctgttgaatgttatcttttcttctcacaggtttgatcccaagcagtaaatctccaaaaaggcaattggagccaactctctaaagccattgcaggaactcaagtgaaggaccctcatgtatcagagaggcagccttgcgcgtgtacatagttatttaatgagaaacactgagaagtcgttggaagaggagggaagaaccacttggatgtatctggatgctgctgctcacgccaagacagatacagcttctggaagccatgctatgaaggtgtgctcccagtgatgtcatggacctaccttctcgtctttatagtgccacaatttatacagttctgtgtttgacccgtcgtcttcatagcctgcagttcttgccattggctccgttaggtttgtcttcacccaccagcttcattccagccagtgaaggtgaaaggtttgcagctctgcccatctaagctagccctctcttccactcgtgaggtctttaaactgctcccctagcctgtgcttttctgggaatgggagtcaaacaagttttattcagagagacccaacagctgagtctggagaaacactgtccggaagatggttctctacattcttcgtcacagtctgggtattcgaggctctgaatggttcagggtcatggcagtttccagggtggcttatgtgattgggggccacaaccgcttccatcttagaagtagatctgctgatggagtgggggaaaggattaatctgccttttcaaggtgagcatgagaaacacaaaccctaggccccggggtgtgaaagaagctggattcatgatttggccccattataaaggatgtgttttctggagcaagccactgggcaccacatcaccctcaactggctccctccctgttaggatctggaaagtgtcttatctagtatccaccactcagggcaggggcctgagccaggatgtgcaataagaggcagggcgctgacctgccgcatctgctgcgtgctgcctcctgccggccagcacatctgtgactccaggaactgtaggacaggcagaagtagatctgaatgctctgggggcagcatggagaagagacatgacagccacactgccagtctgctgcccagggacggtggctgcctggacctctttgcactggcccttcctgcttgaggtgacttgagcagaggggagaactttgcctcaggccaggagcacgaatcattgttcaaagagtctctcccactcagccttggcaatggaaatagctgggggtgaagaaaaacaatcactattttttcttttttaatctggtaaataattaaaagagaaaaacaccaggttttgttgttgtctattcttagctggtgtcaagtttttctttttcttttcatttgtttgtttatttgagctagggtctcatgtagctgagactggccttgaattcttttatttttttatttttttggtttttttgttgttgtttttggtttttgagacaggatttttctgtgtagccctggctgtcctggaactcactctgtagaccaggctggccttggaactcagaaatacgcctgcctctgcctcccaggtgctgggattaaaggtgtgcgccaccacacctggctcaaaagatgtgtatcccaggctagcctcgagctccaggtcctcctgcctct

SEQ ID NO: 22851 - DNA, 1322 bp, Mus musculus
aacgctgcagcccaaccagagacagggccaggaggatctcagtgcgtttgaagtcagcctgatctacttagtgaactcaggacagccaaggctatgtagagagccccgaagatgcaggctcttcagtattatgagaatgtacttaattttttcttgtagtagttagtgtatcatattattgtattatttatattattactgttaagtactatgttctcttattagaagttgaacacagaacctctgagaacacatatgctacaagtgttctaacacacctccagcatcccggattacctttgttcctgaacaaggcacaattggtagggtatgatagggcctgcctatcatcctaacactccggtgatggagccaggaagatcaagagttcgaggccagctggttcacataagatcccatataatgtgcaggatggctaaacttgctgagagctgactctgtggtctcctgtcccagattctagcgatattcattactaagacccttgtccagagacaaaagaccacctctgtaacagagggaagaataaaacagccctagggtggaaactccttgtgaacacagccactgctgtttactgttagactactgctcagcactacacagctgcacggcacctccctgtgccaggtgctagtgggcagcctactgagggtacatctaacttgaatctaacacacttgaagtgagtttgctggtttggacacagagggagcattaagtgctacctggggtgacccttgaggaccacgccccctgtaagcatttgaccattgtgagagtaaacactgaaactcaccattgtcctgcctcagcctttctagagctggaatcataggtatgctgcaccggatccagaaggagaaataactacctttagatactgtgatagggatttctagaaagctgccacatacagatttttgtcctgtgtgaattcctattgttttttgtttgtttttaattttttattatttattttcttcattcacatttcaaatgctatcccaaaagtcccctatgccctccccccccctgccccccgccctgctcccctacccactcactcactcccacttttttttttttttttgagacagggtttctctgtgtagccctggctgtcctggaactcactctgtagaccaggctggcctcgaactcagaaattcacctgcctctgcctcccaagtgctgggattaaaggtgtgtgccaccatgcccggccttttttttttttttttaattaggtatttatttcatttaaatttccaatgctatcccaaaagtcccccacatgc

SEQ ID NO: 22852 - DNA, 1139 bp, Mus musculus
tcctaattacgatccacatatcaccacctttaccctctctctagacttacgaggtgaagtcccatgagggagtaggtcatgaaagttctggggtccccttccctgagaaaatgctttaggtaaggaaatactggctgagtccccaggacctagctaggttgcttaagctggaattaaagcaaccccagaaacaaatgcaacctacaattgtgtggtaccgggacctcgagttctgatctggtcttgtcagaaggaacaagtagtagcaggtctcacagtgctgattttctgtagtctgagcctggaaccgccaagcctgctgctgcctagtagttaaaagccctccagagttgctggctggggaagtgtgttgtgtgctgccctctactagctggtgtgccctgctgctgaattctaaatggcttctagtgtggagaagcctgcactcatggaaaaggcaggcagcttctcacaccttccttggacgatacaggggtatctctctcgggaactgtaaatgataggtagatgtctgtcctaatgagcaaggggaattgggtctcccaagtgatttacagggctgagccgcctggcatcactggtaatgaggatggacaggctagtaggagaaagatctgtggaggtggaggaagaccaaggagaacaccatgccccacccaggccagttcacccctcagggacccacccctacccccacagctgtcagagctggtgtgcagcaggtggacccctgtggccttgtatacccacagtggggggtggggctgtgagtgagccaggagagggaggtgctgcttgcagtcccttagtacatgggtgctctggattccagggagacaaaagcaggagaaactccagtgtgggacaagtctggcataacacccccaggggtggggcagtgtcccaagaacatgctcctctggactatgtcacatgtcactcagtgttgtcttagaggatgggggtaaaaacacaaacccacaacccctctccacacacctttttatataaggtttcatatttaatttggtcatgaattcataatacatgagtattttgtatctaatgacaagtcttgtactgttttatattaccaacacacttctaagaggcataag

SEQ ID NO: 22853 - DNA, 1366 bp, Mus musculus
ttgggccccttatgattgcagagtatctacgggcactgcccagagctgctgctccgtaggcctctatgtggagtctctgctccagtagggatgtgtttctgtaccactcacagttccactgcgcgtaccagttggccgactggtgtcttcaccatatctgcaccaactacaacaacgtgtgccgcaagttccccagagacatgaaggctatgtctccaggtgagtctctgtgtcaaccccacaagtttctgtgacagggctaacccaaagcatgggcagggtaggcttagcgctgccctgaaaatacctcctaacttcgcacccctggcattgttgtctagaaaaccaggagtactttgagaaacaccggtggccgccagtctggtacctgaaagaagaggaccactatcagcgtgcgcggaaggagcgagagaaagaggactatttacacctgcggaggcagcccaagcggcggtggctgttttggaacagtccctcatcaccgtcctcctcagcagcgggctcagcatccccctcctcctcctcctcggctgtggtctgagatgctgccaccgtcttctgatcccgctgctgttgtcctcattagcccttgtccttctgctcttctgtatcatcccctctacccgacaggtgacgagggaattcacctaaccagaatcctaagggcagagccgttctcaccagccaatgtggcccaggctaagaggagccagccctgcagatcagaacagggtccacctacaattccaggcagggcaggaaaacatctgccccaaggtggggagcaggagagagctcagagctcggatattttctctctggacttgacaatagagccagtggaggaaagcttcccctgtactcgggcttgtctgtattggtgtctgctttggtcagaggcagcttcctctccaggagctggtctttttttttttcccatccacagacttttgagggttgcaagtatttcgtgagcattgtccctcgggcttattgaaatccttgagaagttaaggtagaaaagaagtcttcagagcccacatcaagtctcctaggccgtgaggtgtggctgctggcggggagaagaataaactgcagcctgccagcatcctgtaaggactgactgcaggcagtgtagacttagtggtgggtagcagcggtgactccgtgttcaggtttgtaggcagcactttagtacaatgtgggttctctacttcacccttcccgcacacattacatctgacatggatgaaggaggaggaagaggaggaggaagggtgggttctgtgctcagcagttttatgctcctctggggtttctccccctgcctctgggcagcactgcc

SEQ ID NO: 22854 - DNA, 1191 bp, Mus musculus
gtaaaaggtgagctactcctcagtggaacgttatggttagtcacacctgcctgcctgagaacctatttccccagtgatctgcaactggtggttggtactactggcagccagtgctgcgaacttcagctggtaaccagaagaccagggtgggccacagagaaggatggggcctacacatgtctcatctgggagaagggggatgggcggtgggggtagttgtggggccagcagcatcctggctacatcagggatggataaggtcccagccaggaggtacattttggaggcagctacaggaatccacacttgctaaggtgagaggcttaggttgtgacattgaggctgaagagacagactcaggagcacactagggactcaccagttagcctgcccccccttccacctccccaccaaaataacccccaatggagccagtgtggcggtcagagaatgaagaacaagcggccccgagttcagggccctcattcactagggtttttgtttctcagagaggagggggtgtgaggaaggaagaagatgaagaagaggatgaagggggggagggagaaagaggatgacggggaggaaggcggggagaagatgaagaggagaaggaggaggccagtccagagctcctcagtattcctagggaggaatcagtagatcttcggaatggtggggaggggcatgcgatggactcccccccccccccggggtggaaggacaaatgctcagagctctatgggctgctggcctatcaagcctttcaataagaaccagcactttcctttcaaagagggtggaagtcactgttctcttgtctccgttgatgaacagattctgggtggcaggagtcaccatagaaacaggtgctatcttaagcaaatgagccttattaaccttaagagtggtggagttttcacaagattgcacatatagggtaggagggagaaggggtttggtggggggagggtcgaggtggctgggaagccgtgttgctccgggtagggaggcatgtgttgcatatgtgtgcatgtgtgtgcgctggccgcgcctggtgggtgcccatctatatgtgctgtgcaaagctgcttcagggaggaggtaagatcaggtcctgccccaccccctttccctaagaaacaagcatcctccccagtccccctccctctgccataaaaagtggccgta

SEQ ID NO: 22855 - DNA, 1237 bp, Mus musculus
aaacaatgttctgtagtcggtgggagacagcgtgagtcactctggggtcagggcaagtttgtgaggttcctgatggcagctcttcagagtggtctcctcagctgttcctagtctgtctcctctctcatttttccctactctgccaccctctacccctcttggtcttcttccctttctccttctctcttatgccagccacgtcctcccgtccttcttgtgaggagccaggagcccatcagcacccatcccctgcagcctatgaacagatccttcaggcaactaggcttcctactcacctccctccaggtgagccctgccctttgcagtgtcctaccatggtgagaatgtgttcctttgtgccctcctacagagcagctgtggcccccatgctctcatccagcactggaccgggagctagtgttacccaggaagggacttagagcaacgatgacttcattttacttcatctaaatggaaggagtcacttgaagccggtggttactacattaggcaacagaactcggtgtgtgtgtgtgtgtgtgtgtgtgtgtgtgtgtgtgtggttgctggtaccaagcgtttgattccagagacattctgggaagaccttctgcaccgtccaggctatatcccacgccagtgactttgtccagctctccttctgaacccaggactcatgagaggatgcagagctctaggtgctggccttggtaatggatggccttggctctgtgtttacatatggtttttcaatccaggcctgcctcaccaagcggcatgagtctaggaagtggagtgaagtctacggagctagtgagagggttgcgacctgactccgctcctggcaggcatctccaggttccctggcctgagctgtttgcttcacagtgctcagacttcctctttaaccataaatgtctcccggaaagccttcccacagaggcctcaggggctttctcagggaatgtgtgagtgtatgcatacagtcattgagcatgccatcccaaagagccatggcctagcactaagggtgtatgtgtgcgtgttatgtgtgtgtgtgtatgtatgcacaccctagtttgcattaagggttctgatgcatggagccctggctttatgaaatacttaagtcccaagtcaattgaaacaaccaaggacaagcatgcacgagctcctacagatatgcatgtactttctgtagagaggtatagggaaggaagataattatcctttgctg

SEQ ID NO: 22856 - DNA, 1204 bp, Mus musculus
gctccagcgacagatgcaggacttccgcaggcgcctgaccccactgcaccttgagatgcagcggattgttgagaaggtaagatggctaaagggtggccatagttccttttggtgaagccacagaagtagagtggagctagcctctgtggagaggcctgggagacacctggcccttccttgttgtgctagtcctccatatactgggttcttaggagactcagctactctcaatgctctgcactccagtggcaggacatgggagaagccttatcctccattgcttcatgtgctcacacaggctgacagctgggtagagaaagaagagccaacgcctagcaactgagtggctgcctagtgaggtctgcgatggagcctgatgacattagagcccttttggtaccagaaggcagctggagcagggcctgggagccacagcaggggtagcttgagttctgtgctcagcctctgcaggggatgtcaaactcagtatggggtttgtgctatgtggatggatatgtaaggaactccagttccagctacaactaaatacaacgtcctttgcacccctagaatgtcattttgccctcaatcttggaatttctcccagggcccttgtagtcttgtgctgtctcctgtcctcgtccattttagagcaagacgggaggaaaaggcatttccagcccagaacaaggtctaatgccaataaatgggaggaatgggtgtagagttgatgcagccaagaatgtccgtcctctgggcggcacaagtcccgcaggctctgtgtctgttaggtgatggagcccattcaaggagcatttggtgttgggtcagggttgccaatagaacactgtgtcccagctgcccccaacttgccagaagaaccagcacttacttctttctctagttcttatgttcagaatgtggtattggccctggcctagccccttccacttcccataattcttgcctctttccataattcatggtttcagttcgactttgtatataaagttgtttgttggtttttttttttttttttggctttttgttttttaaataaaccaaagtgaaaaacaaaccaagtgtgagtctttgtagctagctctcctcctctttcaagctgctgtaccctctctgtttgccaggcctcagttctctctagaaggcagcaggcaggcagtaagtgccacaggttgtgactgag

SEQ ID NO: 22857 - DNA, 1758 bp, Mus musculus
tccctgagtctttctgttcttaccacaggaaaactgtccattaaaagcagtgtgcatatatatatatatatatatatatatatatatatatatatatatacatatatatatatgcactcacatgtattcatatatatatatatatatatatatatatatatatatacacacacacacacacacacacatgtatgtgtgtgtgtgtgtgtgtgtgtgttcattcttgttcttcttggggaaacatgcttgaaaccaggaatcctgaaatcctgagaacacaactggggaaacagaaatttgctcagtttctctccctgctcttgcctcttgcctttgagacaaggcagcaggaagaggaaagttcagcaatcaaggtactagattggatgtcaggaccaggtcctggtaggcttagggtccagttttaccaaagaaccagttccttcaatgttagaagctaagctttatgttaccgtcatggttgttggtgtttgaaggcgagtctcatctctcctgttctatttctcctacaaatgctttaggaggtagcagaaattgacactcaaagtgtaagactgagcaggctgtgtgactcgtacctgtaatctcagcccctagggaggcagagtcagcaggctcaagttttataccagcctgggcttcatagtgaatagcaggccagtctgggctacatagcaagctcctgtgtcagcaagacaaaatgaagataaaaaaccgtaaaatttaagattgtaggtctgagggtgtggctcagtggtagcacgttttttgtccagtgtgtatgtgacaccctgaatgtcattcccagcaccaccacagccccccccccaaaggttgaaagattccactttacctagctcatgcattatatttttaactttaggagttcccctagctcctgtcctttaaatgcccttatgctggaatcggatggtggcttggtttgtttaaaagagcttaaaaagagtcttaaacatgagatagactgtctgccatgcacccttcctgtgaactcaagaactttgaggaaatcctggggcttcttcagggcggagggctggcatcagtcagacacaggtggggcgtgggagccaactgataatccattgctattggcaacagattcgccccatgagttgaaaatgtggccgttgaccttcttttgacttttaaatgttgaacttgctgttttaagcatctgtacatataagaggctgaaggggctacgggctgcttagcggacacttctcccctggccttactgcccatagcttctgttccctgttaacactagcaaggaaagtgcttgtcacacagaggagccctcagccaggccttggattctgtcattggaggacctcatttctgacctcaccttcagtcctccatccccgccctccaatacttagggtcaccagggggagcactctccggtacccttcacctgggttttaaatggcttctctctgtctggatcacctaggatccagttttagtgaaccctcttccaaagagatacagataagctggatgattttttgcataaagaaagaggattttactcatagttccctttacagttccatcacagtattttttttaaataactcaggtgttatgagaattagaaaataaaataatttatgtcatgtgaactgtaaatgttttatttgtaagattctataaataaagctatattctgtaattggtgagtcccaagtgtcggcttgcttcagc

SEQ ID NO: 22858 - DNA, 1191 bp, Mus musculus
attgccagagctcccaagtaaaacccacagtcctgggccaacctggtttctggtttgcctggaggtacagagaatttgcccttccagcaggttctcaggtgaacctgaagattgtacacataaagaatgacttccttcaaatagtggcctatgccagggtgtctcatggagactggccagctagagcctttgaggaggtcttgggcttgaactggcttgcaagaggactggaagggctgggggagaaggggcgctggggcggatagtctcggccattcaccaagcagtgtagccaaaggcccttggggtatgttttactgcaaagctaaagtacacatttcttaaattacctgcccactgaagcaggaatgttgagcagatgtgtcttagcctgaatgttggggtggtctcttttctaattctgcttgcagaattctgaggtctgcataatccagcctgggttgcggttgagcctgagtccaacacaaagaactcttgcccttaagacccaactggttctctgttttcacttggatgtctgtctgtgagagcctgctgctgtttaatctcctgctcctcatctgcctgcctccctgcccgttcattctccaggatgcagccaagaatgcaaatgccaggcctagtagctcatgcctgtactcccagctctttggttagttgtggcaggaggattgccaggagttttaggttggcctaggctacctagtgagttccaagccaacctgaactgtagtgttcgactacaaataaacaaatcaatcaatcaatcaatcaatcaaacaaacaaacaaacaaacaaacaaacaaacagaagtaggtaccagggggttacctcaatggcggcacacttgcctccagtgtttgaggctgggtttgatttgcaccacaattgaaccatatgttttcttgaacctttcaaggcctgttgtctgtagcctctaatgctatcccctgtgtgatttcttgtgtgtcttagtcactgtggacttcaagtagatgttccctctctactagtttctatggatagagtgttccatccccccaccccctccactagcttgtttttacatgttctaggggtctgaactttcctttaggggagctctcttggccacctctgacaccaggttgattgttctgttttccaacatttgtctgtggtggtgggag

SEQ ID NO: 22859 - DNA, 2133 bp, Mus musculus
ttttctctttctccatccttgtagaattagatttctgttcttcttttaaccctgatatcatagtagggtgttgtggtgcatgccttttatcccagcacttgggagactgaagcaggagtatctttagttcaaggccagcctagactacatggtgagttctaggctagccaagattacagagtgagaccctgtctcaaaaaacaaaaacaaaccactgtcccctcaaagcccacaacaaaaccaaagcctggggtcaaggaagcaagtttgtaggtagccgctggctgcccgctgccttcatggagtgtgtgccgtcagcgctgcttctcctcagccgagcgtggagcttcggacagggcagtgatgacatgttcttagcatgtcaaatccccctaccaaataagtcaagcaaggaaaaaatagcccccaaggcagcctgagcatcagttcctagaggttatgcctacagaaccatcctatttctggtggcagaagtgacatgaagtcattgcagacatcttaaaggagagttactgtgcagctgtctacatgtgtgaaagacatgtagaaaaaccagcgtagggtacagtcgggcgtatgtgcccacctgacccagggctgtgagtctgacttcccgagagtctggctagagctgcttttctggtccttttggttatttgcaaccatcatcagattgctttcctgcagcccgactgatacacgcatgtgcgcacgcacacacttttgttctttgtgactaatcttgaataaattcaattagaacacatggaaaggattcagcagacctaggaacatttggggtggagtgtagtttttctgcaaaagtctgtaaatgagattacgcaagagtctcttccagctgtgggctggtgttgcttggaaaatttcaaaatcccaaagtttcaggcttcccaaagttggcttggaaaaatgtgatagtctcacctgagtctagacatgtaggaaattttcctagggcctctgggcttcagtatttgggggaagcactggttttctgtgttatttttttccttctgtttcagaatcttcaagtttcttcaggcttcagtgggccatccctttactgggctctaaaagctaattttacttaaccttttcaaatgtgtatgtatctatttatgttttggtgtggtggatggatggtaggggactgagcagaaatagtcattttaaataacagtgtgctaggagagcctcagtgtgaagtcctgaggagcagcgggggctgtgggagtcagtgtcagccctcactcagacaggccaagcctgggctcgaagacaacattgtccagggaagcctttagtttgctatagcacccagaggttggcgaggaataagggttagggtcctcaaatacacccatggcttttggagtctatgaccaaggccaggctgagacctgaaatgtaaaagccatagaattaaacagaacagactgaaaaacgagtcttaagttccactttctggatttctctggaagtcttttgaatttgtctgtagaagttgctgttcctagcactccttttctctttaggtagaacagatacttgaccataatgccagaatgtactttctctgccttggtttttctatgccttgtttttcagtttcagggccaaacaattgggccctgtggtgtaaaataaaaacaatgtatgtgtatagttgtgtctgagagaatattgtttattaagtggcttttccttcaaagagaagcaaaagttagagttattcctttattattgtgcgtgtcaggggcagcaccattgggaacaaagtgatttcaccctgagcaaactgggagacctacatagcaatgcattaagtttgtgaatgtgtttgaatcatttggggctttgggtaaataagaaccctcaccagcttactaagagaatactctccactagtatattttcatcagggtgctaaaaaaataaatataattacttacttattttattgattgattgatttttcaaggcagggtttctttgtgtagccctagttgtcctggaactcactatgtagaatgtagaccaggctggcctcaaactcagaggtccacctacttctgcctcccaagtgctgga

SEQ ID NO: 22860 - DNA, 1094 bp, Mus musculus
aaggtgattaggtactgctgtgggcggagaatctaggtgcctccttcccatctgagcagccacatgacccaccaccctagcttcagcttctgcagcctgcacctcacttttggatatcccaatacctggctcaaatgtccctcactgcatgctggtggtcctgggcctgattacgtgtagtgggagcggacagcctagtgttctcacccaccttgtgtgttctcagtctgtcctgtacccatgggccaccagcgcaggcctaggcaggcttggtatgtttgtaaacagccgggtggggaggcagcctccggggcactgactcaggcacccagggttgtgcaagccaagcgggaaaaacagggcaggcactgccatctcgcacccaggtcagggggagcagccacctggcagggagagggtggggcatggtcccctcacacttcctgtgactgctgttccaggctcatatttggcatgctgtatcctgcgtatgcttcctacaaggccgtgaagagcaagaacattcgagaatatgtgagtgcaaagagtggggtagacgacaacattgaggaatggtcagggaggtggtaggacttggtgatgctggagggcctggcctgtcagactccaggggctcgatcgatggtggaacagatctcaagtagagtggtctagtggaaggaaggccagccattattaacaatagccatggaggatctcgtgggcgaagcatgctgggggggggggcactggaacggaaggcagtttctcaggggctcctgtctaagcagatgtgggaaactgtagccagcaatgcagtgggactggctttgaggaatctctgggttgggcaggctgggggcgggtcctggcggcttaggctcgtgagctgagctctgcactctgacccacaggtacggtggatgatgtattggattgtctttgcgatcttcatggcagcagaaaccttcacagacatcttcatttcctggtccggcccaaggattggcaggccatggggttgggaagggcctcaccaccaccaccaccaccacctggcctctggctcacacaaacccctccccttgcttaca

SEQ ID NO: 22861 - DNA, 1369 bp, Mus musculus
cagtaccttccttctgctgcttcgaggccctgaagctggggctgtgagacccttccctacagtgtcctcttcctctgctggctgggagcagcgggaggcagggcagaaacgttgggctccattcctcacggagagagccaagaagtgcacagtcccagagtcacgaggcgtggacttccttccccacgatgggccagggggccttaccatttccctgggctctactgcctagacaaacccagcccggactccagcacacaatgtttgcacccgttccctgtctgtcaccccacatgagagtccccagaagacagtgaggagaaacgaagggggcttagcggggaggtcggtctgctgtcctgtacagggggaggcggcagctctgggaccctgtgcctgtccacccaaaggctccagccagctgcactcctggcagtttcctgcacttgggcctgatgcttctctaactggcagaagcaggctctacctggacctccagctgggaggtcatcctccctctagcttgtatgtcctgtactttgcaacccctaagcttcaaacctcttgctcaagacccaagacttattcaaagctgtggctaagagcagagacgctgttcacacaacgcctcaccaccaccagcctccaggcaaaaccagataggatgcaccgttctagcacctgtccagggaccaccgagcccaggcctcagcctccctaagatgggatggagagtcccagctcccaggtccctccattgccatgcatctcctactgtgctctctacagaatgtaatttattggggcaccctctgctgcttccctgactccctgccctacctaattgcacttccagtcctgtctgtccacatatgtacgtgtatataattatacatatatatatatctattttgcccaggtctgggtttcgtttttacccagaccctggcactccctgtccactgtgtgtgtgatcatgctgggaggggtaactgcttggaattaaaaggttgcactgggtccctaaatctattgtttctatccatgcctgtgcatatcagacaagcactgtaccacaaccagttgtcttacctcttttttttttctttttttctttttcaagacagggtttctctgtatagccctggcggtcctggaactcactctgtagaccaggctggcctagaactcagaaatcctcctgcctctgcctcccaagtgctgggattaaagcatgtaccactactgctgggctagtcttacctctttagttgcccaggctagacctgacctctcactctgtagcccaggaagttttggccttcttggttcagtatcaagtagctggacgcataggcttaggccagca

SEQ ID NO: 22862 - DNA, 1200 bp, Mus musculus
ttatttattttgtgcatatgcttacaccaccattgctctcttcaggcacaccagaagagggcaccacaccccattacagatggttgtgagccaccatgtggttgctgagaattaaattcaggatctctggaaaagcagtccgtacccttaaccactgagccatctctccagccccgctgagccatctttttagccccttggtttttgttgttttatttttgtgtgtgcatgtgtgcgtgcatgctgtataacagatcagaggctgaggttagtcaggtgtcttcctctgtcactctccatgcctgtacacacaacatatgcacatacacacatacagtctcatgagacaaggttttactctgaagggcacattgtcctagacctcactacacagcccaggctgacttcacatgtgccgcgggtttcctgactcaggcccccaggtgctaggatcccaggtgtgggccactgcatctctcagttctgaggtccacctgcctcctgtgctcttgtctggccaatccccagcactatgccgtctgtctgtctgtctgccacaatgcagacaggatgggaagccagagcccttgggtagactctgtctacagttactttgaattaagtattcatttcctcccttcggtactgtgctgatcctccggttaattaaaatgttggagaagatggagctttcgggacccttgaatttaattggagagattaacccataaaagcatggttctttcattcaatttttggaattctctctccttcttaaaattaagataaaagagcatccaggtgtggtagcacaagcctgtaattcaatcacttgggaatcagggatttgaggcatgagtatttcaagttcaaggccaacctaggctacttatataatgagactctctcttaaaaagaaaaagatcaccgaatagtagatcagaagttttggaaatcaagctgggcatcctactcgtgtctttaacaccaacacttaggaggcttagaaaggactgggtggtggacctttgaggctgcgctatggagtctcaaaaggacaaaagttttggaactaagcaactgaactctagagctctgccaggcagcacacatgcaggcaggctcacatgaactgacttagtcatgctgtgagaactattctcacccaagggagtcctgcagtcaggatccttgctgtct

SEQ ID NO: 22863 - DNA, 1174 bp, Mus musculus
cgggaagagcaaagactgcgtgttcaccgagatcgtactggagaacaactacacggccttccagaacgcccggcacgagggctggttcatggctttcactcggcagggccggccacgccaggcctcccggagccgccagaaccagcgagaggcccacttcatcaagcgcctctaccaaggccagctgccttttcccaaccacgctgaaaggcagaagcagttcgaatttgtgggctccgcccccactcgcaggaccaagcgcactcggaggccccagtcccaaacgtagtcagggaggccagtagtgtgccaggctgggtagatgcccctcagcagccttccctctcttctctaactcatccaaagatgggggctggggaggaaggtggggagccagtctccaaaaggaccccgagggcatgaagtttctgatccccactgggaagagacagtacttgtgtatcccagggtgggcaccattctatggaacaggtttgaggccagaggcagaccccggcagaagaaatagggtctccttgacctaaaatgcctgcttcccagcgtctacctgaaataagcgggctgctcagcagattccagagcttgcacaactgtgctcaaatcttgctccctgaacctctctgaatctgaaccaaatagccaaactcttggccagaccgtagggacttacggttttgttttcaaaaacagacagagacagaaagagaaacaaaagccagtcagccactgttcttatttctcgccccaggcctgcgtccccaccccaagccccagaataaaaccattttcctgcaaccgggtccgctgaagaaaggtgggcagtcagaccacagaacttaactgcaaagcgtgcagcaccgagaagtgctagctggggaaggaggcacacaggtgctgcagcctgccagtcccgctgtgcgaggggacaaggcgaggcggggggggggggggggggatggcggcccctccctccgcgggctccgatgtccaggctcacgcgacgcgtctctgctacctgtaggagagaagaaaacccaacccctaggcgcggccctgagcggccgctggcagggacgggcgtcctgtggggcccaggcccgggggaggaggggggtggcaggatcacagcctggggacgccagaagtcacctcg

SEQ ID NO: 22864 - DNA, 1174 bp, Mus musculus; identical to SEQ ID NO: 22863

SEQ ID NO: 22865 - DNA, 1179 bp, Mus musculus
gctcactgaaaccgtggctgaggctagcccactaggccttccctcaatcctggggtggaaacctaggaaaagcaacatggggctggtttcttgctcgtggttgccctctgctgggcacatgagctatcgcagcagcgaggagacccatccagggagggggaggcagagggaggttctgatcatgcaaattttattgtggccctaggcgagcttgctgggggctcttcaccaagagcctccggaaactggagggctgggttacagggttacagccacaccaccttattacattcagactagggtggtggggctggacacctgcaccagagcacagctgctggacatcctgccttggacgcagaagatgctaagatgaggtcatttcttggtcactggcttctttgctctgggtgtagatttctcctgtgcagataagagactgaagagtctaccaaccctccttggccaggcagccttccccagggccagccccaatttcttattgctcaccttcttccagggactcttgtcctgagggctgggcctggaaaggaatagggacagagtgggcaagagagtgcagcttcatgccttagcttcccgggactggctatctcacaggaagagcttttgctgtttcaactgggcctggtgcgcaggcctgaaatcccagttactagggaggttgaagcaggagaataaccagtctatgacctgccagggctatacagtagttcgaggccagcctgggcaacttactgataaccctgtttctcaaaatcaaacaaaaccaccaaccaaaccaagcaaacaaagtctggggctgcagctcaagtggtaccctgtttgctaacatgccagaagcctcgggttcggtgctgagtgctagtgcggtggggatttaactgcatgaattacctcactactgtttcatcctcttctttttccaccttctttttctgggaacaaaaaccaagtgttatttggaaagctaatccaagaccccaagccagaacactgagtgctgggcagtcccagttgagaggtgcagagctcccgtggtggaggtcttggcttgtcccaggtgcccaacacgggaggcccagctcgggtacctcattctttccccccacctttgctatgctcatctgcttctggggagccacccttttgacttgt

SEQ ID NO: 22866 - DNA, 1543 bp, Mus musculus
ttccgtcgagaggtcaacgactcaatgaagaattccacttatggagtgaatagcaatgacatgatgagctgacaactctcggactctaccttgcagagcagcgtccctttggtctggtccagagggtgaacagttgcaagggagagagcctggctgatcccggctccttcctccaggggtatgggggaaatggcaaaagtcaaccagctatttccccagaaagtacggggaagtacggggtgtgcgtgcactcactgagggacagggcactgctggttcctgggggactggggtgggaaggggtggtgggaggagacagacgcacaggcatctgagcctccggccgctcctggggtcaccgtgcagggagagcccggcgccctgccgcagcctgccttgtataaacatgtacattttttcataacgttttcaacaaggtttatattgactcaagtttaaaaacaaaagtgtgactgaaaactttttacagagtctagtgcaccaatgctgacgtgaggggtgatgtatggcgagtgaagaaaatgtgcattgtggtggcctgaagctttattggacaaggatgtgtgaaagtgcagagatatatttagtgacacagtgtagagaggcaaaaaaggaaaaaactccaaatgtatattttttcttactgccctttccctccccacccccactgatgcgttcctgatgctgtattaaccttgttattaggaactctgagccatgcgggagcaccaccctccccatccatggatgctgccctgggccccccagcctcctgcagtgacagataactccagctaaagtctctggtgttcttatctccatcctttctcccattttacttaaccctcatcctcagaaagatgcctcttgctattaaaagtcggatttatgttttaggattcttggtctctatagggagacgacagagaattgagccatttgctctcttgttgagcaatttgcatgagtccaccagaggcctaatatgtgtggccataacttttgtcttccccagcctttgaggcagtgtgtgtggatgtgtgtggatatttatgtgtgtaccctgcactcatgaatgtatgaactggaggaagttactacaggggagggctctcaataacaaggtctacctagcatgaagtatttaacattctcccttgaaaaatatacatttttataaaataaaaaccataataaatgttttgaatattaaaaaagaaaagtgaacctacagaggaacattggatggagaaaactctttgccttgtactttcccacaactgctgctagttatatacatctctagtacagctcttacccatgggacattaccaattaggttttatttttattttcctcaatcctcacaaacaagcttattaattttccttctcctctggcgactgtgtggtgaatcttttcttgcgtgatcaggttgcggatagacttgtaagggtgtttgctgcatacagtgtaagcattgtgaccgccaataaacttcgatggtttctactgacctggt

SEQ ID NO: 22867 - DNA, 1100 bp, Mus musculus
atcgggcgttgtgagtatgagaagacatgcgcgctccttgtgcagctatttgaccagtcggcccagtcgtaccaagaactgctgcagagtgccagtgccagcccaatggacattgcagtgcaggagggtgagtgcagtgtgcagtgagcataggtactgtcagtcccctttgcctttctctgcctccctttgctcccctaccaaaaaaaaaaaaaaaagaatttattaccttctatcacgtccatgcacagagtgaatgaatgaacaagtgccaccgaggactaggacagaataattaagaactattacattgctaaaatactgcttgtatgatgtaggaatgttgattatctgatcactttcctctgagtatcaacctaccagagtaaattggtagccatcttctatcagaaaagtaagatttactgggggattctcgagattaagaagccttctagtaagaagtgtcttacaacagtggcaagaaggtagtcactaaagagtctttttcctactccaggacgactgacgtggttagtctatatcattggagctgtgattggtggccgagtttcttttgccagcactgatgagcaagatgcaatggatggtgagcttgtctgtcggtaagtgtaccctatggaagcatttcattctacctgactactgagtacccgttagggccctacttacacttcccatcaactccacaaggtcttcttcagcagctgaatgcccatgaggacgtagacctgctgctgctctagccagctttcttttgtgcatgcagtaagaactctgcctgtgacttatactgaaaacattttagcagtgatcaacatggaaatgttgtctagaattaggaaaactgagaggataaccattgatctgttcaggggtagtgtctggggttagagagtaggctgtatttgtagtgctgattcatctaagaggaaactggttccttggtctcaccaaaagtggcagcactcctgtagccatgcccttgttgacccacaggactgcacattattttgtatctgtagttctcctttattaagggggggcggggctggtgagatggctcagcgattaagagc

SEQ ID NO: 22868 - DNA, 1179 bp, Mus musculus
tggggtggccctgagccaggcacacagctatatgactggccctacaggtttcttcgacgctttgggcgtgacaaggtgagtgagtgaagggctgagaccaaagatgagttacctaaggagaacaacgagggaggggcagagagccaataaagagagagtggatcgaggaggaaggtcatctagagagacagcagaggtgggaggggaaggagtgaaagccaagaggcctaggtgaggagagatgatgtggagaagggatggggaggagcgtgttcttgccagatgtggtggcacacagctataatgtcagcactgagggggctgaggcaggagacagagttgaaggcctgcctgggctacatggtgagagccttttcccaagtaaacaaccaaccccaacaaacaaaatgcagaggcagaggggcaagagctccaagagctccaagagaagtttctggtgccagggtcagcacttttccatgtgggtggagtccagggaagaacagttctttccctcttttcccccctcactgtaggcaactttttcctttgaggctggcagacgctgtctctctggagagggcaactttgagttcgaaacacgacacggcaatgagatcttccaagccttagaaaaggtcattgctgtccagaagaatgccaccccttccgggcctccatccctgccagccacagggcccatgatgcccactgtgctgcctcgacctgaaagcccctattcccggccccacgactctctgccttctccatcccctggcacactggtgcctggcatgaggccaggggcccctgagggggagtatgccgtaccctttgatacggtggctcactccctgaggaagagcttcaggggcctcctgacgggcccccctccacaccttcccgacccactgtatgacagcattcaggaggatcctggggcccctctacctgaccatatatatgatgagcctgagggtgtggctgccctgtccctctatgacaggacacagaggccctcaggggagacatggagggagcaggccactgccgatgggggtcccagctccctccagcaagactcctctgtgcctgactggccacaggcaactgagtatgacaatgtcatacttaaaaaaggcccaaagtaggggatggccagaagatgggatatgtggt

SEQ ID NO: 22869 - DNA, 1156 bp, Mus musculus
gtgtgtgtgtgtgcttgttcatgttcgagtatggatagatgtgtgtcaaactgtgtgagaagatcaaaagacaaccttggctgcaagtccttggctttccatcctgttagagatatggtctcttctacactgtaaggcaggatagctatcgagtgagtgtctagagatctttgtctctgcttcccactttctataagtgttttgggattgcaggagcttggtctgtggtgtctggattttatgaggattgagaatctgaactcagatcctcagactcacgtggcaagtctgtatagcagctgagacatcttcctagccttggcttccgtttggaatgcatgatatgggtggcaatgtagtttgagactatatttcttattaatgcataataattatacagagtaatgggtttcacaatgacatctccactgagcatcacggggaaaaaaaaagaacaaaagcaacaaaatgggcatggcagaactattgtgaatggctggaagcttgagaggcagcaacaggcttcagcaaagctttcctgagttcagtagggattaaagcagacaaacagttaagggaaaacagtcaggatgttgagcactgcttattgtctgggcaatgagtaagctctgaaagtgtatctacaaaccccaaatgtctgttctctggagagaaagacaaagaaggtaattcctttcaattgcttgagacttctctccagggacccttgcttctcctgagccttagattgtagcagaaacaccatgccctcttcccatgccagttaataacctgggaatataaagagtcccttcaatctttggagatttgatgataattccctaaatgccaaatcagcacacacagctttacaattactgaggggactacagaacaaaaatccttataacagacatgaaatgttgggacctgaaccttcttggtctacaggacctaggaaattggattcagagcatctcaatgcctttcagagcagaaagcctttgcctatgggaactgcactttgtgcccagcagctcaccagcacacctacaatgatgcacattgccttctggatgttctggaccactttccatgccattcttcctggattctcagcctcataccccactggctgctatttgtactgtgaggg

SEQ ID NO: 22870 - DNA, 2088 bp, Mus musculus
tttctctctctctcccctacacacctccctgaaaccccagatatgccttctagtgaaacaagctttttaaaggacactgctatgatcgtgttgaccagtcagcataagtaaaacagtggcaaccacgtctgtgggtttcgcagatgactgccatgtgaaagaacagttcagaatgactagaatttacactaacgttctctacgaaacttgttcaagtctgatgctgtgaaagcaatctagtgctatacttctacctcctcatttgtcttaattgtttggtaagtgggattttgatgaataactggagggcttagcaaacaaaaactggatgaaggaatctgagtgaaaaagaagctgtttgttgagtgtggagttcttccttacacacacacacacttacacacacatacatccacacacatacacaaatgcatacacacgaactcacaagtgagaccaagaaagcacagacccagaaatacggatcattacctgaacagtacctctttttgggatttgagaacagaagacttttaaataataactaaatatgaagcccgtttagcttctgttttctgggccttgaaactcgtgtgtgtgtgtgtgtgtgtgtgtgtgtgtatgtgtgtgtgtgtgtgtacacgcacacatgtgcacacacattcacattgggtctgtgtgcagactgtcaggtaaggagatgtgtccacactcatcacctggtctaggctagctttgaaggactcccagtggttctgcagcatctcctgtaactactgctgttgccgtcagaatttctaatcaaactcaacctttttgtttggggtaccaaatctgaagacaaaattaatttgcaccagtaaacttcaagctgctttctttcttgagaaactaatgtttaatgtataatgtctgtttggatactgttccaaattgttgattgcatgtgggtaccgttgcattagagcactttgcaaattgcatagttcattgtttgtgagcttgcatttgtgagttattggatgatcagattgaattttgtcatatcacattgtacatctcgcctcgatgtcaatgactgccagtaataatacagtctgcaatgaatttatatgaaatttttgttttatcacatgttatctgtagacatctgtaactagcttctttaatttattatttggattttagagtagcgagtcactaatttttagttgctgaggtctgcattttagtgattactaagcacttctgtctgtcaaaaagaaatgtatgttttgtactttgaagatctctgaagaatttcccttataatagaatgggcatgtattgtaattgttttatgtcaatgatctgcgctatagaaaaaacattaacctttattcaaaaaagaaacggataaacttggcctctccaagtgtaagaaaaccctgtcactctaatatactgtttgtttacattttatttaatctcttatgaatagggtgataacttgtcccccaaacaactgcgattacgattgttttctagaacttcttaaaagtgccacatttggcagtacaaatgagtctgagtgtaagagcccagagatttctatatagttgaatgtctaaaatggtaaaatgtgccacacagtggcttatgtttttcatagtaattcaaatgaactcctatttttgatagtaaatgtcatttaatagtgtacttgccatttgagcctcactgcaatgttagtgcagaggagaaaacaatttttaatgtaatcttgattttacctcatatactgtacattccaaaaactcaactttttaaagattatagatacactaccaaacataccaccttaaaattgtataaggttgaacttcatacaagtgaaaaagtataatctcataagaatacataaactatgtagcaaaagtatctgtaaaatccatggaaaataaaagttgtatcattcttttttgagatatgttttttgtatttataaacagttcatcacttgctacctatataagaaaatgaaatatctcctgtccaaggggcttaaacattttcccagtgatatttgaacttcagcctgaggggaca

SEQ ID NO: 22871 - DNA, 1179 bp, Mus musculus
gttgaaatgttttaaataaattcaaataacctcatttttaacatgttagaggaaggaatgatttttgccgcagagctatttaattactgtcaagaattaaagaatactgtatccttttcataaagattcctttgagtaatgggactgacgtcactgagtaccggctggaatggggaggagttgaaggaagtatgcagatgtgttactgtgggcctggcctcagttgtgaattaaaaggactttcaccagctactacctattactgcagagtccaggtaggtgactgtgcctgggcacacactgtccagaatcttctgtttagaggtcactgccacaattgtgtctttgttaacttactttattcatttgtaggctatgagtgttgtaggtgcaggtcctttcagtgaagttgttgcctgtgtgactccaccgtcagttcctgccattgtgacttgtcttcaagaaataagtgatgatgatatagaatacccccattactcaccctctacctgccttgcaattagctggaaagagccttatgaccatggctcagaaatccttgcctacagcatagacctcggagataagcagcctttgacagtgggaaagatgacaagctatatcatagacagtttgcaaccagatacaacatacaggtatacctcaaaatctctgtttatgtttgcctaaaccagaaaaatagaatacataaaattgccataaaccaaacttgttttttgtatgtgtcatttagaatacgaattcaagccttgaatagccttggagctgggcctttcagccatacaattaaattaaaaactaagccccttccccctgatccacctcggctggaatgtgttgcctttaaccaccagaaccttaagcttaagtggggagaaggaactccaaagacgttgtccacagatgctgttcagtaccaccttcagatggaagataggaatggaaggtaggttttctacttcctttttcatgtgtataatttgggggttaatgtatataaatgttataatttgccagagcagaatgaagactactataaagggccactaggtggctcagggggaagagacacctgctgccaaggctcccaacctgagtacactccatgaaaactgcttaatgaaaggataggaccaattcctgccagttgtttgacct

SEQ ID NO: 22872 - DNA, 1199 bp, Mus musculus
ttctttccttttccttttccttttccttttccttttccttttcctttcctttcctttcctttcctttcctttcttttcttttttaggaagaagcaaacaaaaagcacagtcattggtcaaatgagtctgttacaaggagagcaaaggcagaagtgaaaatagagctgagttgggttgtgttccataaaagcatggcagagcaagccatggggaaggtgttaaggagtctaaagaaaggcagacattttccttgcctttattgggtgaaaactgattctagaaacagaaactgccattgcggatgacctaactgaagtctatcccatgcctgagcacagtgtggaagctagtagaactgaatacaaatagagagtgaggccaaagttatccagctcatttagggacaccagtcactatatcctcaacaccaaacagctagcctaataaatacttagaagtcagtccattatctctagattgaggtcctaactccctagatggagagaaactaagatttctgttatttccatgagatcttaggttccttggagatagaagctgccttttaattaattttacattcttatacttagatatagtaggtgtctgacaaatatttgtcaaataaattggtaaattttaataataatctttgtggaaggattgtgggaagttaatgagtatattattttaatttaaaaatcaagattgtctctaggaaatttattagtttgaagtatatatataagataatccaaagacaaaaatagtcttttgaaatattgaaagtatacagtaagccaatatgctcaggttctcattacccctagttaacattctccagttcaatggcacataatttctaatactagaaaaccttaataagatccacattgtactcacagctaagcacttgacacattgtccaaaacctgacacatgagcataatgctagcacatcaagaagccataagtagagggaaagatggaggcatatgtatggctataagaaaatgcaggttgtttggtttggcaggaatgaagttggacacatagtaataaccactgcctgggaccttttattattttacaccatgagcaacctcagttgttagatttctagtatgtttacccttcaaaaacaggaagaaagcttcaaaccagacaggctgtttagaaaagatgctttgtgatctgta

SEQ ID NO: 22873 - DNA, 1214 bp, Mus musculus
cacactctctgattagcattggctgtgataccataggctgacagttttcagtgcccctttcctatcactacatagctgagcctgatggtgaatcttttaaaataccttagccaggagtcacaagtcaaacttggaaccctacatgtattagaaatatcactaagttaatctaaaatatctgtgctgcagttgggtaatacacaaataatcaatattcctgaaaggatctagacaagagaatatataagcagtatagacatttaaaaagctttgccatctttactaacttttcttcaaatagaattttttgttttcactatgaatcacatggaatataaatttctgatcacatagcttacttgtgtgccttccagattattcataaatattaatcaagaaagcattttaattaatataatattgattttccccaatacactagcagatgaaaaaacagattgttttattgtattttaaaatgtagggatggcttaatctcagaatgataaacagcttgtatttcaagagtcagtttgtggctgcatcctgtaagttatctcttcataactcctttcatttgattttaatatctagcagcaacagcctcctgcaggacctgaagagttgtgtactgtacagactgcctcagtgttcaccagaccttaagggagctgactcctgtatcagcattctgtacaaggacacatttctgtgctttactggggaacagtcttttctctctatagtagtaataataataataatagttggaaactttatttttaaattactgcgtagatttttttaatgaaggaaaaagaataaagctctcttattttatgtttgcatctgtccagaattatcaagtgtgttgtctagttttatgccaatttgacacaaactagagtcttctgtaaggaagaccttcaattgagaaaattcctctataagatcaggctgtagggcatttttctaattagtgattgatgggggaggacccaacatacagtgagtggtgccatccctgggctggtggtcctgggttctgtaagaaaacaggctgagcaaatcctgaagagcaagccagtaagcagcactcctttgttgcctatagatctgcttcccactttaggtcccagccctgtttgagttcctgtcctgacttccttagctgataaacagaaatatggaagcataagttgaataaccccatt

SEQ ID NO: 22874 - DNA, 1184 bp, Mus musculus
ggggtagttttttaaaaaaccttggggtgaagactgcccacttttggcatcattttaaaaaggcagttaagagactcgaatacagtattcaccaggtaacagaaaaaacactgaagctttataagtttgcctataattattgtaacaaagatagcttagtagaaaataggaaaaaatatgaccaataaattcatagaaataataatgcagagatcttggggctggagaaatggttctgtggttaaaagcacttgttgctctttcagaggagctgggttccgcttccagccacatcatggtggttcataatcatccatagctccagttccaggagatagaacatcttctgctgatcagtcatgtatcaggtgcagatacgtacgtgcagccaaaacggatcttataaacgatcttataaaagatctggagacagccacaggaggattttgagaaattttgcttaaaacctcagtgagagatgacttaaaaactttgaagtataactagcaaattatcggggaattttagtagtgtcaaactggaaaacatgcactcaagaattactgaacagagtataaataggttttttttttctttttgaagaaagtagcagtttctgtctacttttaccagtacacttttgaatcatacctataatatagaaatattttcatagattcctggagaatgttgatactacatggctatagctgcagaggaaggcaaacataaatgaaaactgcaagtatgccagatgtgttggcaggtgccttgaatccccaccctaaggaagtagaggaagtggaatctctgtgagttcaaggccagcatggccttgtataaggagaccttgcctagaaaagaaaaaaaagaagagcttgaggctggagagaaggctcagcagttacacatgtgtactgatcttgtagagactcaggttcaatgcccagctctcatggcaggtgctttatagctaccgtgaactccaaatccaggagatccagtgccctcttttcatttctgtgagtattgcactcacaagcattgtacacatacataaacacacacacacacacacacacacacacacacacacacacacacacgacacacagacaaatcctaaaagcagaataaattaaaaatagaaggttaggcaccaccagatacatggaatagagcta

SEQ ID NO: 22875 - DNA, 1131 bp, Mus musculus
tctgacataattcttcacaaaaattgaaagaacaactttcagtttcatatgaacacacacaacacattcacacattcacacatacacacatacacacatacacacacatacacagagagagagagagagaatgagagagagagagagagagagagagagagagagagagagagagagagagagagagaacaggatagataaaccaattttgaatactaaaaagaactgctggaagtatcaccatccctgatatctcaagatgcactacagagctacagtgatagccacagctgggtagtgctattaaaatagacatgttcgtcaatagaattgaattgaagacccagacataattgcacatacctatggaaatctgagttttgacaaagaagccaaaaatacacaacagagaaagatagcctcttcaataaatggtgctggccaagttggattgctgtatgtaaaggagtacaaatagatccatacttatcatcctgcataaaagtcaacttgaaatggatgaaggaccccaacataagaccagatttcctgactctgatagaaaagaacctcgggaacaggctagaatttattggtacaggaaaggactttctgaacagaactctgataacacagacactaagaacaattgctacatgggatctcatgaagctgaaaagctcctgtgtggccaaggatatcagcccttgggccatgtggcagcctacagagcaggaaaagatctttaccacgcatacatctgagcgagcagagcttctcaacctttctaaggctgcgacccatgttgtagtgacccccaaccataaaattatgttcactgttacttcataactataattttgtccacagctactgatccttttagaaatgaatataccagaaattctttggtgatattctagtgcttactgaataaaaggttccttagtatcgaccactccagtgcatcaatgaatgcaacaaaaacttggccacattaattctcttgaaccttttactgtctacctgcttgtagttcttgctttaaccagtgttactgctactcagatcatccttaccttttactcagttgaagcatgaaatggcctgtgtcatttaccataagagatg

SEQ ID NO: 22876 - DNA, 1219 bp, Mus musculus
acccccagcagttatagtaacaggaactgtacaatagaaaactttaagaaggaattttaccccatcatatacctgataatatttttctggggagccttgggaaatggcttttccatatatgtctttctacagacttgcaagaagtccacatctgtaaatgttttcatgctcaacctggccacttccgattttctattcatcagcaccttgcccttcagggctgactattatttcagaggttccaattggatatttggggacttggcctgcagagtcatgtcttattccttatatgtcaacatgtatactagcatttatttcctaactgtgctgagtgtggtgcgtttcctggccacagtccaccccttccggatgttccatgtcaccagtgtcaggagtgcctggatcctctgtgggatcatatgggttttcatcatggcttcctcagccctgcttctggtgaacggccaagaggagaaagataacattatatcatgcttggagctgagtcctcaaaagtttaaaagtctcctgatcatgaaccacattgcagtagcggtaggcttcttgctcccatttctcacgctcaccgtctgctacctgctgatcatccggatcttgttaaaggctgagattccagaatcaggtccacgtgctgctcataggaaggcgctgaccaccattgtcattgccatgatcaccttcctcctctgttttctgccataccatgcactgcggaccctccacttggtcacatgggataaagattcatgtggggatgtgctacataaggccacagtcatcacactgaccatggctgcagccaatagctgcttcaatccctttctctattattttgctggggagaatttcaaagctcgattaagggctatattcagcaaagttcatctatagaaattaaagtcaaagtgcagccttcctgtttgtgagtagctgaagaacagaattaagagtataaggagctgttctgcaggcatgctcatgaacattggtgtccaccttcattcactcagagtctccaacttactttatatttgcatcctaaccaacaagttggttcctgacatttaattgaccacaacatttgctaataaagtctatttcagaaatttcattagatatatttttagtggttggaactaaatgggaagtgtaagaaaaaatatttctactggaatcttgcatgctgaaatgtgac

SEQ ID NO: 22877 - DNA, 1687 bp, Mus musculus
attttttaatttaacgtgaatacccttagaaaatgtgtcttgtcttccaaatgcaagttgattgactgtccacattcaaccaaattatcttgaatcttctactgaaacagattgttacaaactgggaaaaagtactaatttctacacattggactattttaatattagaatctaatgtgccgtgtgtttgtttcacatattttacttttgaaatacaagcaaaaaaagtataatcatatgatactgtcttactactgacacagatttcatacctcagaccctctaagaaccgattcttttattcacccaacacatgctttgaactgaagactattgataatactccgaggttgtttttttctttcaatcattcagatcactgaatttataagtacccatgtagtacttgaaagtcaagtttggccacaactgtgcttaagaggaccctagtacagtacaacccaagtgcactttttaatgtttctgggtcctgaagaatcaagatacaaattaattgtgatttacaagcagactgttaactatagaagccttcagtttttttccctcatagacgtgtctaattacatctcaacagtttactctgttcttctacatctggggatgtttgtgttctctctggaatggtacatcttccagggtcttttgaacttgcagttatctattttttaagccaatctggtctaataactctggcttcttcaaagccacaccatttctagtccagctgtgcagaaacttcagatgaaaacagctgcattgaaaatagaggcactcccttcaccccccacctaaaggtgtatttaaattatcttgtgggattaacttatttagagatggtataatttaaaataggggatatttaaggtagcatcagctagcatttaagaaaatcactttttctaaactccatactttttgaaaagaaatctggtcttgttaggaaacaaatttctattttgtcctcaatttagtttcagttttactagtttgatagttatctcaataacaaaagcaatagacagcttcccccatttcttcattaagttttgcatgatcatcacacagattagttaggttttaggtcaagggcttaccatacttctaggtcttttgctagtgagttcaagttagaattagtgacagaatcataggaattttcagagatcctgcttcgagatttcttaaagctgcagacactgcactattggttttgtttttttgtaccggttgaaactatacattcaaattgctatgttcctattttctataatagtttgtctattttaaaataaactagttgttcagagccttactggtgtgatatgatctctgagttaagtgttttctgcatctgagctttctcctcacatcttttccattctgatgaccgacagatttacagaaatatactttttatgcattcatatggtatgtattatatattaatatattctgttctcttgtgtctccttttttatgaaatgaatttgtctaaaaagctgtatgctttgtgaggccctcccagaaacaggaaaaaggagacactaaaaacttgaaagcaacgtatacagcagggaatagaaagactgggaagagacagtaggcggctgtttagctggcagctgccggctgcagggccttcccacatttgaacattacttcgttg

SEQ ID NO: 22878 - DNA, 1179 bp, Mus musculus
aattgaattgtgagataatgattacttgacttagtaacttttaaaactgtgggttaggacaatgacacagcgcaggccatgttgacagttacacaagaaccaggggactggaatgtgatttttttctaccatgtgatttttttttcttaaaatcaattctttctgaaaacatatcttaccatgatccattttctctttaatatcacacctctattttccacaattcactgttatggtcttgggtaacttgggagacttgacttcacagtcaaagtgaaaaatattttattttgttcagaatacattgttgatactggctgaaatagggctcagggatattctaggttgtgtgtctctgacaaaaagaattacttcatagtttctaaattatttaagaaaagccctttttttttcccaagacaataccgggccctcattttcctcttcttctttacttcctttctccttctttctgcatatcagccatttggaaagaactgcagttgcccaagtgaaagaaacaaaacatgagaaatagccccaagcctccaaggaacttgtgatctagtagagaagtgaattacagtgctgtgctgagctatggcaaaaaaaaaaaggaaaaaaggaaggaggaaagagggagggaaggaaggaagatgacagaccagtaagagtcaaactagtgagcacacatggatgagagactgcttacaacagatttgggaatgtgcagcgatcgaggatatgaaggtggccctaacagttacctaaaacccagcattcaaaagctgcagcagcagtttgttttctgagttctaggcaggcctaggtcacagaaggagaccctatattcacaaactaatgcacaaagcaacccctctgcaaattactcctgatgaagatgaaaagccagccatgagtaaaaaggaggtattttatacaagggaagacagcagacaattttctgcagtagctttgtgtgctagtggggtgggagggttcttggaacagtctgtgcctccttctctcacaaagcctgctttagtacttttgctctcacgctgacgatgccattgcagacatgattatgttagtgcactggaggactcattcactaaagattgctacaggcttttgtgtttgcttttttagttgtattagattatatgtgtgagtgtt

SEQ ID NO: 22879 - DNA, 1288 bp, Mus musculus
ccaaagaccctgcagtgatgcacaggacactgacctaagcccctatgtccctcatgtgcatctatttcctggcaccctccccaggcctggccttcccctgtcgtgaccactctgaagagcatttttgcagttgagaggcatgcccccaaatagaataagcacattttgtaggtgctgtgttttaatgtggaagaaccttcctaaggagaggacatagtggggactgtgctttctgaagcccattgtagccatgggccacactgtgttaaagtgtggatttgggaatctgcttatttgtgtttagcattgcgaatccctaaccttgttagatccttggtactacaaggtaggtgggtgggtagatagaattaaggtacttgcatagagggaggggatttgagtaggctgatcacaagtaggactaatcccatgtgcctcttttctccagatgtccttgctccgcagtacccatggcagtcaaatgacatgtctgtgaacatgctgccaccaaatcacagcagtgactttctgttggagcctcctgggcacaacaaagaaaatgaagatgatgttgaggttatgtcaacagactcttcgagcagcagtagcgactctgactgagaaaggtgtggcatgcacagactccagtgcggcagagttctgtcaagggggaaagaaaagcacagacctaaggagcccatgaaaatcagcgggttttcttcctagagcccgagcccctggttttctatctgttacacaatgtttgaggattagtcagaattactgtagtgtttggttgtacatagcagccctggcatgagactgaagaggaactcacacaactcatggagcatacttagaaagagcactgagccagacgtggtggctcacacctatagtcccagcacctgggaggctgagggattgctgtgagtgtcgggccgccttgagctacagaatgagctgagccaccagggtaacagagataagaacaggcatcggagcgctgtgtgatacttcagaagtgctcacttgaacaactcaatatatatatgtggtaaatactgtaatttgtgtaaataaacttggttttgtttgtatttaatttttttcaattttttaaaaaatatttttaaaatttaggtacaccttcagtgtaggaaggaaacatttaaatccagttgaatttgagctgggcagtggtggcacatgcctttaatccagcactcaggaggcagaggtaggtaggcagatctgagtttggggccaactttgtctacaaagcaag

SEQ ID NO: 22880 - DNA, 1142 bp, Mus musculus
taaggactgaacgagctactgaagaccttttgaggataggcagggccagcttgtaaaggattgagctgtgattagttaaaggggctgtggccaggggagacatagttgtgaggtagtctgaccagggtttggtaaaaattggttggattggtggggtggagtgaagagagtagtagggatgagtacagtggagaagcctgctgtgacagtgctgtaagataggatctgaggtgattgtgtggctcagtaggaggaagtctggcttacaaggtttctgttgttatggatgtagtagaaaacaaatataagccagtattgaaatgagtagttgtaagtcctggtggtagtggactgggagatagaaaaggaaataatggttttatctgaaactgctgacaagggatggatttttatattctactgtttggggagaagaggataaatacttattttttaatactttattaataggtgcaggctattctggtcaacatttttggaggaatcatgagatgtgatgttattgcacaaggaatagtcatggcagtaaaggatttagaaatcagaatacctgttgtggtgcggttacaaggtgagtgctggtcacctagttctttctcattctctcagtgatgcagtgctggtcacctagttctttctaattctctcagtgatgcagttgtaaggggcaaggttaatttaaaaaatgatttgcaaatagctacatcttttcaatgaaagcattaaacacaaaacttgaaaaatgttattttcctgttgctgtgataaaatatcctgatgaaaggcccttaaggagcagtttattctggcttatagttccagagggcaggttgtccacagtagtggaaaatgcactggggaggagcagggagcgaatgctcacatctcaatcacacacaggaaaagtagatgaggctataaatggtcatagcctgtctctagtgatgtacttcctccagcaaggctctctgtcttgaaagttctgtgacctcttcggataatgccagcaactggggaccaaacatgagcctgtgggaacgtttctcactccaaccaccacaatgtgattttgttgttggtttttgtttctatttcaagacagggtttctctggctgccttg

SEQ ID NO: 22881 - DNA, 1188 bp, Mus musculus
gagcatggctatgactagctgctttaaaggctcacccctttggcttccccacagtgatgggctgtaatctagaatttaactggttgacttctcaccctttattttgcttagttcacatgtttgtcaggtttttttttttaaatcaactaactctgttttcttgtttgtttttgtgtgtttacttgtttcaatttcattgatctgtttgccctgctttttattacacccctgacttagcttgggttctattgctgtgaagagacaccatgaccatgttgactcttataaaggaaagcatttaattggggctggcttacagtttgtggggtagtccattatcaccatggtagggagcatgcaggcaaacttggtgctggaaaggagctgagaagtctacatttggattcacaggcagcaggaagagatagcgacacactttctccaagaaggctttatctcctaatagtgctgattgggttccttttcttcaaagcaccatactacccacccatctactggttttgaacttggcttgttctgtttttttccttggaacctgagatgcaccatcaagttatttgggacctcttctatcaatgtatacacgtgaggcagaggttgatgttcagtctctccctcaatcactcttcacctaacattctgagataaggtcttttactgaacccagagcacattgattcactagactgtctggacagtaaattccagataccattcttcctgtcttttcatccttagactggcgggaggtgggggagggtttcagatgcatgctgccatgcctgggttttgtgtggtactagagatctgagctcagatccttgtgtttgcggaacacaaactgactgactgagctatctctccagccacaatatcacactaaaatttcagtgcattcattttataagtataaacttttataagtgcattcattgtttcccacagtatctggtatattatattttccttatcattcagtgctaggaacttttctatttccttgctgtttcttgatgacatactgataaatcagtagtatatcgttctatctcaatgaaattacatatgtcatgtcaactttcttctcttgaattctagctttactccattataacgagatagaatacaggaaatcatttgaattttcttgtagttgttaaaacttgc

SEQ ID NO: 22882 - DNA, 1187 bp, Mus musculus
ttattatggttcctctcatatttgatgtcacatatatatgcatgtatgtgtacatttaaatcaagattctaactatgatagaaaacacattgttctttgaacttggcttattttgcacagcatgatttctagttttcttgtaagtggcataattttcttctctttatggctcggtttaggttggtcccttaactgagctactgcaaacagtgctgcaataaaaattgatgtgcaagtgtcttgtgctatatttgctaagagtccttcaggtaaatacctaggggtggttcagctggggcacaggaaaaaaatctatttttttttcatttctgattttagaggaaatgctctccatttctcccacttagcataatggtggatataggttttccatatatactctttattatcctgacgcatgtgccttctactctttttttccttatgtctttattatggagggatcttaaactttgtccaggatcttttctgtatgtgatttatgcttaagtctatttgcatctgaatgtttgtgctgtgtttattaattcatttatgcttatgtgtttttgcatgcctggaatgaagccaaggcagccacagaggctgtgtgatcatcgctttaaaggtgcctttggattgggtttgcaaggattttattgagaattttcatatctttgtttatcgggctcattagcatatggatctctctgtctctcactgtgtctctctcccttgcccatctcctccctcaccgtgtgtgtgtgtgtgtgtgtgtgtgtgtgtgtgtgtgtgtgtgtgtgtgtatgtgtgtgtaatgttcccttcactttctatttatggggtcactagggtgctaggctttaattgtcatcacaaagtctgggaggattcagcagtgactccatttagcctggggattggtccagtggcattcatttttgtttatgtatctatttaagttgtttctgtccccttgatttaattttggtaggtcacatatcacttggagtttattatttctgctaggctttccatctgtttttagaacatagagtattttctattgattccccaaatttcattggcaccagtagaaatctctctctctctctctctctctctctctctctctctctctctctctctctcttctctctctctctccatctccaattttattaatt

SEQ ID NO: 22883 - DNA, 1190 bp, Mus musculus
tgtgtccccaccagcaggcactgtcatttgttttatccaccttggccattctgaccagtataaatgaaacctcaagttagtcgtcaaattgcattttcatacttgttatccagtcttgtctatccactccttcattcttttttatgtgttttttttaccccacccccttgcccacttaaaatttaaaatttgagtgacttcttagacagagaattggcgtttttatttttgcaaaatgttcacagttgagcatggtgctgcgggactgtaattgtagcactgtggatgcagagagagaagattgtactgtttaaagccatcctagcctattgaggtttccaggacagctaggcctacatagagatctccagtaacccaaaggaaaacgcactcgccaacaaaagagagcccacttccaggcagcatcatgacgtggcctttctgtttacgtgtgtttttgttgtattgtcttcacagtcgaaatcagctgtctgccctgcccgcctgcctgtgtggtctgcctctcaaagtcttaatcgcaagcaacaacaagctcggatcactgcctgaagagataggtcagctcaaacagttaatggagttggtatgttactgatttctaagatgctcttgtttgtttaaccgactataagcgttagaggtcctctgaaagactttgttacagaaggaaaaaggagaagtctgtgatcattcccccatccccctcaccccccattgctctaacaaaatacctgagactgggaattttatacaacagacatttttagaatacagttttggaggctgaaagtacgtgtgatccgtttggccactgctgcgggctttccttcctcacagctgatagcatcatgctgggagcaaatgtgtgagggaaagagcacatggctagacaggaagccaaagagagggaggggccagttttactcttatatgatggtccactctcattggtccttagtgccatcctgtaagcagtatgataaccctgtctaagagcatgcccagtgctacaatcatcttctgctaggctccatccctgaaaggatccctgtggaggtttgaagatgcttggcccagggagtgacgctattaggaggtgcagctttgttggggtgggtgtggtcttgttggaggaagtgtgttactgtgggtgtgggctttaaaaccct

SEQ ID NO: 22884 - DNA, 1165 bp, Mus musculus
ctttagtagtcggagttgtgggagtggacccataaacaggaaggagggtggtggaagagggttggggccttgggaatccgtgcagatctgacttaagtttccgaccatatcctgttctgttctttgcgggacgatttgtaccccagcgagcgcctagcgtttcccagggcagtgggtgccccacttttgtgccattgcctagacctcacgactgtcgttgtctcttccgacttgcatcaggtctcttaggcttctgaatggcttggctttcagatggggtccttcagctacttataaaggaagactagggggcggggcaggggagccagctgtggctttcggaggctaggtttctggttaattccataaacatttaatcaggagaccaattgaaaatttagatggagttctgagtccattggaggctagaagcactcctctggagtcattaaacggtgatatttgggtttaaggattgtcaggaatgggtaagcagaggggaaattccagaactcagttttcaacagctggagaggctcttgataggacctcatagttacagcttctcaagtagaagttattctaagagtcgcctgaatcattaaccttaaaaagtcaccccatgttttccttcccatctgccatagttagaatggctgtgtactgcagaatggagaatcagaatgccccatgctaacgtgttcgcgctattcagtagcaggcttagagttattccaacacttcagtattactcatgattcctcccaaggttgggtagagttggcatgtgtgctgtgctggcatgtctttgagaataccattgctttaaaagtagtggagggaggtgttcatctttcagttaccgcctctgtgagttgacactgtgtggaaagggtccttccttcctgttctctctgtgtgcggtggggtgtgcaggtgtccaggcattaggagtgttacatatattttaatgctcctaaaatccttaagtagtcaaaagtaagaggcttcatgctaattctccaccctaaaacagttactattttggagcagcagcggcaaaagaatgtcagctacgtttgtgggcacttaaggcaataccataaagaaaacaaaagcaaaaacaaaaacagtagctgaagagtctgttgttttatgtaaaagt

SEQ ID NO: 22885 - DNA, 1213 bp, Mus musculus
tctcattccaaggtcttgtgatcctaccccagcccactagtttcctgctgctaacgtctgcacatctgtccatgttaggtagtgaccaggcttttcctgagagccaggaagctgagctctttgctatggcctttcttctgctatctctctccacacaggtgggagacagaggctatgggggccacgattacccacaactccactcctctttagaatgaagctgtggatacctgggaacctagaattttctggaatatggtaccaagggggattgtgagagagccaaagtgtcatcgggagggacaagtcacactcctgagaagaacaggaggcagaaccgctctctcaggagcccgtgaaggtatcttcataaagtaggaggggaacgattccatctcagacatacagtttgcgagccgatgtttgtgcttttaaaaaaaggtttatatttatgggggcttggagagatggctcagcacttaagaacacttgctgttcttgcatgtttagttctcagcacccacttgggtggctcacaactatcctttaactgcaatcctagggacccgatgcaccaaatgtgaacatggaactcttacattcatataagcaaggcagtttgctcctgcctccccagtgattatactgtacgcgtacacgaggagtttagtgactgggctatctcccgggcccctaacatcacatttgaagacactattgaactttgctttgcctttttggctgagccttgggaagtcccttctattttacactctctggacctggttcttcctgcctctcccaggtcccctcccctccccttctctgtagctgccctagtgtatgtaggtcttcctatgtcaactactaagcctctgttttgtcctcagtgcacccagcacccaatccctgctgtcttcctgaaacagaagcccagctgtgtcccctggaaccctgcttagcattgcgctgtgaggactgcaaacatcctccggtcactgggctgggcactgtgggctctaccttgcagctccgttccccactaaatccttctatccccccccccacacacacacacactcccctttccctttgtcaaagccacctggcttcccacgtcaatgcatctgggctgtcagtcctctcaagaagctgccctcttcccttttcttcaatatggagtctgattagcctttggggatctccctcctgc

SEQ ID NO: 22886 - DNA, 1195 bp, Mus musculus
ccattgccctgaagaaacattgctgaaggccatgggtgtcagaccccagcacggcaaagagaatgccggggtgaaataggaggagagggaaagaaggagtaagagggaaaaaaaggaggaggagtacagaaaggcatgttcattcagaacatggctgctggcaagggatcgcatccaaagatattcgtgatctggctggaatacagacatgactctaatctcaggagatctgagttcaagatcagcctggtacagaccaagttccaggtaaagaaaagcataggtccaggcttggttgtgcatacctttaatcccaaacaatgacggtaatgttagtttgtagaaggaagcaccaatgtttgaaagtgatgtctaacggaggggcaaattgatgaatcagagaaagatttgacagaataggatgtgcccaactttcacaagaaaagagaggaaagataagctacttcaggaagagacagacagctccggaaggagtacagtacaggatacaatagagctcgtgagagcagtaagtagagttgggtgggagagtggagcagagagagggagaaggaggcagtgttaccgggggagtttttacagagacagattgaagagcgaacaggctggacacaggtaaagacacaacaagcaagagaatgagaaggatccagaagatagaaaagattggaagagttagttcgaggtcaagcagagtaattcaggggctgagagaaaacccagattgaagaagtcatctgggagaggagtttaagccagagtgactgaggtgaaccaaccacccagagctcagaaagaactagaaagagtgagctgattcagcagtaagtctcagaggctgagaacatgctaggcctggattcgattgtacagaggccagaagcttccagggctaggcctaggtcagcagatggaggcagtagactccaagatgacaactacatctagagaataaaagttactgttgcagaaatacttacataaactttctgagccactgccgtgtgtgtacctggtgtttttattaatactttcaattgcacgaactgcttcgctggccactagagactagaagaaataggatgaaaatgttgggtcagttttcagcttcaaaacaggacagtttgaactttctaagcaaacataaaataagcacattaattgaatgcaagtc

SEQ ID NO: 22887 - DNA, 1143 bp, Mus musculus
cataatctttcttgacgttctttggtttgaagacattgctaactacagaggcagaggagtcaccagccacatcagcagtgaaaacttcaatcttcagagacacgtgctttggttcatttaagattttccattaattttatacagtaattgacactcaggcaaaataatgtgaaaatgtctagatttagtaatttcgtctgtgtcttcattaaaattgaagattttaagaaaccaggtcacccctgctcttccagcctatgaatacttcttatgaaataaaagcactgattttcactctggatcaccatgcagaaactgaccttagtcagaaaggagtgttgccagaagctgctgcacaggctgcagggccgtgtacagagctctgaggagcgccagcctagtaagcatgctgggaggccgtctccactacaggaagcccaggtggtttggtttttttcttttgaaatttctaaaataaatgactccatgggattttttttttacacgtgtacattactacattatatattggaagtctttggacctttgagtggggtttaattgttcattatcagagactgtgtgctattttatttttaataaatgtatgttcccttttcctgttgtagattttccttgctctttattaatcagactccagacacctagaaacatgtattaccagcattatagtttcattcttcatatattttcctgcttgtgtagttagcactggacacttgcatacgtgtaaggacactggagggcgtacttcatatccagctcgcaattctggaggcaaacctgtgaccagggtgaaaatcctgccacctcagctcagttgtgagctgcctccgtccatcctgtgctatgtaaagtttacttctttaaatttcagactagcttgttcttgtatgtgtttagctcatgaagcaaactctcaggaggacttgggatagacaggaagctgaagaatttgggcagacagtggtgctgaggtgctaatagagaagatgttataacttgctcctggcttttcatggggctccgttaaagccatgagctgtgttacttctctcaggcctcatatcccatctctggagattgcttggtgacactggggcagtgtgcctgttcatcttg

SEQ ID NO: 22888 - DNA, 2208 bp, Mus musculus
tgggttgtgtggtgcatttgcttatttattatttgattattgctttgctgtcaccgtcattgtactgggagtgacctgaggcttggacttggcagaggatgcagctccctgcaggacatccagtggctataacttctcgggcttttccccctcatgtttctgagactggagatttctgagagcgaaagtccacagtacagctaacccaggctaacccaggcatccctgttgcttttcagctgaacctcctgctgtcagtttcaaagtagtcccagtggaccacgagtgtcagcagtctgtcccacaggagaggcctgaggagtcctgcagcctgcaggatgcccaagacccccatgtgggacggctcctgtagaacatggatgtgcagcctgcagaaggaaacctgggtgagccagagaagatcaaaatgccaaagactgacagcagggatagctgcctcattgaactggtctccagcagtggagagaagcgacagggggccacaattcacagtgaaatgttccttcacacagcttgtgcaataaagtaggttacagtagtgactagtgtgatgcactcataggaactcagctgactggaaagctgccgggtctcagcaaggcattcaccccggccattcctcggacgctgtgacttgaagaactcttccttctgtgtcccgatgcagagcttctcatgctgggtcgagcgaggttgagttggaatcggatggttgctgccaagaaggcatctagcttttcctggactcaggctgtcatctttctgtgggctgacacaaggcaggggcagttgcaagaagccaaggcctcctataaggctccttgaactgcatcctcctcactagagaggtgtatcttgatgatggggatcgccacagtgccggcaccagtgtgtgagtgggagtgaccagtgaagaggttttagcgtggcacagcctggagaggaggcggcctgtggggagtgggctcatggatggagcttagttgcagtcattctttataaagtgaatactctttggttgcctatgttgtcctagacactagccgtccggcatccccagtcctgccatagctgaacacctaagtgtggcaaacgctgcccgtaccttaaatatgacaccagtcaaaagtcaaaggactataagcatctgtgaatttccctacaaattcctctttgaatttgggattggattggctttgaccctggtgttacaataaatgtagccagtttcttggttcagttactcagaccgtcgtctgtagggtgggacagtgctgagggctctgaaatagggcagatgacctcatggtgcaggtgaagggacaggaacagcctcttgcacagttgcacgtgggtgacccatcccgatgcaacaggccagtttctcagcccagtttaaattggtggtggccgttgcttggtagagcatattactctgtattttgggaaactcagaggtaagagggtccatattttttctttgctatgaaatgaacgagttaggaagattgtacttactattttaaatacatgtcttatgtgataaaccataatctccagttctgtgtattatatgtacattgggtgttcagatagcctttccaaagaagcgaggacgtgaccgttgtacagtgctgtggctcagcagtctgatggacagagcaggacttgttcgaggactcttgtagtgctttgatttgtttgtttctgaaaacactcacataccttaccaactgctgggagggtgggactgatccagttcgtttgctgaatgaatatttgtttaaatctgtacagtttcacgtgtttacttatacagagtgtacatactttgaaataattaatttaaaatgctttatattatttagctagaaattgctgtttttaataaataaatttttttaaaaaataaagatctttgcttcctactttgctgccacgtgtttgttatgttatgttgattctctaaaagtgctttaattgagaacttggttgggacaagttgtagagaagtggaatatttatcagatatagtacctgagttcctttatcgagctctgctcagtgataacattttacaagctgtggtgattactatagctaggattttgacatcagaacacttggctagtcttagctttcccatgctttattgtgtaataattaattgtgaaaaggacatttttt

SEQ ID NO: 22889 - DNA, 1193 bp, Mus musculus
ctgggatatggagtctttatctacaccaagaatagtagctccttctagtttggaaattctgtgtggctaactgatgagcagtacttacaaatacacatgtgtttttgataatcgttttttaaaagtgattttcaggtccattgttagtcacttgattctcccgtgttggttgtctcacaaagatcccaagattatgactcatattgaggaggagaaaaatgtatttcctgattttgtatggtggctcctcactgaagtactgtatgtaaaatagtattgttagcagtctgaagaacatagatacctaaccttgtctcttcaaatgctgaaaatttctcagaatacttggtatgggcccaaagtacttgaggttttgttgtttttggtttttttttccttaaaccttttttttttctttattttggtggttgtttttgtgaatttcttttgagacagattcttctgtgtagtcctatctgtccaggaactcactctatagaccaggctggccttgaatgctcagagatctgcctgcttttgcctttcaagtgctagaattaaaggtgtgctccaccatgcctggctagtgttttgttttgttttatagtttgaacgtgtgtttggtatgtatgggagtaactgatctgcagtgatgtaaagtataaaaggtaataatgtgtgctggaataatttatattttgaagcaatataaaattagtgttaaaataaaagttgtaaacagttgacttgttgggggcatctaatttgaatgaactgttacatcttaagtgttgattctgagcttctagagcaaaagtagtttacggactgattcttgttcctcactcagagcgtgtgcccagttaccattttccagtcgatagttattctttctggctagaggagttgcatattggaaaaaaatcccgaacatctagctattaacaactgcattttgtccttcctttcagtgagctattggagaaattgtgcgtgtcgttgtatgatgtgttccggcccttgatcatccatgtcattcacttagagactttatcggagctctgtgggattcttaaaaacgaagtgcttgaagaccacgtacagcacaacggtaaatacgcagaagtgatcacttcaaaggacttggtcattgtatctgtggctcagtgagtgtgagaaaaaaaaattggact

SEQ ID NO: 22890 - DNA, 3301 bp, Mus musculus
ccatctctaggccctgtgaggtctcctcattcaacaccgaggctcttcgttcaatggtgtctctattgaaaggtatcgattctcattagaatctgctctaggagttcagggtatttgtgatttcagagtgatgcggttgaggtatctcgtggcgtcctggggaaggatgtggatccgtcagtgtgcaagcatgcttactgtggggtgctgactgaacatgggcacagcataccccagaagtgtttgattggcatccaggtggcaggcaaagcggggtggatgtctttcctggagagccaaggtgaaggggtttgcaggtctcaggtctgatctctctattctgaattgaccttgggcaacagctagggagacagcctgagactctcagcatggaactaaaggggacttagcaagctgcctgcaggtatttgctagtagataagctaagttgtctgttggggttgggaacattacattctcttggcagccttaacccgcaactgtagttctttttgacttacgaacaactgaagaaactggacttgtgaccacaagtcgtcgttctgacaaaccgacttccgcgacggtagcccctcctgtgcttctggctgcctcttactgcacagctcatcatggcttctgggatgggagcaatggatggagaccaggttcctcagattgccatgcgttggtcctggatgctttcatctgtgttcagagcctagagcataggaacacccactcaccggtggttaccatcgaagtgcccttgacatcctagataactgatgtacataacagatcgtccttgctgtagaaaacctgcaaggaaatgagaaccgcctgctgctttcttcctggagagtagcctcgctgcctctggtcttctggctgtgtacatcgcccctctgagggggctcctgaagtgggggagcactgttatccccctaccatcgggagctttcgtttcctgtcagtgaagagattttacattgggacagttgtaggaagtacgtctctagcatactgcacggcttcatggttcctgcttgggcagaatctttcacttacagtaagactcgacctttgtgaggcaacactaaccatttgccctaagatttttttttagcaaagtttattatttccatatatcaaatgggggtaattatgctttgtgaagtagggattaaatgaagggaaaactacagaggcggctgcgagaaggatgagtgtgcgcacacctgtcagtaaacagttggtcaaccgtagggacaggaccaaacgcctttgttaaataaagaatcctgcaggtgaaggttttttagtcagttagtgaactgaagaggtgaggctccagagttttagcctttactttatcttgaggtgagtttgttaaacaaacaaacaacaacaaaaaacctttatctgagtttttcctaatttcctggaaaattaatttctaccttcctctttcatttgtgtgatgacagggctaaaccctggtgcattctgggtatcttccccacactgagctgcacgatggcccacatcgatggcccgagggcctgtttatctccattctgataagagctgtatagtcctctacctagtttgtttcttctgagacagtgtctctaagcgccaacagctttctagaagggtgcccagtgcctgcaggttggccctgtgaaaacctcattagcactaaaggaggctcgaagctggagcaatggccagtgcactcccggggccccttcctccttgaggcagaagcatgcaggttttctctgagggttgggcgctttttattccataccttttccatctggcttttgaaattaatggttcctttgaaaaacagtttgcgaagtagaattttgtttctaaaagtaaaagctaagttgaagtcctcacagagctggcccaatggtggcttaaagacaattccctcacatgccattagatggcagtagaggatctgagcgactgctggcctggctcctagtattatgagttagagacttttttgttttttattctgacctgaacattccgttgaagtgttagaatccagagtctttctctctagttgaaaggattggctttttcaaacaactttttaacatacaaaaaaaaaaaaagaatctttttttttaattaaaattcttgtctttatcctttcttctttctctcttttttttcttctttttcttttttctttttttctttttcatctttctgtctttctttctaattttttcccccaattttccaagacagggtttctctgtgtaatcctggcgctctctctctctctctctctctctctctctgtagaccatgctggcctccagcccaaagatcttcctgcctctgcttcctgaactctggaattaaaagcgcacaccaccactagtgggccaaaacaaacaaacaaaattcaaaacaacaataacaacaaaactactttattttttaagtttgaaggtaatttctaaagtacaaaaaggtccattttgaagaccatgtaaagagtggctatcagtattatcaatttattcaaattaggtatatatctatacctggataaaaagaaacctacacttcactgtaaaacttcatgtttcaaggcaagcttgcagtattttacgaccaggatagtgtcaatttattaagtgccttatagggcagggtcttaacctgccttctctctggagttaatgtggttgttgatgtttctaaccccgagacaacttgaaacacttggtgatgtgggtgtggctgtaacacttcaccacctgtcaatttcctcaagtatggtgaaaactacttcacacttttgtagctaagtggaaggcagttgtgtttgtgttgttactgatgctctgtgtaatgttgctagtctgtaatgtcaaaaatggctcctgtgctccatatttattcgtgagctatgaaactgtatgtattatgtaaagagtacacattttccataagcttttctattccaggctctttatacattgttggactgtgtggcataagccttgtttcattatttaataaactgaaataatatatgataatatggcttacagtcattttgggtacatagagagatttaaacagaccaaacgggtcctgaagactggggagaagcagtatctgtgaaagcagccgtggaaacttttctctgcatggagaagttactgggatcaactcactctttgccttgtccttaagagatggcccctgccctcacccccatgtcattttgtgaagtattcaacattcacaggccaat

SEQ ID NO: 22891 - DNA, 1152 bp, Mus musculus
ttatatggatgctcataaaactgttgattgtagtctgtggactgattgttaagtcactaaagtcaagagcagattgccctccattgaattcagtaaacatggagcagccattacagtatattttcctctagattcctctctgtttaggacttccaggcctttgatgcacatggtcctgtgtttagtgaggaatacgttgtaggactagagaaatggctcagtgggtaagagcactaactgcttttccgaaggttctgagttcaaatcccagcacccacatggtagctcacaatcatccatagtgagatctgacgccctcctctggtgcgtcaaaacattgtagaatcagaaaaagtttgttgaacccttttataggaaccccatttgggttttaaggatgctagtttttgttacttgtgagtatttagtgtatttcattttaagtgttacttcctgccttgataacctcatctgtggtgctttttttgttttggtttggtttttagggatacctgaaagaaatcttgaaagaaattggcattcagaatgtaaaaggaattcacaagaacacatgggagctgaagccggagtacaggcattaccaaacagaagagaagagcgactgagagactcgtgtgctaaagagtcagtcacaggcaggcctggccagcccacaccacaagttgcctgcctgcctgccttgacaggacaaagacacctgggtctaccactcctctcagtaaactgttaaagctgagattccataaaagtttcttaagtgttttctgaagagaaagatgttatttatagactaaactcatgttacaccattcagcgggcatgctggcacatgaatgtgtccaaaactcaggagactgaggcaggcaggtgtgagtttgagaccagcctggaatacacagcaagacctcctccatagaagaaaaaaattatggtatgggtggagctctgggaattaaaactacttttgtttttattggttaactttgcaagcgtaaatgggatatctcctaaatgaaaattttgtctctgaggaactaaggtaagaaaggagaaaggtgggaggcaggggcatcagctaagaaatgattacaggaacacagagtccaaattccttctgcaactgaagaggga

SEQ ID NO: 22892 - DNA, 3415 bp, Mus musculus
atactgttaggatgagggtcttaaaactcacacccacagtgacacacctactccaacaggccacaccttctaatagtgccactctctgggccaagcacatacaaaccatcacacaggcccttgcaaatccatcaattttaaatttcttagcttgtcttccaaactgaacctagtctatacagagcatgggggtttgtccttcctgctgttgtatttatttagttcctgtcaggttaattgtttttattggttttaaggtaaagaagctgtttggattatctcaggttaaggaaatattgtgattttaacagtaaatatttgtaggggaggcaatctgaaggacattatactcacctattctcattcatgtgaagtctaggatgctgtcttcatggtctcaccaaagctgcctgcatcttggaacgtcacatgtgatcatctgattcatatatgtatatagcactttgtatctggtttactggaatattaattctggatggcttttaaaaataaccaaataatcactggaaatggggaatctgtactcgcaaccacccagtgggagtattatatggtttagtgctgtaagcaatgcctcttgagctgttaaacagacactcctaatgagggagagaaaagctaaatgcgaattctgggcatttctagcaggtttttttgttctgccgactctgtattctagttttcacaaagcatagagttgtaatgggaaaatgttttgattcccaattcatgtgaactttataaaaattaggcaaactgttcaaattacaatataaagtatttcttaatagtggcacaatttttatactggtataaacagcctattcaaggactgctgcttcttaaaacctgaattattttgagtaaattaaacagacttcttgtccccatagatttagatagatctaccctttggctaaagtgaatgggtttctgcatataaaactttatacaagagtattaattctgactagcatggtcatgagtgcctttaatcccagcacttggaaggcagaggcaggcatatctatgtaagctcaaggccagcctgctctacagagtgaattccaggacatccagtgctgtgtagagagaccctgtctcaaaaatccaagaaaaaggagtatttattctgtccttttcatattgtgattatccccccccccatgagaggaaaatgtttttttagctattagaaaacctaacatattttgtgaaatttgttacttttaaaagttattatgtgtaagtacactgtagctgtcttcagacactccagaagagggtatcagatttccttacggatggttgtgagccacaatgtggttgctgggatttgaactcaggacctttggaagagcagtcggtgttcttaactgctgagccatttctccagcctctttttaaagttaaaatactaagaaatcaatcaatttaaaggaggtagctgtcggcagagcgtgtacagctcttgcaaatcacctgactcagttcccagcacccacacctggtgtccacactccctgtaactccagctgcacggggtctgacccctcttggggtccatggtcatctgtgcccatgtacaaaatgacactcagactcataactttaaaaataatcttaaaagtaaaaataccacttctggacactcattggccttgctttctcagtggaaggggttaggaatatctgtactatgcttactatttcctgtgacctcagataaaggacagcccaccagatgtatgattacctcgctggcaccctggagccagtgctattttctgttacccagatgacagttgcagtaaagtatatgccatttccagggaggtttggccacatggagacataaatctcaattaatattgaccataaaaaaatgaagcagctctgtgtgcattacagaaagatgttcctcatatcatcccatcttccaaagagcagaggcctgctggagtccactgccctgacagtcagcatttcctaataaaagcagccctgcaacccctggccatgttttacagggagtgaagaagaaaggagttactagcaccaggtcaaaccctggtgtctcaccactaacgttggccatcaattccctggatggccttgtccaggtccgactgctcagcctcaaacagtattcacatcactggtgagcagacggttggttttagtagtaggggaagatgagggactaaaacaagagaggacctggccaacccaggataagactttcagattggcctccacagggaaaactgagctctgcttgtggggtgggggacatagtctacatgagttttttcatttatttagctttaagaacacattcacttattcatttatcctttgttaggtgtgagattgctatgtgtatagatctgagccttccatgtttcagagtcacataaatcattcgctgttacatgatactatggttcttatgcagactaatcatgttgataccattgtgaaatacatgacagtggtgcagagctcataagctcgaggcctcgtccgcttccacttctccatggtgttattggtgcttctagaaaagcctctccagggcattatacctgagaggaggagtctacatcgaggaaagtggctccagatgagagaccacgaagcaccacctacctgacttctgctgccatactgaggcttcgtctgggctgcagatacagagccttgtgctgctgtagaagagctttttgtttggttgttgttgttttgtttacagctttaaaaacccactctaacggggcccaggcatgtgggtgagcgtgaagtcctggctccatccccagttctcagcaccacccagaaattgtttaactgtgaccatggtgtgtacaaggttgaaaggttgtatactccttgtagccgtttcatttaggaaaggctgcttttagaaaaggatcattttgaagtatagttttatatatacatatatgaataaaatgtcctctatatctgagaagttggaatcttccttttttgtttttctttgttttgatattcttagctttcctgaagcaagcagtactggcagcaagaatatcctgaacaggtttcttctggttagccagtcattgtggactattatgcaggtgatgggaaggagaaaaagaattcgggtgggggaggaggagtgaagatgctggtggcacagacctgcaaccccactattgagcctaaggcaggagaatcacaggctaaaggcctgcatgggctgcaccatgttttccagttcagctgcgatgagcgagaagcactatcatggaactgactgcagggtcaaaagcctgtgctgggaccatggagtccatcttacctttgattcccgccagggttctaatgaaaattccagtgtttctta

SEQ ID NO: 22893 - DNA, 1213 bp, Mus musculus
gctcatctctggctggtcctgagccttattcttactgtagtttatgaaatgatgaaagccatggagctgtcttggaggcccagtggagcccagtctgtgttcctaagcagtaaacgcctgttagggttgaagggctgactctgcactgtgggcattgcgcctcttgagagatgcagagcagaggtagtgaacagtcagagtgaaccgtaggtgggaataggtttcaaggaattgtccaatttaccaattggccgcagctgtcaaaatggtgattctttctttggttatcaggtaactgaccagtcaaagctactaaggaaaacggtgacagtcaccgttattccaacaccttttaagttggaataagtcttaagaagagaaatcatagaattaataataggagaactaaaatgttagcctctcaacatggaagactatcagctaagagataacctgcttttagtctttcttggctataaaaactatttcttaattataactcatttttcaaaagttttaatgcttttaaaagtaaatattaaagataattttgaactgaaaaattccccacagaactctgaattcctgtagaatgatgacagctttgttgtcctgccttagtaagatagcttacaagtggatctaaacaaaagttggatttggaactgaaactgggatttactagacatcctgttgtattctttaaaccacagtaggagccattttatgcctgagcccactagccttttgtctcagcactgaagacagaaagtgatttacccttggaatctcaagctttaatgaatttcagctctgttccttaaagtatgcaaacgagatgttagtgcattcctattacctcatacgctacaagctactgcaaagtcaaactttgtgtatcactgtgaactgttttgtttgaactttaattctgatgcattttctttctagatttttaaagaacaatttcgtgtcacaatatgcaatcctatatcttttccgtgtttactctatgaatattaatataagtgattttttcctagaatgatttattgtgtaatatttgtattatgtgatcatttgaaaactaataaatattttctccatggaaaaaatgcacttactgataaatggcttatttttgtttcaggagtagaaagtgaaaattgcaaccgtatttttaagtgtatttatgtgtcttttgctaagtgtt

SEQ ID NO: 22894 - DNA, 1928 bp, Mus musculus
cacaagtgtgctttaaatgctctttggagatagaataaataattggttagggagagtccaggacctagtaagctaaagcctttctttgcctcctgttttcaggatctggtgaaaagccatttgatgtatgcggtgagggaggaagtggaagttctgaaggagcagatcaaagaactaatagagaaaaactcccagctggagcaggagaacaatctgctgaagacgctggccagtccggagcagctcgcccagtttcaggcccagctgcagactggctcccctccggccaccacgcagccacaggggaccacacagccccctgcacagccagcatcccagggctcaggatcaaccgcatagcctcctaggccccaacagaactggctgctgctgctgctgtctgaactgaacagaccgaagagatgtgctagagagaagccgcctccacagtcacccatttcattgctgtctacgaaagagacgtgagactcacacgctgttctcgctttctccccagtattaagcactcataagcttttggcttgaagaaatgtactagttgagtgaattaaaggttaatcagagagtgagcagggatgtgccctgtgcaacgtggcagatgtctgaggaatggtttaattgaccccgaggagctctgtgccttttcaaccctccccagccgcccaccctgcttctgagagctcgggcggctcgccttcgtggggctcgcctgcgtggggttcggaaagtgggctgctcctggattctgcgctctcttctccttcccttcaaagaactcggagaggccagaaacaagactgcaatggggggcggggggagggatgatgcagtccttatacaaaaccgacaactgtcaccaaagcttataaaacacgatagtactgtccctcttttctgaaccatcagaagacacaaaactgttagtgacacaacggtgacaggtagctgggacctaggctatcttattatgaaggttgttttgcttgttgtatatttgtgtatgtagtgtaacgaatttgtaccatagaggactgtccgtaactactgtttagcttctacacattgaaatgtagatgtttcattggctgtctgaaaaggtgtggcttgtccttcctagagagatctacttaaaaactgctttgtgacaaaaaccacacctgaagaaattttaagaatttggcccagttagtcactctgtgtaatcccggaatctagctgctgaagtcttgcgaagtaaactccccgtgaccgatgtcagttaagctggtgatacctggagaagtggtcagttgctaaggaagtggatttcccagtaggggtttctgcacctcacctgtatagtcgttctgcgcatgtcccccacacagtccccactgtatttacctgttctacttgtcacctttcaataaagcatatcaaatgttgatacacacgtgtttctatatgacgccattaatacattcatttccacagctgctcttcatgaagtcaacagcagtttgcctagtaaagtctcagggcgctgacaccagtgctttgactccagaagagaggagacattgttttgattggggggggggggggaatgcaggcagaagggctcattctcttgtgactaagtcacttcacccctctggactgataagagaatcttcacttctccaatttaaaatttgagggtttatgtagagcttatttattcgtagttgctgaactgagagggaacaagcctggttggtgtgtgaaggttaaaggaagagggacaggttcgtttccacgttgacagctctgctgccagaatgagtttctggcccctgggagagtagttgtgtttgtagacactcttctgggggttgaaaggatgtactgggcttgagctaggtaggacctgggacatctctcccttc

SEQ ID NO: 22895 - DNA, 1174 bp, Mus musculus
acagaatgtatttggacaaagcattgcagccacggtgaacatgtataattttttgggggggtcatgatcccataaaccatgaagtacaacaacagaatagtatttgcactgtgtgaagcttgatagggtctagagaccctttagcacatgtgagaagatgtaatgaatcataagaaaacactaagccattttatgtaagagacttaagcagctatggactctgctatctactagagcaggggttcctggaactaatctccaggaaggtgcgggataattaaactgcacatgagtcaggattggaaaatgcttggttaggaaattcttagagcctcccagctatgttcacgaaaatgtatcatggtgcctttctttgggctggctcagatggagttccattgcgtacctctttatcttcctagagaagtgggggagctgagtatatgctttcagggggactaaggagtatgagaccctctgcatgtcccaaacattcactcccaagccaaccgttgctccttctacacgctttcttcattcactttgctgagttctgatacccatgtgtctcccacaagcttctattccatccgggacttgtacccttccaaccttgttcacagaactctcgggccaaactttctgaagatcttatgtgtatcacccccaggtgtgattcttaacacacatctgtatggttacctcctggctcaagattttcatgatctgacctaggcccatggttatggcctagcttagtgacatttgtcctcccgcaagtatcttaggctctcggcaggacacacaccccgccaagtcctttctcatttccatcttactacacccacactttcctctacatggggagctaggacagacattcaaactcactcagaaggagaccatattaacccatatacagtaaatgccagctctagtttcaactctgaggctttgtcccccagggtgaactaccggggactggtgagatcttttggggactactgggaggtccttatgtcattgaagctatgtccttgaaggagatcgtaggaacctagtcctccggcctcctaaccatcaggtgggcagattagctctgcttcctgcttcagtcatgtattgctttaacccaggcacaaagcacaggtgccaatcaatcatgcaatagaaa

SEQ ID NO: 22896 - DNA, 1195 bp, Mus musculus
cctatcagtcacactgtctccaggtaccagaggctgtgaaggcaaaatgtcattgcctcttctaagccattatcacacccataacttcatcccatagcctgggccaaagaaccagaataaataagaggcaggattagaaaagaaagggaggccaggtcccgtcaggctctggccacctgagtccttctcctcctccgccaacgccccgctgcagcagcctccaccaccatgggaatgcaggtggaaaccatctctcctggagaccggtgcaccttcccaaagcacagccagaactgcatggtgcattacacggggatgcttgaagatggaaagaaatttgcctcctctcgggacagaaacaatccttttaagtttacactaggcaagcaggaggtgatccgaggctggaaggaaggggtagcccagatgagtgtgggtcatagagccaaactgataatttcctgagactatgcctatggaaccactgggcacccaggcatcatcccaccacatgccactcttgtttttgatgtggagcatctaaaactggaatgacagaagtggcctcctcccttagctctgcacatggatctgccatggaggaatctggtacctccagatgggtgcacatgaatccatggggcgcttttcctgacgtcccaccaccctttgtgtagacacttgcctgactgaatgtgttctgtcactcagctttgcttcagacacctccatgtcctcttcctccttctgtatgtgtgttgacctaaactatatgccataaacctcaagttactttattttgaggtgaagactcagtttccgtctttcagatctaagtttccaatgaagtatattgtcaagtgttaacagcacaagcgatgggttaacttagaataggaattggtgttgaggggtgggcgatttgcaagaatttttattttattttatttttattttttggataaaaaattttatctattatatattaagacattctgctgctgtgctgcaaagccatagcagattcgagatgctgttgagggctggatttttctctagtgagggaggtcctatcaaactgaaagccctacccaaactgaggtgggaaggaagcgggggagagagcctttgcttctgacagtcctcccatcttctgaaactagctgccttttaaagcaggtcccttcactgctat

SEQ ID NO: 22897 - DNA, 1145 bp, Mus musculus
tcctgcccttactccaaaccacctccgtggaacttaacacacatcgttattctggttcagaagctcttctcattcagcttcaagcctacccttttagagtctgccaaccacttgttgtttgtcaattagggggcatttgggtagcaaggcagaacaggcttaccttttgtgcttccttgctctcccgagagcatcataaacgaggccgttcaccctggaagcagtattacttgggcaagtagcagcaaacctgcttccctggaccagcagttggtagggaaaggtcctttcctcagattctgagccccaaatccaagcgctgccaagcttctaagctctgatgacccaggccctctttatgtgcctgcacagcctcagagctggtggcagcatcctgtagttaacagcttttggtgctcagtgctatctctgcaacagctccagtatttgtttaactactttcccatgttaaactctctctgttaaaatcactagtggggtttctgctttctgattgtaccctggcatatatgatatcctctgtgggttgcttggttcctctgtgtgtgtgtgtgtatgtgtgtgtgtgtgtgtgtgtgtgtgtgtgttatgtaatggttgggacagctgaataaggcattgaattaaaaacatacgagtttgcattctggctccttactttctagttgagaagtcttggccaaaatacttggcttctttgagactccaattttcttattagtgaaatgagattattaatgttgatcttgtagttgaatgaggtaatgtctaaaaagtgcctggcactgactgagttttcgagagatattggctattacgttatgtgtgtctgaaataaaactttggatctatatttcagtgagagggacctactggcttctttgggcaagtctggtctctatttcagcttccttggttcatttagggtgtttccttacccaagaagactacagctcttctattctacttggcatggattcagactgatttagaaatgaggtagggagagcaaagaatgtaaaaggagttggttttacgctgcccgataaatcacagtacaagcaatgtccttgttattcattggagattgccactgggccacctgacagacagtgtgtgcctct

SEQ ID NO: 22898 - DNA, 1170 bp, Mus musculus
ctgcaaatcaaagacccaggccaaattctctgagtcttcatgtcttagttctgccagggctgtccccagggtgctgtcctagaagggtttgtgctcacagggtaacctcatagagcacagctgtgcagtgacagctggcccctcgctggcccagaagttgtctcagggtcatgctttctctttccaccaacctctcgaagattcagatctatgcattttactgaggaaggagcccagggcctgggcactgacatcaaaaccaggggaattcaaggcaagagcgggatgctctattgtccctgccagatcaccccctgcattgtgtctttcaattggctttttcccttctgggcaggctgggtttgtgttacaaagactctgcctggtctattgtttgtgcagggatgctttcccagagcagggtgggcgtttgatggatttattcaataagagcgaggaaggacaaactggaaccaggaagccaccactcaactatttgtggactttggaggaggtttgaagaattcacaactgaacagtttttacaaaggcattttgagcctttcactttctcgtgtgaacatttctgtagttgtcatcgtgacagaaagtgtagacttcagtgtagaagtctggttgccagctatgcccagagggattttgctgactaaatatactgttcactttaatattcatcttagacctctgctgtgttctcctaggaccctgaccacccaccagggttctttgaggactggatgtgttacattcttgaagtcattatggatcctccagatcacgagggcgatagataagtaaggtggctaactttctgtcttttctactgaggaacttgttggcgtctgacagagcatctcagatttcttacataaaatgtggaattgtcaatagtcagatgcatcagtggccaaggctatggtgtgcagtttctatcagcgtgtacaggacatcctgcctggttttggcctcaaggtaagttggcaatagtttggaagaaggtgctattccatagagctctgagacggtgtcattggtggtacaaaagaaaccacttcttgtagccgggcaatggtagctcacacctttagtcccagcacttgggaggcagagacaggcggatttctgagttcgaggccagcctggtctaca

SEQ ID NO: 22899 - DNA, 1157 bp, Mus musculus
agctaacatttctattctgccaaatggaaatccccattcagttgcaacagcagataaagattagctagcccttgttctctatttttacaaagaagaaaaaaaaaagcaatctaccatgtactcttggcagcctctgttctgcacccacggggtgtgtgatgtgcattcagtttaaggagggctccgatccacgatgctcctctgctgagaagaagagaaaggcatataataattcagatgaagaaagataaataacaaggggctgggcagtcctctgcctcgaaaggacattcaataagtgctgtgaaaatggccacttctgaaaggatggctcaagcccagcaggcagctgccccttgacctggatatgtatctgcagaacgccctgtgcttgaatacagacacagtggctttgtcacacagataacgtgcatcaagataaggagctaggcccctctctcatagctcaggattgccgcgctctcttctctgtgatggcgtgggcgttcgcctgtcagattctgtcactactttctgacacagctctggggctgtgtgtcagcatcacagtggacccagagcaccttggactgtggactttgacctgcctgtacccctaacccatgacctaccacctttttaggttataaatgactgattaatgaacaagtatttcagaacgagctaggaacaataacataaaatgaaaaagatagactcctcagtttctcagttattcatataaaactttctggtgagccctaacatggtcaacagtggagtaacgctgagaatcacagattctcagtgtgaagaaagaaaaatcactcttttctctacctcctcctcctcttcttcctcctccacatccttacttgtcacctttctatatactctttaaatcccaatgacatactgaataatgtattgaattctgtttatgctcaagacaggcattcacttagtactactgtggagcctcaaaggacattgaagtagaaaaaaaaatcccaaactataatatacatttgtttattaattaactctttgtaaatagctggcacataaatatccagcacacagatcttacacttacataaatacgatgaagtaggcagggcagggtttgtaccccccacatccaagccaagcagcct

SEQ ID NO: 22900 - DNA, 1150 bp, Mus musculus
atctggatcctgtcgctaaggagcccttttctaatggaagcctttctcctgtgcaaatggaccctatgtatctgggttgtaaattcctgatcttagtggaaatttatgcccttactgttacgtggcacctagcgatgccacagttggctcctgacttctttcataatgagcaaactttctataatagagtccttccctgtgaataaaattgccctgtgcttttgaaattgccttgtgtcccggagacccaagcatccccaggactcccctattttgctgccctttcttaaaactcagtggagcccttgttaggtcctaacaaccacacctgtgctctgcgtggagcaaggtaggcgcccccagtggctccccatgtgtccttcagcctggaacccccacatgtacttacaaagcacactgggggctctgtgccactctgtgtggctctggcttcctgctcaatgcagtgagaccttttaagcctgaggaaaggcttcagctactgggcagctgccaggcaaaagaaaggaatggggaaagttaaatggttgtctgaaatggagagccaaggatgcttgaattcagacaaggtctcagcctcactgcctgcatacagcccgcagaaccccaatgcttctcaacttcccagaacaccatcatcttcattatggcttactgtgatttgggggtacctcatagtgttaagcaaggctcagaagagaactgtcacatgagagagacttcacccacttccttagcaggctctgaggacactgagggaatatttatgtaataagatgcaaagttgctatggaaaatactatagcaacctaacacctcctggagccaggcaggggcttgtaacagcagtctaaatttacatctactggagtgtcattttatcgactcttagtatctccttctgacaggatgttaaaatatgttttcagctccagtttgggcaaaattaacacagaatgtctttggagtttaagggtagtcttcacaacttctggaaaaaactatcagaataactctggaaggggttagatgacagagtcttggtgagtttgtagattccctcaaattagtcactgatctcagcctttactctgtaagcagtaagtggaaaagcctgattgtgaaatgg

SEQ ID NO: 22901 - DNA, 1167 bp, Mus musculus
agtctataggctcattggagcatctgccccatttgaagtcacttttgagatgaagataaaggcacttgggagggagttctagaatttccccaagtcttcccaatagcccgtgaggctatatttggagggataactgaggctaaacctcacgattcttgatggtggtctcctctaagattttgagagtggtgtacaggaaagggcttcggacggagttcactagagctgactttttaaatcttacagaggaaactgaggcccagagatgcaaaggataggggccagcctagagagccagaaaccaaccactggacccaacccacagcctccacctcagagggccctgatggggagggaggaggcgggtccctgagagcgaagaagagtgggagggcgaaggaaaggaaggagggcagatgtgggagtgaaagaggcaccctcctggaggctgattggctctggaggccagctctctccacgaggtttataagagttagggctgcctggggtaccctgccatctctcccacgtcccggggagccactgccaggacctctgtgaaccggtcggggcgggggccgcctggccgggagtctgctcggcggtgggtggccgaggaagggagagaacgatcgcggagcagggcgcccgaactccgggcgccgcgccatgcgccgggccagccgagactacggcaagtacctgcgcagctcggaggagatgggcagcggccccggcgtcccacacgagggtccgctgcaccccgcgccttctgcaccggctccggcgccgccacccgccgcctcccgctccatgttcctggccctcctggggctgggactgggccaggtggtctgcagcatcgctctgttcctgtactttcgagcgcaggtgagtgattgacatccctgtccgagtctctgcggtgagttggggggtggggtgggggctgagtctggttctaggacttattctggaagggaaagagacccaaccccccacaaggaagggaagttgggggcctccagccaagctcatctcctatcagcgcagcgtgcagaagctgaactctgattctggctgaggatgggtttgaatttccccccattggccgctcccctcgtgtgcctcaagtgatcgcacgctttctccccaccgtgaattttt

SEQ ID NO: 22902 - DNA, 1160 bp, Mus musculus
acaatacgatacttatatatcatttgactgttttcagaaacaacaacaataatcttccttatttatttcaatattctcaaaagtttgcttcaaaggtccaatactcaagacagtatttttcatttgataaaatgctagtattagtagttgtgtcacatgcttagattcctcatccaatgaaatgtgcatatttaaagccaagtgctttcttactttaaacgtgttgctttgggtgttgctgaaaatagtatacagagttgagtacatactgaccttggtcacagcaacttttcttcagaggaaagcttaacagggagtgtactgggtaaaagatgggaccaggctgtctcatactgcagtgggaatgtgaaaattagcctctatcctggtggtgatctgatggttcaagaagagaccctggtgagttctgctgtgtagatttggacgtaggaaatgtttatgaaaccggtgtccttataccagttaactaggaaaagtaatcaccagggacagaggataatgactgacattccttgttgccctgaatgggctcgatctcctctgatctcggaagctaagcagggtcgggcctggttagcacttggatgggagaaacgttgaggcgggctagagtgcaattcccaacactggcccattgcttagtgtttctgagttccaagctcctcacttgtgcctgactcatttccttcttccggataacatgtctttctctcttgctttagaatcccccagtgctatttactaccttcaaaacttcttttgaccaagcacttgccatatacactaaaactagctgtactgtgcatggctttcccaaaagaatttttcactgaagacaatgattctcacccttcctaatgctgcaatcctttaacacagttcctcatggtatggggaccccaaccataaaattactttgttgttactttataactgtaactttgctactgttatgagtcataatgtaaatatctgatatgcaggatatctgatatctcccaagggggtcacgacccacagattaagaacagctggtctaagagagcaatgtttctctaagggtcctcttagcaccttgacaggatcacacctatctttatagtatccctgtggcatgggtttatttatttaatagttgc

SEQ ID NO: 22903 - DNA, 3071 bp, Mus musculus
gtgtgtgtgtgtgtgtgtgcgcgtgcgtgagaggataaactttaaccttcccactagtttattcttttactttagtgttttcttagttagaaaaccactattaacattaaataaaacgtctaaatattgtgcagtaagaattttgtcttttttatttattccacaaatgaaaattcaggttgtaaaataaattgaaattttaaaaattaatgtagaaatgcattcagaggagcctagtagtaattttctgtgttggatttttgaagaagaagaaaaaaaaaaaaccctcctcacttcaccaagagtaatttcttttagctaagtgtttctcaaccttcctaacactgcaaccctttaatacagttcctcatgttgtggtgacccccaaccatcacattattttgctgatatttcataactgtaattttgctactattacttggacatattggtgttttctgatgggggtcatgtagccccagaagaggttgcaacccacaggtcgagagctgccatttcagcacagaagcacctctcccccagtaaaatgtgtctggactgtttcataaagtctcttctcatgatcttttttggtctctacattccctactgtgttttttagagattgcaggctgctctgagtgaggtgaccaggctgtgtctctgtgtctgagatttgtgaagatgggagggtctcccctaaccgattctggaatctaaagcaggtcgtattgcttggggctggtgatttttcttcattacatttttcatttttcctcaagctctgacttttttagaagctacagtgagtagaagacacagcacctatcaggggacttaggttaatttgaattagtaattatggtgaagttatttttatagagatgtcagatttgctttgactccagaaacaatttaagtattttgaaactacattataaactgtagtttttcctcaattgaacatagagacacggggcctgccttaaacatacatttttaaaagtttcttcaagtattttccagagtggggaaatgcagggaataatacccatgtgcactctcctgcgcttgcacgaggaaccagcacactgcacgtatgtaatttgcatgatatgtattgcttagattaacagtaaaactgacttctaatttctttgaggtgcaaatgacaatgttggttttctaaagttgaaagtgcccaggcgtgtttcagctgctggtgtagttatttgaggcgagctttaactctgctcctggttcctttgcattctggtgaagccaagcagcgctcactcagtgttcttcattcagtgcaacagagacggagtggacctcacactgcgttggctctgtgcagggacacgggaaacagaagtttcggcagggtgcgcagcagtgtaggttgactttctgtaaagaaagcgtttgagtgtagagcagtgttgtgggccggacacaggggaaggaggcggctttaaagcactttgtctttggagcatctctattgagatgcgctccatcttatcacagatttcttgacatatttatattggaacttgtatactgtcatgcattttgctcctaatgaaatacaatttactcaaaactgttaaaaagttgtgatgtgcagtgagctgattcttgattcaccagttttaaaggtattctgtgatccacagacagacagacctttgccggaaaaaccaacaaacaaaaaccccacagaagaaatggcagtagagatgagctggctccttgtggtgtaaatctaacattataacagccttcagtgaactcatgtagtacctttgtactttcagaaatgcttcatttacccctaaagatatttaatgtgaattaattcagttcatactactatacctctgcttagcaaaggacttatagtgctggtaggaagctgtatactgagtgcactgtgtggaaagtgaagagttggcccatgtgacagctggcagctctgacagtggtggtgcatgctctccgtccttgtccagagcctcatggctacctgctgtccaccagtagtgtttctccacagctacttgcagcagcttctagtcagtgtattattttgtaatttttcaaagaaatctttacacagagtttaaagatgttgggtccacacacgggtagggaaaatgctctccatttaaaatcatgtctgccagtcagcagcacatgagaactgtgggagtgtctgttgggattggaagcggcgtactcaagtcaagtgcgcttggctcgtcagcacaagccctgtaggcaccccttgtttactgtgcgcctgctctgcacacacaggcgcggtgctgctcactcctgcctctctatttatttattttgaccatgtgtacattcctttcatagagttagaactgcggttctgcaggctcctattgcagtctgttgtatggtttggatactatttaatgccaggtttatatgttgctggatttgctgccttcagttacttgtgctgtgttccaagcaatctgcattcttgttcacttaatgaatattaagtagaagtaactttgaataattgtggccatttatttgagtttgctcatttagtgcactaaggtcttatactatataacagtaactcctctttttgctcttgagtaatttaatgttcatttaccaaacttggaatttcaagatgcactaaagttttatttagcggtggctcaaaaaatgtttcagaacttacttttgtaataatttgcagttaattgttcttttgtctttactcttgttcaagcctgtgatctttcctctcccagccaagaattattcaataaatttaaagaaatgtcaagccatggttttccttctttagcatcctgttcattctttgttgaactaaaacaaaggcattcaagactggtatgttggaagacataaaaggaactatgtgctgatatcatggattttgaggataagagaaattaggaatatttttagttgaatactggattctatcttttcagagatgcctttactgggtaatataggagacttaaaagctaggctgctcattttgg

SEQ ID NO: 22904 - DNA, 1231 bp, Mus musculus
tcaaaaccctcacttaaatgtaccaagtcaaagaaatgtgctgccagctttaagtcattccgatgaaagcatacagacgtgcacttttgcaagtgatatggcagctgatgtcattgcagaagccgagaagattgcaaacgctagaagctgtatgcttttcaggcatgagaggaacatttgtcatgttgaaggtggccgaggtaaagcagaagagaaactggatgtggaagatgttgcacatccaagagaagtcgatacttgtgttctttcattaccaagtggcatgccaggtctgacatacaagtatcccagttgtgaaagtgtgactgatgagtatgcagggcatgttattcaggtgctccaacagcaaggtggcagtggagagctaatcatggagcagtatgccagcagactggcctaccggtctgtcactgcagcagctcgggaagcagctaagacagtgaaaatgaagtgcggttcgaaactcttccctctgcacggctgtcatgggaaaacaaacaaggaactgttggtgttctcaagtaaagagcgtcaccaagaagtcgatagacaaagaaaaagaaatggcagccatctttgcaaataccagacatgtgaaaggacacaggatccgtgtagaaatgaactttctgaactgtacagtttttcagcctctcttgctagcagcataacaagagatgcaaagaaacagctcacagcacctaaagttgacttgccaaaatcctcaacagatggttgtttttttgaaaaatctgaatgtgttgacagcagtgagaatgttactggaccagaacgttcaaagtcttgtcaacctttgcaaagccatggattttgccagaatacaggctatctaagtggatatagttgtgcagagaatgctcaagctatagaacagtatgctagaaaagtagtgggtgacactttagagctaagtttaggacccacagtttttcataattcagagaccacagcatcagcagatagaattacttacgcagaaaaattgtcaccgcttataaatgaagcttgcagatactgtgaccttaaggaattccatggttgcaccagaaattctgctcagctcttttcaaagcagagtccgtgtgctagtgctaagccaagttcacgttcaaaacttagtagcattcgtcagaaatcaagaatttttcatcttgatgtacctcagattcatgttaatcttgataaaagg

SEQ ID NO: 22905 - DNA, 1168 bp, Mus musculus
ttaagaagagtttgcatggggcctggtatcgtaacttagttttctacctgtcacttccagagctgatcaatatgaactgttaataaaatgtgtatatgctaattatgtgaattactagttgaaatgcttattggtaaacttgtcttttgttttttttttctccctctcttcctttctattacttttgtttttctttctatgtttccttttttaattaatttttttctcttactttttcaggacctggggattccgaaagtgggtcatatgaagcgaattctccagggaattaaagagcttgaacggaaccctcccaacttggtctgaggggtggtcacactggtgctatttctgggaagagaagtcctcactcaccactcaatacagagtccttggaagccgctgcctgttgttgtgatttactgcacagataagcacctctgaagcacctctcccgactgatattttgctgtgggtgaaagttttgatttgaggtattagaaaataatttttgtgccaaaaaaaaggccattccacaaagccatgttctcattgtgcaaacctgacatgctaaaaaaaaatgctcacagtagtggaagaaggattagacatgattgccttgtctaaaaagtggacttgtttgcccatcatccagtgagggtctttagatctgggcccacaggaggttcctatgtgtgcctgcaactgtgttaacagtatgcagctggaacttcgcaggcttcccagtgaaggcattggctcctctctagaagtcactggttaggagataaagataggggttgtacttttaagtttttcaccctaagttctcagtatccactggtcaaaaaatacggtgaaaccaacccatagctcactatgactgatgcaaatctgatgcacgatgttccttgcctgagttgtctttctttttcttgcatgtcatgtatattattgtaatatttcaatagctttgatgtttattataatgaaatttaatttattaccacccaactacccaagcactttttggttggttaagggcactttggagtaaatattccatacctaagagtctgggaatgtttgtctgtgccatgatcaacaaatgatatacatcttatgcaaaccaaattctttgcctgttccaaactacaggtgtgcacat

SEQ ID NO: 22906 - DNA, 1195 bp, Mus musculus
tgtgcacatgtgctcatatgtgcacataatcgagctaagccaccaaaggtcataagtgagtacactcaggttacagagtagatcagtatgtaaaaactgcatatttatcattatatttctatataccgcaactgagcattctgtccatgcaattaagaaaaaagttccacttgaaattgcatcaccaataacaaaatactcaggaatgaatttaacccagaaagagaaatgctggaagctacaaattgtagaactgctaaatggtaagtgagaaaatatcacagatattccttttcatgtttttctctttattacaacatgcagacatttggaaatattaaaacacttcacgtttccaagcatcatcctctgagctttggctactgagtggtcactgaaaaccaggcgctgggagcaagctgtttgagaagggcaggttgagtggaccaggcctgagtctgcttcctcttaacatgtgatgctaatgtttctggcaggtttgagagcaggacttgctgcctccattgctgggagttctatcatcaacaaaatgttgctggcgaacatcgatcctttcggggcaacaccgtttattgacccagatctagactcactgtaaggaacacttttgtagctatttgacttctgtttttgtttgttggtttgtgtttctgttttgttcaaatcctaaaactttgcatgtgtcccaaagtgtatgagtctatctgcaaaaaaaggggtggtgtggatgctcagaaatggatcatggtctgtccctgagatgggtccctttctcacctgctcagcagccactccctggtgcagagatctgtgcctcgccctgaggggtgaccttagtgctggtttgtacttgtattcatgccatccccagcctttctctcttcagtctgctaaccctgccatctttcctcaccccattacacagtttccttatttctagcttctaacccacattgactgcatctcttttttagactccccaaaacacttttggaagcttgagatatatttactattgttttcattttaaaatttgcacacacacacacacacacacacacacacacacacgcatgtacataccatgacttgtatgtctggtatggtcagaggttgacttacaggagtcagttctttctgtcaaccatgtgtcctgggaattgaactctggtca

SEQ ID NO: 22907 - DNA, 1223 bp, Mus musculus
taaagtagtcagtgttagagtgttaatagttggttcacatcgagaaacaactaatgttctggctttttaagctcattttacaaaattgagaactatgcagagatgccaccaagccagagattgtgcaagactgattgttgaaatttataagttatgctatccacccagagttacagctgaatggtatctcaattctgttttcctgaatttaggggacacattagcagctgttccctgacacaagtctgtctcaatagatggtttctagagttgaatcatccctttttagtaaattgtgatgttgaattatcaagaagtgtggattatgaacttgagccagctcaggagtggagaatttctattttgtattagtagactttaggggctatttttatatcatccttaattattgttcaagaggaaaggtattagtgaaaagtaaaacattctcattaacttcaagtctctgcttgtataaataacatggaaatggtttcagttctaattagataggattccagttaattagcattctgacatatcttcctggtaacttacagcgctttgagctccaaggttctggacattccctgcttcctaaggagattgtaagagtggagaggatgactgacagccacggctcctatgcccacgtgacaatccgggtcgcaggaaaagaggtgaccattaaggtacttcatcatggtttattcatcctaaaatctgtcgcatgccggccactcctgtggcctaagttaggctcttgatcccctgctaagtcttgggctctgctgtacctccctagatccttcattttatggctacatctatgtggtaacccagagctgtgtgtgaaaaattctttccttcacaaatcaagtgttgattaacaaacatgttttgtgctatgagttctcactaaggaatagtgctttcaaatggacactcactgccaaagggaaaactggtttcctccaatggagtgtcactggtatatcagccacactcctgggcaggccccatgcccagaagtagtgggcaacagaaaacaaactccatgacatttgtttctttgtttttgtgagctcttttgtttgttttggcttttttttttgttttattgggtttttgttgttgttgttgatgatgacttttgtgttgttttgagagagaaagaacatgaagtaggatgggtagtgggtggggaggacctgggaagaatt

SEQ ID NO: 22908 - DNA, 1135 bp, Mus musculus
tctccaattcttatcagaatatatgtttaatgttctcctgaaattatatttgtcctcatttgtgatggcaaaaccaatctttgagcctacaaggctaatagccttggcagacttacacagacagtatgagacttcttgaaaaacagctaggctgtttcctcccagtgtgtcctctttgtagttgaaatgttatcagtaagcattggttgtacgaacaaaatgatcctgaaagcctctatctactgaattgccatgttctgtaagctgaactctaatgggtgttgttggaccttacattgcgtgtgttatctcagcagataggtgtatacgtgagttcatggccattcttgctcttttcctttgtggacctatattgggtctacaatataaactggagaacaacagtgttttttgtttactttttctttgcttaatttaaatcctgaagacctggaggttacagaggccaccttgtgttgtgtgttggccagactaggcttctctggatattagcaagatgttgctgagactaatgctatgtcctgtacaaaatgttcaggtgaagtagtcgccgggtctctgaagattggcgccgtcagtgtgccagtgcacaatgcccatgagaagatgaaagtgcctgacgttcttttctacgacaatgttcaggtgagaccattgcttcgtggtcttgagctaatcatgtcatagttgttaattctgatccaaatgatactgatgtgtaattgtagtcatgatttcctaagttgagttcaggtaaggtaaaatgaagtgctgaaatatttttattacagtgatataagacttaaaattccttctaatggtcaaaattagaggagttactgctatgggtttaatatgtgtgtgttatgtacacacatatgtatgactgtgctcgaggctagtaaagcattttattgaataaaaactaacagacctattggttatcgctttggtgtctagttaagtcctttctgtagctcacaggaggcaagcatcttatacatcctgtctttctctttcttccttgctgcatattccaagcttcccctttgttttccttttttctttggagagtggactgtggcagagattttgcctttaaaccttaccagta

SEQ ID NO: 22909 - DNA, 1221 bp, Mus musculus
gggaagagcagtcagtgctcttaaccactgagccatctctccagccccttcagtcagtttttataaaagcttttatttagttcattttatattagttttcttctcatgtaattttctctgttattctcttaatcttctttgctttgtttttctttttctctttttttttgtttcttcatcatcatcatctcaggcctgtggtgatgtttctttaatttctgattttaatactatctgtttttccctttagtcattccaggttaagttagtgattttgttgatctgatccaaaaccagcttacaattttttcctttttctgtatggatgtgttggagcatgcctacggttttatactaccgcctcagttcttcctgtccccatgtgtagtagaaaggccaggaagagagtaacctccttggctctccttagaccttaccatgtaatttagaaataggtgtccaaggaggctttccctccctccttcctgcctcggaggctgccgtaaactctggactcccttgcatctgcttcttttgagcattgcgttacagttgtgtgtgctgacattactccactctgccctgcttcacagtcttgtctgtctgtcctgtcctctctgtctctgtgtctgcctgtccttctctctctctctttctttctttctttctttctttctttctttctttctttctttctgttggccccactggctccggcttgcttgcttgtttatttatttatttattaattataagtacactgtagctatctttaggcaccccagaagctctcattacagatggttgtaagccatcatgtggttgctgggatttgaacctctggaagagcagtcagtgctcttaaccctgagagccatctctccaggccctcacagtattttcttgaagaaactttgtataaaattttgctaaattccattattggtcctattttttctttaataatttgtggtagattccttacgatgtctgtcatctacttttatatctggatttaagatctgttccttattgggaatggtggcccatgcctttaatcccagcacttgggagacaggcatgcagatttcagagttcagggccagcctggtctacagagtgagttccaggatagccagggctatacagagaaaccctgtctcgacgcacccccccccccaaaaaaaatctgaaatctgttcctcttcactttgccttata

SEQ ID NO: 22910 - DNA, 1295 bp, Mus musculus
ttttgagacaataagatgttgtttctactgtatggaatatatcttaaaatgataccccttttcctgaaaagacaaagttgattaggactggagatttggtttagaaagggtagcaatttgaaatagtaatgcaatatgcaaaattcatacagtccctgaaatccgattatttcaataatttgctgtgctaaaagtccatgattaatatatgcatagtgaactacataaattaattaaggtgtttagtggattttgttttgcagttaattagtatgtttatattttgatttctctagtttttgttaaattttgcctagagctatgaggtcttgtttattactagaaaaactggactgagaattgttgtattttgaaggtaataacattttccttcagaataatgaaagatgacattttttaaagtaaatttttagttatcagttatagtttgttaaaactctagtatgctctccttcctttctgcaaagaaagaaacattaaggttactaagtagtgactccatactgataatgtgttcagtggacttacaaggtcacaggaaacttaaaaaatcaggattccactgtttccaaagaatttaaatttttactttaaaatttaaaaatatatattggtaaatatgacctgtttctcacccaccactttcttgaaaagaaaccactctagtaatgtcatcaattatttaagcacctttctaaccccccccccaaaatgtgagaggtaatttgctttataaattcacagttttgatcggtatatgttaaatgctttgttgactcagaagaacaacccttcactggacatgatttaaataatgtacatttttcttcattggtcatgcactgtcttaaaaagtttgcttccctaaaatattttggctatatagttttagtattcatcttagaggctttatcagcagaaagtgatttattcttcaatgttttgtgacgtaatattggttttgaaaatatgtataagctaaaggcagtattttattgagatcagtagctatagtgtttatcaactcaagttaagtgccagcaaagacctttaaaacttcaagctgtgtatagaactgtcctgtgtagtattgaaatattgtcagttttttaagttactagaaatgttcttgatttgcagcttgaacatatttttgtattaaaagttgactcttaaggaacttaagtggatggtgggtggtggcatttggggccagtagttaaagtatgtttcttcagttctttccttaatcagtggtatacatggccatttta

SEQ ID NO: 22911 - DNA, 1729 bp, Mus musculus
agaacaaatgagactcatcctagcacatgttcatctgaggcagagttgagtgttttgagactaacgtcagcattataaatgtagagccaggcagtacacacctaactcaggattggagggatggattcagaggcttgggagcttgaagtcatctacactaacatcagagagtatacggttagctaggactacatgaaacgctgtctttaaaacccaaaacagaagtagcttagtgttcccaggtgaccagcttctgatgtaccctcggttaccacttagaaggggcttgtggttcatatgcaagtaattaccgtactctgtcagctaacagctttctctctgctccagagaagaagttgatttggaacttccaagcactgaaggggaatgtctatcaacttcagaagctggcgttggggaaatcaaagtggtatttaaagagaaaacagtttcttctctgggagttgcagcagatggagtggccccagtcttcaaaaagagaagacttgaaaatggaaaatctcgaaacttaagacagcgaggtgacgacgagtgactgtgaagctatggatggaaggggtgtcctttccaagctgctctgtgctctgtgaagctgtggagaggaggtgtgtcctttccaagctcctgtgctttgaatactgtagtgctgcattttacatttatgctaaatatattttatgtgaatcaaaataaatcttttttcatgtgaaatttatttttgttccttaagtggtagcctaccacattgcattgtaatacagtgtattatgttcaatgtctaaaattgctaattatataataatttaagatgctatgtatctgttatttaaaacatggggaagacctttgctctgttcttacttataaacatatttattctgcattgaaaatgcattatttccatatgctgaaattaacttgttacctgagaagtaagaaatcagacacagccccaagacaatgtggttttgacagtcctttctgaagcctggatgtagaaaactgcagatcggcttgtcttactccatttaggacggaagaccaggagaaggacgcacctgagcactgacgtgcagagtgacagctggaccaagggttgaaacctgtgcttgcctcagatcagctgatagctgtagtatcttacaaccattttaacatggggccaagccttggggggcttgagatagaggggcagcctctgccctaccattggttacgttctggcacagccctttcccagtccggcatccttttcatagccctggatccgttggaaggtttacctaagttaactgcaaaaggcttgaactgaaataggttgtgttgtccacttagatgttccccattttctggttccatttcttcaaatagaagtttcatattctatttgaagtacttccctttattacttttgaatatttttaatcatttttcttaagttgtacagtaccttttggtagcaaatgtctttttacaattgttagtgtacatgtaagaatagcttattaaaaaccataaagtaaatatcggggtctctttttcttctaatatgcatcaaagttaccttaacattgacaaaacagtatttgaagtattagtcttgacaatcactcaggctgaaactctgtattttgcggtattttaatttttgttttgttaagagttttgctgtgttgcccttgaagactaacctcaagtccagatcctc

SEQ ID NO: 22912 - DNA, 1160 bp, Mus musculus
tcagtaaaatgctctgagcatcatctaattgtatataatggtaactcctttctgttgctgaggttggattatgtgctagtgttttatcctccgattttgttaacgtgtgtgccttggcaccatcataaggaatttaagtgaattattttgtgaaacagggatggtctctgcaccttttagagaagttaacacagaggcttagagcttacatatgtaggcctagagtggacaactggttaatagtagagttgggactcacactgtggtcatccactctgaagtcagtgtcttaaccattagtctactgggcaaatggttaatgttagtttcttgattctttctgcatgctctgtgtgtgtgtgcctgtgccgtaaggtggagaggccagaggaatcaggcgctctctagccctttcaccttattcccctgaggcgaggtttctcgtgtgttttaggccagccccggagagtctcctatctcttccttgcagtgctggggccgtaggtgtgtgaggcccagtctcttttatgtctcggctgggtatctgaacgtgtcctcaggcttgatccataggctctcctccctcccgagccaccttcccttaaggtagcctgagatgtgggtagatctcccttactgttccctgctactctttgtaattcattatataagtttctttcttaaagagattaaaaaaaaaaaaaggcccaaagtttcccctatttttctgtctaattttatcgaggaacaaagacaacagttgcaggcaataattttcatgttgctgggttttagtcttaaggacccaaggcttctggaattgaggcttaaataaaaataaagctgtaattcttaattagcataagatgcatctctatgagaattcaggtcatgataccattattccttaacctcctctaaacagaatctttgttttttagacaacaaataccaaacaaaattggcagtggttgaaattacttaaaataagaggtgcggcttctccgacactgccttaggtttaattaagataggtagttgtcttgttttttgtatttaaaagcatagaattttgccaggctattacagactcctaaagtcctagtactctgaagctgatgcagttcaggcctaggttacataatgaactggaaacttag

SEQ ID NO: 22913 - DNA, 1213 bp, Mus musculus
ggaactttgagaaattgctgcagagaattccctcatttagtttttatgagaagtatttgtaactgcagcaagattttggttctaccttctaaattctcgaataaagcatagattctcgagtttaccagcacacagatgtaactgtcaataagtaatctgagttggagaccaagagaatgccaggcctcctctgccaccattactgtggtttcagtacttaaatggagagagatgcccttagtttcagagtgtatagtatagcagagagaaggctgacattcaggaaaacttaggaatggctgaatgttgggctacagaatagttttaacaaaccaaaaaaaattaccccatgatgaattctttgcagtctataataatgcatattccactggcaactcacagatttgacatcattttatcagcctttgtatagcctagtggcgggtctgtgctctggtaggtgttactgataattttgtggcaagacactcccttgtatcctcagagctgatggtgaagtgaaggagaaacatgttggaaagcatttcagctgcagaaagtgtaggagagttcatatttacagtgggctggtcccagaccctttgctaatagcttgtggaagtgcactggagattaggagaggctggctccgaatgaatccctgatgcccgcctcaccttccagtgactgttacgtgctggataactggcattaccggttcacaccaccatgtttggcttaatctttttgttggtggtgtccatgctgaagttctaactgaccttttgcccacgtaaagctgcaaactactgtccttgttcttgagcactaaagggaaaggcaaggttgacttcttgctagagtggagttcaggaattctttcctttgggaaacaagatagtgggttgtggtctagatgttaaattatctcagtgtctttgatcctaaggggaagagaggcttgctacagaagcaataaaggcaggacacctccaccaatgtacaagaatttccagcccactcactttataattttcagcagttaagcctccccccacaagagatatccttattgtatgtgtatgtgtgtttgcatgagtgtatgtacaatatttgtgtgtgtatacacccagtgccgcagaagaggccgcaggatgctctggaaatggagttgcagactctgtgagcctcctccatgtgggtgctgataacc

SEQ ID NO: 22914 - DNA, 1137 bp, Mus musculus
taagcactcctgggatggaaggtgcaggtccctctcacatcctcttcaggtgaaagcagggcccagctgtcaactcagatggagctctgtgccgatgtgtcccttaaggctggtccccagccaggaggagacactgtttatatctcagaggggacaaaacaaagcaccaagtcctctggtgaggcttagctcctggtgctgtgtaaagtttttctgcttacgtcagactcagtaacttgggaaagctgagaatgaagggaattcattaatttggccaacatcttcagagaagctttgtaggatcccaggcgtgcccacacacatgcacgcctcagatacggatctcaacgaggttataactgagaaccagttccagtctccaatctaagtgggaccatagcatctgccaagattcccaggctgtgtgtgtgtattcaacgggagtgtttttttccttgtctgtatttgttgcatcttaacaaagttagatgctacaagtaaaatgaagggtatttcaagggctagcaagacggctcgggattaagatgcttgctgcctaccctgatgacttgagttcaagtcctagaaaaggtgaaaaggaccaactcctttaagttgccttctgacctccacacttgccgtggcacgtgtatatacaataataagtgtaaaattaaaacagagttcaaatatgcataccgttaatcacaattttaagtacttttattgttaatggaccaatagaaatgactttgaaaattgaaaaataaaataaaaaaagaaagggctgcatggatagagggacacttcctgagctccatacacagttggagtagccaacaagagccacatggcttaggtatcacccctcatcatcactcctcctgggtgtggtctctatcctccctgccattcctcaccttttcatcagttgtattttcctctgtgacccttatttctacctgaatttatattttcttcttattggaaaacaatgctaaagataaatccatggtagctgggactttatcttatgtttatctgtacacataagggaccaagtgactacgtggatggacaagtaatcctttatctcctagggcatcactgggatccgttttgctggaggagagaagt

SEQ ID NO: 22915 - DNA, 1228 bp, Mus musculus
attggttactctgtataagttgatggtaagggccttacttatgttactgaccaagaagaaatcaagctggtggccgactaaaagcttcacccctgctgactagtaagtattcttggtgatagaaggtactttgcacattactgaaggagaaacatctaactaaacctgtgacctacaatagtcaccttcttgcaagatatactgatatgatagtggcacaaatgttatggcagcaaccacttactttttgattggatttaaagcccactccatgagatggaactcccatgcgacactgctaaaatgtccaatagtctgacactaaataggttatgcaatctaagggaaaaccttatactactattctggtaaaggaacatagcaataaaaatatgtcattaagagttcgttctctttaagtgtgcacctacactcaacacagtattctatggaagataattcattgaggaggaaattgaaatatattgtaaagtggggttgaacagtaagtaggtttgcttaagttcacatacacttacttagcaaatttgttcctgttgcttcaaggaaggttctagaattactataaagactgtacttgccatacttgtggtggtttcacccatgtcctatcattgagagccttgggtttgagggagttggcctgataggaaggaaaggaggaagctgtggtgggtctcacctggttccatatgcagatgggtaggaaacctctgtaaaccaaacctaccacttacctctgcttcaacttcagccccaagaacatggcccagactggcccagaccagttcagcccagaccaggagtagctcagtgggggcagagagtggagaaggaaaggctgtgggggaaagtagatgcccagagctaccccgaaccttggtttttcaatatggattagaagaaatgtcaggtgacatttgatatttctaaacagccttcttacattttggtataaaagctgtgaacttcataactttgtaagtgagatataaagcaagtacaagaagaaaataaaatacttttactaagtgaaaaaaaaaagagtttgttctcagctgggttttgttttaagatccattcattctgtcttttgtgtggagaattgaggccattcatctttgaattattattgaaatgtgtgtgttagttttgatcaccatgttgttgatttttggtgttgtggtcttagtcgtcatttttgttt

SEQ ID NO: 22916 - DNA, 1692 bp, Mus musculus
cttggttttcacactgacaagtttcatgtttcttttttccttactgtagaaaatcagaaaatgcagttgacagaagggtcacgtccacaccacagtatcaattgcaactccaccaggactccagtcgccaaggagcttaattataatctagacactcatgcgtctacagggaggatcaaggcagttgagaaggaagcctgtaatgcagaaagcaacaaaaaaaaggaaatggaacttcttggctctgttgctaaaagcgaatcagttcctgaagttgaagccctgctggcaagattacgagctttataaatgaaactggttaaaaaaaaaaaatgattaagccaaacaccaagccatgctttcagctgtaacacttgaaaagttacttttatgtaagtgactttatatagttctaaattatgatatatattagaaaaagtaaagctaaatacatgattgcaatacttttcctgtatgcttgaagtttttgcattactcaagattgtaatgggctttaatgcttttatttttgtcttctggtattcctttattctgtatttgccaattaaattatacctgttgctttagagagcaaggaaacagccatgtgttcaactgtgtccttaagaaaatgaaatctttctaagtaatttttaccacttcaacattaatgaaagagcatcaggttgaagacttggtgtctgtccctacctacttcaaatttgctatctgaatagccccaaatgtttccaatacagagtcagaaatgtgtgtgtgtgcaagccacaatgaccagtattggctcacattaactaacactggaagacacacttccaaaaacgatgcagtaggaatgtttgcactttctttgcaaaacatacaggcattttgcaaagtaggaatatgtgtgtgtgtgtgtgtgtgtgtgtgtgtgtgtgtgtgtgtgtgtgtgtgtgtgtgtgtgtgcatatatatcatcacaacatcacagtactacctaggtcttagccaaggggacactttcaccctcagtactatggctttgacctaaaattaccatttggaaatttcccaaggaataaattttttatttttgacaaacttaggatttcatttttttttaagctgacaatcagtaactgtgacaacaatctgatgttttggggacagtttccatatgcaaatgtttcagttgtacctcacttggcaccattcctttgttatttccttatcaagaataaataaataaacttgctgcttgcactaaaagacgtatgtctcttctcttgctcatattctttggatgtgatggaggcagatgtagtctaagtatcctttttgccttattacttgtaatgagtgaatgctctttaactttcagttaaaggcagctatgtgcaactagtctgacaaggtcttctgcgttttatgcccttccttaagtcgccacctcctttcagctccaagttaataaaattaattagactatgaaccaagctctcttcatagtcatcaaagaagcatttatccacagtattgtgggaataactttggccctgtagtactacagtgagcattctagtctctacttgcaattcctgttttccataagacaaatcttaacaatgggggcaggggatgaagttatcacatttaagtaaataagccatggtgacaaagcataattgtttg

SEQ ID NO: 22917 - DNA, 1148 bp, Mus musculus
taccccccactgagaactatgtgaaggaacaaagcattcagtgtagaggagaatgcttctgtttctttgaagttctttaatctctttacagaaaagatatcatatgaaagggctttgtaactgaatactctattatcatcattgatttctaacctctcttctctattccattcactgggagctcttagcccaagtcttaaacacttttatttttaatgttggtatgcgctgcattgtccctaaggttaatttttttttattattccattgaattttgacaccatttgcttatttcttttaaccattgagtgagaagttaaaacttttaattggaaattaaagtatcataacaagaagaatctttaacataccagccctcttgtgggtgaagtgtgtctaggtcaggcatctgagccttggcgtggcgaggctggaggagggagactttggcaatggatccacatagaaagaaaggtgtgtgagtagaatgtgaaaatggctgggagacctcggctgcttttcaagacctagtggcttagtcatcttaagaaaataaaaccctggagtgggttaggaactagttggagcatgaagccaagaggggagaagggcaggactgtaagagccaatgcatggacctggccattgcctggggctgctgctagcctttccagaattgttagagtcaaaggaactgactccatccctcaagagcacagtcacgcaagtgaaaattatttggctcagtgatttcctgacttattataggtacatgtaggagaaagcatcagttaacatatgacagaactgcaaatgggagctcttggcaggacttagtacccagcttgctgcttagtgcaatgtaataaactttactttttatttaaaaaattataaatgtatatatgtgtgtgtgtgtgtgtgtgtgtgtgtgtgtgtgtgtattctaaaagtggaaatggctagttttgtaccaaatgttttctataaattttgttaaataagatgtgcaaatctatatatcaaatttacatacactcaagaataattctcatgtaatgtgaaattctaatttatctgatagaatagaaattacagtttgttaaatatagactctgtgttttcaagagttctgaccaagctaattg

SEQ ID NO: 22918 - DNA, 1161 bp, Mus musculus
gcttaaggaatgctatcctttaaattcttaaaatcatctctgagtttaccatcttacttgtaaaagataactttcatgaatcatatgaaagcttgtcagagggcaatatacatattttatctatcagcagaattatatatcaggggtgtgtgtgagtgtgtgtaattagaaatatattcattcatagagtcctgcatgaaaatggtaagttttcttttctatggtaagttttggcaggcccagcttctgtataataggcactgtaccatacacctggtcgcttttagaaactagttttatgctttaaaaaataactcatttctaggagaaaaaaatatgatttatgatgactgcagacactgaagtacattccatctaaactcaccgtgccattggtctatataagcaatgctccacactgcgtctgagaagccctgtcctctttagtgggcaggacacagacacactgttgagatggctctaattaaaaaatggctgatttaggacagagctggaattttttttgttgtttggaaattcctggtctagttctgatgttctgtccttctgctctctgccaccaccatcgcccgcatttgcatgtgtgctttgacattgctctggtaaccccgagggttgatggaattccctgcatctcttttcacagagggagatgagacaggagtgatggatagtctgctggaggccttgcagtcaggggctgccttccgcgacagaagaaaaaggacaccaaagctgaaaggtgaattcttttcttatctcatgttactttctagggaagagcggtttctccccttaattcttttaaagtcatttgtcacaagaacagtgctgtgggcagaaattgtttctaactttcctaaatttgcttaatcccttgcagagacaggtgtcagagagagatgcattccagttggctggtgtcagtagtgcattaacaaatcgatgtgcattgaagctagacaatcctgaccggtgtgatgagtctcatcaagagacccatatgcaccttgccccagtggaggttagcgtcccacagttaaatgtggggtaaaagtccaagcatcactgttccgagtgtttcagggcggtcaagcattgcaccatcactgaaaagacctaagcttgggaaaatcacag

SEQ ID NO: 22919 - DNA, 1132 bp, Mus musculus
cacacactctctaccacacacacacacactctctctcacacacacacacacaaactatctctctcacacactctcacacacacacactctctctctttctcacacacacactctctctctcacacacacacactctctcacacacacacactctctctcacacacacactctcacacacacacacacactctctctctcacacacacacactctctctctcacacacacactctctctctcacacacacacacacacactctctctctctctctcacacacacactcactctctctcacacacacacacacactctctctctctcacacacacacacactctctctcacacacacacatacacacacacacacacactctctaccacacacacacactctctctcacacacacactctctctcacacacacactctttctctcacacactcacatacacactctctaccacacacacacactctttctctctctctctctctctctctctctctctcacacacacacacacacacacacacacacacactatctctctcacacactctcacacacactctctctctctctctcacacacacacacacacacacactctctctctctctcacacacacactctctcacacacacacactctctctcacacacacactcactctctctctctctcacacacacactctctctctcacacacacatacacacacacacacacacacacacacacacacacacacacaaaactactccatttgaattatcagacactgaacaattaaagaattcatagtcctcaagtatgttggaaacactaaataacagatttttttgcatgtataatttgtctgaaaccttttacctaaaagatacaacaaaaggtcaaaagagacgggtgcagaagaatcttttctaagtgaggcattcaacaaactatgtaggactcagaagacattgcttctgagtttgtaaagacttgaaatgtgctaataattctgaggaaggagaaggaagagcaaaggagttttcactgaaaaggaagccacatcaggataaggaaagcattaaagataaaatcctgccattcagaccaggtgagtaaaaccagggc

SEQ ID NO: 22920 - DNA, 1213 bp, Mus musculus
gcaaacaaaccttttttagacctttctgaatatgttttaaacatgacctagtgcatttcggtattgagtaaagattatttagcgattctgtgactgctttgtcgtctgtttcctatgcatcccgttacatttcttaaaactttgttttttgttttaatgcttatttgattgcttaattaaacttcactgtttcattaaagctttcttttcattgcacatctgaatttttaattttgtttttgaaggatggctggattccttacagaaacaagcagagctcctctcttcctgccatcagtttcaagggacatattgcttcttccgtactgtcataccaataaatcatcccagattacttgccgaggtacagtgctgaagtataccatgcattttaaaggaaatctgctattttcttttcaatcagatgagcaatgtgaagagactccggccacggctcagtgctattctctttaagcttcaatttgaagagcaggtgaacaacatcaaacctgacatcatggctgtcagtactgcctgcgaggagatcaagaagagcaaaggctttagcaagttgctggaacttgtgttgctaatgggaaactacatgaatgctggctcccggaatgctcaaaccttcggatttgaccttagctctctctgtaaagtgagtttgtttttttaacacacatatttgcctgaacacttacttttaaatgtcagcctgattacattatttaaatatttttattttgatgggctcattatcaagaacttgaaatgaaccatgaactcaaacctagagcgaactgagctaatttactcaacctctgaactaaatccaaatattaattttctctgatctgcaaatccaactgaaggattttatttaataactaaattatatcctaaacctatgctttctcaaaccaatgaaatagaacatcaaaatattacttaagctttatatttatttagttcaggtaccatcatctagtttattgcttaggatggttaaattttttgcctgtaactatttaaagatttctctatgttgttttgcatatgcaggctaaaaaataaaaaatgaaatatgaaatatgaaagcaaaagtattaggaaaacacatatttcagacctcattgatgagttgaaactattatgaaaactgagtgaatttaaatagttctttattgttttctcctggtttctttca

SEQ ID NO: 22921 - DNA, 1187 bp, Mus musculus
gaagatttggacagtgcttgggcctgggttgatagttggctgttgaaatgtgttaggacttttttttttaaggattcaaagaccaatacttttcttttttgtcctcaaatattgcatccaaatttgaatctttaaagaaggcctcccttttttgagatgggatctggctttgttcttgagttgtcttagaacttctgggctcaagagatctttgtggttcagcctgttgagtaactgacactacaggcatgtccctctgggccaggctcccacctctctgttcctgcatcttgcaacttactgcatgtattagaaacactacatagaaaatccgcacaaagcatggaatcccttcattagaacaataatgcaatactatgtatgtgtttttgaaacactcacttttttacttgttgacacttttatttcttctcccaaacaattctgggaaagaaacaaggcatgttatctacactttatatataggcaaaagttatgctttgaagagaagttcatctgaaagaagcggggctggacggaatacagatctgagtgtgagaccacggcactctctgctctgccatgcggctcctctgattaaaagaaatcctattatgttttatttaaagtgttcttctttgatttaaaataattttcctctcatctcctgccaccttaccactgccccacagcggttcaccctcatcccacgatttatattaaaggctttaaaacttgccattttttattaagaccatctttcatcatttggcacctctattcacatctgtaagtatttgagctgtaaataccaaccaccatgctgtggtgtggacaggagacacaggggctctggagtccaccctccaagtgcataaccctggcttttacagctatggtgttttcctctatcaaatgggggacataatacctgtcttatgcggttattgtgaggatgatagcatgcatattgtaaagcaactttctcagtggccagctcattgtgttgctcagaaaagagcttacttttgacactgtaggcttcatttccactggtaaagttttgtttatcatctctgacttttcgaaaatgtaactttctttttgtcattaaagaagtaaaattgtctttcctttgaagattcatattttcttttcatccagtagaatacaatttttgtttagca

SEQ ID NO: 22922 - DNA, 1099 bp, Mus musculus
gagagagagagagagagaatttatatcagacttaagcagaaaaaaaaaaactgagtatataccacacatatcctcttggggctggattattttttagttgagcggaataagagaactaaccttgaactcattggtacagaagagaacttcctgaacagaacaccaatgactcaggctcagagatcaacaattgataaatgagacctcatgaagctgaaaatcttctgtaaggcaaaggaccctgccaatagggtaaaatggaagcctacagcttggaaaaagatctttaccaaccctacatctgacagagggctaatattcaaaatttataaagaactcaagaagttaaacacccagtaacccaattaaaaatggggtgcagagctaaacagataattcatagcagagggatctcaaatatccgagaaacatttaaatgttcaaagttcttattcagggaaatgcaaatcaaaacaactcttaagattccatctacaccagttagaatggctaagatcaaaaaactcaagtgatagcatatgctggtgaggctgtggagcaagtagaacacgcttcccttgctggtgggagtgcaaacttgtacaaccactctggaaatcaatttggtggtttctcagaaaactgtgactgactagttctacctcaaagttttcctactttagaagtctgtaagactaacatgttattgccttccatcttatactgttcactaacagtgggctcaccttggtcatcttgttgctgagacattcctataatgaaaggattctatgattgagatttaagatttgcttattctcctggtaccttaggaagtttgtttcatggacagttgatttatatgtagtattagagcttgagaaatttaatgactgtgtagtctagaaaagacatttctaggatttctagaaatagttgatttaaagaactgtgggtcctcagggagctgaaggggactaaagccccatagaaggaacatcaatatgaactaaccagtatccccagagctccttggaactataccaccaatcaaagaaaacacatggtggaacttgtggctatatgtatagcagaggat

SEQ ID NO: 22923 - DNA, 1099 bp, Mus musculus
tgagcttgctgtggctgaactgctgtcttctctctttcacttgatgctcttctagattttgtggagcttaatacatgtgacataatcactctacttctgacccattcttatacaattgttaaaatggtttattattcagttattcttacaaatctgacatttttaacttgggtccttgtgttattcccactgggtcacaaagttggtgtggcacatccaatttccaaataaagagcttataaattattaaagcaaaaacatgtatgtctaaaaggagacattgacaattttgcttcaagaggtaattaaaaaaaaccagttatttaatgtatatgagtacactatagctgttttcaggtacactggaagagggcatcaaatcccattatacatggctgtgaaccactgtgtggttgttgggagttgaactcacgacctctggaagagcagtcagaggcaatgttttaatgagcttaaacaacactcagtagactaccaatagactgttcgtggcatactcgactacatgtgctgttttaaactgcccaccttttctggctttattgtcacagctttatgaaaatactacacccattaattctcatccgattgatagtaaataaagtcctactgataaggggctagagaggagcatcagtgcctaagagtattgctgctcttccagaggtcctgtgagtttgttttcgagcactcacatactgtctaagaaccatttgaaattccagttacagaggacttggtgttctctttatggctccatgggctctaggcatacacattactatgcactgacatacatgaaggcaagataatccatccacataaaattagtatttcaaaatacagaattcataaaactccccccacgttaatgttgtatttaatgatgaaagcctgtatcttgccctcgtaagatggagagtacaggggggcctgcttgcgtttctcatcaccgcactgtaggttgtacccaggacacagaggcaagggcagcaaaggaaaagcacgctgattatgaatggaaaaatgaaagtctctgtttgctgaaggcaagagtgtttaaaaagagaatttcaaa

SEQ ID NO: 22924 - DNA, 1180 bp, Mus musculus
agcttaagacatttctctagtattctcttaaactttgtgtgtgtgtgtgttggccagtctcactgctaagaagcacagtagtgtgtcttgagactacactttgctagtgaattaagattgtcattaatttccagtgtcacttataaatgaagatcatatttatactatagaactttacctatctaagttaggattcacaataatcaattccatattgtgcattttcctatgggcagaacatcttcaaacccaatacaaatgtaagcattgaaaggaacattgtgtcttcccatagtgatctgttctctagggaatggtgaaaaggagtggaaatactgaccaaatgtcaaggaaagtagagttggcagacagaatctgtggtacttacttcactgaaaaacaaatgagcttgatagatgttgtgaaaaatggggattggatgaaaactatgacatggaggtgttttcgtttgctttgtttttctataataaaacaatgatcaaaagcaacttggggaagctttggttttcttcagcttacaaattacagcccatcttcagagggaggctaaggcgggaacctggaggcaggaactgaagcagagaccatgagggacgcttcttactgacttgctcttcctggctttgtctgcctgctttcttaggcagtccaggaccacgtgtggtattagagtccacagaggattgggtcttcctttatctgtcaccaataaagagaagcccacaggccaatctgataaagacactttctcaagcaagtttccaccttcgccaggtgtatcaagctgagaactgaggttaaccgtgacaggaggctaactaaggagtgaaaggcaggagagagtgcttttggctggatttataataggattagaaagaagtagcttataccctgattttcacgggatactttaacctaaggccagacgatgagaacataagttatttacacctcatcgctgtttatctgctaggcagtcagtaactcagtgctatttcttttggaagaaaaactcaagtgatgtttaatttttaaacatatctcttgttttggcaggctcatcttcagttgtagaaatcactatgagtagcatgcctttcctagcctggtataaataggctctgtattcagctgccgtggcgctgatattagtgggttt

SEQ ID NO: 22925 - DNA, 1161 bp, Mus musculus
tcatttaaggttgaaatttttcttctaatgctttgtgtagagctggatttgtagacagatttatttttatcgtgtattgattcccctttctcaatttttgtcattgaaaggttttttgaatatagctgtctggcctggcagctgtggtcttgtagcatatttagaacatctgcccaggatcttctgggttttagagatcccatcaaaaaatcaggtgttcctctttatacctttatatgtcactttgtcttttcccctttcacttcttaatattctttcatggttttcacatttaatgttttaattattatatgttatggtaaatttcttttctggtctagtctgtttgctattttgtattcttaagctctttgttaagcttgaaatttttcttctatcatattgttgaaaatattttctgtgtgtatgagctaagtgtcttcttgtatttctgttgttcttagatttggtcttaccatagtgtttcagatatcctggatgttttaagctggagtcttttaaatttatcattttctttaaatggggtatccatttcttcattatacttttgctgtttaagattctttcatcctgtgtattctgtgggtgaggtttgcctctgtggctcttgtttgtgttcctaaattttccatttccagttttctcccagattgggttttcttttgttggttcttttttcactttgaagtcttgaattgttttactcatttccttccacttttgtttgtttcttagacttctttaagggtctctgtcatattcataaagggtattttgaggtcatttcctcatgcctcagctatattgcaggtttcagggcccagtgttatggctttgctggcctccagtggagacatactagcctggccttcattaattatgtttatatgccagtgtctagccatctgggtatggggaggttgtaattctaggtactgatagctggtcttgtctcttttggtgggtgtcttgttctttggtttctgttgctctctctgtttcttagagtgtgttgcctggtaggaacaacttctgggatcctgataggtgtggactctgtgggtttggggtaaaattgttcctggttagtgagagctgacagtcaagaatgtggatggggactgagattccaaagcaggg

SEQ ID NO: 22926 - DNA, 1326 bp, Mus musculus
tcatttagaggggtgtggtcctgaagggctacagtactgtcacttttctgccttaagtgttttcataacccttactttgaattttatttgtttaagtgtggctgtatgatggctttatcagatgtcagagctggtttgctgattgtatttggagccacaatcctctgttgagtactcatttatgatttactttcacatattttaaagctggaatgagacacctaaactatttgtcagaagcaggataataaaatcagtgcatcttctgaaggttttgccattctttccctcctgtgtgcagagtttgcatagattaatatatactaattttcatgcagtttggactgtgggcctcactgttgaggaaaaggcagccattcttctgtctgcaagaatagttacttgagagaaacatctccttgaaatatagatgccaccagcttaacatttctcttctctccccatttaagcaatatctatgtgtgcataggtacatacataagaattcactgcagcaatacaatctatgcagatgtcagtacatgtgatgtagagtcaaggtagaattctcttagctctgagagtagttgtgttgcagtctaagagcacatttatttctgtaccttgggatcatctcaaggttaaattaatcaaaactctacaaaattataagcaaaacatctactgtaccaacaggaaggcagccttagttgaccgactcactgtacagatttaaagggctgcagaggtgcagagaactgctaagaggtcttagcatggttgttcacttacactgtggaatcttgaactttcagcttttgccttcttgcactacatatgtgtgtatttttatgtgaaatactatgtttatttgattaagatttatgtttgttattggcgcaagatgttggaagatcacctcttaagattttcaaaaataccagtgatgatttagcaaaggtatgtttttccagtaaagcgcagaacaatcaaaaatagcttgcatttaaaccaaaaaagcctttataaaaaccagttgcttgtactgcttctcagttatgtaaggatgaatcagcaagcaaacagcatgaaatattaagagacagaaagactgagttaatagtttggttgtatggaaaattaaaataaaaactaatgctttaaatctaagtgttaatgtttttctcatgaggtttaggggttaagttggtggccaaatatttatttatttccctttccaatctggatgtgcccaccattttatttctagaacatattcagggatgatattttagacactcaaaatacatgttctgattttgaatg

SEQ ID NO: 22927 - DNA, 1749 bp, Mus musculus
atttatcacgaaacgcgtgttcccaaggcggccgtgagcgcagcatctgattgcctcttgaaaattttttgccccttttacgaggggatttcctactttaatttttattttttaagcctcaagccaggacagctggagagtacaaactccaggagcgggccatattgtttttgagagccttttgtcttggggcttttgcagtcccgtgcaagtcgtccggcacacgggtcccggctcggagcctccctgctccagccttctccggtgtcgctggtgccacctgtgcgctgcggcgcgtgccatagctcctcggagccccttttgtcctgcagtaggccttgttagaagtcctcctggcggggctcggggtcgtggggggtggggagatgaatgctgcagccagcagctaccccatggcctccttatacgtgggcgatttgcactcggacgtcaccgaagccatgctgtatgaaaagtttagccctgcggggcctgtgctgtccatccgggtctgtcgcgatatgatcacccggcgctctctgggttatgcctacgtcaacttccagcagccagctgacgctgagagggccttggacaccatgaacttcgacgtgatgaagggaaagccgatccgcatcatgtggtcgcagagggatccctcgttgagaaaatctggggttgggaatgtcttcatcaagaacctggacaaatccatagacaacaaggcactgtatgacactttctctgcctttggaaacatcttgtcctgtaaggtggtctgtgatgagaacggctctaagggctatgcttttgttcacttcgagacccaagaggccgccgacaaggccatcgagaagatgaatggcatgcttctcaatgaccgtaaagtgttcgtgggtagattcaagtctcgcaaagagcgggaagcggagcttggagccaaggccaaggaattcaccaatgtttatatcaaaaactttggagaagaggtggatgatgggaatctgaaagagctcttcagccagtttggtaagaccctaagtgtcaaggtgatgagagactccagtgggaagtccaaaggctttggctttgtaagttacgagaaacacgaggatgccaataaggctgtggaagaaatgaatggaaaggaaatgagcgggaaagccatatttgtaggccgtgcacagaaaaaggtagaaaggcaggctgagctaaagcggaagtttgagcagctcaagcaggagaggattagccggtaccagggggtgaatctctacattaagaacttggatgacaccattgatgatgagaaattaaggaaagagttttctccctttggatcaatcaccagtgcgaaggtgatgctagaagatgggagaagcaaagggtttggctttgtctgtttctcctctcctgaagaggcgaccaaagctgtcaccgagatgaatggacgcattgtgggctccaagcctctgtacgtcgccctggcccagaggaaggaagagcggaaggctcacctgactaaccagtacatgcagcgtgtggcggggatgagagcactccctgccagtgccatcttaaatcagttccagcctgcagctggtggctattttgtgcctgcagttccgcaggctcagggaagacccccatattacacgcctaaccagttagcacagatgaggcctaatccacgctggcagcaaggcgggagacctcaaggcttccaaggaatgccaagtgccctgcggc

SEQ ID NO: 22928 - DNA, 1241 bp, Mus musculus
agaacttgaccaacagagactagggacttaactatgatggaaatgttagtatgtgtgtttggagcctcaacatattttaggagatttttgatatagatttattattaggcataaatttataatcacataaaaaagcctaaaacttctgtactgcatattaaaatagtcaactagtaaagataaaattttaagatttaatgctataaatagacaaaaatacttgagtatgaaattatttaacaatagtaggtgttagtatttgaaacataatgatttttttcctcaaataaatgtaggacacattaaaatatatctgggtctcattgaacgcggaggcagctgccgggcattcctggtctcgtcgtcagcgcagccgggcctacccacaagcaaccatgtctaagggacctgcagttggcattgatcttgggaccacctactcctgtgtgggtgtcttccatcatggaaaggtggaaattattgccaatgaccagggtaaccgcaccgcgccgagctacgttgctttcaccggcacagagagattaattcaggatgcggccaagaatcaggttgcaaagaaccccaccaacacagtttttgatgccaaacgtctggtcgggcgtaggtttgatgatgctgttgttcagtctgatatgaagcactggcccttcatggtggtgaatgatgcaggcaggcccaaggtccaagtggaatacaaaggggagacaacaagtttctacccagagaaagtgtcctccacggttctgacaaagatgaaggaaattgcagaagcgtacctcggaaagactgttatcaatgctgtggtcacagtgccggcttacttcaatgactctcagcgacaggcaacaaaagatgctggaactattgctggcctcaatgtacttcgaatcatcaatgaaccaactgctgctgctattgcttatggcttagataagaaggttggagctgaaaggaatgtgctcatttttgacttgggaggtggcacttttgatgtgtcaatcctgactattgaggatggaagttttgaagtcaaatcaacagctggagacacccacttaggtggagaaagttttgacaaccgaatggtcaatcatttcattgctgagtttaagcgaaagcacaaggaagatgtcagtgagaacaagagagctgtccgccgtctccgcaccgcctgcgagccaagcgcaccctttcctccagcacccaggccagtattgaga

SEQ ID NO: 22929 - DNA, 1239 bp, Mus musculus
gaacaagaaatttaaatgagaatatctaaagttctttatctctttaattactaaatattttatattggccatgaaatggataaggttcttataactagaatgtgaaacaatgttgggctgaaacaaatttgattagttttaaataaatttatagacacattattaaaacaaagaggcgaacattgtaacttttcttctgctgaaccctacacaacatcgttgggcactatgtaaactaggcagtagaaggagtttcctagttagttttgccttgactccctattttgaatgcaaacaaaatggtgttttaggacataaggtgtagttttttcttaacttttaattgattctttgtgaatttcacatcatacacccaatcccactgattttgttgctttgcacacaccctacaccttataaataccttctcctttaagaatctgattgtagccgggtgtgatggcgcatgcctttaatcccagcactcgggaagcagaggcaggcagatctctgagttcgaggccagcctggtctaccaagtgagtcccaggacagccagggctacacagagaaaccctgtctcataaaatcaaaccaaaccaaaacaaacaaacaaaaaaagaatctcattgtagaaagctgtagtatttcgcagagtcttctacagtgtatcctttttccatatttctttacttgttcattgcaatgagtcattggtctggttctaggcctctggcatttgctacattgtcaattcaggatccttactcagattcctttaatatagcttgataattgccccgtatcaatcagatactgctgctttatatatgtaggaccagttccttcatgcactccaggagttcatctatggggtagatgttgggttgtgccaactcacacccccaaggcgagctcttgagcacttgatgctgttgatagctcattgatgctgttgcccgcatggggcacagtcagctcttacactatcatagcatcagggatggttcacccacttgttccactctcatgagatctgtaaccagcaagagacatggccgttctcttgcttccatgaccaggggccagctgtcccatctattgcatgttgcaagggccaagggtttagagggaaagactgagggcattgatctcttgtccacaccctctcatagcagaaatgtggcagggtcagctcttccatgctcttcagaacctgctcattagcaagttctgaaa

SEQ ID NO: 22930 - DNA, 1209 bp, Mus musculus
gggatctgcaaccctataggtggaacaacattatgaactaaccagtaccccggagctcttgactctagctgcatatgcatcaaaagatggcctagtcggccatcactggaaagagaggcccattggacacgcaaactttatatgccccagtacaggggaacgccagggccataaaaggggagtgggcgggtaggggagagggggtgggtggctatgggggacttttggtatagcattgcaaatgtaaatgagcgaaatacctaataaaaaatggaaaaaaaaaaaaaaggaaaaaaaaaaaaaaaaagaagtttcaaggatatgttacacagtcatatgcatgcatacagatctgcttataaaagtacacacacattcatacctactcacacacaatttctttaacacctaatagttttaattgttttcactaccaacatacttgggtattaagttaggtttggctatttaattgatattttcaccaaataatattcttaaatatcattcacacattaagactgaagagggtatactccggtttctcttcagagcgtataaatctttcaccttttactaaagatttccatggagaggaacaaccctgagtcttaaaccaattttttgaggcgttgtcttgacaaggctccacatattgtcattaaaagtagaaacactaaataaagctaatataagtctgttaaaaaaaagattgaagagggttgaatatagtaaatactttactactttgatttattttttaaaaaaccaagataaacaatttaaaaatgaaacttcatgaaaatgaagacttatgtaaggcaaaatgtactgtcaatcagcaaagtggcaacctaaagaatggaaaaaaattgccaatgccacctctgatagaggcctaatatcaaaaatatgtgaagaactcaataaaatagatgtcaacagacaaaacaatgcaattgaaaaatggtgtatgggtctaaacagagaactcatgatagaagaatgttaaatggatgagaaacacttaaacacatccttagccatcagggaaatacaattcaaaactagtttgagaccttacacctgttataattactaacatgaacaacacaagtaacagctaatgttgggatgtggaacaagaggaaaactcatcctttgcttgtaggagtgcaagtttgtgcagctgttatggaaatcaatatg

SEQ ID NO: 22931 - DNA, 1178 bp, Mus musculus
gaaggacaacatttaattggggctggcttacaggttcagtccattatcatcatggcaggatgctagcagcttccaggagcagacacagtgctgaaggaggagccaagagttctacatcttcgtccaaaggcagtcacataccacatacattgcgtatgagatatttaaattacaattcatagcagtagcaaaattacagttatggagtagaaatgaaagtgattttatggctgggagacacaaaaccatgaggaatcattaaaccattaaagggtagaagcattggctaaggaccactgtgctaaaagaaaatacaaaaaaaaaaaatcctcatagatccgggccttgctcagtcatcatcagagaaatctctgtctgtactaaactagatattatgcagagaataaaggatcttgggaagttcatctgtaaacaggatgttttcatcaaatctccctcctccctcaggacacagagagttctgcagaagggaaggtataaagtatggaagaggaaccagaggggattaagaacaacaagacatcaaggcctctggacacaaaatgggtagtgtacttatgaactcattaagactgtgagaagaggcacagggcttgcacctgtctgcagcagctgggttctgagaaaagtggaaacgtgcccctatccctaaaccagagagaagtggaaacttgcccctatccctaacctagaagctatatcaaatgatatcaacttgcaaatgaaaatttatttttctccaagggagactgactacagaaataatccacttttcaggtaggcagcatgttccgtagtagatgtatattacaaataaactccatggtgtccacataggttgtcttataattagagtcaatgaagttatcttggtcatacttatgggttctttgtatacatattaagagttccagtttggggttcttatggcattcctgtgtgtacaaacatgtaaatgtctgaggctgtatgtgcttgtttgtttgtttgtttgtttgtgttgttgcttttaaattggcttttacttaattatttgaacacattcttatttgttttgtattttaatttaatttattttaattattcctcagatgtctttttgatttctgcaagaaagagaagggtgtggagctggatggaaacaggtgtagaaaaac

SEQ ID NO: 22932 - DNA, 1190 bp, Mus musculus
tttgtgtgaccacgtacaattgaccaggacaggggtgttggaagatggttcaactgcatactcaagagctcaagggtgttgtgaagggaaacataaaatcaaacagtgaagtctgatactgtcagggtaataaagtcttactagggttgatggtgagacagctggcttaatggtaccatttttgagagagaggagggaaccaactcctgctgtccttatctgtggtatctggggttgaatctctcctccacccttccccttcctccctataaccctggaccattgtggtcccacatgagcccactttccagaggccacccaggcagacctatctctcacagtctaatcacttctgtgtgtcctcacttccatacctgtaccttagtgttttgttgctgttaagtttgctgagcttaaagaaaagattgatcggcgttctggtaagaagctggaagatggccccaaattcctgaagtctggtgatgctgccattgttgatatggttcctggcaagcccatgtgtgttgagagcttctctgactattctccacttggttgttttgctgtttgttacatgaggcagacagttgctgtgggtgtcatcagagctgtggacaagaaggctcctggagctggcaaagtcaccaagtcggcccagaaagctcagaaggctaaatgaatattacccctaacacctgccaccccagtcttaatcagtggtggaagaaaggtctcagaactgtttgtctcaattggccatttacgtttaatagtaaaagactggttaatgataacaatgcattgtaaaaccttcagaaggaaagaatgttttgtggaccattgtgtgtgtgtgtgtgtgtgtgtggcaggtttaagttattagttttcaaaatcagtactttttaatggaaaaaacttgaccaaaatctgtcacagaactttgagaccattaaaacaagtttaatgagggagagagagagagagagagagagagagagagagagagagagagagagagagagagagagagagaccatgacagtggcagctcttaaaaagaagactatttcattggggatagcgtatatcagaggtttagttcattattatcatgtcaccaaccatggtagcacatgggcagacatggttttagataggaagctgagagctctgcaataagattggcaggc

SEQ ID NO: 22933 - DNA, 1099 bp, Mus musculus
atattcccaatgggcttaggttttaaaaagtctcattcaactctccctcctccagcaactgagcacacgtggacagattcatgacaggcctacaacctgtgcatccatgagagtgggtgactgtcactttaagtcagagtttggaggtggcttctcatagaacaaacctgtagttaaagctgattgatgtagcctttgtgtgtgctaccaatgaaaccaaaatcaaatttgaaagtgcttttcagctatgaaagaaaaagcatagaaagcctgtgtattgctttgaacatactctcatgtgaacatactctcctgtgaatattcacacacaggtgtggatttgaggttgcttgttgaaacgcaacaacatacaagagagaaagaaaccctggagttggatggatggaaaggcagggtggatctaggagaagatgaggaataggaaatcatgaccagtatatattgtattcttaaaaaaggggatctagggctggtgagctggctcagtgggtaagagcacccgacggcttttccaaaggtccggagttcaaatccagcaaccacatggtggctcacaaccatccgtaacgagatctgactccctcttctggagtgtctgaagacagctacagtgtacttacatataaccaataaataaatctttaaaaaaaaaaaaaggagatctacttttaatagaataaataaataaataaataaataaataaataaataaataaataaataaaatgtaaataaagattttgggggtgactgtctctttcccccgtactacttaatataatacccactgcctagtctcctatttcaagctaacacagttttttttcaattttgtattagatattttcttcatttacatttcaaatgttatcccaaaagtcccctataccctccccctgccctgctcccctacccaaccactcccacttcgtggccctggaattcccctgtactggggcatataaagtttgcaataccaaggggcctctcttcccaatgatggccggcgaggccctcttctgctacatatgcagctagagacacaagctctgggggtactggttagttcatattgttg

SEQ ID NO: 22934 - DNA, 1173 bp, Mus musculus
tcttcttttcttttctttttttttcttttaagacaagcttttcctgtgtagcactggctttcctggaactcactctgtagaccaggtcagcctcaaactcaagagaactgcttgcctctgcctcctaagtgcaggggttaaaggtctgagccaccatacctagtttcagtgttgagttttatcacaggctttgatcagatctactgagaagatcatgtttttcactgatcctatttttgtgctatagtgcatcgattattttggatgttgaaccatacttgcagctcttgagtaaaacaaaacttgaccatgatatatgctcttttaaaaactatatttaaaaattatttttggttacggctctagcctctctctttctgagctgctagcgctcctgcgaacatggtgaacgtgcctaaaattcgccggacattctgcaagaaatgtgggaagcaccaaccccacaaggtgacacagtacaagaagggcaaggactctttgtatgcccagggaaagcagcgctatgacaggaaacagagtagctatggtgggcagactaagcctattttccgcaaaaaggctaaaactacaaagaagattgtgctgagactggagtgcgttgagcccaactgcagatctaagaggatgctggctattaagagatgcaagcattttgaattgggaggcgacaagaagagaaagggccaagtgatccagttctaagcagattttgttatgaagacaataaaatcttgacctttcaacccctttgattgcagttgttcgtttgggagggaatacattaaaagctttcagaaattacctgaaaaaaattatttttatttacatgtatgcctcatatgctcaggtgccaatggagtccagaaataggtgtcaggatccctggagctatagttttaggcattaagcagttgtaagccaagtaatgttggttctaggatcagatctgtgatcctctggaagagtagaaagagttttcaaccacagggtcccatgtgtggcattttgaatgtgttaatgaattcagttggaaaatatttcacagaagatgtttgtttatgctcaccaaatagtttaattttttattatattcttataagactttatattaggggataatatttggttcccgagtgagttttgaaacatttt

SEQ ID NO: 22935 - DNA, 1242 bp, Mus musculus
atctgataatacaacaaaaaataaaaatcattgtatttttccagtaaaaccaattgagttgtgatgtggaataactagctgtttgttaaatatggtataggtagatttacctccatggttgtcttaactatggtttcttaaaataatggatcttgctctcttgttttgtctaggctgctgaaaacacaagctgacttccagagaattcctgatgagatatgtcaagcttagcaagaaaatttgaagattccatcatagtcaagatataaaatgacaatgctgcatgctgagtagaaaatgttttcttttacaaagaattataaaaccatggctgagcatgtcagtgggaagtggcttgagcgagaatcagcacgtgtgtttacatcacgtcttgttgtaatggccccaactccagagtgttgccacacttatttatgtatatttatagctctgctagctgtgagtttctaaacagcatctacccgacatgcacagctgctgagcctgtttgaagttagtgggttgtatcagaggtgatgtgtagtagttatgacttgttgacattaccaatataaaccttaattttgaattgtttaagcataaaaactggctgtgtgttccattgagctgtaagttaatggaatttgagctgctgtttgtgaagttttctgtttcacatcttgtttttaaaaataggatccaaaacatctcaaatcatctccttaacagaatattttgttttttacccagtttttggcagttaaaggtgtaaagaagatcatttttatattgccgaaaacttagaacttttagaaacttggatttttaaaaaggaatgccagggcttgacttagcattatttgtagtttgaaccattaaaatctaataagaacagctgaaatgcatttctctgtaaatcttataaccacataaaggtccacaaaataatgtatgaagtgaaaacagcaaacatacaaaattcctttttaatgttattgcataaaaacaataagcttactagcgaatcttgagtggctattaagtcagtacataggtggtgtatttcaacagattaattcatgttttctaaagaagtaggatttccagttgttcaacaaaaactaatgaaatatgtaccagtattatttgcagaaaatgtttgtaatttttaccattaaagcttttaactcattaaaatgatggtcaaagataaatttgaaaagctggatggagttgcttctg

SEQ ID NO: 22936 - DNA, 1161 bp, Mus musculus
ggactcccagcaggcagcagcggcagcaatggcagaacaatagaacaatcagggaggcaggctccaccctaggtgatctccttagtggtaagcaaagtcaaggtctggctcagcctgcttcaggcttgtgcgggaggttacatgggacaatggctcagtgaagcctttgagatacaaacatggttttgatccccagcgttcaataggagtctgggttcagggatgtgtttcctagagctggggtgccagggtagagatagggttcctgggtcctgctggccagttagtgcagaccaatcaatcgacttaagacctggtcaagctaaggtggaaggtgactgtggaaggcacctggtgctgattgcagacacttgtgcactgcacagagaattacggaaccacagttatcactactagcactttagagacctctcttccctccatagtcactgttctcagcaccctagctttcccctccagcatcctgagttctaaagtagacattcaccagtctcactgactgaactaggagtctgaaattactttaactttagaaaagtttatgctttgtttaaatacaatcttctttttccactgggtttttcccccttttctgttacatctatcgtcttcatttatgttgaatgccactgtaatgtgttcctttcatgcaaatagatttccttccacaaatatacaacaatttaccctttctgtgctgagtagatactgagttgtgctactctgagccttatttagcattattgtagttcatagctcttcatgcttatatatgtgcagttgttctaggtatgtacccaggcataaaatgctgggctgttggttgtgtgttaatgatcattacagtgccgcgctttctttcccagagtagttgtcttgatttatatttcaccagcagcacatgatttgcctctgcttcatgttcgtcagtggtcagccatctctcattaaggagcatgtttgggacctctttgtgtaaattgcacttctgagaaccctaagagtgaatgcagttcatggggttcgcccagcctttttaaaaattcacttgctttctttgtcatctttttaaaaactcagtttatagctttcacagcaggatgaaaactgcaaagttagtaggaagcagtgaagtgaacc

SEQ ID NO: 22937 - DNA, 1227 bp, Mus musculus
atgaaatctccgcgtccatctcagtgcagccgcccgtagtctcaagaccaaagacgggtgctcagcgagttagtgtgatgctgatgggtgcctgcttcacgtactgtgcctacttccctcagtaatgtgaaaggctgcaaaggaaattggtgctaggaccagaaactccaagttgttaaattatgttttttttaaatcaataaatatttctatatttgcttcaagtggcttgtttaacaagtaaattatggcagacctcatggctttctcctgtcctacagggtcaatgaactgcttgttaagactttgaatggtagtcttgaatttatcagttctaggaacatgagaaaaatgtggaaacggaatgcactatgtatttttacatgaaactgtgtgaaagaagtcttgaaatataaaacttacagaggtaaaaggaagtaaaatggactccctaaaatttcatttctgtggggaaattacttggttcgtggtataagcgcgctagttaatactctgaacactataaatgtagaaaggtgctactgggcaccatccaaatgctgccatctgtaggggcgaacatgggctgccacgatagcatgtacctccattcctaggcttggtggggagatgaacagaacacagcagagtcagaatcactgggagaccggggaatttctgttgagaactatgaagaaacaattgggaaaatagctaaataaaatacatttaaaaacctgtctgtattagaaaagaggtggatataataatgtgtttgagaacaaagactgtatttttgtactttcttaaaaactacataactcaaaatgattcattagtcctagaaaataaagatttactaccgttatgtcgttttccttgttctgtatggtactccatccttggtatgtttattgctaacttacacacactgtgaccgtacctggtccaccaatactaaccatgttatgaaatatacaacactggaagttgactagccagtttgtttatctggaaatagctattatctatgatttctgagtcttaagaggagtagcctccctggctacctatcagttttctaaaatagtaactataacctaggctcaaatgacttgtctccatacttgatctaggctttatatgttaaacaggaatagcagtcctaaaagggctctttgagtcagatattctcatattgtagccttagctttcattcaactttta

SEQ ID NO: 22938 - DNA, 2215 bp, Mus musculus
tgccattttaatttgcctacttacattgtgttcatatattttgaaaagacttctctactttaccgtggtcctccgttgtgagtgttgcagggctataggaagacaaagcctggggtacccgcatctggtttggaaccctgagttttgttgttcagtcagcagccctagtcatggttgccaatagttttcccaagcaaggcgtcaccgaggaggaagaaagggggtactctcatgtctgcttactcacaaaaacagatagtggcttaggaattgtggttatatccagttatacaggcgaggaggggctgtggtaaagacagattaaaaggaacaaatgaagtctcatttggtgtgccagattgcccctgtcttacaaatcccagactgattaattggtattggtatttaggagtattttatcaactttgcttcctccatttccagttaagtagttctacacaaatccccaggtatttgtagatatagctacaggttttacaaatacacaggcatttggtattgttgattttgtttttcagctttctgttactgtggaaaacatctatatgttaaggcagaactttttgttttttttttttaagaaaaaaacctgtatagccccggctgtcctggaatttactctgtagaccaggctgtccttgaactcagaaatctgcctgcctctgcctctcaagtgctgggattaaaagtgttgccaccactgcccggcaaggaagaactaagcaagtgtttggtccaattaaaatggatcagtgactgagactagagcgggaggctgcaaacctgttcgtaaaggtcacagcatttcagactgttggctgaattctagccatagcaccgctctgctgtaattgtagtttataagcatccagacaatatgtcaacaagtatggttatgttcttggaaaacaaaatcattcacccaaggaaacaagcttcaattttatgtataacagttctttgctgtggaatcgggcatatagcatacagcttagtggttaacttgcctagtgtgtagaagaccttggatttgatctattggaaaacacaagactgctctttaccaggtgctggaaaggtggctcagcagctaagaggcaagcactggctactcttccagaggatctcaggttgattcttggcactgacatgatggctgttaggcaactgtattctgcttccaggagtttcaataccatgtcgggccttcagcattcaagtagtacacagccatgaataaatacaggcaagataaaatttaaaatgttaaaatacatttgtagtagtacacctgcagtagaggccatcttggtaatagaaagccagtaagttatgtcttttatcttgctgtgtgtttgtgtatattagggcaacaaaaataatccaggctttaatctcagttaagcagattatgataaaaaacctatataccccaagcctcttccttgaggctgtaaaatgttttctctagtgctagttatgaaactaaacagatttcatggtcagcctctcagtgttcaggctgtgcatctccagatctgaaaggatgaagataacaagggctggagagatggctcagcggttaaggacactggctgctcttctgaacgaaggacctgagttcaaattccagcaaccacatggtagcacacaaccatttgtaatgagatctgatgccctcttctggtgtgtctgaagacagctacagtgtacttacatataataaatctttagaaaaaaagaaaaaaaccagcatctatgctgaatgtgttacaactcttattagtcagtattcacccaaataactactattttcattgtatttatattgtagaaattagaaggaatttgatgtatatggaaagcttgaatatcttacatgcaaagactgccacttagggacattagtatcagtgttgttgttattttaatctatgggtggtcctagaactggttcctcttagaattgaggatgactagactgctctaaaactaaaagagcagtcagataagaaaacacccttgaccttcacattctagggattgaaacaagactaaaagttgaatgaaagctaaggctacaatatgagaatatctgactcaaagagcccttttaggactgctattcctgtttaacatataaagcctagatcaagtatggagacaagtcatttgagcctaggttatagttact

SEQ ID NO: 22939 - DNA, 1138 bp, Mus musculus
atgtgggtcaaataaattttaataaaactttgaagctatcttaaagtatatgttgcattgaaggttaaggggaactaaacgtatgcattgaggtctaaaagtcaggccctcaaagacagttaaaagtcttgttttttcccctaaacacttttgatttactaaaggattttttgcttgcttattttatttgttttcatgtgaatgggcctttgtgcagggaggccagcaggtgctgtcagtcagtcctacagctgtgctaactgatgatcactgtgagccatcacgtggatgctgggagtgaacctggctcctctgctagagcaacagtgttcttgaccactccaccccaacacgctgttttaatatactgttagcgaacagtgtagcactgccgaggcgatacataaagggatggccgattgagtacaataaactatgacttagttgtaaagttgtaaagtgtgcctttctgatgacactttttgatttcagggacactttgtaaagaatttaggcgatgttggagagaaggagacagaaacggaagtgttgctgctcgagcacgatgttcctcatcagcccttttcccaggctgtgcttagcttcctgcccaggatgccctggagcattactgaggaggtcagtcagagcactctgcagtgacgttcacattgctagcttatcccacagtgtgtgttgctttgttgttaaattggtgattgaacctagggccttatgcaagtcagtcagacactcaaccactggagtaaatccttggccctattttacatcttggtttttcttttcagttgggttttttactatgttagccagtttgccctggatctttgtcctgccttagattcctgcatatctaggaaccagaccacgaagtagtttaatttctacatatgtctttaaataatgtagaaaccatggctgctgcttcacagttagttagttccagcattattagctgtttactgttctaaaggtagtggagcctgggagtatggagactaaaaatgaggcagactaaagtcctctgcaatagccaactttattcagagcatcagacaatttatactgagggttgaatataggtaatcaagtaaggggtacaattacatggacaagt

SEQ ID NO: 22940 - DNA, 1170 bp, Mus musculus
aaaacaccttgtccctacacacaagacgccccaggtttaacccaaaggcccaggtgtgttggagcacgcctgtaatccgggctctaaggaagtgcagatgagaagagatgctaagggtcatcctcagctagggttcaaggacagccagggctccaggatacttacttcaaaagagggggggggggagagggggggaggaggaggaggaggagaaagcatgcatgaatgaggccttttcttttggcctatagtttttagtgctgtatttcaggtaatcatagctcttcctggaagttatgtaagttttcagactttgctgcgttagcattctctttctccacctcttgctctccatccccaatgcctgcctggaaacacacacattcatgtgttcctgtgtttattactgagtcatttcaaaataggctgcatcgaatgcatttatctcttcagggtgtatttcgtaagaaaagaaatgttcttacagaactccaaaaacatattttaatacaagaacatttgatagcgatgtgcttacaacaatgcattatcccaataatgttctttcgtagtacctttcaatgatcttttaatcacacatagatcagaagatagcttctcgaattgttcctttcttcctccatgaaggttccttgcatgatgcttagtgtgcttacccgctgagtcactcactgacctcatgttactgtgtgtacggtataggctgcagcccaggaacttgtaattctcccctccctccttggcctgcttcaatctcaaacccttcttgatcttgattttttacctaacccattttgctttcatggcatttggttcattttcatttaatgttacaggtatttcatttaaaatacaggtaatttttaatattaaaggtattcaaaagacatgaaagaattatagatttctgttgggctcttctactcacctttaatgctgtaaggtacaatcagcaatggttaaaactcagtggtaccgtgtttcctagctgatttagctgcacagcaagcattttaatcagaatgcctatccgaaactttgcgtaggcacttgaggaacacaactggtaattcacaaatgctgtttcccatgctcaccttccatgtcactgattaagacaataaatctttattgatacctaatactgtg

SEQ ID NO: 22941 - DNA, 1102 bp, Mus musculus
aaatatatgcaatcttataagataaatctctggatttttttccatcctgtagaactaaattcttaccatgaaatcccctttccttctcctccagccattggtaaccatcattctactctctgctcacaggaatttatctaatttagagttatctttctgtttattttactcagtgtagtgtcttcaagattcattcatgtatgttatatctctaaaaaaaaatagtttcacctgggtatggtggttcatggttgtaatttcagccctcgggaagcagaaatagagttatctgtttcacagttcaacagaaattcacaatatattgaaggaggagaattgacaggtataggaacagactggatgacagaccgcccccatgaggaaagataggaaatgtgggataatgcgttccagtctgttagaagtggaattttaagaactacagggagctgggagggtgctggaggctggctggtgactagcttgcttttatttttttattttttttttcgcccttttaagactggatctcttgggctggtgagatggctcagtgggtaagagcacccgactgttcttccgaaggtccgaagttcaaatcccagcaaccacatggtggctcacaaccacccgtaatgagatctgatgccctcttctggtgcgtctgaagacagctacagtgtacttacatataataaataaataaataaataaataaatctttaaaaaaaaaaaaaagactggatctctctttgtagattttgctggcctggaaatctgtgtagatcaccaagcctggaactcctagagatccacctgtctccgcctttcaattgctgggattaaagaaatgcaccactagccctgtctcaaaaaacaaacaaacagaaacaagatatggagaaaatgtatagaaaagatttcaagctgggcatggtggtgcatacctttgatcacagacaggactctggaggcacagtgaatctctgggagttcgaagccagcctggtctctaaagtgagtccaggacagccagggttctctttgacatggagaaaccctgtctcgaaaaacttggggggaaaaaagcttacaagaaata

SEQ ID NO: 22942 - DNA, 1175 bp, Mus musculus
tctggccctggggccttgccattggccacaacgctgccagtccggtgagctggccctgcctccccggagttgggtgaaatagaggcgggcgtcaagtgtcagtagtcgcggggcaggtacgcgctctcttaggttgctggtggagcttgggggtggcgggagcgggttccggcgagagggtgagcgagcgctggggcggggcgggagaaagtggctgcccgaggacctcggcggtgacgcgtggccgagcccaggagccccgatctccgtgcccgccttcgtgagcgtctggctgccggcccaggggtcccccgccgcggccccccgccgagtccgccgtcccgtgccagcccgagcgaggtgggatcgcgatcgctccgtgtcccgctcccgtaatccccagaccgtccatgcccacgcgggtgctgaccatgagcgcccgcctgggaccactgccccagccgccggccgcgcaggacgagcccgtgttcgcgcagctcaagccggtgctgggcgctgcgaacccggcccgcgacgcggcgctcttctccggagacgatctgaaacacgcgcaccaccacccgcctgcgccgccgccagccgctggcccgcgactgccctcggaggagctggtccaggtaagcagagcggccggcctcccttccccggctcgggcgtgtcccgccgctacgaggcgcgggcgacaggggccgctccagactgggacgcgcgggaacgggtgcccgggtggacagccccgccctgcgctcccagacggggcgccggggagtggatgggggagcagggcgggggcccacccggatctgtccagaggagctaaagagagccgcgcgctcgcgtgcaccttctctttgcttgcgtggggatgaaagcttgtgcccacgctcaacttggcttaaaatgcttcttgaccgctctctcccgatggccctggccttggaagtccacctgcctgcgtcctctggggtgaaatagaaatgcaaattggagtactggggtttcatatacccccgtggaggctcaccctagaatgtattgtagggccccgtttggaaaactagaatcttaaggttgtattggaacaccgcttttcccttaaaaagaaacacggacaaaaaaggccaggggtgttgtttttcttagtgtgcgcgtaa

SEQ ID NO: 22943 - DNA, 2595 bp, Mus musculus
tctggtttgtatggttggccttgagtagtggtgtggaaggccgggtggactgattcccaacataccatgtacattatcctcgccgctacttgtatatcatcctcgccgctacttggggggggagggatggggggcgcactgcacggttcaccatggggatggggtgtgggctgtgccgctggtcttgcagcagaccacctcaccctgtctcttccttgtcacaggcgagaagccctacaagtgcacctgggagggctgcgactggaggtttgcccggtcggatgagctgacccgccactacaggaagcacacgggcgccaagccgttccagtgcatggtgtgccaacgcagcttctcccgctccgaccacctcgcgctgcacatgaagcgccaccagaactgagcgagcgagcgctgcgcccacccgcctgacgccttgcagtccgctctgccatcctttaaaccgcagacctaacttcataaaaagaaaaaaaaaggaaaaaaaaaggaaaaaaaaaaaaagcaaaggaactggaaatgtatattttgtacatttgaggccacagggaatacattgtatcaataccaaagtgtttggtcattttgagaagctggaagcttgctctcatgctcaccactagctttatcccagcaaacttcctctccagacaggcagccgcatctcagcatggggaaccggtgggggtgcacggggtgcgtatgctgtttctataaagactgcacacacgcaatcgtgtgtgccattttttagggtaaacaaaccgattggcaggcacccaggcacattgtcaagattttacttgacgtggactcgttttttttctgaagatttgattatttccagagatgggaggtacacggttgtgtgtacctggcagttcacaaatagccattgaacaaaaattttgtttttgtttttgttttgttttgtttttatatgagttgcctatatttgctattccgaattttgtaaatatgcaaatcagctttatagatttatcacaagtttttaaggattgttgggggggggggaagaaatcgtacttttgaaaataattatgaatacatttccaattagaatttgtggtgagatacctctcagaaaaattaccaaatccatttctttggggaggggataatcattcaaatgagagtaaaatgcaaatttcactcactgattgaaatgagattttattttaaatatgagagttttttttatgtgaatttaaactgaaatgcttaaagatagctaccatacacagacgctaatggtctttaccataagttaaacagtatcttttttttttgttttgttttcttttttttttgttttttaagtggaggaggactgttgtggctgtgttccttgttgaacttaagactctgttttcactcgtggaagcattgaatttccaggatttctaggatgtttgctcatgcagtgctgttggcgaaatgacaatttatgcggatttttgcatgtactatccagtgagacagtaattttattgaaattacagtgccacgtagtaggtagcctgttgttaatactgactcgtctgcctttgatatcagtgatgtgttgaaaacttaaccaatatgcaacatggctatgaatgtgacatggatgctgttaaccaaaggacagaaaccacaagcaaaatgccaaaagcgatcttaattagaaatcttaattttgtttttaagatattgttttatcattatttattttgtggtaatatagtaaggttttttttcttttcttctttttttttttttaggaaacaactttcgtaacttgataaattatagttttgtttgttagaaaagttgcttctcaacgtgtaaataggcgacaaatggtgtaaatagttttgtaaggctccaagatgtttatacgtggacacacctacatcagaagcataactcggctgctgttctgccgcctcctcccttatttttgtattgtggtaatttcctatgcaaatatcagagcaagcagctgtcgagctgtagaattttttgagagaatgagatgtttatatattaacttttttttttttgaaaataaaaagtgcctaaaagatgtatgtggtgccttcttgaccctccatccatatcacgagcatattatagtcctaaatcaagtttctttgcgtgggtagcatcaggagggtgaaccgggtgtggggttacaggctttgtaatcccagccacggaaaggctggatttaaggacgtggacaacactttgaatcataactcctggaggacacaaagctgaaatcgggctggctgtgtgtctctgttgggaagtggattgcccagcctgcacaccttacaagaagccggcagtggaggtgcgctgccgtagtcccggcccacacaggcaggaaggagtggagttcaagggttaccctattccacaaagtttgaggctcgtcttaactatgaaaatagaaacaagaggtgtatagagagggaattcacaaatgctgaggtttttgtgacctctggaactttttagcctggtcagctggaggcagcgacttgtattactctgggaaattgtcga

SEQ ID NO: 22944 - DNA, 1099 bp, Mus musculus
tcatgcttctctactaacattaagaattaatacttaattactgcttcacctctttaatttcaatatattattaatctgaggttttagttctagattcatgttacaatataatttcaaagacttctcatcttctgcgtcaactttcatgatgttgttaaaggcagcatttgaagtcagccgtaggactggctgtcaccaccagtcagaaatcattcatttatgcctttcttgcctctttattttaaccccttctattttatgtctcccttgaaaacctaaggcataccagggcatccaggtccccttgcttggccagctttgccttctatacccagaaaccacaagttatgagcaatggaaatcttctccctgtgtgctctgacattgagctgagtgacacttccacaagactgacatttgctcctctcactcagtagcccatccttatctgcagctctcatctgatctcaggccttgggccatgttatggaaggcagagtcactggggttctctggaagaaggttggtgaaccaacacttgacattacacacattgttctttgtatttgttagcgagacggggtatcattatatagcacaggctgacctcaaactcagctcctcatggttctactctctcagtactggaattattagcatgcacaaacatctgtacttttcttgttaaaactatgaaactggatcacccagagctcccagggactaaactgccaaccaaagagggactcatgactccagccacatatatagcagagtattgccttatctgacatcaatgggaggggaggcccttggtcctgtggaggcttgttgtgtagggggatgctggagcagtgaggcaggagtgggtgagtaaggggaggagcacccccatagagacaaaggggaggggggagaggaggggtgggatgagggcattgtggagggataaccgggaagggagttgatcatttgaaaatgtaaacaaataaaatgattaatgaaaaataacctatgaaactctcattcattgttgtttttatttcacattcttaagacaactattagttttaggttatatattaagccagcatctaca

SEQ ID NO: 22945 - DNA, 1115 bp, Mus musculus
caaacagacacgagtctctgttctgatcctggaacgtgtgaccttgagcccatcacctaagctctctgaaactgggttctgtcatctgcaaaatggaaataataccctataatactgagatggttcagtgaggcactggacacgtacgtacactgcatagtgtgtcacctggcatgtgactgtcatagggactgatgaaatctaaagccacatcatcaccactcataccactcaatgtaatagtaggttttagctgggtactgtagaggctgcaatggtccagtttccacgtgtgccgcaggcagctgtgaggaccatgtttctcagcttctgttttagggcttgagtatgggacagaagaaaggttaaaagtaccacagagccctgaagcagagcggaagttaagcctgttaggaaaagctactttctacgtcttttccttgttattcatctggtagacacttgggtttctttgtttaactctctgcttttcttgacttgttttctgattctgctcatgtcccgtgttttctttcccatttgaccattgcttgccaacataaacgaaggtattttcttgtactatgaccagtatcgaaacgaatacaagactcagtacagagaaacttaagtatttgttcaaggcagtggtatttctcacatgatatttgtactgttgtgttaaagcttatagattttcagtggaaactgggcatggctgtgagctctgacagctgcagatctctcaagtatccttacgtggcagtgatgctgaaggtggcagatcactctggccaagtaagcagcaagtccatcgagatgacaattccacaatttcaggtttgtcgttcaactcactgaatttaagtgttattgctggttcaaagctgtatacagtctctcttcttaagagaacatttatttacttgcaagttgatatattttacatgtagttattgctaaagttattttctctggaagcttaagtttttgtttttcaataagacatgccaatttgtgtatggtaccattttaattactctaacagtttttgatggttatatttaggaatatttcatcttctctacaagatatctactttgtaattaactttt

SEQ ID NO: 22946 - DNA, 1244 bp, Mus musculus
cagatggccctgagggtggaatgccctgagtggaattttgtgtatcagccaactgaattaattagcaagaggatgtaacagagcagaaatactggtgagtccatatgtaaccaaagggggaatgccatcaaaatcccaaatggaccaattgcatcccctcgagcctctatcaagacagttcaaggtatagtgaaggcatgctttagttggctgcagaaggtttctctcctacggctatcaagatactttcttaagttaccattgttgctgccgccgatgccgagtgtgactttaaatgccaaccttgcacagcacacgtgaaagcctccgttccgttcttgttccgcatctaggtcagtgagtgggaagcgtgtgtgctcctactgtaataacattctgggcaaaggagccgccatgatcatcgagaccctgggtctttcttatcatttacattgttttaaggtgagcctgagtcagagagcttgccgccgctgccaatgccgatgctaccaccaccgctgccgctggcctgccgcactttgcttggagagcgcatggcttctatgagccccgccccgggttgtggatgtgccactaacaagcttggtgctgttatctgtccgtctgtgccgtgctggtgttgcagattgcttgctaccgcttaattttccaacctggaatcttcttttatatgttagtctggaaggcctatgctttttgtagctcaatatgctagaattctataaataaaatttacagtgcacagtgtgttctctagcgtgctgccatgggtagacttaaaatttaatttaccagtgtttttagcaacatggagacatgcagttatcagtgtctcaaacgatagcttttaatagtgtctagaaggaaaaccactgtaaatatttttacaattgcatagcctgcctgcctattcctgatatttttgttttttgttttcctatatagtaaaaggttcaggctgtaattctttgttttatagtgtctaggcctataaacacacatcaggtttcatttttgagctttcattaggccagaagaaagtctccctatttttgatcctggaattccaaagttagcagcttgcttaagcatataaatttgtgctgtatccatgtagaatagactgagtcagaacagtgtttgaacacacccaacacagacacacacacacacacacagagggagagagaaaaagagagacagagacagagagacagagaaca

SEQ ID NO: 22947 - DNA, 1201 bp, Mus musculus
aacttctttcctggttgtccaggccttcctggaacgctgaccctgaaggtgggagaatgtctaggctgggcatggggtcttggcagtgtgtctgtgtgtgcacttttctctcttaaacccaaagccaaacataattgatttttggaaccactgctcacgccttttctctccttcagtacgagtaacagagagttgaaggttttgtttttgtgttcattcatactctgtgttttacaaataaagaattctagaccccagaggctgcaattgcctgcctttgtcctaagactaagcggcaggtaactcttcctacctcactgggccactctgagtgacgactgcttatgaactcccttgagctgacattcccgtttctgaatctgagtgcttttctctcttctctcctttgcctaatcagctggacggccaaccgccatgtgatgtaaacccccattcgaaagcgctgttgcagatagaagaggaggcgcttgtcactgatgcagagctataaaaaaaaaaatgctggatggttttttcccctcttttttttttttaaaggaataatcattgcctcgttaaatgacataggaacactgtggtgttggtaggacctgtatttttgttgtttatttataagaaggtaattatgtgtgtgtgtgtgggggggggaggagtgcagtattgaccttttaaattcagcatcctaaaagcacaagtggaaaagaaaactaaacaaagctcaagaacttaaaatccttctcatactcatatgattaatgatctcgtttgactctctagtggtttttcgaagaaggtattttattttaattttttaagttcttaaacattatttgaaatagttaatataaatgtgtaactgtgtttgtttattataatgtattctaagttaatgtggatccatatgaaaaatttcacttaaatccactcataaatttgcttcttttgtggttttctttacacggaaataatccaattgaaaaataattttgcctctctgtaatgttttattggtttgaggagggcactcaattttctttacaaggactgttgatgctaagcaaatgccaggagagggctgtttactttcagtaatgaaaaatatccatggcttgtataccagtgatttcctccagaaacacgtgagctcttctgttccgctgcctttgtaaataaacttggt

SEQ ID NO: 22948 - DNA, 1166 bp, Mus musculus
gagtggttagtagggacagtcagcccttacttaggtctaggactgtgggagggttggggagggaggaaagatgggaggaagggcgggagggaggagggggacatgctcatttattatttgaaagttggaagtttgtataatccatttgagtatgtgcgcatttaaaaaaatatgaaacagtacgtgtaaacttagattttatcaagattagtagaagacccatcttcagctggaagtctatcgagctattttgagtcctaaacttagttgctaatacttgtataacctaaccaaagagttacctagtagagtttttagtgatttgaacatttatttttcttgttgattctatttcctcacttatagcctatttacttaagcaaaataagtttgatttttaattacttagacttcagatctctttattattattattattattgttagcagtagtgtttttaaattgatgttttctgcaaggccagcaagtgtgggctgctgggctgttctgaaaaccggaacaatgctctttctttcctgcgtttgtttgacgttgcagtgacagattcgaaagatcaacggaagcacggggggggggggctgcccatctgtagatagctgtcaagtggaatgtttctaaatgaaggcaaataagtacttcagtgtgagccgagcaataacgcggtatttaggtgaatgcaacagaaacaggggacctttgccttattgcctttcctctcacgtggaatgaattcccagtgtgtatcctgtgtacaccacagcagagaggaggtatgcccgtatgcttccacaccacagcagagaggaggtatgcccgtatgcttccctctgagagacgtcctttggataatctgtgattacagagaagcctttgtgtatgtgtgtgtgtttgttttatcatcttactctgaaatatgtttttaaggatttttgtaagagccatttgaagtgtttaaattagagctattttttccttgtttttaaaaaacgaaccttgtaccgtgtatctcatcatatccgaggcagatgttatgaattgggacagttttattctcagactcctgtgatcaaatctgtacataccatatacaaacattttacacgaatcatttagttttttaattcatctactgatgctataaaat

SEQ ID NO: 22949 - DNA, 1486 bp, Mus musculus
cttgttttataactttgagtattggtttctaccaatgaaacccccctttgtcaaaataacatacgaagaaaccccgttacctacccgacatacaacatttaccgacttgtgacaacttccactctgctgctctccagacagcagcatccatgttcttccagggctgtgtctacagtggtgtctttattcaccttccctccctggggctcactgttggaagtgcagtatctggacatttcaagactcttgcagagtagcagaaaccgtaattgtactggccaaagtgaatgggttgtaatcgttatttgagaattactccatctcagctatggagagcctttgatcccaaggtagcatttttctcgggctactttttctgttacagtagtgctgtttcgtagtttaagggtttttttttggggggggggtcatctaaagaattgctgtttttatagttattaccgccttaggttccaggtctattttctattcacaaggttttaaaaccttgtttggactctgttactggaatagtgcctctagccatggcaaatacagaaaaatttttggctagctggctgttgtgacagaagcaatttaacatctctagatttatgtccttacctctaaagtgattcatctaccaggagtatgtagattgggggcacctatgtaggcacaggaaggcacacggagtgcatatacggtgtccactgggactaaaagaacacaaactgccatccttgaatttgcctgacgtacgtacaggccatccattcctgggtaattgctgagactttgagctggcacagtacacattgcttctttagtacaggccatggaagcttctggctccagacatggctaggtgaagtgtccttctgacttcctgtgcatgtcctctggtttctctcccaccatcatcagagagagcacactttcctggaaaggacagaagtttgtcaagggcctttgttagcttgctatgttgcttttaggggcattagacaggctatcaagctcctgtattttgatcagttgaactcattttgttttcctatctaacactagcataataatggaaaagtcttttaatatagaaacatgccagttattaatttcctaatttactaatagctggctgcttcttgagacatcagtacactactgtgtcttaagaagtctcatctacgtatctgctggcccagatgtcagggcttagcaagataaagtgacctggaattaggttctcactcaggatacactggaggctttccagcactcttcagattgtggcctttagaccggtatctgtgcaccaaatgttaccagtctgtgttattgttcagtctaataaaaaacataaacaaaacaaaaaaaataaactcaagaaaaaaaccagggcttgcatcttgtatctttgatcttatttgtccaggaatttactttttattgtttgaaagtataaaccccacaaagcaaaagc

SEQ ID NO: 22950 - DNA, 1215 bp, Mus musculus
atttcagacactatcctttagtctgtgttctagttgaacacgaattttttcttcatctgtgagtttagtgtaatttctttatgatatggcggctggtactcaaagcctgagcttgtagccaaccctgggctgcagagtgagttccagggaggaagaaaacagagtgatgctgtacattcctaggataaatcttactttgttatggcatatttttaaaatgacggttatgattttcttgagttataaatgagcaacaaggatatagaactgattttataagacaaatagacaaatagtatgaatgagtataacttctaattcattatcacaactgaatttttaaaattgcattatataatgtggctattttctaggacatgcacttgattaaacagttgaacagataaattttaaaataatttataaataattgggctttgttccccccccccccccccaggcattctgtgtgtggctgaccagtgtcatggcttacgagaactggccctgaactaccatttgctaagtgatgagttgttgctcgcactgtcttctgaaaagcatgttcgcttagaacatttgcgcattgatgttgtcagtgagaacccgggacagacacacttccacactatccagaagagcagctgggatgccttcatcaaacactcaccgaaagtcaacctagtgatgtatttttttttatacgaagaggaatttgacccattctttcgttatgaaatacctgctacgcatctttactttgggagatcagtcagcaaagatgtgcttggccgtgtgggcatgacctgcccgagactagtggaactggtagtgtgtgccaatgggttgcggcctcttgatgaagagttaattcgcattgcggaacgttgcaaaaatttgtcagctattgggctgggggaatgtgaagtctcatgtagtgcctttgttgagtttgtgaagatgtgtgggggccgcctgtctcagttatccattatggaagaagtgttaattcctgaccaaaagtatagtttggaacaaattcattgggaagtgtctaagcatcttggcagggtatggttcccagacatgatgcctacttggtaagggactgcatgacacaggacataatgagtgagtagtaccttcattcaagaaacgtattctaactaaaagtttatctgctctaaagctgatacaatgctactgttctgtggc

SEQ ID NO: 22951 - DNA, 1067 bp, Mus musculus
ctgccaaggaggaagaattcaggtttaaaattgtaacgtgctttatagtgataaaagagcctggtagagtaaaagaaataagtgatgtgtgagagaaagtgatgctgctgaggagaccacatgcccatgggaaaaacctgtctttagataagaaccgcattgctccttccactgtaacctgagagagaatgaaggaaagaaaattggttttccagtctgattattaatggagattataaccagttgtttctatttccacagaagggaaaagggaaatcatgatgagcttagagtgtgaaggagacgtaacggggctatagggaaagagtgaaactcaggtgtgtgtgagctgaggaacatgccgtgacagctacaaggttgcaggcagtgtgctgatgcagacacagtcactgaagtggtaaatgacggtaactgcataatcaaaagtaaactttttgctatccactttttaattcaggcccagtgaaaatatgcttattcgtgtcaataacgatgggacctactgtgcaaactggactccaggggctatcgggctctacactgttcatgtgaccattgatggcattgaaataggtaaatagagtgttaagtaagaagttgctgcaaagaactagaattaaaatcatccttgtattgtttacccttgtgacatacatataaataggtttcataacatctttgtggcttcattttctccttcatagtgagcaattcattaggacattgcatagatattatttgagtatgatttatgtgatcactcattggggctgtcatgagctcccccactttcctagtgtgtcagtgaggtatgattccctccttatctctgtgttatcctgtgtatgccacgcccccacccccacccaccctgccacagcaacctgtacctaccatcctcacctggtaggagcagacgccatctatttgacaggtgatctggtttagataggggtctggcagagagtggctacttagcacacattgctaactaaaagattttatttctcactagttttggaaaaaatactgatttttctataatg

SEQ ID NO: 22952 - DNA, 1194 bp, Mus musculus
aatttattagaaagtagccaagttgcagttacaattggtaagactctaaaggcattgcttggttgacttaatacatgaatacagtattaatttaaattctaatgccacataaaagtattttaaaattagactatatgaaggacttagaaagtatctattaaaaatctgtataattcttcatgtgagtatagaaacagaattttgttataatttctttcataattttatatatgatgctttattattttagatgattttattctgtaatgtagattgttgtgtccttttaataatgctttctattatttaagtttttactgcatataaaataattgaagtagtataggaagtgaggttcagctataaagttcacttgtttccttgccacgtcctaatcaagcataggcacacagccttcacaaagcgctctgctgtgatggatacaagggcaaaaacccaccgtcagttctagtctagaataaatacagattagctcagtcagtagactctcctaagtgcatcacaaacttatgcaactgttattggttggttgacacttgggttcttcttaggcttttgagaaatctgttgaaatgaacattgttaaacctacaactgtgcggagagcagctctagctttacccaggcattggatgcctgaggcacagagcatctactgtggaagagtcatgcttcccactagtgccccttttattagtttttcttttaatttttgcacaaggacagtttgatctcattgttaaacagcacaaaatacttttttgcataaatgtgctgtgtacgttgcagtttaatatcttaatgttcttccacttagggctttccatagtccttcaattgattttaattgcgtatgggttattttagatttttcctcaattaatgagataaaattaaataagtacctttgacctaaaatttcttttcaactttgaaggaattttccttaggataagtgagaactgcagggcatgtatccatgtaagcatttgtgcccgaggtgaacattgggatggcttcctcagggactttccagccttaacagttcttgagacagtgtctctcccctgaacatagagcttgcctttttatctcaaggcaagtagccacttccctctgcctcatccttggtcttgccatgcctgcttgttaatgtaggtgctgagattttaa

SEQ ID NO: 22953 - DNA, 1199 bp, Mus musculus
atgactgtatccttatttgtgcccagcttctcccaaaagaaaatagtttattttgataagagggaggctattaatttgagtagcatttaaaaatgatatgctcaagcatgttttcccctcatatttgaaatggaaaacttttctagtcctaaaattatgaaattttactttgctttaaactctcatctgtccttccctcaactgaaggcagagtatttcgtacaggtatttacagaatatttgctgagttataaagaaaagagttattacattgtactcattgtactagttttccattcctgtgtatttgtcgtcctgcccccagatttgattccagcacttagtggatgttggtgagacacagggaagcgtcagcagagcatcctcctctatgctttcttttgattctcagaatccaaaacctgctttgagtgtgatgatacttcagaacatactgtctggcacaagatttcctttaataagtcatttattttaactcagtttctatgaactgttattgaatctgaaaacaccaaaggagtcttttcttgtctgaagactgggttgttccagtggttagcacctgtgcccatgattatcccatttcatgaatgcgttgttggcatgggggttccctgctctttgagaggagcaaaagtaactggttaagctgtagcagcttatttttaaaagtgatgataaaacttgaactgaaaaaggtaaaacttgaactagaaaactactcttgtatgcaaagaatgtttatagtgaatgtgtttatgtgggttgtcaacacttctattatttatagttgaattatgttgtttattaaatatccatgtttattatttttatattttgaaatttaaaaataaaatagtcttaataaaaacagttgttaatgttttaaaattatggtatctcttataacagttatatttacatgcttaaggtttagattcaccatgcacacacagtggagacttctgacactgttagtgaagaaatagccaaatgtttcctctttcacgctctaccctcttcccacttgagttcttcaaggtcaaccatggttccaatgtattatcagcccagtgcctttgcccatgcatgtgcaaaccttagtctctccggcttctatacttctgattttctctttctttttgtctggtagccaaaaagttcttcctatgttgagt

SEQ ID NO: 22954 - DNA, 1188 bp, Mus musculus
gatcaaaattatattgattctgatttttttttctatttcctttaagttctactcagtcacactttcttctacaaagctgatacctgcaaacactttttccctcttgagtatgcattgtgattgtcttcatgaaaaacaagatgtgacaaactcatagtcgtatataagtgatctgtcttgatccacattgattatacatgcatggttaaaggaaaagcatgtatattaggtaattaatcatttaaataataatttggatagccaacaaggtatttttgtttggttgtgccccaccacatgcccactttttgtgtgtgtgtgttttttttttcttacaaattggcagagagccatgaagtattcataaatgtttaatcagactagttgatacttttttattttcaaaaaagactttacagtagtagtgttatagctgcttaatttagagccaaaggacattgtctgaagagaccatacctgccagtgactcttttgatttgttcatagatgaatgctacacactgtcaccttaactaatcttgccattgctttttactttgctcttgaattaaaaacaaagcaaaccaacgtagaatatgcccttgggaatcaaaggtcgtgttgatttctccttaagatcattgcccttttttttttttaattgttggtagattcagttggtcagttatatttaagtccctataaatcagctaattagagattctcttttaaattttttcttgaatagacttgtcatggagctacgtgtacataactgtacaaaatcatttttgtgtcattgaatggagcagtttacctctgcatgattgcattatggaagccttttatatatctttatatttttcaatatacttagattttacaatattggtcgctctagtcatgctatatttgttttttttaatagaatttataaatatttatgctcaaaatacagatcaactaaatatttttggtcttgtttacaagataatactttaaagtgatacaggcccctcaagtgtcttaggaaacagtcattggtgctataaaacctttcagtgtcattgagtctgttgtttagtctttgctaggctttaatctactatcgcttacactttagctagcagcagaattataaagaggtatttgttagcgctggggtaagagcgcaaccccattagagaa

SEQ ID NO: 22955 - DNA, 1112 bp, Mus musculus
tggtttgatgatagtttcaaaatttattataaatttccctagaaatgtaactgaaattaccaattctattcagttaagctcataaatgcttatcaatttctttagcctaaaattgcataataacttaagaatttcagtattttaagttgtgctttgaatgaatcagaagaccaaatctgactgtttggtcctctcgtgtgaggactgcatcctccaggattcactagattcacagttgtgctttataagcactaatctgcatttcgttatagatgttaggggtgtgtggctattgagttttaattcatgagtgtgtttctgaatactagtattttatgtacacatatttcttcatttaaaacataagataccttttaaaagtagatggtagttcttgtttttctaataagaaaacagactgttagaaatgaagtggtttacctaaagtcatagtgaccaagtggaagtactgtattcttagtataagcattgtgatttcagtaccaactttataaaagaaaaaaaaattgcagaactctgctgctgtgtccttcctaattattgatcaaccatgatattgtgataaccatggtagtctttacctcaaaatcctacaaagaattagcagactccttggtcttcaggcagttcatgtttacccttttaaaaagcactttgttcatatctctgttataatattcaatgttgtactataatttatctggtttatatgtctgtcttcccccactagattgcaagctcctccaggaaggggaccatgtcttattcatctttttatctctagtgcttatagtaaacctggctcatgtgagcacttagatgtttgttggatgaaataatgaatgaatggatatttacatttataataatgaggttgacaattacctcccttgttaattcttatcaattttctaaaaatctgatagtctcctcagtcactggggccattttataaaatgatagtgttatgtgtctcttcacaggggttacaggtagcgatggaggtagatacctagaatcaaatctgacatttttccagctcaggcctctagattgtgtaatattaagtaagtactatagtcatttccagg

SEQ ID NO: 22956 - DNA, 1224 bp, Mus musculus
tcgttcttggagaagatgatttgactgatcattgatctgcatatgctagagctctacctgtgtttcattagtattatctaatggactgttacatatttgtaaaaacaatttttggtaaaatatgatgacgatggatttcacaaatagataaaagaagaaaactaccttctgatcttgtattttgaagattgatgtttgcattttatttcagtaaacaattgctaaagacatctcaataggacatatgcaatgtttttattacatacttctattgaacattacagaattctttgggttatttgtaaattaatgaatagatttgaatacttatgacccaatacttgttataacatagaggattttgttttactccaaataaggaatgaatttgcatttaaaatcttaatgaatgttttcaaaatgagtagatgacatagtatgctaactaacgtctccaagttatgtattcataatactgcacagtagtatgcttaggctttactatgtattagccgtttgttggatttgtgtatgtattttatcacatgggtgttaatgataatggtgtatgactgctttacatatgagtcctatgcatctggatgctaaaaataaagtggaatggtctcttaaaagaaaaaagaaaagaaaaaaaaaagcaatgacaaaaaaaaattcatgacaatgttccttgatttaaaaaagaaaaaagaaaaaagaaaaagaaaaaaagaaaaaaaaagaaaaaaaagagaaaatgaaacagaccattccagatggtgatctgcttaccccctatcaaaaagagttataatcactaaataataatggttactggtacctttacaataatgtgcaatccaatgtttaaaatttataccacttcagtttggcttgatcatataaattttcaacagatgtcttaaaatttaaaagcaggctgattagtttggaaccagacttcaagtagcgctaacatttggtgaataagacaacttcatattacattttggatgtatgaaagaaaacttgaccatttgaagatgtatgaataaagaaatgtactatagatactactttaggaaaaccctgtttggtaagtgtcccagtctgatattttaagtgtgcatttacttttataaaaatctttcacatttgcaacaatactgtgattttttttttaaagtggattctctagcacgtgaatataattattgaaagtta

SEQ ID NO: 22957 - DNA, 1224 bp, Mus musculus; identical to SEQ ID NO: 22956

SEQ ID NO: 22958 - DNA, 1203 bp, Mus musculus
taccatctaagttacttttcaaagactctgcttacttaaatattcttgattaaatcgttctttagaaatcagtgattattgaaatatatttaggacccatgttaagaatttttcaaagagaatcaaagatctttaaggatttactataagagatatgtttaatactgaaatcatagttgcagtatggtttttagtattaaatgagatagtttagtaattggtgtattatataatgaggcatatttgccaaaagttttatgaattttgttattttacttactgagtatacatatttcagttttctttttgtgtatgttaagaatattagttgataatagcttatattattgagaatgaagagagttcttataaaatgtaaattataattttacccaatactaaatataatcttatttttgatatcatttgttagctcagagatagtttatatttccagagtcttttgcatttatttctaatgatatttacttacagaaaaggggttctgtatgagaggagacatgtgtccttttgatcatggaagcgacccagtagttgtagaagatgtgaatctgccaggcatgctgcctttcccagctcagccacctgttgttgaaggaccacctcctcccgggctgcctccacctcctccgatccttacaccgccacctgtgaatcttagaccccctgtgccacctcccggtccattaccacccagtctgccacctgtcacaggtcagaagatagatttgtttcccactattcattatttgttcacctaaagtctttttgttcatgctcatctttttatgcagtttgtaaagaaggccggtacatgcctggtagaaaccaagtgtacccccttttgcaatatcatgtatgacttcagcctttggtaaactagttactgtgctttgtaagagcctgtgaattatatacatcctgataatagcccctgcctttagtccttcctagttcatatcaaacctgttttgtaatacatttaaaagaagatttactataaaaaagctagcttacttgttaagaggttgttctttgtagaaaacattttagcttgataaaagaatatcaggtttgaatgtataataatttattttgtttgtttgctttcagatgatatttcttattctttggttttgacaggacctcctcctccacttcctcctttgcagccgtctggca

SEQ ID NO: 22959 - DNA, 1125 bp, Mus musculus
gaaaataatgaaaaacaaaattcctagaatactacccagtgtaattagcacctttcaaatcaactgtactaccatttcatgttcttttcaataacttaaaacatatatacttagtgtgtatgcgtttagtttttctttaattcaaacaaagcacattattgtagcaactattcagatgtctaacagttaactgctagtagcgtctacactgtatccctttctaatgtacattgttgttaaatttagctcctattcttgtttctttttttttttttttttttctcttttttttcctttggagacagggtttctctgtgtagccctggctgccctggaactcactttgtagaccaggctggcctggaactcagaaatccgcctgcctctgcctcccaagtgcagggattaaaggcgtgctccaccactgcccagtctcttgctttttaaatttaaatttaaatttgcatgtgttctttattattcttctagttgatgacttacaaaagcttaattatttaccatctttggtttttaatgttttttttttttatgtaaagtttttttttttttgcatagttttgacatgtaattaaaaaattcatactgtttgcggaaggactgtaagtacattatgtggagttaagcaaggctgctttgaaatggcaacagtagatctcagcgtggaaggatgaagaggagcttcctaggctttggagaacatattttatgaatgtcgagcagaggaagagaagactagcaatggttagtgatgccagaggcgctggagatcgcacaggactttgctgagtgaagttaatcatgttgtgtgttgttgaagctttttgtagaagctagcaaagggcttagggtagctgagttttgagagtgatggagaatgaggtaggataggaaagacaggttgcatttttagccctaaggacaaatatgtgggtctgtttactcagttataagttctgtagttgtagcagaattctgttctttttttttctttctttcacaaatcattaaacatttaggtattgaaattttctctcaatacttagaattgatgtcttttgatttttaacccgtttgcttagtcagtcttttgcatgcatttttggt

SEQ ID NO: 22960 - DNA, 1326 bp, Mus musculus
ttctccatcttttctccaacatgttgtctcttactttgtcctgtatttatttctgttatgcttttaggcccaggaaatcgactcttcatttattttatgactgtattaagtccctggctcttcccctatcatagtaaagaagactgtaaatgtattttttagaacaagtgtatactacatctgaagatttcagtataaagctcttggataaacttccctttggagaatcttccagtacaaatgtttataaaatcatggcgatgactgcccaataccacaggtgtagaagtaactgcaatatcatatgtgtttaataaaattttatttattttattttacaaactgtagatatttaaaggtgcttcaacatttctcggccaggctagttagcagtaacttagctgtgcatagaaatgactgcaagcgctctcggtcttagcgccatcttccttgagactcctgcgccatgagagcgaagtggcggaagaagagaatgcgcaggctgaagcgcaagagaagaaagatgaggcagaggtccaagtaagccagcctgtgcacctacgacgcctgcaggagcagaagtgagggatgctgagggccgggacaagctatcggactgtgtgctgccatcggtaatgagtctcagtagacctggaacatcacctcgccgcgatcgcctggagaaatgaccgcctttcttacaaccaaaacagtccctctgccctggacccccggcactctggactagctctgttctcttgtggccaagtgtagctcgtgtacaataaaccctcttgcagtcagctgaaaaaaaaaaaaaaaaaagaaatgactgcaagcatgcagacacactgtatcttgacgtccacaagagtctcaaatgtatttttgaatcataattggtggctcttttccactgtataatctatggtcaaccttggaatggctgttccctcaatatctaatgtaacattttggggatagatcaaataaagcaaagtcaaattgggagtatgtcatgatttataagaacataaagacagatcaaaaaattaaatcaatatatacataggagttcatttaaaatgtttgccggagctagagaaagtacccatggagctgaaggggtctgcaaccctataggtggaacaaaaatatgaactaaccagtacccccagagcttgtgtctctagctgcatatgtaacagaagatggcctagtcggccatcactgtgaagagaggccccttggtcttgcaaactttatatgccccagtacaggggaacgccagggccaagaagtgggaatggatgagtaggggagcag

SEQ ID NO: 22961 - DNA, 1148 bp, Mus musculus
gccctccccccccgtaccccccccccccatccccggccgggccccagaccctcctcccccgccgcctccaccccctccgcacccccacccccgcctcggcttcgccgccgcgcctccgcaacgcccagtctgcacgagcgagagctgcgcgccgcagcgccagcggaggagaggggccggcggagcgcgcagcgcccaggcccccgcgcgcgcccggcccggccctcggccccgcgcctgcctccacttgggagcagccccgggcccccgggtcttggcgagctggccttaggttctttgtaaggccgtgctcgcctcgctttctctcatcgaccaggaaaaaaagagactcgccaacgttgccgcttcggcctcttgttcattgagaaaaaaaaaaaaaggagagagagaaggggggaaaaaggaaatactccgcgtgcgcttctggaagggaggtcatctatcccggaatccgggagggttccaacggtggaggactgggttccaaaatttccccgtggttttaatccaccgattgcttggaagttggactgaagcagagtttggaaagaaggaaaaagtttgcatcaggactggatttatttgcacatcgctggaagaagaggattcaagggagaggggttggtgcaaagccgcgatcacggtgaggagcgtttggcttttccccttctggaaccatagccggccgggagtggggtccgggttcctctctccactaaaccagcttgcttctcgggagcattagggaactaccccgcggatctccttcgcctagaacaggggttcggccatggccgggctacagggtacgcctatgcagtatcccccgtcccacgacagctcactcgtaaggggtttggggcggaggaccgcttcactgcgttctactcctatccctgcattggcgacgattcagtcgccgagagctttaagggagggaaaacacaaagtgttttctaggtcgctgttgcaggctctggcattgctaacctgttcctccattcgtttgaaggctaagttgtagaagagccatcctgaggcggaggcgcctgtggggctgcggtactgggcttctcacctctccacctcaccgggccaggagacccggcaggcgagcggaggcgaga

SEQ ID NO: 22962 - DNA, 1172 bp, Mus musculus
gggccgggcagtggtggcacacacctttaatcccagcacttgggaggcagaggtaagcagattcctgagttcaaggccagcctggtctacagagtgagttccaggacagccagggctaaacagagaaaccctgtctcgaaattaattaattaattaattaatatagaaaataacctatgcagatgcaatagtatcagaaaaaggtgaaatgtttcaaagagagaaaaatattaaagattgtgggagcttcggttattaataaatatgttagccagctttgaggacagtttataaaagcttaactaggccatgttacaaaacaagacatttgaatcattttccacacccgtttgattgtttattcagtgacccaatactcattttgaagctgtagctttgataacagtatgaaagctttgatagagcatctgtctctgaaacatcagtagacaccggcctgaaaagtgggcatccttccaggacgcttccctctcatccttctacagaggaactctgtgaggcccattcttcccggagagatgcaacagatagatattaacccaaacggggagtgtacgacagaccaaagtaaggagggcacgaaagtccgcgttagtgaactgctgagttgtggctggggttgctcacaggaatatagatagtggttacatgcagaaacagggatgtctcaaaacagctggagaggaactaaagaaaacagatgtgatactgaaaattccaccatcaataggtcacaagtcatgaaagctgcagctttccaaaatgttctctgtacaccttggtggtatctctagtctcttctctggaactcagttggtaagagtgtctctttctctctctctctcttatttgatattttctttacatttcaacagttatcctctttccaggtctcccctccagaaacctcctatcctattcccccccccccatgagggtgtttccccagccaccaacccactcctgccttccagccctggcattcccctacactgggacatcaagctcccataggactaagggccactcctcccactggtgtccaacaaggccatcctatgccacataagcatctggagccatgggtccctccatgtgtattccatatgcctctgtatttgtcaggatctggcagagcctctcaggagaca

SEQ ID NO: 22963 - DNA, 1183 bp, Mus musculus
tcgatttcgttcataatggcggttaactccagtatttctctgtataattttttgtttgagtgacctgttaattcttaatagtggggatttcagttttagtaatgattttcctacaaatgcatatgctgttgcattttgtgaatagatgttaaaaatcacaatgctttcttggtggatttttcctttgatgagtttaaagtggtgtcttttctatctcttttgattaatcttggtagctatttcattagacattagatttagaaattagaataactacaccatcttatttcttaggtacatctacttggaatatctttttccaattctttactctgaagcaatgtctattgttgatgcttagatatgtttcttgtatgtagcagtaagatcttgactgttttcatttccattctgttagcctgtgccttttttagtggggaattgagtccattcatattgagagatattaatgaccatgaattgttaattcttgttattctgtagttgttgtcgttgttgtcgttgttgtcgttgttgttgttgttgttgttgttgttgttgtcgttgttgttgttgttgttgtcgttgttgttgttgttgttgttgttgttgtcgtcgttgttgtcgttgttgttgtcgttgttgttgttgttgttgttgttgttggtgatggatgaagtggtgtatggttgtgtttctcttcttttgttttactggtgtgaacttatgtcttgtgtctgtaactacttacatgggtattttgttccccattctaaggagggacgaagaatccacactttggtcttccaaaaactcacgtgatatgcactcactgataagtagatattagcccaggaacttagaatacccaagatacaatttgcaaaacacatgaaactaaagttagctttaaggtagatttttggaattttcagggcttactgtaataggataacgggtttcttgtggggacaaacttctctagctgttgttgactgtgttcttaacatgttgtttatgcatctcagtttgttatgactgattataagtcttggcatcactgagttttgttttatattgttttgttttgtcattgttgtttttgtatgggtgttttgttccttggcttctgttttctctctgtatttttagtcattgtggcctagactagccacatgacaca

SEQ ID NO: 22964 - DNA, 1193 bp, Mus musculus
tggagtctaccttcttgagttctttatatatattggatattagtcccctatcccatttgggataggtaaagatcctttcccaatctgttggtggtctttttggcttattgatggtgtcttttgccttgcagaagctttgcaactttatgaggtcccatttatctattcttaatcttacagcacaagccattgcttttctattcaggaattttccccctgtacccatatcttcttaaaagagtgacaaaatactcacaggaggaaatactaagacaaaatgtggagcagactgaaggaaaggctatccagagatggccccaactggggatccaacccataaatagtaaccaaagacagactctatgtgaattccaagaagtgcttactgacaggagccttatatagctatctcctgagaggctctgcaagagcctgacaagtacacagatggatgctcacagacaaccattggactgatcacagtgacccaatggaggagttagagaaaggactgaagggtctaccgccataccacccagaatgtacccgatctcgtctgatctcagaagctaagcagggttgggcctggttagtacttgaatgggagaaaggactggcacctgaaggggtttgcaaccccataggaagaaaaacaatgttaaccaaccagaaaccccagaactcccagggactaaaccaccaattaaagagtacccatggctccagctgcatatatggcagaggatgtcttggttagacatcagtgggaggagctgtccttaagtttgaggcagatacggggtgggggggggttgttatatgctccagcgtaggggaatgcccggttgggaatgtgggagtgggtggatgggtgggtaggtaggtgggtgagccccctcagagaagcacgaggagggggatgtgatagggggtttctgagaagggggaaagggaaaaacatttgaaatgtagataaagaaaatatctaataaaaaatattaatatgaggaattgttgcttgcccatgggctgggattcaaattgggccagttattggttggccagtcttttagtctctgaatttcttttagacaggacaaattttagatcaaatgttttatgggtgaatttgtgtccttttccctccattgggtatcttgcatggctacaagagatggcttcttaaggttcca

SEQ ID NO: 22965 - DNA, 1214 bp, Mus musculus
gcatgctcattagaaaataacatgaaacttcaaaccaaactgaataatcaattttggtaaagtctgaaggacatcaatattccactcgggcaggggaagaggtgctatatatgtgtatatgccctgctgaatttcagacaaaaactattgggaaggagagacttgctgattaccccccttaattttttttgtgtgatgctctgttatttccttctttcctctctcccttgcaggaggtaaaatgcacgtttgctgccccccagtaactttggaacaggaccttcacagaaaaatgcatagctggatgctgcagactctagcatttgctgtaacatctctcgtcctttcctgtgcagaaaccatcgattattatggggaaatctgtgacaatgcatgtccttgtgaggaaaaggacggcattttaactgtgagctgtgaaaaccggggcatcatcagtctctctgaaattagccctccccgtttcccaatctatcacctcttgttgtctggaaaccttctgagccgcctctatcccaatgagtttgttaattacacaggggcttcaattttacatctgggtagcaatgttatccaagacattgagactggggcttttcatgggctgaggggtttgaggcgactccatctaaacaataataaattggaacttctgcgagatgatacctttcttggcttggagaacttagaatacctgcaggtcgattacaattacatcagtgtcattgaacccaatgcttttgggaaactgcacatgctgcaggtgcttatcctcaatgacaatctcttgtcaggtttacccaacaatcttttccgttttgtgcccttaacgcacttggacttgagggggaacaggctgaaacttctgccctatgtggggctgttgcaacacatggataaagttgtggaattacagctggaggaaaacccctggaattgctcctgtgaactaatttctctcaaggattggttggacagcatctcctactcagcccttgtgggcgatgtggtctgtgagacccccttccgtctacacggcagggatttggacgaggtatccaagcaggaactttgtccaaggaaactcatttctgactacgagatgaggccacagactcctttaagcaccacggggtatctacataccaccccagcttctgtaaactctgtggccacttcttcctctgctgtttaca

SEQ ID NO: 22966 - DNA, 1290 bp, Mus musculus
ttggtctataaatgaaatggaataatgaatccagaactcacatcctacacattctatgaagttataaagtcaagaagaggaaaagcggctacaacgccgagcggaggaggtaggaacctgatttccagaagcagcttgtaggcaccatggccgggaccaccaccatcgaggcggtaaagcgcaagatccaggttctgcagcagcaagctgatgatgcagaggaaagggccgagcgcctccagcaggaagtggagggagaaaggcgggcccggaagcaggctgaagctgaggtggcctccttgaaccgcaggatccagctggttgaagaggagctggaccgtgcgcaggagcgccttgccactgctttgcagaagctggaggaagcagagaaggctgctgatgagagtgagagaggtatgaaggtgattgaaaatcgggctctaaaagatgaagaaaagatggaactccaggaaatccagctaaaggaagcaaagcacattgcagaagaggccgataggaagtatgaagaggtggctcgtaagttggtgattattgaaggagacttggaacgcacggaggaacgtgctgagctggcagagtcccgttgccgagagatggatgaacagatcagactgatggaccagaacctgaagtgtctgagtgctgctgaagaaaagtactctcaaaaagaagacaagtatgaagaagaaataaagattcttactgataaactcaaggaggcagagacccgtgctgagtttgctgaaagatcggtagccaagctggagaagaccattgatgacctggaagataaactgaagtgcaccaaagaggagcatctctgtacacaaaggatgctggaccagaccctgctggacctgaacgagatgtagacctcccccatccctgccccgcggccattcctccctctgaccttgactccgccagaggccagcctccctgaagctgaccttgaaactgagggctgatctttttaactgaaggctgctttccctcctgccacccccttttacccctcttgtctttttcacaaaactgtgtcagccttttcccagagttccagttggaggggctgaacacctttgggaacaatatttaagggaatgtgagcacaacgcagtgtcttcgatgcagttatgatacgcacattgtgattactttctgtcttagcaaccatttttaacattccaagcacttctgccgcttggagcagcacattttagcctaatggatactgtctcgccatggaggagaaacccaggattgggc

SEQ ID NO: 22967 - DNA, 1217 bp, Mus musculus
tccactcacaaacacctatgcggacaaatacagtccgtgtccagaacggaagctaattactatcttgtaccttccccggttggatggtgggcttgcaatacaggacttactccctgtgtatcaactaaggtttttaattcatctcatgatttttgtgtcatgatccagctgttaccccgcgtatattatcaccctgcatccagtttagaagaaagctatgctggccggcggtcaaaaagagaaccaattactttaaccctggctgcattcatgggaataggtatggcagtaggagtggggacgggagtgtcagctttgatagaaggaagacagggaattcagtctttgagggatgctgtcaatgaagacctagcggcaatagagaagtccattgacgctttagaaaaatctttgacctccctgtctgaggtagttttacagaacaggagaggtcttgatttgttgttcctaaaggaaggaggactgtgtgctgcccttaaagaagagtgctgcttctatgcagatcatacaggaatagttagagactctatgcagaaactgagagaaagattagagcgaaggaaacgggaacgggatgttcaacgggggtggtttgagtcgtggtttgaatcacgaccatcttggataacttctttaatttccgctgtagccggaccaatccttatgatatgcttagctttagttttcggcccttgtataataaatagaggaatggctttcatccagagtaaaattgatacagtaaaactcatggttcttcaaaggcaatatcaacctatagttcaggtagatgaagagttaggggacaccaatctctaaaattctatgattagaattagtctaaacagaagaagaggggaatgaaaggaaataaaactgtaattcatgtaatgtatgttaaatagcccaaagagttgtttctgagctttgaaacctggggctgagaacatagcagaacagaccaggacatgcccgggcaagcccatcgcctccctagctcccacccctctgacctaagttaaatgttacaggctgctgatgtttaaatggaccaatcatgtgaaaccgtgccaattcctcccccagccccactccttttctataaaaacccctagcttccaagcctcgtggtcgaatccactgtctcctgttatgtgagatacgtttcgacccggagctccgccattaaaaaacct

SEQ ID NO: 22968 - DNA, 1440 bp, Mus musculus
ctttggctttttcctttttgtctaattatttatttcaaatttagcaggaataaagtgaacctcaccttgggactgaagctgtgaccagtcagaataatgtcaaagtgcttacagtgcaggtagtgatgtgtgcatctactgcagtgagggcacttgtagcattatgctgacagctgcctcggtgggagccacagtgggcgctgcctcgggcggcactggctgcgtccagtcgtcggtcagtcggtcgcggggagggcctgctggtgctgcgtgctttttgttctaaggtgcatctagtgcagatagtgaagtagactagcatctactgccctaagtgctccttctggcataagaagttatgtcctcatccaatccaagtcaagcaagcatgtaggggtctctccatagttgtgtttgcagccctctgttagttttgcatagttgcactacaagaagaatgtagttgtgcaaatctatgcaaaactgatggtggcctgctatttacttcaagtgttgtttttttttaaactaattttgtatttttattgtgtcgatgtagagcctgcgtggtgtgtgtgatgtgacagcttctgtagcactaaagtgcttatagtgcaggtagtgtgtagccatctactgcattacgagcacttaaagtactgccagctgtagaactccagcctcgcctggccatcgcccagccaactgtcctgttattgagcactggtctatggttagttttgcaggtttgcatccagctgtataatattctgctgtgcaaatccatgcaaaactgactgtggtggtgaaaagtctgtagagaagtaagggaaaatcaaacccctttctacacaggttgggatttgtcgcaatgctgtgtttctctgtatggtattgcacttgtcccggcctgttgagtttggtggggattgtgaccagaagatgtgaaaatgacaatattgctgaagatgccgatttccactgtaaaaatgttcacgagctgatggagtgtatgaacacattctgtaaactgtgatttctattgctttcgttggtgtgtaaaacgggatttttttaattgaaatttgtgtttttaaattgtggtttgtttttactgaatcatttcattttcgtgtttgctcgctggatttagtaagaagttgtgtgtgggggcttaggtgaagttaaactgccttttgaacctggtatgacttcaggtttattttactctaaaacccattaacatgagttaagaaaaatgttactttctttggatctctgtttattaaagtgtgacaattcagatggagtgttttctgataagattattcctaatccgtgagttcttaacagttaacaggtggtggccactctgttaatgtgcacaccctgtaagaaagaactatccttggactgttcttaccatgtgaccccctcaag

SEQ ID NO: 22969 - DNA, 1440 bp, Mus musculus; identical to SEQ ID NO: 22968

SEQ ID NO: 22970 - DNA, 1440 bp, Mus musculus; identical to SEQ ID NO: 22968

SEQ ID NO: 22971 - DNA, 1440 bp, Mus musculus; identical to SEQ ID NO: 22968

SEQ ID NO: 22972 - DNA, 1440 bp, Mus musculus; identical to SEQ ID NO: 22968

SEQ ID NO: 22973 - DNA, 1440 bp, Mus musculus; identical to SEQ ID NO: 22968

SEQ ID NO: 22974 - DNA, 1440 bp, Mus musculus; identical to SEQ ID NO: 22968

SEQ ID NO: 22975 - DNA, 1123 bp, Mus musculus
atatagttgctataagctttcaggaatgggggtgggttactaatgtcttatgttatatgaaagtagttaaatttatcctatattaagaaggaagcattattgagactatatactgttgattttactaaaaactctaagatgtccattttaacaggcaaacctagcacagaaaaccagctggattttccctgtgcatggtttgaagagtcagtcctacataattgctgacacaatgcaacctgcaactgcccggagaaagaacagttcactaaaatttgttgtatttatcatccaattctgttctgtaactggtaacactagtttgtctggctttagagaataggtgaatctctaaaacagtagaaacagctcagttgggcaagggccgttctagtagcatgcctgctccttggagttttccagattattttgtatagcctattccagattcttgtctaagattgctttgctctgtgcactcagaattggtgtgcctttctatttgtgtaaatgatatataatacattgctagttgtctaggatctattcaggaagtgcgtgctgtgaattttaaagtatgggaagattgttaacaagggtttcaatgttttgtttttttttttctggtaagctaaaatagaacattgtgaggtacctggtttattgtggttacagacttggaataatgttcattgttttgtgctaataaattgtgttaaaatttggtgtacatatgagcatttttaaataaagttattttgtagcactgatgatcttgtatcttgttttttcctgtaagtggcccaaatatctttttcttgttgagggcatggggagaccagtcttagctttaaccatggagtttgtcttttgccttaatttacagggaagaggaaatcattgtgtgtcctgatttcaaacctcagaataaggaaaattagcagggtaccttttacaagttggtcagaaagcaacaaattgtgcttgtgtgtttgacttgggttcttaggattttgtaggaaagtctccaggatcaaatgctaagatgatggacgacacaaagcctatctgcccactcaggactagaacactgtatgtatgctgcagttaagacttggagact

SEQ ID NO: 22976 - DNA, 1914 bp, Mus musculus
tttgtcatccccccccttcctgtttttaaattatctctgggttttgagtcagtgaaatgattttgcttatcagtttagtggcgtgataaagcatatctgtgaatcaaagtgatcagaagtaaagtggatctccaagttgttgggcattcagcaccgccatgcagagggttttggctggcatttaacagcttttgtgcttgcctgggcttctaactgttcctcaatgagccctgtgatttcctggatggagacagacaggcataacctccaagaaagagaaaggcttgaaaatttactcatgttctgttttttgcctgcctctttcccacaggtatacttcagacggaattacccagatattacattcaccagccccgcggttatgaacacctccaatggacagccctcggccttaacaatatttgaaacagcattgtgaccaccaggacatcatcgtaaagtctgtcttgaaggtgttccccaccccgcccaggggcttgcacttggaggactacagcacacctggtttcctttctttctgccacagatccttcacagacgagagactgttgtctttggatttttccctccgactttactctgtgatttcaggttctaacaacatggcctgtcgttttattttaaaagttcctgctgttctttacaaatccagttctgaggtgcaggccaccaacagcagcgtctaccaggttttgtgccttaacagtctcaagggctgaagcccattcattttataagctgtcaccatgggctgctgcttcctcttgccttaaaagtacactctccaggtgtgtcagggactctgtttacttgaagactgtgtgcagttgccagttcgtctccctgctgtctttgagctaggactcataatttccctacaaaggtctctggttaaaatagaataggtagaattaacaagaaccacaacaacaacccccccaaaaaataatccatataatttaagtatattgctggagagagactatcccaccacctatacatctacaaagatatatgtctaaagttggaaaatcaacttctgctttctcagaatgggagaccgagcgcaggttaggcacccctcccccttgcatctgtgagtccctctgggcggctcgtgtactgatcggatctgtgagtccctctgggcggctcgtgtactgatcggatcggcaccatgacacttcccctagactgtgactcccaaatgcataatattaatctcatttggcttctggtttacagaaggtaaagctcctattggctgtgagccgttggtgaaatcctttcacatcgacaccaaaagctctccccagctagtgaaaacctgaacatcgttagagtcaccgactttacatgctcagaatgctgtgcacaagccacgctttctaaagcccatccagattagtttagctctgaccactaatggcaggtcttaaggaccttgtgattagtcaatcaacaaaccacaacacttcctaggacctgttgtactccgtgtaactataggtctgaatattttctgggtggtggtggcaagggtctatgtcagggttcaagttactaaaggttttactgtcataatttaaaggggactcttcacgacccgtcacaataaaccattctcaagttatctatgtgtgtgtgtatatatatctcaggtttttagactggttgacagaacaaagcctgttttaacagtggaaccttaaagagcacacctacaccaaaccaccaaaaccacgccgagcacagtgactgtttgactcttggtattcagaagtctgtaatgaatgtaattatgtttaggccagtaaatgatgtagattcgtcctttattggtagtcgcagttgatatttcaagagagtgagatgccatgctgacaatattaa

SEQ ID NO: 22977 - DNA, 1115 bp, Mus musculus
aggagaggctacagctagggcccagcttttgcttttccctttcctcccttcctcccttcctcccttcctccctccctccctccctccctccctccctccctccctccctcccttccttccttccttcctagaaaaaaatgtttcaccggtttctctttttaattctacaacacttcatcaggagagggaagattttcaaaactgactttgagctgcccagaaaataacaagatgaaatattatatcacacatgatgattttggtagaactgatagacgacgattgactaaagctgttcgtacctgatagtggaatgcaagcgagcaggaagacaaggcacctacagacaccgggcctcacgttagctataaaaatcagtcaatgatagcttgtaggggcttgccccagggcctctttatagcatcctggccactcagccgctcttttatagtgtgaagaaaaggccagacagatctctcagaggtgtggtgctgaaggctttttagtcagccccctgaggaaagtgtgatttcacttgaacgatagctggaacgtcacagattgtattggtcagtggcttttataatgatgtaggaagaaaataatgaggggttctgtgtctttataaatggcatcaggtcatttatagtaataataataatacaaactatatttgtattaagtagtgaatatacacattgaataagaaagggacccaaccacagaataattgatctgttgtactcagtctctctcattctctctctctacatacctgtcgccatctttatcttgattctctttctctggttctcccgctcacttttttgtgttcgcatgtacaacaaacctccacggttggctctgtcttatgccagactttgcctgtgatagttatcagcagccacaagtaggtatttctcatatgtggggtccctttagacctcattgttatcccctgattgggggatgttttgtgatttccctccaagattctataatttgtcagtttaatattcatataaagcgtgttgatttggatatcttccttcctagattcccaaatgaacattcagttttctttccttcatgtcttggcttgcatgtcacggtgt

SEQ ID NO: 22978 - DNA, 1168 bp, Mus musculus
agaggcctctggatgagggtggagatgccacaccgtttgaaggcatcaggctctttccttctgagcctgtgctctgtgtggtctcctctgtgttgaatgtcctctgccagttctaaagctcctgacatgctgtggctgtctgctgactcttttcccggcaggatgagcaagcctttctgctccacagcctttctgatcctgtctctttccacctctgccaactgtgtcctgtcagacgtaggtgatttcagtaccttgtgcccccctcaatataccagaatcatttttgggttttcttcagcagtcattcacaatgttccataatacgcagagttggcagaggtggctgactgttcattcggccttctatgtgtgtgctgcatgtaggacccacccatgctgcatgtaggacccacccatgctgtgggagcagaggaccgcctttgactctgggtccctgtctgtgcctgtgattgatacacaaaagttggctgccttccatgtggcttatctgtcacatctgtccccctcaggagtaaaactgcggctttcacggatgccaggatccggaccatgaatgaagtcataacaggcatgaggataataaagatgtatgcgtgggagaaatcgtttgctgacctcattgccaatctgagaaagtaagtcttggggtagactggactgtcttgtgcacttttctatttcctaattttaccgaatgaatttagagttctctttgatctccctggtaactcacctcagatatgatgtggtcacctgctgtggcagagtgttaagtataatgacctgggacatcccttttaacctgggcttctgtgtgccattattcccaggcaaaagctgcatttctcctcttcttgttcgtacctgtctgtctctgtctgtctcgatctcattctggttttgatggtgctggggactgaaccaagagattcacttgttctggacaagtatcacagcacacaccactgagccgcacgtccagccttcaggtgcactgccatagtcgaatggagttcaaaatgttcctgaatgcttcaccttccctataaataatgattccaagatgcaaaactctgagataattacattggtgaagctctacttgatgtcattgttcattgggaaggtggtatgaaccggttgc

SEQ ID NO: 22979 - DNA, 1348 bp, Mus musculus
attcagctggagagcagtccagccatcctcagggtttctttcgcctctgtctcctcagcaatgggattattggtacgtgatgctgtgtatgatgtgtgtgtgtgtgtgtgtgtgtgtgtgtgtgtgtggtcagaggacaactgggaggagttgtgcgtccctccaccacgtgagtccaagggattaaatccggttgtcaggcttgctggcaggtgtctttgcttgccgagccatcttgctggcacaggttggaccatctatgactaaccacacacctccgtgcggctttctcacctgtacaacctgccgttctctgagtcttgatctcagacccacagactggaagcccagcaacagggatctggctttacagctcgtgggctgcacagatgttttcttgtagcttaaaattcaaggtctgaatgttagagagtgtagcagcaaaggaggagggagatttcaaaccatgccttttctttctggtgctggcagcagaagtgctgagggggcagtgatggctggtgggcactgtgctgagccctgcagtctcatattggactgaggtgcatatggtgaagccctgatggaagaagccatccgagtggagatgctgacatcttcactgtcagaaggccatcagtgtcttgagaagttagtgggaagtcaagagttcccagagttgatcagaacttcacagggtcccgactcagactgcttcaagcctgtaagattggggttcctaggacactcacttctgacacagtgaatataaattcaggacctcctatgacccgcttgggcttaatagcaatgtctcacaggactcaggaaagtgctatacacagaactatgatttttctacagcatgtacatactggttgaaatcagtcaggatcccaaaagcacagctttctggtcctatcccatgagctgggatttgccactttctggacatgctaatggctggcacattgtcttataatgatacccagagtgttggcaaccgagaaagctcataaaagcctcacctgttgggcttgctttctgcaggtggcattgatgtgcgtgggtcatgagatccatctcagactttctgccctctaagccccagagtctaggcaaagtccatgcctgtcaatacatgattcgtccatccggggcagtttccatcgttggttttatgtagtataaactttccaggggacctaatgtgagtcaccttgttagcataaaccatcagaccctgtgacctgggaaattcccaagacttagaaaagctagggtcaaagtccagccaaagtcaccattgcatgagtcccctccctcccaccactgctatctagatcct

SEQ ID NO: 22980 - DNA, 1207 bp, Mus musculus
ccttcactctagccccacccacaccttcactctagccccacccccaccttcactctagccccacccccaccttcactctagccccacccccaccctcacatgtcactctctactccattcccacccctcaccacatcactttatagtccctccccctcaccacaacactctagccccatccccaccctcacacatcactttctggcctcatccccaccgtcatacatcactctctagccccaccccatgtatgtaaaggaagctgttgttatagatgggggggtgtatggacaagaatcttaataagaaaacctatatatgtatatagtcctacattcttttttcttaatattagaaacatggtaaagcatggtagtgcaatgtacttataaaagtacgtgatgtggatggagggcagactatggacataagcagaaattccgtctcttgctgtatcttcatcagcatcactcctttatataacagtaatgaaaatgacttccttcaaggtcttgtgaagattaaacacaatgtatccaaagatctgggatgtgattggttaaaacaagggatgcatgtctacggccacaccactctgaatctgcttgatcttgtctggatgctgattggtttgctcatagatcttctctctgaacgtatatgattacatttcctgtaaggatggtgttgctcagagctggagatgaggatcagtggatagagggattgcccagcatgcaggagtcgccagtgtcacaaaaatcctggcatgaggccaagactgcctccagaccccgtctcaaaaaatacaaaaagaaaataacattgatttgatatacaccgacagtaggtggatgtggatggattattttgcaaattttaaactaaaaaaggcaaaaagtgttgaactgccaacaaaaaaagaggttgatgccaagagctagagaagaaagataccaggaagcagatgggcagggccaaagagaggggccaaaggaagttaggagaaaggaggagacagagacacacacacagagacactgacagagacagagagattactcctgggcagcagtagctggatcaatagccaggtctgttctacagtctacaccctttattgagaaattgcctcctaccaagacagctccctgtaactcacgcactaactcattctatgcctactaagtgtaagaacaaacaccca

SEQ ID NO: 22981 - DNA, 1164 bp, Mus musculus
tcactggacacacttatacatttacatctgtgagtcacatggctggtgtttgaaaatggaggcccagggtagatggatagatagaaggatctggaagtcactggaggactgggctggctgaagtcatctagttagagatcagaagacccaaggtcaatactagccgcccccgcccctccccccataactttattcctcaagaagggcaggaagagagtggcaatgagggtgacttaggtaggcattgtcttgaacagcaagggggaaaaggttccggaaaggtggcagtggtcaagtgtatcagatgttcgagaggcaaagaagactaggatgcagatggggaacgtcccgtagctgcacagcagttggccttgacatcgaaacctcaaggaactgataaagaccacatgtcagtttgaatgagttgagagccagtgaggaaatgctcttaaccaatctgttatccatgtgtcctgggaaggaaagccagagacctgatacatcagttgaaatgtagagacaagagaaatgtgtcttatgtgggagttagcatgtttgggtgctgatagaaaataaccagaaggtagaaaaaaagacccagaaatgggagagtgctctgtggtttacccaaggagtcaggtttcccacagactcccgtcttctcaaagactggagcgtcccctcctccccaagcaggccagactttgggccaccgtaacctacagaagtgtttccaacagttgtgctgattttcttccactggggccagtctgtttgtattcctgcccacaatgctttgtagtagaagcaaatcagatggcagaaagtttcattgtagaaccgtggtggaccaccgatctgagtaagtggtgtattggaaacatggaagtgttgagcggtttgtaagtggcccaccattcttcggtgtgaaactgatctctctctctctgtttcagtatcttatcccacctcatactcgtgtcagagagcgcttcagactctgaaacgagtattgtttcttcaggtcatctttgagattctgactttctgctttggttcccatacctttcatgtctacactcacagcacatgtataccattcagtcatgtgtacatcctcgtgtaagtacatgtacataagtatccttcctttcaccacctcct

SEQ ID NO: 22982 - DNA, 1191 bp, Mus musculus
ggaggagctgtgatctttggtggattgtgtctcagtattcttaaaggagtgtggacagctgagcttcatttttggaggaacagttatgcttagactttggtcagtccattcacttgcaagtatttctgtaccagtgtcctcagctctcactgcaggaggggagaccgtcttccaggaaacttaccagcaggtggtaggctgtatgtccaggtatagactggaagtatttttgttgttgttttatatctataggagaataccaatttcacttgaatttaattgttaaactaaacagagtaagttaaagtatatgaaagcggctctgtggttctctagacaacactgttgaaagtcagtttgaaatgctttttaagaaagtgaagttccaagttgtttggtcgaaattccctgtcacaaaattggttagaagtggaaagttgctctgtcaacatgggcagagcattatggttgcctctcgcaagcagtgcgctgaggcagctgtctctgttgttttccttgctgggttttggactggctgttccctggctgtttcttctgtgagaagaaagtagaggcttgcaaatcgattcaactctggctgtgtaccttctatcattcacttaataagatggcacttcctcctgagacattcccgtccctcttactttaaagcagatacttaagaaatgtactagtcagtatttgtatactgtataatttttgccttaaaaatctgttgctaaacaagaatattgaatacttatggaactactgatgctgtgttgaaaacttagaagaattactctggtaagaattattgcctctattctagaaaaaaaaattttaaacattgtgagatattttaagcataaaggtctaatatattgcttttatgaaattaaacattttagttaattgtgggaaggaagcatgaatgtagcagccaagcacaaatcattttgttaacctatagtcatatcaacttgagcagatatagaaaaagattttgttaactgcaagaacatgaattacataagttgagttgggcaaaacattttaagtgctttttgcctctacttaggagcctttttcttaccaaaacacttaacaatgcatttcaaaatacctttcagctttcattttgcttcagtgtctcacagttcaaggcaggcaagaaaactcacagctttt

SEQ ID NO: 22983 - DNA, 1921 bp, Mus musculus
ctttcagtctgactcactccttttgtgatgtcactgacagttgtgaactggagtgacggcacctctgctttgcacagcccagtgttcaccagcagaacaaaggaggcatctcggtgcttacactcccacttagagcgatgtcagctgcccgtagtgtgggttgaaggtgggctgcatggacacaggtcccagatctagctacctcctaacttgcttcccagaagggttttctttttctctttttttccccttcctacttgtaacaacccaaagtaactgaggattaggctttgtcattgcaaattttggtgccaaaggcatatgccgtggcaggaggttagtgaggtaaccctcctgtgctcattagtgaggtaggggtgtccagcctgccccaggcgagtcacagcgtcagaacagtagtttctgctacctgcctgacattgcaaggcaggcactgtggaaccacattactgaaaaagcattctctgcctttgtctttccctctgtttgcagagccacttccacattccaatttctctgtttaggaactgcaggtaacctgtgtagtaattctgggaaaaatatgaccaaaggtcactttggctgaactccgttctgtccatagacgtcccctcctctgtggtgagcttcctaagtacagtgtcactgggctgtgtccagtgctcgtcgctctggaagaaggaaaggcacctgctgtggggccacggggccactccttttatttctcagctctaaaactttactctttcttactgtgaatagaagaaaacctgaaaaacatctcagtggtttattaatgtgaattggatgtaacgtcttaagttaaaaatgtagtgagtgttaaaagtctgtttttaaatagcagtatgcagatttgtcactggagttctgataatgaatggaattaaaattcttttttttttaacataagcaggcatggtggctcaggcctgtaatcccagaatgtggggctgcaatagcatgtcactgtgactttaggccccatttcaaaaataccaaacttaaacacatccccaaaacgagtgtgagagaggattacagataactaagtaaaaaatgtcagtggtcaccgttatctattcctgggtcagaagctggcatgtgccatgaaggcggcaagctgtactaggtaactgtgactccgcaggccctgtgggtgccgacctgccttacagatacgtcctgggtaagtggggggccaagatggtttgcttgactgtactggactttgctgtaggaggagggagggaaatggtaatcgctaagagctcatcttttccagatcgtatcatttctcttctattagtggcagagttgattctgtaatttcaaatgatgttcaaaggggaggtatttttttttaaacagatgatctcatttgctgaatgatttaagagtaaaatttagccactgcgtggctttgtgtatagtaacaacaggttttattgcactatctatggttgaaatacctgtgcaaagaaatgcagggcacaggggaggtaaaaattcaagatgtttgatacgttaaattattactcttaagtttatatttgttttaaatgggacacatcttacttaatccatctcaatttagtgttttaataaaaaaagaactaaaattatttcaacttgggcttacatgtgtcaatatgggcaatatgaatatgggcaatatttttatgcccgtgtattttcacatttaataaaaatatttatggtcatatccactacttgcttcttattcatgtttagcctttgacttaaaattttaagaaagtccatcttagaagtctgtttctacctttatttcacacagcatcagggacagagttgatgaagggctttcatttatgtgagtttgccaggaagagcagagaac

SEQ ID NO: 22984 - DNA, 1183 bp, Mus musculus
aattttttttttgatagcttccttttctcatcttgtgatttgaaagattaatttacatgtctcatttctagatgagtaacatgctggaaaatccagattttttgaattgtgtctttctttgcaaggacatttttaaataaaatgacctgggttggatagttttatgtcaagctgacagaatctaaagtcatctgagaggagggagcctcaatttagaaactgtccttataagatggggctgtaggcaagcctacaggtaaattttcttgagattgatagtgggagggccaagccaattgagggtagttccaccgtccctgggctgctgtcctgggttctgttaagaaagcaaaatgaataagccatgaggaacccttccattgcctctgcatcagcccctgccttcaggtccctgccatgtgagttcccattctgaaattcttcagtgaacactgtgagagtgtaagccacataaaccctttcctccccaactcgcttcggttattgtgttacatggcacccattgataaccctaactaggacagaaatcggcacccggagtgggctgacgctgtggcagacctgaccacattgtcttaggggagatgattagaggttttggatcgctgaagtggtcttgtaggaagtgttccccatgtcacacacaagctgctttctagaggctgtacagcctgctggtagccaagctcagcaatgtccatctcccaggtgttgctcctcctaaagacatgaagtggtcagggagagcagctgaggtgtggcaccatcaagagggcacaggagaggctactagggaatgtgcagcccagttgcagcagagaccccagcgttttggagtcaacagaagcacgggacaaacagcaacagcagcagctgtgcagtggagctggtctgagcctagaggacaagctgtgtgtgccgcagagagcagaggcaggggagtgacccaagcccctgcaggagtccagaagatcatgagtgaacactgggcattgagttagttatacaggtggagttgtgtcttgctttgatctatgactctgccctggttcttccctcttgaaataagattttttttttaacactataggggcctaacttgaaagacttatgattttaagactctggattttttttaagactggatttttaaagtgtttga

SEQ ID NO: 22985 - DNA, 1129 bp, Mus musculus
tggctccagcgccaagatgacggaaatgttccaagtcagacttctattcccaatttttttttctaagatttctctattgctattccagtgatatccctaaaagacatctgtgtaggagaacttttaacaacgtggaggaatgtaggtgcattggaagtattgagtttattaacatgaaatgtgtgtgactatcaaggtacactgtttgccttttacatttaggttgaaacctaaacatcactgcagataaatctctttgctttgaaggttttattccccaagttccttatgtgtgctataaagaataattaatataatgaaaaaatcaatgctgtgtataaattatttaagctttactatcgttgtaattttctcttcaacacctattgatctgtaacaattcatttgttaatttcgttctactaagatattcattgtgttaggtctgtggtagtgctgtcgctgcactttcacgagcaagtcatcaatgactaacgatacttggaactagttaacttactagtgagtggcctgaacggctggatactttgaaacattttcctacaggaaatgtgtgggtgaccactgttatatttagggtgtgtatttgtgcacattgtcaattagaactgctttacagttctctgggttgttgtgctccaggtttgaatgccttttctttccttttctggtgctggggatagagtccatcacctttccagtgcttggcatggcactctaccactgagctatggcaccagcatttgcctgaactcacacccgttccatcatttttcattctttttcctctctcattccttccttcaatttaacagttttacacattaatgaagctcaccgcagtatttaaaattgtgcatacaatatatactgatcaacttttcccaacatttgatgtttactattctatactggaattaacttcttgtctctcccctcccctcccctcccctcccctcccctcccctccccttccctttcctcccctcctcttctctcacctcctctctcttcctctcctttctcctccactcctctcttttcttctccccttccctctcatcttctctcttctttaattctctttctcttctctccacaccccacc

SEQ ID NO: 22986 - DNA, 1324 bp, Mus musculus
aaaccacatatacatacacaaacacaaacacacacacacaaccacacacacatacacacacaaaaccacacacacacacacacacacacacacacacacacacacacacacacatccctaaatacttcctataaccttctcagactgtgtgttacttgtatgtgtacgttttcaggaaccaagggtagtgactgagcacttggtgtgctcttccctggaaagactctttgcccactcatcattcctcagttgcctgcagcacattgtgtgtaactgacgccggctgagtttgcccttgaccacatttgcacgtctattgttgatcttctttagctcacagtttgtcagtcatacttgtgagacttatggatgtagcccttgaaattggtaggggacacattctcacagcaatctctctgatcttctggctcttaaaatctttctgctttttctttcacgatgatccccaagccttaggtatggaagttgtttcataggtgtatcagttgggactaggctacagatctcattttgattggttgtagttttctgtaatggtctccatttttgcaaagagaagcttccttgatgagtgggaagagccacacttacctgaggatataagaacagatacttagaatgtagttaaggattatgctggtttaatgaagtaatggttgtaggttttcctcctaagatgcctggcatcactagacctgagtatttggctaagtttctggtaccaggtatgatcttcatcttgttgagtgggtcacatgtccaagtagagagcagttgcctatcaccaacgcatgagtgccattactgtatcctagcttccacaggaaggaagcactcaatagtcctgtccagccatgatggctgtgaagcacactaatgaccagcatggcacgataacatacctaagtgcttcaatggactcttcaatgccactgtcacttgttaacttaatcaccctaatggtagataccagatgactggagacagtttctggctcctgggcaggctaaaatgaagaagagaaagtagctacccggcttcactgtttttctcatggaaactttaataaaggctctggaccatgtttttaccctcctttttttctgtcttctgacatcatctgatgctcctcatgtgaccatacatggtgttctatctctcctgtttccgaggatctgtgtgcaaaagaaaaatctgtcttccttcataatgctcattctcaaatatgattccacaaattctttgtgtgtgtgtgtgtgtgtgtgtgtgtgtgtgttaggaaccaaatctaggtcctctagaa

SEQ ID NO: 22987 - DNA, 1102 bp, Mus musculus
atttccaataaatcttttaactggattctcgcatggcagctatgtaatggtaatcagtcacagaatgtaacacttggatttaattaagaatataatgagaatgtaatataattaacattatcactgaattccctataatttattttcttttaaaaagatactgttatgtccagtataaaaataggcattaattggatgcttatcctatagactcactgagacttctatcccaggctcactggcagaattaaagttttacctttctcagtgtgcttatatttgtaaccttctgtatcccgttgcttggttgattattgaaacaatggtccctaagattggaatttcttcatcagtcttgtgttggggcaaaggaaaggctgagtgaggtctgtcaccaacccaggaaggaacttgtctgacagcttatcatcctgccttacatgagagacttgcgcaaacacagtgttgatagggaccaagaatgctaagttatgtcctccatttaactgaaacctcttggcaagaccctttgggactggggcttcttggacccttaatttgtcccttaatgtggctacattgactcaatcacctacttttgtcactttaattggcttgttggtcctccagggtccaggtgccacccctcccaacctcagtgacacggcagccagcacagccttctgttgctgagttcaggcaagagctgcagtgtgaagaggctgtgggcgaaggctttgctcaggatgcttacgtgtatttctgtgcactctgaattttttctttgctaagtgtgtggtctttcttgtttctcacatttcttctgccaagagtctaggagcccttctaaccacacacttgatttagatggaaatcctcagtagatctctaacacattatatcattttttttatttacactataatatagcatgcatttcttgtacacttacaaggcagatataattcctgtttgtcctgtacagtgagaacagactttgcgcactctatacaagcttgtcccccagagttcattaaatgtttaatagttggatcactgcatttcaaatgagttaacttatgcctcaggacccagctggatt

SEQ ID NO: 22988 - DNA, 1199 bp, Mus musculus
tctcttttaaaaaattagtatgttttgggtgaaaaattatctttgaaaatgcaaactaacgtttagaaaatgaagatattttttatttctgtggtgtgtagtcttcagtattttaaatcaaacaaactctagtatggattaaaaatatgtggcaatagctaatatttgtgtttttaataggtgtcttcaagattcctgggttcaaatctgaatatttcatttctgtttataatgtttcctgatagacaaagagtttttaaagataagggtctcctcattgctgaagggccagagaattcctcgcagtagcaactctgtgtctcattggggtaggtcctggtcttccgtggtgtgtgcaccacctacactcatctgtctcataggatccaaaggcaggagggatggtcggctgtttcctgttctccccaccctagctgcatgagaatattggagggcctcctggtttcattgtggtagtcatttgggtgtaccagagggactctgtttctgggacataaacccatctttgctttaatagatatcgtcctttttcatcgcaaagaatgttaaaagtgcgtcttctgcattttctcaggtgtccctgagagtcatttggctggctccgccaatgtgcaagggatgtggaagtaatgtcaggagcgaggtctcttccactttcctgcagaatagagcccacaggaggaaatgcatcttctgggataggagaggatgctgcagaggctgtgaggtgttctgctagtcgcttttgtgatgcagaaaggctttaccatgtacatgctttaccttgtgatagtgtgttctggctggccttgtcttgcccacactggggaggtgattcacacagcacagtggccatggaaaattacttgtatttctgttgccaactcccaaacaacttggtctctttaaagatgccttgtgtgtgaggcagagcctgccctcaagaaaggctgcaaatagaactggtccattctgagctcaaacctctgtgactcttaatccaagctatttcctacctcatctcccaagtttattttgtagttcaggaggaagaacttagggtaaatgagagattttcttgttctccaaagcagccctctatcaccctggtcacttctcaaaggcaaaggggtaaaacttgcatggattaaaaaaattttttttccaagggtggcaag

SEQ ID NO: 22989 - DNA, 1119 bp, Mus musculus
gccatatctagctgcagagaaaaactagaaaatgtatttattattcactgccagctgttgtgataagtggggaaaggtctattgttaaagaaacaatggaaaattaatactgatgaaagttattagtccataagtatacagtccttttcaatgtcatatattttctcatcaatttgacataggaagagactgagatttgctgtgtcagcatttaatgctgttcagccatttctgtgccgtatcttgattggcctgcctatgttgtgatagactggctggcattttcattctcttacacttgatcatttggagggaggattcggagatgctgaaaggattcccagttcgcgttcatttacaggaaagttgctcagagcccctggtctttcagccttggagtttttcccactactgtatgctgcctggcatcagccctgggactgggaattgcaagaatatgaaattaagtctttattgatttctgtctctcttttttccaacttgttgtagagttgcagtgacctagaaaatgccatggaccagtccagtgtactcttagctctgcccccagcgatggggcctctcactagaatgaattgttcagatagagtgtagtagaggggagtcagagaacggcacatgaattcaggggagacactcaaacacctctagctggataccaaccctattccacccccaaacaatccaatatgcacactgaggggataaacatataactccaatggggcactcagccttccagaaactcaaaatcagtagctgaccactaggaaagctgatcgggtgatcaataggaactctgctcatgaaatgccaccatctctctacttccccgagtcgctggtgtttcatcaacaacacattgtgacagttcttatatattttattagttattcactgggttcctctgcccatcgctggagagaggaagtgctttacactgtaataaataaacaacttcactcaggttatcagattccttcccagtcatctggctgatggatcggagactgaggactatggaccacatagcaactatagaagaaagtagggctgcaagaggcagaccacccaatgagagaaagatgatggttaaaa

SEQ ID NO: 22990 - DNA, 1185 bp, Mus musculus
tttatgcaaatgacaaacaggctgagaaagaaattagggaaatgcctttcactgctgcgtcctcagccatgagtagactcaggctacagaagaggcttgcctctagtgtcctctgctgtgggaaaaagaaggtctagttggatcccaatgagaccaatgaaatcaccaatgccaactcccgtcagcagatcaggaagctgatcaaagatgggctgatcatctgaaagcctgtgactgtccattcccgggctcattgccagaaaaaaacatcctggcccaatggaagggcaggcatatgggcataggggagaggaagggtactgccaatgctcggatgcccgagaaggtgacctggatgagaaggatgaggatcctgcgccggcttctcatgagatacagggaatctaagaagattgaccgccatatgtatcacagtctgtacctgaaggtcaaagggaaggtattcaaagcaagcggatcctcatggagcacatccacaaactgaaggcagacaaggcccacaagaagctcctggctgaccaggctgaggcttgcaggtctaagaccaaggaagcacgaaagtgccgggaggagcgcctccaggccaagaaggaagagatcatcaagattctgtccaaggaggaggagaccaagaaataaagcttccctcatgtctgtacatagtggcctggctgtggcctcacttggatcagtcactaaaataaaacaagcctttaaaaaaaaaaaaaaaaaaagaaaagaaaagaaaagaaattagggaaacaactcccttcacaatagccacatataatataaaatatctcagggtaactctaaccaaacaagtgaaagacctgtataacaataatttcaagtctctcaagaaagaaattgaagaagatctcagaaaatggagagatttcccatgctcacgacttgtcagaattgacatagtaaaaatggccatcctgccaaagaaaatctatagattcaatgcaatccccatcaaaatcccaaaacaattcttcaaagacatggaaagagcaattctcaaattcatctggaaaggcaaaaaacccagaacaccaaaaacaatttttaacaataaaagaactgctgggggaatcaccatccccaacctcaagctttactacagagcaatagtggaaaaaaaaaactacatgg

SEQ ID NO: 22991 - DNA, 1216 bp, Mus musculus
ataaataattgacaagcattttaaaggcatatagtatccataactggacaattttatctgatgtttattaattatatgtaatacactgtagccgtctttaaatgtttcagaagagggcatcagatctcattacagatggttgtgagccaccatgtggttgctgggatttgaactcaggactttaggaagagtagtagtaagtgctcttagccactgagccatctctccagcctgaattttcttttttattattattattttttattttatgtatgtgagtagttgtcttcatacacaccagaagagagcatcggatcccattagagatggctgtgagccaccatgtggttgctgggaattaaactcaggacctctagagcagtcagtgctcttaaccactgaccatctctccagcccggtgaattttaattcttaatattcttcaccaataataattgtactgaagaaggataacattggaaaatatacttgattagggaaccaagatatttataaaatagacgttccttgctccctctttggcattttctcaggaaaggaactgtcctaaaactgatggagtgagcgagagacaagagaaacatttctcctttgtgggcaggagagggaggcaaagcttgtaggttttgattatgtatagtgaaatcacatagggttacaattttatttaattatgtatagtggaatcacatagggttagaattttatttgctccaaggtagtagtggacactggacagaaatgaaaaatgcaatctctgcactgtagaacttagtctacctaggctatgaaaaagatagactggacttagagctgtgttccagtgtgcctttatccttgcctgttctcctgaagtgaatgtaacacaatgtttcccaccgttgaatatacaaatgagaggccctcttaggagtccaatgccattcatactgaattttcccgttcatcctggaaccacgtgactatttggcatactttatttattctcactttgaaagaactggcttggtgacaccaatgcgccccccacgcccccaaggatgtcaatccccagaaactatgctgggtttttcaagaaggattgccatggaagactttttttttccccccgagacagtttctctgtgtagccttggctgtgctggaactctgtagaccagctggcctcgaactcagaaatccgcctgcctctgcc

SEQ ID NO: 22992 - DNA, 1106 bp, Mus musculus
ggcaaggccagggcgggactatatagtgaggccctgcctcaataataataataataataataataataataataataataataataataataataacaacatctccagcttcagggattcctggtgttttctccagtttgaaaacaataattactttgatttcaagtttggctctgccttagcaatggggaagggagaaggtgtgggttgtaggtatctgtgtgaccaaatagacacatggaagtactcccttctctacagtctgagggtgagcagtgttactgtctgctgacaccaacctttaaatgcacagtggtcctcttaacattgctactgttatgcttagattgctttaatggaatgctaatagcgtgggtggagtctgtactggtgtgcgttgtgagtcacacaggtgtctacactggagtgtgttgtgagtcacacataaatttataaagtttgagctgcacacttcatgtctggattttgtatttgtagatgaggacggcaacaaccagtggcctgaaggtttgaagttcctctttgattcagtcagctcacaaaacatgggactccgggaagctgcccttcacatattttggtatataatctgttttaatattttgaacactttaatgtcactaacatctaaaacattttagctgattgttttagcctcgcagttctgagagttataataatttaagttttctctgttggaaacaagtctgaaagaaaaaacagctgttcttttcacacttggcattcctcatgtgtctctgacaattctgaagtgttttcacacaggaccaagtgtaactttagaaaaaccacattggtgatgatattttgaaaatggtaaccccatgggagatgttgctggatcttctgtggtcgttttataatattttaacaaacttctttgtatttaggagcagtgattgaagcggtgactgttatgtggttgtctgctttgtttaaaataaaatagcagcactaggttaataactttaccaatgtaagcagtatgtaatgggttttaaacacatcactgctgtatttcagtaaaagtgtttcatttagttgttttcctaatgcacaggaga

SEQ ID NO: 22993 - DNA, 1085 bp, Mus musculus
tgtgattaagccattcttacagttgggaggctgttttcattgtggtttcgggttttcctctcccaggactcaggcctaagtgtgtttggtgtatttggtgcgtgtgtgcatgcgtgcattctacactcaaaaggaaaggtattctcttaactccgggtagcacatttgtacttgcctaattgcagtgggcaagtatttagtgcttcttaggaataaagcactgcatcacaaggtgagtcttgagcacactggttttctgtttctcatttgtaggctgtcaatgactcatgctaccagaatgatgactcggtcctaaaatcccttgttgagattgcagacaccgtaccaaagtacttgcgccctcacttagaagcaactctgcagttgagtctgaaggcaagtgaactccctcgatcaggatttttttcttcttgtcatgttccggtagtctgaactactgaacatataccaatttgtctttgtagttgtgtggagacactaacctcaataatatgcagcgccagcttgcccttgaagtgattgtgacactgtcagagactgcagctgctatgttaagaaagcataccagtctcatcgcacagacgagtaagtcaaaactctgccaagacttttgtgattgcaagcttgttgagtacctttgctaggatttgtgtagtttctcagcttattcagaatatgagtatgtgttgagttaggggaatctgggaatctgtacatgtttgaacccagtattgtggatctgcttttaggactttgcagatctctgaaacctggtgttagaactaaaactgccattcttaaatcatgtacatagttgatgagtacacactgatgaagagaagatagatacctgacagcaaacagaaaggagagttcatggctgcggctcccagtgcagacgggaccacagtgcgctccactctgctcactcctgacagggagggctgcgtatgctcaggaggcccatgtcactgttgtgctgtggacatactttagcttagggaccaaccttcccattctttatgagcttgatttagaaagtgaatgcacagcagactgtagtt

SEQ ID NO: 22994 - DNA, 1121 bp, Mus musculus
gcgtacatgatccggtctgttaactgatacccagcctggggacatcctgagacatctcagaggcagatgagctcacagcagtggggatccatcctgccggtcctgagcttctgtttcaggtctatgttctgccacaggtgaattgaatgtatttctaggatgagagataaacagttttcctcaatagctgcttttaattaattcttgaaaaataagatgcagacaacaggacaaaaacctggtagactgattatgaagtttctgtgtgccaggctagaggtgtggatctcctgtggaggagtgcttgtctaatgagctggaacccttgtatctacccctgacttagcacagtggttttatttaccgagtgctccttctctacctggagggctttaaactcacaatttgcataaaagactgaattcttctctgtataatttgttctatgtactttttgcttattctaatgtcattgtgtgtttagcaatgcagttgctggtgagagtgcattagaccgaatggcctgtggacttggtggaaagctcgttctgcccatgattaaggaacacattatgcaaatgcttcaaaaccgtaagctaccagtgcctcagagtccagtagtgtctgtgctcttcttaagcttaggctctgacaaatgttttcactgttaatctgcttgtttctagagtgcttaacctaattcttagattctcctgatgaaattctattcagtctaaagctaaagagtgtcttttcaggagccaggcatggttacatacccatccctgaagtcccagcacttgtgagcatatgaagaggttcataataagttcaaggccaaattaaactgtatatcgtgaccctgtctcagtgaagaagttttaccttaatgctgaagatattactctctttttttccccctctagaattaatatccgtgcagatattaattttttttgttgttgttgatttgacttgggacagttagtgtttctgccatagctggcctgggactctgaagccaggcttggtggtaaacagctgtaatgccaggctggctgtcattgaggaggggagatggacaaagatcaggctgcataagaccctgcctgcaaatacat

SEQ ID NO: 22995 - DNA, 1174 bp, Mus musculus
aaacatagtttcctagaaggatcattcagggagaggtcagtcacaaaaataaagagccaggcaaggtggctcacacctgtaatcagggtcaggagtccatctgccttggccacacagcaacctgctgtccgtgtgatatagtctgagctgctgtctccaagtggtgtattgaattacagaaggaatctttctcggtgactcagtaggacagcatgaaatagagtattgatttaaatcagtaagcaaaagatgagctttctatgtttaaaaggaaagaaaactagaaatgagtccagattgtgttttatcagcaactgtgctctgagatagagctatgagcttctgacttctggaagggtggccataatatctgtttagaaaaactgtctgaagaacttgggaggggtttccagttagatactgaaatgatcgttttcatgtcttcccttcagctgattcagaaaggcaccaagttagttttggaacaagttgtgacatccattgcatcagttgcagatactgcagaagaaaagtttgtcccctactatgacttgtttatgccatcactgaagcacattgtcgagaacgcagtccagaaggagctgagactgctgcgagggaagaccatcgagtgcatcagcctcatcgggctggccgtcgggaaggagaaagtaagcgatgggatgggttggtcagaccggctcttggtagcatggctccagggccttgggactgctgggggaggctgtgttttctgtagagtcaacagttcctgaatgcttttgggttttgtttttcttaactttgccctcacacattttaactagaaagacataattttaattttaatctaattttaaatagaaagacataattccttactttttttcattgttaatgttaaggattctgctttggtctggttccttgaagtttcttttctctgtttttcaagacagggttctctgtagcactggctattctggaactctatagaccaggctggccacgaattccaagatcctactgcctctgtctcctagttttgggattaaaggtgtgtcatgtcaccaccacccagctcactgttagggactcagcccacatcattgacagcagtgacagcagtaaatctttgtcttactattccaaagcccattttttgtttttacta

SEQ ID NO: 22996 - DNA, 1884 bp, Mus musculus
ctgagtggggtttcagtggtgtgtgtggtgctgtgccaggcagtatgtgttcctcctccaaaaagatcgaggcctaaggcctaaaagtcagcttcactttcagttaaagtggtacagatacagagaaagaagaaattgtaattgcatcatagggggaaaagtaggacagcctcacctgccagctccattgggaatgtttggagtgtgtgccattgggaaatgcatgaacatgtcaatgaatgtttcctcaagaagggaaagtggctttatctgtctcagttacccattgccttacggcctgtttggaatgttcccccagatttcttacatgatctcagcatgggccaggatgtgcaaaatccttgggaaagaattccagcagtaccttcccgtggttatggggccgctgatgaagactgcttcaattaagcctgaagtggcccttctagacagtaagtgccttcaccaggacatggtagctgggctccatctttcccttcctctcacgtttgtctgtctctggttactagcccaggacatggagaatatgagtgatgatgacggttgggaatttgtgaacctcggagatcagcaaagttttggtattaaaactgcaggactggaagaaaagtcaacggcttgtcagatgttggtatgttgccttgattaagctttgtttatcccctcataatatttacttagttagttcataagactgtttaataacctcatgcaaatacattagaactttgtacgtctagatttttctcctttgcttatgcttattctgcgtgtgtgatgtatgtgtgtgagcgcacacacacaagctccatggcacacaaactcagttcagaggacaactttcagtgatggcctgcacccttccactgtcacacagtccacgtaacccacactgggtctcaggttgtcagcctcacacacaagtgcttacccagagctggctgtccccgcctgtgctacagaaagtttgcagagggtttggggatgggctgtgggagtaacttttgtgggggatttttgtgtatttcagtcaagtctatatagtgacttaatatcttttgaataaatgaacagaaatgtgctggtcgtattaaaagctaacagtctgttttcagtgtagacaggcatggtcagagaatcggtgctgatctctggaaaccccataacctggcccttgatttcttttctgacaggtttgctatgctaaggaattaaaggaaggttttgtggaatacactgaacaggttgtcaaactgatggtcccgctgctgaaattttatttccacgatgatatccttcaacagttgaatataagcacatctgggtgtagtaacgtaatgtctaccctcacctgagttgcacatggccattgctgtgcgcctgctctgacttggttgtgtgtgcttgtctacgtatgccttcatttctttcacctcatgcaccaaaagtgtgaaaaggaaaggctgaaccatactgtagttggctgtctgtgaccttactgagaattgtgaaggctgacacttgttgtaaggctcctgtagtgtgataacacctagtggataacatctgtagggagcatcgtggtaaatctcagaggtggttgataaggcatagttaatactgtgggtgtttgtggtctacatgtgtactcactttaataagccagcccagccctcctgttcaggggtgtgctctacagtcagttccccagccaacccctgctaatgctggaggagcaagtagcactgcgttttatcaggagcacagggccttcacgtaattgtgcatctgtgtccattatccagaggaggccagaagatgtggtcaaagcccctggaactagacttaaagatggttgtgaat

SEQ ID NO: 22997 - DNA, 1139 bp, Mus musculus
cctgccgcctcttcccggcctccttaccacaccgagaaccgttctggtcccatttctgctttagtctccccacccagtcccatctacagcacaacctgtgcttattctcatagatggaaatgaaatgaaggtggagcggtatctaggcctgcaccgcgccagcctgtctagggaggagaggttggtagtgctaaagtgtgagaggctatcaagcacatacagtgagtttaggctgccgcgcgggccggctctcgtgctcctttcagacttggtatccctccccttacatacagtcctgggacagtgacaccttagtaatcagtgactggaccagagggaaccgttcatgttcatattcctccgtgttagctgacctgttcttacttgcttattttagatgcactcccgctgcttgtaagagtcattcaggctccagaggctaagaccaaagaaaatgtcaacgccacggagaactgcatctcagcagtgggaaagatcatgaagttcaagcccgactgtgtgaatgtggaggaggtcttaccacactggctgtcatggctgcccctacacgaagataaagaagaagctgtccagaccttcagttacctgtgcgacctgattgaaaggtacaggccaccttctttcctcactcgtgaccagcagcatgagagagagagtgagtgtgtgtgtgtgtgtgtgtgtgtgtgtgtggtaaccaccctgacctgttaccttgtaaccctgtcaagctttaacggttggataaagatgatgtaacttgaagttgttctctttgtaattgtgttagctaatattgtttcatgaaagctaccctcagctattcagttgcccactacatttgctgtagatcaggtcagtggggggcgaggtgtatggtaaggcatactgaaatctcgggacaagttcagtgtagaaagatcctgtctaaaagaaatgaggtccaccaggcagcattgtgatccggcctcatgtgtggtatcgctcattcagttttcaacccctgcaacagcatagtggccttagaaactactacgttgtatgattgctttggtgtctttctgccctctagttctggctctttcactgttagttactgggtttagtttgttggttcaggt

SEQ ID NO: 22998 - DNA, 1828 bp, Mus musculus
aaacgagatgcagtttaatgatgtcagaacaaagcaattacggacgactcatttagtgacttgagggtaggacataggctgctttaaggtaccggctgccgggccagttttattgaggtagaggaatgcactctgaaaaaaaggtcagatttattggttttacaatagtcgtcaaattaaggtatagagcgtttgtttgggcattgttacagtcgtgtgtgtttagtacttgaagagatcactatgaccaaacatgtgcatttccccctagacttctggaggattgtggactgaatgcatagctcaactcagtccggagcagcaggcagccatccaggagctcctgaactctgcctgaagggccttaactaccacctgccagaagactaactccaaataaacgtttacccttttgtttaggtttctttgttttgtttttgagcaagagagcagtagtgttgtgtgtaggccgttcttctggagccgtgcacaggaaaagtaaccctgtgtgcagggtggactgccatggatctcatcaaacccgcagaggaggtccctgtaagcctgatggtagcactgcagagtatttttctattgctgtgtctgacccacaagaagggaaagaggaaacgattccttttttctcatagacctgcagaaacgtaaggaacgcagctttcagatcagttcatccacatagatgtgtgttacacagactgggggacaacctagtgtttattctgtaaatggagtgagagtctggggggatggaaagaagccaaccagctgctgacaagccagaagcaaagggctgtcacttgatgtcacgctggttctttgcaagaaggctcatgcagtgactcggtgtggaggctgtcccactccctcccggcccttgaatgtgaagtgtcgttggcatgtctggcagtcgtctcattcactcctcaataaacagcattgaaatacaaagaggcctgtgtagaacttcagtactgtctgtcgttgattcctttcatgttttaatagaagagtgatctgatatttttttaaggtgatagttctggctcagtgttttacctccacgctctgcagtgcagccttggaagtgtgtctcctgtcttggaaagcgcagttataacacagctactctgttcacaattggtattctgaaggtttgcacattcaaccggcttttttaaagcttagggttgttctgtagatccaaacgttttggcttaggatttccattgcagattgtaattgctttagagacacacgcagcttttgaatttttttaattttacaagtattatggctaaacttatttactgaaaatttcagtaaaatgtgtgaaattttctttatgtattaacctcagagcagtaactgatgagctgttgtttcctttaagtaattttctaagggatcttaatagatttctgttgaaaccttggtgttaacgttttcatagtttgtactaaatttaactgtgatacaaaaatgagttttatgcataaatcagaatttaaaattaaaaaattttttctttaaatgatttgcattacttcattaaaacaaaatttggaatgaaattgaaaatgaaatggattttattcagatggctctgattggcatgtgcccttggactgcgcactcagcctccagctctgcatggttcaggtctgcaggaaatatgctgagcgtgtggcttgagcatcccatcgggcagtgcttccagaatgtcaggtgcttggcctcttggagaaggggtgtggtgatgtttggaggggcttagtgctctgttcccgtaccagtgctgcaaaccctc

SEQ ID NO: 22999 - DNA, 1166 bp, Mus musculus
gccttgcttgtccttcctcagtctgggagcactgggctaactcattgcaaagctctggctctatgcctgagtccctgctctgtactctagggatcctccagtgctcagccttgccctggctctgaggtcatctgaacttttccagatgcagctgagtggctttgtagtcctggccaggggcagggataggaatctccctgacttacagtgggaattcctttgctcgtagcctctgccgtctatctcttccagcctcggctttctgcatttccctatgatatgatatagtctttggttgagccggtattgagtgcatgtctttgggactgtatggacactgctcttaaacacttaaaatttttactagcagtaattaattgaaaacatttgggggagtggtgctggcaagatgattcagtgggtaaaggcatttgttgtctagcctgggttcactctccatcatccactagaaccaacttctgtaaactaccctttggcctccacgtgggatgcatgtgtgtgcatgggcaggcacacgcgtgcacacacattaaatatgatagaattttttgatgctgtggtaagagaagtattccccccaaatcccactacccattaaaggcgtagtcagtactcagggtgacactgcagatagcggagccctcagaaggccgagcctatcatggagcttttacagcggtctcttgaagggggctgtgagaccccggctcagttcttctctgttttctgggatataagtgggattgcctaatcctgggatggaaatctctagagacatgaacttaataaaccttttttctttatccgtgcattttctcaagtattttgttgtaattgtggtaaatggatggatatgtgtttgatttttctgtgtattttcttcctaagtaatttcaacaaaccagtcaaattttcaactgatttgtttaattttcccctctaatttctattatttgatttagcaggtctttatttttttctttaaatcccatctaccaagctttactttggttccccctctggtttctttgatgtttgaactcactagcaataataggagctgtccttaggagaggttgtcacgttgctttctgatacattgcaaactctcgccctttctgtgtgttctgtattaaacgcttcct

SEQ ID NO: 23000 - DNA, 1170 bp, Mus musculus
cggagcggagcttggttgttttaattgtgatcctggtctgtttaagggacttttccttatttctgcttacacagaagtctgataactaaataggaatgagctcttttagccttgtaatgtgattgcccatcccctgtgcctgggaacctgttacctctttccccttgtattgtagcacagttttctcctgattggttctgtgccagcaaagccaatttatcttccgcttcttagctagtatttaagaaagcaacagtcccagcaaattaatagtgcctaaaagaattgggggcaggtttgttccgaaatccaacatcccgtcatctgagagtagtcactaactgtccttacaggggcttatcctctgctctagaagatttcagaagttagtcagagaacgtgcgtgcctgcagtgagccgagtgtagcagggttgctgaggtgacaaattgtccccgatgtccctatgcaaagctcagaaagcaccaagccttcccagaactccccattctctgaccttgtgacctcaggctccaaggcttccaaagcccacagtctccatctgggacttagaaaggacctatatttgtgtgacgttgaactgaggtgaggaaggccagtgtcacagttggctgtcaaaaacgcaaagcagagaccagagggcttcctgagacctcagtctatccactgcagcatacatgcttcgggcctctggactgaaggagcctgggcctttgagccttgcctactcgctgctgctctgcaaacagtatctcacggccaagggtgggagacagagaaactcagagtttaaagctcctcgcggatgctctaggaccccttacattgtgatgttatgttagattttattttgaaatatatctagtggttccccatgtggatccttgttaagagcaaactgaaaaggcatgaaattcctttagcgtgaagaaatgcacttaatgagttccagagcccaatgtgaacggcctcagcccctgaaacagtcatctggatgccatcgatggtattttattagataggcatttaattagaggaagcttttgggccagattctttcttatatgtgtgattcatattcaggaatttcttacacggccatccccctccccacccaccccacccccgctctttggccctgcgcttaaaa

SEQ ID NO: 23001 - DNA, 1158 bp, Mus musculus
gtcattttaggtggatggaagtgatccgaagtgccaccagctcagcctctcgggcccacatcttgagtcacaaagaatctcacctgtactgacggctggacacgcccactggctgcgccagccacggatgctttcctggaggatagaatgaagcctagcaaaatccacacctgtgtgaacacgttgaagatctgcagtggttcttgcccacatcccttcatgggcctatctccaaacattgtcttccccataccaacctctttggacagcctttccctccaggcctagggggtgggagggcggtgtcttgccattctccaggggcgctttagtttgtgccactactgacacattgtcatcaagagtgccaaacgacagtctcgtcctgcagcatggccagcgcagggccatacatccgttcacctgcagactgctgtttcccaaacggatttttccagtgttcacaacacatggcgcagtcttaagtaaatgagatcattttggatttcatttttttttccaatctttctacttttataataggacattcgtaggactcaacttttctcagataagcaacttgtggagtactccattccaccgaaggggtgggctccagcgagaccctggtcgccacacctactttcttggcggaagttgaccaagctgtttgtgattcctatttacaagatgtagtggggttgttttctgtggagaagcagatacccagtgcaatacgtgggcgtcagcgccctgtgcgtggcgtgtacagtggcggctcctaggccgtgatgttttgctgtctgtttcacaagcatgagaagctgtatgtcgttgactggggtcgtctgtgctgttacatggggggcattgagtgagcttctcgggagaagcatcgtatggtaatggtacgtagtcccagccccagtgattggccccaattccctgcaaggccgtggtttggtttgaacctgcacattctctagtagtatctattgtacctgtctccaagtctttctctttttatactcattccttctgggcatggggtacagacaggatgacagcccacatcctggacagactcctctgggggacctggctgccaaacactacctgagcctcccagtggaaaactgtttgcctgttctctagggc

SEQ ID NO: 23002 - DNA, 2588 bp, Mus musculus
gctttatatcgatagctcctcccccgggagacagagagtcgctctggtggatcagtgtacagattgtatatagcgtcatttttacggaaacccttttggcgtgcataaggatcactgtgtacacattggccaagtgcttctgtagataatgtctgtggagtaaatatttgacaggccagaacttgagtcttttgccttgcctttattacatgtaaattttgaatctcgtgaccagtgatttggattttattttgtatttacagggtctgtcattaataataattaacccccctcccctcatggaacactcccgtttgtacctcaacagatgcaaattcccctctcgttcaccctacgccctttttggtacacttagaagttttccttttccatcaatggtactgtttcttagtgttttcaattggaacatatcttgtctcacagagctttaaattattctcctaagtttcttgtggatgaagcgctctcatctaacctatgttgggttgtgccaccacgtctgtaccagatgtcccatccggcatctttccattgaatcttgtagtgcaacttgcgtatcatcttctccacctccaagtgtctgaatgcttacacaaataaattttataactcactcattttgcatactattcttgaaatgtggctccacggagcagatggggcacctgttttgcacatgtgcatggttgaggaagtgtgtgtatgttgagacaggttgaacgactccaggggaaagtgcccagatgtcaaaaagccaaatgtccaggttatcttcctatgcaatgtgtgtgctaggtccctgagttacgaccgacaccacgggtttgtgaaactgctgaagttcttgcgctgctgtgggggccgcatcttctggtcctgtccgccgaggtcctgtccgcgaagctctccgttcttttctcttgcatccctcagcagggtggggattccccggttctcagagcaggtcttgctggtctcactcagatctgtgtagtgttttttttgtttgtcgatgctaattactgtcctccttttggagggttaggccttgagaaagggtttttggagcaggaactttgagtgaacttagtgacatcagcgtggccttgtgctggtgtgtatgtcgtgttctaggaaggcaggccaaggatagatgtgtcaggcgtgagacaattgcttagatttattaagtggggtctaggtttttagactattgtgatagtctattagaagtagtagatttaggctggagtaataatttcatccaagaatacgttttggctaggggaaataaagacaattttttttttctttttaaattgagtctatgagttatgtgtgcagttccctcaaagaccagaagagggtatgagattcctctcttgggaactgtagttacaggtgagctgccctgtgggtcctgggaattgaatctaggtgttcttgcagaacagcctgtgttcttaactgctgagccatcactctgaccccagtccagtgttattttataccaagtatgttacctggaacaatagtttgagaatatttcgtgtttctagagtactctgctttggagtactgtgtgtctctttttctgtacgaggcttgatgtataaaccaaaggttgttgcaggaaagtcaccaaatgaacctgttctgcagagtgctgttgacttgaagagcgtccctgagggccacaagcattgctagtggaaagctcgtcaattgtacaagtgggtagtgatacagtagtaaagccagttgtcttttctctttccagtgctagtacatgaaccaggacttgtgtgtgctgggtcagtgctttcctgggcttttcctgcaatccccgccatcctgtctttaacagcttctgctgagctgctgagaggactagatgctaattaagcataggcttatcaaaataaatgtaggctggtcctctgtactcagtagaccacaaggcacgggttcccatctcctgtgaaagcaacaagatggtctttgggagtttgttggaaaccttgctgcagatgtggggttgacagttgtaaagtggattgcctcgttctatagtctcctctatgttgttacattgtagcacaaaataaattagatgttctctggacgttttgtttagctcagcttggcaagctgtattcatgtgttcacttctagtcctttattcagagcagggcctgtctgagaacaccactgctacccatttcacatcacaggctactgtgggtgagcacagcatcactcagaagtccttccacagtgtactgtccacagctcatggcaaccatgccaccagtctgggaaaaggagcacctcagagagcggtgaggcaggccgagtgccgactgctgagctctggctcacagacaggttgtcctttgggttatccatgttcctccttatgagtgccgagattgtaggcatgcctcacatgttggctcaatgatggcttcccccacccccactgctgtcccactaggtaacagcctgtgatgtggaaccaaccacctgtgcagagtggaagacagtgggttccttcctagcagctg

SEQ ID NO: 23003 - DNA, 1151 bp, Mus musculus
ttaggagcaggctctgaagcagaatccagggctgccccgtggtgcgatggtctggctttttaacccagcagtcttgtctgtttgtgtgggatagagtggggtgaagaggaaatgtcctctcgtggtgatgacttcgacatgtgtgctttccagaggcccactgctaaggaattattgaagcacaaattcataatccgcaatgcaaagaaaacgtcctacttgaccgagcttatcgacaggtacaagaggtggaaggcggagcagagccacgaggactccagctcggaggactctgacgtgtaagttgccctgtccaggctctccatgcctgtagcagagagttgggccctgcttcgtgggggtgggggtgggggtgagctttttttgtgtgtgtagctgtggccagggtgggggtgggagggcaaaagagagtacaaacttagagtcatggccagaaggaggaacctgcggagacactgaggccccaaagggactaatagtgaagtggcaggcggatccttaggagaggtgtggccactgtgtgctggaggcagcagcaggagtgatggagctggtggtggtctgggcagtgcagcccctggcctggtgttggtgaacttggtaggatttctgttccaagggagacagatggccaggcgtctggaggcagcgactctggggactggatcttcactatccgggagaaagatcccaagaatctggagaacggaactcttcagctctcggacttggaaagaaataaggtaccgtgtgcccaccagccagtggcgctggggaatctgtccacagtaagcctgctgtgggagcggcatctgccccttaaggcattgacaggttaaagattgagttctgtctgaccattaggattgaggtgcgggcttacttagggctgaattgtgtatcttcaccttgtgtgcaacactgggtcctcctgatctcgaccacaggtgggcttggatgtgaagtttcctgtgtgagaattccagaagtagctgttggatttactcaagataccctgatttttactggggcagtttttattgcaggcccttaaagaccagtatgttccttttggtactgaatatagacttcatgtggatgcggtgggtttccactacgattagtttgtc

SEQ ID NO: 23004 - DNA, 1105 bp, Mus musculus
agcaaatgttttcttgtgcacaggagtgagaagcccctcccacttgtgtaagctgtggccttccgtaggcgcctatagaatgtggcgttctgcttccccgaggtgactggaaaggagctctgctgtggcagcagtcctgtgcagaaagtgtcatcagcccaccctccatgtgaacatgactggtgtgaagagctaagatgatagcagcttaaatcgtttaagagtgctagactttttgttgtttcgttgtgtttttaggctgggtttctctgttttgtagctctagctgtcctggaaccactgtgtagaccaggtgctgggattaaaggcaggaggcaccagacactgctgaccgccccctcccccttctttaatgtatggcccgttgcatgggacatttcagctgtagctgggtcctcatcctttctgcagcaaagtctgcgtagcctgccctgctggaggcctgtgatatcggggggcctctgagacttggcggagggcctggtgttgcttatctgctggctctgccagcccctttcctgccgtggccatgctgttcctgagtagtctgttgaaaatggtgtgaactgggtgtgaggactaggagaggagtgggcactcccttcccccaggaaacacccacacctcaccctgtattttcccgcaacctgaatatgggggtttcctgctttgcccatttccccctggtactcacaacataggtgcctgtccatgtgtcatttagaactagatggaaaactctcctgaatttccatagtcttaggatgatgtattttaggttcctaacaggtttctatccttctctaatacaaggcctgcctcaaatccagggcagaattctgtctgtctgtgggtggttggttgttcatgctatagcatgctcatatgttctagttctcttcactgtgtgggacccagggatgcagcaggccaataggcatggtggcagttgtctttgctgcttcagccgtcttgcaggaccttcagaattcgagttagaaacacacgcgtgtacattttgtccacacgcctgcttgggaagcattgagttttctgtggttaattgcattgcacacattgaaca

SEQ ID NO: 23005 - DNA, 1156 bp, Mus musculus
aacacctgtacttgttcttgaggtgggagagtagggccctagctgggctctggagaggaggaagcccttcagctgcatggctccttctttatcagacttgccctgagtcactgaactcaggtacctctgtggagatagctctgtgggagattagttacatattactgggcaaaagcactgtaaggaagggtttaacttttgaggagagagtgcatcgtggagtggaaactagtggtggtggtgggggcgtgggaggcagctggatgaactgtctggaagcaaatggatgttgctattcagcgggctttcccttcccctttttaatcaacactgaatggacccttagggtgccactatgctgccttcagtgtgggccttccgcgacttaagcctcgcagatgcacgcagagatatgcctcctaggttattatgcctctaggtcatttacagcctgctcaccagaagcccacaagaagtcccctgaagtctgtatgggtacctgctgttgccagcttctggggtgttggggttcagctctatgaactggttctctctgctttctccacgtgtcttctttgctgtcttctgctgtggcttgagactccacattcacgagctggaatcttagctttcagatttatgtgttcatcatgttggatgtatagcttttgggaagcagggctagacaagaccatggtgcatctcggtgatgggccaggtctgtggggagaggggacccctgagctgacttgctgcccttactgcctgaccgtgggactttccagcatttgaggctatgagaagtgagctccttttgtaaattacatggtctgcagtgttctgtcttagtaccaggacaggcttgagttctgtctctctgccctttcttcttatctgctttctagcaggtgcagtctcctggctggcaggtgaaacaactaagtctcacctttgtctggatgaaaaggatgacaatgaaaaagaggcatctggatgggtccagagtgaactgggccaagcgggaggggagggggatggttgagaaaaagaacagagaaggggagaaggctaaggagaccaagagagcacgtggaaccaggagggagtgcagctaaaatgctagtttatataggatcagagaagctgggggaagggg

SEQ ID NO: 23006 - DNA, 1204 bp, Mus musculus
aagagaaatgctggctcagcctgttgggacgcttcaccacgggcttgtaagggcacagcacaagtcagtgagccgtgaaggacatctctaatacaggtcagaactcggagagatccctgagagcaagtggctgccaaggccttggccttctcaacaggggaaagcgagtgatccattcatgcccttatgtcatcaaattgtcgtttggagatcgaaagccctagtgtagggtctgattcatccattcaatacctttctcctgaatcttaggagcaggaagaaaattcctcttgctacttattgtctttgtagaatgttgtattcttataacatgcagaggcaactatgacctttgtcttcctttaaatagctaggacttgtgtttaaacagctttgccaagtctaggagcctcctcgtgaggagattgatggaagtgataggctttagctcaagcttcctgatcctcagaggcactggtggtctctagagtcagaaacaggtcttcatctgtgaggatggagacaagtctataagcagtctctcgcctcccaccaaggagaccacgcagataagtgagcatctctcagaccacagggaactctatagtgatgcctcttcttctgccctgtgcagttgtgtttgtccttggcagtggaatgtacaagaagttccagccccagggcaacatcatgggcaaagtggccaagtgcattggtgtaagtgctcctccctctccctccctgtcccctcccacttcccttcccttgcccctccatccccctctcactcactctccctcctcctccctatctccctcccatccccctccaccctcctctcactcattcctccaccctccccacccctcccctttcactccctttcctttccacctcctctcactcaatccccctccccctccacttccttccccttcctctcccttttccctccatccccctctcactcattccccctccccctccactttcttccccttcctctccctttcccctctatccctctctcactccctcctcctccccttcccctctcttcccctccctccccttcctcctcttcttctccctccccctccccctcctcttctgcctccctctctccctctcactgaatcaatcactccagaacttttctctaccttccaccttctttaaatcaaaattcagttttaaaaaagaa

SEQ ID NO: 23007 - DNA, 1149 bp, Mus musculus
gagtatcctttgtccttctctgacgtcttcattctgtatgtcacacaatgttttgctcctggtagacacagatgtgccttattcagttgtcaagcctgcgtggggcacagaggtgatcctgagctatgcaggagatgtccttggtttatttccgtctcctgctagtcgatctgtctcattgctgtctctgtgtgggaataactaacatacagctataaaagtcacaaaatccacgactctggttctgaacagaaccgagaagttattacatgtgtggtagatctcggtgtagcttccagtgctggtgtgtgagtgtgggctggtgagacacgtgtctaaatgttatgtccccgtttgtcagggttgcttcggttacccgttgagcatcttcttcatcgtggtcaatgaattctgtgaaagattctcctactatggcatgcgaggtaagtttccggctcccctcacccttctgtaagagcaggtgttgcctcagcccgccctaactctgtttctctctccccctgcgcccgtggaaagcactcctggttctgtacttcaggaacttcctcggctgggacgacaatctctccacggccatttaccatacgttcgttgccctctgctacctgactccaattcttggagctctgatcgcagactcgtggctggggaagttcaagtgagtgactgggtgggacttgatcaccacgggaacagagatgtatgtaaactgtgagctttgcgatttgggatggtagactcccgggttggggaggattcaaggaaaagaaactcacaggacatctgtgaccttctttctgcttcatattgtattcctagcactcgtaacactgtaaattcaagaaggttgagttgttgttgttgttgttttgttatttgttcacaccacacacacacacacacatacacatacacacaagcatgtacgcacacacacgcacacacatactcacaaacaaactgtatcattttgaaatagtggcagggaccctgactatcatgggtgagaaacagactctgcctgatgctcaggtcttgctgctgcagggtcatgtggcttcatggatgggaagccattgtgagtactcacccagacaggaaaattaccagggaaagtctctgggaact

SEQ ID NO: 23008 - DNA, 1194 bp, Mus musculus
taaattttttagataatagaaagtcaaaatccattagacacaataacagcaaaagcccatgtttagtcagtgattagacacactggcaccactgagctctccggataagggagtctgaagtctagatgtggtcctggtcatacttatatctcccagtgacctacaggctgttccggaaacatgggctcgcccaatatgctcactgagtggtcttaagtaaaccaagccttgttgaaattgaaatctgagttcaaatcaagtctcttgtggcccctggctctacacttgtcctttctatgatagcggtcctgttgacacaggtacattcagataagaagtgctgacttcagtgtatggccagcagatagcttgggattctataaaaggagcttagcaacctctgccctggaataataaaggcagttctcaggaattcacacctttcaaaacacaaaatgcttcctgcaggatgtctgggtcctgccgtctcaggcttctgcttcaagaagacaagctgccctgcaaccaatcagggcactgaagaatacccacagcctggtttgctctgctgccctccctggggactaaggctcttcttggctgactgtagccaatctcagctactttgtgtgttcttcttttttccaccctttatccccctatcactagagaagagaaaaggggaggagagagagagagagaaagagagagagagagatagagagagagagagagagagagagagagagagagaggagagagaaagctggatctaatatttttttctaatttctcctttgcttgagtgtggttggacacttccttttccataatgaagttctaagcctgatgattggtcaactaagggctcagccctctaaacattacctgtaaccgtatatacatttgctgtaaatcagtgctaggtaatatttaacagggatatatagtctctgctctggagataagattcctcccctgtgaaccacgacatctagggacacaggaaagatactgctgaggtgagtctcagcccggctttgtggactctgggcttacatccctccctcatgagaacacctgggcctttatgttagtcttattccttgcttggtcctttgaaggccttggggagaccacattctctgaagtgtaagtagatagagcagtgtgctgtctcctcaagaacaaaag

SEQ ID NO: 23009 - DNA, 1192 bp, Mus musculus
tctgcttcttccaactagaaggaagctggacatcttgggccctgtccatccatctctacttcccagtccatctgtcccaaagccttcctctcccctccctgagtgtagatgttccccgggactcttaaactgtttcctcctgtgagcagtcttcagctccccagtataagccacatactcccctgtgggaaaacccagcatctggccaacatgacagccttccttctgtttgtcttggataaagaatatgtgtagctcaatactcaatggcctctcaacttcagcttcttcatttgatgttaaggccttccctttgagcagcacagttgccctgtggctgtaagatgtgcctgttgttcaggatgctgcaaccattttcagcatctgagttccaccttaccagtcacttgagaagagttttacttgagaccacacaaaccactcttaaaatcagcccatcccgttactgtactttttggctactttattgggctcttaaacctatcatccttctccaccccgagcccttccaacccttcaacactaggcaggagagaaaggttagagggaaaggggtgtagatgactacttcctgctgattaggggcatcaagttgcttgggaaaagtccaatctttgtcgtcagaatatcgacaaccagcaaccagcaatccaacaaacagcaactgctgggaactaaaaaagggggggcctggggaagaggggaagggaaggcccacaccccgccagagttccacctatgctctggtcagtcaggcgtgggagagctgccatacactttccactcatccctgggtgggtatctaagcctctgacccactcttaggggggtggcagaggggcagcccaacctgagagccctggtgctactttgctaaagccaccaccagggttatgggagaaagggatgagggaagaggttcccaacactggtgagagtgagcgcagccttgatgagcagagactgtctatagttttagagctttattggagaaaggcagggagaaagagagaaggtagaagagagagagaaagagagaggggggaaaggctagagagaaagagagtaagagggagaggagaggagaggagaggagaggagaggagaggagaggagaggagaggagaggagaggagaggagaggagaggagaggagaggagaggagaggag

SEQ ID NO: 23010 - DNA, 1127 bp, Mus musculus
ctctcacacttagtggtagcctgcacatctaccgcatacttggggctgcagtacttgtgttttcaactctctgtctcttagctcgatgaatgagaggttaagttaaagcagggtacgcccagggtctcgtgacctttgctctcattccctgtttccgtggtagaccaaggttcccccccacccccaaccccaccccccgtcctgtggcacacatgccacactgctagatttccttcttcctggactatataacagagtagtttactacacagacactgtggaggattttcacacaagcagatgggggccctatctcagacatagtcactgtcgaccccctgctgtagatggacgccgcagcaggagccagagacagccagctgcagctagaacagccctgtgagctgggctgctctctcctctgccttcctgcagtccatggagaagctggtaccctgcctccttccttcctctgtcagttctcagtggcatcctgtcctcctgcgtggtcaggaagccatgttctctgactcctttccccttggcctgtgtctctccagtccctcctcctgtgaggttgttctcccatagctgaatggcctgtgtcttccaggactcagtctttctcctgacctctggttctgatgaggtggcttttaccctttcccaccaccctctgtttcagcacatggaacctggccaaaaacatgctaagagaatatcttcctgtatctatcatgtgtacaatgtgtatgactcatatgtatgcatatatacctgttcatctctacgtagatattcagtgaaagcttggggccatgcatgcccctctacaaacaaaacaaaacagaaacttacacagctgtaagcacaatgccttctcttaatctagccaacataagtgagcagcctgccagggagacacaggggctggggtgaacttctctccatggccatttcttccctttttgtcagacctcagctaggccagcagggggcagcagaggcctgtgacaatccgtcctctgtaggcctggctgcctgtgcgttccctaaatccctggagaatccacagtgtatgctgcctgtgggacacaagcatttctgaaaacagtgcatcttaatag

SEQ ID NO: 23011 - DNA, 1192 bp, Mus musculus
gtgacactgcctcctgcttgggtaagacataggtgttcagcttattcatttaacccctgccattgcatgtgtgtcttctgcttcttttggtgaactggtttggttttttttttcaattggcataatagtctgctcttgccacatgtaattcagggaggtttgcagtgttttcttagttgtcagaatactgttatctccatactggaatgaggttctctgaaaagttgcatccctaatgaatgtactttctcagaacgagagagactctgccttggctcgatcttgctgcttcgaggcctagtggctttgctgtgcactgttggagctgctggctgtctgtccctggccacatggctgcatgtagcctgactgccccatgtacaacgctccagcttcactaactctcccgcctcgcttggtgtaacgcgtctaacgttgcttctttcccatttcactcatgttacaggaaccaggaggggttgggacccataggtcatgatcgaaagtctcagacattgcctgtttcccgtaacagaacaggaatgatgcatgccagattgcagcagctgggcagcctggataactctgtcacttttaaccacagtaagtcccacgccaaaccatcgtaaccgccaagccatctcagaagggagagcccctgccacactgtaccgcgtcaccaacttgatttttcttccagagccaaacaagtaggaagaagagttccctccttggaggagagtcctgtgcagtgggggggtagcagaatgtggggccaaatcaactacagcacccgtctcaaagtgcccaaacttcaggcaggatgcagcagattccgtggccagacattggctcgtatttttgttcattttattctaccctctgctgtccctcctggcacatccgggtcagattcggttgcctctctcgctcggtgcatgtaattggttgagtgcccacattctgacgttccgcccgcaagagaccgttaagcccgtgaatcaatttgtgagggtgtggaaagcatccagtaacgaagtgactttttctgtgttttcagtgtgagaaagatatcaagtgtgcttgggatttctgtagacaatggtaagacttaatcaggttggggccgcttcccttgcaaacaagacctttccattcatcttgcctaactgcagggcttgcctaacttcac

SEQ ID NO: 23012 - DNA, 1201 bp, Mus musculus
tatctgagtgagtggctttatcctttcctgtctccttttcgtctctctagctaggaggtgggaagcacactgtcctcagggcaggaatacagtgcatgacacagtttccttcacgagtcagtcagcagtagccagccttaatatattgtaaaaaattgcttgtggctgctgagatacctctgtggttcagccacttcaataaaacgatacaaaatgtattcaccgtgttggtggctactgtttttctaagttaaatctagagcctgtttgatctcttcagaataagcttctggtttcttttcagctcgttatttttagaaatacggacccatagcactttttctaaaactgctgagggaagataagttttcaaattcagaatttgggttgtttttgaaaatttgtagttagtgtttctcaacccacaatagctacagctcagacagcacccttgatcaaacacattatatccatggcaaaagaaaaaaaaaaaaactcttcagttctcttgattagtgttatcgaatacattgtgatgtatgtaagcagctttgtgtctgaaatatattagaaggagctcagatgcaaaccttgttctctgaggggaatgcctgtggaactggcctgctggcaggagtggtttagtctatgactgctcccacgattggcagtcaaccaggacaactcgttctgttagctaactcttattaagacgtatgggttttaaagattcagttttgtagttctacttaaaacaaagcaagagagttttatatttgatgccagtgaagggaccactccacacacttgagccaaaagagagagttccttgcatagactcatacgaggatgggttaactctcagtggcgtggaaggcctgctaccttctgaggcacgctgccctggagcgagtctggccgccctgagtgagtgactacttttcttctgtttatccatccacgaccaccattctgatggccacacacgtgggcctcccctgatgtgttaatgctttcctgtgggtggagaatgaccttctagaagattcctgaaagccacgagctagccatccataccttttttcgatattgctaataggcttcaaccagtggcttgagcacagttttatctgcgcgctctctaatggttgtcatttgtctgcagggtctgcctgcaccagttccagtacatggggaagcg

SEQ ID NO: 23013 - DNA, 1144 bp, Mus musculus
tgggatgtcttaggtcttgtcatgtgttggttgcctgtagcttgagttacagatgatcacacacctgatggccacataggaaaaggcagaggtcccataagccctcctggataacttaacttagttcctcctgttcactgtggaaaacctcgggaggccacttcagccagcagtgttatcatctaaaatcttttcaaaccagtgtatgactctgtcacccccaggtgctaactggggggatctgtgctgtttggaggttattgggtgtttgctgcctttgatctcctgtccaaaccagctgacagtgaagcctttccagagagtcgtgcctgcctgctgccagtggtcacagctgctggtagatgtttcaggaagagctaaatgcctgagtggcaggacttaggcttcctcctcattctaaacaaattagctctcccacttttcatcttgtgagtggtttgttttgttttgaaaaatcccagtcattctgaatgtggttttcttcctagataaggcacctctgtcgaagagtcttctgctggtccccagtgccctgtccctcctgctgactctcctgctgcctcactgtcagaagttcttcgtgtatgacctccatgctgtcaagcacgacttgcaggtgggcaccctgctcctttggcatctgggtggagagggggcgcttttctagacttgccctttcttcctacagttccttagtctctcaaaacccctaaagtttcaacaacagcttttaaagttttctttaaatatatgcttgtattttgattatatctaccctctctatccccctctagcccttcccagccccaccatgtccttctaacttcatctcctcctcctccaatcactgctgcccgtctgcacatggatatagggtcattctctggaacgtgggaaaatggtcagtccgtcggggtcacacctgtaaagaaatagatccttctctttcaacagccgtcagttgctgatatctcctcggctaggactggggctcatgagcccccgtcttctccatgctgcagtgttgactggcttgaccttgtgtgggtctcatttaggctctgcagcagtgagttcacaagtgagacagccttgacacatccaggacagtttcacagcatgt

SEQ ID NO: 23014 - DNA, 1732 bp, Mus musculus
tctagacttcctattcttttactacaggcttgacttgggagtagacgtgaactgactcgggtcaatttagaagcttgagctttcccacaaagccacgtgaggcacatgtggtgctaaggatacgctgtgtgttgttgagcctccattttctgccctctttgcaggttgcccgcctcatggagatgggattttccagaggggacgccttggaggccctgagggcctcaaacaatgacctcaatgtggccaccaacttcctgctgcagcactgacatccagccactgtatgacagtgatgtgcccgccaccacatcagcctgaggaccaagcagaccccagcacaggtgttctcaagaggagacggtggttcccaccatacactgtccttaaatccaagatggttgccgtgtagtatcaaataagtttgccattaaattagcatgtattttctatctttatttttttactgggcatttctcagtgtggagagccgtcattcttacgtgttcaaatgcatgacggttacaggtttcggtggctgttttatagcaccgcagagagagacaactgtcctgaagctcgagtgcagtctgctcatcctcacgtcagggaagggcggcaggccatgtgacctcagaaaggctgtgtcacactactctgtatggactgggttttttttctcttcagtttgtattcacatctcagtgacagagggagctggagatgagcctcctccagcctagagtctgccccaactcctgctttcagtacagataatccagtgctggtgtgaggttctagaatgccccgtgatgcctacctggggtcattttgctcagaatgcattacagtggccacttgggcaaaggagtgaattggaataaagaaaaaagttgcttcagagacttagtggggctgtgcagagagcaggcgctggccagcaatggctcagccccggcctgcccaccctgggccagcctgcagccctccatacaccaccagcccttctggcagcacaccttccctggccccatccttgccccttgtagtgggtgaggcagtgcccactgtgcagacagtcagggaggtgtaagcaggaggcagcccctgtgagcaagagcagctgtaggaattgacgactgtcccgtaagcaaactgcaccgggtgtattctgcacagtgagcagcaatgtgtcaaattgatgcaaatctaggtgtgtgatacttacaataaagtttttatgtgttttacttttcagtagtttttatacttctccaaataaaactttaggcaattccaccaaaaagaaaaatgaacccagacaacgtcttgagaaggccgaggcctgcacagtgagcactcccttcttttgccgcagtgcggtcaccgtgggcagtgctgactggggccctgaacagggttggagctgccctgcaggcccagtgtgagcacggtgaccagcttccttcactgacggggccaagggacactgctcctggaggtaggagtgtaaagtgaggcactctaagacccacccagtaccgctgtatggactccttgtctggagttcaagcctgggttcaagagggcaagggctctctgtaagtgtgatggcttggtagggtgtagacaagcttctacgctgagggctttatgcagatgctaacaggttagccttggttttcagaacagcaggtccagaccagaatgggaaaggagtggagaaaagttg

SEQ ID NO: 23015 - DNA, 1505 bp, Mus musculus
tttttgtaaggaatttaagtggttttcttcaaaacagctcacagagctgtattacattcctttcccacaagagtttaaaagaacttttaaaagttcttttaaaagaactggtcattttacatgtgggtttggttgttttatctcttaatgtaaagtaatgaacttgtgtgttttcttttataggaacaattggcttctttgcatgcttttggtttgttaccaaaatatacagtgtggtgaaagtggactgaagaagcccagtgtgtccagttaaaacagaaataaactaaatcttcatccacaaagacctgttttgtgactaccttgagttttctcagacttattggcctagtaatccttcagaaacaacatacttccaagtccacctctcccatgcacctgcacctacaagatgtgtttcaacactaaagcatttgtattgtgattggattaagtatatattcagttgttctcagtgaagagcagatttaaatattatgtgcatttgtaaatacgatagctataaacttttcaatacttctaatggcagattataggaggccataatactgatgaaagactggacagttgattgtaaataggattttctagactcggtaggtggaaagaattatttttctttgaaggaaataactttttatcatggtaattttgaaggatgattcctatgacatgttcattggggggaatgtggcttttaaaaatcttgtattggttataattgttcatatcttcttacttttctgtgttgacttcattattcccatggtattggccttttaaactatgtgcctctgagtctttgaatttataaatttgttatcttaataaatattgtaaaaatgtcttcattgtatcactccctgcatattgaagaaaactctgtgaatacaaatgtgttggccactatactattttattggatgatattgaatactgtggatacacactttctgtttccacttaagtgaaactgtcgggctttgtcaagtctgaattttcactctgaaggaatgataaaaattgtagtcatgcctgtctggtcagataaatgacacatttagaacttaaatgcaggccttatattgttactattaaaaatttacactgtagacttacgttccaaagtgtagtaattttttaagtcagcagggtataggagcacacctttgtaatacctctaatttggaaggtgaggcgtaaggatgatgtgtgtccctctgggctgcacagtgaattggaggcccccctggattacagactcaaccctgtccttgcacacagcatgagttaggctctctggtctgcacattagcatttgttacctcatgattgcagtgggtttcacaaataattcttgtcctagattaggagctcactaataactttcttacatctggcaagtttgaaccagttcatatggaaagctgacagatgacagtggtgtcagacagatcttcatcaaaacaccttttattgatggc

SEQ ID NO: 23016 - DNA, 1156 bp, Mus musculus
gattggtcctgtctgttcaaggaagctcccatcaaaatccaaaaggccagggtttggagagcatccaggttgctaaactcatgcagctttctgtaaggaggtgtgcttagagagggcatagaagcttccacccctcatccatgccctgccctgtgtatccttctatctggctgttcatctgtatcctttcgaaggtctctgattgtaatcagtttccttgagttctgtgagccctcctagcaaatgaactggacctaaagagtggagtcttaggaacctctgacttatggtccgtcaatcagaaacacaaggaaaacacctacagcttttgcttacatcttaagtaagggcagacatgagggactgggccctaattgtgtgggcctggtacttactctctccagctgtaaaatgtcagagctgagtgaaaggatatctaggtggtgtctgcatttcctgggtatgtggagagcagccctccccacagaaagctgcgtgagcctacgggagaatggggaccctctggtcatttgcttactgttgagtttgctgttagtgtatatcagctacagtctgtcatcagatctggattttggaaatattttcttccagtctgtggctttccccagcattctctttagactatttcaaaggggagatatttctaatctgtgggtcctgagagtttccccttcccctgttctttcttttggaaggtaaatgctgctgtgtatgcatctcagatctatgacccctccagctgttctagtcagtttgttgaggaacctgtccttgcttcttcatccagcagcagttggtagcatctgtaggtctttatgggctgtatgacaatgttcccactgctttgcaggcactctctttatgaccgtcttgtctgctgtattgtgatggctctcctgggcctttcacttttctaggtaaacttcagaattagttcgttaattccacaggctaatttactgggatttgatcagtatttcattgagtccatacagtgagtcagaggaattaacattttaagaatcttgagccgggagtggtggcacacccctttaatcccagcattcactccggaggcagaggcaggaggatctctgagttcgaggccagcctggtctacaaagtgagttccagg

SEQ ID NO: 23017 - DNA, 1129 bp, Mus musculus
tgtgtgtgagcgtgcgcatgctcgagaattttcttctttgccccttcacaaagggacatttacataataatgtgtatttgctagccccgatggtgccttttcatgacaactgaccaccacttcctgataatttaggctccatctcctgcttccagagtcccaccttattatttctactcatttataaaataactaataaaagcctccacaatctcaggcatgttcaagaatgtatggggtctactcggtttctactactactggtgctggcttaaatatgttgtcttcacttaagcgtaagacctgagcctctaaatggagtgttcaagtgcttctgcctgagccttgatgccgtgttttctatgttaaatgtagaaggcctgtttaagatagattgtaaatttaccttagtgtatatttcagagcatttattgtaccagccctgctgatatcccttgagccctgttccgggtgtctctatggttggagagttacagagttagaactatggttggccaaggttacagaaactgttttcagaaccacactccagtgggctggggacactcttcctgagcagtgggtattatagcccaggtttaagcactgacacgttccctcccctcagggagaaaaagaaaattttattttaatacaaggctttccaggagacattcgtgtgtcccacagctaagtgtattttattacagtaggcattcaggcactttctgcctctcccaaaatgagggtcttcccaccccccaccccccgcccccaggtccaaccaaaccccaaagcactagatcaggacatctttgaggacagatgtcacaagaccagcttatgccattcctaagaagtgagctattccctaccccccacccccactcgcagcttcctggacacttgttatagtgttatctttgggctgacactctccaagtgattgcacaaaggaggtaaatctgctaggggcccctgtgatccgctttcctctcccaaacgcaactacgagtgattgtattggaaattgttccagtccactagacatatatgccattccacacttcttccctatattcctgccttcctgcgtattggaatagttacttttctgggagacagtttc

SEQ ID NO: 23018 - DNA, 1168 bp, Mus musculus
gaatctctcatagtcagcccaggctggctttgaacttgctacgtagttgaggatgaactgaactcattctcctgcctcagctgctcaagtgctcggatacaggcacggaccaccatgcctgtttagttcacacattgttcataccactcattctttgactgtgggcatgtttgcctctctgcgtgcatgcgtggatatgtgtgcctctgcgccttacagattataaattcagttctggaaagaaacactgataccatgccacacgagcacacttttgaagaaaaggtgcctgcatctgttttccacagcatagatgctcttgatgagaagacagactccggaggggatttgtcttttatagacaaagctgaggcagggcatctcttgtattatacaataccaggcaatcaattggtaggtaagcccaagctcccaccgtgtcatgcttccagtaatactttaggagacccaggaggtcatcagaaaagcagctgcttagatgactagagctagaggaggccctcagcagcactgaaattgtgtagtatatgttgagttgtatgtatttaacttgaattaatttgccgcatgtgtctggtggccatattggatggtacagcttttgttcataggtacaaattacttatgagctacaagctttttcaattaaggtaattttaattaaatttacttcatgccagattatttatcatctctgatataagtagtgaataactgagtgtatcctgactgcatatgaagtgcacatgagtgaccctgactgcatatgaaatgcacatgagtgatcctgtctgcacatgaaatgtacatgagtgaccctgactacacatgtagtgcacatgagtgaccctgactatacatgaaatgcacatgagtgaccctgactgcacatgtagcaccatgagtgatcctgactgcacatgaaatgcacatgagtgaccctgactgcacatgtagcaccatgagtgatcctgactgcacatgaaatgcacatgagtgaccctgactgcacatgtagcaccatgagtgatcctgactgcacatgaaatgtacatgagtgaccctgactgcacatgtagcaccatgagtgatcctgactgcacatgaaatgcacatgagtgactctgactgcacatgtagtgcacat

SEQ ID NO: 23019 - DNA, 1157 bp, Mus musculus
tacatacatgtataacaatgttcttatagagtccagcacacgtataatggagacatacatacatacatacatacacgcacaggtgtacacacacacagagggagagagagagggagggagagagagagaaagagagagagagagagagaagaagagaagagaagagaagagaagagaagagaagagaagagaagagaagagaagagaagagaagagaagagaagagaagagaaccacagatggttaatgtggtaagagatgagaataagctacaaaatccatacacagcaccgggcaagagaaagaaaccagcagtcagttctaaagacgtttgaaaaggtagagaagggcctagaagaacttctctgtgaggtgggggtaagtagagcaggcagggtgatctaagatgtcaggctgtgtcaagaagacagtagtccaagatagagggctctactagctgaattctttagatggacagtgtttgtgtccaggggagtacagaggggctggccaatgggtgaggtcagaaaagacagccaggcagaaactttcaagaggacgcctgtgctgaggctcagcagagggcaaaacagctagagatgtaggtcatgagagtcttgtctctaaggagcctaaggagcgtgtttgtatgatgatccaagtgacctgagcagacagaggcagacagaggtgtaagagccaagggagttgaagcaagaaaggacattaaatgagtaatgtccatgtgtcatgtgggatcagagcccatgtcaaagactggctacaacttaaaacatattttttcatttctttctttctttttttttttttcttttttttttttttttttttgaggtaaggtcacatttagctggtttcaagctcactgtgtaactgagggtgactttgaaaccctaatccacctgcctacatgtcccaagaactgggattatagtcagatagcaccatttatgtgatgttggggtcagaagccagaacttcctttatggtggtaggcaagttttctaccaaccaaaatacatctttaattggagtgaaatctcagaacaatggggctggagagatggttcaatggtcaagagcactagctgctctcccagaggatctgggctcgattcccagcacccacatggcag

SEQ ID NO: 23020 - DNA, 2366 bp, Mus musculus
gagtggaaaaattgagatatacactgccaatacaatttgtgtgtgtgtgtgtgtgtgtgtgtgtgtgtgtgtgtgtgtgtattaaaggggggaaaaagaatattaagtcagaacttaatacatcaaccaggacccctccatgtcccagagtgcctctcagaggcctttgacaccataatgagggctgcttttgagccttctggtagagacttaattctgcaaaggcttcttgattgtaaaacacacacttgctgcattgacaacagatcctggactgtacctgtatccaaaagtctttgtataacaatcaaacaaacaactttggtttctaatactttatcactttaactccgctgcttttattatcaatctcaatgtaacctgatatttttatacaggattgttccttcagtatcttgtgtgattttaaaaaaagcaaaaacaaaaaccaaaagtcaagccaagtgcagccaccttaagatagctccatataccctgctactgtgattgttcaagcagaaatggagagaagctactgagacagacaactgggaaactgtgatcttttataaaccagaagtaattcaagtgctttctctgtcctctgctggtttgtgttttgattttaaatagggaatttcagatgctgcctcctggctgtatccaaacttgttgagtagtaaggagttatggttttgaccataagttctttgggatgccaataggcacagtgatgtctgaggaagtgttagggtacatcctgtccatttttaaaagatttaaaaaacaaaagacaaaaaaaaacaaaaacaaaaacaaaaaaaatcaaaaaaaccaggccaactcctcttttatactactgtattgacttttttttaaataaaaaaaaaaaaggtctttatttttaaatgcatttcctttcatctgtgccacaaggactgaatcttccgtttataatgacatgtgaagtgtatggtttattttacaagaggaggagttgctgtacatgttaaaatttttaaaaggtttatagttaaccaccaaatgctgatgaatgtgtgacctttgccagagctgtcaagccaggacacaaagggtcaaggacctaggacaataactcttagtcagtttatgttcggttggtacaacacatctcctgtgcaaactgtagtccatcagaaacaccatacacatatgctaaaggtactaatttatcctcagagaccctgaagacaccccctcccccatgatttgtagaaatttgttttgtgtgctgtgagtggttaatgtagtcttgtccttgttaataacttgtctgtgaatacttttatttgtacagtttttaattaatttatttttggagatctttttctggaagagttcaaagcacaccaaagaaatatattatacattttggcgaaagattgtcatttatgatccattgtttatttaagaaaaaagaaaaggaaaagaaagtgggaaaatataaaaatatatttttaagcttacttgaatggacaaggtaatgtgaaaactcgactcttcctgcacgtctttttgcctcgtgttatgagattatgtatagtttataggtatattagtacagtgcatggtgctgttacgtggacaccttttaatgttgtcttcagattgttacagtaaataggaaacatgcagaccttcctttacaaagagagagacctacaacttgaatataaaataatcctacattttaaaggtttatttgatttttttttcctgttattcactttcaaatagaaaagataaagtatgaacttgggtgggataacttatgtactgtaagcttgttaggacaaagtattcctgatgtataatgagttgttttatttatacaactttttcaatggtagtttgcactattctttatcatgctacaggtttatttattatgaaacaaaggaatatgtattttatgtattttgccatgaataggttaactctgccacaaatttattggttcctgatacactgaaaataaaaccttaaaatgtgtacctcccttagaaagaagtcaagaatggtgatggacaaatgtaataaaggtattcttcctatgtattgctacattttatccaaggcacatctctgtcattcttttaaaacagaacagttgcaaaaggagtgaacctgcctttccctgatctattatgagcttctgaagaagggacaggtgggagtgggtggggtagcttggattacttaccatctaatctgaagcagtgagtctcagctttcctaatgctgagactctttaacacagttcctcgtgttggggtgacccccaaccataaaattactttgttgctactttgtaagtgtagttt

SEQ ID NO: 23021 - DNA, 1551 bp, Mus musculus
ggtgtccgcagtgcaccgaggcgcgggttctggcagcagcggctccggagggggctcggcggccggcagcggtgggggcggcggcggggcgggcggcgggggcggcggcagctctggcgggggcagcgggacaaccggaggccatagcggcctctcctccaacttcaatgaatggtacgtgtgaggggccaggcctttctcccattccctgttcccttatccaccgtcgccctcccaaaacccatcgagggcaccttaggatcgtcttattaaaattatgaatctgatttttatggtgaaaaaaaaaagattttaccagcagaaggatttttttaactgttttttttttttttttttaagaaaacaatctaggcatgaaaagcaaaatctctctgtatgtctgaaactgaaaacataaaaaaaaattaagaaagtaaatcccacaaaaatatcgagccaaacttccctagcccactttccttcccacatgcttcctagtctttttgacaaactgtacatagcggacgccttccttttccacggtgattttaatggcttattggcttattggtggatagaagtttgtccatttgtaaactcccggattgcgttccctcccgcctttctcccatttcccttccccaagtgatgggccttttctttttccttttagtttcccggtttctttctttcttttatttttttaaagtaatgtggaagaaaatggtttattttgtattgtggtattaaatattgtgttccttttaaatgaggcaacttgattgtaaacttcatgcgactatagactggaaaatatgagccgtgccaaagtctcccttctgtttcttcaacataccaacccatagcacacatcaccaacaccaccaacgcttgtgaatgtattttttctgttagctgggtttacatgtgatgtttcagtgcttttgcgacgttcgatttgttagttcttgtatgaaagattggggggtgggtgggtgggagtaaacgttgtgccgttagcttttttccgaaataacacccttctgtaaatatccgttgccatatttatccatttgtaattaaattatggtattaacttgctacagaggaaacaatatttataaagaatgtttcttaactataaatatgtacaattgtgggcataaactgtttcagattttttatttgaaggtttaagtggtttgatcatttcttgtgatgttttgagagtaatgcatacagaaatataataaaatgtgttgaaactgcatgaacatactttttccccccctagcagagttattgaagagaatgggaaggagtcagcttgaggcatgacgagggtatggattgggggaggggggaagtgccaccttgcattctttggaggaaggtctatttatgcatagagaatgggctaaactgcccctttggcagaaagtctcaaaattattttctacatccttttgttgggtagctgaggatgaattaaatttttggaaagcccctgtgaggaatggcggcaggaaccttcagagtgtctaatggctc

SEQ ID NO: 23022 - DNA, 1226 bp, Mus musculus
accaccaaatgtgacttcactgcttcgtttacaccatctcatcatcagagccttagagatgtggatgttatacatgtttcactgcaaagtgtgtttgtgcttgaccgcagtaacaaaagatagtttcttttaaatttacgcaccttaatctatttcagtattgtccttgctagacaagtcggggaagggtccattaaaaactacatggtgttatttgggaagagtatattcactaatcaaggaatagattagatctaatcttttgactttattgatgcaatgattttcctatgtgctggctgctaagtactttgctctgtgctgccagccaactcccctctactgatgactttatccttgctaaatatcttttctaaattgatagcaagaaacaaagagcagtctttattgttatgtccagtaaggtgcttttcgtggaaaatctaaaaatagccgaacttgtaaatactttttcatcttccagaatccttactctgggtttgggatttcttgtgatcccctttcttcctgcaagcaacttgtttttccgagtgggctttgtggtcgcagaacgtgtcctctaccttcccagcgctgggtactgcgtgctgctgacctttggatttggagctctgagcagacacactaagaaaaaggtaccatagggctggggcagtgatgcagtgggtaagagagcttgctgtgcgagtgaaggctgagttcaaaccatagcactgatgtaaactgcctggcatggctttgcatgcctataacccccaagcttgagggctccaagctagggagatcctggaaactcattgtcctgccagctttgcgttctaaggcctagagtgagaatggaagacacgtgacatcctcctgtggcctctgcatggacacaggtgtgtgtttacatctgtgcacccatgtgcgtgcaccacacatatgtacataccaaaaagaaaaacctagaatgctgcctcagaaaaccatagcaccacatgttactaatgacctctgccaactctattcagaaacctgttgccgccatcatcctgggcatccttctcatcaatgcactgagatgtgtgatacgcagtggtgagtggcggagtgaagagcagctctttcgaagcgccctgtctgtgtgtcccctcaatgctaaggtaccttgcccaccagattacatttttaatcttccagtagataagaacatacaccatgga

SEQ ID NO: 23023 - DNA, 1157 bp, Mus musculus
ttagagaaaggactggaggagctgaaggggtttgcaacccataggaagaacaacaatatcaaccaaccagactccccaagagctcccaggaactaaaccaccaaccaaagagtacacatggagggccccataactccagccacatatgtagcagagtatggccttgtccaacatcaatgggaggagaagcccttggtctggggaaggctcaatgtcccagtgtaggggaatgccagggcagggaggtgagagtgggtgggtgggtgggtgagcaccctcatagaagcagggggagggaggatgggataggagagttcagggggcgggaaaggagataatatttgaaatgtaaataaataaagtatccaatagaaaaagaaaaaaaagaaaagaaataaaaagaaatgttcaatgactttagtcatggggggttgtagtctcccctcccctagcctgaaacctgcttgctcaggggtggagcttcctgctcattcgttctgccacgcccactgctggaacctgcggagccacacacgtgcgcctttctactggaccagagattattcggcgggaatcgggtcccctcccccttccttcataactagtgtcgcaacaataaaatttgagccttgatcagagtaactgtcttgactacattcttttctctcgccacctagcccctcttctcttccaggtttccaaaatgcctttccaggatagaacccaggttgtggtctgctggccggacacaacagggggtgaggggagaagtggtatagtaggcacaggcatgccacctgatttcatctactttgacagaattgctaaagtgagtcaataataatgatcaaaatctgtctgaacctataaatatgcacatttcaagataaaaatatatcaataaagtttggggctaagtctttcatgactacctaacaaacatgtgcagacatgttttacatgtaaaatgctcctcacaggttcatcacatgttgaacacttttcccaagctggtggtgcagtttgaggaggtgtggggaaactttaggaggtggggtacaaccagaggaagcagatcactcaggaacagatcttgaggtttacaacctggctccactcccagtctcctgctttcctgacctgcccaggtgtgaacc

SEQ ID NO: 23024 - DNA, 1183 bp, Mus musculus
gccaggaagtgggagtgggtgggttggggagcagggctgggaagggtataggggactttcagaatagcatttgaaatgtaaatgaaggctccttctctcagctggtctgctggagaccccctgagcgccatttccattccgactctatgaaagaaaggatcatgaaccaggagaaactctccaaactgcaggcacaagtgcgcattggtggaaaaggaactgctcgtagaaagaagaaggtggttcacagaaaagccacagcagccgataaaaaactgcagttctccttaaagaagttaggggtaaacaatatctctggtattgaaggggtgaacatgtttacaaaccaaggaacagtgatctattttaacaaccctaaagttcaggtatctctggcagcaaacaccttcaccattacatgccacgctgagacaaagccgctaacagaaaccagctgcgtgcagacagtctgactagtttaaggagactggctgaagctctgcccaatctgtggatggagaagcaccacttgctactggagaggatgatgatgatgaagttccagatctggtggagaattttgatgaggcttctaagaatgaggcaaactgaattgaagcaacttctgaagaaggtgatacttgcagaaattacaggagctgctattttatatcatgactgctttttaaaattcttttgtttattatgaatctgataaaatctagatccctaatatttttaagcccaagccccccaccccacccccaccccccggacactgcagctcttttcagttttcgattatatctaattcattctttgcggcaaataaagctgaagaatcctgagaatacagtttggaaagggttaataaaattctttgcctagttaaaaaaaaaagaaagaaatgtaaatgaagaaaatatctaataaaaaatgttaaaaaataaaaatagaaggtctgtaagctacaaacttgagctaacaataggtccttaaggactatgaatatgaccttacaggggattgtgggaatctagtttctgcttctgattttaaatggcttgctgactataaagtatgtggcttcactcaatcatatgctctgaccatatgttgtctattgttgatttaaaatcaataacattaaccagtcagggactggaactccagcattataagc

SEQ ID NO: 23025 - DNA, 1843 bp, Mus musculus
gagcagttactctcagcagaacacctatgggcagccgagcagctatggacagcagcgtagctatatggtcaacaaagcagatatgggtagcagcctcctactagttacccccctcagactggatcctacagccaggctccaagtcattatagccaacagagcagcagctaggggcagcagagttcattccaacaggaccactccagtagcatgggtgtttatgggcaagagtctggaggattttccggaccaggagaaaaccggagcttaagtggccctgataaccggggcaggggaagaggggaatttgatcgtgggggcatgagcagaggtgggtggggaggaagcaagttggaatgggcgctggagagcaaggtggcttcaataagcctgatggacccatggatgaaggaccagatcttgatctaggccttcctatagatcccgatgaagactctgacaacagtgcaatttatgtgcaaggattaaatgacaatgtgactctggatgatctggtagacttctttaagcagtgtggggttgtcaagatgaacaagagaactggacaactcatgatccatatctacatggataaggagacaggaaggcctaaaggtgatgccacagtgtcttatgaagatccaccaactgccaaggctgccgtggaatggtttgatgggaaagattttcaaggaagcaaacttaaagtttctcttgcccgaaagaagcctccaatgaacagcacggggggtggcatgccaccacgtgagggcagagggataccaccaccacttcgtggaggtcctggtggcccaggaggccctggaggacccatgggtcacatgggaggccgtggaggagacagagggggcttccctccaagagggcccggaggctccagaagaaacccctctggcggaggaaatgtccagcatcgagctggagactggcagtgtccaattccggactgtagaaaccagaacttcgcttggagaacagaatgcaaccagtgtaaggcccctaagcccgagggcttccacccgcgatcgtggacgaggtgagggggaagaggactcatggaccgtggtagtcctggaggaatgttcagaggtggcagaggtggagacaaaggaggcttccgaggtggccgtggaatggaccaaggttggtggaggaagacgaggtgatcctggaacaggtgggaggaagaagaggtggacgtggaggacctgggaaaatggataaaggcgagcaccatcaggaacgcagagaccggccctactagagacctgcagagctgcattgacgaccagatttattttttaaaccagaaaatgttttaaatatataattccatatttataatgttggcgacaacattatgattattccttgtctgtactttagtatttcaccatgtgtgaagaaacattaaaacaagttaaatagtagtgtgctgcgttttttttttttttttttttttggttttgttttgttttgaattttgttttgttttgtttttttgtttttcctttttactatggttgttttaagacttaacaatgggaaccccttgtgagcatgctcagtaccattgtggagaaccaagagggcctctaattgtaacaatgttcatggttgtaattttttttttaaataaaattccaaatgttaaaaaaaattaaggttaaagcaggaggttctcaagttccagaccagcctgtgctacatagtgaaatcttgtctcaagagagagaaggcagccgggggagctgaaaaccatatgtggaaaataaactatgatacagaaattatatcattcggtatctaaagtatcaatgga

SEQ ID NO: 23026 - DNA, 1182 bp, Mus musculus
actaaattatttaaaacaaggcatacctctccccaactcagtctaaagacacaatttcattttgagaatgtttacagcccatttaattaatcagtgaactaaaagtcatagaaattggatttgtgcaaatgtagagaaatctaccatattggcttccaaaatttaaaaattttatgccacagaacatttcatccaaatcagatttgtacaatagggcacctgaaaagtgactgcagcctttggttaatatgtctttctttttcctttttccagtgttctagttacattaatgagaacagaaacataaactatgacctaggggtttctgttggatagcttgtaattaagaacggagaaagaacaacaaagacatattttccagttttttttttctttacttaaactctgaaaacaacagaaactttgtcttcctactcttacattctaaaccgatgaaatctttaacagattacactttaaatatctactcatcattttctctctcagagtcctagcttgagttgcactgcatgtatctgtgcatcttgttctcttcatttaatgctgtactgttctgctgagctctgagggactatcttgagagatgtaatggaaggaaagcgtggtgttaatctgcgtactgcttaagacagtatttccataatcaatgatggtttcatagagaaactaagtcctatgaacctgacctcttttatggctaatacgactaagcaagaatggagtacagaattaagtggctacagtacacacttatcaaaataaatgcaattttaaaacctttcaagtgtgtgtctttattgttcagcatgctcacattgaaaatagaagtgatttttttaatgccttaaaaaaaaaaaaaaccaaaaccctaagttgtaactaatgcattaagtgctctgctcaaaaccgtcttcgcatgaggcgggtatctttgcaggctgcaaggcgctgctctaggtctcggatagtgttctgcagacttgcaatttctttgctcttttcttcctgaagatgctgaagcttctaaatgaagcagaaataagtctgtcacagcaacttagaggtaaggttaggtatagtgaaccacaaaacaacaatcacaacacttgtattttaacagactagcttactctgaaaggcctgccctctcatttttgtgtg

SEQ ID NO: 23027 - DNA, 2341 bp, Mus musculus
tttagtggatcataatcagttaatcaagtgcttccactccctttcccaaatgcacttatgttttacaaccatagtaccgttgtagacgtcattattgctggactggtctttgtggccagataaattactttacttgtatgacgtacctttaggaatactgtgtctaaaggcttttttcagccctttccagtagaaattagatgttcctttattttctcgcttcctttcacatgtcaccacagtacaatgtgttgtaattttttttcttactactgaacgaactccatatcttaaaattttatctttgcacacactgttcattgcatggtaggtagtaatgtcttctgaattaatgaggcatgatttgaaatgccaaactttgcacaagacggttgctgctattgcattccaaactgccatgccctctataccagtggttgatatagcaaaagggagcatgtcttcctcggaggagtcaagtgttacctggacactaaacctgagaaaataagactgtcttcacaagctgagaacttccatttttgcctttatgacctttgggggctcactggttgatacaattatgagggtatttctgggtgctttttgtacaatttactcccctaccccaaacaattggagagcaatttatagaccataatagttgtagtactttctactgtggtgttataaaaggaaaatacatcttttggtattaatcttgatgagtaaattgttttatttagaatgaagtaacctcaaaataacaaatactccacataacaataagcctataatagaccctttcaatagctaatatgtgcctacaacatgccatattttgtcctaggcactgaggatataaacaccctcctgttacaggcttttagtggaggaagaatgtacagtatgccaagtgataacacacttagcagggtgtaggggactattgtgacgtggagatggtgctattgtatttagagtggttagaaagatccatctaagcactgtcttcaatttccatcctgttttttctgatgccttgtgtatgcagtacatctgaagattttcctaaggaagtggctcttaaaacctccttttattgaatctaatggctttctcattcgtggtgtttctgatgcctacagcctaaaggtcttgggttctttattcacttgaggtggttttctgtccaccgcccagttcccttttctatcttctatacggttattacatctttccacagaaaccaaaactctgtactgtctttagtattacttccctattattttaaacacagtatgaagtagcattgtatggaaacattacagtaagaggtacttaatatagacacagcgtatgtattatatcatgctggtgtttggtagcttttgctttcctgcgtctagtgaaaatttatcttcggtttgaattctctgctgttgattaaatgtaaaatgttacaggattttcccacaatccttaaacgtttatcactctttactcagtgtgagttttctgatgtggagtagactttaagacttgatttaagagcctgtctctcttgctatgtttataggctgtctggctgctgtgcattatttcatgttaagtcacatatcatgacatccccttatcctttgcttacagtggaaaaaggtgaaagtcatgactaagaggccaccataaaagatacattcccagcctcacaatcttgtgctcagtcttgtgatgttcattaaagtatgaactgtgtctgaaggtgttttccagttatcttcatgacattttaaatacccaccgctactaacttggtctgcttgtagattgcttgtctcctggggcccctttataactccatgaggatatttcatctgtcacagagtccaggattcaatagtcctctagtattacttacccttcattcatttactataaaaggaaatagattataaaagtattatgtctacataagcttaagatagccaggattaaaagtattcattatgtactatgccggtgtttcctagttttgtttttgcaaattttagtgacatgttccagctacagtgttttggaacatatacttaataaaataaaacgaaacccccctacttgtttcttactttcttttatattttattcttgcatcacttttctgtcctaatttatgaataccttctttctggtcctagtaactttcaaagagagtagcataatgattcagattgtgagttcttgaactagaaggcctgaggtaaatcacaaccctgtcatttcctaactggaactgtgtcaattgctaagtctttctgtctttaaatagtatatatttttaatt

SEQ ID NO: 23028 - DNA, 1182 bp, Mus musculus
tggccttctccaagctagtaagtggtatgacaaaggtttattgtcagagcttttattagtgttgtaagaactgaattctaaatgtccttcccaggagtctttagtgacatccatgtgctggctatgatgtacagtggagagatgtgctactgggggttaaagcactgcacagatcagcagtcagaaaaccatgaagttgatactgatgtttttggagcaagctgcaccacacacaaagaaaccttggatttccgagaagtaggagaaaaaattttgaagaagtatgtgtcggtgtgtgaaggacctctgaaggagcaagagtggaacaccgcaaacgcaaagcaaatcttaagtttctttcagcagcgctgtagctaggtgttcatctaggtctcaactcaaatacataaagatgctgaagtggggaagaaggctttgacaaaggagatgtactacactgatcttgagacggttacactacataaaggtgcccagtgcactacgcttctctaatgctgtcacctttccctgagtggtcttaggtctgtgaagaatattctctaatttctagaatggcatatatgccattctaactgaacttgaactacatataaacctgccactggtaaggaggaacccaatgtagatggacagttgttttctaatattttaggttatattttttattgtactaaaatatatgtaacacagaatctccttattttgaagtatgcatacttcaaagatggaaatcaggttttctccttgtttcaaatataaagtatagctataaatgtaggcaattagaatattgtgactaatatttagatttcatttccagtaattaaacaacaaaggatttaaaagatgaaacttatttattttgccatgcattactaataatacttaatttacttatccattttataaattattttattttatttaaaacaaaaactgcatggttactccaaaaagaaggtaaattcagtatagatgagaccaccattagttcagatgcttgtagggcacatctttgcatataatgaactttacacatattttgcctttcagtaagactgaaatgctgaaggccaaagagcctagtttgctgtcttgctcacctttctctgcctacctcaagtcttccgatgcactagacttctgtcccagtgacatctt

SEQ ID NO: 23029 - DNA, 1943 bp, Mus musculus
cccaggctgccaagattgcattttcaacacataggatttaaacggaaggatgtcagtaatcaatagttacattacacatttagcaagaagtttcggctagttttcttctagtatttctggatttgtgcagccatagacattgttctctccatcgtgatatatcagttccgtgggaaaaaaaaaaaaaaaaaggaaaacattttattgtggtcttgcttcatgagtgctaagaaggttgtctttatcattgttgctcacagtggatatatgctcatcttttatgctatatgtattaaacctcgacttagccctgaaggtgaattttcatgtgcatttgtgatttggtagaatacttttttgatgactatgtatcttttaccttcctctgttttgagagatgccagttatgcttgctttcttagaaagtcctccttccctccacacttcttatagctaaatagatactcgaaaaagcgaacaggaatgtccctgtgaaaagtaagtagaagaaaggacaaggcatatgctctgctggtgctgacatcccactaaatgttgcctttaaagacaaccaaccgtctacctatggtgtgctatacctttgtattctgaagactgtttttctgtattgatcaccaatgtttacttatacatctcttgagcaaaaaaagaaccatgggcaattgatcatgagtcctgaatcatagtgacagcagtatttaaagagatgatattccaagatatctcccctttagcctctccattctgctcagcaaagattgtaaacactgagttacttttttacactacagtggtattctgcataggttagttctcttcacaaagggctactgctttagccttatctgtgctggggaaatgatgggaaaggctcagatctgagtggctagcagggtttgtgtggcagagtgaatgcagtagcttgcattcatcagggatgcttcctcagaagtagccacaatacagacagttgccagggggcatcactccagaagcttccttgccttggtatcagatatctgaaaacctaggcaccctgaagccagactggacagctggcgtctgcacagtgaaacgtatcgtctttctggcactaattagaggaatttatacacgtcttaggtgatggttggcactggaactcactcctcaagcataaccacagttagcttgcacatgttgtgaaggggagataagcttttcctccatagtacaccctctaggtaggactgctttagtggatggccacgtggctgaaagcatcctctgccagtgttggtaagaagaacccgtcttagatggtacaaggcccaggagagtacgtatgttagagcacacatttgagaaatcatcttgctgatattgatatgtcttcaggcgcacttgcttatcattccggtctgttactttaacgcaaggggcttctaagaatgtcttaaacttcaaagcctgaatagacaactttctaagagtgccatgatattttttaaaaaatgtgttaaatgacacaataaaaattgcaagttgatggagacgaatgtgtgtgtcctcttatttgggaatggtgcgtgagaaacacctcaaaggttgattctaacaaccattggtcattaggtcagcaggcttctacttctaccacgttgttaccgtctctgtctctttcttttgtggggagggagtgtggagacagggtctctctgagcagtcctagctgtcaaggaacccattctacagacagactggccttgaactcacagaggtccacatgcttctgcttcctgagttccagcatcaaaggcaccaccatgcctggcattagatttgctttttaccttacctaatacatatatttctttttctagaaagtgaaagaaatattacttaattgaattctgctctacctttcgccccatcactgagac

SEQ ID NO: 23030 - DNA, 1407 bp, Mus musculus
tgccattacaagatggcgctgacagctgtgttctaagtagtaaacataatctgcacacgtgcaggggcagttttcccgccatgtgttctgcctttctcgtgacgacaactgggccgatgggctgcagccaatcagggagtaatacgtcctaggcggaggataattctccttaaaagggacggggttttgccattctttctcttgctttcttgttcttgttctttttcttgctttctttctctctcttgctctggctcttgcttcttactcctgaagatgtaagcaataaagctcttgcgctcttgcgctcttgccctcgctcttgctctcttgcactcttgctctctggctcctgaagatgtaagcaataaagctttgccgcagaagattccggtttgctgcgttcttcctggccggtcgcgagaacgcgtgtaagagagtctcaaggttttctgcgtggagacatctaatgtagcaggtcttcttctcttgagtaggccttctggagctgctttttcgctcgctgtctcactcactggagcaccttgagcctagagaacaaaggctgggaaagctactatgttacaggactctctgacttggcagaagaaatagtcaaaagctgcgaggactgtgctatgacgaggtagaatttctaaaagaaatcttcccaaggtaatggacctgcctttgttgcccaggtaaatcagggactggccaagatattagagatcggttagaagttacattgtgcatgcaggccccaaagctcaggacaggtagagagaacgaatagaaccattaagggacccttaccaaattgacagcggagactggcgctatgattagatagctctcctaccctttatgctcttcagggatagaaacacccctggacagtttagactgaccccccatataaattactctacagggggcccccctccactggtaaaaatagcctttgtacatggtgcctctcttctttggaacgattcccatctgctaagagctgttgctgacctttggaggaagcgctttaactgtttctgtcttggctatggaaaaataattctcaaagttgctccatgtttgtttcttgggtcgctaagcacctagtacttacaaggttctcattgtaagcacacgaaacagtcaagagaacaaaagagaacgtagttcccaagtcagacctagaaacagcagaggtagcagtgttaaaggccaccatctgcccaccatctgtcagcttgtgactctgataaactgctacgtatattgactcttagtgagaatttttaaaaataagtttggtattttttagttgaaaataatcatgcatatttatcaaaaatacagaatgatatttaatccatatagcaccaccatgaccttatctttccctta

SEQ ID NO: 23031 - DNA, 2693 bp, Mus musculus
cggccacatcaaaacgaacctgggaaggctggctttcccggatcgggatcccagtcccagcactgcacaaccgccaggggcgccgccacgcactgggtgtctgactcccctcgagccccgggaccggaaaccagacggactgccaacaccgcagcagccccgacaccgccagaaaccctctccaaccaggaggcgggccgctggggagggcggagccacagcgccaggcacgccccctaccggtgttgcagcccaatcggctccctggctctctcgcccgggagactacacctccgcacccgaggcctgatagggctgcaccaagacccgccggaagtagtttcctgggcggaagcttatccacaggaagtggcgggggtgctttctcttccggtctctttggcctcgccggtagaagcaagatggtgagtgtggtttctgggctctgtaaatctctctccatccttcttcctcgggctgtcctgcctgttgcccggcgcgtcggtgacaaggttgcgagtgaggggagctgatgggcgaggagacggcgtgctgtggtccgcaggaactggaaggatggctgctgtgtgcagagcccggcccacggtcctagcgccgctgtgggtctctctgggctttggaggagacgtacgcactgcagccccgggtgggtgatcaggacaggcttggggacatctgtccccagccgccgagaaaccggctgcttggtgggcagtaccgcgactgagagacgggcagaatgttgtccttaacgcctaaagccaaggaggcttaggtccgcgcagagtaaggcattataatggtcgtgtggatagccggtagtgcttcctacctaccctacctgtgtgctaagatttaaatctttacaccgttttgtcccgtgtggatcttgtttacgtctcatccatactcattgctaagaaaatgccagagtacattgagaagtcagatttcagagttgcttatatgtggggttttttttcctgctttttcttttaatgtgcagacgaagggaacgtcatcctttggtaagcgtcgcaacaagacgcacacgctgtgccgccgctgtggctccaaggcctaccaccttcagaagtcgacttgtggcaagtgtggctaccctgccaagcgcaagaggaagtgtaagtactgtaatccgcaggcgggcttttaccttgacctgaggtagcgatgtaatagaaaacacatttggcacgcaacaactttggaggttggtttgttggctgagtggttaaaacatagtaatgacactactgagaaaatgggctgacactgggtgcttgggaaaaccatttggaatcctattttttttattagataactggagtgccaaggctaagagacgaaacactaccgggactggtcggatgaggcacctaaagattgtctaccgcagattcaggtacagttttggctaaatgtcattggtcctccagggtaggatgaaactttgcactcttactgaagggtaggaatgatactggggtttggtgtgggcctgagacgcccacatttgtcaagactatgagtgggatctggggggcagcttacttggatctgcctccagactttgctcaagtctgctaagctgttctgggtgccagtcataacatagatgggtatctttttactggaggctaggccttgatgttccttaaaagtacagaatccccagcccccctcttagactttcctgtggggtctgtgctttgacaggtgcttttgtgtttgtctctgttttaaactcagtccagttttgtgaacttgatgtgtagtggcttgctagtgtttgataggctagtggcatgttttgagcctgattaacctttatgtgcttagaatcactcatcttcctatgtagtattgagtagaaatgagtgctacttaacatttagacttctgagttgagcagcttcaagatcctgttaagcttggtcagtgtttcctgttactaaaggaaaggtgccaggacctgtcctttatagcttaaggaatagcttcataaatactttagttcttgtggaaatagggaaaatgagcccaaaattgttgagacagttaactttaatgtaatgtgggtgtcttgattagggtaaactaatagcttatcaatgatgtcctaaaaaataaatgtctgaacatatgactgctataatgatttcagcatttaactgagataagctcattacggtctgcttgatcaatttggaggcaatgtttgatattgctgctttaactttttttcttatctttaacatggcacagacatggattccgtgagggaacaacgccgaaacccaagagggcagctgtcgcagcatccagttcttcttaaggatttcaatcagtcataaaataaatgttctgctttcaaaaattctgtggtgatctaaggtactttaacatcggttcagagttcggttatatgattgctctgggatcctacgcttcttccttcatagttcctgtgggtccgaagctgggaggggctgggtggactctcgggaaagatactctgagcctgtctcggtccccatcgtgtttgcttggccctgggcatggaagtgggtgagtgatgagctgaacgagcaggcttgctagagatgaggacagttactggtgtggttatatcactaccatgcctacagtgt

SEQ ID NO: 23032 - DNA, 2693 bp, Mus musculus; identical to SEQ ID NO: 23031

SEQ ID NO: 23033 - DNA, 1220 bp, Mus musculus
ctccccactaaataatttatttatccactttacatctctatcacagcatcctctcttctcgcagcccctcctcacactgcctttcctctcagctccccgacccttcatctctgagaaggcggaagtccttcctggggaaccaacccaccttggcacctcaagtttatgcaaaactagttacattttcgcccactgaggccagacaaggcagcctagttaggggaaccagatccactggttaagcccctcccccagttttgggggggacctgcttgaagaccaagctgcacatctgctacacagtccagggtctctaggtccagcccttgcttgctccttggttggtggttgattctctggaagcccctgtgagtccaggttagttgactctgttggtcttcttgtggagtctgtttgtcctccgagtacctcagtccttcccctaactcttccaccagacttcccaaacttggtgtaatgcttgggtgtgggtctttgtgagcctctcggaggacagttatgccaggctccttcctgtctgtgaatccaggctgacagatacaaacagcctgggactccaaagaggtagaagggaggacagtagtccagaaatgtgtctgtagcctgggctagcctagaactcactatgtagaccaggctggcccgcctctctctctaagttgctgggattaaagatgtccacttaggtttttgagacagggtttctcactggcctggaactcatggactaggctagattggatggtttacaataaatgctaagtatataatcccaaatgagtcaaagagaatgttcagagcttcctaccctagtttcttacttgatgaaagaaattatatctacagttttggataaacctcaagtgtttttgagaaacacttattaatgtgtgtgtgtgtatgtgtgtatgtacatggtaggggcgtgtgtgccacagtgtgcttgtgagaggatggccttaggaagttatttctctccttctattatgtggaccccatactttcaaaggcataggattatctctgttgcctcaaaataaggacgctggctcctctgcgggttgccttgcctgggtttgctgctgtgcagaccagcacagctgtcgccgtttggaggtttctcaatttgcctcctgcattggattcctgctcttttggggacagagtctaagtcaccaaggctggtcttcagctatctt

SEQ ID NO: 23034 - DNA, 2342 bp, Mus musculus
aggtacacacagcgtaacacacacacaatggactgtaggtctcaagcttacttgacttttggccatttgaatttgctgtaacaggtctcagtcgaccataaatttaccataaagccttcacatattagtacatgttgatgtattttatattagcttcatgaatttattgagttgcctggaatcctcatagaccttattagataatgctgttttctgggctccttaacttccaaaatagctactagtttccatttttggttacattgtgaactatttccatattcctcttaacatgctatttttgtgtagtaagtcatttcagagagcagtctggatttaacatttttctttggcttgtgagcccccaaagccccagaatttatatgttcagaccctccaagccctgaatttactttttcaggtttgcccttttatatatgaagtgctgctttggatccaagagccgagttgctcacactgtagtgaatcgtgttgcttctgtcagtgcacagagacgctatcatgtcagccagtgttgaatgtctttggtattttctaagccaatccagtgcatagaaaggacagtgtttatacgctctgaatgctaggattggggttttagcccctgattttattctggacaatttttaaagaaagaaaagttgcaagaatttagtgactgcatgtgtatttactacttagctcctacaactactgtttggccatatttgctctctagatccacacatgtataatatacagatatgcacatatattcgagtatatgtttgcttttattctgaaccactgagatgttaaggtatatatatatatatatatataccagccctgaatacttcagcacttcctaaaaataataataatgtcctttagaaaccttctgaaaccattataaaatcaataatttccagatagtgcctggttttccagattagctgtaactgcccagaattccatttaagttacagcctgattttatttgcagttctttaatcaggttaataacactattttgaaaagatgtagaagaaatcctttcttcaaactggccaagtttatttcaggttttaattcaaaataatgagtggctaaagaagtgtgatttttcttcaatctctgatttatatgcctctctccttttagtggtagcatagcataatgggtgtaagtgaagatttaagtcacgctagacaaagccggtattgtgtgagctaataattaatgtcatattggccatatttggtttcctttaagtttaggaaattggtcagaggctctagcccagtggtgaggctgggtcatctccagcaacgtgaaacaaaatgcattttctttaaacattaaccatcccccctttgtaagagagacttttccccccactgcattcatttaaaaatattttgccccatccccaaacctgtccagcacttatgtaagaacgcatttggaggacatgatagcttgcataaaagatgacgctatagtttatgcactgatttccggacaaaaatgatgcttctttttgttcggggcttgttttattcaactccgaattgaatgctgtataaagtaatggagactccatttacctgagttcctgactgtatttatacctgtgtgtttgtgccctctgtgtggggctccctgatgtcacgtatgctgtctgaatgcagcgctgtattcccgctgtgtagaacagaaggctgcatttgtaaagttatagatttgtaaataaaactgaggaatatctctataaactgttggggggacggggcacaaaaggaggagccaactaaataggaccttctaaaatttgttaattttgtaatctttgcttcttttataagttattctgtgattccttttagttaccgagttttattttgaagacattaaaatattgcacttgtataaatagtatgataaatgcagactattgcagtcaaattttttaaaagctaggatatctgaaatgacaactttcagttaagtatgtcaagcccaggacaggattttcacaaatgtattgtagtttgcaaattcttacactgaaaatgtaaagggagtcaatgcaaatgatttttaatcttttttttattatcttttcagcaatttatattttcttgtgattttatgcaaccatatttttactttgtcttgacaactgaaagctgtgtgatgtttttgacagaaaagtactgtatacatagttttaaatataacagattttgctgatatgtaaaaattttgccattaaagttgatttctcatgaaaggaacttttctaccaagtcgggagacgcaagagcttaatatatcta

SEQ ID NO: 23035 - DNA, 3261 bp, Mus musculus
accctgaactctggaaggaagacctttcttgggccagaaagctccaagaacagcagaaagtagcccagaggattgaaaacaaagaaatgcccccggaaggcccggacctctctccagggtccatcccggactatgactttgaaagcgatgagattgttgctgtttgtgcagccgtggcagaaaaacagaagtcggtgtctgcaaataaaacaatggttattgtgtcggcgtctgggactgtagagatcgtaaacgagaaggaagagggctcttccaccccagatggctccgtctttatcaaagcccggtgaagccatacacaatggagagatgtttgaatctttttttttttgttgtttgcttgtttgctacttaatgttttgatgacataggatatgcactgtggaggaagagggggaaaaaagaaatcctgttttaaaacgattttttaggtgaaacatagaaaaatcaagttgtggaattattcttcagtgagcggactatgcttctgtaacttcaatatatatacttagagttagcatcttacgtgaaatgtgttctgatcgataagcatttaatttgactgtatgggaaagtacccttaaaggcacagtttggaaagtgtgttcttgaatagtgtgtcttgacaggcgtgttactacagtgccgacatggagactttgctttgtgataaaggaagtgtgcggtttctttccctcctgtaaatctgctgttgtcattctcccatttttcttgcttcaccagtgtaagttttcatcaagattgaatatttctgacattcttttggattcaaagttattgctttgttatatgtgaatatttgaaatatttcaagtttgcctaaaaatgcatgcagatgtatgtgtcctgaacatttctttgaaggtttcgttgttcttgttgttgtgctaatgttctaatttgtgcttctgttttgactttaaagttaaaaagtgctaactgtcttcttcaggacttgataactggatactggtgtgtcagagatggattcattttactgtcaagattgagtcatctttaccacaagtcagtcctttgtcaagatgaatggcatttgcagattgtcagtaaagtctatttctgcattatcctggtcaaaaaagtttctttccttttattcttttaggggagaggctaagtaccccagagcgctggattagcacctgcccgagctgcatcctcagacctctttcttatttttgaaagtgtgaagaagcttgaaaacatttcttgtctttagcccatgctagcctcagggttatcttcctgccttagcatctagactgctgggaatacaggtatgatctaccactgctgacaaatacttcttgcttgtaactttgcagtgaacaatttataaacatctttctaaacagcttttttgggaactgttcagtgaaatgaaaaaaaatagttacaatttcaattaagtataaaagtaaaaagagagagttcttagagtgtcagggtgtgactgacggggagctgggatgtgatgaatagtgtaatcccacaaatacgggacgggtgtggtaaggaggcagctcagtgtcaggagtggtagcagaggcctgtaatcccagcactgaggaggctaaggcaggagagttgtaagttcaaggccagcctgggcaacatagtaagcccttgcctcagaaaaaagcaaaatcggtgggaaaataaaacaacacaagaaaaagtttattagagattctcagtcacagtcacaaatcagtactattattgctatgagttactgtttttgttgcatatattatagtgcaagtatatgcagtttacttatatatatgcatatatagtgcaagcatatgcaatatacttatatatatgcatatatagtgcaagcatatgcagtatacttatatatatgcatatatagtgcaagcatatgcagtatacttatatatatgcatatatagtgcaagcatatgcaactgttaggtgctgttcattctgatgctcaggcagttattattgatgtaactttttttttctttcagagatacaaattatctcagttgtattatgtaatcttagcaaaaactgttgtgacatataaatgtgctctgtatttttatgaggatggtatttttgaagtattttagaggaatgttcactagttttttgtttttttgttttttgttttcagagttagagaatcagcagttttcttaagaagtattatataccgccctccccaattatatcttcagataattagcccctggatagaagagagttttagaatgactaaaaaaattattttgttaaataacaagggatattctcagagagtacctagatgccaagagaattgatatgttacatacaaatacctgtttattatataatttgtgaatggttttccctctgttttggagattttcctcttagattttgacaattagatttgtatatcttttttttttcctgtgtagaagtatatgtgagccacttggtatggccccttacacatgctagctagctagttctaggaagaacttgtcttagttcggaaatacttctcacttcttcagaattttgaaaagatttttatagtcttttatccgaatgaagttactgcttgtgaaactgaaagatggttgtcagctagagattgttcttagcgtagagtctgtgcctctacctccaaagaggcaagcccacacgtggcctgcatgttgctgctgctgaacctgttgtttcaactgtcctggaattggcgggtcatgctggtctttctgttaccccagtataaggtacaacatagatgtaagatgtgggggagggagaatgagttacgaagaaaaaagaaaggttcatttctccagaccccaaaagatactttagctatcattccgtgtaggaagctaaacatgcatccattgttttgctggggtgtgagcaacagtatataaaagtttactaaagctgttaattctaataacactcgaattttatgaatctggagaagatgatactcataatgatataattatatttaatggatgatcataaacaacagtgttagtgattaaaattatattgaatatggatttgtgttgttctggtttcaaaatttatatgctatagatacttactcaagtgttacacgtcgagaccatacgtgtaaacttgagactcgtgatacctccaaggatgcaggtgcccagggtacaaagcattgtatcgtaatta

SEQ ID NO: 23036 - DNA, 1144 bp, Mus musculus
gctttattctgagtaaagctgctatgtacagattattcattctgtttatggacacatgtattactttctttatcttaaatggatacaactcctgttgtttgtacagcttacatgaaacttttaaaggtctcccaaattatttcccaaagtttgccttattttggatttacgagcagctgctgaagagttgttcattttctgatacctttgtcaatcttggtatcgttcatctttattattttagacaggctagtggttgttatattttaagtctgtatttccctggtgatgtggggctgcatttcttccttttttctcctcttttctgacacagtgccgtgtgttctggctcaggcagctgtgaacttgccacacaattagggacgaacttgagctactgatctcccgttttcttcctttcaagctttgacagtagaggcggtgtggcccatcacaccgggtttatatgatgctggagactgagcgccaggacaggtaagcacttctggttggcctgcatcccagtgcctgctgctgtttttcatggacgtacctgacattatcttttggggagaagtatagattcaaatttccccattttaaattttgatttctttactccattttacaactaacactggataagaattctttatgagttactgttgtgaatattttctctcctctgtagttttcttcaaacactattcagaaagtagacacgttagactttggtgaaggccggtataaaggggttttctcttcttccatttcgtgctgagagatcaattcttaactaagtcacaaggaatttctgtattttctactatatattttcagctttgctttttatgatcagttttgttgtttgctaagttcattttatatgtgataatagtaaaatctgaggtttggtttttgatgtctagcactgttcatagaaaaacagttgtttcctacctggcataggcctgtcatcttagtacttgggagcagaggtgccattgtggtatccaagacagctggagcaagacctgcctcagaaaataagcaagtacataaattaattaattaattaattatgtctttttgtgataaggtacacagttactatacaaatgttaagtcaattacatttctagga

SEQ ID NO: 23037 - DNA, 1170 bp, Mus musculus
attttcagataccatactcttctaccttttatttttaatgctatttctgctgttattagataaatacaagtaattatggtatccaacttaatttttaagaagttttggtgacattctgttaaaactacattttagtttgtagaaaacttgtagagaaaaacataagatggaaatgaactacttgatatgttttgataaaataaaatttcaaataccacttaaaaaataaaatatgaagaaaatccaactggtcttcttatgagattaaattgacctttgactaaagaaacaaggcacacttaaatatacaaaatatgcttttgtaatacacattatttgttcttactgattgttactttcaaagaaatgtagagatgagtgacaccagcaaaaacagcaggtttgttttttgtttttttttttttgttttttgtttttttaattgaaggagacactgacctctttgcgatcaaagataagtattaggggatcaggaatgttcaatacactaggttgttccatcaagaaacataatactgtttatttgtccagaagggcgggaatagatgtattcattagcctggtgagcagctttgctctgtgtggctagggacttttccagtactgtatccactgcctcagacccttaaactaagcttgtttttctcagtcagtctatagaacctatctttttaaaattattgttattagatattttcttcatttacatttcaaatgctatcccaaaagtcccctatacccccccccccccccccccccggcagaacctatctttatggactttacaaaacaattgcaatgtagttatgtctggtctgtacttagtttacttttttcctccaggagatttatgcaaggtttgttgtgcaggtggggttgggttaattatcaccagagtagttttcatcaaattgtgctgtgcttaaatatgcctaagataaccacttggagtcagactccagaagtttgagacaatttagtcatggtgaactgaattgccttcttgcctgcagctcatctctctgatagccatttatgtcccagagatccacaccccctgacacccccctccccaagtagctaacattagaataaataattctatccagttatgatgcagatgaaccacaacaatgaccagcatggtag

SEQ ID NO: 23038 - DNA, 1171 bp, Mus musculus
accggatcccaaacatcctgtggacaggactctccctatcatcatagttatccaggtagttaccatgacttttaagaggcagaaggtagtgtggatggaagcagagatgtgactctcagcgatgcgattgcggtgtagtctctatggagtggtgaaatcatgtgctatagagtgctggtggagcccaagctgaccacagtggggacaggaggcaaccatctgtgttccaaccctccctgcttttcctcttgttataatttttcaataaccccccccttttttttttaccaacactattttatggcagctctactgctccacatcctcattatttttagtaactatttattttttttcaacacaagttgaagcgcttaagtaagtgacactctccctggaactgaagctgaggtgttaggtcctcagtgacacaggttcatttgttcatcttgtctcttacagagcctcaggaaaaactcgtgggtgactagggcatgtgtgtaactcacaatggttctggttcagcaggagatacaaataatactgttcagaatggacgaggactgttacagctgtagaagcagaggcagctgacgctatctctttcatagtgttctaagaagataaaaaaaaaaagacccagtgtctgagttaccctataatacagctacatgcgaactatttaaattggggtgagttcaattattccaggtagaattatatttttaggaaaaatgaaatgaactacatgaaagcctaggtctacacatactaggtgataaagtgttttcgggtgtctcagcatcggattgtatttttggttacagtcagacccatatctaggagtggtggtacacagcatcttctgttacaatagaaacaagcagaatctgccctggactcgttggaaccatccgaagggtatctgtctccgctggggagcacggagaagcctcagcgtgagagaatgaatgctcttccccatcatccctgcttctgcaagtgtagactgctagatgccagcccttggggatttaagtcaagccaagatctacaggaagttctggagtgattgttaccacttctttggtacataggcctgctttatccttagtttctctacccttccattctgactccacacaaggtgtggaaaatgtgattctaaaat

SEQ ID NO: 23039 - DNA, 1617 bp, Mus musculus
aggaatcgtcgctattgtactcataactccacacagacatgcacatatacatagttagaagtcacataaaataaattttaaacaagaaggttagagaaggcgggcaggaaagtactattatcaaattgtcagatcctgagtaattaaacttaagtgttgatgtgacccttgtcagttactgtcccaccaggtagggagcaaactgggtatgtattcagaagattagacaaaaggttaaaggctgctcctagggaggtgtaaaggtattcaggatgttgagcaatcttacagagagttctggaagccagagccaagccctccataaatagaacaaaatggtttaatattagcagaaatttggaccaatggatacagaagtagttgtagagaacatttgaggttgcctttaagagtattattccagggagctggggaattcatgtggaggtcagtgtgaaagcaggtgtgagtggaagcaacagaaggagtcatggctgccaaagtgtttgagtccattggaaagttcggcctggcgttggcagttgcaggaggcgtggtgaactctgctttgtataatgtggatgctggacacagagctgtcatctttgaccgattccgtggcgtacaggacattgtggtcggggaagggactcatttcctcatcccttgggtacagaaaccaattatctttgactgccgctctcgaccacggaacgtaccggtcatcactggtagcaaagacttgcagaacgtcaatatcacactgcgaatcctcttccggccggtggccagccagcttcctcgtatctacaccagcattggcgaggactatgatgagcgggtcctgccttctatcaccacagagatcctcaagtcggtggtggctcgattcgatgctggagaattgattacccagcgagagctggtctccaggcaggtgagcgatgacctcacagagcgagcggcaacatttgggcttatcctggatgacgtgtccctgacacatctgaccttcgggaaggagttcacagaggcagtagaagccaaacaggtggctcagcaggaagcggagagagccagatttgtggtggaaaaggctgagcagcagaagaaggcagccatcatctctgctgagggtgactccaaggccgctgagctgatcgccaactcgctggccacggcaggcgacggcctgatcgagctgcggaagctggaggccgccgaggacattgcgtaccagctctcccgctctcggaacatcacctacctgccagcgggccagtccgtgcttctccagcttccccagtgaggccagccgggccacggcctccatcatgctgaatgacgccttccttctgccccaccccagaaaatcactgtgaaatttcatgattggcttaaagtgaaggaaataaaggtaaaatcacttcaaaaaaaaaaaaaaaaaaaaaaaagagtattattccagaaagattgaattactgtgcacacttgtaaaataactaagttatgttgtcttagataggttttccagtgctgtgaagagacaccatggccaaggcaactctttattataaaggcagacatttaattaggagctggcttacagattcagag

SEQ ID NO: 23040 - DNA, 1085 bp, Mus musculus
gtttattacttcttcctagatgcatgaagaagcagaggctgtgttggcaattccaccaattcagcctatagttgatgagtctgctgaatcctgacctcatgcttatgacgtttatagctggatactctatatgtattcctactgtggacttcctgaaagccccacaggatactgactggctgacagtgaggcaggagagccttctgacactggccagcagttattggtacagaacagctgggactgctggcattcctagccaagccaacttctctcccgcgttgggcccttctcggggttcgtggttcattaccatggttttaattcagttaccatcatatgcaagagccaagcactgaatatctacataggttttctatttttttattttcaaagcgcaatggcagtggaacaaaacaggacatgaagacgcatccttcacaccgttgttttctgaatgctttttaatcaagggtaaatacaaaagatgccttgtttgttaactaatttgtggaaagcaggagtcactgactccgagactgcatcctgttaccccgtgggctgtaactgctggtatcagaggaacacactcgcctttccacacttcttaatgtctgtaacactacttcagaggtttataacttcacagcagaaggaacacctcagcactcggaacttggaagttagtttacgatgctagatgcataaggatgcttacttgtcctctgtcgcttcaggttgttgcaatacgttgttaaaggctatttctactaattaaggtttttcactatggttgtgatgtagtaaggagtaaatacttctcgtgttcagagcacattgtacccaacctcctccactcctctcaccacttacaagggactgagccagatgagcagtctggacaaagcaaaggaagcatgaagtgaggctgcagtctctcaaggaaaagacagctttgcctgcagtttacacattccatgggaaaaaggaagagccatatgtcctattaaaacgtcattgagactcgttattaagattcagaattgtggtgaaaagccttaattactaaattttaaagcagcgat

SEQ ID NO: 23041 - DNA, 1151 bp, Mus musculus
tgaggaagacacaggagtctgcactagtctttacaagagccgttgtcatttcaggtccccgggggttcattacagtacatttatacaactcacaagagtgtgggattccgcccctttgagtatttttatagttaggtggataactgccgcagatgcatggattgcacattttgactctataatacttagtatgaaaaattaatttatgccaaaaaaaaaggaaacatatcttacaatttccccaactaggttgatctagcacaagatgcaaagtcttggggcagagcgggagtggtaaaatcttttaatgtatgattgttgaaaaatgttccattactagcctgtcaaaaaccctaatgatgcattgtaaaacaaatgatgtaaattaaattagctttgaaaagtggtaagggattataaagaggatctcagatttaatgctctctgaccacatgacctttttttttttttttttagtaatacgctgctacatttttggaggttctggtgtttgtaggtcactgaacagacattgaaatctgatttatattgtataactgtaacatagaaagaaaaagtatttatatattttccttaagaatatttcattgagttgtgtataatttaaataagatttgtcccaaaatggttttgctcactttgatttttttgttgttgttattgtggttgtattgtttttgtacaatgtgtacagtttatgttaagggcattaaagcctcctgaagcataatcttatcaaagggattcattgttaataaaatgtacttaaaattcttaaacttgtggtggtgttgacattatttgaaaatttaatgtgtctcattgggccttggtatgaatcatgtgctgatgttgacaggtgtggtttctagtaaatgggggtttttgagtctataaatgggcatggtcttgtaccacgaaaagaggtcccacttgtacttccttggcattctcccaaatttagtgtgccatgcttactcttcaatttcaaatcattacggtgaaggatttggacctagaaacgtctttaagtagaagagctctgggcttgctgaggtagtgttaagacaacgaccaccatggaagtggtttgatgctcaggagtctacacacactcgcctgagcagata

SEQ ID NO: 23042 - DNA, 1203 bp, Mus musculus
ggtgttcagatgcttccaatagcaccagggttaagggcctgtatgcccaaggctcacctgatgccagcgaggtacgggaacactccgatcccattaggtcctcctctatccagcttcctctctccccaaccctctcccaaaaacaaataggaaaaccagaaatggactaaacacagtctatcaggaccatagcttctggcttaagcttgacttttctcagcttacttttttgggttagcctcagcagagagtccagaacctcatggacctggacccagactctgcggtgctgagtacaaatcaaggcagattgtacgcgcagatgtaccatttccccggaaggagctcaagacttccaggcacattgtggacagatgagtgccctgccacgtggggcaggctccatccagccctgccctgggcttcaagatacctgaccgtgtcagactgttcattgaggacaacgccggactttcttctttccatgtaacagttggataagtctattctatataataactcgtcttcaacaggagggcttaagaacattttaaaatcttttaagataattaaacataggaaataatcttgcaaggtatggagtctgaaggtgctgtttgcttggagtctggaatacctaaaaaaaaaaaaagtctaagaattccataagaaatccctgattcctgtggaatcttgaagaatctgatgactttagcaaaacataccctctggccacctcctttaacttgctggggactatgggccccacctgccatatgctatttgctttggccaccagatatttgtagtagctctgtggctgcttcaagagatagcatcggggctgaggaatggtgggatgtcagaacatgggtcacagaataagtcctaatagtggtgggctctgccagaagtgggaagagagatgtttcttaacatcatttttatccgcgaagtgcattggaaggctctagccatgttgttgttctgaccctggaatgagctcattgaaagtccaggctgggagagaagttgagtgtgctattaagtgacgcttccccaaatgacctgatcctggtggtctatgtaagcattaagacaaagcaccgccttccgcattagcctgcccatcttaagttgagcagggctttctgacaccacgttggcttctctctgctggatcccctaaccctaatgcactgt

SEQ ID NO: 23043 - DNA, 1882 bp, Mus musculus
gcctttgggtgcatgacagtttgaaacaccccaggagtagacgacctttatttgtgtcatctgaagtcccccaaatcttacagataatggcttgttcttttagttcagattttatcttttatttttattttattttttattttttatttcttttctgacagggtctcactatgcagccctggctttcctggaactcactatgtagataaggccagcctcagactcagagatccacctgtttctgtctcccaacctggaactcactatgtagataaggccggcctcagactcagagatccacctgtttctgtctcccaagtgttggtgtgcgtgtcaccatgcctggcttcttattttatcttctaaagaatcatgtgagaaaaaaaatacaggatgacaagggacaaagtcatgatcctgtttttaaccctaggattcaactacattttggagctccatgatatagttagtagctcttagaaattttcagtactgaaaaatattccaagccagagccaacaccaaagagtttctgtcttccttgtgccctctggctccatcctctacccagccactctaagccctgctgcctcctccccccacaccacgcccctccccttctcccaccccctccccccctccccactccctgaaacatcttactactgctatgccctgcttggcctctgccttgttccccagtgaagcttctcagtttcttattcccatctaattgggatcagagtttgcgaaggttacagctcatcattccgcactacgttaatctgggaacacgggacggtcaggagaaatggactcattctgtccaaaggatgtccttttggcgtgggtgtccagaatgttgggagtttagagtgctgctcaccccaccctgcctctcaagtccattctcaaggaccactgactgaggtatgcagaagcggggcagccctggattattgtaggagaatgtgacgtaggactaaggccaaggcagcttttttttttttttttttttttccccattgaagtgaatgcagctgcctccctgggcagtgttgttacctctgtgggtgtgtatataggagtagcctaaacaggaagaggacaagggagaagcagaccaccactgccatgcccttaatacctgtctcatggtttgggactttggcaagtgtgcactgcggcatcagtgcaagggtcgttcgtgccttcagtgcaagttggcctcgtagtggatatactctgacgtcgggggtcactgtgagagaagagcctacaggtgttcccagctcgaagtggatatactctgacatcaggggtcactgtgagagaagagcctacaggtgttcccagctcgaagtggatatactctgacgtcaggggtcactgtgagagaaaagcctacaggtgttcccagctcttaggaaaaggagagaaactattccttcctaagaagagcccagtcattggccaggcaactccagatatctcgaccagaattaggttcctgtctgtctgttgaacagagccacatgcacacccttttgtaagccagtttcattcagatttccctggtgagacatggagattgagggtatcataatacttatgagtggccattttcaataacatctaattaaagagaacattcttaaatacttaataggctttttgagttttacactccatgaattagtgcacatgtaccttcggaatcttcctgttggttgaacctgtggtgtcccggccttgagacggcagctctgcatatctggaacgctgggttgtgtttctgagctgggtgatagaggtgcttttgttcctgcagctggcaacagaagccgccattcatcgggaagctcgagggaggagctgtcag

SEQ ID NO: 23044 - DNA, 1186 bp, Mus musculus
actggaaggattgcattccgaacacccagcactgtcgcactcagacatgacagtaggaaatcacagtcttagaagttcttgcaaactgaactcttgttagaaagctctcctgtcacagtaatcctgactgtatttgcatccgtcccagccctttcagtgctcagtatacctaatttagtgaaaggcttaagaatgcttcctcccgatagaaatttgaagtcaatgtcatggtattttgcaattcaagtaccccttcatatgtcaatatgcagaaagtattatctcaaagtctcttactgcttaggcacttactcagatagaatttgttgtgtttgcactaaggtaatttctactgtttcctgtttgaaactgggttgaaatgagcaaaatggccttttaaaggatcccgaaagtacaatacttggcatctcaagtgaagtgtgggggaagggccatcagctgctaatgccaggcacacagtgagagttctgtgtctgtattgatggggtccctttctagagtgtgacagattccgtggaactgtcttgaaggatgggagagattaagatgtgactcgcatagataaaaaagaattgactgaaagatttggatacattgtggaaacagccccacagtgtgagggaaactgtgaagactcatcaggcctttcactagatgcgccctgtcagcaccctattcactgcagagttgtttgcttttgtgtcatgagctattagcttggagacccatctgtaccaatctggcttgcgttatgtcaagcagcatgcatgagcgagcttagctgatcactagaagaactcattgtcttggtaagatataccaaggcatttccttgaattgatttgatactttcttgtgaaaaaaagtttcatgctgtcatacctgtcttacctcagtgtccaggacaaaaaaatttacagagggggtgggggtggggccaagcaaaaactgttaatcttttagacataaccctagaatatccttcaaagtgatttcgcttgaatcgtggattctgcccagtgctattcaccctgtttaaacctcttagtttactagggttgttggatttttgctccctttatcttaataattacatgaccatattcatgctgattataatacagaggacttatttctaaatggaggcataaatgattgtgagcaa

SEQ ID NO: 23045 - DNA, 1250 bp, Mus musculus
gattgcacattaaacaagtgtgcaatttttggttgctggaaccgaatactttaaaaatgaaaaaaacatgctgaggataaaagacaggaacattaatgttagttgattcatatgggccttcaagatcgcctttgtatagacaatcaacatgaaaagaaatcccgctgtaataggcattttgctgtacttatgcctagaatatttggtacatctaaattggctgccttcctaattttattctgatttcttacatgcgcttttatttgtaattattccatctcaaatgggtagtttcaactttccgaactagctccaacatccagtagcatatctttagagatcaaaatatctttaggtagtaatcccatcgtccttaagtcctgagcagctgagccctttggcaggtggtcctagaacaaaaggctgaagggaggtttgcggggcgatgctctcctttgatgcaaacactttcactgtcttttccgattagctcaattataaacacccagctccttccgcttacgtttccttctgatgtagtctttgacaaagtatgaacagcatggtgaaggaatgttgaggaatgaaccctgtccagctccttgtgatggggtagatgttaggggataccacaggacacagctgctaaaagacattctctttagagttgctttaaaaaggttgttctggatagagagatacgctgagtcccagatgataccaacttacaggcatgtccaaaggtaaagtaagccatctgaaaattctcattggtcctaggaaaattttttaaaatttattttaccagatctttcactagcagacaggccatcagccatcttccctgtaacactaagaaattaccactttttttcctttcaaatttgcattacagtgcattactgtttacaagacacacatactgtgaacagatctaagtcttcgtcttttgtaaggtttgtagaatgaatgttgttttaaaagatggtgtcatgttaaatatctctaggtctctgtaaatgctagctcctgtttactaacttttgtttggtcaggtgtgtgtccatgtagctgaaagaagatagaaattgctgtttgcataactttcccctgttttgtttcttgcaaaattatcactacagacttgtgttaaatcaaaggatcggttatgatgtgcaatacctaaaatcatgttcagtcctataaggaatcttttcaatgctcacacacaggacataaaggagattgat

SEQ ID NO: 23046 - DNA, 1180 bp, Mus musculus
cttgagaaccagtaactgcttagccagacctgtagagaaccaaggaagagaaagaactctaaagccatgtcgctagcattgtcctgggaccattcgtgggtggctggggtttctgaaggcacttgaaagccccttggccccttttcttgctctctggttcataggtgtctattctctccaggactacagaaagaatcaaccctgctggatttgtatgatggttggttataatacacagacatcaaattcttcctgatggaaaaggatagtttttaaattgaaaattgtctccaactctgcttaacaaagtaacccattcaggaatagcttttaacttacttgaagagtaccagacattaatctaaggacccggaatatactgctgaacaaagctaatccagatctctggccatggaacatgaattctagttgagaaaggcatagcaaaattaatttaaaaaatcaaattctgtattaaagatatatgctatggcgaaagggaagcagagtgaatggagttaaagggccatggctttaaataaagtgggcttaaagggtaacatcattagggcctgagtaggggagaatggactcctgtgccctctgccctctgccctctgccctctgccctctgcacatgcactgtggtgcacacatcctccctcctcataactaaccaaatgcatgtagaggagagaacattaggaaggaaaactgagccatcaagtgtaaaggactccagtggttcaaatggggcaagtgtgtctactgtcactgttgtttgatttgctttttaacacttgcttgctagccgacattggagagcagcgccccagatttgaggaaagctaaggaaatgtggagacctgttctttcagcccgccccacccccaccttcacctccacggggcggggcaggaggatgccaacactgactctggaatgactcagcccacttcagtggcacacagcttacaaaccaccttggagtattgttggatgtgaattagcaacttgcaggctctttgtagctttctccatagttctggagtatcagaaaagggtttgcagccatttaagcatcaccagtcaggtgagagtagagtttctaccaaagggatttcagagtttgcaggtcttccttcttaatggaagagcgggatgttagaggcaagggcta

SEQ ID NO: 23047 - DNA, 1244 bp, Mus musculus
aggagaagctaacacattccgttcagattttatgggagaactaggcttagataacgaaccatgaaaataacgtggattagcttagtcctcagtttaatgcttctttttgagctaggtaacgtagttaacttagcgtagccgctaaggaccaacactttagtttaatgttttcagtggccagataattttgcattaaaaaaagaaaaacttctttctttccattctgagtgctggggttaaaggtgtgtgagccagcatgccagccgagacaaagtaagatttaagcaatgcctttactctcgtagtgcttgaactgcaaatctaaacgtagttggaaatcgcagtcattataggacaggtggggtttcctgagaacttggtgctgtgcgcagagatgcctagagcggtgaagggtctgcagcagcagaagaaagagtgactgtttctgtgtttccagggacacaagcagcagtgacagtgagagtgacgacagttctgattcatctgacgatgagctaatcggccctcctttaccccctaaaatggtaggagaatccgtaactactgtggacgaaggcacccttggccctttacctccacctctgtgtgaagaaggagaagatgatgatgatgacgagttagacgatgaaggagaagaggatgtgagtattcaaaggttttgtatgaattcagagaggttgtaagttaaaagtagtatagagaacaaattcctgctaagctgacagtcatgggtaggatagccaccacctgttgagtatgaaaatcagacttgggctgttgacatggcttagccaggaaaggtgctagcctccaagtctaatgccctgagttccatccctagggtcacatggtagaaaggaggcagctgactctgaaagttgccctctgacctctgcatgcacacacatacacaacacacaaataagtagatgtaataaattaattttttttaaaaagcagatttatttttggttagcttttatatttgtttcattttgtggcgctagagcttgaacccacagtgttggcatggtaacccggccctctgtcactgagctaggtccccagcccccagctgactttattacagtttccaggttctctcctgaaaatacagcatcctaccgtgtcgtttacagcatcactgtcctgacacgccactcagaaacagtgactttagtaaaaggtaggcaaggggaagatgcagcagactttgctaagtg

SEQ ID NO: 23048 - DNA, 1202 bp, Mus musculus
aaccatgctgcagcatatgttagaatttccagtctaagactgaataacagtcttttgtactatacatatataatgtttatccatttttgtcccttttgatgtattctacttacttataagataaggcaagttatcatgactgaccaaattgatttaatgtactagggtatgttatacaaggcttgagaaactcagtcctgggaaacttgatgatgccttctagaaggtcctctaggctgttggtttagtggcacttaagaaacgagagaaggcactacagtgtttttatttttcacgtaggcctttgcaagtgtttccagagtgtattcatgccagtgtatttcatggggatgagcacatgattgccccagttggcggtggttggaggcaggggaggaatgggggtgtcactcttagctatgctgtatttgacatgaggaagcagttcgccctgtgtcatttggtgaaatgtcattagttgtattttgtcattagaggctcaactgagtgaaaagatttcacttcaggcgatccagcagctggttagaaaatcgtaccaagctctggctctctggaaactcctttgtgaacatcagttttctgtcattgtcggagaacttcaaaaggtgaggtgggttttgtcctctggggttatttaatacccaaaatgcttctttcttttttaagtttatgtgttctgtgtgtggtggcacatatcttcgaggcaggtggatctttctaagttgtaggccagcttggtacacatagtgaattaattctgggacagccagggctgtgtagggaaatgcatgcacatgttctgcctatacgtatgtaagagcatgaaatgcttgcctggtggtgttccaaggaagccatcagatacccttagaattggagttactgatggttgtggtcttccatgtgggtgctgggaactgagcctgtgtcctctttaggagcagccagtgctcctgactgctgagctgcctctcctgtcccctacagatttagcttcaagcaacgtttcacagtgatccccagttcttttcctggtggccagagagtggctgtggttgttgttgcagtctttcttgatttttaaacttacataaacttttgttttccccttttagaaatctgaaactctcctatttagttgatggaaaccatttcattttccctggcaggtagctggtggc

SEQ ID NO: 23049 - DNA, 4016 bp, Mus musculus
gcccctggccggcaggcttccggttgacaatggtgcttagggtagatgaccttgccaagtcccctttctgtttggaagcacttaccgcttactgagtaatctaacccttgcttttcatcgggactctgagaaagttaatcgaatcttggtctgaaacgactctttgaaggaaatgggtttcagtatagctggttgagggcctgaagcaagccagggctccgtgattctgaacgctttctgcttttgcagaggttctgagttcacttcccagcccccacatagcagctcagggccattcatagcaacagttgcagggtgtctggtgccctcttgtagctgtggggggtcctggacaggtgcatggtgtgcacacacacacatacacacatgcaggtaaagcactcagacacataaaaataaaggaataataataaacaaaagtcaatgagtgacctgaagtctttctccttacaggagaaggtttacaaatctctgcctggatgccgtctgtggatatctggtggaacttcagtcaatgagttcttcagtagcagtacaagccatcactgggaattttaaatcgctccaagcaaagctggaacggctccattgattactgtagtatattttcttgtttgcattttggtctgtaaaataaaagctcagctgggtccagaaatcaggtgttgtatatctaagaattttggtagaacatttttttaatgaatgatagttatctacaaatagtacatttgccaaatgatttagtttttttttttatgattagtattttttttaattgataagttgggcccagatatgtagctcagtggtaaaatgtttgtatagtgtgtaaaaagttagtagtaccacacacagacacagcagtctatgaacagctggaataagactgtgtatgattatgacacacaaagattttgaatttcactagtggtaacaattttgactttgtattatttatctacaggtttatgtaggatgttagtattaaaacttataggctatgccaggtttggtagcacatgcctttaagtccagcacttggggaagcagtggcaggcggctctttagaactcactgagatttccaggccaggggctacacagtgagaccttatcttcaaacaaacaaacaaacaaacaaacaccttataggctgggtctgttcccttagtgctagattctgtaacagtcttaattagtcatttttaggttaatattttatcaattacagccctttatgttctctcttcctctttttttctctctccctctcaccataagtacatacattagattttatgtatacatttatatatgtgtgtgcaggctatatatgtatgttgtatgtatatacaggattgtttgagcatgtgattgtaacacttctatgtacttaaaatcttcatgatcacccagctgtaatggtgctcccctttaatggcggcactcgggagtgtgggggagagtcagagtggccagtctggtctacatactgagttacaattcaaccacagctctacagggactactgtttccttagaaccctcactgtctaactgtatgcttcaagccagcaacagtagcagcaaattaaattacaaattaaattcctggctctctggtcagatctaccaagccaaaaactgtggcataaatgccagtctctgtgtcttaacaaccgttccagtagatgcagatttatgtcttattgacttgtaaatcctgttttatctagtttgtttttgttttttaatactgatgggttttcatgctaaacaggtaaatgtgctcccactgaagtttaacatgttaaaagaacttactaaactaagtgttccaaattattatcaaagacaaaaaaacctgagaattactaaggctaaccaagagaagagagagagaaaaagtgaaaaacaactggtttctactccttagttgttttgttattttatttttgcagcagattgtgacatagcgtaggctagtgtcaaacctaactgcctagagtgatgttgaaattccgattatccggcccctaccacctgtgtgctaagactgtaggcaggcttcacagtgcctactttttgtgatgcaggctgttaaattaagcgagcaccttacctactgaatgagttaagttcacagtcctcaactccccacccccactcctttttctttttctcttttctttcctttccttttctcttctcttctcttctcttcttttctttttttttttttttgctaggtctcactaatatagcccaggctagctgcaaacacatgttgatcctcctgcctcagacttccaagtactggaaatccaagcatgtgccaccatacccagcctccagtgttatttatactgttggaagtattctcttctgtttgttggcactggtggaaattgggcagtttgtgagtacacctgaatatatttctacttttatcttctcctgcgattacggatttctttttcacaataccgtagaatgcaattccgttttcactttgaatgtgtatttcctaaaagatcaacgtaatgctcattgggtgtcactacctcgtgtttctcagtttttcatcttattaagtaattttatagcatttgatatattaatggttttatgcatttatacttctgtcatgctcattttaaatgaaggtcttgtttaaatgctttaatctagttgtgtttccatttctgctagacatacacgacactgtctccagttctgtggtaagcgtgtttacatattagcatgtgtgttacatacacttagtcatctgggtgaggtagctcttgcatctaatcactacattcagcatgtttaggtacgagtactgaaaatagagatgtggctctacacacatatgcacagtaccttaatagatctgcaaaatactatattaaaaaagatgtaattaacagatacttaaacacactctcctttattcttaaagcaccttacagggagcttaagaattcgcctttaatcccagcacttgggaggcagaggctggcggatttctgagttggaggccagcctggtctacaaagtgagttccaggacagtcaggtctactcagagaaaccctgaattttcacttcacagctaatgcttgcaatggccttcctacaagaacagacactgctagtccattgctgctaacatttctcatccgtcaaatgaaattatctaaatggcctgtccattcagatgtctgatttgaacctccaaaggggtgccaattctggaactcggtggtcagacgtagcaatggcagcgttctagcatattatccactatgtaagagtactttgttcctggacttcggtcagtgcattatctttatgctgtatgtagtgcgtttgcgcaggcaatgaatggttcattggtagaacatcttgagaaagtgtgtttattgtgtctgcgagggtgttgattgtgatgtagttttaggtagtttcagtatggctgaatggttagggaagaaagacactatgcctttctgcaggatacacaatactgacctggtttgcatgcaatatgcatttgacaggttttcagttgttaactaatgacttcttcattgaacttggagtcacataagctcctctttatgtcttatagttagtttcatctcagaagtctatcacaggttatttgtatattttgtttctccatgttgccctgctccttcactagtggtgatatagtcatagcaaataaattaatcaaaaccccaaatctgagttttttgaaagagattagtgtttttttaatagtctctattaatatcttttcttaaattatcttaataagaccttttatacttttgagttctctactaaaacttttaaactcttcacagagttttgttttcttcataagtgaagtggttgaagctaaataagactcttaaagttttgtaaaaactaacgctatttctaaattgccttactatttttcttcaaacagtagatgttaa

SEQ ID NO: 23050 - DNA, 1199 bp, Mus musculus
tatgtgctgttagtctatttgctgctttaaaatttctggttgctttaaaatttaccttctacttgattttttttttttttttttttttgtttttcttttgatacaatgtctaggtgtgaatttctgtcttacatctaggtagaatctccactttgaagatttaacattgggcagtttgtgctgttgccatctccttcccctctgttctgaaaatgcttgttaggtttattttggaccttgctctgtttctttaatttttttaaacttacatgtttgtttatttgctcgggggggtggggcagtgcacacctgaaggtcagaggctgaactaagggagttgtcctctcctgtgtgagtcctgtccgaccgactgactgaaattctcgtgcttggcagcaaatacattcttctgctaagccatctcaccggtccctggtgctgctgtgtttgttttcagtgtgtgtgtgtttaacacttcacaatttcttagggtttagggctcagtggtgccttccccagcacttccccagacctgctctagctcactaactgctgtctgttcgctgtcccagtgggtcactgtttaagtttgctaactatcttccgtagttaaaacgttgtttctagatcttactgtttctgctgtggtttcctatcttttccctttatgtttttcataattgtatgcctgcattggattagtgtctttgcagactcaagaggacgtggaagagcaaaaggatgcagaggaaacttcagagactgaattttcagaagcagaaaatcattctagccagaaaacctatgcatgcccttctgtggggtctgctgcttgctcttctgtgggctggaacatcccttctcctggtactgttctcacttcttagatttatatgttcttgtgttgcattaaagtgttactgaactgcacctgggaggggcacaggtataaagggttgtgagttaattttataatattcacttcagggaagaaaaacattttaaacatgccattcaacataaaaaaaagtcacaaacacttcaaaccatctatagtaattagtattatttaattttataaacattgagatgttaattattagaatgttgacatttaatttataacagtcctattggttatttgctgtgccccaaccatgtactgtttcttgcacagttcctttgtaaggttggcgggg

SEQ ID NO: 23051 - DNA, 1099 bp, Mus musculus
aacatcataagcattgttcttattccacagtggctcatttacatattttgtaactaagccatctgcctcattgccgaccttaggagaaagtcatctccctttcagtggtgtagacacttttttgggtggggaggtgggtgggtgctgtgcatgatttagtcctaggactaagtccgccctaaggcttacttctccacttgcttatgaactctctgctgaaggaagctttgtgcagctgttagtggcattttggttttattgttttgttttttacaatttcctttttctttcagtctatggtaaaagacaaaaggaaagagaggaaaacgtcccctgctaaagagaacgagtccagtgagagtgaagaagaagtgtccagacctcggaagtctcgaaagcgggtagattcggagtcagactcagactctgaagatgatataaattcagtgatgaagtgtttgccggaaaattcagcccctttgattgaattcgcaaatgtttcccagggtattttattacttcttatgttaaagcagcacctgaagaatctctgtggattttctgataggtaagtttacataagagtgagagaaaagcatgccctggtagaggatccacaggcgccatagaacaatattagaagaaaggaaaggatacttcttcactccatgcattccagatttaaatgaactactaatttattgatttacataaaaaatgctttattagagagttagtctaattttaaaatatatcccagttttaacaagaaatgccgtgcagtaagagtatagacatagcctgactatagaggaagtaaagatagagaactatcagaagccactggagacattctgagcatctcagtcattgggagcttagattcttttctttttctttttttaaatcaccaagtggggctgagaaggtggggttaagagcacctattcctcctacagaagattccgcttcagttccaagcagccataggagatctgtcagctttctctggcctgtgcaagcaccacacacacataacatacaaactttttaaatcttttgtaaaaatatcacctagtcaagctgggcgtggtggcgc

SEQ ID NO: 23052 - DNA, 1149 bp, Mus musculus
ggacatgtgtttgtatggccctataaaaataaattttcatttatcaagtcatagcaaataatactatcttcgataaaagttacacataagattttagtgaagctcaatgttattaaatatataaacataaatgtatatgtatgtttaattgagaatactgaagtaaaggaaaatactgaaatatagaatacctttctatgtatactggtctaactcaagattttggactagtaagatgatagcttacacatacacacacacaacatgtattttcatgctgtattgtgttaagtattttaaaatttatgagaatgttgtttgcctggcagatactacgagttcttggtgaaaatgcaattgccgttcgaacaaaagccatgaagtgtttgtctgaggttgttgctgtagaccccagtattctagcaagggtaagagcaaaaagtctttgttttacttttcttctcaaatttgaagatcctctctgtggctgtaaatgacattttgtttctctccctcttctttagcttgacatgcagcgcggagttcatgggcgactaatggataactccactagtgttcgagaggcagcagtggaattgctaggtcgctttgtcctgtgtcgccctcagcttgctgagcagtattatgacatgctgattgaaagaatattggtattggtcttctgtcttatagtaacttatgaatacataccttaaacatcacaccttattttaattttagtataaaatttataattaatctaaaaagaataaatgtgaattacattttttctgttgcttaatctgaactgtatcaccattctaaaggttatgctttgaagaggcaagtattataaagcccattgttggtaaaacttagatccatttttcaattattcttaggccagtttataatcactaattagtagtaattatgtatgataattaactgtttttggataggactctggagtaattatattgtctttgcagtgtgtgtttgtctgtctgtctatgtacgaattacttccatagcaggcagaccccccccacttcaagcatattgattccttatagagctgtacattgatgcattagcacacagtgttatacattgctgcaatggcaaggttttgacattaccattagt

SEQ ID NO: 23053 - DNA, 1130 bp, Mus musculus
agagggcagagccatcttgcctggatgtatggtatgagttgagctaggagccatgagcactcagtgttcagctatctgtctcttcaaacaatggttcctcttctaactcagaactgagtagagctctaaagaggaaactttgtgttctactattgtttaaaagaatggtaatgttatatcttccatagccaaagaaaaatatttagattgtttcttgagtaatttgaaacttttatcaatgagtgataaaacaacttgtatttccttttagctttcaactgacaaaactgtgaaagtcctaaatatattggagaagaatattcaggatggatcaaagctttccactttgttaaatcatgtaagtttaagacctgtgttaataattttacacctggtattgtaaacctgtgtatatatatatattttattcctactttattaacaatgatctgttttatagaataatgatactgaagaagaagaaagattgtggagagacctaattatggaaagagttacaaagtcagcagatgcctgtcttacaactatcaacattatgacatctcctaacatgccaaaagctgtatacattgaagatgtaattgaaagggttatacagtacactaagtttcatttacagaacacactctatccccagtatgaccctgtttacagagtagatccacatggaggttagtttacccttttgtactggtagatatttttttttttggactgggttgggttcgtttgtttgtttgtttgtttgtttgtttgtttcagcaaactatcagaattattcattgtaaatttttaatgctaaatgaatcaaaatactaagatttagttggctcaaattaatagattatgtataacatacattggttttgatttttatatttaactggaatataaacatctttactagttcattactttaacatttgtaggttgaacacccattaatctgaaaatccaaaatgctttgaactctgaaaagtctttgaggagctagagaaatgtgtcagcagttaagattgttgtctgttcctctagagaattaaatttggttccctgaaactatacacaaccacctgtcacgtcagctcagtgggagccagcatgtggca

SEQ ID NO: 23054 - DNA, 1195 bp, Mus musculus
aagttcctaataaaagtagctcatagccacgtagcacagtttctctttttacaagtttatttaattgttttatttgtttttttaagcagaagatactctaaatttactaaatatctgctttagttggaaagatacaggttctctgaacctttttttaaaaaaacagatttaattattcttgctgagacaaaaccaaggcttgagagcttattgaattaagtctgtattgtcactatttcttcttttttgtaactcttaaaaagtagccaaaagttttgtttcagttaggtaaaggagaattaatgcatcaaaaacttaaaattctatagtttacaagattatttaatgaaaatccttcctttccaaggtgaatgtggataacaaaggacatagaattgactagtgctttaaaacttcagtgataattagataaattataattcactaatgaagtaaagtaagtgttctgtcatttattttccaagaaccttttctctatacggctcttaaggtagctgccagtttctattactccccatattccgcattaatcttttattataacgtatttggatcttgtgtgtgtgtgtgtgtgtgtgtgtgtgtgtgttacatgcatgtgtactttgcatgctcattttatgtgtacatgtaatgaagcctgaggccagtgttgagtgccttctgtcattccccacctactcttttttagccccctctctccttccctctcttccttcctccctccctccctttttgtttttgtttttgtttttgtttttttttaaacagtatctgtccctgaacctgattggataagactaacagagcatcgagctgcaggaatcttgtttctggcttctcagatctagggttacaggtgtacaccaccaccctgacccagatcttcatgcttgtgtggcaagcacttacaaaccaaaccatctcctcaaccttgagattttgaccttttttttttttaatgaggatttttagtcgtttcttgactcttgtctcctgttttagaaaaatcatgctattcatagtgtaggaaagattcatgagaaatgaaccaattttggaatatattcttagaagtaatgtttggtctcttaagagctgtatataaaacaaaactgggttgttttctttgacaattatcaagtatgatacttctcacctattataaaaatat

SEQ ID NO: 23055 - DNA, 1193 bp, Mus musculus
tgtaagtttacatttatttaatttctcgttttatctttacagtgtctttgcaagattattttacatgttcattataaggatatacatcataggcaaagggcaatattatttatgtagcttccagcgattaaaatagtatttgtacttagaattccaactgaaagttaaaaaattaagaagtattatatcataagtcatttcctatcttaagaaaacaattcctgcagatgcagaatatgactaaaactgaaatgcatttgctcagaaccccccccccatgtaaaaacatagtaattagagtggggtgatggaatcacaggcacaatctccttttaactattgctccagtatttataatataaatatatattacatttacaataaggaataaaaaaaaccttaattgtctcaaaaaagctaccaaagatcagttgttgaaaacaatacataaactaaataaaaacttgacagtacatctgaaaatcatagcaatttcgatagaaaactgggcactgtggtacaggtatagcagtttgaataagaataaccccataagcccatatatttgtatgctcaatctgtagtttgtacaatgatttgggaacgattggggatgtgtggccttgttggaggaggtgtgtctctgggggtaggctctgaggttacataagcccatgcccctcccagttagtcctctttcctctctctcccactccctgcctctctatcctgcctcaactctataaacaatgccccaataaacacttctataagtggccttggtcatagtgtctcttttcatagcaatagaaaagtaagacatgtagttatttgcaaaaggagattattattttaaaaatagtagagatagctttcacatattactgaaggactttaggcattgaaaactgatctgtaaactctaatttagtttccttattttttcatgtaagttgcatctagcagtgtggtttaatgggccattcagtatggctagttggaacccacagatactaagtgccaaaataccctggaggctttcttgaagttgctgaaccaccttctaatgaggattggtttggtatcttggaaaaatactggttagtgtttgcttgccctgctgcctgccccaatcccagcccactgggtgaatttcatgtcatatgtcagcagattggagaaacagatatcag

SEQ ID NO: 23056 - DNA, 1130 bp, Mus musculus
ccggggccggccagtcagggagagcagcgcggcctcggctggccgccttctccgggattgagggtggggggctatgaggcccggagcgcctgagaagagggagatcccggcctcacgccaccacagcggaccagcgcccggctgctgtcgcctcgagggggaccaaaaggaaaaaaaaaaaaaaaaaatcaagccggtcacccgagcaacggcgtagacgccgtcttgcagaagcgaccccacgggcagcatccacggccgtccgttgcacaggacaagggcacggagcagaaccgccgctgctgctcccgctgcctccgccgctgtcgccgccgccgccgcgcctccggagcccgcgggagccggcgcgctgaggcagagctgcgagcccgagtggcggcggcggcggtggcggcggcggaagtggagtagggaagagggggtggttgttagtgtttggcgccggcggagggagtcattcctgcagctgcacttccggtcggcattttgttctgagagggagagacggaacgagagagagagacacacacacacatacacacacacatacacacacacacacacacatacacacacacacacacacacactgggctccttcccccccgcccgccctcccgtccctccctccctccgtcggtaccgactcacccgacaccagcaaagccgccagggagggacgcccccgccgccaggaggattggttcccgggcccgcggcgatgcccccccggtagctcggggcccccggccgggtgtttgtgtgagtgtttctatgtgggagaaggaggaggaggacgaagaagaagccgcgatttgtcttctcggctgctctccccccggctctacatgttccccgcactgaggagacggaagaggagccgtagccaccccccctcccggcccggattatagtctcgctctctcgctctctctctcttgccaccgcggcctcggcctccgcttcggattcagacgccgattcgcccaggtaaattcctgctcttttatttcggcggcggcggtggcggcggtggcgccggcgccaggtccctcagcgtttctcctcctcgctcccctccccgccgtttcctcagcggccccgggtct

SEQ ID NO: 23057 - DNA, 1868 bp, Mus musculus
gggtggagcttcctgctcattcgttctgccacgcccactgctggaacctgcggagccacacccgtgcacctttctactggaccagagattattcggcgggaatcgggtcccctcccccttccttcataactagtgtcgcaacaataaaatttgagccttgatcagagtaactgtcttggctacatttcttcttttgccccgtctagattcctctcttacagctcgagcggccttctcagtcgaaccgttcacgttgcgagctgctggcggccgcaacattttggcgccagaactgggacctgaagaatggcagagagatgctaagaggaacgctgcattggagctccacaggaaaggatcttcgtatcggacatcggagcaacggacaggtacacatgctagcgctagcttaaaatttcagttttgtaaagtgttgctgaggatgcggtaggatacgaattaagcttgaatcagtgctaacccaacgctggttctgcttgggtcagcagcgtgttaatcggaactagaaacggaaacaggcaggttagccgcagctttttaggaagctgcttaggtggaagaagaaagggtttaaagtcgtggatcaggcggtaggccgtagctctccgaagctacatgaggtgtgagaaaagaaagggtttattaaaaggaataggcggattgccccagttaataaaaaatattctccggctctacctcgcctccccaaaaggtaccaagagccacatgtgtgggttttacccacgggaggaatcgggtccatgtccacccaagccaaggttaaaagcccactcatctacggatgaaaaaatcatttgatcacctcagttaagcgttgccttatttaacttaattaataggggggagagagattggagacgtactattgaaagggcaagcccttcactgcctcccacccaaataaaaaagccaattggccttgtactacaagagccggtcactccttctccctgtttcccacctatcttccaaaaatgcggaggaatatcaacttagtgctattttcacatcgttcagtcaaacttagccagagttccaacgccctacttaaaattcaactagaaagttacctaccaagtactaattagcattataaagtcagagtctgcagctccaggcctttcagttagttgtttactagaaaggacagtcttaagccagatacagtttaccataagaaaagttaaagaatcccagtgaagcaagttttttctttaaccctagattccaggcagaactattgagcatagataattttcccccctcaggccagctttttcttttttttattttgttaataatagggaggagatgtagtctcccctcccccagcctgaaacctgcttgctcaggggtggagcttcctgctcattcgttctgccacgcccactgctggaacctgcggagccacacccgtgcacctttctactggaccagagattattcggcgggaatcgggtcccctcccccttccttcataactagtgtcgcaacaataaaatttgagccttgatcagagtaactgtcttggctacatttcttcttttgccccgtctagattcctctcttacagctcgagcggccttctcagtcgaaccgttcacgttgcgagctgctggcggccgcaacaggtgtcacttggaaatttctccccacaccccagcactttaactgaatgaaatgataacgtaactctctgtaaaggatagactctgacagaaggtataatcggctaggcgtcatccccgactacctttcttcttctgtgtgtctatgcgtgcttactttgaaatttggttcatattttaaaagtggaagtgttcaca

SEQ ID NO: 23058 - DNA, 1784 bp, Mus musculus
ttttttctgcagatacagatgaccagccatgcaccgaccttgttaggattcttaatgacaggctaccactagagtcaaggtgacaaaatgggacgcgtgtgctctcctgctgattctgacagacaagagctgttcaccgtgagacggactaaatggactagaattatgtcaaagcttctgtattatttacagttggtaaccaagagcattgatactctttagaggcaggttaaataaaggattaagtatttaggatttgaaatttaactgtacaagtgttgttttcttcctaactttgtggaattggccatgtgtatcagttgattagtacattatttttatagtacttaaaagtaaagatttaaaaaaatttttgatgatggagaattttgataaatcctgatgttgacttaactgaagttggtaaatgtgttttctatagctaagaattttctaattctaggaaaccatgatggaatcactattgattgaaaccatgggaacagattatttgtagacaaattctgacttgttttgggtgtcatcagtgctagatgaaacacatctatgggacatgtcattgacactttgtaaagtattaatttccatagcaattattgttcagacaagtaactgagtccgatagcccctttcctgattttggttttggatttctattatgaaatcaaggattagaaggataatcaatgattgtgctctgttcagtaaaatgttcaaagacccttcctttagtattgggcatggactctagtaaacacctgggacttaagacagaattttggaattgccttaaattagtattgtgatttccatttcctgtattctaaaatttaaacaatagctttgcgggatgaacagcttccccatcttccggtatgaaaaccactcttagttttggagaaaactattttaattcttgattttgttttcatgaaaagcttctccattgctagataatggatggtattttcatgctgggtttttcagacttgtgcattttcagttgttggtgaacttccttttttattgacaatatgaagactcattctgtgccatctaccatataagtatatatctgtatcatgttatagatatatatgatataatgaattgttgcatagacatcgaaatagaccgtttatggaacttgagcttcgtgagctcagaagtaaaaaactaaagctaggatgtatgatgagatcaaatgctcttagctttgccaaacgcaacacgctgctctttaacaattaagaaaaatgaatgtcactgtgtgaggtaatttagatctgtctgggtttgtgtgtttatttagaacatttcccttgactatagaaggaaataagtgtttttatctgagccaactctaatttctagtttaactttttttttttttttaaatggatatatttaagatatccctttatatgaaagttaaataccttgttagaaaaaaaatgccactctcatctttaatgtacctagatctggttgtccatgatttaccacacatctatttatacgtaccactaattggtaatgagctgtgtgaaatcgttcttaaactacccttggaaaggtattaaaattacttattatgctctgcctacaatctaacttctactctgtggcaggcagggatttatttgtaatagactaatggcaaaggatgttggaatatcaaaaatgtctttaaatgggttaacctttaatgaccactttatgcaaataaaattaaacctttgtccatttttactttgttttct

SEQ ID NO: 23059 - DNA, 1393 bp, Mus musculus
ttcagcatgcttttttaaaagcgacatttgagccaactcttccaagtgcccttctaattaagtctatttagacccaagttttaaaaattacccgtggctaacaatcttcatggtgtttgtcataactttctatctatttaattattcagtattttataaaacttgactttgaagaataagctatatgtacggtgagctgggcggaaagcagcagaggctggtagcatttgaggtggtcttttctgggattaacacatttcaactctgtgcaggcatgaggttagtttcacagcagcacaggagtgcatgatgtacctaaaactctaaatgagaaaacaaaaacacagagacacagccggaagcaggacaggattggtgcaggattgaaaacctcaaaggctgttctctaaaagcaggttaatatgaagaagtatcctttaatgtttttaggaattctaccatgtttccagaatcttaaattaggtgagaaaatctacttgtgtgctttttaaactttataatcaatgtatgttacaatatatgtgggttgtttagctttttaaacttacttgctttgttttaggaatgtgatattattctagtcagccttctgaaaagtcggatagaattccgagctgatcgggtgtgctgatcgttcctttagtactgcggttattttttacattactctgaaatcaagaacttgaaattcttttaagtggtcttaaacagtaatcgcttgaaactgcccgttaggttactggacctaaaattgttaggttgaactgatttctgtccatcggcaatctacacgggaagcgtgcgcatgtgcagcttccgacccgggaagcgtgcgcatgtgcagcttcagagcaggtgccgcggcttgcacttcacctaagtgtttaagaatcacggggcattaaaccttttgataacatatggtttttttagcacttgatacacagaagcaaagggatcaaattgtgtttcttaaaaaatgaaaagaaaaaaaagaattaaggcagttacctctgtagagtatttccgtgctacaatccatttctattaacttcatcaaaaacttttagttaacaacatgaagtgccttcatctgctcagacctaaagaacattttaagtgtcacacaagaatggtcatgcttcaatcccctagtagttaaaagagtgctaactactacttgaaactattgtttacacattagtgatgggctgatggcgggctctggcctccagatgccctcagacatacagtacctgttcttccttacgcaagtccagctgtgagctatttttgccaacatgtcgcggtaatacatgtcgcagtaatctgtatttttgtatgtgatttctacttttatagactgatttta

SEQ ID NO: 23060 - DNA, 1173 bp, Mus musculus
taataagtgtccatgattcccctcactgagctgaagagacctcctggtaagctgctgtttgcctttatggactggcatttggttctattggggtttgtctttctgttttctgttatgaattgggatttcctggtctttccagccagttactttgctacataaagagttgtaatccaggggttcccacagttcctttaacatttacggcagattcccaggtgctctcctggatgccctcggcaggaaacttctatgttgggacagtcctgtgtaatgtcaaacttctctatctgcctgcctcagatgccccatacgtcctcctcctgccttgtttaacagtgaccatgaccatgacatctgtttgcctttttctagatctttgtaccataattaaacgatgccccaacctcatccgcctcgacttaaggtactgttttagatcaaactttggagtacattggctgtttgtgaactgggggaggacctaaagcagggattaagcagcagtactctcgaccatcatggtttgactcttcctttcggttgcagtgacagtatcatgctaaagaatgactgctttccagaattttttcaactcaactacctccaacacctctcgctcagccggtgctatgatataatacctgatactctactgtaagtatgatttacatttacgctggtgaaaaagcacaggccaaaactcggtagtaaaatccatctttagatggatgaatacatgttcaaagcatgaacattgatattgatgtgccacaaaatgcccaggaaagaatatcgaaatagttcacagaatgtccagtaatcctgaatcgactaagcttattaactaactaacagctactgtcttagaatgctatcctagtgtctgtgaaggaggctttttcctctggggcacccacagagagcacggaaggcatgcccaatgtgagtgggaaacatctcccattcatttttaaagctcacagggaattcctgtaatctaatgatgggcatctcggatcgtaagaagaggtgagaagaactggtctatgagagcctgatgttatctgaaaagagggcatcttatgtaggtccatgaaagttaagaatctcatgcaggcattgcttacttcattccaaagtcttccttacaccaaataaaagtgtacagca

SEQ ID NO: 23061 - DNA, 1156 bp, Mus musculus
ggtgttaaaacccatgctcacagtgacatacctactccaacaagcctgcacctcctaatagtgccactccttgggtctcgcgtagctaaaccatgacattccacttcctggcccccataggcttggttcaaacacatgaatctatggaagccatacctagccatagcataataaagaagtatatttagtccaacttccagagtccctataatctatagcagtctcacaatgttaaaagtccaaagttctaagtctattctgaggtttatccaatcacttaactgtaatccccaaagcaagtcaggaaaccaactgggcaaactcccaaactctgcatctcatgtctgatatcaaaggggtcttcagatctccactcctttttcatctttgttgacctcaacaaacttctttctcctgtgctggttctactccctgttagcagctttcctctgcagatatcccatggctctgacatctttaacagcttgaggtcttcaagtcaacctcagcttcccagcttcttgttccactgtctgggatccacacatgatcttctgagctcctgcaaaggcttctgtagcaccctaggctttggctgactccacgccactgctgctgcagttcttggtgattatcccatggtaatggcatctctagtaaactggggtcttcacctacaattaggcttcaccaatagcctctcataaggctctcttcatggtgcccaaacttaacttctttgcatgacctcttcagtcctgggccatcaagtataactgaggttgcaccttcatcaattgccttccctggcctctcacagtgccaaatctcagctgctctccttgaccccttcataccttcaaaaccagtatcccctgggcgattcttacacattatcaagtccagctgcagcatgaggtacaacctttcctacacacagcttctttgtgctctgagaaaacacttctcagaagatttcacctaagtgatgctggtctcttcttaatcactgctaatttcttagtttcagctgaccagcatcaattgtcccagtaatctctcctaagcttggcagtactgaaacttgctgtagattgaccttgaactcagagatctgcatgcctgtcttctaagtgctgggattaaagaaaggtgt

SEQ ID NO: 23062 - DNA, 2033 bp, Mus musculus
atagccaaagagttccccagattctctaatatttaaattttttttaagatttattttatttacataagtacacagtagctgtttccagacacaccagaagaggacatcagacccctttacagatggatgtgagccaccatgtggttgctgggaattgaactcaggacctttggaagagcagtcaatgcttttaacctctgagctctctctccagccccaattctctaatatttaaaagatgcctgtttatgctccttgtaaagaaaacatctggctgttcagctattgaatggtaaaaataaaaataatccatttatgagtattgctaacacttaaattatagcatagaaaaaaacccagaaaaatgtatttgaatgaaatatgtagtaataacttgtttgttaaacatgcttattattttagattggttgtttcaacctttgcatttaagccaaagttgggtattatgttttaaagagccagtgttttattcccaaatgaacatggcttagcatgtgttagcagggattgttctatttgtgtttctcacagaatacgttctacatggggtggtcagacttgaacttgtccagggcagtttctcacctgttcccctgcagttattacaagtgctcaagtgttactctgtcatatgtcgaggacatagttctatgtaggtactgaaaggaagtattcatttctcattatctttttttttaaatggttgcattttttatgaccttccatatagattccccctttaaatcattatcaatagatagatttactctgaattgaaggttgcatagcccgcttgatcctaggacacatttgcatataaccttttactgtgaatgcagtcagagagcagttgaccagaacagtgataatggaatgctgcttataatttcatgattggtttctggaataacttaggcagatcacggaacctttcagtgcctcagtttcttcattttcagaatgaaggacgtatttactactttcctactgatctacctctctaacctgttgtgagggagttaaagtgatgatcatgtgctggggttaagaaagaggaagcaagttgtctgctgtgctgtgcccttgtgcccttgctttccgtccctcccctcctccctcctcactcctccctccctccttccctccctccctcccctagtactttgaagggacacggatggttatcacagaaagggtctttgagaacgttgaagtccctaaagcaaaatgaactagtttgtctgaaggtgaaatagtgactcgccatttgttctgtggatttattttgaaatatttttcttaaatatgtttttgggtttttttccccttaatactcagatgctactgtcagagtagaaggataaaaagaggactgtcccgttttacttctaacttttataatgctctgagacagaatgataggaatatgcaaaggggttcaggcccttccccttagggtgacactagcagaagtgtacactgtgtgcagatgcctcacaaagactgcagctctctgtaggtttgagttctttccacagtgagtttgtgatgtttcaatgatccagagtgttcaaaattttaaagagtttttcttacagggttttgtccccaaccatatagaaaagttactttgctgcgtaaacttgagtttagaaggcagtggtttcaagctgaaagcattgactttattgctgaggaattaagttaatatttattaagctgctctgtataaagcattgatagtgtgtacagtattttttcagacacgtattaacatataatgacacagtcacaaaaatattactacagaattcacatgctttatgtacaaagtggcttccttaaagaattatttctggtactctttttcttacatgttaacaaacatcatagaattatgtaaaattttgatttttttgagacaaagtttcatgtagcccaggctggcctcagactctgtatgtagctgaggatggccctgaagtcctgatccccctccacctcccaagtgc

SEQ ID NO: 23063 - DNA, 2361 bp, Mus musculus
ttgctattggaccacatacaagagttttaggatagtttcatctcacagaggatctcatctcacaaaagtgttaagagttaaatcaaagcatgaaaatccccatcataaaaacccatcagatccaacagtccacagtgtccaaaaaggaaaggttgctggttgatatgtatctggcctttacaatttcaattgtccaatgtaacatgtaagcataaaatatgttcaaatcgagtgtgggtaggaacgtcactgtgtgtttttaaagtatattttagcatgctaatggacaaatttcatttatgtttatttacagacctcattttattcctttaataggtttaaggaattttttcaatagtatatcgattaccatattacagggaaaataaaacctttagctacatttcaggctgtaaagtaaaatttatacttaaaatttgaatgggccatgcctgaaaaattacaaggatgatagtacatttgtacaaagagacaaaacatgtccctaaggaattatacacacttgcatttcaaagtgcagtggactgtacagtactggacgttaaaagctgagaggtaaatgcgtgtaggatttgtctttctctgtgcctccctccctcccacctccctcccaccaccctcccacctccctttacaacatggctttcatgtgctgataggcttttctcttttgtttatgtacacagttgataatgagcagtacactcaaggaactactttacttcaaatcccactcagtgaaatcgcagtcttgtacctgaagtagtaaaacacattttgctagactagtgaacaatgtctgaatagaagcacagtgcatactagctcagtgcgttttctttgatgttactaaagaggacactgcagtaaaaatgttttcactgtaaagttttgtataaaatgatttttaaaaactcaacattaagaatgtgagatatttcatcataaaaaggaattcataaaagtgcacatgttaaaagtggaatagattaagggttacacaccaggctgtggcacatgcctttaatcccagcccttgggaggcaagaggcaggtggatttctgagtttgaggccagccttgtctacagagtgagtttgaggacagccagggctacacagagaaaccctgtctcaaacaaaacaaaacaaaacaaaacaaaacaacaacaaaattaagggttgcaagaagagtgaaatttgatttctttttggatagtacttccaaatcagtggcttttgttgctagagacttggaagcccaggcaggtttggcaccatttctgggtctcagccctgtgagccatcctcctgccctcctttctcctgccaagggatcatgctctcacctccatttccttccatattagccactgtaacaataacaaagttccattctcaaatgatttctgggtggagatcaggtgaggtcttgctataatttaaaaggttcttaataaagtaagactgtgtaattctgctactatcttaaaagatgtttttgcttcttcctagaaaacccttccttttatgattatattggtaacttgtaaaagaattttgttgtgtttgatgcaaaagaatattgggagtggctgactgtggcagacatgtaaggcaaatccacagcctattaaagtgcacagcatttgcatttggtattatggcataaatctctatctttattgaaagaatactggctaatatcttccctgttaggcatgccaagttgtaggggagagattgtgttatttatttatttttttttaaacaatccaatggatttgtttttgtctgtattttgagaacaacttgaaggatttttttttcattttagaagatagagtatgtatacctgccttttaagttactataacctaatatatataaattataacattgaaaagtgcaaaaagctctaattattgatgttatttccctggtatttaatttttataaatggttttgtaagtaaataattgtagtattgctttgagtagtttaaagtcatccttaaataagttctgactcaacatactgccttagtacaatattctaaagtgaagtactctgatgtgaatttgaaacatgcctgcattttctaagtttcttcatatgtatatgtacatacaccagtacccaagaaaagcataccagaagcctgatttccacattgcattgataaggagcttggtcttttgccttcatataattcagttgcctgggtgaaatagaacataaatctcttcaaatgtctgtccattcacagttttcaaaatggtaacttttcatctggggaagcatgatgccaagtttatctgtaatcagctctattactgga

SEQ ID NO: 23064 - DNA, 1196 bp, Mus musculus
gcccctgtgttatttatttattgtttctagttccatttttagatcctggatggtttcattcctttccttggcctgtttgattttgttttcctgtaactctttaagggatttttgtgtttcctctttaaaggcttctagctgtttacctgtgttctcctgtatttctttaagggggttatttatgtccttcataatgtcctctatcatcatcatgagaagttattttagatcttaatcttgcttttccagtgtgttggggtatccaggacttgctatggtgggagagttgggttctgatgatgccaagtaaccttgatttgttgcttatgtccttatgcttgcctcccaccatctggttatctctagtgctacctgccctggctatgtctgactggagcctgtccttcctgtgatcctggttgtgtcagaactcctcctagtcaagctgtctctgggatcctgtgactctgggatcctgtaatcctgagatcctgggtgtgtccaagctcctgggagtcaagctgtctttgggaccttgagatcctggtgtgaccaagttcctgggatcctgggcgtgttagagcacctgggagtggacctgcctctgggtgttgttggggctggctgtggagtttgcgcccaaggtcctaccaggtttcatgattaagtttgcaaatccaagaaggtatagggctgtagttacagtttagaaaggctccttggtgacattgtggagaatagattgagagatgtaatcttaaaagccaagaagccacatcctctgagcccaggcttgagccaaggtgaagggaagaatcagatgcacattcctcataggtcgtacggtgggagggggtgggaccagacaaaagcttgacattccatgtgtagagtttaggtttttccaagagaatccaggaaaggcatagatgcttatggattttttccagaaactgagtctggtaaggacttatcatggtttctttatcatggagttttcctgggagcactttgggagtttcttgggagagcagggaaaggctgagtagagaggaaggttggtaggaatgttggtgcaataacatctctggtggatgattcttcagagctggtaaatggtaagctaaatgtctgagcccttgtgttcctgacgcaccatcatcaattgttggtgattggatcatctggggaatggt

SEQ ID NO: 23065 - DNA, 1194 bp, Mus musculus
cttattgggcctgcctctcagaggatagtagccatgctaggctcctgtctgtaagcacaccatagcatcagcaatagtgtcaggccttggagtttccccttaagatggatcccaagttgggttggttggttattgaactgcctttcctccatttttgtccctgcagttcttttgacaggaacaattctgggtcagaatttctgactgtggaatggcaaccctatacctccacttgatgccctgtctttctatgagacgtggactctacaagttccctctctgcactgttgggggtttcatctaaggaccctccctttgaattttgagagtgtctcacctttcaggtctctggtactttctagatggtctccccacttcttacctcctgagtttgcatatttccattcattctgctagctctctgggcttctctcctgtcccctcccccctgatgcccaatcttgttcccttttccacctcctctttcctctcccaccctctttctgcctcccttgattgttttcttcttcccaagtgagattgaagcatcctcacttgagcccttctgcttgttaaccttgagttctgtggattgtatcctaggtattctgtacttttttggctaatatccacctattagtgagtacatgtccttttgggttagagttacctcactcaggatcgtattttctagtcctgtccatttgcctgcaaaactcatgatgtccttgttcttaatagttgaatagtattccattgtgtaaatgaaccacattttctatatccatttttccattgtgggacatctgggttgttccccatatctattcaatagtgtgtgtgaagttctggctagagcaataagacaacaaaaagagatcaggggattggcaaagaataagtcaaggtatcactatttgcagatgatatgatagtatacacaaggcaatcccagaaattgtaccagagacttctagagctgataaacaactccagtagagtggctggatataactcagacacatcggtagccttcctctatagaaatgataaatgggtgagaaagaaaatagggaaacaacactcttcacaatagtcacaaataatataaaatgtcttgtaactctaacaagagaaaaacatatgacaagaacttcaaatctctcaagaaatgaagaagacctcagaaaatgg

SEQ ID NO: 23066 - DNA, 2125 bp, Mus musculus
ttgagacagggtccctttatgctctgaccggccaggaacttatgtaaacgaggcgtagatccacctgcctttgcctcggtgctgagattcagagtatgctgtgcttgttttagagcattctgtaatgaagtcgtggctggtttaccttttggcaatatacccaaaccacaaggaatgtttcttttttgttgaagattatagaagaagacgctgctctagtggaaataggacctcgttttgttttaaatctcataaagatttttcagggaagctttggaggaccaaccttatatgaaaatcctcattaccagtctccaaacatggtaagctgggggttttagttgattctcttttgtttcagtctgtgattctgtagttttttagccaaagtaattttgtaattagtgctttaccactcgtaacactaaatttgttttgctgcacatttctgcaaattcccttttaaaatgattttggtgagggtacatacatgaatgccttaattcaaagcatctcctctttgctgtgtctagcatcggcgtgtcataagatccatcacagctgccaagtatagagagagacagcaagtcaaagatgttcagaaactgaggaagaaagaaccaaagactatccttccacatgaccccactgcagacgtgtttgttataccagcggaggagaagccagtagaaatacagtgggtgaaaccagagcctaaagtagatctgaaagcaaggaagagacggatttacaaaaggcatcggaaactgcaacagaagatgagcagagggagtgcaaagtgaatcagaggataactgtatttattttgtattccatgtgtaaatacttttagtatacagaacgagctatgcctaattagggcaccattttaaaaaactgaaatctttaagtcggtgttggtctttttctaataaagcatcttaactcaccagctactttattcttttcagagcctcacttagcacacttacgagttggcttgccctgtttgcttagaattgcagtgtggttaagctgatattcaagcagactagttgggtctgtaattacttaccaagacgttagggactttagagtggattttttttgtgggtggcagagtggaggagatggtcatttactgagttttctctgctgaagtcacgaattcatgaagccttgagaagccgacttgtgattgttaacggatatttgatctcactgaaccaccaaattgtggtgtttactgaaaaaaacctgttctagttgtggctcagcctttgcacacacctttaatcccgagggctgaaatactgacacaccattaatcccaaacaaggtaacatcagtttgtagaaggaaacacccttgtttgaaggtgatatataattacgtggcagacaaagtgacgagtcagaaaaagatgggagagaataggatatgcccgatgcgggaggagagaggctcttgagagcagcagagaaggcagcttcactggcacagttgcacagagacgtgctgaagaaagaatgagccagaagattagaacagatagccagagttcatttgaggtcaagcacagcaaagaggccaagagagaagtcagattgaatccgtcagcttggagaggagtttgagccagaacacctgagttgaatcagctagctggagatcagaaaactagaaagggtgagcttaattcagtctgttgaggctgaaggcactctaggcctggaatacattgtacagaggctagaagcttccaggactagacctaggttagactgagtatgcctcggagacaacgatgacatcaggagaatacaagttactttgacatctgatcatttcagtgcctctacctctggtgcatccaagtcttaggttttgaaaaacaagacctgtttgtaagcagttttaaatttatcttagacaacttcagattctagagagcagtagcaacagggaaaacagcaacctgagccaccagtgatgatggggatagctgactagggagatgcatgaacatagatgatatatatatatatatatatatatatatatatatatatattatacacacacacacacccatatatacatatatgtatgtgtatatatatat

SEQ ID NO: 23067 - DNA, 1517 bp, Mus musculus
agtgaatgcttaagaccctttctcctgtggatttaaaaactctactctgtccccccagctgccttaaatctcatccccttgcttgtggtctcatcatttgatgagtatcattaactaaagtacaacgttttaagccaagagtgaagtctccttaaaagttttcagtaagtcaacatactgtaaattttctatgcaaacttgcctagaaaactttccacaatgctcaggaagtccagatatttgtatttcaacaaaggacagtaaactatgtgtttacagccaaaagacatgcctcatagttcttaacctcaattttttaaaagtgttttttttcctctatgatatttttattggcttttaaagatgttttcatagctaaagccctaagtaagtgagattagattatattaacattatttttagataaacatacttaagacttctcaaaaatgtaactttttcctcaaaagttttcagagggtagttatatattccaaactcagtatgagctgccaccagaaccactaggaatttctgtagtctacttctgaatgcagtaaatactccttttgcccgttgaacttgtaaacacctcaaactctagcacccacgaatgattcctgaaagggctgtcagttccagtcagcttctccatgttgaaagtaaaagttccaacatggcaccgcggtgcatagcagaaacctcgggggaaatacgcctaccgaccttactttcaggttgaaaaggttcaacttgcttgcagcttctcttacagcccccatggtgagggagataaatgaaataaaggaactttgggtgtgttactaaaggtagcggtctactctgacaggacccatctgaggccacgtggctgagttgggtctgttcatctgtcttaggtaacgatcaataccagcatgaattgggtctgttcatctgtcttaggtaatgatcaataccagcaaaacaaaagtggctttaggttggtggtgatacttttcttaagttgtctgactacagttaagcatttctcaaaaatgtccccaaagaaatgtgaaaggatttgccacgggacttaagaaatgacaaagccacctccccttgtgtccccacacagaaatgctgcagagtgtttaaaacttgagacattttgtaggacgcctgacaaagcgtagcctttttcttgtgtcaggatgcgtatttattacaagtattctggttaaatattgaaaagttatatgctgtagtttagcattttttttgtctttgtaatttacagaaattattgcagaaaataaatgtggttcattttgcatcccttttatggatttgtggtgtttgtgagcagatccagtggctacagtaacacttgagggtgacggtttttacatcctgcttgaccagtgggagctatccccaccagatcacttaagaatccactccaccatcctggagctgtgcccaccagatcacttaagactccaccatcctggagctgtgcccaccaggtcacttaa

SEQ ID NO: 23068 - DNA, 1146 bp, Mus musculus
caatgatgtcataatccggcagctccaagattccctgcatgatctgcagaagagattggagagctccgaagcagagaagaaacagctccaggacgaactccagtcacaaaggacagacacgctttgcttgaacaacacagagatctccgagaatggctctgacctcagtcagaagctcaaggaaacccagagcaagtacgaagaggccatgaaagaagtcctgagcgtgcagaaacagatgaagctgggtctcctctcccaggagagcgccgatggctactcgcatctccgggaggcgccagctgacgaagacatcgacacactaaagcaagacctgcagaaagcggtggaagaaagtgcaaggaacaaggagcgggtgcgggagttagagactaagcttgcggagaaggagcaggccgaagcgactaagccacctgccgaggcgtgtgaggagctgagaagttcctactgctctgttatcgagaatatgaataaggagaaggcatttttgtttgagaaatatcaacaggcccaagaagagatcatgaaactgaaggacacgctaaaaagtcagatgccacaggaagcccccgacgactctggggatatgaaagaggccatgaacaggatgattgatgaactcaataaacaggtgagcgagctgtcacagctgtaccgagaagcccaggcagagctggaggattacaggaagaggaaatctctggaagatgcagccgagtacattcacaaagctgaacacgagaggctgatgcacgtgtcaaacctgtccagggccaagtcggaagaagcgctgtcggagatgaagtctcagtattccaaagtgttgaacgagttgactcagctcaaacagctggtggatgcacacaaagagaactccgtgtccatcacagagcatttgcaagtgataaccacgctgcggacaacggccaaagagatggaagaaaagataagcgccctcacagggcaccttgcaaacaaggaagcggaagtggcaaagctggagaagcagctcgccgaagagaaggctgccgtgagcgacgcgatggtccccaagtcttcctacgagaagctccaggcctccttggagagcgaagtcaatgccttagcaacaaagttaaaggagtc

SEQ ID NO: 23069 - DNA, 1135 bp, Mus musculus
ttacactctagaattacctgtatagaatgtctgtctggtaaagaaacggcagacaaaatgttccatgtagacatcattttctctctggaaagttcaggtcaaacattagctgtctcttagttagagcgcctctccctcctctccatttctcctccacccttgctcagtcttcactgtgacagatgaaagcagaatccctcatcggtcctgggattccctcattagggtggaattctcctgaggtctccttggagctctctgagggtgatgagcgaggagtgcgtgttatcttccgtgtgtttgattagaggggatgcattaagtggttaggaaagcactgagggtaaatcagtaaaggggagcccttaactgtgacaaggtggttacatctgtcagtgcttagctctcctcatcttccaggagaaataagggtccagcgactcaggcagcatccgggaaggtcgcactgatgctgggtgtgttgctaaggaaccaagggaggcagagcatgcccagccttgttctaccttgacaaaatattatattctacttgggcacctaacgctttctataaaggaaagaactcattttttttttttaaatctttctctatacttgcttatgtattagagctggctgattaagtcagttgcctgatttataattatactatgcctcttgttgcttcagcgtgaattgggctcagggtacttgatttatcatgggaagcaccaaatagggagaagatagatttcttcaaacctgcttggtgcttttaactgtagaaagccaaaccaaaccaaaaccaaaaaagtctttggctgttgatcttaagaacagccttagaagaatttggtctgaggaaagatcacaccaacatgtatgaatatgtatttaacttagtagatttcaggtcatggcattgtttgtaatgtgtgaggatagtcttttttgggggccggggggacctgaatgtttcacaggcgggaagggagataggctcttcgtatacggaagaatgacattctggggataatgtctctgagtcttccatctctgagtactgtgagtcccctatccgagtatctctgagtctgtctctgagtactgtgaaccctcttgaacactgtgagtt

SEQ ID NO: 23070 - DNA, 1123 bp, Mus musculus
ttctcttccaggagtagagagcgaagaattatcctcattatggcgggacagtgggaagcctgtcagacacatgagacgcggctagagctacttctgagaacctcagttgttttctttttagttttatttgttttatggttttcaactttaagatactcaattctaacattagaatatgtttaattttagaacagcttgggtatgcatatctattttgagtgtaaagctcatagacagtaaattacgtgtcaggtgtttccaataagcatgtaacataggaattaagctatactaaaattgggctgaaatttaagcatatggtttcataatctagtaattatcaaaactgctctctgatgctgctgaagtgatcctttggctaccgtaggtcatataaaatgttatccaagttgcatctcactagtttctttgctaaagtgggctatcagaaaatacaaactaggatttacaattcatttctcctgggcagtgtagtgcataagaccctgacagcaacacacaagtcagaatagcaaaactcaaccctgacagggaagcaaggctggtcatggggaagcaagggatgtctttccatcagagatgggaatcttcacactactcatatttatctctgagggctccctgccacgttcctgcctggaatgctggagtgcttcctgccgtctgctggtatgtgcaaacaaccctgcatttgaggatgctgtctaccatccttaactgtagcttgatgccactgatatcagtggaacacctcaacagaacaagcacgttttaacgctgtggttctggcttttgtggcatgagtatactcgtggtgagtggacgtgtggctgtgtgtgttttctgttctctgtccttagcttgggaatgtaattgttctgacttgtgcttttgctgtccgtagaggggagtttccattcttggatctcagatttataaccacttccttattttcgtcctgcctcctaatgtgctttctgaaaagggacttgaccttcccataatccagttttccttgaagtgttaaatcatccacttaagctgtatgggctttctgtgacctgtggaatgtgaatgtctctccattattgacagtcaactg

SEQ ID NO: 23071 - DNA, 1150 bp, Mus musculus
ttcgatgtctccctacgtggaattgcttttatatgatgttttttttattaggttcactgccttaagtgactcaggccaaaagttttaggtacttaaagaggtcctttttaaaaataaccagaacattttgtaagcctgaatgtatatggccatttgtccacctcagtgtatcttaagttacagggaagttcgggtgccctgggatcatttctgctgttgaggaaagtccttccaggtctctcactgaagtctcacagagcttcgcgccttgtgtttcagttgttggtgaaaaagagaaagccagtggcacggtgaacatccgcacgagagacaataaggtccacggagagcggacagtggaggagacggtgcggcggctgcagcagctcaagcagacgcgcagcaagcaggcagaggaggagttctagcaggcacacgctgtgcccgagctggcgccgtgtcagggaagaccttgtacaccgggaagcaagcgtggcttcaggccgagcgtggagtagctctgcagtctgcatgaatcggcctttgatctggccaagtcttagagaatgttgtagatgggggttaagagaaccatttaaagtattttgttcattaaatgcctctttccaaaaatggaagatccaaaaatggggatgttttatgtacccgggttattttgtatgaattcaatcaattaggaaataaaaagattttaaatgtgtctaaggagaaaacagagttgaattatggcgttaaaataaaatttactaccaaagatatcaagacctctgtcctcacggttatatagaagcgctggtcaggttgtacccctcagtctccatctgaggcatagcgtatgctgatccctaactgaggtgggagctgggtgctggcttgttagtgacatttttatttcttctggggaagacagctttaacttaaaacagtgatgctcaaacttttaaagctgtgtcttcaatgaaatagctgtgtatggaagactattccatgttaaataatctatattatgatgaaaaacttcaaatttctataccagctaatcattttatggaaaataacatgagggaaatttcttgtgtaattttttaaaagatttatttatctatttatttattatatgtgtgtacac

SEQ ID NO: 23072 - DNA, 1150 bp, Mus musculus
aaagttctcctattgaacatcaggaactgaattcccagaagtaaacctcattttggtcctttgttctctttttttttcccccttgtaattgttgtactgatcattccatatttatttaagttctttcttatattagccctagaataatctagaatactttaccaacttggtagtttattgtacattcccatttaaggtggatttttgtgttcccttttgtctttgtcttctttgtgctggtgcgctgtgtccaataatctttcctttagatttcattttggtgagtaaggcttctatttccagaaaattattgtatcactgaagagtttatcttaattctccttttgttgttcatattatattatgtaaatttgttaaaagtcactccccggatgaatttaactgaaaagttctcaaatggctcacgtgacactgatgctgctttaaggaagtgtcttgctcacctggtcaaacacccattcctcactgcattttgccaattcaatccattttagatgtaacctcgggtatggtgaaagacccaccggacgtcttggacaggcaaaaatgccttgacgctctggctgctctacgccacgctaagtggttccaggttcggaacatcattttacttttttcttgtagccttatgagagagtagttcagtacaacatgtttaactatgcttaaacatttcaaacaattgcctaaacaacactattttaaattaaatctcagaaaataagttaccatagaaagctgagtgtaacgatctgcattttgcggttactattaatttgacaataaacaggtttggggggtgtttgtagtctgggttttttatttttagtggctatatttaaagttgacttgcttaggaacatcacatgtttttgtatatatattatattccataaggctgcagattaactttgctttaaataatggaatatgtgtttaaagctttgtgtagagttataagacttttcctcttctttctcctaagttactaagtgtagggaatgaaaggtgaggaagcagctgcttggtttagtgactttgcagacatgcaaaggcacggagaggaaaccaaacagatttccttaacctttcagtccctagacaaactttagctctttacttttccatt

SEQ ID NO: 23073 - DNA, 1882 bp, Mus musculus
tagagtgttttggctttaaattaattctatattctaactctatttgcagtttgcattgagactccttgcattccgtcagatacacaaagttctggggatggatccattaccacaaatgaatcagcgctttaacatccacaacaacaggaaacgaagaagggatagtgatggagtggatggatttgaagctgaggggaagaaagacaaaaaggattatgataacttttaaaaagtttgtgtaaatcttcagtgttacagtaggtgccggtttattggctgttttccattcatattaatctctactttaaaagtttatcaagagtataaagagtttcatggaagaaccaagtttttctatgattaaaaacttattgtacagtgtcaggtattatatggatggaaagaaagagatttgactagggggaatatattggtctttccccccccccaccctttttcattattttgattttattgactggttgcccttactccctgtatttttgtgtcttttattaactagtgcattgtgttattaaatcttttctgtatgtaatacaggatttgtgcttcagttgctctgtgtattttgatacttttattgagaagttctgtttgctttgacacagttgtaagttactttgtgttatagatggcaccctttacccttactactttatagcagtgcggtttttttgtaacgtgaaactgcaggagttttcctttgttattctgtatgtgaaggattacaatataaaagctaccctgccatctaagtgctcagaaatagctgtttctgcagatcttgtggcatttgtctatctagtgtgatatataaaggtgtaattaagacaaattccttaatctaatcaagtttgctgttagttgtgcattagcagtataaaagctaatatatattatatggtcttgcaacagttttaaagcctctgcataattgataaaaaaatgcatgacatttttgtttttaatagacatttaaagtaataattttaggtttaacacgtagatctttgtacagttgactttttgacatagcaaggccaaaaataactttctgaatactttttcttctgtacaagtggaaagggaatttttcacatctaagtgggctattgttttcaaaagaactttatcattgtgcaactaacaataactagccctgactatgtgacagttccctgttgatgtgtgcaattactctagcggcttctacagtcttaacacagttgaatgatccccacatcctgtcacccagatcatttataggtctattaactgtgagattgataaagtattactgatttaaaaaaataagagtatctaagaaaaaaaaaaaacagaaaattatttggtgtggccatccaacatgcttatgtcttatacagaatgctaatcccctggcagtggtgtaatgagaggtcacaccttactgtgatgtgtgtgtgctctggtgcacagatgtcattttgttgtcacagcactacagtgagatacagaataaacacttaaattcatgtaatgacttacttgtgttatgtggtaggcttgatggtgacaacttttgcttgatctgctacttgcgcttcggtaaaactgcattcatatatactatgtgtatatgtgttactcctgacaagggcgtggtggctgacctcataatcctaacatttttaggtttcaccaccatattggttcatttttctaaggttggaacccttccccatatgaaagaatacaagactggcatttttgcagatctgtctatattatctgttgtgtttataaaaagttgagagaaggggatatgttttggtggatgtgtagtcaggtgtggtaaggtatgaggtaaggggtgcctccg

SEQ ID NO: 23074 - DNA, 1099 bp, Mus musculus
cttgcctctggtatactttgtcccatttttttcccagtccaaaatcatttctttttctaagtgttttgtttattttgaaactaggtttggaatttcgcaggctggcttgggatttgtggccctcctgcctctgcctccagaatactgggttcacaggtgtgcatgctgtccttgtttttcttgtaatgtgtatttttctgtaacaaggatgcctgacttttcttttagacatttaaatcatggtttaaaatttcaaaggcctttttctttaatgatggtctcaacttttattcatctctcctaaggtttttccccctccttggaattatagattctgaaattaacctctatttttgacttgatgttaagtatatttttccaccttatagcagcctcttataagacaggtaacttcccagtcccttagcctaaaaagcctttcagaccccagctgcgtgtcggtgtctggtctggacaaggtggtcagacagcaagtgctgcatgccgtgttgcagaaggtctcagcagatgtgctgtggtagccgctgcacactggttccccagctccagtgtgtgactgtaagatgaggcacaagaagccttatccacttacctttcaccttgaccataactaaggtacttttcctgggactgtcttaagccccaaaccggccccaacttgattgttttcttcaaacactggtctctctggaggctgaccgaataacagcgccatcttcaggggtttccacagtgcttgagctgcagataccgcctgcttgaatgcaaagaggaaagagtctgagaggctgaaagcttagtcttcatcttctttttgaaagctagattaaatgaatttttagccaacaagtgaattcaaaagtgaagaaagccagagggagatcccgtgggaatgatggttgtctgctgggtgacaagaaaattcctttgtttttgttgtaaagttttctctccacttctgcatgtcctttcctatccttacgcaaacaccagcagaatttctctgcttccatggagcagaggctgctctcagccctagtgtgttttggctgtagagtctgtcttcaggagctgtagt

SEQ ID NO: 23075 - DNA, 1073 bp, Mus musculus
acctgctctgtaatgaacacaagagaaggcagccgaaagctggggcaggggtgtgaagagggaaggctcccccaggctacacagtgagctccaagccatctgtgtaatatagtgagacccaggctccaaacgagccacacagaagaggcttgaggccagtatgagctgggtggatgagaggtcagaaggtcccaaggtgaggctggccctgagccattcggtgactctcccgctcagcgtcactttctctcctcagttagcagtccctgctcctctgagtgagctgctgtcaaggctgagctgcagtgtgtttgtcctgtgtaaacagcgggagaaacttcgtgttcacattccgtgcatttccttccctgaggcctctgaggagagcttgctttggttttccatcaggtgaacagctgctttgtgaagccagcacagtcctgaagtatgtgcaggaagattcgtgtcagcgcggcgtctatgggagactcgtgtgcactgacttcaagatttccttcctgggggacgaggactcggccctggataatggcggggtatgtgtgaactgcatttgctgcgtgggagggaaagtgcaggggagacgccattggtttccctgcagcttctccctcctcccaacaaacacaaaagaccaacgtctcctgtagtggtctgctcttgcccttcaagggctccttccaccaggaggaccccttagaaataccacctgtacttcatgactcccttgctcttgcccttataagttgacaccatcaactctttcccgattccttctgcactcagcacagcttgagtcacttgttggaatagccccacacacagttcctcatggttcctctctgctaagcactttcacagattcgggaactgaaggctgtagtgaaactgaccaagagcatagcctttgagcttgccttgtttctgtctgatctgaacctagttgcagggtcatggtgagacttgtgtctacttaggagtgagctgtaggagaggaacagctgtgcctcccagtgaaaccctgccagggccctgccggactgaccccgagtatc

SEQ ID NO: 23076 - DNA, 1097 bp, Mus musculus
aaagtgagctccaggatagccaggactacacaaggaaaccctgtcttgaaaaaaaccaaccagcttactctcttactcttgtgtctctctcctgcctcttgccctcttgctcctcctcccttcccctcttcccttcccttccccccccccctccacgtggtcatggccaacctctacttctctactctcttcctctctctgtctttctcagcctctactgccctcttaactcccctcccatgccctggataaactctattctatacttaaaaaaaaaagaaagaaaagaacaaccaacaaaccaaccaacaaaaagccttcaagaaataaaacaaaaacccccaaaagaatgctgctgggaggggtgtgtcctgagaagctgacagtcttcctgctctttagcattgccatgtagcactcatttctactcacattgattatagtgtttgatgagaaaaagaaacctctgtttggacaactgaagaagtaccccgagaagctcgttatccattgcaaagacctgcgggtgctccacttctgtctgaggtacacaaaggaggaggaagtcaaaagggtaactagctgcatgtgtttttagggttttcccatcaggcttcccccagggactgtaggcatggcttatattgcctgaaggtggaagggagcctttttcttggtgcagctgaaagcagctggactcacgtggagagagtgggcaggcaagactgtattgacttggcaagtgctttgagtcctccagttcctagagctggccacctagaaagaagccctgcagggtgggaagtgatgagttaggtaagggtctgctggagagtgctcaggctggtcctcgtcctgacagtctgctaaacaggagcactaccttccagcaactaagagtcagtgtgcttaccactacaaggtatcggttccgtgtggacctagaaacacaggtcaccaggtgtcttagtcagggtttctattcctacacaaacatcatgaccaagaagcaagttggggaggaaagggtttatttggcttacactgccatactgctgttcatcaccaaaggaattcaggactggaactcaagccgg

SEQ ID NO: 23077 - DNA, 2240 bp, Mus musculus
tctccttttcttccacagttctggaagacattcaatgaaagccatgcctctagtatgcataggacggagttcctccttgacctgtcataggatggggtcgtctcctgacatctgtattatatgtatacagaatggctcacggccaggctgctgtgagagctccctcctgttgtttctgtgccaagataattatgtagccattccgaacaagaggtattcagggatgtgcttagaccatagcatattccttgacttaaaccatagcatattccaatgcgtgcgtgtacacacacacacacacacacacacacacacacacacacacacgcagcccatagagaacttggacagttctgctggtgtcatccatcctaatgttcagcccctccttcctgggctgtaacaacacaggatgcgggcagcctccttcccttttcctttgctgtcactcccaccttcccttttcctgctctatgcataccatcctatgagtctaccttggtgtgcatcgtcccagggtcctgctgctgtgacctgttgattaaactgggggcagtcctctgtcttccacaggggagctcattcctggagccctcagttttgaccacacatttggccctctgctcaccacacctggactgtgcctctctgcagcccctcagctggtccccttgccttccccgttaccctcacagatgctggggtgggcaggccaattcgaatgtggctttcacaggaaagcggtcgtgtcagaagcagttatcactcatatatgcctcagcgatgtcaaaagccatagaagaaacccagctctgcctagtcaccttggatctgctgtcttaaagatatatatttttttaatgtttgaaagaatcctttgtaaggctcagtcctatcattctcaacagagccctgttcagtcccacaaacggtgtgaagagtgggagtgggcgagggacctcattgagtctgcctcaagtgtttgccttttatctatatttgctggtcaggagaggtcctgttgagggcgtctctgttgctcatgggcaataagacattttgaaacttcacaaagaatcctttctgattgcactgaatcatctttcatacataatgataatttttcctcgtctccctccataataatgcacaatccgggttggtgtgttgacccagcaagttgaggggaggtcaggatttgtgtttctggggacaaatgcactcagtctcggttgccttaagagtctttcaggccaggttcgtgctaggcttgcgctaggaacttagaacacaccagtccttagctccctctccctgggctccttgggcttctctaaactagcactaaccgccacgccctgagcctctgccacaccctcagcctctgcctcccaagtcctcagcggagagaactatttttgttaccatattataacgtgaatgtttatatggtagactctacagtcttagtgattttctttccaaaaaatgcctcttgtgatgttttgtacttcacaacgtatggtttaaaggcacatggtcatgacccttggtatagcagttgaatgtgcattaaaatatttttctatttttttaaatcacaatagaaaaagtaaataagctgttatgacctgtgtggttatgacttatgtatttatatttgaagccagatttctataacttggatttgtgtacagaacttcccgtgggtttatatattgtgtatttttattcaagattgagatgtggattatgcttaacattaaaagatacaataagaccatttgtttaaaacacactgtgcaagtttggaagtgtctgttaataatttactgtgtataacacttgcatttgtttatacctctatgtttttacactgaagataaactagctttaattaaattttaaaaatttaagggattaagctattagactgagtcagcttcactgtgcagtttattttctgggtgttaatgaaagtttatacatgtctcactgcattggagctgactgcagagattaaagcacaactttgaaacagcgccatggttggtgtgcacggtctgctcctagtttatcctcctcattcgttcaggacttgataaacgtgtcctgggttctggcaggccccacagcaggcagagcccagggaagcacaaagctgtgctttccaggaacccccacacctccaccctttcctatcctctgcgtatatgcatgtatgaacactcgtgtggttg

SEQ ID NO: 23078 - DNA, 1178 bp, Mus musculus
gccctgaccactttacagccgcagtcggaggtaggaaagttttacaaacacaattcgtcaatttgtttaacctctctacgccagagcacagtacatgaacagctttaaacgcccgagtgtagatgactccttttgaaactcgggagtttcacaggcgaagagccaagtcctccccgtaggtagtgaggacccgggctatagtggctgatccccagggatgctgaggtctcagtggggtccgccctagcctggcctcggcttctgggatccaggagagatctcactggtcgctggcgccaggccggacctttagagtgaactgagaggcggatgaaagccgggcaggtcaccgatcgcaaacctttcgtctccagactcagggccactagcgagtccagaagctcaagtgtccgccgaagtgggaggcggctagccacgccccccgctcgcgccgcttccggcaccccggccccgccccgcgccggcgctgccacatcctccggtgacgtcagcgcgcgccgccatattgggaagcgccaccgccgccgccgcctccgctcgggctcctgggctgtgtggggggccacagccgcgggctgaaggctcccttgtgtaccccatcgacgcccggcccgccggcttcgcccagctccggctcctcatgaccgccttcggccccgcagcccacggacatcgccccagctccaagaattaacacggaagctcccggggccggggccgtgagggagagccggccggtcccgcgtccctgtcggtccggcgcggctcttgtgcgggagccatgacctcgctgacccagcggagctcgggcctggtgcagcggcgcaccgaggcctcccggaacgctgccgacaaggagcgggcggcgggaggcggcggcggcagcggcgaggacgaggcgcagagccgccgcgacgagcaggacgacgacgacaagggcgactccaaggaaacgcggctgaccctgatggaggaggtgctcctgctgggcctcaaggaccgagaggtgcgggcgccgcggccccggccggggtggcagccggggtggcagcgggacccgggtggctccaggtggggcccgggtgggcgctggccgaggcctcacctgtccctgcttccggagccccgcgcccctgagcgccctctcgtcccaagga

SEQ ID NO: 23079 - DNA, 2620 bp, Mus musculus
gattagctaaaaacctggtagaaaagggtgtactgacgacagagaaacagaacttcctcctgtttgacatgacgacacatcctctcaccaataacaacattaagcagcgtctcatcaagaaggtacaagaagctgttcttgacaaatgggtaaatgaccctcaccgaatggacaagcgcttgctggccctcatttacctagcccatgcctcggatgttttggaaaatgcgtttgctcctcttctggacgagcagtatgatctagccaccaagagagtacggcagctccttgacttagacccagaagtggagtgtctgaaggccaacaccaacgaagttctctgggctgtggtagctgcgtttaccaagtaactgtcagaattcaatgtttcctttttctcatgtgaaccagtagtttttcttctattgactctggttttctgcagtttgtactttcccacactaataattggcttttgttctacaaaatggtgggtggatatttctttttgtatgtacgcaggattctgctggtacgagaggccttcctctttctgtttgtaaccaaccttctcgccatattggcaccctaccccctgttgccactctcactgttcctgttttgggtttctggtgtactgtgaccttcagagtacctccagcccccacctcatgcacagcgttctattacctcagcttgagtctcccacatgtgcttattcacctggccttctgcctgcagttcagacaagtcacagccaggccttcaactcaccaaaggcaaacatctgtatctattaggacgttttatacacaaacctcagttgagatgtatacttagcaaaattatttttcaattgaaacagcacagtaaatacataatataaaatgccccttgaatttttgcttcctttgtaaatctgttgtgtgattacagttgttataattttagctgttcaatcataatggtccaattgtttcacaaagccagtttgggatgggctgcattccactaatgctgtatatagtttgaattatatatgaatcgccccttcttctggccacctctgcctcattttagtattgaattgtgcatctggtgcccctcacttgcttcattcattgttatctgatggcaaaatagagctctcattattgaaggagagagatgtgtgaccctttcagggctctttatgagctatgcccctcatgatagtctacctgtgcatcccttttgggacttttttttcctcaacttttcctgttttttatgatttgtgtaggaaagaggcttgtgaccagtactaatcttgagtacagtttttttgttttgtttttccacttttctgtccttaagtaaattaatgtctgctctgatatatcgttcatctactcatcttctcttgagaaaagaaaatcagatatcagtcctagcagatgttgcatgtaaattggtagcaagtaacgactacaactcaagacgattaagaattttgtaacagaaagctctgctatgttttaatttttatatacaattatgatattagcataccataagactacaaacatctgctttttaatgttgattttattcattatcattgtttatttactattcgtttcataatgtaaatactatacattgaacaaattaaatgtcaaatttttattattatagttcatgttaatagtggggctttcaggtgtctagaaacttttggttaacatttgatgcaaaaatactagatgcgtataactttagagttgaattttaagggactccctaatatgtatactatctttttatctggagtaataaataaactatgatcttgaaagtgcctgaatcagagcaagcatgccatttgatttttgtgctctcgttctctttgctttaggtgaaggttatttagtatggcacggtaacatttcagctgcaaggcttgggaaactgtcttaaaagaaccagataggaaatactttaaacttggcatgccacatatggtgtttgttgcagaaactcaattctgctgaatgaaagctgtcactgacgatacaaataaaaggcggcagaacactagagaagcaggcagcgtgtttgccaccaaatgggtttgcccttccctttataatgatgtatagggaaattaaagaataaattaagaaaatttaattttgttattttatgagtatgagtgtttttcctgcgtgctctatatgcgtactccaggagtacctgccagaggccagaagagcgcatcaggtgtgagtcgtcatgtggtgcagggagctatacccaggtaggtcctctgcaagagcagtgagtactaactgctgagccatctctctggctccataggctaacccactcccccacccttccttccttctctccctcccctctcctccccctccctccctcccttttctctctttctcttcctcttcctcttcctcttcctcttcctcttcctcttcctcttcccctcccccccacctctctctttttctttttgagacagggtttttctgtgtagccccgactgtcctggaactcactctgtagaccaggctgaccttgaactcaagagatcttgccccctctgcctcttgagtgctgg

SEQ ID NO: 23080 - DNA, 1244 bp, Mus musculus
gagaagcaaataagggcccacagcagtctcagggaaaagggagagccacggctgcgtctggagaactgtcggctctcagggcacccttgaccataagtataaagtaacattcgcagatggcatgtcagaagacccttgccagtccatgacggtgcttgcagaaagtctgccgcgctaagcgtgttggaattgtgcccacgcggttgctggatcttctccagacttgtttgtatgcaaggggtctggttgaatacacctaagcaaaattttgttgttgttgtaggttttgtttgggttgtttgtttctttttggttggttggttggtttggtttggtttggggtttttgtttgttttttggtttttttttgagacagggtttctctgtgtagccctggctgtcctggaactcactctgtagaccaggctggcctcgaactcagaaatctgcctgcctctgcctcccaaatgctgggattaaagatgtacgccaccatgcccggccgtttgtttttgatgggttggttttgattttctgagatgacggggtttctctatgtatccctgatagccctggaactcggtctgtagcccagtctgacctcaaactcaaaagatccgcctgcctctgcctcccaagtgctgggattacaggcgtgcaccaccactgcccagctgcttacagtggaaacgccttttgggagttttgccttggtggtcattatagtcctcagttggcattaagcatttaagcactaggtgtcattttcttggcagtcagtcaatcagtcgagtggttagaaagttgctaagcagataagggcacttgctgctcttgcagaaggctggagttcagttcctagtacccatatggcagcccacaacctcacaactccagtgttctcttgtggcctccaaaactacacacgcatgcgtgtacatacccacatgtaaacatataaacataaagtttttattggaaagacctgtcactgcatagagaagagaatgttttctgcgccgtgcattgaagatgatgcttcatatatttaatgagccaagtttgcccttagccagagagtggctgcagccactactatttaccctgagttcccaccccaccaggcgtgaatgggaccgtctttatcctagaagctaatttctgcttgcctgttccctgcacttttgttcagtaattactttataactgcttaatttctttaaagggtaagatgatatgtaaag

SEQ ID NO: 23081 - DNA, 1129 bp, Mus musculus
tttaatccagggtgctcgccccatctggcccttcgcagacgcctgtggctgctggggtacgctggttatttcttacagctccttccttccagacacctatgcaaccgggctatgctgtgaaaccactctcactgtaggtctgtgggcaaggcggctgattgattgagtactgtgggtgggcgggctgaggtatggtgggcactgctgtctgacaggctctcccattgtcctgatacaggtgagtgatccaaacggggagggatgtgccctccttacagagtcaggagtcaggagtctggggacttgaatgtaaatgtccctgtcccaggtttccagagccccggccttagcataacagagctcccttggttggctgtcagttatcctcaattatggctgtttctcaggtgagctctggcttgctggctttttctgatgtctcactgcaagtgatggaagttttccctgtgtcttcaggaagcccgctggcattcacatctgactttgacttgccactgtcgtcctctgttgtacacgggatagtaggtttctgtggagtcatagcctcctcggtgaactcttcagagtttagcctaattgggagccccaccagccaccagggaatatgctgagacttaagaagccccacgggggatttcatgccaactaaggattggtacggaagatggtccttgccatccatgtctaaaatccatgaacccctcccctctctttttttttttaattttaaaaatttaaaaattgctgtggtttcaaggcagggtttgtcagtgtagccctggctgtcctaggctccctctgtagaccaggatgccttcgaattcacagagatgtaccaactgcagcctccccagtgttaggattaaaggcatgcgccatccccctccccaagcgatccttattttttgctctatagttctaaatacttggtatgttgtattagctcttccagtggtgcccagttctcagagtgaaaatgggatttgtctggctgccggataccagggttcatttgtactgcttttaccactagtgataggggctctgctagtcagaaagtcggctctgctcgggaatgtcgtctttgttcccatttccttagcttact

SEQ ID NO: 23082 - DNA, 1204 bp, Mus musculus
gggagtttggggtgagaaaatagttcttacttgttgtagaataaatgctgtttctatgaatttttatagagttaaacatactcaattttccccccagcatgcaatgatgctgcctgttctgacccatcacatccggtaccatcaatgcttaatgcacctggacaagttgataggatatactttccaagaccgttgtctgctccaggtaagcagtgctttatagatccctctgagcccacggtgaggctggctgagctcaccctgcacagtacaaacggaccctgagaaagcaccaaccctccctgagctccctgccttggccaggatgggatcctccctgaaacgaacgggtggggtttcgggattgttctaggaaaatcgtgcagcccagttctgcagatttgatgctaaaggaggagccgcgaggctttcctgcagtgtttgtttggtatggagtatcatgagtctcggggccgagtttttaaactgagcttgtttcattacaactatagcttgccatgactcatccgagtcaccatttaaattttggaatgaatcctgaccatgccaggaattctttgtctaactgtggaattcgacaacccaaatatggagacagaaaagttcatcacatgcacatgcggaaaaaaggtgtgtttgggtgacagtaagacgctcctgtctgctctgtgctgcttccgaaggcccagagccacccgtccttgggctgatcccctggtggctctgtgaacccctccctctgcgcctcatgcatcctgggtaacagtcactttgggtgcggaaaatgttcttacttcagtcacatattttgaataatggaatgcagatgacaaactttttaaagtccaattggggtgagaagaattcctttctttatatcatatgattttctaaaatagttcttaaattatttatttgtatgtttgtggtttttttttaaataggaattaataccctaataaatatcatgtcacgccttggccaagatgatccaactccttcaaggtaaatttttaaaaagcagacttgtgagaagtaatgtacatattttgtaatttactcacttcaagtatagacttcaaatggtttggcgagtatattcgtgaaattcttgaactgtaggtgtctaatttcagggcattttcttcatattaaatccaataccctatgcccacgagtagtc

SEQ ID NO: 23083 - DNA, 1112 bp, Mus musculus
ctctccacccactccaagtgagtatgaccgaccgtgtctgcagtgagtcccgaaacttcatggccacctttcccttccctgcccacctgtagtctctgactctcttccccagaactatgactttatggtgggcgtcagggaaatttcagaaataaatagtagactgcgcacgcacgtgtgctcaggtgacctggtaagcatggggatggcgctcctgaggcgacaactgcggctgtggaggaacagccctccacacagtgggcgcctcacaccgtgttggcgcttgcacgccatgtgcctgcccgtggagggaaagtggtgttagaggcgatcttaggcatagttaagaaagtagagcaaatactaaatgaatattgctaaattttaacctagtttgggctttagaaatcgagtcggattgtataatatttactacacagtgctgcatgagagctttttactttttacttgggatttaggaatttaaaagatctatacatagtgcgtgctttccctcggttagctttaaaagtttttctgcttttctttctgctttagtttaagatatgtatatttcccttagtctcacgttatatgtgaatatgtatttaacataaatagtagtcactagtgatcagatgttcatcgaaggtttaccatagtaaacggcagttcagcgctgtaagaagattctagtgaaaataagagttatgcagtactgttgaaaatgttaatcttagttatacttcttaaattttctctttgccagttgttaaaggcttgttgcatggagcaccacctgtgtagaggaataatgatatccaccggaagtaaattcagttttaatgatgctcatttgccaaaacagtttgcatagtatgttcaagatgcgcagtagtccagttactccaaaatcagaggctcctaaacggcagctcccagacagccgttcccatttcctagaaacttgtcagacagaccaactcccagcaccgcgcgcacacacacacacacacacacacacacacacacacacactgacgcgcatgtatatggcagctgttcttcagctttcgtcttccttagagagttagtctaataccagagatttt

SEQ ID NO: 23084 - DNA, 1182 bp, Mus musculus
tcttccctctattcttcttcccccaccctcctctccccatccccttccctctcctcttttgtcttcactctgtcatttcttcctgcgtttttctccctcccacaatttttttttctcatctctgcttcttatctttttgtctcctcatctctctacccagtcaatcctgttctacctatctctcttctccctttcattgtttactctctttttttctctttcactctcatatacaaccccgtgtcttcctgagcccatggcagtacaggggtgggtgggttggggaagtccttcagtgacctatttgtaaaaaatataaactttaaatttgaagctataaatttgtttttatgagaattttaaaagcttttataattctttaggaactatattaattcaatcagaattgcaggtgtaaatacatcaacctatgtcttgttatttgttctctggggacaaagtttaagttttatttcatttgtatttacattttcattttggttgcagaataattttcatacagaattttttatagtttgtgttaatggactgaatgctgcagcacaataaatgttaaagcatttgttttgcttacctctttggcatggtctgctgatggccagactctgtttgctgcctatacagacaacttggtgcaagtatggcaggtgactattggtacccgctaaaagttttatgacaaaatcttagaaataaactggctttctgaaaaaaaaaaaaagattattcttaaccctagagaatcttgagcccccaggaaatggggaggcctggtaggggtggaggtggggttgggggtggcggtggggggtggaaacatcctcttggtgacaggggagatgggatgagtggaagggaggactgggattgggggtaatgactggattgtaaaataaaataaaataaaataaaataaaataaaataaaagtaataaaaaccaaccaaacaaacaaactctaaaaatgattatctctcataagaagaaatggattacattcagaacacaaacacatgcattaggatagaattcaatatgtaataatttgatgtttgagattaatgtgtaagtgcctttataaaaagaaaatgaaaaacttttatctgagagtagctcttgttattttatttgttatagattttgattacctcagtttttagat

SEQ ID NO: 23085 - DNA, 1149 bp, Mus musculus
atattttccggctctacctcacctccccaaaaggtaccgagagccacatgtgtgggttttacccacgggaggaatcgggtccatgtccacccaagccaaggttaaaagcccactcatctacggatgagaaaatcatttgatcacctcagttaagcattgccttatttaacttaattaataggggggagagagattggagacgtactattgaaagggcaagcccttcactgcctcccacccaaataaaagagccggtcgaactccttctccctgtttcccacctatcatccaaaaatgcggaggaatatcaacttagtgttattttcacattgttcagtcaaacttagccagagttccaacgccctacttaaaattcaactagaaagttacctaccaagtactaattagcattataaagtcagagtctgcagctccaggcctttcagttagttgtttactagaaaggacagtcttaagccagatacagtttacaataagaaaagttaaagaatcccagtgaagcaagttttttctttagtcctagattccaggcagaactattgagcatagataattttcccccctcaggccagctttttctttttttaaattttgttaataaaagggaggagatgtagtctcccctcccccagcctgaaacctgcttgctcggggtggagcttcctgctcattcgttctgccacgcccactgctggaacctgaggagccacacacgtgcacctttctactggacccgagattattcggcgggaatcgggtcccctcccccttccttcataactagtgtcccaacaataaaatttgagctttgatcagaatgaatttgtcttagctccgtttcttctttcgccccgtctagatttctctcttacagctcgagtggccttctcagtcgaaccgttcacgttgcgagctgctggcggccgcaacagacgccaacaagtgcttactgacaggagcctgatatggctgtctcctgagaggctctgccagagtctgacaaatacagaggcagatgctcacagccaaccattgtactgagaacagagtccccaatggaggagctggagaaaggacccaaggagctgaaggggtttgcacaggaggaacaacaatatgaagccccga

SEQ ID NO: 23086 - DNA, 1166 bp, Mus musculus
gatggtgggcttgcaatacaggacttactccctgtgtatcaactaaggtttttaattcatctcatgatttttgtgtcatgatccagctgttaccccacgtatattatcaccctgcatccagtttagaagaaagctatgctggccggcagtcaaaaagagaaccaattactttaaccctggctgcattcatgggaataggtatggcagtaggagtggggacgggagtgtcagctttgatagaaggaagacagggaattcagtctttgagggatgctgtcaatgaagacctagtggcaatagagaagtccattgacgctttagaaaaatctttgacctccctgtctgaggtagttttacagaacaggagaggtcttgatttgttgttcctaaaggaaggaggactgtgtgctgcccttaaaaaagagtgctgattctatgcagatcatacaggaatagttagagactctatgcagaaactgagagaaagattagagtgaaggaaacaggaacgggatgctcaaggggggtggtttgagttgtggtttgaatcacgaccatcttggataacttctttaatttccgctatagccggaccaatccttatgatatgcttagctttagttttcggcccttgtataataaatagaggaatggctttcatccagagtaaaattgatacagtaaaactcatggttcttcaaaggcaatatcaacctatagttcaggtagatgaagagttaggggacaccaatctctaaaattctatgattagaattagtctaaacagaagaagaggggaatgaaaggaaataaaactgtaattcatgtaatgtatgttaaatagcccaaagagttgtttctgagctttgaaacctggggctgagaacagaccaggacatgcccgggcaagcccatcacctccctagctcccacccctctgacctaagttaaatgttacaggctgctgatgtttaaatggaccaatcatgtgaaaccgcgccaattcctcccccagccccactccttttctataaaaacccctagcttccaagcctcgtggtcgaatccactgtctcctgttatgtgagatacgtttcgacccggagctccgccattaaaaaacctcttgttgttacatcaaggtgttgtgttctattcgtgattct

SEQ ID NO: 23087 - DNA, 1106 bp, Mus musculus
ctttacaactaggggaggaatatcgactttaccaaaataaagtaaagccccctgagggattacaggactggttgaatcgataccctcaggcgtgggcagagacgggaggagtggggatggcaaaactggtcccccctgtggtgattgaacttaagtccggggccacccctataggggtccgacaatatcccatgagcagagaagctcaagagggtatacgcccccaaatcaacaaactgctccaacaagggattttggtcccatgcaaatccccttggaacactcctctacttccagtaaaaaaacaagggaccagggactaccgtccagtacaggaccttagagaagtcaacaagagagttcaggacatacaccccacggtgccaaatccttataacctcctcagcaccttgccacctggtcggacatggtacacagtcctggatctcaaagacgcttttttctgtttgaggttacaccccaacagccagcccttgttcgctttcgaatggcgagactccgagagtggacaagccagacagctcacatggacgaggctgcctcagggattcaagaactcgcccactttgttcgatgaagccctacaccgagatcttgctcttttctgagccaataacccacaggtgactcttctgcaatatgtagatgacctgctcctagctgcagaaacacgcgaggactgtgaaattgggacccaaaacctcctgggcgagttaggtaagctggggtatcgggcctctgctaaaaaggctcagttatgccagatagaagtgacctacctaggatatgtcttgagagatggacaacggtggctcacagaagccagaaaacgagctgttatgcagatcccgaccccaaccactgctcaccaggtaagagagttcctggggaccgccgggttttgcagactctggattcccggttttgccacactggcagctcccttgtatccactaaccaaagagaaaggggaattcacctggaccagagaacatcagctagcctttgaaactctcaaaaaggcactgctgcaggctccggcattggccctgccagatttaaacaaacctttcaccctatacatt

SEQ ID NO: 23088 - DNA, 2439 bp, Mus musculus
aatctatcaccaggctccggtctccaaggtgcctcaaaacgggcccactaatttggctaaggtaagaggtaatgcaggggccgatcgaaccttcctctgtgttccttgaaaggcttatggaagccttcaggcggttcactccctttgatcttacctcggaagcccaaaaggcctcagtggccatggcctttcataaggcagtcagctcccgatatcagaaagaaacttcagagattaaaaggtgtattacaagaaggagacagttatgcgatctagtaaaagaggcagagaaagtgtgtgtgtgagagagagagaggcaggagacaaaagaaagagaaaacaggaggaatagtagacaagaaagaaatttgccacagtggtaggagaaaaagaaaagacaggatctagacaggaaacctgggcaactgaagaccgagcctcagctaaagaggctcagctgtgtcagactgaagtgacttatttgggatacacccttcgaggtgaaaagcagtggctaaaagaagccagaaaaagactgtaactcaaatccccaccccaactacaccaaggcaagtaagagaattcttgggtactgctggcttctacagactctagatacctgggttggcgaccgtagctgcccagttgtaccccctaaccaaggaaggtaggtgtttgtgtggaccccagatcaccaaaaagcctttaaagagattaaaaaggccctactgatggccagcctatgcctgacctaaccaagcctttcactctttatgtaaaagagagagcaggggtcaccagaggagtccttactcagactttgggactttaaaaaaggccagtgacttacctatccaagaagttacaccctgttgccagcgggtggttttcttgcctgaaagctattgctgccataatctgcttgtcaaggatgctgataagctcactctgggacagcaaataactgtagtggcatcccacactcttgaaagcattaccaacgctcctgtgacacatcagagctttttgttgtctaaatgagtgatcttcgcttcattccacctgctgtcccactgcgtgagactgcacctactcatcactgcgctgacattctggcagaagaaatgatctgaaggatcagatcagccttggtctgaggacagtagcctcaaggttaaaggtaagcagaaggcggggacagcagtatggtggtgaacagaaagcaagtgatctaggccagcagccttcctgagggacgtaggcccagaaagctgaacttgtgactttaagacaagctctataaatgacaaagaaaagtctacactgacaacaggtatgcttttgccactgtacggggcaatatacaaagagggctgttgacatctgcagaaaaagacctaagatactgtggctaaaaaaattcaggtggcagatctaaccgccaatcaggaggcccaaggagcagtgatcctggcagtcaaggagccctaaagattattatgacatcagagagaccagctttagatacgtcgctgagcactatcaagttatggacagtatttgacttggcctgggggccaagaaattcaaaggtgtggttaggtcctttgactgctatgttacaggactctgacttggcagaagaaatagtcaaaagcttcaaggactgtgctatgatgaggtagaatttctaaaagaaatcttcccaaggtaatggacctgcctttgttgcccaggtaaatcagggactggccaagatattagagatcggttaaaagttacattgtgcacgcaggccccaaagctcaggacaggtaaaaaaaaaattaatagaaccattaagggatccttaccaaattgacagcggagactggtgctatgattagatagctctcctaccctttatgctcttcagggatagaaacacccctggacagtttagactgacccccctataaattactctagagggggcccccctccactggtaaaaatagcctttgtacctagtgctgacatgctgctttcccagcctttgttctctaggctcaaggtgctccagtgagtgagacagcgagcgaaaaagcagctccagaaggcctactcaagagaagaagacctgctacattagacgtctccacgcagaaaaccttgagactccggtggaaaggcccttatcttgtactcttgacgaccctactttctacctttatgggaccccttttgattttgcttctgcttttaattataggtccatgtgtgttaaatagacaagtcacctttattaaaacagaaattagtgcagtgtgacttttagttttaagacaacagtaccatgccctaaagtaaaggatcaagtatgtcaaaaaaaattgtgtctagatctaagattagaactactaacaagtagaaggggggaatgaaagtataacaacgtaa

SEQ ID NO: 23089 - DNA, 1190 bp, Mus musculus
acaccattgttctgaacctagacattaaaaacacagatatctttcccaggaggctgccgaagatggcagaggggcaggttctggtattgggtggccgaggccatcttcgtggtctcctggcgcccattgtggccaagcaggtacttctgggcaggaaagtggtggtcgtacactgtgaaggcatcaacatttctggaaacttctacagaaacaagttaaagtatctggcctttctccagaagcagatgaataccaacccctcccgaggcccctaccacttcagagcccccagccgcattttctggcgcactgtgcaaggcatgctgcccataagacggagagagtccaggctgccctggaacgcctcgaggtgttggatgggatccctccaccctatgacaagaaaaagcagatggtggtccctgccgccctcaaggttgtgtggctgaagcctaccagaaagtttgcttacctggggcgtctggctcatgaggtcaggtggaagtacaaggcagtgacagccactctggaggagaaacggaaggagaaggccaaggtgcactgtctgaagaagaagcagatcttgaggtcacggaaacaggcagaaaagaatgtggagaagaaaatctgcaagttcacagaggtccttaagaccaatggactcctggtatgactccaataaatactgtttgcctcatgcctgcctggcctgcccttcctctgccgccgacggggaagtggggaagtggggaccaaaggttccttaggcactgctcctgtgggtagaggggacatttagagagctgacagtgtaccacttgcttgagttttattaaagtgcaaaccatggaatgaatcacttgagcttcagtgttgaaaatgagtagcagggctgccccacccacctgaccgaataccatattctgcagcatgaaaatgaggtctgcacatgagctggggtttagaagtgcacactgaagcactgccttgcagcagaccacaaagcagtatttttttctggaggattgtatgtgctaataaattatttgacttaaaaaaaaacccagttgtcaaggtcagagcatattctataggtgaaacaaacaaataatcagaaacaacaacaaaaacagaatgggctaagaaatgaatattttggaaaacttctataactaatcagaggtaagcat

SEQ ID NO: 23090 - DNA, 1199 bp, Mus musculus
aaaatttatgatagaggagtgagggttgggggaacccatccttcaactgggggccatgtctatctactagaccttcttaatattatgtatttttacaaatctcatttcccatagtctttaaatcctagggagccttttcacttgtacattagtaggaagatggcaagttcactgatttactacagacctcagttaaaaaaaataaggaacagaaaccaaaatatggaaaccaaagttaaaattgaaaaaatgcacaataaatgactgtattgagtgggaaagacctcatcgcatttgagatttgaataaaaatatctatacttgaattctgagaattttctgtacagcctgataagaaagtacattgtctttctgtctttctctccatctctttttaactctatccatctctatctctctctctgtctgtctgtgtgtgtccgtgtctctctgtgtgtgtgtctctctgtctctctctgtctctctctgtctccctctttctctctctctctcctctctctgtctctctctgtctctctctgtctctctctgtctctctctctctctctctctctctctctctctctctctctctctctctctctctctctctgtcttctctctgtgtctctcctctctttctgttagggttgaacccaatctcatatctgctatttggctttatgtcccaacccgcaagactctgttttccatcagcaattgcttattgttaatactatctagggaaagaacatcaatgcctctttagccttgtaggtttcctgaacttcctaagccttatgaatttcccactctcctggaaagaaagttctactctctggaaaaaaaaatgtacataacaagcataaagagaacagtaaaaacaaagacacactcacaacctgaagcaactctctacagctttggcaacaagttgaattaggttttcattgtttaaatgcagatagaaatggtaagtattcatacgttctgtaaagtcaggatcactgtctcactttaatttctcaattattttcaaacaataatgctcttatgtcaaattagtaaaataataacatttttaacatataagttgtttaatgaaaacttttgataatttttttaaaattgtattatttcctggaaattttatgcaaatggctgatattttacttataaatcaaaagctatgatatcat

SEQ ID NO: 23091 - DNA, 1152 bp, Mus musculus
ggccccggaggagggcgaggccaaaaagactgaggctcccgccgccgccggccccgaggcgaaaagcgacgcggccccggcggcttcagactctaaacctagcagcgcggagcccgcgccctcgtccaaggagacgcccgccgcctccgaggcgcccagttccgcggccaaggcccccgcgcccgccgcgcccgcagccgccgagccccaggccgaggcacccgccgccgccgccagctccgagcaaagcgtggccgtcaaagagtaaccgggacagccaaccagaaccgacgccactcgcaaacgacctgtcttctcacgctctctctctctctgtttctcactctgtcctctctctgtctctatcctatactaacttgtttcaaattggaagtgaggatatgtattgcccaagggattaaataaacaaaagaaaagaaaagagaaaaaaaataaagaggatgtgtcccatcaggggagggagggggcggggagaatccaaatagtatttttgtggggaaatatctaatataccttcagtcaacttgaccagtcagtcctggattttcgagatcattgtctgaaagtacatcatctgtaccctgaaccgctgtcccctaggctccatccttaaaaaccccagcatctctcccgcgatgcagctggggagggaggcgtttgattctgcccacaggaccagtgccaaggcaatcagatctttatgaaagcagtattttctgtgtttcctttttaatttacagcctttttcttaatttttttggtatttttttaaacgttcgtggatgaatgccaactttcagacggagcccacttagcttgtccacatgtatctcaatgccaaccctccatttttcctctccagatatttttgggagtgacaaacattctctcatcatacttagcctacctagatttctcacgacgagtaatgcatgtccgtggttgggtgcacctgtagttctgtttattggtcagtggaaatgaaaataaaaaaaaataaaaaataaaaaaaaaagaagtctgcgttcactgcagcgccagttttcttccatctgtgtctcagacaccaacacaccacccattggaaaaatggaaaaaaaataaataaaaaaataaaaaaaatgtacaatg

SEQ ID NO: 23092 - DNA, 1176 bp, Mus musculus
tgcagtctgtgccagttttacgttttgagaggttaccagggcacctccagttttttacaacagcagccagttaagttctggaaggtgaatttaagtcataaaaacttacatctagtgagttttcttgctttatttaaaaatattcttttctttgagccactgttagttttataaccatgcatttccctgcgtgcctgtgactggaagagaagacgagagcgaggcagacacattcttgggtaatggaaaaggagtaaatcttacgccacagtttcatttttcctttcaggatcattgatctccaacttgcttactttactaaggttcccagaagatgaacgaccgtgttaatgtctggcattgaggcaattgtcaaatatgcatcttaactgtggtttatgtaaaataaacccctctccctcagcactggagagatgtttcagcagttaagaacacttgctgttcttgcagaggacccaaattcagtttgtagtacccacatcaggtagctcacaaatgcctgtaaattcaggtccacaggatctaacaacctcttctggcctccacgggcacgtacctgcatgtggcacacagacttacatataggcactcacacacatatcaaatacattaattaattataaataaataataaaatctttaaaaacaaagccctcataaccaatggatcaattaggataaattaggataaagacatgattttttaaaagtagactattattaacattattattattattattattattattattattgaatggtaggtgtagttgtaaacctgtgtagtcccagcactggggagaacgaggcaggagaattgaaaactgagcaccaggttggacctacccagtactcaaaaacgaaaatggtatgagcgagacggctcggtgggtaaaggcccgtgttgtacaaacaggagagccaagtttggatccctgggccaaaggaagacggggtgcacccatgagcccacgctctgctgggtggagacaggaggacagctagggtttgctctctggctgggtgaaaactggggctctccaggttcagaggactcgtggaagagagtgagcttcctgcatgatggtctgagaggaacactctgcagatctttgcagagcagaggatgggaggatgaagaaccctccgagt

SEQ ID NO: 23093 - DNA, 1383 bp, Mus musculus
gtggactgtagtcatatgctacaagatagactatttggcaagaggaaaaggcaaagagggagagatggtcagataggcctcacaggattttgatggtaaaaggtcctgaagacctgccatttgtcccagagcttcaaggcacacttggagatgatatctttaaggccttggaaaggtgcccgtcctttgcatgctaaagcacccattggggaagtggggtgtctccctcttattcgtgatcacgatctctctcaacccccgccccccactttcctgaaattaaataagtaacttaaatagttgctctttaacttcagtaacaaccttaacaattcaaggtgccattttgtttgtttgtttgtttgtttgttttttcagactgtggtctctctattgtgagtgcatatgtgtgaatataggcactcatatgggtgtgcattactgtgtaaatatggatgtcagaagaggacactggatcccaggaatgtagggctacaggcatttgtgagccaaactctggtccccattgtttgtttagcaagtgctctcaaccactgagccatctctgacaccccaatgatactactttcaaagtcttgcacaaacttcttcattttgacaacatcctggatgggctctaatggcacatggagcaagaacactgggcagacagcagtgtgtgctgccagttagaatggcacggttcatgaactagcacactgcaccctggagacggactgcaggacctgatgctgctcgtctgcccttcctggctttctgatgctttgtttttgttgtgttgtaatctagagggtctgtctgtctgtctttctcttttctttctttctttttctcctccctctttcttttccttcctcccccccccttctttcttccttttttttttctctgtgtactgctgactgtccttgaactgctctctagaccagtatgtaaactcagagatctgcctgcctttgccgcccaagtgctaggattaatgttacatgctaccacccatagctttagagtgttttttttcttttgtggtttcttttaaacattctgacaataatatattaagttcctctgatggttttttagacatcttttattacatacttttgtttccttacttttggtgtttgtttggcttttttttttttttttatgtattgctttaaaagggggcggggtcttactgtgtaggctagactggttttgcacttagaatcatccatttgtctctgcctcccaggtactaggattaaaggtatgcactatcactatagtttgtaagtgtcagtgtcgtgtgtgtgtgtgtgtgtgtgtgtgtgtgtgtgtgtgtgtgcgcgcgcacctgaggtaggtatcttccctcag

SEQ ID NO: 23094 - DNA, 1217 bp, Mus musculus
tgttccccttttcctgtggtctcattctgaagttggggcctgtcatttggttgaaggatggagcacattacacaatttcagtgaagcccagattagtaaatttacattagaccacaggtgcacacacttgcaaaccctctgagtcttcagtagcttgcagatcaggggaatgaggtcctgtggaggtggaagaacaggttggacctggtcatgacgtcactggactctgctttccagctcccgagcactgcctgctattcattcctcagagcagaggagcagaaacaaagagggtccagagccacaaggctgtgacgctggccacctctcaaaccaagcttgcttgcagcctagtggcctgagccagccggctgctcacgggctcctgctacctgagacaagccagtggccctccgtgatcaatactgcctcctaggttggccagcgtccatggggtgaacgcttttcctctcgcatgctcagtaaagagaagccgctactgtacaatcgccacctgttccgtagagcgcactggccctgcctgcgcacagcctgcctctctttcttgttgcaacacgttgctgtaggtattgaatggttgagagagacggtgctccgggtcctgagcagccgacctggaggcacaggtacgcagatgggtttggtctggtttttggtggtggtttgccgtttcttttcttctttacccttttcaggtcttactgtagacatacagccatagtcagaacaccacccactctgttttgcgtgcttgtcagggtgctgtggggagacctgagaggacttttaagagtgttccctgacatcctagggtttttaaactttgatcaccctgtgaccttccatggttttgtcatgtcaatcacagaatctcagccggatcctgcatgcatccctggcaacctagtgaccccatagcagtggtctctcagaccagggctgtattgtagcatcttgtggggtcagtggcagagactttcataatcttgagagaacaagttaactgttcttggcccagtgaataatgttgcctttcctttagacaactcatggcgaccactggggcaaatgattccttctctaaacatttctggagtggagagcaacatgtaccgtgttggacacaggcttcacaggtgaatgccatctgcctgtagcctgctgtgggtgcctgtggcctcaatgatggtgcaaac

SEQ ID NO: 23095 - DNA, 1211 bp, Mus musculus
aggagatcctccgcctggagaaggaaatcgaggatctgcagcgcatgaaggagcggcaggagctgtcgttgaccgaggcctccctgcagaagctgcagcagctgcgggatgaggagttgcgcaggctggaggatgaggcctgccgcgccgcccaggagttcttggagtcgctcaacttcgacgagatcgacgagtgcgtccgcaacatcgagcgctccctgtcggtagggagcgagatttcgggcgaagagctcagtgagcttgccgagagtgccagcggagagaagccaaacttcaacttcagccagccctaccccgcggaggaggaggtggacgagggcttcgaggcggatgacgacgccttcaaggactcgcccaaccccagcgagcacggccactccgaccagcgaacgagtggcatccggacgagcgacgactcatccgaggaggacccttacatgaactacacggtggtgcccaccagccccagtgccgacagtacggtgcttcttgctgcgtccatgcaggactccgctagcctgcacaactcctcgagtggggagtccacctactgcatgccgcagaacaacggcgacctgccctcccccgacggcgactatgactatgaccaggacgattacgaggatggcgccatcacgtcaggcagcagcgtgactttctccaactcctatggaagccagtggtcccccgactacaggtattccgtgggaacctacaacagttccggagcgtaccggttcagctcagaaggggcgcagtcctccgtgagtatctgccatcttgtccctaaaggtgggagagtgggggtgggggtgggagggctctcattggcctagacctcacccaggagtctatagtgggctatgctggccagtgacccaggagatccacctacctctcttccctagtgctagggttataagcaggtctaaacaactcaagctgtttttacaaagactttgagaatccactcaggtagtgtacgtacttcactagcagagccgtctgccaagccataaactcctgactggttggagatgagatcaggcacattcagaatggtgtagtcatagatagaccagaactggcatcttaaaaatgaggctcagcatggcttttctgcagaccctgaggaagctggcccactcactctcctggggtgtattgaagtacagtccaagccactcaat

SEQ ID NO: 23096 - DNA, 1177 bp, Mus musculus
tttgttgtgttttcttcggtagtttttgtttttacctgtgtgtgtgtgacatctggaagagggcaaaggtcactgaactgaagtggtcaggattggagacaagcaccttaacccactgaaccatattgcggccctcctcaaaggtttattttctgttcctttgtagcaaatatttctataatggagtcgccagtaggatgacctccatgtgtgtggctggttggctggttggcttgatttctgttgctcttgatctagattaacattgggttcagctggcttcagacctactctgtatttgaaggtggtctgaacccctttcgtccacttcccaaatgctgtcccggaactcagagtcacctgcccctgctgggattagaggtgtgtgccaacaccgccaggcagtgcagtgcaactctgcaaaagagggattgacttttcctgatgtgcattctgggtattcaacccaggctctggtgcaaagaggcaagaactttagccctgagctacgccccgcgtctccatctaaatattttcttcctcaagtcagcacttataacgtttcagacttcagaacattgcggattgtagctggcagcgcagaagtgctgagctagcatgtccttctccattcctcgtgatgacctactatgaaggaacggcaccttggagagtggaatcctggtttcattgctgctgtttagccactgccccaggccagcatgaatgtccttatgtctttatttaagaccgctgactggaaggaagttttcctggtcgtatagaacagagcaatactcgtcagacaggcctgcgtgtcaagtcaggccatcttccttgtgtgttttctttgcagatgtggagggtttagtcagtgccagagaccacaaggcctcagccagccacactgcgtaagccagtgagtcgttccctcctgacaagtttcccagcaccttcacagaggagctgctagattccttacggctgcagccacttaacacgatctctgatgactttacatcgaagctttataaaaatctaaagctcttattccgagatactttaattgcttctgggaggctgctgggctgggtgtggtaggtaggttggtatggttatgtttgttctgaggcagcggttctcagcctgtggtgtcaagtccccccccccccccctc

SEQ ID NO: 23097 - DNA, 1289 bp, Mus musculus
tgtcaacctttaacagtctgcacaatctcttaagctttagttaaaaatcctagatgagaacttgccttaaagaaaaaaagaaaggggagaaaaccacacggccaccaaagcagccagaagtgccttaaacttgcagagtggaccctaatcgaccttaactgtgctactgagggggagcgctttcacctcccggtggggtttgcagagcttggaggcggggcatggatccactgattgtgcactaacctccccagcctgatttcctgcaaatgaggggagctgagggggcggggcgaggcagggagacagcagagggggacagtgtgttgtcggagtgctgctggcagccttccttacgaacatgtattaacgtttttggggtttttttgtttttttgttttttgtttttttggttttttttttgctttgtttcaactgtctgtgcttgcccgcgcatgcatgtgttcacacactcaacactttaatcattgtcctgtgagcattaaacacaaagggaaagaggatgtgcaatgttgtaaacagtctgtatattttcctagttcagagttctagtctcgaggtggctttattaacagacccggatcctggacgttcctgtctttgctgtattttttggaaagaaacattttttttggactcggtttcgttttacatgtagctagggcggcgacctgtgactgctgtattactaacaggtctacagcccagagagataactgtatttataaaccactcttaaactgctggctccagtgtttttagaatgatatgaagtcattttggagtctttttttcattctaaaagttaagttaaaaaattttttttgttttgttttggtcttctttgaagggtaacttgtgttatcactctggctagattgcagatataaccatgtcgaatgtgggggaggggggagctgctgcattcccaaactctgtacccctcaagcaaacctctaagggacctccaacacaaacgctgaggctttaatggaattcacacgttgttttgtccctggttcctacaggtggcctgaacacagcacctgtaagtaacagcggttgtaaccagaagaaaaaagaatctggacttggacttttatttttatatgggaaaaaaatatataaaggtgggccaaacgagtctgctcacaaagcaaagttactttggccttatcccttacggacagttacgtggaagcagtgtctcttggctcacaaagtctgacaataaaagatattaatatgctgtgtttgctttccttgag

SEQ ID NO: 23098 - DNA, 1618 bp, Mus musculus
agtgaagagaaaaaaaaaaaaaccaaaaacaccaacccccatcaaactattaaggtctttctataagtattctttttcgttataattcccaagcatgcagagatttatcataacttgctaaaaagtgacagctgtgagcacatgctgcagcagccccttcgttatcatctcagaagcagtccatcaaatcctgacagatgttaatgtcaaaaggagaacgtatccaaacgtttgtagttgaagggctatggacatgctgtcaaaattaattttctaggaaaacctttaaaaataagtactacctataggctgaaatatttccatgttacttctacagttgtagacataggcttacttgtcgagtggcatgctccactgactgccacatctagtcttgaaaagaggtggtactgacccacaggaagcaggcagttatgtatctcttagtgatgctcttgcaatgtttgcaatggtaagtgcacactattttgcacactcagatgtaagcaaaccccgatgtttctgtattgtgttatcgtctcctaggattgtaaaactagctactggtatggccatgagtgatgtggtcattggtgatgaaaaactacttctgtttttttcagtttacaaatgcagaacagagaagcttgcttgaacttgaaagtgtatactctgccactgcagtctcaatatgtaatccgtttcttactgggaatctagaccatgctttttcctttaaactgtcttttcatcacctttacgtaatcaaatttgacttacagtggaaaccaagatagttgtttttgcgaaacaatcttttagtaagactgagggaccatgtcagcaactatcttaaatcttcagttatagctggcatttccacacagacatgcaagaccctgacaaaggaaggggtaataatataagactatagaaatctgtgtttcagtttcatctcttttatttctaaagaataattacaggtaacttgatcttttaatgtaccatctcctatttatttattgttttctttctgaggtattaaaatatctagactgaattttgccaaatgtaagagggagaaagttcctgaagactctgactacttgcttatttttgattgaccttctatgcttatgtcattagtgcctcacaacgtgtttgatgtcctttattgatacaaagtgagcctgtgccttcattttcttgcccattttggtaccaatgtaaatttgtgttagaaaatcttgaaactctgtgagtctgggaagaatatatctgaatcctattcaatacatttgctggatgtgaagaaaaatacagccacatatttataaaacagttgttaccagtattcctttttatgtgtatgcctcttcatttagaaaatagtctacatttaaaaaaacaacaaaaatgatattgaagaaaaaaatttataatgatcagtaatcaaaaatcatgttttagatcacttacaagaagataaactagtgacaagcctgaagtgagatccagctcaaggggaggctccaaggcctgacactattactgaggctatgacacgcccacagaaagggacctatcatgactgccctccaaaagacccaacaagcag

SEQ ID NO: 23099 - DNA, 1243 bp, Mus musculus
tcgggaaaacaccaaatggtggatgacgcctgtgcagcgagagggcccggaggacccgggggcctaggattaggaggccgcggcggcttccgcggaggattcggcggaattcggtcttaggggccgtggtcgtggccgaggccgtggccgtggtcgaggccgcagggctcgtggaggtaaagctgaagacaaggagtggatccccgtcaccaagctgggccgcctggttaaggacatgaagatcaagtccttggaggagatctacctgttctccctgcccattaaggagtctgagatcattgatttcttcctgggtgcgtccctaaaggatgaggttctgaaaatcatgccagtgcagaagcagactcgggctggcccgcggaccaggttcaaggctttcgtcgctattgaggactacaatggtcacgttggtcttggtgttaagtgctccaaggaggttgccactaccatccgaggggccatcatcttggccaagcttttcatcgtccctgtgcggagaggctactgggggaacaagattggcaagccccatactgttccatgcaaggtgacaggccgctgtggctctgtgctggtgtgtctcatccctgcccccagaggcactggcattgtctctgctcctgtgcccaagaagctcctgatgatggcccgtatagatgactgctacacttcagacagaggctgcactgccaccctgggcaactttgctaaggccacctttgatgccatctccaagacttacagctacctgacccccgacctctggaaagagactgtcttcaccaagtctccttatcaggaattcacggatcatcttgtgaaaacccacaccagagtctctgttcagaggacccaggctccagctgtggctaccacataagggtttttatacgagaaaaataaaagaattctaagtctgctgataaaaaaaaagaaagaaaggaagaaagaaagtagacactttgctttcatttctgcattgatacaacgtatgctcagtatatctgcaaatacaaagtattcccatgtgatccgaaactgtccacgctctgtgaccacagtgtacaaggctagagagctcagttttaatcactctacagctaactttctgaacactaagtggaggagtcattgcttggctgcagaaactctcctaacagtttttactatacgtagcagaagagagaaaatgtgaaactaagaccaaggggtgggggaggct

SEQ ID NO: 23100 - DNA, 1297 bp, Mus musculus
tgatgtgtcttcttttaatctagaaaaagaagatggagaatgagtcagccaccgagggagaagactcggccatgaccgacatgcctccaacagaggaggtcacagacatcgtagagatgagagaagaaaatgagtaagcacaggctgctgggggccaccgcagggacagtcaggacaacaactgtcgtctctttcctcctcctcctcccatcaagttgttttctgttgtttaatttttattcttggttatgaaagaggccttgatttagaggtttcgtataaattctctagcatactgggtatgctcaccgatgcagggacctgaagaaaggtctttactgtcgctttgtaactcagaatcgctgacttcacgcccctgcttcataaaacccaaaagatagagctgcctcttggtcaacgtttctactcccttggacaatctccactttggaaccaaaggacttgggccagacttttcctgttcatgtttgcctcctcctaagaatcaacaggttgaagctcagcctctcttgacttgctccccaacactgtggctctggagtcatgaactatctgccgcacatactggtgggccccaggctgcagcccacagtctccctgttcccagaggaagggctggtggccctgctgggccaacgtagtgggaatttaatctcctgtagaaattgggtcagtcaccaactgacttgatcgtcagcatcccattgttttcctggtttcactgagttgccgcaccccacagtgtatatacatgagctgacttttcagagctgtcccgcaagtgcagctccagtgtcagcaccctccgcatgagtttccctgaaggcttgcgtttactcgccttccctgaagatggcactagagcgagaagtggagcgttctaactgtccatttctctaactgtccatttcgttttcacagtgagcaaagctttaagtcgtaatctagcatcctaatgccagggtcttgtctcgtaacttctgatgtagatgtgccgcctatttctgcaggacaggtaaccgagtgtactatggtactcccctccacaccataaagcaagacattttataaacagtatcaaggtcactatgtgataccccggaaataatgcattggaaatccacttagtgcagtatatttttctaagttttggaaagcgggttttttcctttaaaaaaaattatggacacagttcactaaattcctgatttagtcaaagtaactagactgaaagaacctaaacaaaacaaatattttaaagatataaatatatgct

SEQ ID NO: 23101 - DNA, 1175 bp, Mus musculus
ctcctctaagggcttatgacttaatgtggtcatcggccactcatttatcgtctttggagaaatgtcttccaaatactttgttcaattttaaactgatgtcttattgtatactttattaaattaacattaaattttttatgttccaaatataagtcccttttggatatgtactccattctttattatccttcttgactaggttcagaggggaggagactgtttgcagctaagctgttgccactcattgtctgggatagtgggtgcagctcggtgttgggccatctttgcccgtggcttccctcagaacactcatttgcttttccttcccaggttgagatgttccttcttgcctatgctgtccgccacagcatccgggtgtaccggctgtccaagtataacacagaggagttcatcacagtctaccccactgatccccccaaggactggccaatggtgaccctcatagctgaggatgatcggcactataacatccctgtcagagtgtgtgaggagaccagtgtgtgagggacacacatgtgactgccaagagatgcgcatgtgcagctcctcctctgggggcctcagatctgcaggtctccaaggacaatctgggagaactctcgggcccctggagccaactttggaccattatgttctgaagactagctgttgataatgagaattaattagccaagccttcactccttgttctgttatgcagtgtgttccactgggggcttcagcacgtgcctttggaaggtgcaaactatgtctccataaggcggatgcttttgggtcaaagaaaactgtttggaaaggaatctgtccaatgaaagttctgacggtaaactggttttacttctctttttaaaacagtagttttgtatttgatttttattccctttttgggggggaatggtggtgatggctctcattcatggtcttcctatgagatatgcttaaatggtagtgtcctggaatgagtagttacaatatcttttgatagcctcatctgcttttggagggatgagcaatatgccaattactatattttaagtagattgtcttagaagacaaagaatggggtccggctggaagaggttcagaagaaagtgtggaggagtctagacttcatttgctgaggctttgtgccctggcattgggagatcctcttt

SEQ ID NO: 23102 - DNA, 1201 bp, Mus musculus
cccatatttctgtgtttttcaaagaaaccaaaattctctctctatacccctactcagagaaggtgcctgaccacacaacctgctcagagcagtgcatttcctagagctggagtgggttttccacgtgtaagaggactggatcatcgagctcaaaaatctttcactggagaggatgtggggctcaccttcttggggcaagctctggaacctctcttggtcttcctcggagcatacaaagaagtactgaagggtatggtgtacatccaagaacaagccctcgggaatgaggacctgctcaccagcagacctctagccaattcctcttccacatattcctgtagctatgagttggtgctacgctgctttggctcctggcagatcgcacgtgcgtacctgcccaggagtatctttggatccgcaaatgaaacacacacacatttatttatttttaaaattccttggctacctcaaaggctgggcactcctaaaccttccactgctaccctaggcccagtcagggaagtgaccaatggccacttatccaaaatctcacacggctggttgactttatctcctgctgctcctgtatcccatccttcttcctggagtcctggtggttcttctgttgctctctgcatcctacccatgcaactctaagggtcccaccccatctcgctttacccaaccattgaccactggcatctttattgctcaatcaaaaaccaatgggggaaaaggacctttagcggttgggcatgtagattcccgattgaatcaaagcattggaaccaatctccaacatgtgcccttgggtttgttctttgctgctctgtgcccagcgccctcctgtgtgagtggggctagcgctgcctggctcagctcatagcactgagagtgctgggcctgtacaccatctttataacactgcttagtgttaaaggagcctgcatatatgttagcggtctctgtctttgtggtaagaggaggttcctgctccttgctggtggtgcctccggcttccattgctgatatatcagcttcaccctcctacctggtcactactcagtcattcagagatagttttgagctgctgttgtgggcttccttgtgcaatatatttccttcttccttctagttcctaagtattttttagaagactttttaaaagttgccataaaataaagaaaaataaagtaagaaa

SEQ ID NO: 23103 - DNA, 1182 bp, Mus musculus
cctctgctctgtgtggaggatgctgttgcctggagtctcccacctttggctctcacagtcttgctgcctcctcctctgtatagctccctgagcaggggagtgtaagggagttagagaaacgggaggaagagagaggggagctagagagtgggagcaagggagaaaggcttgttaaagtcagtaaagcatgtgtgttagcgtaccagagtcctcatctctccaaaccttaaagaaaagcatttcttcttgtacattagaagaaacagaatcatgtcatttgtgacatcctccagtcaccgcttagaacccagacgtttcccgagtcccgagagagcatgagatgcgcaaagatgacagaggcactagggtttgtacttccttcctgaccgtgtggtagggttagccacagttctgcctgaatggatggatggagatgttggacttgcaagggcatgtagagcgttctgtctgtctgatcttgccccacctaagtttgttcccaacgtttattttgtaggtggtagagataagcgtggaggtcccattttaacatttccagcccgcagcaatcatgacagaatacggcaggaggacctcaggaggctcatttcctatttagcctgcattcccaggtaagctctgtgtgactgccttgccaatgttttctgaagttctctgtctagaagacagctaaaccgtaggtctagttccaaagagagatcaaacataaaattaagattgtgatcttcatttttattgccacttttataaccatcgtctgattattcaaaacactctggctcaggaaccagaaggcaggccttcacgattgcagaacgttgagtgttgatggtggaccttgggtgctcatttagctgggattttaggatcttacactgccgagttggaatttaggaggtcttcagtgagtcttacagcaagctccaccactccagattatcagaaacttgttcttttggacaacctgcgtgtatctttcttacactgagcttccgtgcatcccaagtattcttttgatgtgtagcatgaagtttgtgagacattcaacatctttatcagctggctcatactatcttaccagtttggagatgctattaaatctgagagattagtgacaggctttcggtgtggatgttgaccaaaaccgtgggcaagcagttt

SEQ ID NO: 23104 - DNA, 1188 bp, Mus musculus
tccactcgggtcttcggaatatgagcagaggctcatgggacagctttgggggaaaacatacagaaacagaaaaattgcacaattttaatagcccgaaccccaccacccatccctaccaccgccgtgatatatttcagatatcagggactttggctgttctgtctttaaagtgttcaggaagtgtgtggatgccagcagctcatactgtgtcaagtattagggcacggtctctaaactcattgcctacaaggtgaaagtggggatattgcccattggtcccagcatgaggagaaagcagagggtaaatacactgatggtaggggaaggggcacctgcactggtacaggtatataagagctgatgtacacgaccatggcgacccctgcactggtacaggtatataagggctgacgtatacggatggaccatggcgacccctgcactggtacaggtatataagggctgacgtatacggatggaccatggcgacccctgggctgtacaagtgcataagggctgccttataaggaccatggtgacactgatacaagaacctaagggttgccttatatggaccatggctatgacgatttggccaatggcctggcctgttatatatttggtgccgtcagccgaggagaagctcagtatgtcttctcaggaccatgatcctctaaactgtgcaagaagtgacaaagaaagatggctccatgaggaaggaacacctacctgtgtgaaggctcacccagagcctggagcggcaacctgaagcctcagccaggagtgacactgcgtccatctgatggggtcacagtagggggatgaagtcattcagtggagactcgtactcctaagtgggctagtaatatagctaggagatggaagcagcagcattcacttgccttcacccaccccacgaggggctggacgataagctagaagttggtttcctgcagagaagaaggtttgaccaagcaaagtcctgagcccagctttgcccctagcatgcttaccacatctggagttcacagcgagggcagctgtctctaatagcatgtattctctcatggagggctctcatctgtgcctgggctctcctgtgtgggccagcaagcaggcccatgcagggttcctaatagaggaagccaacagtgcagtatggtaaaaagggaacaaaggtgtagtgtt

SEQ ID NO: 23105 - DNA, 1129 bp, Mus musculus
cctcgtacttttgcagcagcagtctacctaaaattaagccatcctttttagcccccttttgtctatttgacagccacactgctaaatgattttccaagttcatggaataattcttttcccacttaagaaaagaaaaaagccattctccctcacagtgccgcacctcaggcaagggttcattcggccttactgctttaggtttgccaaacaaaagccgtggagtcggatatgagacgtgaggaccacacaggaagggctcagatcaaaggggaggtcattcctaggtgatggttttcagccggagaatgaagactggaaaggagaagaaaatgaatgacgttccggtttgctgacctgatgattgctgaggtcaggttgttagtcctgtgtgctggccttgtgctgagactgccccctgcctccatatgtggagtggttagaaagatccgtgctgctgggtgttggaaaggtgacaggtgttgctgtctggcactgatatttgctcctgattattaagctgatcatgggatgtactgtccaaacagagatgcttctgagaatgaaacggggtgttgctgctaattattctggaaaagtaggcttaaactggaattgttctgtcaagtcgagatggatggctgccttactgactgcagaggtggagagagtcacactcagatattgatgactcaggggtagttttctgtgacttatcatctgccttgattcagtcccggacacataatggtgtggacagttgacgaagagtgggtctgagacatgatgctgagtcagaggctctgccaggagtgtgctgtctgaaaggacctccagcacattccacgctccctttgcccagctcccggagtggctggactgcttgttttgtgtgcagtgagctaagtgtgacttgagtcctgaatcaggatttgtcagcactcgaggcctggccggcttcctaagcttcttcctaagagctgagccaagggggtctttgtgcccccgcctcccacacgggactgcagagggagcaggctaaaacaggcctttcactgccgaagaagggggctagagggttattggccactgtccctgcctgctcctgggcagcctgtcagctcccctgcct

SEQ ID NO: 23106 - DNA, 1120 bp, Mus musculus
acacttacctagaaaaatcacttatgttgataggagcgagctgtgttagacgataaaaagcagtaacggtgaccttccaatccttcatcagctctacagtggcgtggccagggttaccttgagcgtgttatcttgacaggacggcaggaagacaggtcctgctcggacactgaaggaagaaagcatttgagtggcacttctctgaattcctgtggaatgtctttcctgcctgggtgtcctttccctcattcctgcttctcttgtcctttggtgagctggcaggggccgagccatctgcctggaggacaggtgtgctttgcatcttcactttattgaatcagatgcagcggccaggagaggtccacagctggagcaagaccctggctccctcccagagtgctcttctttcttttcagagttctcagaggaggagctgtcaccaaaggagtggcacaggaatggccatgaggagcttttctgtgaccactgcagagctggctgctttatcacattttggcttagtccctgcctgtgtctctgaattgataaaaagcagcctaaggctgtgggggaaggccctacaggtgtgggtgtgtggctgtcacctctgctttctgtccctgagttttcctgatttctggtgttagattctccttcctttaaagtaactttgccttacctaactctccaccaaaccccttctatacttcagctccctgctggcttaaagagaccagtatctctaataggctgtcccaaggttgtgatgtgattaggccttacacgcaagacctccttgtttatgggaaatctccctctgaacatttatggttaatctgtaaatgttcatttgcaattcttagtcaatagtagacacattaaatttccttcataactgtgttttgacttcataatttcccctttctattctttatccacctaaggaagccccttaagatccaaataaggagccgcctgctttcttgggaaagtttatattgcttgtcacagagctggtgagagatgttcacttgggctgcagtgagcagagctgcaggaagagggtgacctctggaattgtctctctccagagactttgccccctgtggagtgtttagtc

SEQ ID NO: 23107 - DNA, 1123 bp, Mus musculus
ctcgcgtccgcgcgtccctgcgtgcagtccggtttgcttgcgcgtccgggaggcggcggagggcagcggcggccgggggcctgcagttcggagagcagtccctggccggccaggcttgggagtgaggatgcagactccgcgctggagagccagagagggcggcccaggtcaggatccggacggacgggcgggccagggagggcgcggggaggctgtttgcccgcctccgggaggacggagagcctcggggtctggtgagcggcctgcaccggggtgagcgcgggaggctgacagctcagggtctcagtggcctctttcaaagtcaggtcccaaactggaagagatcagggccgcagtccaggtcattaggagctagcaattgaagcgaccagccttgggcgaggcagataacttctgggccgttagacacctggtttagttctgtcttcttgatctttgtctggcagggttatttttgattcgtcttaaccgattggttatgaagagaagtgacacgttccgtctcgactgtgtcaacttgggtttagtgtgctctttccagctctccctctccggtgagggccttgtagaaagctgaggtttagaaagacatgaactccttcaaatgaaagctttaacggtttttaacaatgtattatttattttttagtgtgtgactggctggaggcatggcccaaagccaccattctttctttttttccatcacctgtcacagactaaatggttttgtgcagaattcatcttcccaatgttcttgcgtcctagaggtggattttttttttccccttatggcttaatgcacagttcaggaatgacttgtttccaagattctccaaagacatgctggtcttgattgcctctcttcactctgggctctgctcttactgttcgtagtcctgggtagctcgttcgttttagagttcctgatcaggtaaagccgcttactgccttgtttcctttattccacctccaaagtgacttgaaggagccagcgcagattttcagttggtttcagagttgtcccatccccctttagaatttcatttcaccctccactctgaatccttgccccagatctcagtggttggcatgtaggctggtg

SEQ ID NO: 23108 - DNA, 1109 bp, Mus musculus
ggcaggcagccagccagccagccaagcagacaggcaggcagacagaacaagcaagacagagaaagagagatctggtgtggctgggcattttatgtacctggcagcagtgagcaatgacccaggcagttgccaccactgagttgctgagaggcaggttggtgaagcacctaatttacaacactaatcactcagctggttcctaaatacacatcttccccccacacacccacccacccaccgccagttccatgccagtataaagtacagaataaaaaattggcatcatttactcaatagacgaataacgacatgcctttctataatgtgaaaactgcctccaggtaggcatacttgcacagactgccccatgaagcatgaagagtaaatgaaaattgcatcccttggaaaggaaacaagcccttgatggcctaacctgtttttccttcatgggaaatcccaaaagacaatagtttttctgtgttggagaaatgtcgaaagaattttgcaagaatcttggcgctctctctctctctctctctctctctctctctctctctctctctctctctctctctctctcttagtgatcctctgtatggtataactaggtgacattcagaacaatgtgtatgaaatggaaatacaactttttaatatcagtttcgctgcccgcattccagcagcaaagcagccagattgaatggtcattttacaactgctaagtggtggacctgagatgcataggctaggctgccagatagtctacagactcactgtccctgccacctcccccctcacacacatacagagttatgtaatttcactggtatactctgatacaagagctagcatgtaccggtcgtacacattaccctggctccctgtaaagtaaactaatgattaaagttattcttaaggaactattagtgggaaattaatctgttgtaaaaaaaattaatctcagttaggggcttctacctcacctttgacatttgattcctaaataaaagacacatagcttttattatttataacaagccttaatcagcactagagctgagcagatatctgtcctctatgctattatgtctgcttccctgccaataacc

SEQ ID NO: 23109 - DNA, 1167 bp, Mus musculus
gtgataactccagctgtgtcaagttgacacaaaactagccagtgcagaaagatagatgacaggcagatgatagacaggtggatggaacaatagataatatagatgtatatataaagatagatgatagatgataggtagatggatagatgatagatagatagatacatacatacatacatacatacatacatacatacatacatacacattatagatgatagatagatagatagatagatagatagatagatagatagatagatagatagatagatgataagaaagatgtgaaatttggagagaagaaagtggtttgtagacatgagggaacaattgtaggtaaatgcattcacagtacattacttttcatatatgaaaatgtcaaaattaaatgaaaaaggaaaaggtgtttagtaaatattcgacaagttaaatgttcaaccagtggcagctactgatcccagttttcaatattaagtgaggaaaaaaaaatcttatcctaatttttccttccacaaaacctgttttcccttactgtagcctaattggccttggaaataatattactatgtagaattcctgttagtaaaagtaccataaaccaaccataactaatggcgtaaacagtttacctcttggtctcttaaagcagcttagtctggctagggaatggtgagagttgttcatttagtggttgctcccagcacaaggaggaattaatttgtactcgctgactatttaagacttgttaaagtcttctcctttgctgacactctttgcactagaaatgtttctgtgacccagaatatgaagtcaaacactcattgctaataatttttaaataaacactttaaaatcaattctctgttttccatgtaattgttcagtaaaaggacacacgtgttatttttacataaagaaaatttagctgagcaattaatagtgaagcatataaagcatctccaatatttcctggattgattgatattttgattttatcaataccggtggtgagagtgccagtttgcatagatactataaaatggtgaaggcatatttagggccattccagagatagttgtccattctattctaatcctaagccaacactcttgtaagcagtttgtatgaaccttgagtcagcaactcacagccatccttgacagc

SEQ ID NO: 23110 - DNA, 1129 bp, Mus musculus
tcaagtccactggcaactatgtcgacttctactctgcagcccgtccttacagtgaactgaactatgaaacgagccactacccggcctcgcccgactcctgggtgtaaggagccaggacacgaggcactccggggacagtgcatgtgcatgcatacaccacaggacattttgtttctttttttcttttcttttcttttgtttttttttttctttccctgcaaatttagtttgttaaagcctgttccgtaggaaggctgtgataaccaggaagaaatactcagagctattttagaaagctaaaatgaatcaagagttaactgggaaatcgataggaagctaaacgcaatcctaattgtgaccgcattcaacacctttctagtttgaactatagcattttgaaagtgctttatagtccggtgaggctgaaggtaggagagaggagacagtcagggtggtgggcgtggttatcgctaagcacaagacagactagtttacacactgtggggacggcttctcacgctttgtttactctcttcatccgtgtgactctaggcttcaagttgcattggggttcctctgtacagcaagacgtctcttgccttttgttaatgcattgttgtaaagtattcgatgtacattacagattaaagacgaagagtgcattgtgtatattacaccaatgccactgtgtttcctcatcaatggttctaaatattgcttcaatttcaaacttttgaaagatgtatgggtttccaattttctttttttttttctttctcccagtatgttttaacaaaaaaggaaaaaaaaaaacaggaaaaaaaaaaaaggaatatttagcagtattgttcgttctgatatgtgatttgtttgtggcaactaaacgcggcatccagcagtctctcccaagctaacaagtcattccacacccctcgtcaacaaaatgctttttcactgcctaaaattctagatgtagatatttgaaatagatttttttcatttataccagttttctttatgataatacagtgttaaaagaaaataaattacaattgatctgtcatccatccttgctaagaatgtctatttccatggaccagtcttacaaaatacacattcttgcacgtgt

SEQ ID NO: 23111 - DNA, 1124 bp, Mus musculus
ttatttgccaggtgcaacacacagttctgccccaggctgaagcaagcctgtgatgaagggtgaagcctctgtcagaccagtggcagctctcagcattaggtcatattaatggggaccttgaatgacattcagttaaatatgcaaacggaagggccagagctgtgcttgtgaatgtcctagctgtggtggctcacagggacactccctccccaccccaccccccaggggatgactctgtaacctgttcggatggtgtatatttagacagattgcagagtctgagagtctacccagattcccaaacaatgtgaaacctgatagggctggagttctcctagcctaagctgttctactagaaggtgatgctgccccaggtggccaagagcaaatagcgtggctgcatcagggtcagctctggctttgatgtgtgccattgcaggaggggcccagacctgagagaaccccacccctggagagctcccatagcctccagcctactgcgtgggcatgggggtagactctgtgggaactggcataggctcaccctaggacagcatcttactctaaaggagcattgagattcctagtttgcctcagtatgagatctgctgctgctgaccagggcattgcgctttgaaagctttctctggctgtggtgtgattcctgttgttctagaagaaaatgaagacgggagaaaaacgaagctggccatctcatatagagcagtggactttgagtaatcagtcagttaagataatagttagagagttctagaaactggttcaaaatggttcgactatgagtaggatgagtggatactaaatgtcccttgctcccatcccaccatcccaatcctacctagagcctgctgtggagttagaacccagaactccattcaggtgacagctaagtctactacgattggaaccttcttggttccaatgatagttctggaaagcaaacaatgaaaagagaatcgtgcccagtgtttgctgggtgtgagggtcttcggcagtggggaccagatggtgaggaacggaagcaggcttctgcatcgccagggttcaggttccttctcctggtttgagttctgtttttttttttttttaaatgtgaagagatt

SEQ ID NO: 23112 - DNA, 1099 bp, Mus musculus
tgctgtctccagcaggtgtccctatgactttgttgtcacatctgctccctggtatcaccttgtcttccacttgcttccttctccagtttgattatcaaactccttgcaccagatgccttggggtctaaggaggcagaggaacaaagaagcctttggtagtctctctgcattaccaagctgcgacctctaaatccccaggagtgcatggagggcggggctgtggcttctgccctctgctttcagaaggaaggctgggtctattctcctgacttggaggagcagaggagcaggcttggggctaggcttgcactgtgtttattaactgtaaatagtgaattccaagctgacaggtgtcttctcagggatttatacataaatacagttaggggaaagttaaagtgtattttaaatctttaaagttgaagtgtgttttaaatcttttggatgtttgagtcaattaggattaaactggacagaagacatatttccaagatagtgtcaatgctgctgtttctaagagcgatcttggaacttgtctctctgtggagatttatgggcaccgtggccatgggaatagctgtgcatattaaagccagagttgtatgtcagttgcttcttctgtttgtgacccttgggtgaacagttgcctccagttagtaagcagagacaactggttgccagatgggccatccatacccaccccacccacccccagtgctgtccactgctcccctggtcttttctccttgctttcaagaataaaatgttcagtcattctgcagaaacccacatagctcttcaggaaggatcagggaaagttctgcatacttggcccatcatgtccttgatgggcagtgtgcttgctgcgctagaggaagacggcaggtgacaggaaggactttgtgccaccttttcagctcctaccaggcttcctagccacacctgatacctcaagaacagcaagatggtccccttcagctttggattcccctgtttctggaagcttattctgcacatcaggaaagaggactcaagatgttggctagagaatgggtttataggctcagagaaagtataccaagtgctctctgcccattcc

SEQ ID NO: 23113 - DNA, 3352 bp, Mus musculus
tcccctgcacatgtttggactacagtgacgagcactcctaacctccccagtgtaatacagaccccatcactgagcatcatgtgcagtctccacagctctggcccttcccacaaacctcaccttatgccagaccctcctccaacgtgctggcctttgtgctcgctctagacgccctctagcctgcctcttgaaaggttgctagtaagctgctgtgaatacagttaacaaggtgtcactggaagaatggcatatgtgtgagtcacacaagaaagtgaccaccctgtttttgtactctaggtaccttgtggggcagcgcctggtgaactatgagcgcaaatccggcaagcaaggcccgtctacaccgcctccggtgtcgtcccaagaataaagtgcttgtctcagctccttgagcttctccttgccttttcgtgtcctttgttgtggacttctcacttggagattctcctgtgatctcagcgttgtttaagttaaatgtacttgacttgtctcctcagcattcagagagcagcgcatccggcactactgctcctccctgcatctgccgacatcactgctgtcttgagatctgtacatgtgtaaataggagttccttgatgccctaaaaccttggattaaacagaatgtgcattgtacatctttaacaaatgtatattaatttattaaatctagttgtcactttattttggacctgctgtgatctcgacaggaaatgtgccacagagcagtagtgtataggcgagactttgagtgacatcttttggagcacagtgcatggtgttgccagcagttctcaccaggtaactgcatcctgtccttggctggtcagtccttccttaccaggagccgaatgggcagtggagcctgtggtaggggactggacggagtgcctcacagacagtcgtatttggaaattattacatgtaacaccaaagctgttgtacattttctactgcctgattgttttcatgtgtctgtgtttgtaatattgtatagtatattgtgctagatgaggaaattatttttaattttgataatttaatattcctagtgatcagcattgggagttggggtttttgtgcttgttaggggcatgtctatacttagaaagataaactacaaatgaagatttttttattgacctcctccccttccatacagctctttctttttgtcaacagtggccaaaagtgtcatgccggatgagaaatctaaggggatgtcatcaccaacaggaccagtagtgacaggtcaaggccctaggccgtggaatgaggccgactgcatcagggacgatgagtagaacatcctgccgtgctggcagcacattgcagctgaggctcagttaatataccaggaaacccctgttcctaaggcatggtgtttacagtaaaccgcaaataaaaccaagttttatttgtttgaaaggaagcagactgagttggccttcgccataggaaagagttgcattggagaaatgctgtgagattttagagaatttaatactcagaggaagcctggttcccctagcccaagcttcatgtttaaagtttaaaagattaggatggttgtacgtcattcaagtgtttaatggtaaaggtgtattataaggatagtgctagaagctttcatagactgtaaagagttccatggagtattaaacccatagttggaaaggtctgagggcccacccccacctctaaatacaaagccaaacaaaagattaagagcaatgctttctggttttgttcctttcttgattttgtctttttgtcgttcttaaattcactaagtaataagcaaatactttgttttaaagcagcattatatttaaaaaacaaaaacagtcttgccatggatccagtgttaacactgtcattttgtaacagcctttctctcctgtagcaagcctaccttcactctcagactttgtccttccataaagaattagcattttaaaatgcagtgccacctgtcaatgggaatatgtctataaagcctaatcttttgatgctggtatattggacatataacattcaggtttcatttttaatttttaaacaatttatggatctaccacaaaaagctaagcattctcagtcatctggaattgtaagtgagcttactggatgcttttctgagaacaaccacaaacagcgccgattgccaaggtgggccccatctcactggcagggcctgctctcctgtgtgctttgtccagtggctttcaggaagatgatgtcctcgtggggatttattgtgcataacatttgctagggtgacatacaggttttattcaacaatatcataaacatttaaaaccctcaattcagaaggtgttcctatttgctgccggtctttacaggaaatttatagagatgtgcatcattttgaattaggctaacacccagtcttcaagggagtttactaggaaagacctttgtgctttattattgataatttgaagacaaatcaccacttgggattagttttacatgaccagttatcagatggtcacttcgaaatgtatagttgttcattattaacaaattatggtttgatttttaaactacaaagtactaatagtttagatgaaaactgaagaaaatgccaatgtaaaatttgtgtgtagctagccttaatgttccatgtttatagttgtggttccagcccccactcccgttctccgggggtagggtagggagataagacatgtattgaacagtaatttttgttttaacagtcagtatagctgttattactgtgaattctcaagatggtccctcccctcaagggacaatcctcctatgagtttatcagacatgtcgcttctgtgtcgcacaaatgctttattaaagtatattcctaaattcaggttgagttgatgaatttttaagacaaacacaaaatacgcattggacatttgtaccctgttgtgtttgcagacacaggagccagtgccattatgcaagaacttggcacttggcacggtgctccaaattagttccttcctctcctctctggggtggagaatatcaggctagttactgtgatgcctcattttacattgtgatgctcaaagttcttgtttaaaacaatcctctaggatcgtaactgttcagtcattatcaaggggagagatgacatagtaccactgaagtgttactagagacctcatctgtgaagggtctttaaattctttgcttaaattgccctgtagcggggcacttaatttgccctgtcaatcagatgttttgtttcagcttattgctgttgttgtcaaagatttaaaacagctgtcgtgagtaagggcttcttcagatactctccaata

SEQ ID NO: 23114 - DNA, 1172 bp, Mus musculus
tagcatcacacagattctgtgtccaatggctgtcgcaggaaggttgctttggagtttggcgtgactcatgctaggtttctgtgagtccaggtttcttttccacagatcactctggttttgtttcaattgtctccagagtcactgtagtggttttttctgtttgttttgtttttgtttttttgccttattcacaaatacacataagcacatctcttgcctaagtagaactcagttttatctcaggcataaacaccttcaattttaagaagagccaggtgctctctttggttctggcttgtagccagcaaaaatggccttgcatcaaagctttccagacaaattgggtttttttagaagtccttttcccagccagtctccacagacaccaagatggcagaaagatcagacctcattcttaatgcacaggctcattggtccattttctattgctttaataaagttgtctttgtatgattttacagatgttactgtggaaatgcagaacttagttcacaataaaattgtctttgttttaacaggtgttactgcagagatgcagaacttagttcaccggcggatttacccatttttattgatggtcgttgtgctgatgggaatcctgtccttccaggtccgccagtttaagcgcctttatgaacacattaaaaatgacaagtaagtctagagttctgttcatgtaaacactcttaaggtggtgtcattttgtgggttttgtgcttgtcttaggattttattgctatgaccatagcaactcttataaaggaaaacatttaattggggctagcttatagttaagatattatcatcatggtgggaagcatggcagacatggtatggtgctgaaatagcggagagtattacatcttgatctgaaggcactaggagactatgttccacacttggaggtgttgcgcatatatgagacctcaaagctcacccctaccggggcacacttcctccaacaaggccacactactccaacaaggccacacctcctaatagtggcactccttgcaagcctttggaggccggttttattcaaacaacctctgtgctcagtatggtaaattacatgagaaaaaaatgctcatttagtggacatactgggatatagcatcagcaggatttgtgaacagattgagtgcatggcg

SEQ ID NO: 23115 - DNA, 1214 bp, Mus musculus
tagcacaaataatagaaaacttgtgtctttattatattagcataataatttcagttggtaataaaaagtaacagaaagccgggcgtggtggcgcacgcctttagtcccagcactcgggaggcagaggcaggtggatttctgagttcaaggccagcccggtctatagagtgagttccaggacagccagggctatacagagaaaccctgtcttgaaaaactaaaaaaaaaaaaaaaaaagtaacagaagcactaatattcataacatcccaggctagaatgaatttgtaggtggcctggcagatcaggacactcagctcattgactctctgtgttttgggtgtttcttaaccaagtaattctatttcctaaagtgttgttggttgtttttgtttattctgatgtgaaaatatttatagaacatcaagattacagttctctttacctagccacatgtctcatttgtcagcctttctattttcagtatttgctggccgttggttaatgtcattttggacggggactgccaaaatccatgagctgtacacagctgcttgtggtctctatgtgtgttggctaaccataagggctgtgacggtgctggtggcctggatgccccagggacgaagagtgattttccagaaggttaaagagtggtccctcatggtaggtttctggaataagagattgatcttattgatggtcataaatactttaacagctatttcccatttgttttcttactgtgttactagttttcaggagagttatctttttatcagaaagcacatttgtttaagatggtaactttctatttcactggaaccatagttctggaagtacccagacatacatacttaagagtcaaccagaaggggctggagagatggctcagtggttaggagcactggctgctcttccagaggtcttgagttcaattcccagcaaccacgtggtggctcacaaacatctgtaatgggaatctggtgcccttgtctggtgtgtgtgaagacagcaatggtatactcccataaataaaataatctttaagtgggggaggggatagggagtttttggaggggaaaccaggaaatgggacatttgaaatgtaaataaagtaaatatcttaagtttaaaaaaaaaagtcactcagaatcgtgagctgctaagtaatctggtgaaaaaactaagaattacagaaagtgctattggagatg

SEQ ID NO: 23116 - DNA, 1130 bp, Mus musculus
ccagggctatacagagaatccctgtctcaaaaaacaaaaaacaaacaaacaaaaaaaagagtcagggactctagtggtttggatgtaagctgtaaagaaacttctgtaaagaagtcagggagtcagaaatcctgttcttagcatgggaggatatagagttacatgtatgagagatatgtgattaatagagagagcaggattaatagtttggtagatgcttggtcacatcagcgtgcatcactgagttccactgttgatatttaagttaggagtcggggaagaaatctctactactgtagataaaggtggtattccagctagaagagtcacagtcatacaaagaataagctaggctgagaaagaggacaatacttgggctcttgtgcttctagactggggagtcaaagggggagcagctctgtagcacactgctgtccagcacaagtgagcatcacagcatggttgttggtgaacaccaaggaaccaggaacagcttcagtggggtttaggaggatagcctcactgacttggagagaatgggaggaaaggctataaagacaagttcatttggctttggagatttgttatcggaatagatattttataaattataatagggttcatgtagtaaacctggctttttgtattgtagtgatgctccggtgagtgagctgtcccttgagctgctcctactgcaggttgtcttgccagcattgctggaacagggacacacgaggcagtggctgaaggggcttgtgcgtgcatggactgttactgctggatacttgctgtgagtatggcagctgactctgtgggcatctatgttatctgggtctataacctttttgtctaaagccagggcctcatgcatactgtacaaatgctatactacagagtaacaactacagccccatgttttatttttaattttgaggcatattcttacccaagctgtcctcaaccctagaatatttgtaccctagtcttcttagtgctgagcatacgggtatgcgccactatggccagtcttgttttataacctttctgaaagaagtgtgttctgtgttccactcgataaagcctagtttcagaagctacagagacagctcagcagtaagcgtgcctgctat

SEQ ID NO: 23117 - DNA, 1135 bp, Mus musculus
attcagtatcacttgagcagcacttacctgtaacaaccacagcacaccaaaaagcaacagcttaaggaaagaaactgtagaagaacgttgtagaatcatctttttttgaataacagtgctttgtatttctggtatttgcatagtcaactctctgggcttccctgttggctttcagaggcaagatagccttgtccggtgtccttctggggtcgcatacagggccgcccacacagtaagaggccgggttgtaagttgactgtaatagagctgggtagcacctgcccccacctagggtcccacctcctcagagcctgtctgatgaaccacgtggtcctaggttaagtgtagttcatttatggttccattttggaagttcactggcattgactacatctgcctgtcctctctgatgcatcctgacagctgatcgccattgcaacaggaggacggattgtcccacggttctcagagctcacctctgagaagctgggctttgctggtgtggtgcaggagatctcctttggcactacaaaagacaaaatgctggttatcgagaagtgtaagaactctagagctgtgaccattttcatcagaggaggaaacaagatggtaagaattctgtccttgggctggagagatggttcagttcctctggaccagcatgaggaactgagacatggcctcctccccagatcatagaagaagcaaaacgatctctccatgatgccctgtgtgtcatccggaacctcatccgtgacaaccgtgttgtgtatggaggaggggcagccgaaatatcctgcgccctggcagtcagccaagaggcagacaaggtaacagagtggcagtgagaactgctgtctaggtctcgtgtgtttatgtcctctcagcttcattctgtagatgaaaggaagtttattaagcttgccctgagtgacttttcaatgcatgcttatgaacagctgttgggttggctattgcccagtgcacttactgtccctgtgtctttccagtgcccaactttggaacagtatgccatgagagcttttgcagatgccttggaggtcatccccatggccctttcagaaaatagtggcatgaatcccattcagaccatgactgaagttcgagccagaca

SEQ ID NO: 23118 - DNA, 1115 bp, Mus musculus
ggttttgcagctagcacttgtaccactatgccaacttggcagctttatgacctcttgttaaatagtgtgagtggtgcttagatatgtgagctgttagagagggttgaatatgctacctggtaagtctgagctgtggagcacctgaggactgctcactccgtgtaactgaagagcctgctaccactaagggcttcatgcattcttttaagggaaaatcaatatacacttgggtttcaagacttgtaagttcaaatcagagagggtttgcacggctcagatttactgctttgcctagaccactattgaccccggtccattttgaactcagaaagtagccctggtcttcctagaagtactgttgaggtgtatggtgtggctaggatgctgcagtcatatgagggatgtaaaagttgtgtgttttcatcaggattaacagctgtcaccgacagatggctgagatcgccgtgaatgccgtcctcacggtggcagatatggagcggagagatgttgactttgagctcattaaagtggaaggcaaagtaggtgggcggctggaagacaccaagctcataaagggtgtgatcgttgacaaggacttcagccacccacagatgccgaaagtgagtgcccgagtgaggcgtgctcttaggctcgcataccgcttctaactcaaacccatgcctaaggtgatcttcctctccccatagaaagtggtagatgctaagattgcgattctcacgtgtccatttgagccacctaaacctaagacaaagcacaagctggatgtcatgtctgtggaggactacaaagccctgcagaagtacgaaaaggagaagtttgaagagatgattaagcaggtgagacctggactgcttcctgaactgactccaccggttcctagaggaccagcactaagggattagcatctggggcttcattgcttagctacaagtagcatgcagtacaacctgtgttgggtatcagtcaaaaacagccactgtcggaaaactaaatggtgtatgaacaaagaagttgattttgtcctgggctaccatgacggtttagctgtgcctttcattactttatcctggccttgagtggagcaaacgagagct

SEQ ID NO: 23119 - DNA, 1171 bp, Mus musculus
attaatcaaagaagaaacaaaaggaaagaaatttgtttccaggatctttgtttctttctctcctgtctaataataagggatgggaaggggtggtaaagggtggggaaaggaatctacaaagtagcaaaggccagctgcaggcctacatcttcctgtttttacacttattgtggggagggtcagacagagatcagaatacaacttttgggaggaagttttcctactgtgaattccagggcagttggtgttgacagtgagtgccttaaacctcttaagttcttattatctaaatcatctttaaagggcagcctgttggaccttgactgtggtcaaaactgagaaggtgggggtctcctcctttcaataatagccctggattacatccagccctattttagaatgttgtgatttcggggtagcatgtgaggctatactaaaatgtgtgtcttagattgatggtctgctctgctgcttgcagtcttggctggggccttgttggaagaagctgaacagctgctggaccgaggcatccacccaatcagaattgctgatggctacgagcaggctgcccgaattgcaatacaacacctggacaagatcagcgataaagtgcttgtcgacataaacaaccctgaacctctgattcagactgcaaaaaccacgctgggctccaaagtgtgcgtgtcctatcagtagtgtactgtggcctgtaagccttcccttcagagggctgtgcacctgtcctaaaatgcagcagtgtggtttgttcaagtttctgttctgcttgtttccctgtgttctgattgggagggcattttgccatttaggttattggatcacctaagattttcctaacccgctcttcccgtcacctcagcactagggaatcattttggggaagctttttttactcagtacacaagtgtactgatctaaagatttaatgtaattagaagaatggtcttaaaattgatgtcaacatttcctaatgtctacttttacccctaaagatcagcaacctcagtcaaaaactgctcctctctctacagtagcaaaaccttgcagtctgctgctgtattaaagcccaggggaagcagttacacgtgtgctacatttaaccctgctgtgtagggttatgctgttcctgtggcatttcatacgtgtttacttg

SEQ ID NO: 23120 - DNA, 1181 bp, Mus musculus
ggatgcagattgcacagactttcagtgcctcctgtggtctctcaggattcaccaaagcccctttaaggttgttcctttgcccccccccgccccccaacaaagctctctggtcttaaatgccctcttcctgagtggtgttaaggagactagatgtgttttaaaagaacactgtaggagcttagactctcacatctcacacccacaagaaggagcacaattggatatgatacaaagtgcaggttctccatccttaaggtaaatttctaggctgctaggatgtgtgaaagagcctcaagcatggccctctctacagactaatgtcttatttagggtctggcttggcttcccagggctgatcagagaaatgtgacaatggactctgtccctggttattcctgatggttgacatagactgatctaccttcacccaccccaagtgagttctgcttttctgtgacctttgaaattcaacccacactaagaatggcattctttcacttcaaggccacatccaaagaaggagctcagttaagtgtccaggcctcagcagtaaatatctgcaggatgtacccagacacacactctagaagatgagcctgtgctctgtaacagggtggggttcactttctaaagttttcttcttccttgacatggtcagtgactcttcaagcttccatcgggatgtcatattttacttaacctgcatttccagaaattaaagcattctagaaatctacaagcggtttggctcattgtgtgtgtgtgtatgtgtgtgtgtgtgtgtgtgtgtgtgtgtgtgtgtgtgtggttagatttctagatatggttttttggcaacctaatttccttaagataaaacgggtacactcaaagcagttcaagttgtcttttagaaatatggaatgggaagaagaaaaatgctaagtttaaacgactcttggaatatcttcaggaaaggcagatggcttctggcatgaagatagagagagtatccttagggtttcctcggagttattttctgacattgagactcatatatgtcttgggtgtttataagcaaagagtagctgtacttatttttagaaagatattctgtacttattaactaatgtcttctaccttcctctgtctttgagaaatggagccttgaggtgacacgaatacttccagaagtacatcta

SEQ ID NO: 23121 - DNA, 1177 bp, Mus musculus
gaggaaaagagatgaaggcttgaaggcatgatatccacagcatggtgactggatccttctacccagagcctcaacacattcaacgtctggtcaatctcttcctgctccatctggcctgagttgctgctaaactcaggttactcacgaaactctgcgttgtttcctgtgtccagccagcacttgaattgcattgtcttacaatactcacgtggactgtggtgtgccatctgaccctgcggggtgactaatgtcaacatctgttctgcaagcatagggaaggaagggagaagctaagaacgccactcttcttcacccacacgtgtgaacaggttggcagcgtctgcctttcagccactttcaaagtgttaaaataattagctgacccgtattttaagtaggatctgattcctggcctctgactgttccctgcccagcatcttctctggctatcagcaggaagggaagctgggatcagatcacacgccatgaagttgtgctggtccagaatgtcttgggatcatcagtagctctcaagagtattgtggcagagacccacttgggtgggtggggacgacttcaaatcagcgtaaggtgtcagaggccaaggtaattttcatgagacattgggaagcatccatgccgttagttagcctccctgagctggattatcctcatttccaggctgacatctttatcagacagtggacagctatttacataattgaaggcactggtgaattaattttgataaaatcagtgaactatattacctggagacaagcctcgtaaatgcaatctaaggtacagctaatctcctttctctaaacatgcagatatctacttggatattggtttaagtgcatatatcccacttggcttctagctaatcctaatcttaactgtttatcccccacctttttgttctgctttagatagtggaagggaatggaagaggtgtgctgtctggctttagtcatctctgccggttcgcatcaccatgctccctagaagtggctttcgacagagagaactgggctgtgagatgtacaattagttacagcatatgacagtcatatttttcaacagagtggcttattaatgaagaaaaatgcggcctttgcgtcttctctttctgacagtgatgtgagtggattcccgggtttctaggcctcttcat

SEQ ID NO: 23122 - DNA, 2399 bp, Mus musculus
aggttggaactggccaaactaattcctgaaagccttgaccttctctttttcttctcttatctcagccgtcattgctggtggtgtgatcggctttctctttgccattttcctcatcctgctattggtgtaccgcatgcggaagaaagatgaaggaagctacgaccttggagaacgcaaaccatccagcgcagcttaccagaaggcacccactaaggagttttatgcataaagctcccatttagtgtctctatttaggagagcactgaacttttcaaaataaagctttggcatagaataatgaagatctttgttatctgttttgttcattacagagccatactggccctttaatgatgagaattccattgtatttaaattttttcgtgtatttctttagaatgacataaaagtaaaaatctaacatctgcagtgttctgtgaatagcagtggcaaaatattatgttatgaaaacccctgacattcatggaattgatttgaacatctatgtgcaaatacaaaatgattgtgtttgtcctctggttcaaagatgactgctactcccccttgtcagcaagtctccagttaaccttactgagttggtcttcatttatttatctcttgtccctcttctctaccctcccttcttgtcacctttcttagaaacaaaaccttatgccttttgtagctgtcatggtgcaatttgtctttgaatgattacaataatggtaatttagtgtatatgtgatttttctcaaatatgttaaccttaacctccactttatataatgtttttaaatatcagactatccattttatgcttgctttaaatttcattacttgtagcttcaggcagatttgcaaaggcaaattaatgtgtaaaattggattattactacgaaactgtttagtcctagctatcttcttttgggaggatttgacataacggacaagcctcagcaaacccaaagatgctaacagtattttgagaagttgctgcagattcctctggccactgtacttgttaatttcttgtcatttgaaggtacgagaaagagtttaaagaaaaaaaaaaaagatcagtttttgttcttaacatgcatttaaattgcaaacatctttttaagcctttgaagtgcctatgattctatgtaacttgttgcggactggtgttaatgagtatatataacagtttttaaaaagttggtattttataagcacagacaattctaatggtaacttttgtagtcttatgaatagacataaattgtaatttggaaacaacaaaaaaacctgctgaataaatcacatggcctaatattgaaaatgtcactgttataaattttgtacatttcttaccaaatgtacatctccccttgctgtgactgaccgtctgctctcagtgactatatgggtttggtttctgagtatctcatggtgtctgtcaatcaagaccaaagaacccctcagtgaggctgttaattacgagatttacctctaaattgttcagaggaaaagtattgttattctgcatgtatttgggtgcaggaataggatgactgccaggggatttcaaggtttgcagcctttgtagtgtagctactgacaatattgagagagatgccttcttttgcaatttactcttaaaagtataaattccaaagaagcaaagcgacctttctagaagtaggtgtctggggaacagacctatagaattgcttacctgtcaaagctcccctacagaagaaccctgtaagtgacaaccacagccactccatggggtaggagggaaggtagggggctctgcctgttgaatgacagcctggctgcttaagatggatgtttctagaaaaggtaatgccagaggaggagttggaggcatgggggtgccccgattgggtactcactgaacagagcatttcctttttttgttctgttttctattttaccattagtttttagttttaaactgtgagccatggaagtagaaagaagacagcaagatccgcagcttttccagcataaaattaacttttgataaagtttggctacttcgtttgagcaccttccctgagcttgtcacagaacacatttaaacaaaactaaagtaacacttgaaacagtgctgtgtctgaatctttaatggccttaattcatacctttctgtccaattacagctgtaattcaccatgttaaaaggaaatgatgggcccttccaaagctgcacaatgcccctcaattacggaggctgagaatgtagtgggtatacctctaactgtgtgaaacagtggaatttaatttgtagaataacttgcttggaatatctatgccagggaaaaaaaaatcctggcaaatattttgtcactgctgtaaagcacatttgttaaaagtgccaaaataaa

SEQ ID NO: 23123 - DNA, 1196 bp, Mus musculus
atgctggtatggaagacttcattcttacctttgtgagggggtccttgagaaaataggcaagggaatcagggcaagataggtatgaacctggtattgagtgggtcagtaaaacttgatagaaatgcattgtgatgctgcagagatagttatcctatctcttagtgatgaaggtgacagaagagaccttactcagggttgggatgggagagttaaaggtgtatgtaaacaagatgccaggtcaaggatggattcagagttctgggcagtcttcatcatcgttagttaatttcttttttttttttttttttttgtaattacagaaacaaaccaaaagtaatgttactatattgggtagaagttacatcctaaagtgtgtaagattatgctaaatgctgagtatttgtcctctaaaatcttaccacattttgtatttttgtctaatgaggaaaacagagctgtataagtttgcttttgctatttattatgtaaatttccaaaaaataagagtgaagaaagtggtgcctggaccctgtgtaccttgtagctagaagcaatgagtaacctaatgtcatctgtatcttcttcctcctgcatttttcgtgaaagtccaagtgcatataccagtgcagctggatctactttgggagactggggcattgagctgaaatgtgcactctcatgatcacaataactccactaatgtgaattttgtgtgaactgatgatatttttagaagtgggactcataaatgagtcttcacaattagtggaactcaaaagagcattggtgaggatattctgccacagatacaaaagaagagaccattatgttgtaaatctgcctatgaccctgatgtaaggcacttgagacccttttctcctttgtaacatagagacttgtatggactgttagggttgctgtgttctgtgaaaataatcaaatacaacataatcttttcattagtttctgtagttgataatttgatatcctggtaataatgtgattatttccctgttcctaagtggcataaatacttgcaagtgtgcatgtacaatggaaaaaaaataaaaaaaatattcttgtgtcaccattgtatttaatattacaaagtaataattggagggttatgaggcgggagctgagcagaagcaaggagtgagtggtgtatactagcctaagtaagcaggtcccaggcc

SEQ ID NO: 23124 - DNA, 1196 bp, Mus musculus
gcctccaaacccacacagctcaaggagaccccactccaagactagagtccgcccggccccgcccatcgccccatgtgacgcatgccccgcccacagcctccacgtgacccgaccggcctccgcgcgcagcgtggatcgcggccggagccgccattgttccgccgggggaggacagcgggtcctggcgctggcgccccgacgccgcttagcggccgcctctggagacactctgtccccgccgccccgtgtcctcctggtggcggcggcgtgaggccggctgcggagactgggaacctttggctctccccgtggcggcggcggccctctatcccctactccggcgtgagggttggccgcgatgcgctcggcctgaggtgtcgcggccctgtcgcctcccacgactgttccagcggcggctccgctccccggcgtcatcccgcgagtctctctgacgggagggaagatggctgcacgaagctggcaggacgagctggcccagcaggccgaggagggctctgcccggctgcgggagttgctctcggtcggcctaggttttctgcgcacggagttgggcctcgacctggggctagagccgaagcggtacccgggctgggtgatcctggtgggcaccggcgctctcgggctgctcctgctcttccttctaggttacggctgggccgcggcttgcgccggcgcccgcaagaagcgaaggagcccgccccgcaaacgggaggaggcggccccgccgactccggcccccgacgacctagcccagctgaagaatctcagaagcgaggagcaaaagaagaagaaccggaagaagcttcctgaaaagcccaaagtgagtagtggcgaggagcccggtggtcaagggaagcgagagctcaggtcgaggtggtaggtgaacacgttccttgagaagggggaagtcggaaagtgtaagaaccagtaggaaagtcgcgttttcctgaatggaaattaactccaggggtaggtataaataaaagtgaccaaacttacagccatcatatgagaaccttggtttccccaaaagcagatccttcctagaggcctgtgaaagaaagtaggctgcatgtggaggttaatgggaccttacagtgacgttgggaagttctgaaaagactgcccggtagagagagatgtctatctcaagccacgttgagacctgagaccgt

SEQ ID NO: 23125 - DNA, 1105 bp, Mus musculus
ccactaaagttaaaaatttttagaattggatctagggaacctgctttcttgtacctgcctgttactcaggatgattgtgaattcctggctgcaagtgctccttgcaaccttagccctgagtttttggcactacaggtgtgcaccactgcctggcttcttttttggtttttgttttttttttttttttttttttttgttctctttctttttcgagacagggtttctctgtgtagccctggctgtcctggaactcactctgtagaccaggctggcctcgaactcagaaatccacctgcctctgcctcccaagtgctgggattaaaggcgtgcgccaccaccacccggctgcctggcttcttaaatttgtattcgtaacatgctgattagtttgaaaaccactcactggaatagaactataaagtctatactataagaacttttattcttttcttttttgtatgcttgttttagagacagtgtctcactatgcagctcccactgtcttggaactcatcatgtagaccaggttggccttgaaatcacaaagcttcacctgcctctaccttcaaagttctgggattaaaaatgtgcaccgctatacagatgaccttgtaattcggcactgaggctagagaattacgttttgaggtccatgccattttgaactggtattcatcaaaagaaaaaaaaaatcttcctagccatgcagtggtggtgtgcctgtaatcataaaattcaagcagaggcaagggagatcttgaattagaggtcagctatgcagcaagactctgtgccgcctcccccccacccccaattttttttttttaagttgagttacttattcaggtggatttagtcatataaactaatagtttctttgaatgaacattttatgtttcaggatattgcctaagtcatgaaaatccatattttcaaaacgtttgtgtgtgtgtgtatgtttgtgtgaacttgtacatgtgtgggtgtagaagccaaaattaatgttgaatgtcttccttaaccacccctttctgtcttaaacattttattatgtgtttgaatgttctgtttgcacataagctttgcttggggccatggaggccaa

SEQ ID NO: 23126 - DNA, 1248 bp, Mus musculus
taatgtgcagtcattatatgtaatataatatacaaaattatatcgaagggaagaacatgtaactaaggagaagtcttcattttcatagtgggtgagtattcagagtatactagatatgtgttttcagttagtcattttgctattgagaacatcactagtatgcattttctgttgacttttaaattaaggaatctgttagccaggcattgtggtgcatgcttgtaatcccagcatatcgagggagaggtaggggaaccatgagacttatgtaagctacgtagtgagaccctatctcagaaacaaactttaaaatcatgtaagaacttcatagcttaccttcttatactcaggctacttaaaggacactaacagggaaggaaagagtactaagtactgataagctgagctatcatagaaatacagaattaccccatttttttaacaagaaaccatatatctgtttttaatctttactttcttttaagtttcttcaaggctgaatgaaaatcttactgtcaatggaggaggctggagtgaaaagtctgtaaaactctcctcacaattgagtgaggagaagtggaactctgtcccacctgcttctgcaggcaagaggaaaacagagccatcggcttggactcaagacactggtgacactaatgcaaatgggaaagactggggaaggaattggagtgatcgctcaatattttctggcattggtaagaacttttagaaaaaaaattgtttaaaattggtaatgtgatacagcttgaatttttcaggaattgtgaaggaaagcaagccattaatagaaataatcctaaactgggcatgttagtagtgcattcctgcaatcccaggctggaggatcgggaggttagcctcagtgccataatgagttagagaatagcttgggctacaggagatactgtgagagagagagacagacagacagacagacagacacacacacacacacacacacacacagacacacacacacacacacacacacacacacacacacacacacacacacacacgcaaagaaatactagtcttgccatgcagaagtaatagtgataattaacttatcttagattctttgcacagaatagagcaactaacatgactaacatcatttactttctgtgtagtgctttcacattcttgatcacatttgctcatcagtagagctaactgatatacttgtgtgatattgatatatttttttaaaggtttatgtatgta

SEQ ID NO: 23127 - DNA, 1152 bp, Mus musculus
aaggaaaggaaaggaaaggaaaggaaaggaaaggaaaggaaaggaaaggaaaggaaaggaaaggaaaggaaaaaagaaaagaaagagcttacatagtctgtcatgatttggtaaacctgaagagcctgatcttgaaaaaacttacaaggatgggacaagtgtattatgagggtatataattttggtactattattaaataaagcttaattctgtaccctaaaaaataaattggtataaaaatatggccaggttaaaaatagacagaggaaaaagtgaagattaagaagactgacaaaggagagtaacattaataactaataaatatgttttgtggtatgtctaaaaattccactaaatcttgtgcttagcaacatttggacaatgttttcactttttcctagctcttaaaatatgctcagggaaaagaataatagtttaaaactacagcttaattccatataaagaacttttagtgtttggattttagcttctggcaaaatgacagataactaattgaaattattattttttagatggtttgtcttctgctgaccctagctcagactggaatgcaccagcagaggagtgggggaactgggtagatgaagatagagcttcacttctgaagtcccaggaaccaatttctaatgatcaaaaggtaaatacttgttaaagagactgaggagaattctagggcacagaggcaggcactattgagtctcagaaaggaggtggtattgaacactataagaaacagagtggttagacctaaagattgtctgtgtgcttttcattacaaagtttggaatcagggttgagggtgtagctctgtggaagagcatgtgctgagcatgtacaaggccctgagttcagtcctcagtatcaaaaagattaagagaatcctggacttaaagccatatttcataaagttaagaagttaagagattattattagggtttggagaggtggctcaagggttaagaatactggctactcttaggactggatttgattcccaacacccacatggtggcctacaaccgtctgtaattccagtcccaagttatccaacacctcagatagagcaatgctgcacaagcaggtaaaatacccatccatacacataaaataaataattttctttaaaaag

SEQ ID NO: 23128 - DNA, 1148 bp, Mus musculus
taactggatagcccactatggagtgtgtgcctttattcattctgccaggtagcccaagttagtagagattacttttttttaaaagcttcccccttgaaattagattttcataatattaacttgtgtatgtttgttgactgtcctggcactcaatctgtagaccaggctggcctaggactcacagagatcccctacctgtgcctctggagtattggggttaaaggcatctaccaccaccaccaccaggcagtgcttatcattttatctcaagctatattcatagatgctatagatgatgttttgtttagttgtgtctctagagggcagaaataaattacactgctacatataaactaatcagaagccattttaattttgcttgctgctagtctctggatatggctttactatttcatattatatgaaatttacaaaattctgagacaattttattccaaaatagcctgtcaagactcttcctcctgctatctctgccgagccatctattaccttatcaaaaggtgactctgacaacagctcttcccaagtgccaccgatgttacaagacacagacaagcccaagtcaaatgctaagcaaaacagtgtgcctccctcacagagtaagtgctttgtttgtcttgcatctttttcttacatcctgtaagaatttagcagtctggtgcgatagtagagcagcactgctgtctaaaaatgtgtggtcccttgaaagttcacaggcttgagttgtgaggaccaggctgctaaactgatgtaagcaggggcgtgcctacttgcttggctatttgccctttaaatctgcacatgtctctgggacttctgggaccttgtgtttcgtgttactccttttccctccttcagcagctgtctatcccaaggagccagcttaagcaacataaggctgtcccctctcaaaaagaggcaggagggaagaaaagaaaaagaaaaagcagattctgtaggttgccatcagttcagtgtcagcagttacaattaataccctgggctgtaaaagaagggaggcagagaatagctaacttgaaaatatccaagactggaagacttattaaacaataaaatgttaacattagtagagttttttcatcagtgttactttttgggttttgggg

SEQ ID NO: 23129 - DNA, 3052 bp, Mus musculus
ctggccttgaactaatctacctgcctcccgagtgtggggactaaaggcatgcaccaccactacctggcaccatagttgttacttttatattgttgatatatactggttatcctccttacattttttttctctcctcaccttctccttccctttttttcccatttagccaagtctgaaactaactgggaatctccaaaacaaataaaaaagaagaaaaaggccagacgggaaacgtgaatttttttttcctgaattggacatgtgtttacaaacactgtcttgaagattatgctgtttatgcaataatttgtgaacatgtacagagttttatataaatttaaaccaatttttaaaacaaaactgaacacaaccaccataaaatggaatcaaaggaaagttaatttatgaaataaagaggtcaacagaatacacagtgctggaagacacttgggagagtcttttcaattgaacgagaatgatcgtaatttaagactattatcctggttttacaacagttacctgtttacaacagactgtgccctgtctcctctgcagctgaggaataatgaatggattctgattagagagaaggctgccgtgaggccagtaggcaagtccttggatcttatgcacgaccttagaccatttgaatctgttttatgcttaaatcaaagtgctttgatcaaatgtataatctgccatatctttacatatttgttgtagcagtttgtattaaaagaatcacaagtgcaaattaaaaggtcatttatcatttatttaactaaactgtcttggtttagtttacagttctttaaaagttctaaattaaaacattaaaaaatgcaattgacagacacttgtatgacttacaaagttatttttgatagtcttaacattacttgaattattcaaaataacagtatattttaaattaagaaaggtaaatatattatttgtttgatacattaagactgagactaacaatgctcttgtttatgatttgaaaagttttcaggcaaatccaacttagtgtttttcctttccctagcaattttccagtgtcaactcttagttgctagtaatttttttaccttaaaaatgaagtaattcgcaacttttgagcatatgacggagaatgcaaaagtagtcagacagctttaattgatattgtggagacctccggttatcaggaatacatttttttactgccttaacctcctgtagtgagtagaatatgcatcagtttcttgaaggggattcgtgtttttataagaattttcatgtaactattgcaattgtggttaaaaacagaaaggaacattttctgcttgaaactgtgttgatttgaatgacgtatgatctgtcaccattttcaggcactgtgtgatccctaggaaagtggcaggcctctctgtaactgttaatagtgcatgctcggccatgtacactgtaaatagcctttaccaaacgtgtttgacaaggaccataattaacatcactttagtaaattgtgatttttttaaaaaaagccatgatttattgatgtgagtggcttgttttcatgtggcgccagaaatgaacctgtttaaaagctataaccaatggtactgatctatccattaaatactgtccttaaactgtagtttaatagtattgtcaactaggaaagctaaaatggtttttgttctgttgaagactggccttattaatggacagctttcctcagaagtgattaacaacttttttattgggtgttaacatctgtttcaagaacatggcagtatgtttacatgtcgtcagaagttttctttgaatggaatttctaaattaatttacttgtttaaataaattcagaactgggtagcattgtttttatttgcttcactattgaggtgaataagagctgatgtgccacaaatggagccttcagatggctgctttgagcttcgtgttccctcaggggatgccaagatatgtctcaaggagagattaatgaggggtttgtaattacagagtgtgccaaggtcagtgctcacaagtttaattgaactctctcaactctacctcactgttccttttccttataattctctgggctaggtcaaatcagaaactttatttttcggttcagtatctcccgattcaatcacttgtaggaggtggtaactacacttagcagtaagaatatcacctttttgaagagatgtgtattatgggagtggaagcacagcgatacactgggtaggtcagtgtggaagtcgcctctgtgccttccttctcgctggcttgtgagccaggcccccctcccccccaacccccacgccggtagaaggaggcaggtatatgagtcaaaatccagttctcttaaaatcgttgctctttacctctctatagatctttgtgtggcagggcagtgatttttttttttttttttttgtcactgaacagaggaactggcttctgtcatcaactcagaaaactctgatgccacctgtttccctgaaataggctctctgaaaagcctttctgttgtggagcagggcgtggccatgtcagagttctccaactgcattatacctataccctaaattgagaaacaaacagttgagagagtccaaaaataaaagttgaaatatcattgatgtaattaccatgtttcatttgtgcatgcattttattggggatgggaggttggaataatttatccaaatctaatggtattatttcataggctaatccagtttgtatttgagttaaagatcccagagtgtagtaattaattgcagcgtttggtttttcttaattaaaagtagtcctctattaatatagtgtgaaatatcaaaatttaggatttaagtttaaggtctaatggctattttaaagtttttctgtaaattctttgcacaaactagaattggaattgctttcaaaagacttggggaatgaaaatatgtcatgtgtaagatgcactgagtgttgtaaataaaacagaccatttttgttttgtttaaattgttacattctctgtgggaagggactttgtccttttgtt

SEQ ID NO: 23130 - DNA, 1102 bp, Mus musculus
gcacctccaaacatatttcttctctgtttttataaaacacaacaaaggtaaacaaaggggcttctctagacctcaggttaggatggtggtcccaccccacaactccaaaaagcagaagaacaagatggcagcagctttacctataccagaggaggctcttcttccttacaaaggaaaaacaggactgagatgttctccaccttcttaccaaacacagaaataagacagactacccaaagagtaagagaaacaaaacagagaccttacaaaggaccacataggaggcaaactcatctattactctctgttagtatacagattccactgatctaccctcagggacctatgtcctctgtgtcctctaccaggtatctgaagccagcttagagaaccctgccacccgagccccctctctgttccagcatttgttttctctccttgtctcattgtctttgtgtgtatgcctctccctagcgctctctctcactctctctctctctctctctctctctctctctctctctctctctctctctctcttccccgcccttttctctgtcctcatggctctgcctttctgcatgcccacccctgctcctctgtcccttccccagtaagcctcttttataccagggatgtcataacttctcaaggacacaccttggcctgggtctccaaaggtacctccttgccccattaaatttcataacatcctgggatggagagctgttcctttagtcctagagatctgcaaactctagtaaattagattccccaggcagtcctgatatagagtggttaggaactgaactctaccatgatagttagtattctctccaggaaaggagtacataggctaaggacagacttcatgtcagtgacagttctattccactgtactgatacagtggtgcgctggtttcatattgcataagttcaccaggggtgaaatctggcatccaatttcagggcacagataagatgctatctccagaaaggccgagggctctcattagtaggaaggctaattgtgacctgagtatggggatcccgcccataaacactgtgctgggaacaaatatggcttgcagcaagagcccca

SEQ ID NO: 23131 - DNA, 1099 bp, Mus musculus
acatcccaagctcaggctgatgatggtgtgtacatgctcggcccaggaagtggcattattagagggtgtggccctgttggagtaggcggatctctgtgggtgtgggcttcaagaccacatccaagctgcctggaaatgagttttctgctagcagccttccttcagatgaagatgtagaacttaggatccccaggctctgctggccttcgagctgctgcaatgttcttccaatgaaagcagagtcccagacccactcctgactcatggatctctagtaaaatagtgaaatgtggatttttgtcatcaactcccttagggcttcacttccggtaacaaactccagtactacaattttgtagcttctgaagggagataagaaaatccctctgtgggaaatgggttttgatcacgaggctataaaaaagagcagtgctgtccgctgtcttttcagtcaggcgctgagtgggttttcagatcatgtctggtggctccaaggattacaacagagaacatggcggcccagaaggaatggaccccaatggtgtcatcgagggcaactggaatgaaattgttgataactttgatgatatgaatttaaaggagtcccttcttcaaggcatctgtgcttatggttttgagaagccttcagctattcaatagaaagctattatccctgtattaaaggatatgatgtgattgctcgagctcagtcaggtactggcaagtcagccacatttgccatttccatcctgaacagttggagattgagttcaaggagacccaagcactagcattggcccccaccagagaactggctcaacagatccaaaaggtaattttggctcttggagattatatgggagcaacttgtcaatgcttgcattggaggaacaaatgctcaaaatgaaatgcagaaggtgcaggctgaagcccctcatgatgttgctggtacttcagggagtgtttgatatgctaaatagaagatacctttctccaaaatggatcaaaatgtttgttttggatgaagcagatgaaatgttgagctgagggtttaagggttagatctgtgagattttccaaaaattaaatacaagcatac

SEQ ID NO: 23132 - DNA, 1791 bp, Mus musculus
gcccttgtgcctacacatgggagaaccgttcttattcccttattcctttacatataccctctggctatgcaggcacacgtagaccatgtcaggaaaacagaggtggcagaagtcatgccccagctaaggtttcaaagtctcatacaaaacgtgtccacttagtcctagaccggagtaccagttctcagaagactttaagtgtatgcatgttcagttaaagcctggcctcggacgcagggagtggatgcctgcttttaaacactgactctgggctctcctttccaggtgctgctgcctccgtacgatgatgctactgctgtgcctagcactgccaaggaaccaccaccaccttacgtgtccgcctgaacctggtgcggaagagctgagagcagcagtttgagcccttagctgcatgaattatcctgtggtttcacttccatgatgaactctctgagccacattttacaatttagatgttaagctgaagcctctgttgacacatgccctgtagctaagcactgactagcgaggctgtaggagtggagtgtggtgagttcccagagtctttctcaaaactacagacgttggtccccgggctggcttatacctgcctggccccagagctgggtgggcagtcatacttttcttctccattccctctgattgttttgaaagtataaaattaaaattagatgatacttaaatctttccagtatacgtaatacaaatagtattaattgctctaattagatagttaggagcccttccatatgtgatataagaattcccctactatccctgaattcaatgatactctgaatttgctggtcaaggattttctttgggccaaataaagacccccaaggtaataggcaacagtgagggcaacagctgccgggctgcctgttgttttgggctatggttgatgtgtctccctgtgtgaaaggggggccagcttgctctgcactgagagactcacactcccttttccttggttacctgcaccaacagagccaccatgtatgtttgggaaaaggtgttcacactcttttcttgcaaggtacaacctgctttgaatttctaagtatgcctaatcattcattaaaatgtcaagcagtcttcagaaagataaggaggtttgttcccatgtagaatactctagactgtctggattgtgaaagacgtttatgttcatgtctctgaatgtgagcaggtctcctgcttggtccttgctcaatgtgctgtacacaaaggctttgcaattaaagtttgtctgcatccaagaaaacagtcgtggctccgctgactgcctggtgactctccctgtcctcagtgctacacagatacacacagctcagcccatttcacacacacatgttctaatacttaaatgctgatgaatttttttggaccaaccacaccctgtgccgagtcactcacctgtccttgtacagtgctcagcagtgctgtatgtgatcatgccatctccatggtacccacacccgcccacttttttcttccctaagagatgggttcttgctttatcctctaatgttgggattataggtatgttccaccacattgggtcacaaaacatgctctttgatttttggctttttgaggcagggtttctctgtgtagccttgtctgtcctagaactttgtagaccaggctggcctcaaaactcggagatctgcctgcctctgcctctgcctctgcctcctgttaattgtcaacttgataggctttagagtcccctggacagtgaggccagtgggcatgatgaggaag

SEQ ID NO: 23133 - DNA, 1250 bp, Mus musculus
gacatgggtttgattatccactgctagtctttgtgatgtgggaccactttgtcagcctttctgaggtcagtgccttgttttacgaccagggctgctgtgggaatcaaatgagctaatatataagtgtgcctagcatggtagcctgacttgttgtagaggcttagtgaattctctctcatccttgctttctgtgaagagattaatggtaaaaatacatgttgccagtagttgcatgtgttattgaaccttgacttgcattaaaggatcgagacagtgacttttgttttctttacagggaagtcgagttgaaatcgaagcaatcgctgtccaggggcctttcatcaaggcatgactataagtagccatgctgatgttgactccggaggttttagaatgtctttcacactttaatttttacaaatgatgctgggaagtataaaaatgaccagagtggttgaagttattgtggaagtgatcaaatatgtggagatttgacattaattggagattattcagtatagtgactgatgttctaatttcacttatgttgctgggtgtgagagaagaggtgcacagctactgagatgggaagcagaaggaaagatgggctgttgtacatgagaaatagtaaggagcacatctacttaaatcatattaatttgctcatgtgaaatacttagttcttatgttagatataagaaactaaattgaaatattcaaacttgaatagtaccaggagaacaagtggaccaaaatcttatacagataatattactttaattgaaataaaaaatagatgtgtaactttcccttggtttttaattttgttctcttattttttttaacagtttaattatacattaaaactactacctaatagccaggcagtggtggcgcatgcctttaatcccagcacttgggagacagaggcaggcgaatttctgagtttcaggccagcctggtctacagagtgagttccaggacagccagggctacacagagaaaccctgtctcaaaaaacaaaaaacaaaacaaaacaaaaacaaaacaaaacaaaatactacaatctagtaaagggtgagtagaaattcttaagttatgggctagagagatggctcagaggttaatagaggttaatagcactgactgctcttccagaggtcttcaattcccaggagccacatggtggctgtcaaccatctataataggatcttatgccctcttctggcatgttaggtgtacatgcaga

SEQ ID NO: 23134 - DNA, 1192 bp, Mus musculus
ttggttttttgagacagggtttctctgtatagccctggctgtcctggaactcactctgtagaccaggctggcctcgaactcagaaatccacctgcctctgcctcccaagtgctgggattaaaggcatgtgccaccaccgcccggcaaaggttgtgttttaatgctctaaaaaacaacaccggttcctttctttagtcttggtttcatcaggttactcataaaaattatacactgggattttgttttttgttttgctttgtttgttttggagggggtgttgttttgttttgttggttttttgagacagggtttctctgagtagctttggatgtcctggaactcactctatagacctggctggcctctaactcttagagatctacctgcctctgcctactgagtgctgaaattaaggcatgcaccactgcccagatatacactgtttttctaagtcttgttttgagtttgataaaacggctaaaactaaagaagaaaaaaattattttatttatatgtgtatatatatatatatatatatatatatatgtgtgtgtgtgtgtgtgtatatatatatttgtatgtatctgtcttctagtggtgaaaacaactgttttactggctgacatgaatgactttggcactgtcaatgagatctataaaacatgtaagtgatttgaccttattctcactcacttttaaagggaaataagtctgctgatataaatgtatcattgtcaagtaaaagtgagatgtgaaaatggcattttgtcctgacacaatccattatctggttggaaacacagtagtagcatgcccttgtgagaaagatctctatttctattgcagttcttaaaaatataatgtgcataagctctgcatattcattttcctagaacctaactttattgtttgtttctctggctttgtaagcctcccctaaatctttttagacatacagacttattgctatgatatggtctagctaccttcttgtggctctctgcaaatcaccgggaacttactgaacatttccatactagttcttagtccgtaaagtgaggacaggattctgccaccttcgggcgttgtcagaatgattacattaattatcctgtacagcacttagaacagatactggcaaggtctaagctccgagcaaatgctcctgttgctgtcattgccgtagcagggg

SEQ ID NO: 23135 - DNA, 1209 bp, Mus musculus
atatatttacagtagccaactaatattgtattcattcatattaagtataaaaattgtatatataaaattttactttgctttagtatgtcagaaaaaccacttccttttctatacttaatacattttgaaaactatatagatatttttattaaaaagtttgttttgagcataaaaatagaaataagttctttcagtgctgaacacaggtttaaatttagtcatttaaatacatgataattataagtcacattaagaacagtagtataagtaaggagctagtaagtattataagaggtccaggtcaggaaaacacagcttgtttgaagggttgaaaagcttcaggattgatcttgaaggttgggtctttttttgtaaagagaaaggaacatatcattaactctccaggttctcttttttgcattgtttttgtaagtgtagttttcgttagtcagaattaaatacagcatttatgcattcactttttaatgtctgcttggagtttaaaatgttagtataaaattgacttcttctaggtccaacaagtcaacaagactttccttcagggaaaaatgaggatttgggaatagtccaagaaaagtctaccaagagtcttgttatcgggcctctagattgccgtctggacagcagtgcggtgcatcgggttttgaagatgattgtttgtgctctggaacatgaatatgaaccatatagcaggctaaaaccaggtttgtctttgacctaaatcttttttttaatacttaatatatttttatttttaaaaagcaaaagattatgatttgtacattatacagtgccacataatacagagtattacataaagtattatgtggcacccgtcaaatacacatcattttatttcatcaattgaaatgttatttaaacctgtctgatatttttttttataagatattttctacatttacatttcaaatgctatcctgaaagtcccctataccttacccctgccctgttccccaacctacccactcctgcttcctggcccgacatacccctgtactggtgcatatgatctttgcaagaccaagggcctctcctcccatgatggcctactaggccatcctctactacatatgcaactagagacacagctctggggggggggtaatggttagtttatattgtttttcctcctatagggttgcagacctcttcagctccttggatact

SEQ ID NO: 23136 - DNA, 1127 bp, Mus musculus
acagtaaagtaatctttgtggaagaatccccttattaccattccttccattatccccactcatatttaatgagttcatacttgacctctttcacaagatgaagtccactgtctacttttattgtttttgatttaaaaggaaaagtgatttgaatgatatttaaaaataattgtatatttaattttaagagcagtgattgtttctgggctctttttttctttagagttgaatttttatctgatacaattttatttttggcctacaccatttctctcataatctctcaagggtaatcttcagtagataaattacttctgtcacttcagcgtttttgtcttatctggttattgcataggaatagtcatttataactatattctttctaaaaagaggaatattgccctttttcttaaagtgcctgcttcagcaacattttactttcatacagcagtacatgcaggcttgaaattcggtgcatcctaacagtatttattacttgtctctcctcttacagcttgttatttttgtataatgattattgtataataatttcaaactattttattttaggtgctgtatttctttgtagtgtacaaggactcgctgttaacattgacccaatactgtatacttgggtcatctaccaaccacagaaacgagcaaatagacatgcacaacaggtgagtggtctgtcagttatgttaacacatccaccctttccttagctgggaagatttcaatgctgccactggtactaaagctaggactacatgctgcagtcattaatgactcacataagaagatgctattattactgatctattgtgaagttagatgatgctgttcttatggactggggttggatgagactgtcctaactggttttctctttattttatttatgtgctagttctttaggccccattatgcctttcaaacaagatctgtaattttatgtatacgaaactttagttcaacacagtttgtctgttgaagtaaccttgtgcatatttacatgcttgtaaggctgaaagattagcaacactttttttttttttattcttacacatctttggatttatcgaataaacctgctttgaactttaaccctggtaatttgataggta

SEQ ID NO: 23137 - DNA, 1191 bp, Mus musculus
tggtacccgcagaggccagaggcatcacatctcttggagctggactttcagtctcttgtaatcttcctgatgtgactgaactcatgacctctggaagaacagcaggtgctatccagtgagctttctctccagtctcttgaaactatctttaaccaagaaagtgctttgacattttatgttagcaacaaatttatttccccctcttaaatttgcccttcaaatatgaagatttccccaattgaatgattccttttttaaattttatttatttatttattcattcatttatttatttatttatttattttagtgaaatcttcacagttaatacagaaatctgtacaggaatgtgtacaagagacagacagaaacaaggcaaagtcagtggtgttgttcacttattctgatggagaaaaagaatgctatcccgaagaagtcacttgtgcccagttcttccatttacccactttaaaagccagggcaacctacttgatagtggtgaatgatcttttgatctgttctcggatttggttggcaagagttttattgagtatttttgcatcaatattcataagggaaattggtctgaagttctcttgctttgttgggtctttgcgtggttttggtatcagaatgattgtgccttcatagaatgaattgggtagtgttcctttgtagaatagtttgaagaatattggtattaggtcttctttgaaggtctgttagaattctgcagtaaacccatcttgtcctgggctttttttggttgggagacttttgatgacagcttctatttttttaggggttatgggactgtttagatggtttatctgatcctgatttaactttggtatttgatatctgactagaaaattgtccatttcattcaggttttccagttttcttgagtataggcttaataaataggatttgatgatttttttttaatttcctcagtttctgttgttatatctcccatttcatttgtgattttgttaatttggatactgtccctatgccctctagtcaatgtggctaagggtttatctatcttgttgattttctcaaagaaccttgttttgtcgatctttgtatagctgtttttgtttctacttggctgatatcaatcctgagtttgattatttcctgccatctactcctcttgggtgtatttgcttccttttcttttag

SEQ ID NO: 23138 - DNA, 1175 bp, Mus musculus
gctcagtattctattcataagtgttctattagtttcaaagtaattataaatagaattgttttatttttactttagtgtattacaattttatgccctataactttgtaaaactcattctaacctttctgtttctgtgtgtattattagaattttctacattataaaatattacctacagattttacttcctttgggtgtattttctttttctcaactgatttttctgattaggactttaatactatgttggcaagaattggcattttttttttttttttttttttttttttttttttttttgctgattctaaaggaaaagctttcagtttttcatcaagtgcaggttagtaatagattcatccgcagttgactatattgagatgtagtttttacattttagaaagtttacagtctagtaggactagactttatggatggtagtaataaagattgtttatcattcacaaagctattgtgtttctctccatagaattctttggattgcgctccaaagaagttcattgctgacctgcgctcctgaactatgaaacatgaatatgtgtgggctaaggaatagtttctttcaataaacagtaattatatggacagtaagtctttgcttggttattaatgataattcagagcctttaatacctgacgcctaatgttcttataattctagataaatattataaagacaactcctataattatctggtcctggctttggtgtcctggagtacctatgagcatctgtacttctggtcttgatgttccaatcctatcattaaaatcagcctttgcaggaggcagaggtagatatgttactgaaccttgagctggaggccagtagagtgagtttcagggcagcctggaatacatggttagatgccaactcattatttttggttgtgagcttagcctttaatggctgagctatcactccagcccaagagatgccattctataaaaatctgtccttagatttcactgccagtctttggtattgctgttgtcaccagaaagaaagttaattgacgtactattagaaaaattatttttattaatgagccaacaatatgtataatgaatgtgaatatgtgtctaatccagaaaaacacttaactagtattgaggaatgtctgatagtcacttaaagtctgaatgtagatttt

SEQ ID NO: 23139 - DNA, 1143 bp, Mus musculus
cagcagtgtggatgacagtggtgctacccgaggccacacaggcggggcgtccagtggcttgcccgaaggtaaatccagtgctaccaagtggtccaaggaagcaacaggaggaaaaaagtcaaaaagtggtaaactgaggaaaaagggtaacatgaagatcaatgagaccagagaggacatggatgcacagttgttagagcaacaaagcacgaactcaagtgagtttgaggcgccatccctcagtgacagcatgccgtctgtagcagattcccactccagtcatttttctgaatttagctgctcagacttagaaagcatgagaacgtcctgtagtcacggctccagtgattgccacgcccgcttcacagctgtgaacacccttcctgaggtagaaaacgaccgactggagaactcaccacaccagtgcagcagcgctctgctttccaaagctgcttcctgttcagatgtcccacagcccagccatgctgcagacgagcatggcaccagcagaagtggggggaagcctatggtggatttgtgttttggtgatgcactgagagagacaaataataaccactcgcaccagacagcagacctgaaagttgctgtccagactgaaatttaggcccgtgaatgctgcagagtaagaaccactgaacaaccgtgttgggagctggttgaaccatgtgcgactgttaagcttaagttaccagcaaaagccaggtttcataatcgtaatgcaaatacattttgtatgtctagcaaagcattgtgtttcatgttgatattaattaccaaattatgaattgaaggctttaaagtgcgttagtacaagatagtaacataagaaaaaggcatgttttgtgttcttgtcacaaaacactgcttgatgcacatacctgtgtatttagatagaaatttgacttaatttataaccgtatgatactaacactgttctacggcattcttaaggaagatggaggcttagggatgagtggttagtgacattttattgaaaccactaagggatggaacgtggcagattactcagtacatgatcctcttggtaacatttctcttcataactgagctgaaatttcatttcttcatatgcaatgtggatatcaagcttaatgcagccca

SEQ ID NO: 23140 - DNA, 4729 bp, Mus musculus
acactgcctggaattgctgaggtgacgtgtgttcagatggagacaatcctgggcatctcctcctcttaacagatttgtcagtagaataagaagtagtcttgtcctttgaatgcagtttaaatcatttaatgatgtgcctgtgtggttgtcttgatttaaggaggactgtttcatgttggactttaattgtgcaattctattctcgttgctaccacagataatagatgtaatattacatgtctataccttgaatgctcttaagtattgattgtaaggaactaactcagttaatacaggatggttctagcattaacaagattatttggttcaatgactgagtataagagacagttcttggttattctatcatttccctaactttcttttttctttataggtaatgatggagggtgggcgcagcaaagggtttggttttgtatgtttctcatcccctgaagaagccactaaagcagttacagagatgaatggtagaattgtggccacgaagccactgtatgtagctttagctcagcgcaaagaagagcgccaggctcacctcactaaccagtatatgcagaggatggcaagtgtacgagctgtgcccaaccccgtgatcaacccctaccagccagcacctccttcaggttacttcatggcagctatcccacaggtgagtgtgaagaagaaactaagtcaggttggcttcataagctctccacgataaagcactaagttattcgattgggaagacaaatgacaagggtggtagagtcagttgttttgagagcatgtaatgatagttgtgttttgtggacttattttctttacccagactcagaaccgtgctgcatactatcctcctagccaaattgctcaactaagaccaagtcctcgctggactgctcagggtgccagacctcatcgtaagcctcatttagttgtgtctgggaattggagacttggggtgggagtgggggcatgtgtgtagctcagtgatataacaattaacttcccatgtgctaggctgtgggttcaattccccagtgctatcatatgaggcaaatttgtcctattgtagtgattaaattgctcctgataatttatagttgttagatttggctttttttgatttttagatgtgtagcttaggctggccctgaactagcaagcctcctaccttatctttgtgactgctaagatgggtattggactgattgtcatacccagctccaagtttaaaaacaaaggaaaaaaaatgccatcagtgggtatttgcttcaattcttaatttgccttggtagcaatagctttcattctacagggtaatgtgtggcattttggtccttggccatggtatataacaagctgggtttcaggagcacttggtgttactttttaatcctgcttttttttttttaaattttaatctcagatattaaattgaaactcactttctgtaagggtcttttggcttttcataaacccttggccctaggaaagcttaggctttgactcacttagtgaagttcctagttcatacagggtctttcttttgaatgcagcattccagaatatgcccggtgctatccgcccagctgctcctagaccaccatttagtacgatgagaccagcttcctcacaggttccacgagtcatgtcaacacagcgtgttggtgagtcttaaacctctctgtaaagattgatccccaatttaaaatggcacaattaaagtcatttttctctttagctaacacatcaacacagacaatgggtccacgtcctgcagctgctgctgctgcagccactcctgctgtccgcaccgttccccagtataaatatgctgcgggagtccgcaatccccagcaacatcttaatgcacagccacaagttaccatgcaacaggtacagtttaatcatttatttgcaagggtcataatgttcagctgaaatccaaggtctgatggtaactgcacaagctatgagcatagacttacctgggccatcttattaaggttctatgtgaagaaagttgacgggcagccagcagtctccctatgtggtgtcttgtttaggatgggtgtattagacttaatctttttcctagtcctggaaccaaaaactataaagaagactaaaatgtaattgcatctcaagcacagatgtgccacatggggttggttatctgtacttgctgacctttagtcagtatttctctcagcttctctagatcaaattcaggtagcactctgtccttcctatgactatccgttgagagatggctggtttatgtctcattacttcaatattaagagggttttctgttttatgtgtagcctgctgttcatgtgcaaggtcaagaacctttaactgcttccatgttggcatctgcgcccccgcaagagcagaagcaaatgttgggtaagtaactttgttgtcttggtctgtcagttagagttgacgaaaataacaaggaccacttagacactttgcacctaaaatgagatggcttaggatggtatgtgaaggaatactagaaaacatggtgggctactgtttgccattgacattccactctagccttgaaacaaagaagcattgtctatgttaataccaaacacttgaggaactgataccaccagagaagtgactgccttgtgacagattgtgctatacatacgggtgtggtagctagtacatactctatattaaataaggtaggttcctaaacccctggttgataatagccattgccactctgattagagtgtctgttgttctaggtgaacggctgtttcctcttatccaagccatgcacccttctcttgctggtaaaatcactggcatgctgttggagattgataactcagaattacttcacatgctcgagtctccagagtctctccgctcaaaggtattttgtgctttcagcctatgtccttcacaggtttattcttcagaacatgtaaatggagcccttatacaaatgagtatacaattaggctttatatgtaaatactgactacaaacctgtgataaacctgtagtgcttgttttctctattttgggtaacttgctcaaagcttactgctagtagattgcaaagcttgctcagatcagtttgttcagctcctgcagccggattcatgaatgctgctacttagggctcattttaaagtgtttgggtgagaattaatttccttgaaccattatgttttccaggttgatgaagctgtagctgtactacaagcccaccaagcgaaagaggctgcccagaaagcagtgaacagtgccactggtgttccaactgtctaagtgagttctccctcgcccgcttgttccagacataaggacattaggtcagctttccagaggggtatatacataacgaaatctttttcaccttaaatactgatcagcaattttaagtcaatacttggaaacagattttgcatagtaaattgtatgcaatgccctgtaacggaagttggctttcataatcggtactttttaaaaaattgggtgatggctttaagcagtttcttggacctctctctgtcccactaccaggaaactgttagtgcttggttgagtatatatagtaaggtcagtagtaaaaagatactagaatcctgttttttgtgggccatgttgtatgtgatgtgatagctgtgagtattaaaggagtgggtgtggctgtgccagtacaaacaggcagcagactgacccactgaattcaggcaggggctttaattatgtctttttttaacatttacagattgatcagggaccacgaacagaaactcgtgcttcaccgaagaaaaatatcttaaacatcgaaaaatttaaatattatgaaaaaaaacattgcaaaatataaaataaataaaaaaaggaaaggaaactttgaaccttatgtaccgagcaaatgccaggtctagcaaacagtgctagtcctagattacttgatttaaaacaacaaaaaaatacaaaaaaatagtaaaatataaaaacaaattaatgttttatagaccctgggaaaagaattttcagcaaagtacaaaaatttaaagcattcctttctttaattttgtaattctttactgtggaatagcttgggacatcagctctgttttaaggagcagaactgatgactgagcaaggaaacgtaatttggattataaaattcttgctttaataaaaattccttaaacagtagatggttatgcttttatttactttgattctctgggcaattggcagatgtagcggtagttgctgacttaatagtacagagctgaaagcagctaccaattctgtgaagcatacgcagtttgggggtggtgtggatttagacaatctctctgttgctggctagccttagccactcaagttttgggttcgttatgtatgtctcatcgttttcacaattctagtgtgttctcagctacccacattaatttattgagctcttctgtgtatagttagcttgtttttaacataccaacttaccattagtatggtttctgtgctacaaaataaattcacctggtttttttttttttttttttttttttttggtaagatgtgagtcacagtagctacccaatgtattgggaaaaatggcatagtaggcaccatgactaccctgtgctacttttaaccctaccagctttgaggtagttaagtaccgtctgtgcctcacccagaccacttggaaagtaaagatgga

SEQ ID NO: 23141 - DNA, 1748 bp, Mus musculus
cctcaaagcccaccaatcaactgaggaccaagtattgagatgtatgggggccatcattcaatcactcctagttctttctgtgcctgagcctgcttatggtctccacaaaaggggaaggcagaacttgtgttttaagaaacattctttcaggtattttatgcctgcagatctagccattctctgtacttactgttgaaaaacagaaggctttgaaggattattttgaacaagaaaaatcaagttaatgatgtaaagggacaactactgagctaagaataaaatcttccataagcttgaaagaaatcaaacagtatttagaagtgcatatggtagaccagtaaaaccttagggctgggagggctgggacttttgtgttacatgttaggacatgaaatgtgtacattaagtggactactgaattactctgaattactttttttagggcctgccttaagtgtgaaagtaatgacagatgaaagtggaaaatccaaaggatttggatttgtaagctttgaaaggcatgaagatgcgcagaaagtaagagacttaaatcattttttattctatcaaaggcgggtataaaacttgctctggtattgaaatttatatacattattgaaatgtgtatacatttatatgcggacattaatggaagctttccgtattgtaatcagttatttgcattctatgtattagagtgtgtacgccctttatagcctggagatttggggatgagtctgttgttaatgttagtaattggacaaatttttcttgttaatgagatatatgtatttcgcaagtaacggaagtgttttttgttgtccttttttttggtttctataaggctgtggatgagatgaatgggaaggagctcaatggaaaacagatttatgttggacgagctcagaaaaaagtggaacggcagacggaacttaagcgcaaatttgagcagatgaagcaagataggatcaccagatatcaggttcatatttactcgaacaagcacataagacagggatgaggaaacctgttttatgttcatttcagttacttccaggtaacaggttgggagggaagagaagagatgtgggctctacagtaacaggtgtgcttaggtagcacgatagtcttcctgcctctcttcatagttctcttcttttcagggtgtgaacctttatgtgaaaaatcttgatgacgggattgatgatgagcgtctccggaaggagttttctccgtttggtacaatcaccagtgcaaaagtaagtgtgcactatactttgagttgagattgtgtgagtaaatttttaagctagggagtttttgatccttaggttctgctctatcactaactgtgttcactgatacctgttgacttacatagttcattctgggtagtcagcctccccccaagtagaaaagatcctatttcaaaaaaaccttgggagtcagattgcaaagcaataggattctaacctaaattctaggattttggtttaagaacttaagctgtgggtgttttatccagtgtccatgatttgtggctaccttgccccttaattctgatttcccagacatgtccgtagacttacgtagacttagactttgttagaaacaaaatatttacaggtatattgggtaaatgcaaataagaaacataggcatgcttggcttgccctgtgttttagcgtgcagttttttctagatttagtatttctagtgtttttgaaggtctttcatttcagtgttgt

SEQ ID NO: 23142 - DNA, 1107 bp, Mus musculus
aaaaaaaaaaaaaaaaactaaatctcattatgttttctgtgcttttgaacagagaacaagaagccttcaagttgactttgattttttgtgtggggttacagaagtttgtattcttcttttggtgtttattatttatgtcatcttatttaataatgtggaagaattgagttttagtgttatgttgataatactgcaattagatcaagctcttgtattagtagagagaattgagaatttctgtttaaggaggtggtacaatgtaggaccattctgaaacagctatgaagaagcgcgtgtatgcagggctttttggcacagaacagttatttctcttgacaggagtgaaccctttaacccttggctaacttgatcaaatgtgcattgaaagaaaactcttccctttgtaattataaattgttttttaaaatttattcagtgaagacattttattttgtgatatattttgtaaaccatcagccttcatctgagctttatgaaacattttactaggtttgttggacgatttaaatctcggaaggaacgagaagcagagcttggagccagggcaaaggagttcaccaatgtttacatcaagaactttggagaagacatggatgatgagcgccttaaggaactctttggcaagtttggtaatgtgtcaaagttaaatctttatacttagagtaattgtctaaagttaatgactaatatttgactagtaagttttaacacttgatttgaattaggctatagttcactgcacaagagtaatatgcaagtggaatgctgtacagtgaccaacacgagccgtgggtggctgaggagatgtaaagggtttgccacattaagtaagatcctctgagtgcagacattagtgtgaggtaggtgggtgatgtcgggatcctggagtaaaagacgaggaaggcaggattatttgtaggtgacttcctccctttctgttgagcctaggaatggccttttttgtttgtttatctagttctgtattatatctaacatcataaagctgtgttgagctttgacaaagacaggacctcagagttgcagctctggcaggcacacaactcccaagagatgcctcctgagtcc

SEQ ID NO: 23143 - DNA, 1489 bp, Mus musculus
tcaataactacaattattatgagatttgaaatttgcttcaggtgttcaagtggactgtttcccccttgaaggtctcatctctttacttaatgatagtatttttttttcatttaagacaggtaatgggtacatggcagaggtggctggactccaggccagcctgggctgcatagagatcctgtatccaaaaaaagtttcagctttagcacttctttttatagtacactttttttttttaatacaagtattcaatcttttttggggccttgaaattataggctaggttttttgttgtgaagcataactatccaaaaataagtgggataaattgttcattacaatgattaagacttgactttaaagaggaagttgagctgaggccacatggctatccttttactccctgtcactggtaattttatacaaagtggctaatgaggtgttagaagtaatacttactctgaaaatgtgtctcttgtagcggaacgtgctttggacaccatgaattttgatgttataaagggcaagccagtacgcatcatgtggtctcagcgtgatccatcacttcgcaaaagtggagtaggcaacatattcattaaaaatttggacaaatccatcgacaataaagcactatatgatacgttttctgcgtttggtaacatcctttcatgtaaggtaagctgagctataacaggttagtatttgcagcgttgtgctacttttagatttggaagagatctttgtgctgtctgttaaatactgtcattatttctgaagttcctgggattgggtggctaacatttctacagagtaggaaagcaatagcaagtagtgaaaagtgagtgttctgtttcaccctaggtggtttgtgatgaaaatggctccaagggctatggatttgtacactttgaaacacaggaagcagctgaaagagctattgaaaaaatgaatgggatgcttctaaatgatcgtaaagtgtaagtatagctacgtctacagtggatatggtcagtctgcttttaatagttctctatcagtttaaaaacaagtaaatatgtgctcttaaaatacagcgaactggagctggacttagtagcatgcctttattaatcccagcaattgagaggtagaagtggaggcaggcagatctctgtaagatctttgaggcccaccttgtctacataggttagaacagccaggcctacatactgaaactgtctcaaaagaatgtaactggattagtatatgcctgtaatttcatcacttgagagatagaggcagaggatcaacctagctaggctacatgagaatatctcaaaaagatccatcaaactgtgtttacatacatatagcactgactcatatttgctgggtttcataatcattcatgatcagtaatgtcagttactcatcatagaaacccaaaatgaaccaggtaaaaactaaggaactagttcatcagcctatttcattcatgtttagggaaact

SEQ ID NO: 23144 - DNA, 1121 bp, Mus musculus
gggctcggaacacacatttattattaaaaaatccaaaaaaaatctaaaaaatcctttgaaaaaacccaaaaaaaatttacaaaaaaatccgcgtctcccccgccggagacttttattttttttcttcctcttttataaaataacccggtgaagcagccgagaccgacccgcccgcccgcggccccgcagctccaagcaggaacccagagaccgaggccttcctgccgcccggacccagcaccgccagcctcgctcccccggttccacggccgttgagtacgcgtcgattccggttgaattttgtccctctgcgctcgcccccgctcccctccccccggctccgtcccccggccccgcactcgctctcctcctctcacgggaaaggtcgcggcctgcggccccgcgggcagccgtgccgagatgaaccccagcgcccccagctaccccatggcctctctgtacgtgggggacctgcaccccgacgtgaccgaggcgatgctctacgagaagttcagcccggccgggcccatcctctccatccgggtctgcagggacatgatcacccgccgctccttgggctacgcgtacgtgaacttccagcagccggcggacggtgagcggcaggccggagggtggcgggcgggcggccatgcggccggggcggcgggcctagcggggcgggcgagggggcgggagggcacggcgccgcagcccctcgcgggccggcacttcctcctctgcgaccattttctcgccatcggtcgctctcaaactttagggcgatgacgcgcccggagggtggttgagatagccttcaccgcgctcccgccacaagctgtgggattcgggggtttcgagtaccctcctggagcggcgggtggaggtacccctccatcccctgccctggcccggcagtcaggccggggaggaagtacgattcagtgttgggaaataccacgtgttgaaccctgtaacctcacaggcccgaggcctgttcctgccggtggctcaatcgctgggaggagccctaggctttagaagaaagttaaatagggtgatgcctggtggtggtggtccttagggtcgtaagctcgttcctaatagcacatctctgacctgtg

SEQ ID NO: 23145 - DNA, 2554 bp, Mus musculus
tgtggacatcggatacccaaggagatgaagcagaagcaggagaaggaggggaaaattaaccggccttccaacctttgtctgcctcattctaaaatttacacagtagaccatttgtcatccatgctgtcccacagatagtttttttgtttacgatttatgacaggtttatgttacttctatttgaatttctatatttcccatgtggtttttatgttttaatattaggggagtagagccagttaactttagggagttactcattttcatcttgaggtggccaatatgggatgtggaatttttacatgagttacacatgtttggcatagtacttttggtacattgtggcttcagaagggccagtgttaaaactgcttccatgtctaagcaaagaaaactgcctacatattggtgtgtgctggcggggaataatcaggataatgggttccagtcatgagtgtagtctttgtgggtactgtaaggcctggagcacttgtgaggctgtgacacaaacaccctgtggatgcacgctaggatcgtgtgtgtctgcgtgcacactcttgaccacagctccagaagttgtctctagacaaagtcgtgacccaatttactctggtaagggcagaaacggttcacattccattatttgtaaagttacctgctgtttgctttcattatttttgctacacattttatttgtatttaaatgttttaggcaatctaagaacaaatgtaaaagtaaagatgcagtaaaaacgagttgcttggtgtgcccggctccatacgtatcaagcacagcggtaaacaaaatcccatgtatttaactttttctttctttttttttttttttaaagttttttgttttgttttgtttttgcttttgtgattttttttttttctttttgatacttgcctaacatgcatgtgctgtaaaaatagttaacagggaaataacttgagatgacggctagctttgttttaatgtcttaagaaattttcatgaacaatccaagcataattgttaagaacacatgtattaaagttcatgtaagtggaataaaagttttatgaatggacttttcaactacttttctctacagcttttcatgtaaattagtcttttggttttgagacttctccaaaggaaattgtctccttattccctcttggcagctaatgggcttttaccaattttgaatgcagagtttatcataaaaaaaaaaaaaccgctaatgtagcttccatcctcagccacctcccacattttccccttactcctcaacaattgaagtggacttttatggggtggggggtgattggcaaaaggtaatgtgttccatttataattttggtctatggagttttctaacttaggaagccacaatgttcttggcccatgtgactgacactgggcagcattaactgttaagttctgtgcttccaagtcgctgttggttttaagaatttcctgatgctcttacagtctgcctgggattctattcctctatttccatgttgggcacaggctcacttcccttttactgtcttgtcaccaaccattccaacttggtggccatgtatttgggaaaagggccgcatgatctttctggctccactcagtgtctaagatacccgcttcccctgcttgcctcccacagcctcccctcatcctctctacagcccagctcgcctcagttgagcttgtgtttatctccctggaagtcctgccctaaatggtctgtcaccgtctccctttaaaatccttcctcctcctcttcctcctcctcctcctcctcacataatgatggggctaagtcacacccaaagctcacaccctaccgagtatttcctcagtactttacagaaaacaccaaacaaaaatgccattttacaagaggtgtatttttttttcttttagaatgtaagctcgtctagagcagggacaatgttttctgtatgttctattgtgcctagtacactgtaaatgctcaataaatattgatgatgggaggcatgagtctcagtggtgagggaggggagagaaatcccaagcatgttttctggcttgcttcatgatgatctgaatctgaaatcccactccttttggacagattatcacaactactgcattcaggtggggtggggtggggtggggtgggggtgttttctggagaaacgacatcacacacgtggtgccatgacccatcttcctttacaactcaattccttgattttgcctcagctcccagactgaggaagattaagcaatggacagcaggatgtcatctcatttgagtaaattacaaatgatacctggaacctgtcacatttgcctaattggcttattcacatgcattagacattgctaaactagtttgattttagttattgatgtggtttttttttttttttatgaatagtgcccagtagatggagaaagatttgcaacctcaaattttccaccccctggaatttgaataataaatttgtttttaacttacttccctaattgtcccaaatcaaggcttcacgtctgttttgttaatacaacaaatac

SEQ ID NO: 23146 - DNA, 2754 bp, Mus musculus
gcaactatagccaaaaataggggggaggggatgagtgaatgctggacagctctgagcagagcatgaaagacttgtcagctgtaagaaaaccatcatttcaagggcacaagggtcttctccctgaaagtcagcaacttagtgactgtgttcttaacgttcctatttacagtgctaggcagagcttttttctgtattaaaatatagagcaaaatacaggcatgctcaataggaactcctttgaagttatttttaatttcatgtatagatggatttcttgccctcctaagtagtgtagtacatatgcatgtgtgtttgagacttccttccttccttccttccttccttccttcctgcagagactgacatgttgatagtctttcatgttaggtatttgagatgcttgtcagtcgttacagttactgaagctttttcttatgtcttacaggtgacttcacggcacctttgactctactgtctcagaccttaggtaacaaacctgcggctgcttttttaaacaaactgttggtcagcaaacaataaaggggctacagaaacactcgtttttacgctgttccctttgggcttcatgcaaagacaactctgtgtaaatgtacagttgactctgatgtggaaatctgaaaaatcagtccattcttgttataaatttttttacaattgtaattatattgatgttcatattgtgtaaaataactcatttaataaagtagtgctttgattttacaacaccgcaggataaatggttctagaaattctgttctaactttccttattatttgccttataacaatgaattgatcagctagtgttgcaagagcagttctctccctttctcagctcagtggcaggtttgttaaaccagagcagactcattcattaaatcgtgcacttgattctattggcagctgatgcgggttaaagaatggctgatctgcttccgtgtattcacagctacacaccattccccacttctgatcatttcctgtgtgtccatctgggagtcattgtagatgacagattcaattcatacaattggtagagttgccagtgagcccttctggacaatgtgtgaaggaacaaatgtgacctataaaggcctgtgtctttgcaaattgttcaaattcatttgaaattgaactataatttttgaaagatttttgaaagttatctagctaattttatgagtgaatttttacatttaacaagaagaatagaatgatttgtttcagattaattcgcagaacattctttgtctttcaaataaaactctaattttagagccttagtgctggctcctgaaatcaaaggctgtctagtctgacttccacctgaacgagcagaacattgtagggtaaggtaaagtctgccagtgaaggaagactaactagttctgctggtgtaggttacaagcaagtctgccggaactcagcttaagtttagacggtgatgtaatgggaagaacattccgtactgacagctgcttagagctatggccctgacctgtggataacaaacggatccctcgtgatgtagcctgggcagttagtggacagcttagcatactctgaccacctggctcgtgcagctgtgtttgaaggaaggtgattcaagggccagtctagtgcttgtagtctgcacaacagccctgtccccaacctccctcgcagaagtacagtccctctatttaattccctgcctctcacacttggtatccactcttgctacaatgttgctgactagagttagttacaatgttgctgactagagttttcttgtggatcttacattctagttaagtggcaattttagagcttctgaaagtgctttatgcagatgtacggtttcttttagtgacaaactggttattcagagcctgatcgcaatttttgatttaaatcttcttgtttgtttcactgttgtaattcagaatagaacattttcagtcttgtacttaactgttttctgagcagctgaagacaccgtatttcactctgtatctcagtgatagggagtaggtgatggctcttcattctgagcgtggggattgccagcacggtcctaccctgtgctgcagttaaacctgctgtgaggaggaaacgacaactcgagcatctgtaatttagtgtgcagagtctcctaacagacgagtttgtttaaaaactgtttgctgtcttcaaaggtgatataaaatagcaggaggggactgatctgtttgtactctgtatgttagttgtcaaaaggaatggggttcacattaaacttgtttccattctcatccccatgtttagctgacacacttgagccctcacgtgtgctgtaatgtcttattaaagaagatgttaaaacgaaactagtctaatttcttgtaccgtttaagaggtttttacatcgcctctcccccctcctccccctctgatagtttggtaatccaaagtctgacaagtaaagtcttgtagttcttttattggccattggtttccctatatatagctgtctgtaagatactgcctaagagtaaacaaagtgtcattcagaaatcttgctgtgtgtagtgtacagtgtactagaaggaaaaaaaatgatgttaccaacaagaacaacaaaatacttaggccagttgacagggtggttaaccccttacgccagcaacacttgaggcaagacctggggcgttttggtgtggtggtggtttagggtttggtttgtttgtttttgagatagggtttctctgtgtag

SEQ ID NO: 23147 - DNA, 1143 bp, Mus musculus
tgctcacacgggtatacagactggactttcacggccattccccagaggagcatgtctcagtttcactgactgcggatgcttttgggagacaaaggatttgataaacattttggaagcaggaaaaatcaagtcacaactcctttctggtgtggaaaaattgccttttggcaactggtgctgggtccctgctggtgtggctaactgaataataaaagttggttgcagagctttgttcttttgacatgtgattaccaaataattctaagtctccatttttaccactggatttttaaattgtgatgtagcctgtcaatgtctagaacacagttaaagactttcgttgacctgttagaatttttttttgaggtagagtttttcatgttttatttgtatttgtaaaaaagaaagaaagaaagaaagaaagaaagaaagaaagaaagaaagaaagaaagaaagaaagaaagaaagaaaggaagaaaataaaagaaaaggaaagaaaagaaaagaaaaaacaggacaaaaaattcccacaagaaaacaaacccccaaatctgataacaaaaccaagcaaaactgtgccttctatttatctttgattctgatcggtcctggcaattgtttaaagaaaagtaataaagattctagatttgttttcagattcaaagaaaagaaaaaaatacaatattagcaccatttcctagttttttttttcacataaagaaaaaaaatgaaagcagtactcttcggcttcattggcacggtgggtatttggttgccgggagttttgaagagtagtgtattttcattaactagattttgaatgctctgcaagaggtgtctaggacatatttgtccccttcctttgtccccttttccttcctgcctttgattcttcttaaagtgggggtaaggatatgattaagagcttctgccccaccaggcagtggtgcacccctctcatcccagcattggggaagcagaggcaggtggcttactgagtttgaggccagtctggtctatgaagtgagttccaggacagctagggctacatggagaaaccctgtctcagaaaaaaaaacaaaaacaacaacaaaaacaaaaaacaaaaacaaaaaacaaagcacaaacccttcagctcctctg

SEQ ID NO: 23148 - DNA, 1218 bp, Mus musculus
agatctatctcaaaagcaacagaacagcgaaaacaaacaaaacacatggaaacctgttgttggtaaatagcaatctatttttgtctttttgaaactttcagtatctcatttaagggaatgagaatttgaatagaaggaaatataaaactaaattctaaatgatttaattttatctaaatgtacttcagtttatttatacaatgaaagtgtgaccaatatgtcttttttttttcctttttgtcataagcacttaagatggcattaagagcatagatttaggagtcaggtatgagcttgatattctggcttactccttgatgtgaccttggcaagtcagttagtcactgtaaacgtcaggatatttatctgtaaaatttgtataatagtaagtcccaagttcatggaggtgaccagagggctaatatacagaaatagtttgtttatctaatacttttatctccactgcctcacctgctaattaatattagtgagaagatcaagtacagtggcgttgtgatgcagtccactcctcgccagagagtgactgaggggtggattgagataaagaattcattgaatctttgtggttttaatgtttgcaggaggaatataagggtctccttagagagatcataattcttgtcaactgctttgaattcattaatctgcagtaaagaaataatatatagctcttaattgcttatcgtgggaggcttatggagtagtagactccaggttaccatggttgtggttcttgtaagcaaagtgattcttctttaggaattaaaaggataactgttgccagggacagcccaggggtgtttagaacctggattgatgggcatttctcaaagttgtcttctcaaacctggtagatcttcagagttcttgtgatggaaaaagagatgcagtcagtgggcttggggaaggctgagcattccatccctgcctagaatgcagtctgcaaagcagctgcccacatgtacacaacacaaggctgtcagcacctcccacagctactgagtgcactggggaaagctgtcctagaatcatttatacacactggaaatggagaaaagaagggaggtgggagggactagtgaaccattttggatttgtgccaatctgagaaagtgatttaaggttgacgtcatctttatatccttatactcttaagtctctacactgttataaaggaatgttcttttaatggactgt

SEQ ID NO: 23149 - DNA, 1604 bp, Mus musculus
ctttttcaaattcagggtctgtttctctgtgtctctgtctccgtcttgctctgtgtgcctctgtgtgctcatgtttctaaacacataagtaaagcttgctcagtttgtataatgttatttggatggatgtatgttttaaaggctgaccatttggtattcgataaccaacagagtgctttctaggaaagtctatttctcctgctccccaaattccttaattgttgatagtaatgtgtttatggttgaagcctcctgggctttctccccatccatattaacatgcctgttgttgtccttagcttatatttaggcagttgtgttagtgaggctttagtttttaaattgggttttacacagtggggttgtttatgttgctggaattcaaggtgactattaacctattaaaaccaacattgtaattatatatccttgtttaggtttacttctggacatctagcccatcattgccagccagtgaagaaggttttcagcctatgccctcgatcacaataagaccaccagatgaccaacatcttcctactgcaaatacttgtatttctcgactttatgtcccactctattcctctaaacagattctcaaacaaaaattactactcgccattaagaccaagaattttggttttgtgtagagtataaaaagtgtgtattgctgtgtaatattactagctaattttgtagattttttttcccatttgtctataaaagtttatggaagttaatgctgtcataacccccaccccaccccacccccggtggtaccttaaagagattaaatgcaaacattccttgctgagtttgtagcttaaaggcctgagaagcactggcaccttttctctatgatggtttgctagtcgccaacttctaggtctaaccccagccaaagatgacagcagaacaacataatttacactgtgatttatcttttttgctgagggggaaaaatgtaaaatgttctgaaaattcactgctgcctttgtggaaagtgtttcagcaaaggttcttgtatagagggaatagggaatttcaaaataaaaaattaagtatgttctgtgttttcattttagcttttttatggtgttatttgtggttggctgcaattgtgtatcatgtatatggaacttgtaaaaagttcttgacattcggattttagagacaaaaccacttttacctataaaaacctcacttttagtgtgggttatttcagctacattgagctctaggatactaaatacactaatagtttgcatgtaatgtgttcatttgagagaggcacttttctgtacataaaatgggccgacgcacagtaccttgccacagtcaccttttttctttgtacccctctttcagtgcaggtggataggtcacactgcacttgagtgctaaccagatgtctgtactaaggttatgtgtactcagcctgggcactttctgataactgtaaaatgttttataagatcatgaatactgaaaattttaaattttggagaattttaaatgttcttgagcagcttaactacttttgtatctagcctttttttttaagtatcttgttacattttacttttttaaataaattacagaag

SEQ ID NO: 23150 - DNA, 1143 bp, Mus musculus
tttctgctttcgaggcaagtattctcccaattgacctgaggtcccaacgtgtttttatttgaataacagacaataatatttaacatacagaaggtggaaagatggcccagcagttcagatcaccttgctcctcttccagagaaccaggattcaattcccagtagccccatggctcacaactgtttgtatctctagtctcaggggaatctgctgccttgttctagcctctgctgtgccttgaatacatgtccaaagacatacatgcaagcaaaacacccatacacataaaacaataataaataagttagaaagcaaaaaataaatgagtaaagaaattagcaaataggtaaataaaggtagagaaaagatgtaatgcacagaaggtctgtgtgttttagctttacctttaatagttattaaagtacacctttaatattgttatgcacacacatttaaacatgaatgctgttctgttttccttttacctcgaatttcagagaactatttcattttaaaaatgagctcaagagtctgattcctcatcattttgttcttaggaaaacagaaagcgccatggctctagtagaagtgtagtggatatggatttagaggacacagatgatggtgatgacaacgctcccttgttttaccaacctgggaagagaggattttatactccgagacctggcaaaaacacagaagcaaggctgaattgtttcagaaacatcggcaggtaaactaactgttcttactacttggatctggggacatggggttctggggattgaacccagggctttgtccgtgctaatcatgctctctactactgagctactcctctagccgcaagctttctgtgtaggccaggctgggctcaagtttgtgatcttcctgctagcctcgcagggctgtggaatcaaaggtgtgtcatcacttggctaaaaatatattattatcttttaaattggatatgtacactattttatattaggcagaaataaggcttggagaatttctcaaaatattgtatatatatatatatatgtgtgtgtgtttatgtatgtgggactagttgtgtaattagttttgaatttaaattatatttctgttcttatttttaggattcttggactatgtctgttg

SEQ ID NO: 23151 - DNA, 1649 bp, Mus musculus
agctcagctgcttctccttctagcaagtgaagattctctgagggcgagagtcgacgaggccatggaactcattattgctcatggacggtaatgtggatggtggaaatgacatttcagtctagacagcagctacattattcccagacccagcggctttcactatgtcctaacaagtatgacacggctggaggtagtccaatgactaggagtgtttgtcgctctcccagaggccttaggttcggttcctaagacccagacagaggctaacagccatctgctcctccagtcccagaagatctcaccccttcttctaagccttggcactacacaaaaatctctataaatacaaagtactttctttacatttctaaagtggtgtcttcaaatacataagtgcaatagctgaattttttatgcttattaggttataggaggtatttggtatttagaattgttctgttcacaagacaaagctagcctctcacccctaacctcctgcctctgagtcatgaatgataggacttgaaagactctggcttggaaacattttatttggaagaagtgtatgggaagttagacctcagattcctccattgggagtacccatggcaggagactacagtacgctcaaagaactttggggaaatctcctaacttcttttgttaaatacaacatttcttttagggctccaaatccacctcaaaactttgtacaagtgttttctttcccttctgcaaagtatatttgtttgaatatgaaatctaaaaatatcaaatagtccttctgctcacagtgacatcaggaagatctgctgtgcttagatggcctctgttttgggctaactctttcaaccagcttaaagcctggattactttaaatgaaaatttctatggtactgtgaaccttgtacattctagatgtcttggtcatgttctattgctgtgaagagacaccacagtcaaggcaactcttacaaagggaagcatttagttggggccggtgtatagtttcaaaggtttagtttattattatcgtggcaaaggagcgtggcagactggaaaagtagctgagagtttagtaccctgatctattggcagcagaaagggagagagctactaagcttggcatgagcttttgaaacctcaaagctcacttccagtgacacactgtctggacaaggtcatacctccttatccttctaagacttcttaaatagtgccactccctgatgacaaaacattcaaatatattatgagcctatggaggctgatcttattcaaaccactgtactagataccagcacagtgttaacatccctagccccaggtaacgagtcttcccaatcatcattttggatagggaacaggataggtacagttgtagaagtagtatacacacttgggcctgatagcagaattaaagagccgctgcttgctgtgtgctagtcttagcatcccataaagactactatgtatgttatcttatatcagggagcctttgccatgtcttgaattgtatgtgtagctaatggaatttggggggagggttgtttgtattttgattttttttttgtttgttttatttttgaaacagtgtccttgccagtgtagcacaagaactagccttgagtttcctggggaatgcaggc

SEQ ID NO: 23152 - DNA, 1178 bp, Mus musculus
gtaatagtgcttgctgtgagattaggaggactctagttcaaatccccagcaaattaaaaactgggcatggcttacatgtgcttataacctgtgttgtggagtgacaagttgcagtgagagagcctgtatcaaaaggcatggtgatagacatctgtgatgcgtgcacttagacacacgcacacgcgcacacacacacacacacacacacacacacacacacacacacacacacacacacacacacacaggacatactgcacacaccccagagcctgtatcaaaaggcatggtgatagacatctgtgatgcgtgcacttagacatacacacatacacacacacacacacacacacacacacacacacacacacacacacacacacacacgacatactgcacacaccccagagaaagagaaaggccctggcagcacagaggattttgagcagccatgttttcttgtgtttttctctttttagcattgactgaaatataacatttttcatcatgtacttttctcaatgtgttgtatttcatcttttcttctaggtttaatgcaaagattgaggaacagaggtgaaagagaccgggagagagagagagaacgggaaatgaggaggagcagtggcttgcgtgcaggatctcgaagagacagggataggtatgatggattttaggtgttactgaataccaacattttaggcaagttggataaggctttttgtaaatcaatgtacgatttgttgtttggacaaatgcatgggaactgtagtctgtaacttttccaggacatttgaaattactctgcctttttatttatttactaacgtttgacattttgttgcagctattgcttcactattttaattaagtctttaattgtggcaaactgtattacttttaattttctcttgttggaatgggttacacttatttttgtttaaatagtcttttggagtttggtcctgctccattagaattaaattatatcttacatgtagattcttagagacaaacctagataatctgtatttctcaaacattttgtatttaaatgtcataccatcctgatgtcatggttgtcaccatctgtatgcattgtggttttctagtgatgaaggtgtgctgataatggagtcatacacctttcttcctttcacagagacttcaggagacag

SEQ ID NO: 23153 - DNA, 1113 bp, Mus musculus
aaattctagaggggatccaagagacattgacctgaggagaggaagtgaaatacagtgggagttgaagctccaaggcctcctgatgctgtggatgtggatggcaccatcagtcatacacacaggagcgatcagcatagcaagcttctttcattaaataagacatgggttgaaatgtcttgtcttctcttctcttctcttctcttctcttctcttctcttctcttctcttctcttctcttctctttcctttttcttttctgacagggtttctctgtcctggaactcactttgtagaccaggctggccttgaacccagaaatccgtctgtctctgtctcctgagtgctgggattaaaggtgtgcgccaccacgcccggttggtttgaaatacttaagagagcaaaatattaaaaaaccaggaaaggtactatcaaaaagtttgattttaaggagttgattaattgctttcttctctctttatttcaatttttcccaggcctcagtgcagtttcatgggcatggttatctcccatgacatgctgctgggacgctggcgcctgtctttagaactgttcggcagagtattcatggaagatgttggtgcagagcctggatcggtgtgtactttgtgcactttaattgtattctgcatgctaagaacaagttttattgaataattgttttgcttcttttttcttgttttgtttttgtttttaaagattttaactgaattgggtggttttgaggtaaaagaatcaaagttccgtagagagatggaaaaactgagaaaccagcaatcaagagatttatcactagaggtaaaggtatttagattttctctatctctagtatgccatgccacacttaaacattcagaataataataaatattgcttagggatagatacatgtttataattaaaattttaaagaaattataattacagaatttagagcagtaattttttttaaaagagagtttttggttggaaatgattcagttggtgatgtgcttaaggacctgagttcagatctcagcacccacataagacgccaagtgcggtggcatggtggggagatacagacaggattcttgctccttggttagccagcct

SEQ ID NO: 23154 - DNA, 1199 bp, Mus musculus
aattggttaaggagaatcttgtattaaaattattgagaatatgtaggacctgaagcaccagagatagtattataaatacttgctttgagatattctgaggcgcttctggcgttcacactggagtatggtcttcaggtccccaagcgcagattgcactttgattggggaaagctctggaaagggagcactgttaactacctggggttcctgtggatcgctgtgaagttgaaaatcttttttctccccttaatatataactttttattcaaacctaatactgtataggttcttccaactaaaatgtcttatgctgccaatctaaaaaatgtaatgaacatgcaaaaccggcagaagaaagaaggggaagaacagagcctgctggccgaagaagctgacagttcaaagccaggtccatccgctcctgatgttgctgcccagttgaaaagcagtttactagcagagataggactcacggaaagtgaagggcccccccttacatctttcaggtactcctacatggagcaatactcttggggctctttttctttttcaaatgtgatctgtccccccctgccctctgctctctgctctgctctgctctgctctctgctctctgctctctgctctctgctctctgctctgctctgctctgctctgctctgctctgctctgctctctgctctctgctctgctctgctctgctctctgctctgctctgctctgctctgctctgctccctctgctctctgctctgctctgctctgctctgctctgctctctgctctgctctgctccctctgctctctgctctgctctgctctctgctctgctctgctttgctctgctctctctgctctctgctctgctctgctctgctctgctctctgctctgctctgctctgctctgctccctctgctctctgctctgctctgctctgctctgctctatttattatgtaagtacactatagctctcttcagacacaccataagaggatgtcagatcttactatggatggttgtgagccaccatgtggttgctgagatttgaactcaggacctctggaagagcagtcagtgctcttaaccactgagccatctctccagccctcttggtactcttattatacttttacgatcatttttatttagagatttcataatttgtaaatttgtatattgatattataatttattgt

SEQ ID NO: 23155 - DNA, 1395 bp, Mus musculus
tattggttacagcatttattctttcatttttattattatacgataaataatgaaataatgcattcaattattttgtattgtcacttaaaaaaaaacaaaaaaccaaaaccaccaaaagctaggtgtggtgtccctggcctgtaatctcagcattgaggtacgcagaggcaggtcaccctggtcttcatggagagttctaggacagccaaggacgtcacacagtgagaccctgtttccaaaacaaaccctacaaaatgccaaaagtttggattactaactcatgcattcatgcgtgtttgtgtgcatgagtgcttgtgtgtgtgtgtgtatgcatgcactgcaggggtcaaacacaggcccagggttttgtacatgctgtgcaagagctctatcacagaatttcctctccagcccttaacttgctttctagtatattaatatttaatagagattccaagcattttagattgaagaggttaacatttctaccctttctaattactttttttttttaatgtttaggtgctactttgaatgataaggatgacgactctcttcctgcagaaactggccaaaaccatccatttttccgacgttcagactctatgacattccttggatgtatacctccaaatccatttgaagtgcctttggctgaagccatacccttggctgatcagccacatttgttgcaggtgaactaaacagatctaatgctctttcatagttgattttgaaatgttcaatctaactgtaatgtgtcttgttaaaattccagccaaatgctagaaaggaagatctttttggtcgcccaagtcagggtctttattcctcatctgccggaagtgggaaatgcatagtagaggttacaatggacagaaattgtctcgaggtaagatagtcaaagtttataatatatttcttaattagcagttttcctcgcatccagatatgaggagatgtattaagtgcagagtatgtaccccgcagtagaagtgtcagaagcccctttctttcagcagactggagctgttacttttactggtttttagtgtcaactcatttcacacatcagagggttactaatacatgctgcttaaaatttaggtttctaaataagaatacttctatacagacatttgtaattttagcttcaagttttttcccttgatgtgctgttacttgaatgaagaataaaattacttaaaagaggcagcgttaacaatgacacacacctaaataattcattctgtctctggggtactgcctcatgctttataaccaagaaaacactaagaaataaagcttgacgagattatgagtttcaagtgggaatttcagttatcatagctagttatacgagagatttagattttggaaagtcatgttattttt

SEQ ID NO: 23156 - DNA, 1146 bp, Mus musculus
gcagcagacaccctgaatgtaggtctttcagtcataatcagtgttatttttaaagatcatttataaatgttctgttttctctttttaagacttacttattttcatgtttgagtgctttgtacacgcagtatccaaggaggccataaagggtgtctgatccccatggaaatggagctatggggtggttgactgccaccacgttatgtgctgggaactcacctgggtcctctgcaagaatatcaagtgctcttaactgatgagcatcagttaaggtcactccagtccagtcatcaattctaaattttacatatttatgaaatttcatacttgtggtttttataaatattttcatttgtttttgctcctatagacgtgctacattgctgagcgcccgccagggaatgatgtctgctcgaggagactttctcaattatgctctgtctttaatgagatctcataatgatgagcattctgatgttcttccagtattggatgtgtgctcattgaaacatgtggcatatgttttccaagcccttatatactggattaaagcaatgaatcagcagacaacattagacactcctcaactggaacgcaaaaggtatatccatattttggggttttgtttgagaactcctgtgtggtatctgagtaaatggtcacagtttggataaggagatgagcactgcaaaagagaacaaagattgttcatgtcgaaaagtgggcttatcctctagcaactgctcacttaaaaggagaaaccaaaatctaattaaacctattagttgagacatttgtgtttaagtattgttgtattgaggagggggggagtttgtgtggacactcagtatttcttttcggatggggaggttttgttaagtgctttttgttattgtaatgcattaagcagaccactttactatttccccttttctgaaactatacagcagtgtttggttccagatgagatgtctgatggcgcttgcctaaccacctgagttcaattaaattcagttcctgcagattgtcctctggcttccatggacaagctgtgacacacttccacaagcacacacactcaagttagatacccagtgacatctccagtgttcctctcacctgtgttctttttcataccacataagt

SEQ ID NO: 23157 - DNA, 1391 bp, Mus musculus
ggtgattcttatctttgaggtcttttgtcaggtgttgcttacacccattgcctttatctggtagacatcagtagtattcccagccctgtgttcttcacgactctccttgtaacagctaaaagtgtctgcacacattgccagatgcttgcttttgtagtggttatgaagtacagaattattcctggatgataatgtattaacttcttgtccaccttaacactctcttcccccaaacttatataggagaggtatacttttttgctcatgtacatattattagttgaccatttagatttgtataagcctatataatgtcactagcagttagcaactatataagctcatggtaattgtcctttctccttatagcaagttctgcaggtttgatttatattgatccttcaaatttacgccggagcggcaccatcagtacaagtgctgcagcggcagcagctgctttggaagctagcaatgccagcagctacttaacatctgcaagcagtttagccagggcttacagcattgtcatcagacaaatctcggacttgatgggccttatccctaagtataatcacctagtatactctcagattccagcagctgtgaaattgacttaccaagatgcagtcaacttacaggtatgatctactgaaaagttatttattgttttgcctatcaattaggagaatttcaatataaatggatattgcaaatgcttaagtattgacatactagtactatatcaaaattagctctgtttggatagttttgactattttagtttgatcttcatagaactatgtagaagaaaagcttattcctacgtggaactggatggtcagtgttatggattctactgaagctcaattacgttatggttctgcactagcatctgctggtgacccaggacacccaaatcatccccttcatgcctctcagaattcagctcgaagagagaggatgactgcacgggaagaggccagtctaagaacgcttgaaggcagacggtatgcagtcctccatatgcattcatgtataggaacagaaagcccctaaagcctaggctagaggtttttaattgctgtacatctgacctcatcttaatggcaaagaagaaggtaactgtctcatcttacttggtaggcagttgaagcaaactagtctatgtcatcctaggaatctatactgaaaactgttgtcagctttgtgtcctgctcctcctctgcctcccttcatacagcaggcacatgttctctgaaagacttggttttgactaaggctggacaggaatgcaagggtcaagtgtgctatcacttttaggtcggcaccacacatgtgtgcacaggcactatcttgtttaatcataaaatgcatttatgtatttgtatatg

SEQ ID NO: 23158 - DNA, 1219 bp, Mus musculus
agtgcaggtgacaaactttggtgggaagagcagtcacttagaagtcagtcttgatcgtgttagtttgaaactaccctgtgttccagccaacttgtcgacattagttatactcatttgtggctgtatatattacagtgatgtcagcaagcttccatttattgagtgccaggaaattggacacataaacttgttttttacctaaagactaagactaaagatagttttactgttggccttttttttaatagtttaatgcaatgtatttgaaagtatagaaaattcagcccttccccatttcccagaacagttttatacttctaattttgaagcctgtttttagatactaattacaaactatgtgatatgctgatggaaattttcataatgaattgtcattagtaaatgattttaaaacagcataatacaaatttagaaacccttattttagagagctttaaaattttagtttactaattctatggacaaaactggtagagacaggtttattatgtgctgtgatgatctataaataaaattgtgggttcaggttgaggtggtggaaggcgtggctggagaggaggatcatcatgatgaacaggaagagcacggggaagagaatgctgaggctgagggacatcacgatgagcatgatgaagacggtacgtgggagtgggaggagtcaggtgcctggagagcagcctcgtttgctctgcagtaaccgaattcttttcttctgaatttctctgtagtatttttacagtttaggaagtaagtcaacatacatcaaataattgtatttgctaaaggaacttgtttgtgtgagtcagggtgttgtgtaccccaggtctccctcagactcactgtggaggtgagcatggccttaggcttctcacccttctgcttccacttcccaactgctgggactagaggtgtgcatgactatgccaagatccagtcagagctacacgcacgcacacgcacacgcatcgagcaagcactctaccagctgaactacatctctagcccaccttcttttctttcattctaatggggaaatggttgatggctcagtgggtaaggacatcattgtccagcctgtgacctgagttcattattattcatttacttatcatttacttatgtgtgtgtaagtgtttgtgaacataagtatgcatttgcgtgtgaggtcaacaacaatgtagtattttgtctccctcgc

SEQ ID NO: 23159 - DNA, 1281 bp, Mus musculus
aaggagaggactgccacctgcacggtgctctctcacctccaaacgcacacatgtacatacgtcatatatgtgtgtatacacattcacacatatatacataaatcacacacatacatatatacacacacaaaaacattttaaacattttattgggaactattaatatttaaaagtattagactacgttaaccatcatatgaactatctcagcattaatagaatgattgccatttttaaagcttttagatactctgctaggcaccttagtaaaagaactccaaaacaagtacacacccggacgccgggaagaagcaattgccgtgacaatgaggtttctacgatctgtggcaagagtgtttgtcattcttagtgtggaaatggcttcgtccaaaaagaaaaagtaaggcatttcaaaaccttttgcacacatttgtagtgtgataatgttagtatgtgtatgagaagaatcattagaggtttttatttttttcctgctatagcaactttattccacagccaattggaaaatgcaaacgtgtgtttcaagcactgcttccttatgctgtagaagaattgtgtaatgtggcagagtctctgattgttcctgtcagaatggggattgcccggccgacagcaccgtttactctggccagtactagcatagatgccatgcagggcagtgaagaattattttcagtagaaccattaccaccacggccgtcatcagatcaggcaagcaggtatgttaatgttttgtatggaaatggtttatctggcttattaaagctgtgctttggagtagcagttgaaatgattttcacaattctaattttgtcacctaatgtaagtataatattttagtacttatctgcccaccatggattaaaactaaatattaacaacagaaagcttacaaacttttggaattggaacacctctctactaaatgaaaaaatagccacgtagccaaatgtgttgcaagtcgttttatgttccacttcctttgctccaggaagtggctagtgctttcagctcccgcccggcttcccttgagtcctccgacagaaggcacacacacagttaattccttcactacttgccttcttggcacaattgctgggtgctgatatctcctgcctgaaaaagcccacccttaccgatttattattttcctgtctctacctgccctaacctagccctgacctcttgcctgtagtagtggccacaggccccagctccccctgagagctcacatggttgctgcgttcttcttccaaagca

SEQ ID NO: 23160 - DNA, 1226 bp, Mus musculus
gtctcctgacttacacacatactctgccacaagtgcacctctgtccttcactcgccctgcttcataggaagggtaaggccgtcttctcagcttcctcctggatgctgagtttcccttgtatttattaggtgtagtcaatactcgctgccagggcagggtgagccaggcatttcattttctgacagcatttacaggcctgtcagatatgacacatacaggaaacatgtgcttaccgtggttagagttggctcagtgcccatgtgaggaccatgtagggtatgttggagaccgggaaggacaacagaagtaactgtcccaggacattacagttaggttttataggaatttttctattgctttctgaactttgcaccattaaataatatttttttgtatgtagctgatagcagttaccctttcatttaaatatcaataagagttctctttagttttatcaagttataagtcttcattgcaatgtagatctgtaatttaaagtttttttgaacttttctgtgatttttttttttttttttaacagactcaagaggacttcaccaacagcttattgtgattgttgggagaaatgtaaatgtaaaacattgattgctggacagaagtctgctcgtcttgatctactttatcgcctgcttactgctacaaatctggtcaccctaccaaacagtaggcaagtagaatggttaggatagaaagaggtcagcacatgctggtgccaccccctttccttccctccctccccctccccctctccctctccccctctctccttccctcccttcctccccctccccatccccctctctcctcccctccctccctcacaacctgccctgtgttctaggggagagcaccttttgctgttcttagtacagaccgtggccaggcagacagtggagcactgtcagtataggcctccacgaatcagggaggatcgcaacaggaaaacagccagtcctgaaggtgagtgaagtatacaattctgctgatgtacaaagcattgaattctatttttgtctgacccattcttcctttttagattcagatatgcctgaccatgacttagagcccccaaggtttgcccagcttgccctagagcgcgtccttcaggactggaatgctttgagatctatgattatgtttgggtcacaagagaacaaagatccgtatgtatttgttaaaacatttaaaaatttttctcagtttct

SEQ ID NO: 23161 - DNA, 1093 bp, Mus musculus
tttcaggattccctttcccctcctttgacgtgagctgaaagtatgtaaacgtgtctgctggtttgttttgttgttgttgttttttttttttgtttgttttgtttttttacttttaacctttaaaattatccaaagaattaattttgatttgagccctacataaggatggaaaaacaaaaacaaaacaaaacaaaaaacaaatggccattcattcctcgattcagcttagcagctatgagaatgtggtctgcacagatggcaggctctgacccaggctgtctaactagtcctagtctgcctatgagtgaggtgaggttactttacatgtacttggtctatttggttttcgtccttttacattgtcaactgtgtgagcaccacacccacttcccaagcaccttggtattgatgagttatacacgtgattactctttctcaaaagtgaccttttcaattccaggacatttttgaatgtcggacttgtggtttactggagtcgctttgttgttgtacagaatgtgcaagggtttgtcataaagggcacgattgcaagtaagtcccacactgttctgaatttcataaactctcaggttttcattgcagtacaaagtacttatgccttgatttaggcataattcagaaagtgaagttttctacatttcagttcctacatatagaaatatgactggtttaaagagtattgttaagtacttgtagtgtgtgactagaatcgggttaatcttgttaaattagtctgattaatgctttaaagtatgtttacagagtagtttcatttgtattctactgccaaagttttaagtgcctccatccctctccctctgggcctcttttaatgtgttaagatgaataactggactctgccttacttattttttagattcagtaatctcatataataaggtcattctagctggctttgttagtttccacagacctaagcagtaaaactcaagcttaacatttgtagagtctcagtgttaccaacaggaacaccgggttataaatgtacatgtgtagatgctgtaggttatagaaaaatgggccatcagaatcctccacttggggtttttga

SEQ ID NO: 23162 - DNA, 1190 bp, Mus musculus
ttttcctcaccatgtgggttttggggattgatctcaggtggtctggcttggtagcaagtactttacccctgaaccttctcgtgggccctgaaatgtaactcttaaaacaacgaggtgctgaaaaatcagtctggaataaaatatacatcctttgcttaattggctgacagtattgctagagttgtaatttgaaagctggagtgcaccccagggcgtcaccaggcacggttgtgtatcacatgcaggcattctcgttcagctactcagcgtgttgactgcttttctactggctacaggttgaggtggtttggaatactgaaggcatttccctcgtgttctttactttgttctcgcttgcatactctcttcacagagtatagatgagttcatttgccaggccacttatgatcaatttctatttccttgaagataccattatattatagtggccatgaggcagttctcatgtatgtaatttttgacatatttggtgtttagtttcattgaagtgtttgccctcttttgcccgagaacagaagcaaaccttaatgcagcacattctcagatgtgactacgaggcctgccgacagtatctcgtgaatctggagcaagccgtggttttagagcagaacctgcagatgttacagacgttcatcagccacagatgtgatgggaaccggaacattttacatgcttgtgtatcagtttgctttccaaccagcaataaggaaactaaagaagaagagggtaagattcggaaccataacaaagcctttgcaagaactctaggaaaagaagactcttgtagagaaagaacttgtatcctttttactttatgtggtcttggaaggtctgacttttattatgtggtaaaaatatttctaagggttagatgtggaagcagataataagtttgatctgtgttgatcctaaatgtacttcactaattttataagtacaaataactttaaaaaccttcatattttacattacatgtacgtgtgtatgtctgtgggtggttatgtgtacattggtgagtgctaggtgtcggagaagtcccgattgatccctggatggagctggactttagagcaggcagctgtgagccacattgtgttgagaaccttactttagtcccctggaagagtagtgtgtattcttaattgctgggccatctctccaccccctta

SEQ ID NO: 23163 - DNA, 1691 bp, Mus musculus
tggcttcctaggctgctgacatatatggatgcagaaagtgttgggatggatcagtggtgtatttctgtaatgccatccctttggaggtggaggcagaaggacccagaattattcaaggctattattattcagctgcatggtgaagacctgtgtaggacacatgaaacctgaaaaagacctgtttatcagatattgctgcttaggcaatgaggacagaagataagaggtttatatgggtgaacctagttttgggtcagtaaatggcttaacacttgttgtgattagtggctgtgtgagttgtttctttcagttgtgatttgttgatataaacagcaaagttctgtgtcccgtgtccgccccccccccccccccccgttgacattacaatgtggtattcattgatatgtttacaaggatttaagtgtctttagtattgtcagttggaaaagcagaatttgcatgcttttatagaagccttttaaaatatttactaaaactgtatctatctcttatttctaggtgctgaaggtagatggtgcctatgtcgctgtaaagtttccaggaacatctactaacaccacctgtcagaacagctctggtccagacgccgacccttcctcgctcctgcaggactgcaggctgcttcgaattgatgagctgcaggtatgtacgcgagttgagagaatgtggtgatggactcattgaaagtgttacagcgagagcaaaattatgtgtgttgttttgcaggttgtcaaaacgggcggcaccccaaaagttcccgactgttttcagaggactcccaaaaagctttgtatacccgagaagactgaaatactagcagtaaatgtggattccaaaggtaagccttttatagttgtgtacagtttagatcttttgaaacatacgggactagggtacaattgtttgagatttgacagtgaaatgtggctggatgtttttacaactggtgtgggagaggttaaagtttgttaaatgcttgaactgtggaagactttgttatttttcttttcatttctgtgcctttgaaaggtgtccatgctgttctgaagactggaagctgggttcggtactgtgtctttgatcttgccacagggaaggctgaacaagagaataatttcccaacaagcagtgttgcttttcttggtcaggatgagaggagtgtcgctatcttcactgctgggcaggtaagaagctcagcttatctttttgttttttgttgttcattttttaaagagcagatacaaactggcacttttgtgcccgttagggtttgcctactagagaatcaatgaaggctttataatacttagcaccttctgaaagcttgttatttctaacatagcattaggtaattttaaaataagtacactttttgtaaaatccatcttggtttactctcacccctttgtctccccctactccccctcccctttttggggaggggggatgataagggtcccaagcttaggcagaacttgaactgttctatcttgtccttccaagtactggaatcggggcattcttgctcacactaggcttgtgtaaccatctgtgacttggaacaagcattatttattatctttcacctattgtaggaatctcctattgttcttcgagatggaaatggtactatctacccaatggccaaggattgcatgggaggaatacgg

SEQ ID NO: 23164 - DNA, 1135 bp, Mus musculus
ctttactgaggcatttcttctatcttatccttgtgaatgctgggatacaggctgagctgcatgccagactcctttaaaagattacattgtccattgaaggctaagggaaacatccctagagatgcctatggagcatcagaattaaggagaaaaagttacagatgacgtggagcagagaaaagtgtagttgttttcttctcttgtgcttaatttccctttggtagaatgactgacactgtctctgtgaattcagtgattcattcctagcagacaggctgacggcactgctcgttagttataggaatattggatggagaagggtacagtacatccttgttgcttttgagtttgtgttagaaaacacagcaagtctactttcctgcacgtttgaactgattctcgttctatctgtcatcctgaccgattttctttgtttgctaggtgtgcttgagaaataaccctctctaccatgctggagcggttgccttttcaattagtgctggcattcctaaagttggtgtcttgatggagtcagtatggaatatgaatgatagctgtagatttcaacttcggtctccagagagcctgaagagcatggaaaaagccagcaaaactcttgagacaaagtgagtactgggacctctgttagcacctcagctctttatatggtggacatgatcatcaaaaatttgataaagaattggggaacttgctgaaatattttttgtttattgtacgttacagtttctttaaaacatttgattttatgtatatgtgtgttttgcttgctgtgtgtgctggaagccaaccctagtcctttggaagagcagtaagtgctcttaacggccgagcctcttctgaaggcattgttacagttcctgatggtggtcagaatggttctcttttgatgtcttactctattttgtttgtttgttttcattagcctgtgagttttgcagtgttaatctagttcctgagactgttcatcctctgcaggaaagttgttagtgtaacctgataaaagtgtgctaccaccatcgtaagatggaagagtgtgttctttttgctaaattatgagtacattataccattttacacatggaaactcgtgtttccaccatatatatatatatat

SEQ ID NO: 23165 - DNA, 1059 bp, Mus musculus
ttcatggtatggctgtagcctggaatcacacgtcaggtgatcagtgtgactttaaggcgattgattggattctgttaagtattcttagaggagcacatggttggagccttcggaatggttgggaataaagtgtggtagctttttgtctttgatgtacatgagtatatgagtgcctgcatatgtgtcagtggtgatcacaggagggtgttggatctcttagaactggatttaaggacgttgtgaggctccatggggtgctgggagctgaacctgggtcctctgtaagagaaggaagtgcttttaatcactgagcagtctctccaacccccaggtaaagtgtctgaaggattttatttttgttgtattgaactccaagcattttagacctggagtcgttagaatatacattattccttgctctagtgttgaccacagctcttacttaagcctctcctatcatcttccttaggttgctacatgggtggatgaaacattaagttctgtggcttctaagttagaacacacagcacagacttactctgaacttcaaggagaacggatagtttctttacattgctgtgccctttatacctgtgcccagctggagaataatttgtattggtggtaagtgtctttcacaaaatattgttgctacatagaaagcagctttgaagaaaaaatgccatcgtgaggtcattgaagacagtgctgtgtagacacaggaaggagtttccctttaaagccgttgcattgaaaaactaagaatacatttatgcaaacactgtatgcttagcaatcatgttattaagtttcatgacagcacagagtagaataaattatacagactcctatctacagataactatggctagtatttgcaggtagtttttatccttttcttcaacatatacatatgtagtatgttattacataattgtaaattatgggatatgtaatttacaatttcattgcatgaattttcctcaatagtgttgtatgtatgtatgtatgtatgtatgtatgtatgtatgtatgttagttaaataaggctctaaagtt

SEQ ID NO: 23166 - DNA, 1857 bp, Mus musculus
tattatttcaagtgaattcatatttattacaaaatttagacagcttttttaaaggtttatagctaatgtacaagaatgagactcaaaatgactttaaagaataaatggtttaaaatttttaattttaaaaattattaaatatttagaagccgctggagttctggcgtggggggaagtggaggaggctcctctggtcggtcgtctgctggagctcgtgattcccggcgacagactcgagtcattcggactggccgggatcgggggtctggactcctgggcagtcagccccagccagttattccagcatctgtcattcctgaggagctgatatcacaggtgtgtgctttgagaaccttagggtggatggagggggaggccgggctgagccaagggctcgctcatctagtgactcctaagggttgaaaatgtggtttgtttaccaacttagaagacttcaggaaataagagaaaattagcatagcactatcctctgtttattttaggcacaagttgttctacaaggcaaatcgagaagtgtcattattcgagaacttcagagaacaaatcttgatgtcaaccttgctgtaaataacttactgagccgggatgatgaggatggagatgacggtgatgacacagccagtgaatcttacctgccgggaggtcagtgctttgctctccctgctcctgcttgggtgatccttcgactgagcttgggagtttatagttgatgataattgtcatttggaagctatacaggttgcttatagtgtcccatttgaggggaaatatttttactcagtggatttggtgtgatcctaattaagatatgacggcattgcatagatttatccctggctggcatgtaggatgttgttttttgataatatcattgctgaacattggtacttactgaattgcatttgttttcatctgtattttgtttcaatgacgtcattaagtatcatatcttaaaagaggttttgaatttaggaagtagtgcctgcagcagttatgcagactgttcgtccttaaggtctgtgtttctaatgctcagtttatttcttagatcttgggggacactcctccccctgccccaggtctgtggttttaatgtattttaatttccagagatcttttagcggtttatgattgcattatctgtagatgcttcatttattcatatatttatttgtttttctttgtagaagatcttatgtctcttcttgacgctgacattcactctgcccacccaagtgtcattattgatgctgatgccatgttttctgaggacattagctattttggttatccttcttttcgtcgttcatcactctctaggctaggctcatcacgaggtaattttgcatttatttcttcttgattgtgggctgactgtgtggagagctagtgataaacccacctgtatctgagcttagatcttacagtagggcgaagtcattacatagccgtgctttgggggcgcgggggggggggggactttggctttaaaactaggctttaaccttgtgtaacgcatagcaaaggcggtgatttaggaagtatgcttttacctatgagatagatattgaactaaaagtagaatgctagtttcagcaacatgcagcattcagaaaaatatacttcttaatttgattaaaacaatctaatcatgttcattttaagtagtgcgtagatagtggagtatgaaaacttaggagagagctgggcgtggtggcacacacctttaattcctgcactctggagacagaggcaggcggatttctgagttcgaggacagcctggtctacaaagtgagttccaggacagccagggctatacagagaaaccctgtct

SEQ ID NO: 23167 - DNA, 1186 bp, Mus musculus
tagggttcaggatgactggttttctagtagctgagttagcgatggcttggctgagcaagtgtgctggagagaagaactgggacaagatgaaggaggcttggattagaggttccccctgaggagacaggattaggaacgttgtatgcgagcaacaatcatgcaaacaaagcccactcactctccatgagcccaggactcaggcatagggatggagggctactgagtagctgcggctttctgtcgccaaggagtctggctgtttcagcgtcctcagagtcctaccagatttcagggtctaaattgggccatatttggcttggcaaccagtttaagctagtgtgagcagatttgaagttcagtagagcatgcaatataaggatgaaaagttgaagtttacaatattgatatagtagctactattgaacatttaaatgactgactctttccaagatacattacaagaatcacctctaatcgttctgtaagcacctctaccagacaggtggttctattcccactgaccaggagaagaagctttctaaggtctgtaaggctataaagccagccaaagtcacagtgggcttggggcctggcgcaggcttgctttgtactgcagaatactcacttgtgctgtctgtctctcataagagcttggaacatttcaaagacaaaaagctgctacttgcctaaataaggaagccagcctgcagttctgagaagctgatagagtgagccttggtcaggtgaatggatggccttaatcccctgaacagtcagatttcattacaagtattttattgtggcttacggtttatgtcaaggataaaagtttttctatattataaagttgtctgttatgagactttatttctaagtagaattaaaactgggtctagaataattagaacacattatcttcagttggtggagactttgctgtgaatgaggctgcagggatgtagactggatcaggatatgggaaccttgcctgggagcaaggttcccatatcttttgaactagagctgtgacgtggtcttgtcctgttgacagggtttggttcccatgtagtttagtttattgtttaaaaataaagttaacttgagagtagtggcacaccttcagtgccagccagcactcatggggcagaagcacacggatctctgaatttgaggcctgtctggtcta

SEQ ID NO: 23168 - DNA, 1147 bp, Mus musculus
tttttagaggtatgcctgtacttgtaagtttttgttgacctttgtttcctctggaaatcctcttcctaaggtaccttcccacctcctgctggctgacagccaggccctcttctccatttgcatttgaaggaatctgagtgtctcccttcttctccgtttgcattttaaggattctaaatgttgtatttgtgtagtgtcttctggatgctttcctttctcttaaagctgccgggatttagatttggttagaaaggactttggggccctggatggttgtctgtcctctggaagagtagccagctgctgagccgtctttatctctacagcctcaattcagactttttttttttttttttttttttttaatatagaggctagtttaaataaacaatttacatgtaaggttatatgaattctgtgagaatttcataggtctcacaattagggctttaaagacaatcaatcccctgataatttctcttaatgtttaataacattttaagaaaagattgtgtgtgtgtgtgtgtgtgtgtctgtctgtctgtctgtctgtctgaatgtgatatcaaatcttagaattctcccctccatgtgatctaaaagtgttttttgtgaatcttaactgtctttggtgtgttaagaaatagttattttctttatgtgctctatgtaccagaattatactaaaggaagtctttcagcattagaagttcattgttaagaactctagtaggtaaagatttcaaagagcgtttggtataagtttcagacccattctgagtatataatataagtcttggggatttgagtaaagtttgcctgagtccagggaaaacctgtggcaatcctgctgtcttcttaaaggcaggttgattttgattgataaagatctgcctgagagctgtttgctgccatattatttcagtttaaagaatgcagtttgagctgcacatacggcacatactcctaaccccagcacttgggaatggaaggagtgcagagaatccaggaggtcagcgatctccttgacagctgagacactgcttttcaaaatgatcttgcaatacagatacttcacatttttaaataatttaactttaggtcaggtgggattgttcttgttgattactttaaaaaagatctgttt

SEQ ID NO: 23169 - DNA, 1099 bp, Mus musculus
tcgtcagaattattccacctaagtggaagctgccttgaaccgcctggtcaacctgcacctgcgggcctcctccacctacagatctctgggcttcatttttgatctggatgacgtggctctggagggcgtaggccacttctgtgaattggctgagaagagtgagggtacctagcggcttctcaagttgcagaaagatcgcgggatgggaggaggggcgtgcactcttcaggaagtgcagaagccggctcaaggtgaatggggtaaaacccaggaggcatggaagctgccttggccctggagaagaacctgaaccaggccttcttggatctgcatgccctgggctctgcccgcacagaccctcatctctgctacttcttggaaagccacttcctggatatgggggtgaagcgcatcaagaagatgggtaaccacctgaccaacctccgtaggctggcaggaccacaaccagcgcagactggcgcgccccagggatctctgagtgagtatctctctgagcgcctcactctcaagcacgactaggaggcctctgtgccttccaaggggctccccactctgctctgcaccagcccgccttgggacctccacctgaatgaatctctcaagccactagacagctttgtaaccgctctggagcctctctcaagtcttggaccaagttaaaataaagctttttgagacagaaaagaaaaaaaaataaataaaagacagggctaccggggatgattcgagtagagctactcccttaaaggaagggagatgaagggtcacatttagaggcagggatgtgacaacaagcagagattgaagcaataccagccaaagtttcgccaaccagaggtggagtctagcatccggtaaaagcaagaaaatgcaccccaccaccaagaatctgcaaaggaacccaggcctgtgggcttattgatttagaactcctaatgtctggaaatagaagaaaatgattagtgtcattttaagctaagtttgtggcattttgtaacagtaacaacagaaaatgaatacaaggcatcatttaagacacagtcacagtaaagcaaatacattcaaaactgaaaagaga

SEQ ID NO: 23170 - DNA, 1917 bp, Mus musculus
cagacaccggcggacacacacaggtgagaagaagtttgcctgtcccatgtgtgaccgtcggtttatgaggagcgaccatttaaccaagcatgcccgacgccacctatcagccaagaagctgccaaactggcaaatggaagttagcaagttaaatgacattgctctgcctccgacccctgcttccgcacagtgacggccagaagatggagacgcagaataaactttggtcagagtcaggagccagtgatggtgtcaagtgcttctgcaaggctgtggccctccaaaagggcctaaagtagaagccctggcctgggggaggccccgcctgggtgaaatgacaagaagtgcttcagccacaggcaggtcacagaggacagggctcagttcttaccacagagagagaggagaacccttttattcctcccttattttagtctggaaagtttcggctgaggtgagcgcagcacaggttttgaatcacatacacattggggactttgtttttgccatttatacttgagaccagctttgcagtgtgattctttcaaaggattggtttcaagaatatagaggctggaaattacggtacagaaatggagctagaaaatgagtttgtgttacacagagatgtcatcttctcctagagttatcttgtttcttattcctagtctttccagtcaaatccgtggatgtagctaagtatatctaaaactcatttttccactattgttggtatttgaagttgaacagctgtacattgctgtgggggagccaaaggattggaaccctcattaatttaattgcttggaaatgcagctaaaattcttctttggcattttgttttgaaagtttaggcattttactctactttagattttagtttgcttgcagttttttgtgtagatttgaaaattgtataccaatgtgttttctgtaggcttaaaatacactgcactttgtttagaaaaaaatctggagatgaaaatatgtattataaagaagagatgtcaagaatttgagataactccttgagaaagttggctttatgtcatcagcaaaggacacttaacgtcaagcatacactgtggtttttttgtttttttgtttttttttttcaaattagaaagtttaatgaccgttacagatggacagtgtctttttatttataggagtttttcaggatgtcagagtagataggtaggaaaattgttattagaacattcgcttctaccttgaaaaggatgttaatgtggtcatgttcttagcaccacagtgtctgggcatctgggaaactccgagacttttttaaagtgtcatgatgtgatcacacctgcagtttggggcatcgaatccagggccttgcatgtcttctgtaagagctctcatcgctgacctgtatcccccgcaagagcaatgacttttgctaacagtatttcttttctgttgtaaagtggacagatgatacacttggtcgcaaaggtaaattattcaaaatccacagtgaaaacctcaccacactttcccatttaaactatttccatatctcagaggtttctgacatgcaaacttgaacccttgaaagaagagttttcttaaaaattataaaaaatcacgagttacaatttgcacaatattttttgttgaactttataccttgtttacaataaagacttttctttggtatacacagtgagtctgttgtatgtgttaaaacccattctccatctcaccttcatactgacctcattcagatcagaacctgaggccagattgctttaagatgatgtaactgctatgaccaacaagagaaggctgacctgtcatctggagggacttgttcaagttgtactcactcagaccaggaagagatactctagatataacagataaactggtccttaagcagtgtgagaggcc

SEQ ID NO: 23171 - DNA, 1335 bp, Mus musculus
gagacaacttacaggggtcacttttcctaacttactctatgttcacaagtggaattcctgtcctccaagaggaaatgtgacttcactttggtgccaatggacagaagattctgcttgtgctacatagaagtgtgggatgcacttgaatagctggatcttacaccttgatttcaaggtggaaagaaattgatcatgaatctctaatttcaaatcaaaccagtaggtgcttaatatttttgatttgaatattgcccacttgaatatcatgggttctattaataataactaaggaccccagtccattgtcatctagttgtccttggacttttttccaaggtataatatggggttttatgcaaaattccaagctaccatatgcattgttgtggtccagaaatgccaaaacttaaagggtggcacaacttgagtccttggcttgactgtactggcttggtctttgtggcatatcagttgccatctgcataggagagtggttgtatgtaacacagcccaaaattgctaatctcacatgtgaatgataggtaaacttaagaatgtctgtattgtatttgaagactgtttgccataaatctaaagtcaaacctatgtatttcaatttggtatgcttaagaataattaatgtaaaatctttttatatgatattgtaatctcagttcaaatttaattgcaaatataaaacccaaatgatttctatatatagtgaattgaactgtaaaggtaacttgtgtgtgactctgaatacacagataaaatgtttttattcctcatgctttactttgatggcttctatcatgaaatagacgtgaaattttatgaattgattttgtgtatattgcccacgttctttcagaatctgttaaaagtaaagtgatctggggattgcctagcacaatgaagcttttaatgaatggatattcatgggaccgccttttaaaacctgggtgatgttgagtctattagttgtattagatgttgatgctatttagtttttttgttgttgtttttttttttttttttttttaaagaacataattactaaacagtttggcctgttgaaatgaaactccatcctcagttgttggttagtgggtggcacgataggaattccattcctagggttttcttcccagaatacggtaggtttaaacaatattgtttagagtagtttataggctaggatttaaaattagaggtagacgttcttcatcatgtctgcttctaaccttgcttctggcactgaactattctagcagaggccagacatctaacccttctagactgataatactatgcataggaactaatgggatctaa

SEQ ID NO: 23172 - DNA, 1184 bp, Mus musculus
caaatacaggtatgagatgcaagatgctggaattacttcagatgcaatgatgaaaaacttcttctttgcaccctcttgtattcagctgagccaagaagacagcttttccactgaagcttaaacaggcattaacgcttccttagatctgaagtcgcaggttaagcttgtctggtctacattccagtgtggggggaaaaaaaatcaatctttattctgttaatttcttggaaacaaattcatagtaatagctatttgggaccagacaaaatcagctttcatctataattcattgggggtaataggggatttagataatgtatccagagttaaacataccagtttgacccaccccttaagcgtttaaaataaaatatgcaacaaaatggatgacttagtggagatggaagcccattaactgggttccccatcaaatcgtttacatacaagtacacagtttttataaggattcctgttaaaagtcttgtaaagttgatgtctttcacccagatatatcacatgtgagtggaagaccagtgtgacttcattagatacgtttagtgtatttaggatgtgtaaatttgtgcttttgaactgtagtttaataaatgtaaaattgcatcatagtatttgttgtatttgacctaatgtaacccttgtatgattgcaataaaactttgtgtagatcttactgttttttcaggctaaaactttgggaatggggctagctagcaaaggtagttatgaactagttgtgtgtggtctgttttgagggttagtttctttataacccgtttaagtttggtttgcctcaatatactttttagttatttaattagtaatttaagtaaatgtgtttggtaatcattgtgaagttcagatttattatggagagttgatgtgcagtaagcatgatgtttaacaattttaacaccaaaaatatgttaatcctgcataaaccaattgtaataataataggtgtttctgtatagataggatgcatagattaccttagtaaatctttgaatcacaaatcttttgactgatagaaaagattttattaaacactgaaaacttggtgggaagggggtaagagactgcagaggactgcagaaccctaaccttaaagaagggctatgtctgtctgtttccagcatcctgatgccccttccttcgcacagacattt

SEQ ID NO: 23173 - DNA, 1261 bp, Mus musculus
accaggtatccgtaaaagaccttgtaagcagctgactgctgtttgtggtttttctgcaggctcccatggatatccctggcctaaacctgagtcagcaggaatactacccctatgtgtattacaagattgattgcaacttgctggaattcaagtaaactgagctcctcccagtcaatcctggccttgtgttggtgttgctcacacaagtaactctcataactctcacgccctctgcttgctccttccccttcccctagatgaatttctcatgtggtccatatctcaacatttgctttttaaagaaaaatatatatattgtttctttttattgatcaggtctgtaaatgtgtactgaaaaaaatcagagtttatttataaatagaatagtttatttaaagaggtattttcctccttgatatcatggtatgcataattctgtgtgttactgttgtgcacagccttgtttacagggaatggtctaagcataccatttcattcactgtattagtagacataactgttgagtagttactaagttgtgatgtagtgctatgtgacaacgttcaggtgtgtgcttttggaatgctctgactatcttgtcagcactgttgaccccacaggacagaataaaagaacctgtgcccactgtgctgtgtgtgacttgagaggctccaggggccgccgcctcctgggctgcttcaggggctgctgctgccgagctctgagcactcctgtctgactcgcataggatttagttgtgccaaatttgggtcagagcgcaaatcagaaggttatttttccaacacatggtgatatttatatttggacactgggcgtttagctctcttaaataagaagtgggaccagttttgaataaagtgtagcaaaactatgcagtgctagtcatttattttgtctaagtctttacgtttgtttttttgatgttgataatcataaaggcctcacttttactttgcctttctggtacagtccctgaagtgaacaacttgacgtaaaatttaggaagaactcagggtggagttgaggtaacactgtactcctgtaagtcacacagctttgtgagtggagaactagtctgcactgccttatccgttagaaaatcagccgtcagcagctttgctatttgggattttgcattttgtttcataagtaattatctactagtaacatacaaatgtctacaaagcagaacatgtgagagatacccctgccttgctaatttctaccctcaggaggtttg

SEQ ID NO: 23174 - DNA, 1233 bp, Mus musculus
tcagtgtgagacagttgcgagacagttgctaccaagattgttttgttattttgcagtttaactctgctgcctgcctctctgctatgttcttcataaacttgagctatcatgaatgtccttatagatcatctaggcatcttgagtttaactctgaagataccccgagatccagagacagaaagtcacctatggaaggtgacacaggtggttaacgagtatttaggattcagttagaattaacgtactggcagcacattggctaagagtgtgtaaagcagccctgtgttctgtgttcttggcctcattagccatctttcctagtttcactgctttcatttttgttcatcagaacagaatagaggtgtaaatccctcatccaggtttctgccagtcctaacagtggcagctctgtctagggtggctgaggagggctgacccttgaaggaacctacttttcatttctctgaggactaacacagcagttagcagggttgttttagtcgtcattaaacgccagaccctcaaaagtgttgttgatccttctctgttactgtgtgagtttctctgagaattcaatagaaaaatgaaaggtgtgtgagtgcatcctgaagccgggcctgcggagggagcagactcatttcactgagcaggagaaacaaaaagactagagcgaggagtgtatttcctctgctcagaggtttacatggtgtgttctatgaaaatactcagttgtagcgtggacttcagagtatcaaactgaagaaataccacaggtcaggtttgtagtctttgcctctaaaggtttggtttccagatgtggaatttgaacattctgtgggaagattcctaacaagattgtactcaaaaggttgggacaacattgacatcctgttggtgctgtcatgtgactgctacgttttttcaacagtggctgccccatggcctgaagtcgttcttgtttctgaagtatttgttcccaggttgtctgtgcttctgcacactgttagaatagtaaacacagctgaggctttgatgtatgacctgtgaatttctgttgtttacaacttgaagagcaatttcatgtagttcccaatcctcttctgagatgtccctcctccatccttgttggatgcggcttttttgcttgtcttctggtttgagggattggttgtttgagggagttattttcagcaagaactgggtaaggagtcaagaggatagaccgaggtcaca

SEQ ID NO: 23175 - DNA, 1147 bp, Mus musculus
ccccaatatgtattttaaaagtgatgaactagactttgccaaaagtttcataggaatagtttcaatattttgtctttgtgcaactctgttcacgttccttacatttttaattgacgttagacgattcagatacccagagagaccaattatctattactctgtctgctacagcattgtctctctcatgtacttcgtggggtttttgctgggcaatagcacggcttgtaataaggcagacgagaagctggagctcggggacaccgttgtcctagggtcaaagaataaggcttgcagtgtggtatttatgtttctgtatttttttacaatggctggcaccgtgtggtgggtgattctcaccattacgtggttcttagctgccgggagaaaatggagttgcgaagctattgaacaaaaagcagtgtggttccatgccgttgcctggggggcgcccgggttcctgaccgtcatgctgctcgctatgaataaggttgaaggagacaacattagcggcgtttgcttcgttggcctgtatgacctggacgcctctcgctacttcgtccttctgcctctgtgcctctgcgtatttgttgggctgtctctcctcttagccggcatcatctccttgaatcatgtccgacaagtcatacagcatgatggccggaaccaagagaagctaaagaaattcatgattcgcatcggagtcttcagtggcctgtatcttgtgcccttagtgacacttctcggttgctatgtctatgagctagtgaacaggatcacctgggagatgacatggttctctgatcattgtcaccagtaccgcatcccgtgcccttaccaggtaggtgctagcattggaatatgccactctttaccttcatgttcctagaagtgcacttgtcatggtcataaaagtagactttagttaaggagagctatcagacacagggagtaagccccggtgtcgtagccaggctggggactggcccaggagtgctttcttcaagcagtagctctgttacaatacagcaagtctcctgtaaatatttcaaacattaaagtgaaaacaacaattaagtcggtgtatgaaaagcagactatgaagaataggcctcatcataagaaaagaaaaagtatctactgaattgga

SEQ ID NO: 23176 - DNA, 1366 bp, Mus musculus
attcattaaagtattttaagatatgctctttcactctttatataaatccaagatttttctttgctgaagtatttaaaacttttgtacctttatatgtagatatgaatttgaaaatatgcttatgtgtatttgaacttttgaaaatcctagagaattgaatcaaatatttttatgatgtttttctactattttagctactttgcgactgtgatagctgttacactggatttttaaaaaacttgtacagcagcctctttacagtaaaaagagtgggtgtcacactgaaaggtctgtaagaagtggtcacagccacccctaccttccccaaaaggaggaacttggtggcaggtccctccctgattggactgtccctttctttctgcatgttataaatcagcaggtaagatggtaggtttttacaagttaggccgagctgtcgattccccttttaagtgttgaattaggattgaattatggccatttgtagttgctcgtgcctgtctttattttagtattttatttcccgagacaggaactcactgtgtggtgctccttggctgtctggtgttcagtctgtcccaggcaggtcacagagatctccccctctgcagcccactcatctctcccaagccaccacactcagcttttatctgttttaaaaatttaaacttaaaaaaatgtttttggaatagtacaaacacattgtgttgtaaatttctttgatgctatgcaaaattcctatctgcatctaagcctgcaaaagaaaatgtgcgaagggcagagtcagagttgggcaggaagagtgtagtgcagcagatgcagcgtgaagacactgaaggtgctaagacagcgtctcagtgctggtcctccttaaggattatctcgccagcgaggttttcttagatactttgatcccattggagctctgttaaagtttaaaatgaaaattatcatgtactgtatgggaaatgtaaatactaacttttccacatatgtaaacttcagacacaaatttttttgtgtgttcttttcatcaataaaattttctttgtataaaagattgtattgtgtgctaggtatatagtactgacccagaaacagtgtagccgttttagattgataaaggcagaagtcagaagcttcctttcagcggaggtaggagaagacagtgaagaacttgcatattgtcagtttcttccccaagtgtagttttatagccatattgcctacagtgtgttggagcccatgggaggcctgctagattaggcgaagcaagccggagtccttggatctgctcccaacagtggatcagatcatttaaccaaacctcctcagtgaagcagtcttgctttccacatactaaaca

SEQ ID NO: 23177 - DNA, 1209 bp, Mus musculus
ataataaggtattatctaactctagcccattttgaatggggatatttttgttagaaagaagtctgttatagacgtgctttagttttaatccaactggaacatactaagtacagaaattggagaagtcatggatttctctgagaaatatctagcaccttttgccattccattgcttaattatttacagtgagattctggacgcagaccttgtattttggccataaacacttagtgtgtggttagggtgtataaaacctgaacttgcaggatccggtgaagcctttatttagcatgtgtggctacaaatcactcatcagaaatgctggctcatgtttcacagagatggaatgtttgatgtaagcttgttgaaaaactgaatagaaacaagcattctagtttcccttcatttttagatttatggttccagattccaaataattatttgtctgcattggttgctcaaattcaggttgaaatacaaattacatttgtctgtggccattactggtttgatttctaagtcattgtagatctccaggtaaaaggcctgctcccgaaggatgctagactaatactaactcttctgatgagcaactgtcagtactgttgcactagcctctattttttgtaaataaatcattataatcaaagctgtatttaaagggttctttgaaaataagcctatttttttatattttgcaaatggaattgtttttaaaataaaaaatgaaaagataatttatatttacaaaaatggtgtttgctataatatcctttacctttattttttaagtatgtttgtttattcagcaaaattgatacattttaaaatcacgatacactgtaacaaaaagcaagtttttcagcatttacaaattcctggcatataactctttgaaatttggggacaatgaatcaatatttccaggaattcttagaaatttcaaaattactattttaaacacagtcatgactatatctacactttatttgggtatctcaaatttttgttacagaataaaatacactgaatttagtgtaagttagttacttatatagtaagtaaatacaaagaactacagcctacaggaatatttaaacaatgagaaatataatttgcaattcagatctcccaggtaaataacttcagaatgttttataaattatgcatttcgtagttgcatggggttcaccttgatacttatgtct

SEQ ID NO: 23178 - DNA, 1146 bp, Mus musculus
ctctctctctctttctttctttttttctttctctttttttctttttttggctaataccattttgagtaataacacctttgttttgttgccttgactgttttaatttttctatatttgtctaatataaattttcttaaaaaattgttttgttttgtttttgttttttttgagggaaggtttcactgtgtaaccctggctggcctggaatgaatttgaagactagtctgtctttgaactcatagagatccagcagcctctgcagtttctcaagtgctgggattaaaggcatgtaccaccttacccaactaactttttgtttttaactttgaaaagctttgcatttcataactgtgcagtagttatcagaagcacttccatgttactaacacacacacacacacacacacacacacacacacacacacacacacacacatacacacacacacacacacatgcatgtatacatttgtttgcttatttatttatttattgaagggtctcatgtatcctgttgcaaaggttgcctgagggtaaccttgaacttctaatcctcctgcctctccttcctgagttcttgcacctagtgcatacagagttgggaatcaggctcagagctttttgcatcctagtccagaacttttcacaaatgagcttcttcactggtctcatgataccacgtttgttttttcctgtaggctgatagctttttactgagtgtctctgagtcttaactcgagccataaaattattgaacagaattcataaggaagggcctattccacttccctggtaacaactgagctataccctgcctttatttggcttggtataattgtaataatttgggtggcttaaaaccaacagaaatacatgaaaaataattacatttcagtctatttatttgcagatttctgcactgtagaaggttcaaaatcaaggcatgatacgttcattgtatggcctcagtcttactttctggttgtatgtgtgaggtattcttgatataatctcacatggcaccgatcttggtataggttctacccatatattccagtcatcaaatgctccaccttctattgtcaatgtgaaatactggcaggttacaatgatggaagagagtgaggtcatattatttgttgatag

SEQ ID NO: 23179 - DNA, 1624 bp, Mus musculus
gaccttagctgcccagttgtaccccctaaccaaagaaggggaggtgtctgtgtggaccccagatcaccaaaaagcctttaaagagattaaaaaggccctactgatggccagcctatgcctgacctaaccaagcctttcactctttatgtgaaagagagagcaggggtcaccagaggagtccttactcagactttgggactttaaaaaaggccagtgacttacctatccaagaagttacaccctgttgccagcgggtggttttcttgcctgaaagctattgctgccataatctgcttgtcaaggatgctgataagctcactatgggacagcaaataactgtagtgacatcccacattcttgaaagcattaccaacgctcctgtgacacatcagagctttttgttgtctaaatgagtgaccttcgcttcattccacctgctgtcccactgtgtgagactgcacctactcatcactgcgctgacattctggcagaagaaatgatctgaattatcagatcagccttggcctgagggtacgagctggtacactgatgacagtagccttgaggttaaaggtaagcagaaggcggggacagcagtatggtggtgaacagaaagcaagtgatctaggccagcagccttcctgagggacgtctgcccagaaagctgaacttgtgactttaagacaagctctataaatggcaaaagaaaagtctacactgacaacaggtatgcttttgccactgtacgggacaatatacaaagagggctgttgacgtctgcaaaaaaagacctaagatgctgtggctaaagaaaatcagatgacagatctaaccgccaagcaggtggctcaaggaacaatgatcctgagagtcaaggagtctaaagattattatgacatcagagagaccagctttagatacaccgctgagcactatcaagctatggacagtatttggcttggcctgggggccaagaaattcaaaggtgtggttaggtcctttgactactatgttacaggactctctgacttggcagaagaagtagtcaaaagcttcaaggcctgtgctataatgaggtagaatttctaaaagaaatcttcccaaggtaatggacctgcctttgttgcccaggtaaaccagagactggccaagatattagagatcggttaagagttacattgtacatgcaggccccaaagctcaggacaggtaaaaaaaaaaaattaatagaaccattaagggatccttaccaaattgacagcggagactggcgctatgattagatagctctcctaccctttatgctcttcagggatagaaacacccctggacagtttagactgacccccctataaattactctacagggggcccccctccactggtaaaaatagcctttgtacgtagtgctgacatgctgctttcccagcctttgttctctaggctcaaggtgctccagtgagtgagacagcgagcaaaaagcagctccagaaggcctactcacgagaagaagacctgctacattagatgtctccacgcagaaaaccttaagactccggtggaaaggcccttatcttgtactcttgacagccctactttctacctttatgggaccccttttgat

SEQ ID NO: 23180 - DNA, 1322 bp, Mus musculus
agcttctcaagttctatggtaagggaacagatggctgcttttcctacaaaaatctctgtgcttgtgattattagattcatcaggtgacaaggtgctcctctcttgaaattacagctagaaaaattaagaattttgtttggtttaaatgagcaaatgtatacggccatttcatttttgtttctaaatagtttcaaaagtataaatatgttttatatgtcttggttatagattagtggctcataagttattggttatgattaaaaatttgtaacattggtaacaaaaagttgacttaaaactggtaactctgggttagagtaattcagaacatgtggcatgagccaacccatgggaacaggtctctaaagatacgcctgaattgggtaatattctgtgtaattcttatcctagaaatctgatttataaaagataagatttagggtagtgtctttgagatatattggcggctacaccttcttgtgtttgtgtgcaggaacagacagccaaactttgtagcaagtaatgtttttagagttcatttttaaagaaaatagattgttttcactgttaaaattgggttttgcttctcaaaattgtagttgtactctcatgttacaagaaaaattaaaagcttctcccgaaccggagccaccagctaaatcggctcctccaaaatctataaagcctcctgagtggcctagtccacaacctttccccttatccacagcctcaacccccgccgatgggaaccctgaacccctcagggtgacaagaggaggaccgctgcgggtacatgaaactgcaaaacacagagtcctggcggtctctggtagacccgcccaaacttttaacccttcagtactggtcattttcctctgctggtatttataactggaaaattaaccaccccctttctcaggatccccaacgcctcacagggttggtggagttccttatgttctctcatcagcctacttgagacgactgtgaacagcggttacagatgctcttaacaaccgaagagcgagagaaaattctgttagaggctagaaaaatagcccggaagccaacggcggtctacacaactacaaaatgagatcgacatgggattccctttgactcgccccagttgaaactgcaacattgctaaaggtagggagagcttaaatctatcgccaggctccgatctccaaggtgtctcaaaacaggcccactaatttggctaaggtaagaggtaatgcaggggccaattgaacctccctcaatgttccttgaaaggcttatggaagccttcaggcggttcactccctttgatcttacct

SEQ ID NO: 23181 - DNA, 1176 bp, Mus musculus
gggccaagtttaaaagaagaatattactatatagagcagaggcatctaaccttttggcttttctgggtcaatctagaaaaagaagaatcatcttagaactggagcaatggatcagaagctaagagcatgagctactttcgcaagttatatgcagataaaatactcatgtgcataaaataaaatgcaaataaaatttttggtaaaaataaagattaaatagttgttttcagtcactcactaaatacacaaacgcttatgaagcagatgaacaaaaataatgtctgtgtatatttttcataatattttctagcacagaaaaaagcaagagttctcacaaaatgatactaattatgtattgctctattcagagtgtatgaaatacagtagccaggtatgatagtgcatgcctataatcccagcattctggaagcagaggctggtggatctctgtgagtttgaggtcagcctggtctacatatagtgtgtttcaggatagccatggctatttagaaataccctgtctcaaaaggcaaaatcaaacaagaatgtaagacaaggtctaatgtaaccctgcctcccctggaacccattatgtaggatgaccctggacttctcccgctgcttcctcctgagtgctggggttataaatgtccactatcatacttggtttatgcagtgcacatcaaaccttgggttgtaacttactatgttagacaggactttaccagctgaactctatggcatgttcagagtgtgtatatgtgttcatatgtgtaaggctgtgtgcaggcctggaatcctccttgagtcttgacttcaagtccatcaaacttaatttttgaggcaggatctctcattgagacctgggacttgatatctgggctagactgtccagtgagtcctggggatcctcttgttttttctacctctcaagtgttgggagtataaataaataggcttcagtgcttgactttatatacgcactggagatggagctcagtagctcatggttacactacgccagctgagatctctccgcagctcatttggagagctgtttagaatcaagtcggtcctaattttagccatataatgaccacatttgagtaacagagaactgacttttttagctcttaactataaaactaagagatacaaggatgaggtaaaactagt

SEQ ID NO: 23182 - DNA, 1177 bp, Mus musculus
ctgcagtcctaagcttgtccctttgaaacactgcacccgagtgacagcagacagcagctctcaagtctgagagacgctgtgagcctccactccctaggaaggggaacttgagctggcttccattttgggttgataatgaattccaactagtttaaaggactgcttatatttggggaatgggattctgggaattgaactcaggacctcacacttcctgagcatatgctataccactattctacaaccccaggccaaaactgttaagttttcatgaagaataaaaggttatttctgaaaagaggagcaccctcttaaaaactacaaagaaataagagagagaactgattcgtgtggcttctataaatgtgttatcaaatcataaataaaaactgaatagtatattggggtaacacatttgctatagcttagagaatgtattgagagctttgagacataacttacttataaaactttaactgaaaaatgagtgaaacttatatagagatatttctcttttttaaataattaatttttttgcacttcatatattattccttccaacccgtccaccctccgactgttccacatcccatgtctcctccccatccccctgtctccacatggatgtccccacccccaaccccacctaaactccatggggcctccagtctcttgatcgttaggtgcatcatctatgaataaacacagacccagcagtcctctaatgtatgtgttgggggcctcatatcagctggtgtgtgctgcctgtttggtggcccagtgtttgagagatctcgggggtccagattgagactgctggtcaccctcagggtcaccctcctcctcagcttcttccagctttaggggtcagcagcttctgtccattggttgggtgcaaatatctgactctgactttcagctgcttgttgagtttttcagaggacagttatgataaacccctttttgtgagtgttccatagccttcaaaatagtgtcaggtcttggggtctccccttgagctggatctcactttgggcctgtcactggaccttcttttcctcaggctcctctccatttccatccctgtaattctttcagacaggaacaaatataggtgagagttttgactgtgggatggctatcccatccctcacttgatgtcctgtcttcctgctgg

SEQ ID NO: 23183 - DNA, 1132 bp, Mus musculus
agacagtaattccaaaattaagtaaagagaaacatttttttaatgcttaaaactaataaaaatagccctcttagaaaattaaccgttattaaataccttaaagcatcccacctccagggtgctaggactaaaagtgggcgccacaatgcctgacaagtctgctttttggatagctgccttatgtattatagttgtttggatagtgaataaaacatatttgagattatactacttgaaaaactttaaatcctaaaaatgcattccaaaaaatgataaaatttgattgttgtattcctgatgcttcatctaaaatacctcttctgtcttttcccttgccactctcatcttcatttataatgatccaccggctgacagtgtctttacatccaaaatgcaaaacagacagatgggcgtgtcggggaagaacttgaccaaaagcaccagcatcagtggagacatgtgctcactggagaagaatgacggcagccagtccgacactgcagtgggcgccctgggtaccagtggcaagaagcggcgatctagcattggggccaaaatggtagctattgttggtctctcacggaaaagtcgcagtgcctctcaactcagccaaaccggtaggaatttttatgttactcttgacttcttatttgagttgttgttacaatacgcatttttttttcatgtcattttatcacagtagtgtgtggatgctgacatcgtcaagaggaaaggaacagttttagactagttcatccctttgaaatgaaacagtgatttttttttttccagcgatcaaatgaaatgaaacagtgatttttctttttccagtgatcaaacagcctgcttcaaagtgaactttggccactgtaggaaatgtgtctttgctccccaggggagaagccctgtcattaatggctgcctctgatgcctgggaggcacctttgatctgtgggctttcgctttctcctaggctcctcactgtgaagcttaccacattaattttcatccccagcaatttgcaatggagatgacacctcatattttgtttattgctgacgacctaactttcttttcagcttgtaagcaccattcaccagtactatcaatttcctcactaagtcttcatttc

SEQ ID NO: 23184 - DNA, 1206 bp, Mus musculus
tgtcattctaactcataagataataaccagtttctagttcttacatgtcaatcaagaagaaatgctacctaaaaattttcttaagaaattatttttaaaaatatgtaaatggttaaacatgatcttttcaaagttactcatgtgggaaaacataaaaactgtacattgggtacttagataaagagttgtctgttacttccaaataataatgtgagaaaactgccagtgcaatttttatgcactactgtgaattcaggtcgctgtgttcactgtggatggttgtaagttcctgaagataaggaagtgtgcttataatcttctttttttccactgaggaaagtaatccaagtatttttttaatgtagttatatgatttagatgcagaataagcaagtgtgtttttgatcataataacaaattagatttaatgtattatagttgattaactcatagaaataatctatattcatatatcttcaggctttgtatatcatttctttttactgtaaaaactaattatataactcaccaactgaacacaaatggttttctaaaataatgtctctacagtgcattctctttggacttgtttccagtctgaagacagataaggaaccctaacaatgcctataaaagcaggcttaaggttagaaggggcttctaggactgagagattgcataagctttcgttactgctgtaactgattgccaaagacaaaaacaaaaatcatgtattacattcattttccactattccataataggttgctgtgacttcaaagggaggggagaaaaaatttttttaatttctcaaacccaaatcgtcattatgtaagtcataatgccaaataagaaagcaaaatcatacttttatatctatgctatattatctgtggatttttttagttttaaaaccagtggtttattactttttaaggttattttagtctttaatatattaatataacattgggtcttttagccaatctaagacctatttttggctatcagtattttcaaaggcatgagaagggaaaatgtcaatgtgttaacaaagtgacaggagcaagggcaatgctaatcaaaagcaaggtgtggcatttcagtcctccctctccagtgggtacctgggaagagaggcgtgtggggcatggtgaacacagaaagccggcctttgaactagagcaggtctcttgatgcttgtct

SEQ ID NO: 23185 - DNA, 1107 bp, Mus musculus
cttcagcagtgtgattctgaagtctggggatgttgaccccactgacctaggatgacatcatgttaactacccatgctcaccctcccttacactattacacttgaacccaactcctgatcacttttatctcctaatgagaagtaaatgctgtgtagcatccacagatacgaaggataacggtacgctgcaggagttaaggcatcctgtggactggatgctgggcccttccatggagctgcataaaagaaggaccatcctacctaggaaagcatccaggagacagtgacatttccagtgaacagtaaatgctgtgtgaggattgacttctgggtaagaaagcagcttacttactcactggtaaaggagtctgtgttctaatgtagagctgcctttgtcaaacaaagtgtatggataaggggctggagagatggctcagcagttaagagcactgactgctcttccagaggacctgagttcaattcccagcaaccatgtggtggctcacaaccatcggtaaatgggacctgatgccctcttctggtgtgtctgaagagagtgatggtgtactcatatacataaaataaataaatagataaataagtctttttaaaaagtgtagggataaaaaaataataaaacgttttgcagtatcttttaacctgagggaaaaaagaattggagtttaattgagctgaagatttctcttcaggtgcagcttaccatcctttcttctgggcgctgagatcaaatgacgctgagctccgcccatccttccttaaaggaaccacacatcctctcctgggctcttactccagagtgtgggtacatccaaagagaagcccagctttgccgcacagagggaccaaggcacaagaaaggacttgggaggaacagatcaacatgatatcctcatgcgatgccagttccatcgaatcccctcaaatcctgaatctatccatatgattggatattttgcttcggactcatttaatggtggagtactggatctggtttctttagacccatcatgggacttgacttacaggtgacactgatacacaagaaatcacgttctctcgtcatgaccaatccagggtcctagtccca

SEQ ID NO: 23186 - DNA, 1111 bp, Mus musculus
tcatcatcattgtaaaggtgctcctgtctgttcaagtctgggtgggctttacttgtgttcttctttccttgccacactctgcagggaaatctgagcagccagactgtgcctgtgatcagttccgctgtggaaatggaaagtgtattccagaagcctggaagtgcaacagcatggacgagtgtggagacagttctgacgaggaggtctgtgccagcgatgctcaccccccaaccacgactgctttccaaccctgtgcctacaaccagttccagtgtctgtcccgcttcaccaaagtttacacgtgtctccctgagtccttaaagtgtgatgggaacattgactgcctggacctaggagacgagatagactgtgacatgccgacatgcggacaatggttaaaatacttctatggcaccttcaattctcccaactaccccgacttttatcctcctggaagtaactgcacctggctgatagacactggtgatcatcggaaagtcatcttacggttcactgactttaaacttgatggtaccgggtatggtgattatgtcaaaatatatgacggactggaggagaatcctcgcaagctcttgcgggtgctaactgctttcgattctcacgctcctctgacggtcgtttcttcctccggacagataagagtacatttctgtgctgataaagtgaatgctgcaagagggttcaacgctacttaccaagtcgatggcttctgtttgccatgggaaataccctgtgggggcaactgggggtgctacacagagcagcagcgctgtgacgggtactggcattgcccaaacggaagggatgaaatcaattgtaccatgtgccaaaaggaagaatttccatgttctcgaaatggtgtctgctaccctcgttctgatcgctgcaactaccaaaaccattgtccgaacggctctgatgaaaaaaactgcttcttttgccagccagggaatttccactgtaagaacaaccgctgtgtgtttgaaagctgggtgtgtgattcccaggatgactgcggtgacggcagtgacgaggagaactgcccagtcattgtgcctaccagagtcataacagcagcagtcatcgggag

SEQ ID NO: 23187 - DNA, 1163 bp, Mus musculus
tgatatactactgattagccacacagtagagcttagtgtattgctacttgctaatgttaacactgcaatagtaaacatttgtatgtttctattttatttatttatttatatatatatatatatatatatatatatatatatatacacatatatacacatacatattccacagcataaattctatatataaaattgttgggtcaaggaaatatgtacaactaatttttctagttactgccaagttgcctttgagatgaggagtaattgagttctgtaatatagtaatacaataattgagaggtgtttttctgtactatgtcaacagcttattttagtagccatttctaaattaatttgtttaatcaacttaaagtgtttttcatgattgttatgatatataatatcataactgccctactcttatgattttttttctttttattgctgaagtcagtattaaataatgtttgcttatagaacattatttggtccctagtatttgctttgttgaagctgtatgtgaacattttcttccaggttttatacgttcctgatcctgaatatgtctctagtgttgagagttccccatccctcagccctgtaagccctctgtcgccaacgtcatccgaggctgaatttgataaaaccacggtgagtactctaccttcatatgaaatttaatttttcatgaagttatacttaacaaagaaacatgagataaaatcactttgaatatttattttctggaatttgcgcgcgtgcgcacacatacacacacacacacacacacacacacacacacaaaacacttgcacaggaatgcatgcttatatgaagaagtggtggaagggagacaagaatgggtaaagggagagagatggaaaccttgggactagaagcagtcctgaattcaaacttacatttcctccaccttggacatgtacactggcgtgcccgattatgagagcggcctgtagtaacccaaggtcaggtgtggcctgtgccacttgtgctttcactaatgaggaccttgtggatttctgagcacctgggattttcagactgagagtcaatctgcattatatttattgtcattgataacagtggaagtcagagttttatgatggatattgctgactagtaacacaataacaactgaaaaa

SEQ ID NO: 23188 - DNA, 1428 bp, Mus musculus
gaatttaagttatcagactttgtggtagttttcttacgaggagcgcttacattgatgtttcccagatggtaaacagttgatgaaaaacctcgatgtaatgatgtggtatatatgaaatgcatggtgtttgtatattctgttgatagcgctactttgctgtttttgaaaagcctcttctgtgatactattttattatttgcttgtagaaggtaaattgatacagtttttaatgtctaatacttttttattttccttaataacagagaactagatcagttgtcaggaagggggtcctgccattcaaagaaagcgacaggagtctctgctgaggacgcagacccgagagcgcgtgaccagggtaacgacagtgccagcactgctcccaggagcaccgaggagtctctctcggaagacgctttcacagagtcagaactctctcctatccgcgaggagctgctctcctcggagccgagacaggagaagtcatctgatgcctcgtcagaatctgtgcagactgtcagtcagatggaagtccagtccttgacagccacgtcagaggctgctaacgttcctgaccgcactagctctaaccctggggctctatctcatgaaactggcttaagtggtctggaaacagccactaaaggaggagataaagctacagaaagccttcaagaagtctcaggcccaaaggaacaaagcacagaagtaaaaggtcaggataaccaggattcttcccaccaggaaagttcactgcagcaagaggcaggtgaagacagtgtatcttctggagaaacagtagaactgaaagaaaaaccagctgttcttaaggatcaacaagggcaggagctaaaacgggactcagagacagaagtagaggagctgcgcaaactctggaaaactcactctatgcagcaagccaagcagcaaagggacacgattcagcaggtgtcacagagagaaagtaaacacagcagcgcagcagcagacgcacatggagagggtaagtgctagggagatgcaaggctggttagtctgtttgattgcatgttgctttctgctttctctctgagcagagactgctgacttaaggcagtgtgaaggagaagcaaaccactcttgactggctttattccgggaacatgtctgcagtgcctggtctctgaacttcttttctgccatgtttaagcactcctaatgcaaagcactttccataaagtctgtcttatgaacatgttgtacccacactgtataatacagtgattgctccattttcttttcaattatatcattacatatttaatgtccgaatttcaatttatagttaccaaagttttaattccataatttttgtaaaaagaactgtcgacagtaaaaatctacttctgcagttcttttacgtacgtaaaaatccgatgctcatctgat

SEQ ID NO: 23189 - DNA, 1133 bp, Mus musculus
ttgacattagcctttagaggaaaccaccttgaccttcacaactaccaagttttaaaaatgataatggcaaaagtagatgctttgaaaatgttagttagaaataatagtggttgaataaacgttatcagtagcaaagatcagtaatttaaaaccattgggtatttaataaaaaatctgagtaagggccagcaatatggcttagtaggttaaggcactggccaccggccctgacagtctgaactttgtcccaggactcagctgaaggccagcggtgagtttagctacactgtgctttggctcccagcaccttcccaggacctatctggattctcgaatgaaagacagacagacagacagacagacagacacacacacacacacacacacacacacatacacacacaccagttaattttaaaatgcctttgctagctcaaagactgggcagttctaatcctccctgcggctagcgcacatctccctcctgtaatcctggcttaacaccctctaattttatattttatctctgttgccctggctccttcggggcggctccctagtctttgctgcccgagacgcttttgggcagcccttccagggactgcattccttctcacctacatttgggatgattttccttctgcagctctaagtctgacccacctccctcggaatcatggtgattctcttcccttctcccagttcctcgcccacacaatctaaaagttccatccctctctgtccacacagccactggccatttattgattgatcaaaaaccaatagggggcaaggacctttagtgtttgggcacgcagattcctgattaattcaaagtattagaaccagtccccaccaagaaatgacacaatgtgttccacacatagctacacactaacattccatgtgtgcagattatacataaatgcagtaaaacctttgaaaaagaattgtttgctaccaacctttttgtttccgtaagtgttaagaatctaagtttcacaaggccctattgactcctctgtacattcacattcgtttgccaaagaacaaaggaatctgaagtaccttgagtgacgagtgacatgtctatattccttgagaactgccttcttgctgtgagcgtacaaaca

SEQ ID NO: 23190 - DNA, 1207 bp, Mus musculus
tggtggagttggcacaggtgacatttgggcctacttacatttagttctaaataagaaaccacatgccaaaataatacatgcttcatagacctcttctagttctaattcactacagcattctctttattcattttgtaaacattctctatttcattttaagaatgaaattggaggggcagtctgattggcatagaccacagcgcacacagtctgcaggtttgggcgcatgttttcatcactgaatagaggagaattgacagaggagaatgggaattcaatgattctattggatttaatatattaagcaagtaatactatttacatatttgtagcttaatagggcattatcataagtacaaaactaaaacgtgcatatttcttcaacattgtgtcagatacactgttttacagttctcttgttcagccttgttgcataccaactaccccaagacatttttgttttgttttgttttgtttcttctcaaaaggaaaaaaaattgttttgaaataaaaacgtgtttttttctaagtggtatatgttattagttaccattagcatctgctcttataaaagggcagtgactgtagtagacaatactgtaattcagtagacttggtgaatgtgcaagcttactgtcaagtggcctcaaaaacgaaaaggtagaataaactagcaattgtattctttcttgtaggaaaccaacaataagccatgtggcaacaattcgtcagttaaatttcagagcttcatgttatgcaaaaaaataaatcctgctgttatacgtgacagtgacattgtgctgaaaattcagctgttccacacaaatgttgtatatcttgtaaattgatgtctaaagatagttttgttcttatagaaagtgttgactgccaggttgcttatagcactttaaattattctgaagatgaaattaccagccaagtatgttggcttaagtagttttagttatataactcttaaaaatacctagttcttttgggaacagtttagataattatctaaagaaaacatactattaatcagaatctctggtgttgtatgacacgctgttgctaaagatgaatagaaacggcatcgtttcctcgtctgtgtaaagctctcattacaagttaggtaatagtgtctaggttagaggtttataatataatataaggaactgtaaataaatgtacccttcctattagtctt

SEQ ID NO: 23191 - DNA, 1099 bp, Mus musculus
cagagcaagacccaggatagccaagcttaggcagtgaaggatttggaaaacagaaagccagtgacaatgtaatagcacaagcgggtcatgttctaattcctgcaagcagcagaactcggcagcttcagtcatatggctctggctctagagttaagagtggaaggaactactgggacaattgatgctggttagctggagctaagaaattagcagtgattatgaagagaccagcatcactgaggtgaaatcttctgggaagtgttttctgggaacacaaagaagctgtgttcaagagatagccaaggtgctgcagctggacttgataatgtgtaagaatcacccaggtggtactggttttgaaggcatgaaagtgtcatgaagaacagctgaggctctgcactgtgagaggtcatggaaggccattggagaaggtatagcctcagctgtagttgatggcccaggactgaaggggtcatgcaaaggatttgaggtttggcaccatgaagataacctatgaaaggctattggtgaagcctagttggcgtggaacaccccagtgtattggagatgtcagtaccatgggatgatcaccaagaatagcagccacagtggagtgaattaacctgagcttagagtgctacagagggcagagctggagaagtgataccagccctcaggaggagtccaaatgatcaagtggaatcccagacactgaaataagaagctgtaacattgaaattgccttggagactcaaagatgttaaagatgccaaagccatggggtacatgctgaggaaagctgctaacagggagtggaaccagcccaggagaaagaagtttgttgcagtcaacaaagatgaaaaaggagtggagatctgaagactgctttgacatcggccatggagatgcagagtttggagtttgctcagctggtttcctgccttgctttggggattacagttaattagttagatgaatctcagaaaagaccttgaactttggacttttaacattgttgagactgctatagactatgaggactttgaaagttggactaaatgcattttgcattatgctatgtttaagcatgacccccata

SEQ ID NO: 23192 - DNA, 1168 bp, Mus musculus
tggtatgtggtgtatggtccctgtgcttccctaagactctataggcacttgccaccatgagactctggtacaattccactaagcatcagcccaggggccaatggactgttcctgtcgatgctatctagtgtttaaacagcattgtgcagtacaagacctaattcacctgaggtagaacatggtgttaagtgtaatattttattctggaatttaatgaagggtcagtgaaagtaaattttaaggagagcataatgatagacattgttaggcctgcctattaacagcatctctgaatagttctggggtcagagggcacgtggctctagcatatcagatttcatttcagcttccatcatctgtagctagtttcattatccttaggtcttggcatttactgtaacattatgcccttcatggtcatataggctgaagtcctgtcccagtgtgcttttggtcttgaacagctatgtgttcagggtatgaaacagcttggcagcactagtgatccagaatatgatgtacgaacctagaagtattctatccatggtgactctgtctgggggtggatcgaattttgcagtacctgagaatacaccagaaattgtggatgagacatgcaaatgctactggttctttctgaacatcacactgatggtgtacttggaacaaatgtgggcttaggttcccttttagtagtctattaatgatcattctgcaagcaattcctggctatttttgacccacactctatctaatgctgtgccaggcagcactgaaaccatagaacgtgtctccaggcttggaagaagtgaattcacaactttcatgatttgagaaaacaagcaaaaataaagactaggaagattacaacatgtgcctgccccatcagtgcctgatcagctatgcatgcgaacagagaattaaagtttccaggaaactatcacctcacttgataacacatgagaaaccaaatggagagtaatgtatgtgggagatggcccagatagagcatttaaagccaccatcttaataaaatgcaacgggctggggaaaatacagaccaatgcttcaatactccaatgaacagagttagcagagaggtctaaagcaatgaaaatgaaggcaaaaatatttaaaggataaactcagtgaaaaaaaaatctgatag

SEQ ID NO: 23193 - DNA, 1163 bp, Mus musculus
aagtcccatgcctctaaattcattcaacccagttccattgaaagtgatgctgtaatgtcgtcacatgcaatctaaagaccatttaactgaattgtgtaagcaataaagtgctcccatatgcttgtcaattgatgacaatatttagttaaaagaatctatgcaagaaaactgagtttaagaaactgattataaagaccttccaacatctatggagcaatgataagtgacttcctaggctcctgacgtgagttttctagctcactcctaattggcaatagtgatggtactgttgttgagtttcttgtcatcggattctgctgattttacaggttgttattctctcgtactacttaaatgtaattcttaaatgcttacactcttaggctaaacgatgttagatgttttctttagttcacactgaactatatacatgaaaaattgtgggaatttagtgaatattaagtaactgttgtatttttaccttaggtatcttaatgcaattcagacaatgtgtccacatattctacgctatttgactactgccgtcataaccaacaaagatgtgcggaaacgccggcaggtgctgaaagatctggtgaaagtgattcaacaggtaaaaataaacttaaagcagtcagacagtaggtgtgatctctaaatgctggggtaggtcttaggggaaaataagtaaggtgagagggaagtctacatgaaactagagagaaattagcaagccctgagcttacttttgcaaaatcataggtgtccttatgaccaatatggtatgagtgattagtgcttggtggagctgcttgttgatgggttgtggagttgctgcctgttccagatggtgaccattatcttaatgtggcaaaagcccctgaagtttggcttatggagcttctcacttgtaaataaaacaaaacaccgaaaaagcccaagaaatcagatgtaatctaagaatgcatttataatttggacatgtgacaaacttaatgtgttatctgaggtaagggttcgattgggtgctttgagaagatgatattggattagctgtgagttggcattatgttaaacagtgcttaacaagatctaactggacatttggattacttttttaggagtcttacacatataaagacccaattacagaatttgttgaa

SEQ ID NO: 23194 - DNA, 1930 bp, Mus musculus
ttttttttttctcttgtattttggcaggttacgtccaagcctcaaagagagacaagaaattttttgcatgtgctccaaactactcgtatgcagccctttgtgagtgccttcgccgagtattcatctatcggcagcccacccccatgtccactgtgctgtacaacaggaaggaaggcaggcatgtggggcaagttgctaagcagcaggtagcaagcctagaaaccaatgatcctattttaggctttcaggcaacaaatgagagattatttgttctcactaccaaaaacctctttttaataagagtaaatacggagaattaatcctccaacatttgtctaaaaagtatccagtggtacctggagggctgaacagttgtactataacttgataagttttagcatgataaatgagaataccttttatgaagttttatttttaaaggatactggaaatgtattcagtagattatgaatctgtaaaagctgtggatagacgaagctacaggattagagaacaccggcttctgtaaaaatatggagatattagcaaatatagttattttttaaaacctgagatcgaatctcatcttttatatgaaacatacaattcagtgtttacaaataaaaatatttatcatgtacttagctcattgtttagattggtacagtcattatgtagaatgtttgggtagtagtaaaatactgagtattataaaagtattttaatgggctgaagtctatatacagaattgctttaagtctgtatagatttgtaagaatacagcagttttgacaatatttgctttcaacccttgttttacagcaagcagaaatttatttatgtctttcctgtaccacattggaaaaggttatacattttccattattgcataacaaagttcaacaaaactcaggtctaagagtttattccagtacatgggaaactaaagctggagagttagcagttcaaggctagccagggccacatagcaagaccttatctcaaaacaaaagcaatttaaggtttatggtttttcacgcttctctgagatgtctcttgtcctctagtagtctaagctctgcttcctgacatcatacagaaacacattctagagcaaactagggtacaagaggttggagagcctggtttctcattttttgctaagaatatggacaaaatgagtcgcatggctacgtctaaacagacagtaggtctgtgacacattagagcccttgttgggacagtcacacagaatagattttaacgcatttgtctaagttccccttacttttctgacagtttatcctatttacacatgagtttttttcccacaaatatttgtggttcagacttcctctccaaacttccttcaatttgtatccagtatggattgttgtgtttttattttcatactaccagaagctcatgttttagaatgttctcaagagcttaagaggcagcaaataaagattatgtcgtggacaatacctgtagtgatgtttgttttgcctatctggaacaaatacctgcctggattagattaaacaagtatttggtctggggagattgctctgttggtaaagtgtttgccacataagcataaggaccagagtttagatccctgtcacccacattaaatatgaacacatagaaaagaaaaggaaagaaaaccaggtaggcatagctatagtcacagcataaggtacagacacaggagcatcattgccgtccacacagttgatccgaacccgtgagctccaggatctgagagaccccatctcatcagagaaggcacagaatgagcaaagcacttgatgtcaatatttggtcctcatatgcatgcatacaaacatgcacatagtctcataaacatacatataatatagatatgtatataagtatatatatatatacatatgtgtatctatac

SEQ ID NO: 23195 - DNA, 1190 bp, Mus musculus
tgctctggctaggacttcaagtacaatgttgaataggtagggagagagtggacagccttgtctagtccctgattttagtgggattgcttccagcttctcaccatttactttgatgttggctactggtttgctgtagattgcttttataatgtttaggtatgggccttgaattcctgacctttccaagacttttatcatgaatgggtgttggattttgtcaaatgctttctcagcatctaatgagatgatcacgtggtttttgtctttgagttcatttatatactgaattacgttgatagatttccatatattaaacaattcttgcatccttgggatgaagcttacttgatcatgatggatgattgttttgatgtgttcttggattcagttagggagaattttattgagtatttttgtattgatactcataagggaaattggtctgaagttctctttctttattgggtctttatgtggtttaggtatcagagtaattgtgacttcatagaatgaattggttagagtaccttctgtttctattgtttctatttattggaatagtttgagaattgaaattaggttttctttaaatgtctgaaagaactctgcactaaacccatctagtcctggacttttttttttttttttttttttggttgggagactattaatgactgcttctatttctttaggggaaatgggactgtttagatctttaatcttatcctgattttactttggtacctggtatctgtctacaaaattgtccatttcacccaggtgttccagttttattgagtatagcctttttgtagtaggatctgatgatgctttggatttcctcaggttctgttgttatgtctcctgtttcatttctgattttgttaattaggaaattgtacctgtgccctgtagttagtctggctaatggtttatctatcttgttgattttctcaaagaaccagctcctggtttggttggttctttgtatagttttttttgtttccacttggttgatttcagctctgagtttgattatttccggcattcaactcctcttgggtgaatttgctttcttttgttctagagtttttaggtgtgctgtcaggcagctagtgtttgctttctctagtttctttttggaggcactcagagctatgagttttcctcttaggaacgctttcattgtg

SEQ ID NO: 23196 - DNA, 1102 bp, Mus musculus
gtaaagcagctagcagggttccacaaatgttgattgtattccctcatcatttcctttggtccaggctagagaagagaaatgaacacagtagctctacatcctaattttggccataaagttataaagtagactcaaatagtacattttgtttccttggtacatttaagggtaatgttatcacagtaagctctgttcagttccagctttttagaaaagatggatttggcactatccagttctaatataccctagtattacagctctttgtttgcttaagttatttacctgaagtataaacagacttctataatctggagattaatacatttatgaggctataaattttcattaaaaaagaaaaaagtttcctctttttatttaaagaccagtgtatactctaaaaacatgattttaacccttcctctatgaaaatctttcttacagataatgattttaaatgatatgatttgttttttgcttttgcataagaggtaattaaagaaaaaggactagaacacgttactgttgatgacttggtggctgaaatcactccaaaaggcagaggtaaggagcacaaactgtcaggaaaccggcttttagtagggaaaaaaatcctatccaaaagcctttccaaggagttgttgttcctgtgagggaagttgaagagcagttgcctggaggactggtgtagcagtcctgactaagagctgaggtgataggtataagtcggcacttgtggtgtacagtcttagattgatgactggtaaggcagatcagttttaacatgagatcttagggacgtgccacctaaagctagcacttatacaatttattaaatatggcctgattccacctaaatattaataattcaacatttattccagtcctgagtcattgtcctactatctctttccttattaaaaataaatgaaactgtcttcttgattgtctaattaagaatttggtaattcacggtgatgcatatttaagacttagaagtgaaagcatctaaactagatgaatttataggatatctttacacatagccacaatcaaaatcatttcaatataaaataaatgtgtggagatgactacagcatat

SEQ ID NO: 23197 - DNA, 1324 bp, Mus musculus
ttgaagtttttagggaaatgagaaaattaagacattaaatatttattccttgatttttaagaaggcagctttcctataatttatctgtagtattttataaaagtaaagatatgaatatctttctttttaggcagcagaaaattgcagacagagagaagagagcagcagaacaacagaggaagaaaatggagaaggaagcgcagcgcctgatgaagaaggagcagaacaaaatcggtgtgaagctttcctaacacaggctatgctgtgagcgtgccaggaggaggagtctgggcccacagcctacacgcaagcatttgtatgcactggacagtattctcagaatacaaacactctgcttgatcgtaatgtgtttattgagctgttcaggacaccaggattctcccatgatactttgaactattagtaatcaagactcaaaacacaaaaataatgagacaattattttcttcaatgtgttccaaatagaagacaattgtttgctgtagagaagttatttcaggaggaatatacctgacaagtacctctcaagctagtgtttctagctgaataaatggctgtaaataattttatggtgggaaactactctgctatctattatgcttttgttcattgtgcataattataaaataattttaatcttttgtttccatgatcacttgatgtaaattaggtaaactgtaggtagggctttatacccttcttaattttgttttcaggtactgttgacatacattttctataatttgaactggcattgtttggtacaacattaaggaatatgataatttgggtttttaagaaaataacattaaatgcaataattttatttatcaaatattttgtatatccttattttcttttaaacagtattataatgttatacagagctgtaatttatatattgcatgtataaatgttgaaaatcagctgcaatgacaactttgtgtgacaagaactaggatcagtagcttttctctttcattacagatgtcaagatggtaacagtgtccatccttaaaagccattttcaaatgtggaaagccttcagttttcattgattttttttttttaagtgattcttgaagagttctctattttgttttgttttgttttgggtttgttttgtttttaatcttacataatataatgcagggtacctattcttttagctagataacattactgatttcattacaaaccaagatataaatatttttgtttgtgatattggttgatttaaagaaataattgcatattgtgttttatggaaaacaaagcacatctcacagtttaaaatacatta

SEQ ID NO: 23198 - DNA, 1177 bp, Mus musculus
atatttgcctcgtcatctgctgtgtgtatgcacccactggaaagtcactggagatactctgacaaagcactagaaacgatttgcttattgaaagttgtgactggaagggtgatggaaaataagaaacttgtgtcacccccatctgcagaccttttgtccctgactagactcattattggccacctgcattggtggccatgggcaacaacaagggggatgactgtggtgaccttcatgaccacaaattcctggagacagagccaggaatgcaaaccaattttcaggcaacaaaaatctatatccaaaagttctggtgagtattttgtatgcctcttcatttggtaccattgctgtgttctatagagaagttttgttcttccttgtaatgctagagttaaaagtacttggtgcagaggttttaaggccatggacttaaagaagaaaaaagaaacaaatttcagatcaagctgaaaactaaacttacttttaaatcaatgcttgtgtttgagtcttgaggacactacttttaggcctccttttgggacactatcgggttcttagacatttgagcagatggcaatcctactatctagtaagcattgataagtccttctaaaccacccatgccagtatctgcacgtcttctgctatcctttgtcattacaattatctaattacctcaggttagttttctatatcctcagttcaaatcaaggctgctttctgctcccattctcatctgcttcacccccacaaatacacagttattctctttaactgactctaggtaggatagatgagtcgctttcactgcaatcaagcacagcatcatggaacagctggaatagtgcacacacagttactccagacactatagaaggccctagtgctcatttggcgaggctgactcttagctgggatggctttggggctcagccacagagagcatctgagaagtaaacattcaacagtcaaacagaatcttctgactctttagccatctaaggctgctacaagctacaagtgctgttcagaaaaggaacttgttttaaatctgttgaaggcaaaggcttacttatattttgaaacagaaatgttcttaaaaagctagaaataggattttcatttttattattataagttcagaactgatttacttctattttgattgacactc

SEQ ID NO: 23199 - DNA, 1123 bp, Mus musculus
acacacatatttttacacatatatacccaaaaactttaggagggaaaaacaataaaagtctataagtctgactactcaaagttaaaaattaataatttttcatataaataagcatcatctatgcaaatatgtgtgtttattgagaatatatactctatttttatagcaagaaagttgtcccctaatttatataagaatttgtgttctctgaacaaaccatggatttctcaccctatctctaaatttcaggcatatcttgacaaagaaaggaggccttaagacttttagatagcagcaaaagaaggcaatcacatggtgagaaaaacaaaggagcaacaagttttctggcctccaagtcactgggaagcttggccagaataaatgggtgtgattaagaggtactgttgtggagtccctgaagttgctaactactgaatcttcgccctgagaccaatgaggaaaacaatcttgacatatatataatgagactgtttttctgaattcaaagagaaagatagagtccactctcttcttttcttttgactctagctctattgttttcaatctatgtgaagaatggaaccaccaacaactaccaaattgaactctctagttctttgaaaaatataaacttgagattaatgtaataagtagccatgttacctgttacagatttgatctcctcggaagaactcaggaacagtatacagtacagtaatccaggacaggattgataactttaaaatcttccctgttgggttagtctatcagcaagctctaggccaaatgagagactatttcagtaaagcaagatagttgcctttgacagtacttcaatgtatttcttgactatgcaagcacatgcacacatgcacgcacatgtgtatacacagacacacacacacacacacacacacacgttcatttccagaactccacaggtagggatttattgcaaatgtgatccaaagtccttaatgcacattaagatttttttttttatcttaggcttgcacaggttctgtgcctgctgtcaaaattactgtaaggtctactgtgtagattgattgttttgttccagagatgtttcattttattcacctaccaaatccagctcttagac

SEQ ID NO: 23200 - DNA, 1156 bp, Mus musculus
acaagagagatgacagttacttgatctagtgacagaggcagaggagatgtattacgagaaagagagagagagagagagagagagagagagagagagagagagagagagagagagagaaatttgactagaatttccacagtggttggaaagacaaaaaaaaaaaaaagacaagacctagaaacctgggcaacagaagatcaatgtgcttaacagaattaagtgagttggagtaccgagcctcagctaaaaaaggttcagatgtgtcagactaaagttacttatttgggataaacccttcgagatgggaagcactggctaaaggaagccagaaaaagactaactcagatccctaccccaactacaccaaggcaagtaagagaattcttgggcactgctggcttctgcagcctctggatacctgggttggcgaccttagctgccctgttatatcgcctagccaaggaaggagaggtgtttgtgtggaccccagatcaccagaaagcctttgaagaaattaaaaaggccctactgatggccagcctttgcctgacctaaccaagcctttcactctttatgtggaagagagagcaggggtcgagagaggatttcttacctagactttgggaccttgaaaaaggccagtggcttacctatcgaagaagttagaacctgttgccaggggtggttttcttgcctgaaagctattgctacaatacctctgcttgtcaaggatgttgataagctcactctgggacagcaaataactgtagtggcaccccatgcttttgaaatcactatccaacaatccccctgaccaatggatgaccaatgctcttgtgacacattatcagagctttttgttgactgaatgagtgaccttcgctccccctgctgtcctcaatccagctaccctactgtccaagactgacttaatcactgcgctgacattctgaacacgaatggcagtagcttcccggttgaaggtaagcgggaggcgggggcagcagtgcagtggtggacagaaagcaagtgatctaggccagcagccaccctgaaaggacttcagcccagaacttgtggctttgacacaagctctacgaatggcaaaagggaagtctatcaacatttacactgacagcaggtatgcttttgccac

SEQ ID NO: 23201 - DNA, 1253 bp, Mus musculus
tcccttcccttcccttcccttcccttcccttcccttcccttctcccttcccttcccttcccttcccttcccttcccttcccttcccttcctttcctttcctttcctttcctttccttcccctttcctttccttaactatttcctttcctttatcactgattccttttattttacctcccttttcttttcctttttcttaaaaaacataaccctctttaacccggggatcaatttgggagacttaccagtaccaccgttcctcagctgaagagttctgaatccacgcagttggatccttttcagcagtctgttttgcaggaacactttattaccaccgttccccatctgaagagttctgaatccacgcagtcggatacttctcagcagtctattttacgggaacactttattaaccgctccttcccgaagatgcagttctgaatcctccctgtagcaggggatcttcactcatgcctgaagatatttcttttttcccctgggatgcagtttcacgggtttcggcaccatttctatttctatacgcattaggacccgaaagatggtgaactatgcctgggcagggcgaagccagaggaaactctggtggaggtccgtagcggtcctgacgtgcaaatcggtcgtccgacctgggtataggggcgaaagactaatcgaaccatctagtagtgggagagctactgcatgtaagatgttggttttgttctcatcatatgtgctttctttctaactaaatgcaaatatttcttgaaatgaaattcagctcttgtgggaagccaaaaacgccattacaagatggtgctggctaccactggccaccgcccatgaatatggctaaacaaccaatgtgggcatgtgcataagagttttttaccgagtcactgcctgacctgacgcatattaaagaggtactggtagcataaccaatcaggtatggacatgtcactcctaggcctatacaagcagcaccatttctgggctcagggtctttcgcctatgcagtcaatgctctcccaataaacgtgtgcagaaggatcctattgtggtgtcgttcttgctggtgagtccggtgcgcgctattatagatgatgttagaagacatcaagaagaactttagtaactcacttaaagaaatacagaacactgctaaagagttacaagtccttaaagaaaatcaagaaaacacatccaaacaggtgatggaagtgaacaaaaccatactagacctaaaaagg

SEQ ID NO: 23202 - DNA, 1134 bp, Mus musculus
ctctcaaaagaaatgttagcatggtgagcttatgctgtcctgcacccgagcaaagcaaggataacaaccataaaaaacaatgcttaacctttctcagacccacaagtcccaaacctggatcccagttttatcccataatttcttcaatacaacaactgcaaagtagaactctttctttctgcgcctcaggttcctcagctgtaaaatggaaagtatattaataataataataatattaaaaataataatggtaatgtagtacttgtttgtaacgcactttgagatccttggttggagggcaccataagagtgtcaagtattattatgtggccaagggggttatttaaaactctggttcccacgggccgagaaagtttggcatcatttttattaaagatgagctgtaaatatcttttctaagcagcctatagtgttggctatgaagaggcaagactataaccaggctgataagaccatagttttttaatggctaccaaaaaggcacgtgtcacaataacaaatgctgaattctttagggtgtaatatttgacaacatgattgatctgggggaggggatgggtggaaaaaaacatctcaaaatgccaatgtaaaactaacagcaatattcaccagcagaaaatgtctttcatatggaatgatttcatgttgataagaaaaagcattcaatttgtagtcctgatttgaacaccagactgtggggtataatagttctgtttttacaacacatggaatttttttttcattttatttcattttgttttcatagtgcatgttcatttcgactcacaacatgttcttggtgtatttcttatgcaaacaatcttcaggcagcaaagatgtctgttacatctaaacttgaataataaagttttaccaccagttatccatgacggctttggtatggtttatatggatctacgttcatccaggcagcaacagaagctacggatccttaacatatcaatgagctctgaacttaaataataaaactgaaaccaggtcacctattaaaaaaaaagtcactaagatgtactaagctggattcttttcaacttgatttttcattaaccaatctgttacaggtagatttttctgctaaaaaaaaattatact

SEQ ID NO: 23203 - DNA, 1178 bp, Mus musculus
gctgattttctgataagttgtttatggagaagggctaaggtactggaattgcatcacttttatgcgtggataatattaaagcagtgcatgcgagtgagcctttggagttaaaaccagtttccttccattggtataacatgttttattcagagtatgtcttatcaataattgagaacgaaggagagaaaggagtcataatgaatcaagaggaattagtaatagcaacaatttataattgtctagtgattgttagttgctgtgtatgttctaatcaccgtattacacattgttaacaggcctctgaaacagtcactatttctaatcattgtgtacctgtgtgaacaatatgcacattatttgctgctaacctccctagttactacttttaatgactttctctctgtgtatggacagatgtgcatcgtgtattgctaacagcattgtgaagcacctactatttctaattgctctctgtgtgtgtgtgtgtgtgtgttgttctctctacaggtctttccttatggcatgacttttgtcctatatattcatactctctgtctttggtatttctaatgcctgatacatacagaaactcttgttccatgaatgaattgcaaatactccacgcccttgaaaaatagaaatgcacatatatgtgtgatgaaaagataattttataagatttccctgcaaatgtatcatgcctaagtctttttccacaccccataatctgttgaagtctcttgccttctctactgatcctcttgcaaccaggctagtgcctgttcttctttcctgtgcatcccaaagccatgataagcttgcctatgaaaatgatgtcctagttcaagtcatctaattattcaagatggagttttcattgagctgattcacattcgtgtgcgtagccacacctttatcataaaacatagtggaatttggcaaagtgtttttctgtttctcatggacagatgatatgtacttttgacagattttaatgatggtatataataaatatactgagaagtcattaagctattaaaaacttgaacagattcagactttaaaagacacagtttctagtgctgtgtaaaaagccactgtaaacttagccctataaaaatactatatttacttacgtgcatatatatatgtgtgtgtgtgtgtgtgtgtgtgtatat

SEQ ID NO: 23204 - DNA, 1179 bp, Mus musculus
gacctaagtcaaagcaaaagaattagaggtgattggatacaccctgtaagaagcaacagtgaatctattttgctgccagctaccacagtgtagaaaaactggagcgttttcaaagagcgagaaataaggaattgatttaattttttctataagtgtttatgggactcagcttagctatgatggatttttaaatgaaacttcaaatgttactttttgagatccacgctttagaactgaaatcaggtgaagttattattccaggaagacattttatgttgctgaaagatttggatttagtagttttcagtcattggttgaaaatcaaccatgaatgagatttcctaccgctcacagctcccaagacagcatgagatttgtaggtttcagtgttacactacataacattttattagcatattttcctacaaatgttctgccttttgactaccaagtcacctttcaattcctcaccatctagctacacctagagcagtgtccacacatctgcgtgtttggggactgaataaacagttgggattaaatgaaagaaacgtggagtgaaacaaataaaatcctgggactgatgtgatttaaaatcctcatttctagtgagtattcaaaggactttgatgagaaccagaagagacaggtgggtactgactaggccgaggaaaggaggagacagttataaattggaggttgctaactctgagagtcagttggctcccaaatccaaatatgtgactgtgggacaatgcacagtaggagaaatcactccttaccaatatatgtgctcacactcgggtgatgtgtggtttggacacttggcttgacatttgaagtttcttatactgtcaagaatatgtaccaggctttatctgtcttctaaaatgtacacatctgttttcaactcaggaaaatgactgagaggcaacctcttgttcttcttcacatcgagttatacacggggaatgattttaaaaagtaccatttcaatgggattttattatgtagtatatcatatagactttatattataatagagactaaatgtacagttttacagtcattagaaatcactcaaaggtgcagttctgcatgaataagttcttcttatggaattcaggaaggtgtacgatagcagggtggacaaggagttggttacgttttaagtgatga

SEQ ID NO: 23205 - DNA, 1177 bp, Mus musculus
aacctgtgcatttcctgttagtactttattaagtcattatgtatcaatcacagtcaccaatgaggcagttactctgaattttagctgttttgtccatagtaattacagaaccgaaatgtccttatatgttctgtggactgagcaatcctttctcaccaaacatggcctttgagagttttctttttttcttttctcatcaaaactataaaacaaaataatagagcattcagtatgtaatttctgataatcacaatatttttaaaaatatattatcagtatgaaacattgacctacttaagaaattccatcatattggtaaatttattctagccaaatttatgctgattaccttaaaatatgttgatctacttttataaatattatatttcattaattacatttaaatccacacaaagggcattacatttactatatacttgcatatggcagaaatatgcaagtttgagtaatcacacattcttacaacgtccccacattaaatagcaagggaaatttaattctttgactgtgcttgttaatgcatttatattaagtttctgatatttggatactgactcccaaagaggactttagttctggagaagtatcagatctcctttgcctcagtggggccctggcaacatttaatgaggtgagtttggaaagtgagtatgtgtctttgtcttccaactttgaatttccccttcttaccacggccctgggaaactcgctgtactctcttgcgttcctaacatatattccatgtagactgtgttaattttctcaaatctgtacatgatcatctctagaggcacccttctagtcttagttggtaataatttttgtcatataggaagtgcatagaaaaacaaccatcatgcatattccatttttcctacattgatactgacaagtaatgctataaagatcatgagacagtagaagacgtacacttgagcatgcaattggagcctcagccctttcttgttcattccaggaaggatttgtagtcattaaactagttacttgttgctgatgctttgtttggggtttgactttcatttttttattaaagtgtaaaagtttgcaatcctgtcctatagtaatttacggcaacagtaaattaacttctactaagtaatgaatggcaaatgtatggtaaaaatgaatcatttct

SEQ ID NO: 23206 - DNA, 1101 bp, Mus musculus
tcccaatcctactgttttgtaatggagtctacccacttgacaacatctactacagaacaatttttagcttgatatttactcctaataaaaacaagttgaataataggtaatattctcagcctttacatagctcatacacacttagctttgaactttttcctttttttttcacactatgaagcattttaaaagcttttctttgctaaaaattccccttgttcaacagcacacattgtataatgtgtttaaacagtgaacattcctgcaactttttcacatacaaaattttaatcatatttgaaaaggtcaaagctagctatttagcctaagtctattatacataattcatgtatcacatatgcaaaaacagcactcagtacccgatatccactcactatcttatgtatatgtgatatgcttgatttaatatttacatcatggtgacttcaaaaacaggcatatcatacatttgatagcttggtggccatttgttaatgccctatttaactcagaatttcagcagctatgtagtgactattaacatttaaatgttgtgtaacttgacaaactatacatgaattttgctgtagaatcaataggatgagcatctcatttattgtttcttaaatcctacatactaaccaaattatttttaatatatactattattttagggggccacaaagtaaaatcttttaaaacaaaagaaaatacttcttaggattgtacataacagtaataaatttaggtatataattgtagtgttttcaaaccaatattatcaaagcagctataatagtacaaagatataccttagttatataagctcaaatgtacactcttatctagataattttatattttttattgtaaaagaattgctgtacatataaatttttaatgtaaatttactctcttggaaatctgggatccttagaactgatatgattgattattcatataacaaatcatatcaaggtgaatttcaaatgttaccatacaattttgtaatgcactatacacacaaaatcactatgaactcatagtaaaacatgaagttctttctaaattttagaaaaccatattttgagaagtctcttc

SEQ ID NO: 23207 - DNA, 1135 bp, Mus musculus
tgttgctcttacatcttttttttttttttcacacagaaatgtatttgggctgaggcaagggtgcttctgacaagatagatcacccgcctttggtttctcagtgccacatggttaaggagagaactcaccaagttcccattgttatcctctgcccatcccagtatactaagtcaagtgtaacaccagacctcaataaaaaatgttccataaatctttaactaaaatttcaattctaatctctctccctcatttctaaggtgtgccaaataatagcaatatttctagctggagagatggctcagggtgatgagtcgttgctgcttttgcaggggatccaagtgtgattccaggcatccatacaggctaactcataattgcacttaagcgaaacccagggaatgcagtgatctcttctagcctccaaagacacctctgcaaatgtgcaaatgtgcacgtgctcatgtgtatacacacatatccattaaaaaaataacttttttgaaaataaaaagctgaaaagctgtcgcttttgttttgttttgggttttgtttgttttaagtaccaccttttaacgagatcaagatgtgtgcaccattaggacgactaagccacaatggatgcattcattgttcttctttgctcctcctccactatcaccaccactttttaacacagaatgtcatttaccagtggctgataatagtcagtgcttatgaatgtaactgtgtgatagaatataccttcttttcgtcctggcattataatgatgtgcacagttccttcctgagtatctgttgggaagttccttaaagttattttcaaatgaaaagtgtggggcactgagtcaataatatgtcttctcatagaacttctttataagaaggtttacaacatagtcgtgagaattattatccattttaacaaaaaaatccagggcatgctaaaacacccatcatgctcaatttttagtgtctgtaaatgatttgttgcttagataaatatgtaccaggtatttcaatagaagtattaatccttttaatctttatatactgattataataatctatgatcagtagaactgatagaacttatgactccttatttaaccagctacagtaacctttctaaaaagag

SEQ ID NO: 23208 - DNA, 2173 bp, Mus musculus
ctgtatcctcaaggaacatgctcacctcaggccactcccattgtagaaccgtaggtagatgagcctgtatgatgtacagtatagctttttttaattacatcatgacttttggggggtctcagaggccttctatagtttctatttaagagggaggatggtgttatgtggtattggtgtccattgacacttaacaataaatagtgtacacttgggtggtctccttcagatcacctgagcctcctcctggcttccttttccacatcactgacatttccgcttggctccgagttgttctaatttttttttttttaactatttccagtgtgtcacccttcctgcctccttccaaggacttggaatgataagtagttgattaagcagcagactgaaagccctagcagtgttgcgatcaggccaaggaggataaaacttcgcaaaacaactcctccttctcagttcctttacttcccgtaaattccctgactgcaagtttctattgcaccatttcaactgccctttcacttcctctgcattatctgccaacgtaggagaacctcagcacaactaagtctttaatgaatgcctcaatgccttatcttctgatttagaagttttaaagtcggccatttacttcatttcagagaataggtgcgcacacaccttttacaagacaggctcatgcttctgcgatgttaatcaaatgtgaatctttaagagttatactttgtgttataatgattcttggggggggggaatctctaattctgttaaatatttggaatggaaagagtgggtcagcttggttcattgtgcaatctttggcttgatttcttaactgaatttcaaatttttgatctgtaatatcttcacgagctttgaaagaaacctggtcacagtgacaagcggagaaaattttggttgagaaactgaggagatttgtattcttggtggtggagtaggggatgctttattgccatagcaaatacactgtccgtccattctggaaggaagtgccctgcagagcatcatggccacgtttactaaaggcagaaataatgcagttctttgtataaaaccacaaactagtatcatgcttataagtgcacagtagaagtatagaactgatgggagtgagatgccgtgttctacctatggcatagggaagaacattaactttggagtttctgaagcagagtggatggaacctgggaagtgagcttctctccagcctgtgtgtttacttagagtaaccatagtaacatacttaggccatggaagtcctttttctttttctttttttcattagtttgatcagtacagcagcatgcagcatagtaagctagtaaatgcttttatagaaattgctattgccgagagggaaaaaaaaaaaaaaaaaaaaaaaaaacaaagacaaactttaaatcattctggcaagatgtacagactggtagaaaaagtcaagtgcagaaaggttgtcctagattttaggatctagaatgtgttggcttaaagtacttcaggactgttaggagatgaaaacattttcgatgactaggccagatgtatttaggcttctttaataaagcatgcgactgtaatgctgctttcaggatattcgttctctgaggacacattttattttattttaattaattaatttatttttgactgggtctgctggtaaagtttgctctcttcctacaagtacagaaggaagcagtccagaggcgcctcctgttcatatttctttcaacagcaccagccactatttcctggtcatgtatttgcttgtttttattttttcccttttgttgtgtctgcgtctagagcagtgctcgcccttttttggggggctctcaggccatttgcttatgtgtgttctcatttagtgaatgcccttctgtttctgctttgttatgaatggtaaagacatgtaaagagctctaaattatttatgccacctgtgcggatcgctgagctcagatggtgacaaaggatacattggcttaagttttcccttgtaaatcacttttgaaaaagtcagactttttattgcaatcagtatgacttataatgtctttgagtattttgtgagtttgaaggaatagtagagatttttggttaagtaaaacgttggctatatttttgataaaaggtgttacaattgtctaca

SEQ ID NO: 23209 - DNA, 1172 bp, Mus musculus
tggccaagagccatcttccagcggtaagaaggacttgcaaatctcaggcctgagtgagaaggctggcttcaattatgaaagccccagtaagggagggagccttgtctccttcccacatgatgaggtaacagacagaaatatgttggctttctcatctccagctgctgggggagtctgcgagcccttgaagtctcctcaaagagcagaggcagatgaccctcaagatatggcctgcaccccatcaggggattcattggagacaaaggaagagcataaaatgtcaccaaaggccactgaggaaacagggccagtgcagagtggtcaagccaattgtcaaggtttgagtccagtttccgtggcctcaaaaaacccacaagtgccttcagatgggggtgtcagactgagtaaacccaaaggtgacttactggtgaatgacaacccagacccggcacctctgtctccagagcttcaggactttaaatgcaatatctgtggatacggttactatggcaatgaccccacagatctgattaagcacttccgaaagtatcacttaggactgcataatcgcaccaggcaggatgctgagctggacagcaaaatcttggcccttcataacatggtgcagttcagccattccaaagacttccagaaggtcaaccgttctgtgctttctggcgtgctgcaggatatcagctcttcacggcctgctttactaaacggaacctatgatgtacaggtttgtgttttctcttgtgatttccaggaggagaaaaaaagtgattcgtgatgaaatgtgaattcatattttcatgttcagtgtcagctcccaaggccagacacatagcttttaggccctatagaaaagatggatgtatctcattgctactccactctaatgtgcattcagagtttaatttcccattggcagggagcagtacaaaatttccactagatttggaaaagtctgttcgtggaataagctaagattcctatttcttgatctacttcatgatagatattttcagccctccagcgatggcagcgatctctgactgcacatgataattcattgccttgttctagtttctgactattaggcttctcctatattctttctcctgggtcaatcagttttctatcttaaattagtatttgattttatacttagt

SEQ ID NO: 23210 - DNA, 1161 bp, Mus musculus
agaagtttcaggccggtgccccctccccctcccagccccactccccctcgctgtctcttgctggctgattttaattctctcctaccgggagcagcagaggatctggaggtggctggacccgaggggccgccgccgccgctgctgcaagttttctgggggctcctggcaaacggggagcagactaggcaccggcatgcagagtagtaagttgggtgaacttgggagggtagggagggtttctgcgaggggtcttggagtggcccacaaagtggtaaaacagcatagactgcctttgggtttgaagagtttagtttgtaaagccaggcttcaaacttttttcccttaaaggcccagcagggctggagggagagagtgtggcatcctctcctggtatacccgtctctgggcagctcagggcagcctgggcccaggggtctgtgccctgtcggtaccatgaggcagggccttgtagccagggcgcttccgtaggggctgagcaaggggcagacttcctctgcggtgcggttgatgcgccatgtgtcgagcgggtcaggggacacgggctggtgattaaacgcctgacagcggtgggacatgcaggcagacaggctctttgctttctgtctagttcctgtttgggctgtagagtctgaaacgcatctttgaaaggccaaggcaaacacctctatccctccaaataactccaggattataggaccccatgaataatttgagggtgaagcagaagtgggagctgtttgaagtgcaaactgtttttgaggctgggaaagctttttctgtgagtacctgtctgagatgatggtgtttcccctttcaccagggaagtcactaactgttttatggctctaggatcctaaagccattgaagtgagaggacccgaggacttacttatgggggcttcagagagaaccttgattggactcactacattttaagacctggctgacttccccatatctttttaggcctcagatttgatcttttgaaagtttttgagtcagagctatggatttaatgatgaatccaaattaggatagaatatccatcctttatccggtttggggaaatcaccgctagcattttaaacaaggtaagtgaagagagactggccgcgagaagaagcaaaatcagacacaagt

SEQ ID NO: 23211 - DNA, 1187 bp, Mus musculus
gaggcttggtcctcacattcgaggagtgagcacatgggttcagaaagcaggagatggatgaaaatgtagagggccaagggacagaaagtaccctatagaacagagttggcaagagaaagtgaaatgcatcccatcacaagtgcagaggggtaggtctctttcagagatgagcttgtcaataggaggagattatcagaacaaaagaaaaacaagaagactaaagagaagaaggggaaggggaagaataggaagaagaggaaaaagaagaggaagaactaaaagagatgagagagaggaagagaagaggaaaagaaaagagaggagactgatttgtataagatagaacccattgatgtcaggtaagaaaaaaaatcatctactgactttctcactttgaggctatatactgagatgaaggacagtgatctgtactctactgcctctggtctgtcttctgcccaacttggcactacctaaagctgtaaaatatttagaaaccggtcattaagtaggctttgaaagctcttttgtgccagtctgcttgccttttatctgatctcggccctcagttctgcgttacaacatgcactagtcaaaatgtccattattatcagaaataatgaagtagatgactcatgaaatctgtgtcttcaaagccagacttctaggagaaaaataaaaatttctatcatccgaatgtctggtgttatgtgaagcaggctccacctcaagaaatgaatggctaatgatgggattcgggcacttggcaggaagcacaggaggagattttcaagatatttgtgaaatgaacacatagggtaatgtcctatagtggttttaacctggataaacatccagagttttcaataattatggactatagcaaagatgaggacagtggcatagtatcacgtgaacagaattcagtaagttaaaacatgcaggtctttggaagtcaccagtgaaccagacaagcattcaacttactgtcaaccttattacttcccattgtaagaaaatggtagggacagctgtgtagcccaggctaacctagaatttccaattctcctcccccagcgtgccattttcggtactcctctgcagttccttcctcactccactatttcccaaggacagttcctgtttcgggaattttttttaatatataaaaaaaaaatctaagttgt

SEQ ID NO: 23212 - DNA, 1249 bp, Mus musculus
gagagggtgaaactcaggttcctaacaccgctgaaatacattgagacttgatggagatactgtggacacggtggtgaaggtgtctgtgtggggagggctcctcatgcttcctcttaattcatggtcttcctcgaggacctgtaacctgtactgcaccctgtgctgtcccctccgctgtcttagcatgctgtggctctgatctcactagtcagccagctggtggcagagagctaagaggcagggtgtgtggctgacgatgactaagtgggtgctggtttcttcattcttagctcctgtagactggaagatagattcttagcaaaagacatagtctttatctcttgtggaaaacaatacccccctgggttgctttttctttagtgtattcttggtttaaaacaaaatacaagtgattttggttttgacattcattctaggtcatttttcagtttgctgaacattaattatgctttctctttctcaaatatgcaggccagattaacacttactgccagaacatcaaggagttcactgcccaaaacttaggcaaactcttcatggcccaggctcttcaagaatacaataattaagaaaaggagcctcctgagaaggcgttgagtagacagactgttgagaggccacagagtgcacttggaaaaactcatttctgtgctgcaaagcaatggtggggaggcgcagtgccgcgactgctgtagtggtttctagccaataataaaactttaattggttgttcagttgcctttgtgtgtatttatggtgtttcaattcttcatttccaaaaagatgaaagaagtcttgaccagactcagctcgctctcagtgcgtgcgcctgtggcagtctctgctgcctctcccttcccaccctgtctgggctgctgggccgttttcatctgctctggaggcctgtgagtgcgttctgtccttgcagaggtgtccttcattcccaggcttggaagaatttgcctttattggactcttccctttcttcaagtgatagacacccgtgtccatattcatagactactgagcgtacgaattttaaaggtcattttattagattattttgtatatttgtttaggacttgatatttatcttcctgtattacaaaatattgggttaccactaactgttgtacatgcaggaagaaaactgaggagaatacatttaggatacaaaatagatttgaataattttatataccaagcatggtggcatccacttataaat

SEQ ID NO: 23213 - DNA, 1194 bp, Mus musculus
accagcggctgttggagtgtgtgtgtctatcagttgtccaggcttccttgaagctgcagatgattgcaggcagcagtggtgtagatgcggtttttctgtcagttttttatcacccctttgtaagatgttagtacctgaactgataggcgtacaagagcccacgtactggaaatctaggaatggggagaggcaaagagatcatctgctctgcagagcaaaggctctcgttgtgtttagagcctgctgggtaagaagtgcagttgggggagctttaattgtttatgtgttcttcctggtctcattataaattctcactagatatgctaaacagtgcttggccttcacccctgtgctttgagaagaggtggagctcgtgcaggcactcctgggttatgcttgaggctgactaggaggctgactagcaaggtctccctgctggccacccttacatgtgtgtgggctcctcacgctaacaaaaggcgagttcagctgccatctggaaccgtgcgagcgcctgccgggcagcaagcagaatgacatggggatgtgcttgcctttcagcaatcatctggggaagagcctccagctgctgatggaccgggtggacgaaatgagccaggacataatcaaatacaacacgtacatgcgcaacaccagtaagcagcagcagcagaaacatcaggttggtatggggaactcggcagtctcccgagtttaggtgcagcatttctggagtctccttcagaattgttgggaaaccaactgttgactgctagctaacctagtgactgtcatgttttaagaggatattcttcatgtcatatgagttatttacaccttctacttaaaaatacctggcttacagagagctgacctgttaagcccagagtgcaatgccaaggttatgcaaataggtgatacattattgagaaaatcagaggcagaagagatccacagtgccacagctcatttcttcactaactgtaattggtttggtagtggctcattgcagcatacttagcgatcttcagttcatttaaaaatgagcaattgtgattaagagcaagcagttttgataggaaagaatagaccaactgctgtgaaatagatagtatagtacagataaaaatcctaagattacctagagattctcatatgcacacgcagagtcgtacttttcttttttgcctttaa

SEQ ID NO: 23214 - DNA, 1173 bp, Mus musculus
ggttcgtatgtaagtgacgtggtcattgtttccccttcattgttttcttgatggatttagttcttagttccaaacactatgtgtgaaggagacaataactaacttaattcagaccaaacgatcacagtctaatagttgtacaccttttccttacacatttactgttctttggagttttaggatagagaagtagggacaacagttgataattccttatttagaacaagtcattaaaattgtgtttttaataccttttaaaaacaaaatggaattttgttaaagagaaaatggaaaagaccaattatttgaagtgatttgaaaactttgttgttgttattggtggtggtgtgtatatgtgtgtgtgggtatgtgtgtgtgtaaaatggatataattaaccaatagctaatgttggtggcatcattacatgcttgggtttttggttttttttttaattcctttctaatctatcctccagtacagtatcagatggagatgatgcgcagccttcgccatgtcaacattgatcacctccacgtgggctggtatcagtccacatattacggctccttcgttacccgggcgcttctggattctcagttcagctaccagcacgccattgaagagtctgtcgtcctcatttatggttagtaggaggctcctttattattcttttcctcccttaatattattactactatttttgctttctgtctttctgcctcttggagcagcctggcaggccttctcaagtaaacatcagccccgcgctgcagcagcctcagcagcagctaagtctagacagggtttccttctttctgtttatttttcttgctatcagagccctgatgtgtacgttttggaatgctggagtagctgcttcgttttttcccccctctccctccctccttgcaggagctggtggaatgagaccagatgtctaacaaactctcccattgctggagtgtctggttctatacatgactgaccaatcataataccgcatgccaagttctctctctctctctctctctctcttccccttttcttctttttcttcttttttttaacctctgacagcagcgtacaaaacctggactgtttcttcgcacaaagatttttttcttttcggcctatttaatggtgtttcctcaagctctccagaccagatgttc

SEQ ID NO: 23215 - DNA, 1202 bp, Mus musculus
cccttactctactctactaaccatggtcatctggttgcctccctaggacgtagcagagccttgaatggatgctaatagtacaaagccactgtggtttctgaggcttgccaatcatggctccagttctgaaacattcaaaataaaacccactctttctttttactttgactttttactttttttattttctttttgaaaaaagagttgtcttatcagaaaacatggtaatttcagcagatcattaatgggaaggaattaataacagaaagtggttgttgaccccaggaagtaggttaaatagtgcagcgtggtaataaggaccacatatgataaggcgaaggcacctgggttttattaggctgcttgatactttgatcacaatattatttcaaggcttgtctatttaaattgctaaggtttcttgtcatcatgatttagatcacaatttctttcattgcaaagagattttcttttctttttctttaaaagaaagattctggccaagccaaaatttggaggaggtgcaagttcaacagctagaataatcttagaacaagaaaaccattgcatagagacttgaaagccaccggataccaggtccatctgacttctccatagcttttgcctagaccataattacacttcatatggtagggaatgctataaggatgactggaataattcaattaattattgtttgatataaatatacacatttgaaacatatttcatgtttcgagacggcactgaggttctcagctttccctcccaactgctaagtggtttgatgaacatcttcaagaacgtatggaattatttttaactgcttcagccataatgactgaattatactaatcacagaagttaacttgcttgataaattgtcttgcctttgaacctgaaatctttaaacttcagttagcttaatgccagtaaatgaaatttttactcatcaggaccatcagcgtttccttccactgattttctttatcatagaagtagtctttcactgctatttaatggttgtttgttatgtgttacagcaaatgccttagcttgaaaaaacatttattttcagtagtgaagaaaggaacgggaagggttaataatttaagatactattattagcttagtagtaacgatggtcattcagcagtgtttaacatttatatgtgatatgctttgtacatttattcacattc

SEQ ID NO: 23216 - DNA, 1145 bp, Mus musculus
ttggtctttataagaaaacaaattggggctgttcaggaatgctaaagagaatgtgagatagactttccatgtttcacctgcaactgcttgtttcaatactttaatagctttcttcagcctcactcattctatgaaaggaaatagggttatcctcacctggctttttggtgaaaatacactggttctgggcattaacacaccttttgcatttgtagatcctggtttttaaggaatctcttgtaacttttaaaaaaatctacattaatttcacatgtctcctgatatctgcttcctttattttaacaaatgtctggtgatctcattaatagggttaagtatccaagagcctcctgtgagctttatttaataaggctaaaggaaatgatttgcaagacaagtatgtatttctgtggttatgcaaactcactagtggtttttatttttcccttagaagtaagtaaaacataaagtagaatggtttttaagttctcttttgtattctcttttaggtagtattaaagataatcaaacattatcaagaagaaggacaaggcactgaggttgttcagggcgtgctcctgggtctggttgtggaagaccggctagagattaccaactgcttcccgttcccccagcacacggaggatgatgctgactttgatgagggtaaggctatgggctgctgtcaagtgtgtctttgcagtgaacacaaatagtgttagctcatttctcactggaaccttcctctcgtactgggtttgcttaagtttttatagtttctggaaaaaaatgacatgtctgtgcaatgagaatttgtataaaaaagttttatttgtcctgtttggcatccattgtcttctgttttaaagtgtttaagaagaggtaagttttgctagctgttttagaaagattatccttgtagtttaaagattataccagccacaaacacttaggaggcagaggcaggtagatctttgtgagtttgaggccagcctggtctataaagcgagagcaagggctttgttatagaaagaaaccctgtctcaaaaccccaaaccaaaacaaatccaagttgaaaataatttcttttcactttcttgagctcttaggacacaatttatatgtaatttctttaactttttaac

SEQ ID NO: 23217 - DNA, 1110 bp, Mus musculus
gtgtttgtgagcctctctctctctctctctctctctctctctctctgtgtgtgtaggtgcagtagtgtttgtgagcttgttgggcggtggggggggggggtgagcgtgtgtatgaagcagctagaggtcagcatgaagtgtctttctctatcactctctaccattattttttgagagagtttctcactgaatcaataacttgccagttaagtggtcctggatggccgttaagccccagagatcctcctgtctcctttctggtgctgggattgacagcattcactgttgaatgtggctttctgtatgagtctgaggatctgaacccaactcctcacagtagtacggcaggtaaggtcctgactgaggcatcaccccagcaccacataattttaaaagtcagtcctaaggccagtgagatgactcagtgggtgtcttagtcagggtttctattcctgcacaaacatcatgaccaagaagcaagttggggaggaaagggtttattctgcttacacttccacattgctgttcatcaccaaaggaaatcaggactggaactcaagcaggtcaggaagcaggagctgatgcagaggccatggagggatgttctttactgacttgcctcccctggcttgctcaacttgctctcttatagaacccaagactaccagcccagggatggcacaacccacaaggggcctttcccccttgatcactaattgagaaaatgccttgcagttggatctcttggaggcatttcctcaactgaagctcctttctctgtgataactccagcctgtgtcaagttgacacacaaaaccagccggtacagtgggtaaagacgcctgctgcctaccttgataactgaacctcgtccctgagacctagagaccagacctgactcccaaaattgtcttcttacctccacacctccacgcaaaacaaattaatgtcatttgtaaaagtcagttctaagggaggaaagggggatagcttacccattattttgtatatggcaataaaatctgtaagagcttaagataaaagttgtatctttgacagttggagaaacctccacattcaactaactgttgaatacaatgctaccgtctg

SEQ ID NO: 23218 - DNA, 1219 bp, Mus musculus
caattctttagtctggaccaacaaactagaagtctatttgagtcatataaaaccctgcaggtgagtggttcagggctgttatgggacttgtagttttcaagaactcgggctacttccagttcactgatcctctatgtgtagccccccacctccacccccgtcaaggttcactcattaaccaaggtgatcttttcagttctatctatgaggtaagaaaaaggacaaagttaagaaaaaatctcagaacagatggggtctgagactggatcttctatcattccaataccaaatccaacttgaacatgcccggacttacaaaatgccaaggggtgattggaagtttgtggatatcagggtatacattaaatcagtgagcttgggggcagggaagaccaggattcccttgaattatgtttcaatgatgcaatacacacgtaaagatcaccttgtatgctctttgccttcttaaaaaaaaaaagccattattgtgtcagaggaagaggaagcgattcaggtacagaacatgttctaacagcctaaatgatggtgcttggtgaatcgtggtcctaaaggtaccaaacgggggagccaaagttctccaactgctgcatacttttgacaaggaaaatctagttttgtcttccgatctacattgatgacctaagccaagtaaataagcctggtttatttctgtaacatctttatgcagacagtctgttatgcactgtgggttcagatgtgcaataatttgtacaatggtttattcccaagtatgcctttaagcagaacaaatgtgtttttctatatagttccttgccttagtaaatatgtaatatgcatttaagtacacttctattttgtatatttgtaaactacaaagcaaaaaaaaaaaatgaacattttgtggaatttgtattttgcatactcaaggtgagaaataagttttaaataaacctataatattttatctgaaaaaaaaaaaagaaaaaggacaaagttgaaagggggcaaaagtcacataccatctgtctcttacagagggatcctaaaagtcgccacatcacatttactcaagacgcagacagagtttcttgcaaggagaagtgatggtttgctctccagccaggcagccttgcacttgggtaaatcagggccactgttactaagaataatgaaccatgattcctacatagtcttcctccggctgtgaagtcaatgc

SEQ ID NO: 23219 - DNA, 2058 bp, Mus musculus
tctatttcagcgagctcttgctaaaactggagcagagtctatcagtttgcttgagctgtgtcgaaacacaaaccgaaagcaggcagcagcaaagttctacagctttttggttcttaagaagcagcaagccatcgagctcacacaggaagagccgtacagtgacatcattgcaacccctggaccacggttccatattatctgaggagctagatgtgttcgagctagtgataactcactagtacatacaaattgcccccgtgtgcagggcaccaaaaccctttaagaaagtttttagatttctgtttgtacaaaaatctttgccttttctttcttctttttccccccagtgtttctaattttgtcaaccatatttttaagggaaactgcttatttgggttgggtttgtattcctggagaaaacagtagcccaagaacccagaagacttttaacagttcagaacagatgtgtgcaatattggtgcatgtaagaatatggagtaacagtcaaaaggcaccatttttaatgttagttttccattactatgttgaaaggaaaacctgcctaggaaaatgcctgacactttaagaactgtggtttgagtcccttgacaggaagagaaaaatgtcttcccatcagtgaaaccaacggtctggttaaccactgtagtagggatagtgtgtgaagcatcgtgcttgtcttcttgatcatgtttaaagtaaatccacactgagcaagaatttgtgaggttgtgctgactgatcttcttcggctattatgttctgaaatcattccgtgagtcttaggacctctgatgctatgcaccgcagctcagaacgatcagacgtctacagtggcgtgactcctcaggggctgcagatcactctcagaggtgtttggatgtttgcttgaataatgagatcatggaagcagacattcccctgcctgctgaagggcagaccaatgagagactaccccagattgacttcctttaagcaaacagtgctgtaaaaactaatggcttctctgatatttattataaatgttagtactcatctttttccaaggctgcacactcctgtatttgcaacttatttttaataactttgcaactataatcctgtatcagtttcctataatttaagtggagaaaaacatcctaataaaggctttattattaacagaccagatagcaccagaaattatgtgactatataaatatcaaaacatgttcactttgtaggacaaaattatgttgaaaagttctagcttaagtgttggcacttttatgggggggaaatcagttttaaaactaagacttccatgtatacccagtaatttaaaattatgtgaaatattttaaatttgtgaactcgtaattactactttaatgattcagtttctcgagaatggtaattgtataaaattgctcttgcagttttcttttcaatacgacgtgcctgtaaccatggatgtcccctttgtaaaaagacactgtagataattgaatgtttgattatagaaaggtcgttagtttcttgttaaacattttgttagtccagtttttgtcgcttattgggtttaatattgttcttgaaaatagtcgatgctatgttatgtataacttttctaataaaagttgtgtttcaagctgtacattttggaacatactcagttgatgatatgtcacaagagaaatgttgactgaaaaagttaacatggccaaatatttcatttgctttacctaggaatattttgtgctaattaagtgaattttttttttaaagttcagtagttccacgaacactactgaccattgtctgacagcttgttgaaaggcagcactgtcttaaggtaattctaaatctaagcagagtgcttagtgtccatgttctgacagggaaacaagtcacagtaactgaagtcataggtgcagatagttggttggctgcagtattagtgtagggtagtcagaatatacctcttcgagaaggtgagtttctgagcaataaaagatttgaaaatttagacccgggaagagggtgattaataaatgggtc

SEQ ID NO: 23220 - DNA, 1326 bp, Mus musculus
gatggtgcctagaagttcattcatcctcacaaacaacctctatggaaatggaaagtgagctctgatgggaaaagagttgagagtgtcttctggtcaccatcatattggaaggcaatgatggcgtccaaagaagaaggagggctataactccaggaaccctctgaacctgaaggatcccttcaaatgatgccatcaaagctccgtgtttgtcttttcaggaggttgtaacatgaatctgttgtgtaccttccctaagggcattgtgctgatcccaagatactgggggcattttatgaacaacagaaactcagtctgcttttttcactccctatgtagtccttttccactccactgcatttccctttcccaaatttttcctgcctttctcctttcttttccttccttccttaaaattttttaaaaatttatttatgagtacactgaagctgtcttcaggcacaccagaagagggtatcagattctattatagatggctttgagccaccatatggttgctgggaattgaacttaggacctctggaagtctcttaatcgctaagccacctctctaggacctgaaagatggtgaactatgcctgggcagggcaactccagagaaaactctggtgaaggtccatagtggtcccaatgtgcaaatccatccttctacctggatataggggcaaaagactaattgaaccatctagtaactagtttcctctgaagtttccctcaggataactggtgctctcgcaggaatgaatcaaagccctcagttttatccggtaaagtgaaatgattagaggtcttcggggtcaaagctacagtcattaaggagtttgtaagaaagagagtcaatacagcaaagtttaattaaagtatagttggtttcactattaaccatgataaccttgtatgacttcagaaacaagtcataccaacctttgagtcacagaaatatcacctgtagagtaaggagaacacttgtcttggtccatttacatgaggataacacaatgccatatgtttggtgaggtttagataacaaatttatttctgatgggattagaggaaaagaaatccaagatcaagggattaacacatttggtgtctagacgttttctggttcacagatggtgaattctcaatgcatcctcatagagtgggctgtgcttttgaaagttttctttctaaaaaaatgaattgacaaggattgtatattttgaagggattcataatggctaagactgcaggtgtggatactaccgtaatagttacgggagtaaagatagtattttacattctaatttaaatccctttggatgt

SEQ ID NO: 23221 - DNA, 1136 bp, Mus musculus
accctatcttccgttaatttttctcaatgaactttggtggtttatgttttaggttttagtttgttcatcttactctctgtcatagttaagatatttttaaaatgctgttggaaatatgagagtatatagttttatttatacaaaataaaactatgcttttagatatatgtatgtaatataatataatatgtatattatatatataatatgtataatatatatatatagttagttcctgggcaagttcagcaactttctgcttttatgtaatagtagtattaagattatatatttattgacattaatggactgaggcattttagctgtgagcagtcttttctcaaagccttttctaaggctcttttatggcagtgaaacattgagctaagttgctaataagttgatgtgggttattgttaaaacttcaatatttttgttgttttctttaacctgccaagctgccaaatggtgtcacttaccatactggaacttaccaagaccggctaacaaagctgcaggaccaccttcggcaactttctattctcttcaggaagctgcgactggtctatgacaaatgtaatgagaactgtggtgggatggaccccattcctgttgaggtgagtttctctggtaggagcatgcatgccagtggtgaagtatggtcagcacatctcctttagcaatattactcagttttaatactatgggttttactttggggaagagatatagatgtgtattttttcattagtgatatttgtagcgtttgttttctaggcttaaagtgatattttgtgtttgcttatgaattttttgtggttttaatgacagtgatttcttttattattcttagaagaaatacttaattgttattggcaactttttaaccattgctgggacaagctgtagttgagtagaacttcatcagctaaaagtcagaacacttgattaaagatgaaacagagtattgagctgaagccagcagttggagatcagtctttgaagaaatatatattattagtgagaggaaagcagtgactgggaggggagatggaataagggttgagacatgccttctgcaagagaccagcacgcatgaaaatgataaaggaggaagcctgcgtggagaggttgga

SEQ ID NO: 23222 - DNA, 1097 bp, Mus musculus
ccctgaaagcccatgaaactgtaggctaactttggtgtaagtacatactgatttctcagggcatctgtccttaggtgggagcctctagtttgtagtaaggtctcaaagacaatcaggagccactgaggttactttaaactgttttaaacggttgtcaccgtgcaaggaggcagaggaccttatacaacctgtctattctctctacttgttcgttatgattgtggtacttagtctgactgtcagttgatagtgttttgagttaagagagacatctagatctgtcaggggggaatttccagaggagtttatctgaggaggggaaaccccatcctgagtgtgagtggcaccatccgataggctgggctcccggactgaacaaaaaggagagagccattgttcttctttctctgcttcctgactgggcacaatgtgaccaactgcctctcctgccctcccagccaaggctgccccctgcaccacacctttccagctgtgatggacagtaccaagaacctgcgatcccaagggcacccttccttaagttctttttgtcagatctcatgttataataagaaggaaatgaatgctttaatcaccaactgtttaaatcattgacccccccccccccgccccccagcatgatataaaactctggattctgtgcttggaaggctaggcagcccttggttgcatttttacctggagatactcttgcagagctaagtgtcctctcaaggtgcttgtgttctctagttttcccaggtccttttaatggaaatcccagaatgctgtggtctaaatgacatttactaactagcttgggtagataaggagtaggttctagtctgttttcgttcaaaagcaacttctgcatgtgcgtagtgtttgacagataatatgagactcggagattagatattggcctaagacgttagttcgttgcaggatgttagaacaatgggaactttagactcaggactatctggctcagctctcacattgcttccacagagcttcagttgtctcccattattgtgtcagtagaccctcacagtgttgttagcagtaggaaagtatcatttccagttcacaaatga

SEQ ID NO: 23223 - DNA, 1192 bp, Mus musculus
ttctattaaaaccgtctttgggtagactttttagaaggagtcctactgaagccccgaatacagaatttatattcactcccttttttaaaagacctggcaacttgcttcagagacactggaggagcctttgaaacgagggctgcctgacatttttgggtgtcttttcaacaatggggtagtcagaggtctgcaacatgagaacataaaagaaccatttcccgtgtgttgaatttactgcttttggttattagccactgctggcttcaaggctgtgctgttggtgcttctgtgggccggacgtgagtacctcatctctgccactttccattgttaactttgggaagactcgtttaacctttgccttaatccaactataaaagcaggatgcagacacatgtttaacagtacatcaagtacttaaaatagtgtctggcacccagaaaagatgtcttttcctcttaacttgttagaatgggacataatgatagggaaggaaatagtccgccaccctacagccttgaaggcatggttgaaggtcattctgaggagccttaagcattccttttcccagtgcagacgatgagagatgcaggatcacaggacacgactctccctgttctacagtttgtacccattattgattgtgtggtggcttctaacagtgtaatgctggcttctgcactttaacgattattcttctcgtaagcatgtctctgcctcacattctgttttctatacacaggcatcctgtgcacagtggttcccagcactgtctagagataaatgctcgtgacttcagtctccctctacggaagacgccattctgtctttctaccacctctttcctttcctgtcccattgtcctgcttaccacatgaaaaggaccaagggtggaaatcaaacgtaggaaactaacggtttcagaaacgaagggctggatttctaaagccttcataatatattattattttgatatttttgtgtttggatctttaaggtttttttgtttgtttacgtgtttgttttcatttttattttttcctcctctgcttccaaagtctccagaagcacgttggtcatggttttacagctttgcagtgatgggtgcgatagttgctttttttttattgaaccatagattgcagcattgtaaagcttactcattcggaggaggaatgaaggccatttttaa

SEQ ID NO: 23224 - DNA, 1177 bp, Mus musculus
accaaggaagaaagcccaggctagatcaaacctgactagggtggtgtaaagacatctttctccttcccttcctattctcccctcccttccttccttcctcccttccttccttccttccttccttccttccttccttccttccttccttccatatatgtatctatctatctatctatctatctatctatctatctatctatctatctagtatgtatgtatgtatccatctagtacgctttctaatttttaattttgctcttcagttaagactcatcttttgtgaatgtcacctataagggtcatttctacttctgcttttccaatggccagtaatgagttttgtttgctgtgtgctgatagaaagacaattgctatggcactttgtccattggtttgataagctcttttctctccatgtcctgtattaagggttaatcagaatggttccaagccatagcccccacatgcttttgaattcagtcaccaggattgttgagcagtctcgaataatggaaatagcaaatttggacacttgtcagtagccacagtccatcccaagatgctgcagatatcaagagctctgtgacttctggtgggggaatgaggctcatctgttgtccgtccatgtctgtgtggtcccctaatgtcaatgtgtgccttcatcagtgtcagcctgctgttgtttctgctttttctaaagttgtagactccagcaagccacccacactgcagaaccctggaaggtgttatcacatttatcagtgttctctccaagaagacatagactccacacagcttaagataccccatcttaagagatctggaaggaagtgtttgaaatggcatacatgtttgtggttctggtaaccaaggaaacgtgtctctagatacaaagcctcctttttaaaaatgatggcactgtactgggattgtctcagaatcaccctcagcaagattccaaaggggtttgaagttaaactaggtcatcttcagaacctgaatccagagttagccgacacgtgggcaacatctcttaaaacatgcagtgtttagaaggggggccagtgctctgtggacacggggagccgccgtctgcatagtcagaggcttgtttggatagatgtgtaatgaatccctcctggattcaacttcccttgactcttgtttttttgtttac

SEQ ID NO: 23225 - DNA, 1186 bp, Mus musculus
tttgtaagtccaattcatggaagctcttagaaaatcatgaaagctcttagaaaacccctcgtgtgtacatgtactttcccagaagttcacagcaccacagttcccctctcccagggccagtagccaggctgtttctgacttcacagtgcggttggttacatcttatgcatggatgtatagcgagtcatagagcagcctcgtggagaatgaagccagaagagacagtatattttcaggagcaatttagagcatgattgatctttctgatgctgttagtgtattgtttctagctgactggctttacccgcagctcctgggcaacactgtgcttaggaagaattgtgggagaaactgcatcgattacttggtaagttagctctacactctgaaatgaggaaatcagattgtcgtttacccgcatagaaactctgtgatactgtcacatgtgtcaccagtcttagagatttctatgcccaattgcatgttcctctttatttatttttaagctgtctttattcagtttttgtttctcattggagtagcagttcttcacagaatagtaaccgaatctctaagatgaatcaaagatataaaaaaaagggggaaattgtggggctggaaagcgactcagaggatgaaatcctttgctgccaagactgataacttgaacttgagcccctgagctcagtgtgtagcacaaaaggagagagctaactgcagaaagctgtcctctgactacgtgctgtagcatgctcacaagcactggtatacacacacatgcacatacgcaaatacacacaggcacacattcctgcatgtacacgcacatagctgcatcacacacatagctgcataacgcacatgagtacatatgtgtgtgcacaaagagtatttgaaattgtatactaacatgaactgagtttgctttaattaaatcatcactttgtgtatataaattctgtcattgctaatatgctgatagatagccgtgttcttctgtttttttgtttgtttgtttgttttaagatttatttattttatatgactacactgtcactgtcttcaaacacaccagaagagggcatcggatcccatgacagatggttgtgagccaccatgtggttgctgggaattgaactcgggtcctctaggaagagcagtcagtgctcttaactgctgagccatc

SEQ ID NO: 23226 - DNA, 1143 bp, Mus musculus
tgcatttaatgcctttaattcaagcacttgggaggcaaaggcaggaggatctctgtgacttagaggctagcctagtttacatggtgaattccaggacagccagggctatgtagaaagactgtctcaaattttatgtgtgtgtgtgtgtgtgtgtgtgtgtgtgtgtgttgcattacatttatctaatacatttgttatcacttgcttgatattcattaccagagccaccctgttaataaatccggcctgattgctcttcagaacaggtagccccttggcttggtcctgtgaagctgcttcttgttactgatgtcgctggtgcttctcagtcctggtctcaggtttagatgaaaactacagcagggtcactcagctttaaaagagccccccgggtatggtctggcacaccagtgagggctccttgcttttgctgtgaagtttatggagagctgtctgtgctgcagttactgggggatgcaggctttttttttttctcctttggttcaaatatgtatgtatgtatgttcctctggggtgagaattaggcatggcagtcacagcgggcttctccactatggctgcctccccaacccccccccccccccccagggctcctggcattccttgaatactaccttgaagagatagtttagtgcttcctaggaactctggtctctgtaggagttgtttgtttatatatagtctaaaatgcctcccctcccccaaagaaaaatgtacctatttatttaactacaacagtttgtacttttctgtatgttgtttctttaattgaaaatcctatctggagacagatctctttttttttttaaaagaggaaattggaacattgttttccaaatacttaaaaaaaaaaccctaaaaagtttgagaccttattattattgctctgtgcttattttacattaataattcttgatttttctgtttatatgacatcaagcaaaaattgcttcttaatttcaatttgggtacacagtcagttctatattccaaatatgaggtaagttgggtgtggcttaacaccaaaactgcagcacacaggagagacctaggaagatgttcaagtagtgtgttcaaggctggccttggttacatagtaaggccctatctcagaaaacccaa

SEQ ID NO: 23227 - DNA, 1890 bp, Mus musculus
tccgtgtttttatcccgaaggtaaagagcagcctttggagatgggtgtgcattccatggtggcagccccgctctccatgtttgctaaggaggctctgtcatcgcgacacagcgagcaccatcaccaccatcaccatgagcacaagaagaagaagaagaagcacaagcacaaacacaagcacaagcacaagcacgacagcaaggacaaggacagggagcccttcgccttctccagccctgccagcggcaggtctgtgcgctccccctcactctcagactgaagcctggtcctctgtggagacacaagcagggagtgtggagagactgcagaggatgtctatttgtatgcctgaggtttatataggaatgagtgtattggctctggatgaatgttccccccaccccagtcccccccattcttcctgaaaacagaggatgacttttataaaagccttcctgtccactgcaggcccattcagatgctggtctcctgtggacccacaaagtcaggtatgcttgaaagcctttgatggatgtcagaggcagaaggaccttttcaacagaaacaactgccagatctgtgggacccagcggttccatgaagtgctgaataccgccacttggaattgctggagaggctgttgtgtaggactcaatccctcgactgctttttgtgttagccattgaaactgaacaccgtcatttatgagcaaagagtcttatatttctttttaccctaaagtacaaaaagttttgaaagaaattattttttaaaaaatttaaagtaactatcttttggtagtacatttggtgattatgatgttgcaatgtagcagatgcaacattattctccagtcaagatgtttaaattatgttttgttttgtcttccattaagtgcaagtgaatgtgttcatatgtaaaatatctcttgctgaatgtggacagtttacacacttaacacatattctttctaaaattactctgtacataataagccaggcatggttgtgcatgcctgtaattccagcagttgggaagtcggaggatcattcaaggccagcccgagatacatgagaatctgtgtcaaaaaagcaaagtgacaaacgttactctgtctaacaaaacatgatactctgaaagggtgtctttatttgctgtttgcgagcttggatatagataatttggcccacactggagtataccagcaacagtttaaaatacatgtgccatgctttggtttcgtattttaaaagtttgtatggttttatgttttggttttgattttaggtttttggttttctgaatttaccaggttctgtgttaaaaaatattttcatatctattcagttttattatttcttttgttactaaatatttgactcatttcttgatctcagaataaatatttcaaaggggatccaaaaatgctggacttttaaatatacttttagttatatttaacttgtttaataaataactttttaagttggacagtctgcctttgtttttctttatcatcttgttagcttcctgagcatgtagatataatatgccaggttgcatttgcagagggctttgaaatgagtgggatttgaactgtcccagtaacagggcagttcagcagatggagatgaggttaaggtctctgcagaagaaacaatccttcaaagctagactgcgtgagtgaccttgacctggactgtgagcacaaaggaagtgtgctcgggtgctgcgtgcaggagttgggatctcactgcagtttgggctcccttggaactcactgtgtagatcaggctaggcttgaactcccagaccatctggcctgctaagtgctgggactaaagccgtgggccaccacacttagggctgattcaaacttatgaaatggtg

SEQ ID NO: 23228 - DNA, 1205 bp, Mus musculus
gcagggtgggggggaagtgcagtagccataggaaatatattggaatagctattttgaagaaatacagtaaaatgaaagtgggtggcctctgtctttatgtaagccagtctgaactaagatactgttagttggtgttggctagctttccctactcacaagtgattactgtgcacagttttaatatttttttctcctgttaccttgaggcatcattgcctcttttacttagatctaagggacaaacacaaacttcagagacttacaaagaatgcagcagtgaatcttctgcacaacattgccatgtcaaatattaataagaatatgtgcctggccataatagctcacaaaattgaggaagacataacaaattataaagaattctcttattaccttttggatagaagaattaagattgcaagatggttttggaaaaaactgaatccgatcaggaagctggacctctggatagaatgaaccttacataagaagttgcttgatgtttaattttcaaagacttgtcagaatcagaatcatatacgttacaaaataatgtacagttatcttctgtcagcagcctgctagtttacgtttgccctttacaatgcacgtgagtgaaagaaagaatgacttttgcacgctgtcctctggcttccacactcaaagcacagcatctgagcacaagcgcagtgttcaacacacacatgcacactcactcaatatttttttaatttctgaagtagattttgtaagaatagtggtgtgagcacgcctttaatcccagcacttgggaggcagaggcaggtggatttctgagtttgaggccagcctggtctacagagtgagttccaggacagccagggctatacagagaaaccctgtctaaaagaatagtggtgtgtggtaattaatgatgttggttttgtctgcctcttaggcactgcacatgactggaggttacggtgtggtgctgtggacttgtacttcacgctgtttggcctcagcagaccgtcttgcttacccttgccagagctcgggcttgttcttaacctaaaagagaagaaagctgtcttgaatcctaccattattccagaagctggagtaggcaaccaggagtctgcgagtaacccaggctgccacgctcagctagctggattccagaaccctgtgagtgtccccagcacaaaagacaaagcctcactttgtgc

SEQ ID NO: 23229 - DNA, 1152 bp, Mus musculus
ttgggagtgaaaaaggaaatataaaagaggagcgaaaggctcaacctcctgcaaaaactcagggctcagagctccgccccgatgtttttatttttctccttgtccccgccccccgaccatgagagagcccaggccacgcccccaagccgaagttccagacccggactcgccgacttctcctgcttacccgcagggattccctcaccagccaatcgcgtctgagccacggcaccgcccggaacaaagatggccggggcggcctcggggagggcacattgatccaaacgccaggcgcacccgccgggacagcaaaggcagagtggcaaccgcgcggtcaggaacatggaagagggcagcagcggcggcagtggtagcagcgacagcaacgccggcgggagcggcggggtgcagcagagagagctggaacgcatggctgaagtcctagttacgggagagcagctccggtaaggaaaggcactcagtagatgggctctcgattgccctatgcccgccgcggtccggagcgcacacgccatctggctcgtggcaggcgtgtcgcgcggggcgtagggacagttgcgagcgagtgggatggttgggtcgcgctgcacgggtgcctggctactgcagcccggaggctagcagcttcagccaggctgcggggaccgatgccgggaacgcgcggtgcaggctgcgccctagctggactgctgcagccatgcgtccctccgactcgccaccactcagtgcgtgcaaacccccttgccaggtgttcctgatgactgtctagtctgctcgctccaaaaagaagagatttcggatgggaccccagtccctgcgcttccagatagaaggctccagcacccatgagtgccttcggttcagctttcctttttttctagcaagacatgcttccctcattggagcttcaggttacttttatgtaaaacctggagcatatctgcgagtgctttgacgggttgcttctcttccaaaacctttcccagttctttacctatcccttgattggcacacttggtttcaggtgtcacttgggtccgcaagggggcgtgaaagtaccttgttcagtgcccacgtttgggaccccggagttggcccaccgccgcgcacttttcctagaattaccacttt

SEQ ID NO: 23230 - DNA, 1120 bp, Mus musculus
ttttacaagccttctcgtgtcatgggatgtgatgccaatttagggatctgcttgccactacaagctccatcttggtttagatttcttcatctcacgaatattttcttgatctagaaaagacttcctttgaaccagatatcgtagcatgttcctgtaatcccagcacccaggaagtggaggcagaaagatcaggtgttcaaaggggaccctgtgtgaaaacaaaacaaaacaaaaatggagacaaggaagtgcattggggtattggtatgtagaggatattcctcagagtgccaaatgagagccattttacatagtgaattttgacagagatgcaactttctagttatgcattaacaagatggtaatgccatagagttatgcctaagtgatttcttaatgagatgtgataatcatgtattggtattagtagagtggattttattaacacgttaatccaacttttctagctttagtaagaaaacaagattttgaagtgccatggggatggctgatattactattgtcagtcttttgtttatgttgctgtagcatttattgacggcgttctcctttgctcctcctcacacccttttaagatagatattattaccttcatttttcaagtggggagactaggtctgagcaaattcagtggtcttcaagttggagcacctgctgtaactaccatgtactacagtgcatttctccagtgctccaaccccttgcctttctgcccagacttcctctttagaggccttgcgtttagccttcgctccggtgtgctaagaccttatggttactttgctgttgttcttgttttattgatcttatggttactttgctgttgttcttgttttattggtctaagaggtgagggccatcatcatcatccatcttgtgaatgacgaacgctgttcctaagtgggttggttcgtcatatgctcaaaacagcccggctactaaataggaggccttaccacatggcttgaatttctgtctgtctgtttggttggttggttttaagacagtgtcaagctcctgattctgtacttcctaagtaagattacatactcacagccccacactccccacactccccacactcgggctaacacaggct

SEQ ID NO: 23231 - DNA, 1068 bp, Mus musculus
cctttgccttgaaccctagatcctatcatttccctttagccaaactcagaacctcagaagcccctgtctgtcagagagggagtgaagaacagtttggctgacctcttagggttcttcttatccccagtttaaagaccaagtgccagagaatatttttttttcttctgtttttcgagacagggtttctctgtatatccctggctgtcctggaactcactcagtagaccaagttggcatcaaactcagaattccacctgcctctgcctcccaagtgctgggattgaaggtgtgcaccaccactgcctggctgagaactttttttttttttttaaagatttcttatttgtttttcattacaggtggttgtgagccatcatgtggttggtgggatttgaactcatgacctcccgaagagaagtggatgctctttaaccactgagccatctcaccagcgagaacatttttttttaaagatagggtattggtgacagttggcgggtctccctacaggatgtgatatagtcacagtgagtctccctttctttctttcttttttattttttgtttgtttgtttttcgagacatggtttctctgtaaccctggctgtcctggaactcactttgtagaccagctggcctcgaactcagaaatccgccagcctctgcctcccgagtgctgggattaaaggtgtgtaccaacacacccggcgagtctccctttcttaaccccatgaggataatccttcgccaccatgatgtgctctcctaactcattttgggcactgttacctacacacgtcctcttttcatagacaaggaaactgagaacaaacaaggtacaaaaaaaaaaaaaaaaaaaaaaaaaaaagatagggtgttggtggtcatagtgcacacctttaaccctagccctctggaggcagagacaggtagaggcagatctctgtgagttagaggccagcctggtctacagagcttgttctaggacacccagggctacacagagaaatcttatctcaaaaaaccaaaaaataaaaaaaaaaaaattaaaaagctattgctgtgtag

SEQ ID NO: 23232 - DNA, 3466 bp, Mus musculus
attttaaattctccaaattcctacagaccaataaatcccatccaaacctctattagagcacagtcacttttagaatgtccttgcttggtcacatgcctgtctccctcagtagacgctcagcatctgcagatcgaggactgtttggtacccaaagtctagccttcacctgttccttgcccaaaatagtacattagctacttactgttgtctgatgggcaacccccaaactatatcacacaatagctccttttatttgctcacgactctgagggttgtcagcatttggctgatgtgaccaaccactgctccaaaggtgccaggaggtctacacacacgtttgtattcggtgagctagttgtcggaggccttttgttcttggaagctgctgtcatttgattcttgaatgtctgtctcccaaagtcccatgtgttaataagttcttttcactagggtggcaacactgggacaaggtagaaccagccacacatttcagcactcggtgggtggaggaggcaggaggatcaggaattcactgacatccttggtaacaaagcaagtctgagaccacataaaatattgcctcaaagatgcaaacgaagaagtggtaggacctgatgagagaactgcagggacctggggagtttgcccctggtgggactgtgggaccccagctttttttcatcatttatttcttggccctgagacaagtcatttggtttgaccatttgctcctacacagtgtcctgacttatcacatgcctcactggtgagttagtaccgaatggggccaatcagttatggactaaaatctcaaaaactgtgagccaaaaataacccttttctctttatcaggtaattaccacaggtatcttgttatagtgagagaaatccgtctaacacagatggcctcatgcaaaccactccaagccacagttccaggtcgtgtagttccagacaatctagagacaacctgcaaccttctcttctgtagctcagaaacgaaacactttgactttcttcaattcaaacagctagctggagagagagcacagtggcaaagagcctagattgctcttccagaggacttgagtttgcttcctaaaattacataatggctcacaacagtccattgctctagtggcacaagatctgacaccctcttctgatcttcttgggtaccaggggcgcacatggtacacaaatatagatataatgcaaaacatccatatacatataattaaagtgaataaatacttgaaaatgggttaataaataaaaccagcccagagtccaggaacagagaaataagcagtaccttttatgagaagacctgcatagaatctgtggccaattttaattctctaaaaataaatacagaggagccattattagtttaatgcagttattgaacgctttagactctcgaatcaaattcttacccagccattggatgggagtgagatgtacctgaaggctggtttataacaaaaccttccaagtccatgggtcctaaaatgtcagtgctgcttgggctgggtagaacacagtttaatcatctcattgattagtgaatgaggcataaaacaatcttggactatacccagacttgtgcagcttggccgaattccttgagtctcttgccttccatccctgtcacagtagattcttctgtgggataaagtcattcagctgaaacaggtttatggcactgtggactcaaaagtggcatcagggatctttgaagagaagggggaggatcatctgctattgttatttgtttcaaataccaaggtcttattctgtatgtattccaagttggccaggaacttctagtatagcacaggctagtcttaaattcatagccatcctcctgcttcagcctcctgaggacttgaattataggcccgagctaccatgcctgtttaaatgagtttggtcttcatgtggatttgtgtctgtgatcttcaaagaggaaacggtatttacttattcactgcctgagataacatttaactgcgcatcttggacatattcttccttgttcccttataaaatgtattttcaaagccaggcaagaaggctcacacctataatcccagtattcaggaagtggagacaggagagttgtggtgagaggccagcctggactacagagactttgtctcaaaaacaaaactagataagaaattctagactcttttttttgtttgtgtgtggtgtttatgttttgatgatagaaagacagattttgttttttgtttcttcattaacacagtatatgaattagaagggctttttttttattaaaatgaaaactgcattatcttttttactgtttctgccttctgaagtttaattacaactgggcagggtggctcacagcacaaagattcgtgctggagaatggaatttgaggctatcctggctatacacagagaccctatctaaaaactaatttattaggtctagtatctcacacctctaatcgaagcactgcagagacagaaggatcaccacatctaaggctagcctgggctacatgtgatacccaaaagacataataaggaaattcattgagaaatggaagggaatgtgaggaagatcagccatctttgcctagatgaggtgtggctgactttatagatcacgtgacaggtgcctctgctttggaaggacagacaccaggttaagaatatcactgctttctattcaaatggatttcctgagtttccaaatctttcctttcaaatgtattgtggagatagtcaacttcaaggccaattttgaacccttggtactgactctggctgctatgaattctgttttactttgactataaatgatcagaataactccagagcactgtggtgtttctgactggttgaaattgatgattgacattaataatgatttcctgccacctgaacttcaggtatgatgcatatttcttcactgcagaaccaaaaggacaaatgagctgtatgccaaaatgaagtttgccgtcaaagatcgcatatagtattgttaaataagtttaaaagtacttaatatatggctttattttaaaatttcttgagtgtgatttgctatctttaataaaactgtaccataatacttaagatgattgtatgaaaacacagtagcatgaaataaatgttacatttttaaaaattaccaagtgctgactttttctctctttgaaaacaaactggccattttttattcacatcaacgtgatcttgtttttttggttttttttttttgttttgttttgttttggtttttcgagacagggtttctctgtatagccctggctgtcctggaactcactttgtagaccagactggcctcgaactcagaaatccgcctgcctctgcctcccgagtgctgggattaaaggcgtgtgcgccaccacgcccggctcaaagtgatcttctgactgaatagagaaaacgcatgggattct

SEQ ID NO: 23233 - DNA, 1187 bp, Mus musculus
gtctaattaaatgcctttggttatcaaatttttgtttggttttcattttattttctggtctttcaataagtttgtaatttcatgtcatttaaactggtgtgaagtaaaacctcctttctcagagtctaatggtgctaatttaatttgttacactgaatgctttattgtcctttaagagacatgatttatttgagcactgcaattttatattcattcccttttggataacaaaattaaatgtaggaggatataatgaaattgcaggggtttttccccctatcttgagtcccgtagcattggtgacctccagagcgatacatatataactagctatgctggagaattagcaagcaattatgatatagtttattgttctccagcacgatggcatgatctcaaatgatgaagtattataatgtgtaaactcctgaggatgtgtactgttgtaaaatagtgctttgtttgctaaatatgcttaagattcatttgtttagagcactgttgaaacctgctttagttgtagcatgctttaaaaactatggtattttttgttttgttttgtttttctaggtagagcaatgatagacataatactgttgccttctgacaaagaccctcctaagctaaaagagtgcttgcccattgtaggggccttgaaacatctgaaggaatggcattcagcaaaagttatcatagcaggaagttactgtgagatgtaagctcctttggtcaatatgtcattgttctgctactggggtttcgatagattgagcctttgaaaattaccttaatgtgacgaggtagtcttctgttgtactgtgactagagacttgaatctttaccagaacctaggtttttctcctctcctcttgctgagatgtttaaggttttgatagatgctgtcagtgatgccgtgagtcaccattgagcaccgtgtctccaaatgcactgtgcacttttataaaggctttcagtacctctgcgcactagggtggcagctccacaggacttaccatgtcctgtctgttttctgtggtacatgccaaggtacacacagttgtatttgtgacacattagtagaggtcagttgtgcattccacatttgattccaaacttagtacttaaaggatgctaagccagacctagcattggatgctggtgagccccctgtatggaaaggaattcca

SEQ ID NO: 23234 - DNA, 1102 bp, Mus musculus
actgaatttatagatctataggccatgtgttagatttagccctgggcataaaatatgctgtaagttctgactacacttaagcctttaaaataactataaaatgtgtagaaataaaccttcgaagatctttggaataggtgaaaatacgaatatgctgtttcctgctatgaaatagctaaatgatttttatgacaactttgttagttcatggcatttttttatgtctgattaagttgcaaagcaaaggcgttaaaaagatttatatttggacaaagtatactgtatactacagtgtacagtagcctgagaggaacagaaggatgcttctaatgtctgctttgaaaaaggaaaacatttctttttttttttggtttttcgagacagggtttctctgtgtagccctggctgtcctggcactcactttgtagaccaggctggcctcgaactcagaaatctgcttgcctctgcctcctgagtgctgggattaaaggcatgtgccaccacgtccggcttaaggaaaacatttctgcgtcattgtagaagcaatataaatgatttaggaaagctgaaataagaatcattttttttgttttacttgtatttgcttttaggtacttattttgcacagatcgttgcacaggtatagcacaaaggcttgtggtttctttcgtaacattctttagtgaagggtatgagtgcttcctctagggttctaagtgtataagtagaggaatcctaatattgctcattacattccttgttagcttgaattctagttatcacttgccttctcttttagcactgcccttgctacttttctgataaaatactctgacagaagcagtgtcaaaaagaaaaggcttatccacctcacagttgaggtctgcggtccttcatggcagggaggtcactgtggtaagatggagaagcagtgcacttaccccgcccacactcacaagcagggagcaatccatgcaaagtgctgctcagctcccagacagtctagcatgccatggagacggagagggaggggcccactcacggtaagatgggtctttccacagcgattagtgcggtcatgataacccaccacaggcacact

SEQ ID NO: 23235 - DNA, 1099 bp, Mus musculus
ttcaaacctgtaggaaagtgttgatgcatttgtaaattgtattgtaccctttcacactatatattttcagagatcactggaatgttgttatacaagagaattatacttatgtattgtaaataacatgatacatatattaattccaatagttttattcaacaatgtgtaatctaaggtgctcggtactacatgaagtttgagttaattactcaagttgcaaagattctattatatatttatagacaaattaaattgaccatagtcacagatactgtttctttatcgcttacgttttagcctgatcgatatctggataagagtcaacataaactgtcttttccatttttaaaattttaatttaaatatttatattttaggaaaagtatatttgaataaaatcgatgcattttctgaagtaaattgaaaggtgttattagcaagaaatagaaagattttactaagggagttatgtatatgaatgatttttttcctcctaattaaagtatatcatatcagagtggctatgatgagtcaatttcactgttgtttctcagcttgaattttaaacatcattttaaataatgactttagagtgtatttttttttattttgtcttaggcgttagtggatgatacaaagtaagtcaggttcatgtcctggtcagtgcatcaacctagtcatttgggagagattgtttgtttgggtttttttttttttttctgatttgctttgttcttatttctgtgacgtatggaacccataatacttgttcctaaatgaaaaccaggacagatgaactatctttacttggtagattcttcctcagttgcccgagcctggattcattagtctggtaatttgcccatgcttctcatcttatggccatttcaagaaggcaagagggatagagattatgtcatctctttctaacataagctaaataatacaaaatcaaactatataattattatgaactacccagaccaaggtatttaatgaatggcatcaatgaagtatggaaataatttttgggtgtatcttgagtgttttttttttctaaatctgcctgtgttatagcccctatgaatgtcatgtacaa

SEQ ID NO: 23236 - DNA, 1212 bp, Mus musculus
aagccaaggttaaaagcccactcatctacggatgagaaaatcatttgatcacctcagttaagcgttgccttatttaacttaattaataggggggagagagattggagacgtactattgaaagggcaagcccttcactgcctcccacccaaataaaaaggccaattggccttgtactacaagagccggtcactccttctccctgtttcccacctatcttccaaaaatgctaaggaattcaacttagtgttattttcacatcgttcagtcaaacttagccagagttccaaacgccctacttaaaattcaactagaaagttacctaccaagtactaattagcattataaagtcagagtctgcagctccaggcctttcagttgtttactagaaaggacagtcttaagccagatacagtttaccataagaaaagttaaagattcccagtgaagcaagttttttctttagccctagattccaggcagaactattgagcatagataattttcccccctcaggccagctttttctttttttttttattttgttaataacagggaggagatgtagtctcccctcccctagcctgaaacctgcttgctcggggtggagcttcctgctcattcgttctgccacgcccactgctggaacctgaggagccacacacgtgcacctttctactggaccagagattattcggcgggaatcgggtcccctcccccttccttcataactggtgtcgcaacaataaaatttgagccttgatcagagtaactgtcttggctacatttcttcttttgccccgtctagattcctctcttacagctcgagcggccttctcagtcgaaccgttcacgttgcgagctgctggcggccgcaacagacagtaaataggcaaagatggtgccagagaggcctcctagccaggtgacattattcattcaagggaccttcaccaatgtcagatgttggtggtaccacgatcgttcaggaaacaaagaggaaaacaggccctgtcaatcagacatctaacaagtcaccaaggtcacttgtatgaaacaataacttaaaaaaaaatcaactgaacactgttctctgagatctaagacagagatctgaatgtctatggggagtctcatggaaagcttccttgagaagtctggaacgggtcttggaatgagttgtgtggatgtgagcaacaggaagcctgatggga

SEQ ID NO: 23237 - DNA, 2369 bp, Mus musculus
cgaggggtgaactgactgtgtgcccagagcatttgtgctgcgctgtgttgtggtaggaggttccagatcacactggccagacacacgtccctggaggcaagcttcgggacactgattccgttccatcctcgttgcggatgtgtgttcaccgagtcggtggagaaaagagtgtcaggctctaaattttttgttcattgttttttgtcccaggccttttctggtcgagtgtttgtgttaatggcaagggaagtacaactcctcagatgtgtgtcgatcagtttttaaggctaatagaggcacatctgaatgagtcactcataattagaggttccaatagctttaggatcatttgcgtttggaggtcattattatcttgagtcatgcatgtatactctttgtgaatcagacctgctcccttttcataggtgggcttttgccagcagagctcagcttatcactaaataaagttttctgaaggctacagtgctttatatagttactttatgttgtcattctgaaatcaggctgctggccgcagtgtggtgtagctggtatgctctgaatgatgtctgaaggtttttgctacttgggtttttcctttgaggcaatgtgctctaacagtgtgacttgtctttctctgcgcattaaaactgtgatgtatgttatattaggaagggggagtttgaaaaagagctctccctttctccatatttaatttatgtgattaaactgtcgggtggagagaggctgaccctgagccgcctggttctcctgccgacccgaggctgtgataaaatgtgtttgtctaagatccacaagccgatctccctgtgccggtgcctgtgcacttctgtgcaaggaaggtggagactcaccttcggaaaggactgccacttgagcgagcgagagattattctaatgtcctggtacccggctggcttctgggaggactggcttttcgaagggtctgcaagaatgcagaacttttctgtacaaggcagatgttcataacagtttttcccctggacctgattaggaagctgataactttattatccttccaggatagttttaccaaagtgagccggttttgagtgttgacttcacaaggtaagaattcatagtgggttctcttcatgaatgtgaaaaaacaaacaaacaaaccttattttgtacagacagctttcctttttgtaactaatcctttttactggtaaatattgtaaattaaaatgtgcaacttgaaggctgtctgtgttaagtttccgtacctttgcggtggtgtgttatatgatggaatctatgtcactgccttcaccgggtcggttttatgtgatctccagtagtttatgactagcaggacagcaagcctttttgtatgtgattggtgctcacgtattagagaatgtctgaattcctggaagaaatcagtactgaggtttcctctgtgtgtgtgcacgcgcctgaacctgcctgagggtgtgggtgttggtgtggggagagagtgtgtgagggagaaaaagatggtatgtgagtgcctgtgtgtgtgtgtgtgtgtgtgtgagagagagagagaggggggggggagggagggagttttggtatatagcctatattgtctgcaaacttggaatcttattgcctcaagcctttcaagttctggaattagacatataccatcacatttggcttggtttttatttaatgaggcaggatgcttccaaattttaggagtcacagctgtgactgtgcatttctatagctttcacccatgagtgtgagtttcggaactctgaagtcagataaacccttccataggtaagaacaccagactaggacacacatgccaaggttttctcttaaaggtgagcagtttgagtgtggcttcctggccttgtgatgcgtttatcccaagataggtcaacaacaggaagcagggctgtgcacctaaatcttaagagagaaataatgagccaataagaaggaaagaccctgttgatttagaaagacaggacattgccagtctcgtggtagttgagctgtcttttgaatagctaataataggcaatgttgcggctgtcatcgtctccgttgccaattgtgtgtgaggtcccttgccattatacccttccagtagtaacaatcctggataatgaaacgtgctaacccttgggaaggtacaggtctttctggccttctcacaggtagtgtcttagaagcctggcctgggcaagcatgcttgctggcagtttatttgctttctagagtggctctggattgggattggggaggtaacagggcactggcctgggtatttcccttttcccaagtcagttgtcctgtttgctcctatctgtcctgacacacta

SEQ ID NO: 23238 - DNA, 1105 bp, Mus musculus
ttgcaggtgttcgtttgctccggcaagaatcacgtgggtaaagatggaagaaggatatgtaaatagcagccgtggctgctgcaggtgcctgtgtgagcctgggagacctgaagagtcagtactgactttaggatgcagggcaaggctcagcagtcctaagtgatctctgtgtgtctcatctcactgacagcgatgcaagagagatgcaaaccacagctccagaaatgtgggagcagtggttgctgtccatcttcctccctcccatgctcttctcttggtagtctgcgtatttgtctgttttacaaacatcgtgtgtgtaggcaagagctcagaaactcactcgcgttgcgcctgccccacctcctgagacatactggaataaaactaatgttttgaggatggactggggtcttggaagagatgtatgtcagaggtgctttgggcctggaagctgtgggcctcattcgttcttcagccctgatttccctctccctcagaatacgtttgtccctcactataaaagggcccattgtagagctgtcgccgactcccggggacggtaatggacgacagtgaacacgactctttcccatgctcttggctccagcttgctgcagctcactgtgttgcctgggtgtctttgcactgacttgcctctctttgcagggtgatcaatgagctcattggaaaccttgtcggccatctttatttcttcctgatgttcagatacccaatggacttgggaggaaggaattttctgtccacacctcagtttttgtaagttttctcttctcttgttgaacattgtgttgtcctgtggtttcaggtatcccaacaggagacattttcatgaggagacacttcactgccctctctaagcgagaaagaaattcgagccaataaagttcttactgtggtcacagtcaggaaaccagggattcatgccacagcttagtccctttcataacatctgggtaaagatcactgactgggttaagccgttacaaagatcacctatgctgagcaggtcgagttatttggtgctactttagagtgccaacagtaggctgggggacaagtgtcataaaggataacactgcttttt

SEQ ID NO: 23239 - DNA, 1182 bp, Mus musculus
atttccaataacttcactgtggttgaaaccgtgtgcttttatttattttttaaatctgtcattgacatgtatagacatgtgatcattacaacttttattttttaaaaccacgttcatttatttgtgtgtgggtgagagagccatggcactgtgtggcggtcaggggacaaactgcagttgttgattctttccttccaccacatggggcccatagatcaaatcaggttgtccgacctagtgacaagtgcctttacccgccgaggcatctcacaggccgtcttatcattttaataaaaattgggctgtcagagagatggctcagcaggtaaagtcacctgcagccgagtttgatgaactgtgttctatcaccagagctggaagagtagaaggagagaaccaaccagcagttatgctctgacttccgtatgtgctcagtagcgtggatgggcccacatacgtataacatgtattaaaaatattttttttaaaatctgggccatcatgaagattgtcattggtggctcagtgagtgacgtgtttggcgtctagcatgaggattcatgattcctagcactcacataaactgggcgtgccaaccagcacaggaaggcggagacaggagtaccttggggcttgctggcagccgatctagctgactggtccagtgagagaccctgtcttgaggtaacaagattgagactgattgagacaactaatgttgatctctggcccgcacaccacatggggatgcacacatttactgcgcatgtaaacgtatcatttagtctgatgtggtcatccgggtctgtaatctcagcacttggagggcgtacgatgagatgctgttttaaaaagcagaatatagccatcccttgtccattgctttgccttgtgtcatcctgaagaagtgtggccttgacgtttagatggttgtgtcatgggaaagtgcttttgactgtgaagtggaaaagcatacttcagccgccatcgtaaactttatcttcttggttcctagtggttttatgaagagacagaatgtagtgacgatattgaagttctcactctcaagaaattcagaggggacctggcctacagacgacaggaatacgaggtgggggtcaacacgagtgggactttggcatttcagctgggctctggttttatcatcagtagcacatgcag

SEQ ID NO: 23240 - DNA, 1667 bp, Mus musculus
agtagttcctcttttacaacccagaactcattgtttaatatgaactttgatgaatatacaaaggaatatgataaaaagatactgcagaacacaaaacaaatataacttttgtacaagttagccttgtgtacaagcagaaatactataaattgttagacttcatgttacaaataccgacaatgaaatatcttcctcctaataattttatacatgcttacagaaaggcgtatgtctaaaagcaaatgtggcacatgaggaacacacacatggtttacacaaactgcactgtgagtgattgcaatgttaaagagaacgcagaatgcactaatgctagctggttatttattctaaaagcagaaattaaaatgtggttgtctttaaaattttagggttttgtttgtttttcttttatagctacttaaaattctgaaggagaataagttcttcaactcaagatctctgaattactgtgaatgggcccaactaatcctgatgacactgaaaatgctttggggcatacatactctcaaaacagaatccaatgtccaaaagaaatggaacttgatgttgtgccaaagtcaaactgctgcagtcgggggaagttccgcaatgtatatagagcgctaattaaaacacacctgtaaaaaatgaaattttaatacagtccatttttattctgacaggatggaaaccttgtgaatctttgactttctaaggggttaatgaccactagagcttgtcctcacatctagtccagcttactgctgtgtaagatgggctgtattacctgtattctttgacgtgattaagcttacagctttgagtgaccaaacattttacagagtaaaagttgttagaaatgaaagaggagaaccaaaccctactttacttctgtgtcttatttatcaggtcctacaccaaaattccacagtttgcagtgtgcctgtgcctgttatgttaggacaggaagacctgtggtcttgctggccttcatgactagaccctccactgaacactgtctccatttgtagcactgtgtgactcctctgtcagatccgacttgctttttactaaactgaagatactaccccaaagggagaaagaacttagcagagagactcttaatactgttccaagtgtaaaacagtccacagtaaaatacatgtggtgcgctttctcacgggcgccagacaggctcagggcagagtttgcaggaatacttttcatgaaattctaccttgtagtaacaatttcagtgaacagagaaaaagaattcggaacctaacatgttaaaaattaccttttcgtgtaagaatcggggctttttaacggtaagtatgtcgcagcagaagacagagttcctactgacttgtcactagcctggtgctgatgtcgtgttgggaaggaccctttctgttgtgatcataggaccacttttcaatctgtgctttcctcacaggacaaattgtcagttttattagatttggacttaaaaatttttttttggatggtcacacatagtgggtttggccagttcatgttttgtctaacttaatgaatactaaatactaagctcttggttaaatgtttgtcagctaatgagaaatgttatgataaagccttgactatgcatgctgctttcattttgataaactttttatttttta

SEQ ID NO: 23241 - DNA, 1500 bp, Mus musculus
ttttttttgttgttcttgttagctaaagcacttttagttttatccttccctagtaggttattgtatcagactagaattatatctgttatattttgctgtctttgttttcctttgtctttctcctgtttgccaaaattcaattcaagttgtgattttcaagaggacctcaaaacaattctgtacttaatataaaaatcaatgtctttagataaatactttcatagttctaatttgggttaatatttttaaatgtattgtttacttttgtaattatatacacaacaaatattagtgactagtttttgtatttgacaactgtttaccattgtgtttaggttatattctataaatactctttatatgcatatatatggctataaatataaattttgtattactggtaccaaaaacacttttttttttttttccagcagggtttctctgtgtagccctggctgtcctggaactcactttgtagaccaggctggcctcgaactcagaaatctgcctgcctctgcctcccaagtgctgggattaaaggcgtgggccaccacgcccggctcaaaaatacatttcttaaagttgaaatcatttgcttcttccataatgggacgttgaaacttctgctttcggaacagcgtgtgttggaaagcttgtttgagaatggctactagagtttaagaggctatgtatggagtttgttggggatgtagtgatggtggtaaggatcagacctagggcccagtgtacacttaagcacatgcctaactcaagagtttagattttagtatagtttaaagttgagctgccttttcttatgtagctatttaaaatatttctgaagttcagtaatttggatgccttcattagtagatgctgtcctatatacctattaaaaatgccaaacactgataacattgaacatgttcatattgatagagataatattgtataggtctagtgtgtatggatctgggatctccgcccttgaggcagagacgggaagatcaggagttcaaggtcttagctacatagtaagtttgaagccagcctggctacttgagactctgtctcacaaaagcaaataaacaaaggattatgcttaatagttttcattgaagtttattataacttatttcagatgtgtccttttattgtacattttgtataataaatgttgaagttgaaaactgttactcgtttctagttcttgtgtgagttcatacgtgccataacttttgtgtgggagcagaggacagctctgtgacgtctttctttgcttccatgcttatatgatgtgaatctagggaatcaaactagattactggggttgtatgtgtacatgtgtgtatgcgttcatgtgtgtgtctgtgtgcatatgcaaatatattctcttattttgttacaacattttacattttcaagataaaacacaattccaaaatacaactaacccagtttcagttcctgtctttaagttttaacccagggtcatgtctg

SEQ ID NO: 23242 - DNA, 1217 bp, Mus musculus
cctcttttcacttactgagatgggtctctcattttatcctggtgctcaaccagtctggctaattaattgccaactttgggggtcccatgtcttaactttatgaggtggaaactacaggcaagtttgccacactaacttggcaattaaatgaattctgaggattggaatgtcagtccttctgcttgcaaagcaagcacttgaactgctgagccatctctcacccccacattaattctctcactgaacctgaagttccctgtttgactaggctgactagggccagtgagctttggtgactcacctgtccctgttcacaaagtttaggtgataagcatactcagtaatacctggcttctgtgggagagctggggggttgccgtcctcttctcagcatgggttcttaatccctgagccatctctagtttccctgtgttttccattgaacaatagctaagtgccataaaaaatttcatttgcacgtttttacattgaaataaacctttaccaaaagaaatgctactgtgtgattctttgtccataatactaatttgttttcttattttttatgtttagttctattgtttcaaccctgttagctcttatggatggtttggacagcagaggagaaattgtggtcattggagctaccaaccggctagattccatagaccctgctttacggaggcccggtcggtttgacagagaattcctttttagtctacctgataaaaatgtaagaaaagtttacatgctttttattattaataatttttgtaaaatgcattcctttatgtggcgggggtgggggaaatagacaggaagtgtttgtgctgcagagcagatgtggaggtcaggtgtgggaataagtttccctttgtactgtgtggtcctgtggctagaactcagctcatcaagcttggatgtaagttcttcaacctgctgagctgttttccactccagtaacaagttctgatgcaataaaaagttgtagactttagtttggatcatgatcttatgatcattcaaaaggcctcaatagaggtaatttattttcgttaagcatatctccttccccaactgcttttaaaattgttttcggttaagcataccccagatgttgtcagtttcgttagcttcatgagtccttagccagctcattagctttgccttcttccagaatactattggactgcaataattagttaggctgaaaccac

SEQ ID NO: 23243 - DNA, 3082 bp, Mus musculus
ggaatgtgctcgtgttttctgaagcccgaggcctgtcgttacacatcttactgcaaccaagtactgctcagcagccagcactgcactggagacaatctgcatttcttttataaaactgaggacacactttataggctgtagatgactgttacgtttataagcagtcactatgaatattgcagtggtagttttatatgtaagtttctcagacataaacctggtttaattttatattttgttacctacactgagggaatcatgggaggagatggactcttcttcctccaaaaggcttcttggttcttgaggcagtcacgctagaagtggcaagcatccagcagtgaggggtacagaccagggcattaaggattactgtggacgtcagtaaattatgtacgccgagtgaacatgattgagggtatgtcggtcagcatagttacataaacctcaccttgatttctacggtcttaactgatgatcctttgacatctcatgagcgctatggagaacattctatttttaaatgatgtttgtatgtggactcccgttgtcactcacctttggctttatattttcatagagtctttatggaaaaatagaatttattttccacgtgtagttgaggctgttgcacgtctcatcttgtagctttacctaggaactgttagggtaattgaccttgatttcaactaaggattgtggtggaagttggaatcgcacagcagcagcctcagggccgtgtcttggactcagctccatgatgaaacgattcctcagacacaacatctggacctgaaactggcacacagctctggggagtgaagaggcactgactggcttcgtgtgctgtgggcattgggtcttttagtgtctcaaatgtcagaatctttggatttgccacttaggctgtccaggtcaccttccctggggtgtttgtgtgcttagttgagctcccctaactgaattgggcaagcgacagacctgaaacacgcaagcattacactgattgagaacattggagcctaacagctttgctgatggcttttgttatttatacaagtgatatttgtgtaattaacagacttctgcaagtatatgcctttcttgaaaccgttaaagtggccatgcatttaataccatggcctatctgtagaattgactattttggaccaggttacctgtggcacagttagtgctgtgtttgggtaaatgaagtaatgtttagttttctactttgtcttgtataaggtagaactgtatgtatgtcatgtttgtctgtaaaaggaaaagtacatagtaatattaaaataatttctatgactgtgaattactcatttatttttccaattactgagactgtacattcctagtgctattagttatatgtgtatgtaacttttacagtttcaactgaaagttgtccgtatttcttttgatcagggctcttaatctcatttgctttgattgagttaactgtaggtatttatctttgtattagtagtcgaataccaactctaatgacatgtacactaataaagaattgaacagttgtagttacgacagtccagttattgctgagtttaaagcttaaaatatgggagtgatttgctgctataattcctttgagaaacactgaagaagagatgagacctaaccgtgatcatgaacttcagggacagtactttaaattagaacaacactttacacctctctgatttttgtttagtaggaagattgaaaccatcagaatcccagccgaagtccctgtcttctgaggaaccctgttcattttagagaggatgacgtgtgtttgtgctttgctttatgactgtctggttccttccactcacgttagctctcgcagaggcctctattaagttgataaaaaataaataaaaaaataactatagactttgttctttgccaaagaagattgataaaagttgtgcccagttattttgcaaatgtttaatttcatctggcttagcaccactctctctcaccacttattataacttgaaccatgacatttagaagccaagaaaaaaagagctactaaatatcaaaaagggcgtacagtttagtaaaggtctagtttcgactcacaaatgtgtctaaagaaatgcaactttgtatcacttaagaagttaggctcagccattcctttcagtagccgttctcaccctgtgggttgcaacccctttgggggctcagatccatcctttcacagggtcatatatcagatatcctgcatatcagatatttattattattcataacagcaaaacaacagttacaaagtagtaaaaaacaattgtggttggggatcgctgtgccatgaggaactgtgttgaagggtcacagcatcaggaaggctgagaaccactgccttagccctctcttgtgtaacatgtgtaaccagatgcttttgcatttgtttgagggatgtgatttccctttctgggtcgtttgctttctctgccattctcattttttatgttcagtgtttcaagtacactttgtattaaaggattttaaagtaccaaaactgtaactcagtacaatggattgtgttctgttatgatgttaatattatccaaggaaattgtataaagtgttgtcaatttgattattgacacaaataacatgtttacaaataaactggtgttgatcaagttactgtggagagtgtctaattttctgggacttgttttaatattaaatacctgtgcttttcaaaaacctggctttcctgtgttttttcaacaacttttaaaatttggtcctaataccagatttgcaggaaaattaccaggttaggcaagggatgttcattgtctctgccctggctagttttaagtaagcttgatacaagctagaggaaaggagaacctcagttgagaaaatgcccctatgagattggcctgtggtgtgggcagctctgtggggcattttcttagtgactgagactgctgtatcataactcaggccatcactgagagaaatcaggggaggaactaggaactaggaaggcaggaacctggaggcaagaactgatgcacaggctagacgtgcagcttac

SEQ ID NO: 23244 - DNA, 2537 bp, Mus musculus
gtgaacatttacaatcatataaattcattcaatttttaacctttcacatctatccaaaatgaagcagtgttttaagtatgtctgattcactttaattttgagccatgctgtgttaagagccagaggttaatcggatggaacaattctctggcctcccttttacacaaaccatacatgctaacaagtgtacttatctctgattggctctttacctttaatttcccaactttgaacaatcacacagtgaattctggtttgtgagagaaaggcagtgcttggatatgtccggtctcttaaaatagggattaagagagtagggaaaactaagaaatttataatgacatttggaaattaggctaaaataattttttttttatagaaaatggaaattttcaaggaggttgtgtggggtggatgataaagttccagtgctgccgggaaggttcaggaagcatcagttctatggctttggaaagagtttcccctgatgtgttgtcattgtctcatggaacggaaggagccaaaatatcccatgcttaatcctaatctcattagatcttgctttgtgacttttttctggatgaatattttagaaacaacatgtattttctagtttgctacctagtctgtaacacaaggagaggtcctttctccctttggtggatggttttcttctttcgtggtggttatgcacacagttggtgaaagctgtgtgtgtgtgtgtgtgtgtgtgtgtgtgtgtgtgacagctgtgtcctgtgtctgacctgaacaccgtcctgagaatcccgagctttaattgctgaactgccccccccctttatctcatttgctctacatgttaaaaagttatatgtagcagaataattggacatgtggaagagagaaactgaagttagaatttaatccttggggaattaaaattattcatgtttcctaagtagatggaaaagatgaacttcacgtgactatgctttctaaatcttattttggagttttgtttgcacataattactttgggctccttttaaagaaaatttcttttccataagaaagcatgtcatatattgttttctttgcactttgtcctgtccatttatcatagaatttaaggaaagatagcataaaagtaaaaaacatcaaattctcatatacacaagtaatattctcctttggtcaggctagcatcacatgacttgaggtggcagacagattcatctttgctcacatgtcccacgacagcaagcacaaggttccaggtgaaaggctagaatgcacattttactttctgtgtagacatgtgagtgctctttccttcccttgtgtatcggtggcatgtcctgtctttgtttgtcagtgctgtattgtggtgcttaactcttctttgtattaaataccatctccagaaacttgtcttggagtttagaaagcactttggattgttgattttttttttctttctcttgaaaaagctcctcgtccttattaccagaatttctgttaacagaattatgccagttttgttgaaaacttcacttatgggaggtgtaactttcacacgaaagacatgctaattttcagtcaaaatttttgaatcatatttaatcaataaaatgctttcaatcattatgatacttcgttttcaaaagcagacaaacaaaattaaagtctcgttctctcgagctctggctctgacctaacatggtactttgcacagtgtgatttctgaaggtggcccctttaagttaaggactccataccacccgtgttgagcgtttttcaccacagagactctgatgccagctgaaactggactgccctctttctcatagcagctgttctctatcagcgttagagctgcagcggacggcatcgtgcgctgctgtagtcctgtctgttcagaatccatggtgtttgtgtattatgatttatggacttgttgatgcatgtaaactgggtgcattctgttgcctctgtatgttaaatagtgaccaatgtttttacgaaagaattgaacaaaaaaatatcttttaagacgtttggaatgtggtttttgattttaaaatttggttttcttattaatctcagaggcgctgggttattctatgacagaaggaaacaggatcaatgaataaatgcaggtttgtaatgacgcggcttctgtatctgccctcttagagctcccactgatgtgaaccccatggagtgtgagagaaggatgattccatgaaacagctgcgaacgagcgctaggccttccagccccagaggctgctcaggctgctcagttcacttcaggctttgtctccatgcagggcactgtgaaagcagtggaagggttaaaatttacactgctccttggtctgatctcactcctcccctaactcctcccaggctcctttcacacctgactttgagcccctacctcaccccaccccactcaccctcaccctccatcccaccaaggccaagttgtgctgccaaatagtcctggctgagtggccttcctctggagtgtggctggcttgtcagggctgc

SEQ ID NO: 23245 - DNA, 1190 bp, Mus musculus
ttatgcccctagttactactcctctttgcgacattcaggtagtgtccttccaaaagctaccagtatataacaaagacagataacacaattgagtctttgggaatgcagagattgaaatctctcatatgtgcaccaagaaaatgtgttcaggattcggcatctattccttgtcagagcaggcatttgcatcaggccctgtggaattttagttcagagcaatttcaggacaatgtgtttgttcagggttagagacagagattggccccaaactggaggccacatagttctgaaaccagcagaaatctgatgtgtgcatgccccaaccccattcccgtagtgttttatctggtaaccgtgatgagccataaggagttttattttcctttcatcatgaatggaggtgagatgtatcagatttctttcttctaaatgactgttgtttgaaaattatgtctgagagaaattatattctaggagagagagagaaaacaactttaaaaagatattggtagtttatttaattgaggttttttcctgtttcaaatgttaacacatgaccattgtcttgatagtattatatatgtgaatgttggtatttttgattgttctttattttctgttggaggtttattaaatcaaagagaatttgaacctagaatctaggcacatcatgattgaatcactgtctctgtgcctacatcttcatatcttcaaagcagagaatttcctgatggccatgctccctacatttagactgaatagttcttagttgtgatggactctgtatcgctaagaagtttagaatccctggtgctaggagcagttcatattttttatcatatgcaaagcagccgtgcatttgcttctagagggaggcagcatcccaccaagaatgctgtgctttcggacccttacatctagtcttctgtgagacttcttctttgaggaatgataggaagagaaaagagaggcaacccactgagaaatctgttctttccttgatgttaggcaattttatcttaaaatgaatgtccttatgtaaccacattcacagacagatgtactatttatgatatttatactaggtagatttttttctagctcagtttaagtttttcatctgtaatattataaatgactatataattctttttcaaggaaaatgctaatacatacaataagtaaaagta

SEQ ID NO: 23246 - DNA, 1193 bp, Mus musculus
atggaggacacatggaagaggattcgtttcccagacatacttcgggtcttctggctaacaagaattacagctcaggctacagtgttaatgtacattttaaggatggcaaatgaaactgagtccttctttatttcttgggatgatttctgggacgtcatttgcaatctaataattagtgggtgtgattctacactaactgtactaggcatgagtgctgtaatttcttcaatagcccattatttgggccttggaatattggcctttattggatcaactgaagaagatgacaggcggcttggctttgtagctcctgttttatttttcattttggctcttcagactggtttaagtgggctaagacctgaagagagacttattcgcttaagtagaaacatgtgccttttattaactgcagtcctgcatttcatccatgggatgacagaccctgtattaatgtcgctcagtgcctcccatgtgtcatctttccatagacactttcctgtgctgtttgtctctgcttgcctgttcattctccctgtcttactcagttatgtcctttggcatcactatgcactaaatacatggctgtttgcagttacagccttttgtgtggaactctgcttgaaggtaatcgtctccctcactgtctacacgctgttcatgattgatggctactataacgtcctctgggaaaagcttgatgactatgtctactttgttcgctccacgggcaatattatcgaatttatatttggagtagtaatgtttgggaatggggcctataccatgatgtttgagtcaggaagtaaaattcgggcttgtatgatgtgcctacatgcatattttaacatctacttacaagtaaaaaatggctggaagacattcatgaatcgtagaactgctgttaagaaaattaattcacttcctgagataaaagggagccacttgcaagaaatagatgatgtctgtgcaatctgctatcatgagttcacaacatctgctcgtataacaccgtgtaaccattatttccatgcactctgccttcggaaatggctgtacattcaagatacttgtccaatgtgccatcagaaagtgtacatcgaagatgagatcaaggataactcaaatgcatctaacaacaacggatttattgcacccaatgaaaatccaaacccagaggaggctttaagaga

SEQ ID NO: 23247 - DNA, 1180 bp, Mus musculus
aagaacacacttacatatttgcaccctcactgcccatggacactttagtctttgaatgtggccttggccccaggccgtgctctgggataatgagatggcacagccataagcagtgaacattttgtggttagaacaggatgctgctgtgcctgtgcagcatcactggtggttacctggcatccatgattgctaccttttcagctaggtgctcagaaaacatggccagacctagctcacccaagacacaagtgggaatgtaaatgctttagattgccagcatgttttagaatgaatcagtattcaaagtaatgagaagtactgtccttgtatttaaaaaaaaatcacaaattcactgtagacattttagaacaattttaggtctagcgagactgaacaaagcagagaccacacacaccctcataccgcaccccccagtaaagcacagcctcccacacactaaatcacagcacagcggttacacgtgttagaatctgtaaacccactctgacacatcgctgcctccgaagcccatgttgtaaaggtggtcaccgcgacggcgcatctcttagacagtaacttcactgcctcccggtcctacgtgctgtgtgtattcatcctccctactttcttatcctgcagccctggtcttttcactgctccttgataatcactgccccatgcctgttaccccgacccatcgtaataaagcaaaacatgaaaggagaaatgattaatagcttttaagtactaagtgacataaatgttaaaggcccagaaagagattagcaaacagattcacccaagaaatatcccagaagtaggtgcctagaaagcagatctaggacagggaatgggaactggaatggtttagacagagaaatgatgaggtacacagataaccaacctgtgacttggatgggtgaagaaaacacaaggtagggaacgggggacacccagcacagcaggaacatgggattaaagatgtagactgaactgacagtcccctctcttacctcactctgctccaggacacttccatgtacatttacaaatccctaccctactcctagcaaagatcacagggtacccttctagaaaaagatccacccccaaaaaggtctctacagaagcttgtgtgagagcccactgtggaaaggtccagctgtgatctaacctgcca

SEQ ID NO: 23248 - DNA, 1116 bp, Mus musculus
gcaggattgctgagccttgctgagaacaacaaaggaaaagttgttgcaataggagaatgtggacttggtaagtgccaacctcatcacttaacattatcttgaaaaaactacttgttatgttcaaatcctgagtaatttttattctttatcttttaaagattttgaccgacttcagttttgtcccaaagatactcaactcaagtaaggaaatttgttgactttgatttttattttttcaaagtaatattgattgaacatgtagggttagataccaaggtgtttttgttttccctggaagatatcaaaagttaagtgaaagaaagttcacacatgtttgcatgtaacgataatccccaactgattagccgctggatatgatttgaatggtgaaacagcattttatgttatatagacttgggcgggggggtggcaacaggtgtatctatgcacaaactacccttggtccactgtagtttcttatgggaactacataagaatccagatcaaattatctcttaataaatcttgtcattttgggggtgggggttgacatctgtgccacctgagggacttcccatatcatactttttagagatgttatgaactctgcctcttgaacaccaggtatcagttcacctaacctggaaaaatcagatttgcactgggacagaaacccattgtctttaccggcttctcaggccatctttgcactgccatgtctgcctggaccagagtgagccctctgagccacagacgggcaagcctcggtacatgacaggtgctgttacagagctccacagcatgtcttcccatgtggcttttcttctagaataagttaaaagtgattctccaatacagcctgaatattgcagactcagcttttggatccatgaaagtactgatagtgtgagttctatctactgctttgaagataacttccatcgtcagtcagtgttagaactcagtatgtatagcagagtatagattatgctgggtcacacatcagatgtccaagggccagtttctaatagaggtgacctcagtttatcctctaagtggttgctgagtgcctcttcagtggtaagagataggcttcattctttggcctttattgac

SEQ ID NO: 23249 - DNA, 1173 bp, Mus musculus
tatgaagggatgactgagtgaaccggtaccttggagggactgtcaggccggccatgtagaagagttcacgaaagacagaagaaaagtgattggcttggggggcggtgctttttgagagatgggaggactcggggactagcccatgctaggcgatcagtctacggctgaagcacaccccacacctattcctctctttccagttgaattaaacacacacaaaaaaagcacaagtcacaatgattcattgcccgggaatgctcataaatgaacatgcactagggaaaccatcctccagcaagaaccagatcagtcattgccagcacgcgaggcctccgggcatcttccgtgccctggaaaggccatgccgcgaaaaggggacccgggactgtcagcgaggctcacgaccaagacaaacctgcccttacccacgaacttgaagagactcatgacggcgcggcaggctcctcccagggaaaagcggaagtggctcagagcacgctcgtccttccggttccgcctcacaaccgcccgcttccgggttcccggcagcccccgcggcggccgctgaaggtgagccggacgctatggcgttctgcgctcccccggcctacctgacccaccagcagaaggtgctgcggctgtataagcgcgcgctgcgccacctcgagtcatggtgtatccacaggtggggagaggggacccggggctcggggacggaagccgaggggccccgtgggccaggctgatcaaggacttgggggacacagtgaagggagcccgcccttgaacccgggtcccgatgcagtcctctctgcttgatctggcggagatgattgtgtggggcgcaaccaggacccagcgtagaaagttgcatgaagaaataaaaagtacctaggactgtcattgtcatggatctaaagctaacgtttttatgactctgtcgtccctaaccttaacagtaatttgtccattatctttagtttgcagagtaactcagatattagtgattattttagcctgattttacagataagcaggctcattctattccacctcctacgtcattttatttctttaaccattgttactagtcttctcgttaagtctcatacggtggcatatgttgggggagacagatattctccattacattatgagtttgaggctaggcca

SEQ ID NO: 23250 - DNA, 1380 bp, Mus musculus
acccggtcctgcgcatgctgctgccatgggtagacatagtcccttctttactttctcgtctcttatactcacttccactgaatccaaatacatccaaaggggtaaggcaattcagaaaacgtgcaaacattttaaaatgatagcagggaattcttagatatagaaaatgccttttacttaactgtgcccagcaggctgggtgcgttgaaaagcccagatattttgaagaaaaaaaaaattcaaacagatttatcaagggtaaccagcttggagtctagcaattttgccaatgtgcttaccaatttgggggcttgtttttcttcccttccttacataaggacagttgattggcttctaaacaccggagcaaagtggatttatttactgtcaactgggagtctgacttcaattcaggcaatgttttttcttctttttctttttttctttaaaagtgaatttgtcctttctttctttaagtggaagttaaatttgttaaaatgcccatccctaaagtcaacagagaactgtagatttcaagagctcacatttaaagacagctgttcaaagggcaaggccctcggcagcacagcagctgacagtacacgcctgacattttgggcaggagacttggtgggtcccatgtgctccgcagatctcccgttggctctagcctctgatgacgtaatcttctactttaacacctcaccacctcggatgtgagagtaccgttcctctagtcattgctctatagattaacatttaacactgctgtgactgattgctcaaaggacattttatgttatggctttaaagcagaggcatgattattagaaatgacttaagctcttttctttgaaaaacaagctccttttgcagacgaagcaaacagtagtgcctgtggtttagcccgccaatcttgacgactcaaagtagctgatgcattgtgcatatgatgcttgagatggttttgcagatgcagacatcgctgcaaggtcattctaatagagacaagcggtattttaaacctttgaaaggaatggatgtaactgtacgttggtacagcttttcacttgtttagtttttaaacgttagtataatctgaataaagttaatataaactgttgccaaattcaatgtagaaagaatgtgacaaacaccttgggtagttctgtttgtgtttttgcatattgtaaaagcagtgtcacagctgaaaatgaaccctttctaaaggtaaattattgtgatttagttgctagtttgtattgagagttgacctctccctgtgcagtttttgtttggaacttgtatagataacagcgtgtaatgtgtccccttctacactgtaacagttgcttctgcctaccttataaataaagaatc

SEQ ID NO: 23251 - DNA, 1099 bp, Mus musculus
accaagggaccctgagcagctggaggggtgactctccatccttcttacccagctccacaatgtgtaagacaggaggagaaccctcgtgtagtagtaagggacatagaactctagttcctgcatgagaactatgcaggtctaagtagccactacagacactgatgatgctcacaggactgacctggggtcccacctaaagctgtgggtatggtggctctggtctcttgagtttacattccctggtgtgtctgtcctccatcctgcagcctggtgaggagatggcggcctgtgaggaactgacactcgccctgtcccggggcctccagctggacgtgcagaggagcagccgggactcactacagtgctccagcggctacagcacccagaccaccaccccgtgctgctctgaggataccatcccctcccaaggtacgaggcgcccagcttgccgtccggctttccgggcgggtccaggtgaggaggcagcgagccggcggctgttctaaccatagcctaacccctggctacacatgggatttggaatctgtcgtctctgggtgctttggggatattttgctcatttctcgccatccatgcgcaatactccccaccctgaaatgaggcccatgctcatgtgtgcttggcactgtgtgaggtgcctcttcttcgttttaatcttcacaatcatacacaggagagatattctatccccgttttacagatgcggacaccgaggctcagtaacttgaccaagtccacataactccatggaatccagcccctaagttcttaatctagtcggaggtgggcacctcacctctctccctcatcaccatacatatgggccaggcagagcagacatctgacacgagagtagatgtgggatggttggctaaaggctctctgtaacacgttattaaagatcaagtaaatctcaagtaaaggtcccaccccctcagggacagtcagtagtctggacctatctttagtagtcagaaccgcaagggtactactggtgtctagaagccaagaggctgggggttttctaacccccctctgaaacactagccctccagacctcacccaaacaaagaattac

SEQ ID NO: 23252 - DNA, 1312 bp, Mus musculus
cccgagttctgggattaaaggcgtgatccatctccacctactgacttctctcattttctttagtcctcgtccactaattatggcaggttcgccggcgtgtcacgtcctcctcgcctttctagcccgtgatcatccagtccgcccggatgactcctgtagctctcttgcgtttgagccaccaggagccaccaagagttcctccagagcgagctccaccctccgcaggtggggcctgaggaccccgcggcggccaggccgagcgggcaccgccccattcacccaccggccccgcgcccaccccacgcacccgccccgcaccacgcaacatcgccctagcgcctctgcgactggcgccgcgcggagtgcgccgcccgccattggacaaacgctctatagcgccatctcagcctaccgcgcggtgcgcgctctcattggttcggacggcgtgggaggcggggtccgctcaaggggcggtgccgggccggagccccgcctcccggtccctgggctgggccgagcccgccgggcggctgaagcgcgtggggccgggttgcgagcggggcgcgcagcggttactctggttactgtccgcgagggatgctggggacccggcgggcaggagccttcgcctcgctctgaaggacgctcatccgagacagccattcactctcgaggaaggcaagtgtcggtcggacaggttcccggccgtgacttcggggcttgcttgaggaggaatctccaagggagggctgagctgccaggctgccgccgcgcttcgggacgccgtggccatcttttgttggagaaggctgccggggcagtgttgctaagggcagctttcccagcacccagatccttctacgctcccgactccttcctaccgagcacctgctgctggtgacaaaagaccgtttacagccaggcgagcggacatcgaagtatacagccacattcgcacccctcagcccaatagagaggcccgtgtccatcagttggctgaatgaagaagtgtgtaatcaggagccgttggggtaggcaggctttaaatgctgccttttaagatctggacaacttaagatacatttgcactctcaatgatttcaaaaattgatcacatctgactcgtgatcctgaaactatttattggaagaagttcgaccggttgccccgaacccctttgagaactacattttggggacattttaatcactgaagaccttccgaggaaaaaagacccccccaagagacccccaaaacacaaaatcctcagccttggctggtgccaccaaagaagccttttgagccatgtgga

SEQ ID NO: 23253 - DNA, 1149 bp, Mus musculus
cctgcacctgtagctgctcagtgtagagttgagtagttcagttataggattggtcctggttctgtattcgaatctcactgtagatatgcacagggttaggcctcatgtggatttccaaatatgtccatataacattttctaactactgtgtccagaaaaaggaatatgtatattttattgggctatatacatttttttttagtcagtattttgatcctgattatatatggtttggacttaaaaatataccatggatatgatttactcatgtttgtggggggaggggagtctagcttttgctcaaggtgtaaaagtcgggtgtgtttatgtgcgagttaatggtttatgtcgacagatttggaagaatgataatcatttttgttaaacagtgcagaaaagaaatcggtctttcagaaacgacattaacaggagcagctacctcagtgtcgacctcgttcgtgacggacccggaagtgatcatcgtgggatctggtgtgcttggatctgccttggcagcagttctctccagagatggaagaaaggtgacggtcatcgagagagatttaaaagagcccgacaggatagttggggagctgctgcagccaggaggctaccgtgttctccaggagctgggccttggaggtaggctcatttggtgttgaggagttgtgtaaatactcgctcttcactctggactgttctggcctcccacccaccctctctccctcccttccttataataagctttacatgaactaaaaactttctgtgacaatgagagcggaggaggaaagagccgtatcattgtgtgagaagaggctacccagacagagtgagatagtgaaatgccctaaaccgtcacggcagcaatgaagacgctcagctcagtaaccagaactgtcatttacatggtgtggaacacactcctgggggatgctgttcccgccggtcttaagtacgtcttccattcatttaggaaatacttatttactgctgtctttgagcgaggtgttctgctgagtaagtaccaagatggactagtgattaagacaggcatccttgagaagtagcacagaaggtccttagctgtaaggtgagccccatctggaggaggtcagaagaggttggtgggtgccctggaatgtactg

SEQ ID NO: 23254 - DNA, 1192 bp, Mus musculus
ttcctgttttcctctggcctctgggtttctcctttgtctctcgttggcatactcccagatcctagtgccattgggagcaaagcctgcttgtagaggcagtgggcctcccccctcaggtgttgtcatgtgcacagtaaggaaacattaaaaccagctaccagcaatgaaagggttgtctcgtttccctatgcgcctcagctccttccagtgcttcaccttcctccaacagacattttcacctcttgaattccctctgtaaaactgaatttcctgagcgccaatgatgtggtttcacttctgcttactattccaggtggctgaagcccatgtgcctaacttcatttttgatgaattccgaacagtcctgtgacttctttctcctgctccagtgacaggatgttctatgactagaatgaacttggacgtgagaaagatacttgactcctcatgcaacgtgcattttcctcctctgtgggaaccagccattctaaggaaagtggctctcaactgtctaaatcatggcatcgtaaggaatttttatcatgtagatgcagaactgttttgtacttgcctcttttaaatgctcagtataactgatggatgaagccattccatcttatgttctaaggatctgtttgtgcaactccagaccttcagtaaaacagcattgctagtactgagttgccctgcttgtgatgaaaacggataccctgtaagaaaccctgcgacagactggggtgggggtgatgcttcatccactgtaggtctgtatggtccattgagagcccagcagtaaactcgtgtcctacatgctctgctcttctagctgcttctgcccaagccagacaacaaagctgttagccataggaggcagtagggaccaggggtggggctgtaaaggtttagtgataaacttttaaaactcaaactctgccaggcgtggtggtgcacgcctttaatcccagcacttgggaggcagaggcaggcagatctctgagtacaaggccagcctggtctacaaagtgagttccaggacagccagggctacacagagaaaccctgtctcgaaaaacaaacaaaaaacccctcaaactcataacttggttctacatggaaattcctgctcaagggagctgtcatctgctaggatgagacatggcaggagtctgcctgaacctgtagctagtagggc

SEQ ID NO: 23255 - DNA, 1228 bp, Mus musculus
ctcagtgctgctcggtcctctgctgactcaaacatggatgatatctgtaagctgctacgaagcacaggatattccagccagccaggagccaaaagaccacccaactatcctgagagctatttccagagagtgcctatcaacgagacgttcatcagcatggtcatcggacgcctgaggtctgatgacatttacaaccaggtaggaaccagaggccctttagaacttaaaagatggaatttacctttttccttagttactcttttcttttttcttccttccagtgagtcaaacagcatgttgaaactattttttaaagcttttgaatagagctacagggtcaaggacaggaactattaagtgtgggagaatcggaggtttcagagaggagctaggatgtgagcagttgcaaagaagatccgttctttcaagtcatctgttcaagaaacagttactgagaatgtgcctggtgtggtcacttatgggctagatgctggggattcatcaccaaggaaggtaggctctttctgtacccgcacctagggtggacttgtagcttaggaaggagacacccaaggatgggtgatgtacaagaacctgcacattagcttggggaagccagtggggcatgcagccgtggtaccaggatgacagctgatgacagagtggagcataaggccaggctagaccactggcagcctgaacagacctggaaagaccctgcagcatcttaaaattaactcacgttcctcaccagtgtagacattgcttagaatagcccaaatcacatttctgtgttgtggcttctcgcaggttgtggaactcttgctcctgtactgaaaggacttaccgtttgacttcattctgggggcagaggtggggggggatatgatttcatatatatatatatgttactataaggtaggatgtcattgtcatagaacaaacctgccctgggacagctctttagtgaccaatcccctttttgtacaattatattaagtataaataagactatttgattcttagggttttttcttaaaacattgaaaatcagacactatgtgcagacataaggacttaataatacttgttgctgcttgctgaggattcagtctaagtcagcctcgaaggaggtttgtttgcacatcaccttctctgttgcgcatgacagtcctgcagagtggccatcattctctccacgttgctgtggaggaagctaagacttgga

SEQ ID NO: 23256 - DNA, 1236 bp, Mus musculus
cttggcagatctgagcagcagtcaccttttagtacagtgtgggctgccaaatggctggacatgccagactttctggtacactcctcatccaatttgactaagtccctcttggtagaaggttcttcatccttttcttaggtatcactaaactttgatgtaatttcaattgtataaaatagaaaacttataacttaaggttcaagaacttttgtttcttccttcagcatcacccttgattgacagtgtccactgtttctgttgtgttgtggcattgatctctcctccagaacatcaagctggctgtggtggttcctacattttgtagaattacagccaagaaactgtagtagctattcatttatattttccttctgttttaaacacagtggttttgttttacatgtacttgggggggggagaagagaagaagagaagaagaaacccctcctgcaaaagataggtaaaaggactggaaagatggcttatcagttaagagtgttagtggacttgagtttagttcccagcacccatgtggagcagctcacaactgcctataacttcagctctgtagaatttaacactctcttctgacctccacgggcattgatacacacacacacacacacacacacacacacacacacacacaccacaaaaatcaacaactccaaaacccaaaatgtctctttaaagaggttataagccacttaaagtcttcaatctagttttgttcctggaacgttctctttcctgttcatcctgttccttttgctactaaccatatataccctcagctcagcttacagtcttacagtctgccaggatgactgatggttgcacagtatacctggcattgcttgcattggggattggttctaacgctttgtcttaattgggctcccagaatcacgcgggaatatgcatgctcagatgctaaagaaagcctgcctctagttgactttgggaagtaaagttgccagcggccagtggctgggcaagatgaaaggggcgggacttttagattgcacacataaggagagaaagaggagaagaggagaagcaccatgactcagagggagaagggtcagacttaagagctacaggagagaagccatccaggtggaaagggaatgtggatgggggagggggcgggggaaggaggctccccagaaggtaatggggtagcagagatgattgagagtttagaaggtattaagccaggagtactggagggaa

SEQ ID NO: 23257 - DNA, 1202 bp, Mus musculus
gtgtatcctgtgttgctaagttttcaaagttacccatttcaaccacacccaaaccctttcagaggcttgaaatctctttactcagatgtcttcccagtaaagattggggatctctgtgagttccaggagatgcgtgaggactgtgtaagagctaatgcttggtgatggagctgctgctgagtcttggatacaacacacagttccttattctgcagtcagagatcccttacagctttctgactccggccttgtggctgctgggaatatccctgaggtgttttgtctcaaaaggatccatgccttggagctagagaagggagaatgggtttttaccatagcattctcctggcccacggttgtgcatattctgctgatagctgtgttttggaggcaggtgaatttttggcatgtccttaaagtaagtactacagggtttaggtaaatcagccctttcagattgtaaactaaaaggttattagcctagctgagtctcagcataacccgatagtactctgttactgcagatcagacacacccctgtccctctgcccccaagtacccaccgcgtgtgtgtgtgtgtgtgtgtgtgtgtgtgtgtgtgtgtgtgtgtgtgtgtgtgtgtggtgtagaaaaggtcttaggtgtaagagttcaggcaagatccctataagaaagaacttgtatactcattaaatctgggttttacagactgggtaactgttaaatttatttggtcagtgcagtttcatttttctgcttctgttcatttgtgtagtagccatttattgaaccttactatgccagaaattaggatattttttaaaagtcggtgcattaacttagaggcagtcaagcaaattattaaattatctatgttttaaagggccggtgacaaccatgtcataattttgttctagtaactattttcaaatgtttctaattttcaaaaaaaaatatgcaggcatatagtaactttttggataggattttagattctacaatgtgggatgactaagtcaatctaattgacatgcttagcacttcatctactttctaatggtgaaaacatccaaaatctacttataaacttggattatgcgtccttatcccattctgccatcactcttggacaatgcacacacttttggtaaattgtagtcttgactaccttgaagtcagcttttttagatcttacacagaag

SEQ ID NO: 23258 - DNA, 1194 bp, Mus musculus
tgacagggttttatttgtttcacagttaggaattattccactgttgtttcctggtactaagaagtgaacccagggctttacccatgcattgtaagtgttctccactgagctatgccctcagcctcccttttacaattttattttatttttcattctactaacttacttaattacttacagacagggtctctctacatgattcctggctgtcctggaattcacaatgtatgtagaccaggctggtcttgaactcacagagttctgcctgcctctccctccctggtgctgggattaaagggaagtaaaacagagtagctccatccagagaggtagtgtggttcacctcacaggcagcatgtctttagcaggctgtatctgttgatcctgtggtgagtctgagaatttgatattcttacattttttcctccaaacctgaagtcaggctttattacacattgggctttgtcacttgaagaggctcagaggccagtttcaggaagcaaattagccaaaagaaaggtttgcttccatgaacagcaatggtcttctgtccactgtttcattattttaagttctctaagaacttctttccgtcctgagcctctcacctccatcccagccactctggtagtgagcaccactgaccagctattgagagtcttccttagcctggctcactgtcagctgtcaggattcccagagctacagaagaggggagaagggaagtcagtgctgagaagaaggacaaggcatcccctagggcagtccatccccagcaacatgttactgggtcacctttcagagtatgtttgttttatttagcaagggattcacttatcatttctcagtttgatttccaagaaaaattttacgtggtagcaagttaaacttatttactgagcaaaactgtctccaaagacattttcttttctctctcggggagtgtagtagagtttttgacagttgtagacagatcatcatagtgcttggtgtggtgtaaaataacacactttacctgaaggcgtttccagatcattactaggctttttatttttcaagtaataattttcaaaagatgagttttgatagacttttaattaactgtggttttggtgttgtctctatatagcatgccccagtgtatttgggctccattcagtttttatgtctacaaataaatgaatataattcaga

SEQ ID NO: 23259 - DNA, 1238 bp, Mus musculus
gagctttgcctccgccccctccctgggctacgggcccgcgggcctgcggtggggcgcgcgcagcctgctgcccagcccaacccggggggcgtgtgcgcgcgcccaaggcgtcccaggacgttcccacctgcgcctcggcgcgcgcggtcaggagcatccccaggcctccagccaccccttacagttccagcctccaactccacctcccctcccccctagtctcctccctccgctccggtgactgcaagccgggcgacggggccggagtcgtcgcagccacctcattgcacaacccggcttcccaactgtttacacagcccgggctgtgagtgtgtgtgtgtatacagcgtgagtcaccgggaggcggaggaggtggaggaaaaggagaaggagtgcactggccgggatcagtgcggcacacacactcatagtcggtcactctctctctctctcctggagcgcgtctcgctcgctcacacgcctggagcccaggagcgcgcaggattccgagcggcgcggaaaagttgtaccggcttttacgccagactaattgctttgggaagtgcgtttgctcggagaagccgaggagcctgtggaatcctgtcctcgaggctcaacacccgggaactcgggccgtctccacgtcccggactatccacagcctcggcaacaatagcggcggccaccgccaacgaggcgcccagacctggtgcctgtgggggtctggagaccttagccggcctcccacccttggacgcgtggccaacgtggttctggtggacaacgccagcgtcctggaacggctcctcttggggaccgatccaagctctatctgcaaactccatcccgccgactggaagaagtcacagcgcagatccagggatttacaaagccggggccgctccggccagggccgcgatgcgggtcggtcccgtgcgttttgccctgagcggcgcctcgcagccccgcggtccgggtctactgtttccggctgcccggggaaccccggccaaacgcctgctggacacggacgacgcgggggcagtggcggccaagtgtccgcgcctctctgagtgctcgagtccccccgactacctcagtccccctggctcgccctgcagccctcagcctccgccctccacgcaggggaccggcggcagctgtgtgagctcacccgggcccagccgaatcgccgactacctgctgctacccctagctgagcgcgagcatgtgtcccg

SEQ ID NO: 23260 - DNA, 2320 bp, Mus musculus
gtttaatgattcattactttgcagttttctacaaatgcattatctgcactgtgccatgttaggatactgtttgctttctgttcatgaaaagtagaaagaattgtttgttcatcacacacatgatgaccaaaagacatactgatttaaataatgtatttattgcccatattatttgatccaaacctgaaatccatgtttttggctttctatgtgtctccagattagactctatatcttcattcaggaaacttcagacatacttaagtcagtttcttatcctcttcccagatcttggtggaagtatataataaaaactcttttagaaaaaaaaaatgtgctttttagcaacgggtttgccctcagaacgcaggtgttgtgaaagtcactgctaattcaaagcaaaaatgagaaaggaaaagactcacatcaacatcatcgtaattggacacgtagattcccacaagtccaccacaaccggccacctgatctacaaatgtggtgaaatcaacaagcaaaccattgaaaagtttgagaaggaggctgctgagatgggaaagtgctccttcaagtatgcctgggtcttagacaaactgaaagctgagtgtgagcgtggtatcactattgacatctccctgtggaaattcgagaccagcaaatactatgtgaccatcattgatgccccggacacagagacttcatcaaaaaacatgattacaggcacatcccaggctgactgtgatgccctgattgttgctgctggtgttggtgaacttgaagctggtatctccaagaacgggcagacccgagatcatgctcttctggattacaccctgggtgtgaaacagctgattgttggtgtcaccaaaatggattccactgagccaccatacagtcagaagagatacgaggaaatcattaaggaagtcagcacctacattaagaaaattggctacaaccctgacacagtagcatttgtgtcaatttctggttggagtggtgacaacatgctggagccaagtgctaaaatgctttggttcaagggatggaaagtcacctgcaaggatagcagtgccagtggcaccacgctgctggaagctttcgattgtatcctaccaccaactcgtccaactgacaagcctctgagactacccctccaagatgtctataaaattggggacattgagactgtccccgtgggttgagtggagactggtgttctcaaacctgccattgtggttacctttgctccagtcaatgtaacaactgttgaaatgcaccatgaagctgtgagtgaagctcttcctggggacaatgtgggcttcaatgtaaagaacctgtccgtcaaagatgttagatgaggcaatgttgctggtgacagcaaaaaacgacccaccagtgaaagcatctggcttcactgctcaggtgattatcctgaaccatccaggccaaatcagtgcttgttacacagcccacatagcatgcaagtttgttgagcttaaagaaaagatcgattatcattctggtaagaaactggaagatggccccaaattcctgaagtctggtgatgctgccattgttgatatggtccctggcaagcccatgtgtgttgagagcttctctgactatcctccacttggtcgttttgctgtttgtggcatgaggcagacagttgctgtgggtgtcagcaaagctgtggacaagaaggctgctggagctggcaaagtcaccaagtctgcccagaaagctcagaaagctaaatgaatattacccctaacacctgccaccccagtcttaatcagtggtggaagaacggtctcgaaactgtttgtctcaattagccatttaagtttaatagtaaaagactggttaatgataacaatgcatcgtgaaaccttcagaaggaaagaatgttttgtggaccttttgtgtgtgtgtgtgtgtgtgtgtgtgtgtgtgtgtgtgtgtgtggcagttttaagttattagttttcaaaatcagtactttttaatggaaacaacttgaccaagaatctgtcacagaattttgagaccattaaaacaagtttaatgagaaagaaaaaaaatgcattacatcataaacttgaaaaccaccctaatctaaaatctagaaactacaattttagggatagagaaaagagtaattcccccagtttaataaatcagaaatcttttgtatgattaccagtaaacattttcaggaatatttttaataaaaatattatatcacagagacaataaaataatctcagctacatgaagcaaaatagatgaattttaaaacagaaaaataataacctca

SEQ ID NO: 23261 - DNA, 1113 bp, Mus musculus
ccacgacgatgcccctcaacgtgaacttcaccaacaggaactatgacctcgactacgactccgtacagccctatttcatctgcgacgaggaagagaatttctatcaccagcaacagcagagcgagctgcagccgcccgcgcccagtgaggatatctggaagaaattcgagctgcttcccaccccgcccctgtccccgagccgccgctccgggctctgctctccatcctatgttgcggtcgctacgtccttctccccaagggaagacgatgacggcggcggtggcaacttctccaccgccgatcagctggagatgatgaccgagttacttggaggagacatggtgaaccagagcttcatctgcgatcctgacgacgagaccttcatcaagaacatcatcatccaggactgtatgtggagcggtttctcagccgctgccaagctggtctcggagaagctggcctcctaccaggctgcgcgcaaagacagcaccagcctgagccccgcccgcgggcacagcgtctgctccacctccagcctgtacctgcaggacctcaccgccgccgcgtccgagtgcattgacccctcagtggtctttccctacccgctcaacgacagcagctcgcccaaatcctgtacctcgtccgattccacggccttctctccttcctcggactcgctgctgtcctccgagtcctccccacgggccagccctgagcccctagtgctgcatgaggagacaccgcccaccaccagcagcgactctggtaagctaccccattcacagcagggtaggaagcgagaggttggatggacctccttctccaccactcattggcattaattcaattggcctccggggctccccctttctttcccttctgtctaagagctcttcatccctggattcccgtgcttcagctatccctccctcccctcccccccccccccccagaccgccctggttgtcacccccaccccccacccttcccacccctcaggaatttcatttgggtttttaaatcttctggcttatctttcagctccatccactccctttacccctcctaagcattttaattaccctgggaagggtgtgaatgaggataaaggaa

SEQ ID NO: 23262 - DNA, 1116 bp, Mus musculus
atgttgcaggcctgttttgcatatgggcagtgacaagtttgggcttgttcacttgcacagtcctatggtcatagctagtccttcttaaagctctagccagtgggaaagcgtttgtgtttctatccttggagctccaagtgggacttcttaaaagatttagaaggagcaaagctgtcaggaaatcagaaacgtcacatggactccatgactgggaaaaacctcgtggtggcctgctctcagtgcttggatgtgtgctagttacatctcggaggtgaggatgtgccttacggttatttgaactcaactaggttcatgatggatctggtgagacattaaggctggtttaagacattgtgggctattgtgctgggacccccaccccactctgttagggagtgactgtatgggactgccttgttgttttgcctggttaagggtggctgtttcttgctgctttacctattgagtgcaggattttgcataaaccagcttcccttgaaaagtagaagaaattgattttttttttttgattgattctcctctgactcatcctgttttgcttctgtgacagcagtttacagaactggaaaggtgtctcttttctgttgtttctggtaatttgtattatttgctccttgaaagtctgtctgctgagttcttaccatctccacggatccgattcttgtcttctttgaccgtggaaggctggcaggcagcctgcctggttgctgaggcctctgtcttccatgtccgggaccttctgtctgcctgcccaatctagctgctatccttaggcacctcagctgttgactctcttggatcataggttacctttgattccattttgtgcaagatgccctgaatttgttcatattaagggcagaccagcattttcctggggactctgaggaccttggatatttgttgaactctactacacacacacacacacacacacacacacacatttgaaaataccatgagtatggtctatgcatcattttcacctcctctcttccctgcaactcctgatgtgaccccaagccctctcaaatctctaacttctttttaaatcacacataaacataatatataaatatatagtttgcttagttc

SEQ ID NO: 23263 - DNA, 1122 bp, Mus musculus
tgctcagacctgcctgactcagtttagcacccctcccccaaacccccacccaatctggttgcctcgagtcttcctcttaaggcagctgtcctgtagtgcaggaagccaactcccaaggtaaaatgtctttagacaaataaaaatgtctttagaaggcctaggctctctatggggtgagactgaatgctgaggcccgatctggcctctgatagaggagggctttcaactgttgggggcagggaacagctaggagcttggcagggaggactctgtatatactgtatctgtccggtagcactggagatagagccctagctgaccctgagtggaaagatggttggttgcatagttgtgctagcacaggacatactgcaagggtttgggctctagaacttttcctctgctcatgtggctttggtggagtcacctctgccggctagtgctagttctaaagcctaacccatcctttgggaaggagtctgttttatggcttcctaggtaaggctgatgacccatgtgttagtgctgatgtgagccacttgtggaagtggtccagtgttcagccaccacttatccactggggccagatgggctagacctcaaagatctgtagggcaagatggaaaacagtcatcctttgaattcaccaggaacctcatgactagagagatgattaggaggccattgttaccttctatggaaggtgatgagtgagctggaaagagctttgggtatggacacgcttcgaaggcgggcattttgaatagtagcataaaggcagatggtgatggggaaatttctaatagagtgttgctgtagaacaaggttgttcccaaccttctgatccccccttccctgtcttcctagtgcagttataggctatgccaccagatttctggttttgatagaagctttcagaactctcttgtgtccaggaatgattcattttctaaggacatcatccagcattggggcctttcaaaaaggatggccatgtgagtagtttttcacaaactgatgtacaacagttgcctctgtgatctggacctacctttttgatcctttccttttttctacctcgggattcatttttagtgacactataaaaatatatcctattat

SEQ ID NO: 23264 - DNA, 1373 bp, Mus musculus
cagaacttggagccaggccagccttttgtggttgcttttaaaaagaaacaaaacaaagcctgacttccgaccagctgacccctaagcctctaagcctagtagctccctgctgggacctttcagacctgcaggggagcttggctgggtgccaggcctggccttctgtcagccaaagcaagccagagactgacgctctctctccctcatccatactgttggttcaggcaggccctattctcctcccagccaactctgaggctctcctgcctggagggttagcgactgggacccagtgtccgtcgatgaaggctttccccacaccatacccttcctttacccctaggccttccactcacccatatatatatatatatatatatttttttttttttaagcacattcctctgtggacaggtcagggtcagatataaggaagaattgttgattgctactgtagtctgtgattgtgccaaagtggttttcttctcccttgtctcaggtctgattttcttaactctactacggtaagaagatgccctccatcagcaggccgtgtctgctgggacctctctggagacttcctgaaccctgtggatttacagtaagatgcagtttcctggggagtaattctggtggatacaaattccggagtattacacctggcttgcctggagatgttacaagtagctggatggattcttcagcctggatgcccactgaaaacaaggaccgaaactaagaggattgtatctctacccttgactcaatgagaatgtttgttgtcatctctcgggctacctggagctccctctaaaatgtaagcccctaagacccatctcctttcaatgcagtgtttctggtatgttcctgtctttacaccaagctgtcctggatgctggttgagggctgtctgttgatgtggctgctaggaagagatctgctgtcttccgtgtctgtctatgtgtctggtatgacgctgggcgcctgtgggagaaagacaaaaaatagaagttgttcgagttaatgtttctttctttttctttttttcttaaagatttatttatttatttgtttatctatctatttatttattatatggatgtacactgtagctgtcttcagacagctccagaagagggcgtcagatctcgttacagatggttgtgagctaccatgtggttgctgggatttgaactcaggaccttcagaagagtagtcggggtgctcttacccactgagccatctcaccagcccctctaagttaaaataataataaaaagaaaatcccctctggagctacccttgcctatgttgatgggtacttactgattgaagggtcttatttctgtctagaccctaaatacctcgaaggc

SEQ ID NO: 23265 - DNA, 1196 bp, Mus musculus
ggttagcacgaagataaatcctccaaatggctgggagggtttcggctgacagtgcattgtgaattcacatagcatttgcatcttcctggggatgataaatgtttagataacgacaaacaacggggagggggaaagagaaaactgggggaattcaggtggggctgatcagattggcccccctccgtggtgtgatgaaccagcgataaacggcttaactgacatatctgatgccctctgcttcccatgtaagactgaggaaagtggcttagttttgttgtctgatgaagccaatgccttcctgatgcttctgtgggctgatgtgaacccggttctcacatatatatcaaatggcatggtgtctgggtggacaccaacgtccaggattttacatgttctactttattggacattcccaatgtgccagtgttcgatttaattttcctagcagttccaaaggtgaaaaagctgtataatcgtcatcctgcaagtgttgaaatggaagatgggaggggtccagtccccagctagcacgcactctaagatgggatcccttccctggggcttctggacacacctttctccatcatctgcttgctacccaacaagtgtccacgtttagtccgtaggtggcaggttgctgcttcctgcagattcagacatcaagggccctcagaagacactctgactaccagcaagaggctggatacctgaagcctgtggaagtgacagggccttttctgtttatagtcactgctctcccgcagtctctggaagtcataaacctaagccagccagtgctcaggaggatgactggaggctgtgcctttttgtctgctaggggacagtgaatgcaggtgtgacaggcagggctggtggaagaggaagcttgctccttgctctctagttcagaccgtttttcctggattcctagctgattacatggcgcctccaatgatcagattgaggagaggaagccagaaagttctggcattttcctactaaatcctcaccagtttaaatcagcaccctgtctagtccccccccccccccaccaacccatcccacttgagacagggtctcaggtaccacaggctagcctcaaacttaatggacagcagagaatgactctaagcttcagcctctatctcctggttgctgtgatcacaagtttgcaccacatagtctggttttattag

SEQ ID NO: 23266 - DNA, 1192 bp, Mus musculus
ttccaaggataaagcctgctctgccagggccctaggataggtttgtcttcctgtcttctacctcaagaggcccttttgagccactggaatctgtgctgcagtgttcccagttgctggctttgctgcagaaaaaagtgagaaggaaagaaagagagaaacagaaaggcgggtcagccttgctgtgcatttagtttgtggttccagacctccgtttcctggatctgatttgtgtgggacgcacgcaatggcagctagctactgtgtttgctgccacgctgactctgtgtggtgatgaggtctgtccccaaacagacctcctttctatcccactggtcagcatttggtggccaagggcagagtggagcccatgtttccaacagctagccacctcacacagtgaagcacttcagtgattctgaaggtatgttgggttaggctcctcacccctctcccctacaagagagagcacagacaaaacgggatatcttttatttatttatttatttatttatttatttatttggtattttcttcatttacatttccagtgctatcccaaaagtcccccatacccacccacccccactctcccaaaatgggatttctaatgagcagctctgcttggcccgtggaagctgggagtggaaagctggaagactgtcccagagtgggcagtcagagatctgactgatggacgcattggcatttgtgttcagccctcatgggcactgctgccttttgcctctgctctcaaagccatccaggattcacccatctgtgttgatcggcctgggacagcaagagccattgggagtcaaccagagccaatggtagacagaagtgtgcggatgaacttggaggctgtttatggagtagggtggcaaagccaagtcatggcttgcttggtgctggggttttggttggtgtgggagcatccggaagagccacagagaacggtgatgccagtttctctggcaacttgctgagtaagcagatactcgctcatcctctctgatccgcttcgttactcatcagtgggaatagcagactcagaatgccatcagtatttatggcctttacaatttgcttcatgtgctgccggaaggtccctgggtccccaagaattatctattgctattaataatggaataatggagtatgacactagaggataagacatgagttctttacc

SEQ ID NO: 23267 - DNA, 1160 bp, Mus musculus
tttagatgcttcctgaaattatggggactcccttcttgggagggagaatctattcttgagggatgtggggaaagttaaagtgattttcaattcattttatgtttcagagaccctatctcgtgtcacctaggctggcctcaaactcactgtgtagtcgagggataactgtgaaatgatcctccctgcttcgtatcctgagagctgggatttgtgggcctgcaacatacagactgctggcttcgtgatggtggcttgccagctgctccctggagaagcagtgctggggtaggactgactgacagtcacttctggggcaggcagggctggagttttgttctgtttgtgctgctgttgcttctgcatatgctgcatatgctgggatccaactgtccctatttaaattttcttttcttcatttaagtctcccccaccccctccccaataagaaggaagtaagcaggggtgcctattagctcgttgattgcatggacagcagcacattcacctgtcttcactgttcttctacaggttaatttgatgcctattcagagaggccagctaggtgtatctctgtctgtctgtctctgtgtctgtctgtctgtctgtctgtgtatgcatgtgtacacatgtcagtcttttctattctagatattctattctctattctagttattctatatttcaatttttctattctagatatttctagacagtatctgttgtgtgctgaaccccaaggtaggcattttcattcatttctcagtatgaattcagcctgcgagtgacagatcctgtatttcttgttgtaaaggagtaaatgaagtttcaaagagacaaaatgccttgtctccagtcaatatagccgggagctatcagaatcatacacaagtccatcgtctggcctatgtagaacatacaaggtgaagcaatgatggcctagtgacacagagcctccggccgtgtgacctgggaggtactgtatcttgctaagcctcagtttcttacctggcaagtgtgatgatcacaatacttacttcctaggattaatgagaacaaccatcacagccaggtccttcacatggaggagggagtgaccaaccagcatgtgtgcttacaatgccctagtttggataagcttgacccagagctcaactcaccag

SEQ ID NO: 23268 - DNA, 1443 bp, Mus musculus
tcttgctaccctacttggtctcctctcctctcctctcctctcctctcctctcctctcctctcctctcctctcctctcctctcctctcctctcctctcctctcctctcctctcctcccctcccctcccctcccctcccctcccctcccctcccctcccctcccctcccctcccttccctcccccctctttttttttcttaaagaaactttgtttatttgatcaatcaacctattttgtgtgtgtatatatctgttttgatacttgtaggcatagacatggaagtcagagaataacgcattagagttagctcttttcttctaccatgtggtttgtgtgactgcactcaagttgtctggcttggcaacaagtgtctttaccactgaggcattttgccatctgtttgtttttagtttttaaatgaataaaatatccccttccccaagccattctgtactgatactaataagcctctctctttttcttgcattttctagtataccctttaagcgttccagaaggattttgagatcctttcctaaatcaaaggtggaatatttggggatttggaaaattgaggtaagtaagggctggtctcatttcgagccttttggaaacaaaatttagctttgagaatgaaaatttagctttagtctttgtagcaggatttggggtacgttttagtgtgtgtgtgtgtgtgtgtgtgtgtgtgtgtgtgtgtgtgtgtttaataggctttcttgtgtttaggaatctgatttcctagtcatctatatcttggctttctttctcagcatttttttccccacttgcttgactgtaatgctaacatgctctctctgctccaacctggagaagccagtctctcagaagaaccagttgtgttactttgctgtgagatgcctgccctaagagaggagcagaaggtcggaacgggtcctctaatgtgataattaggtgagaacacatttgggacacatgggctgtgagatgttcctttatgcctagtacagtctgtgttttctcctcaccctccattacatgttggaagcatgctaagaccatggctcctctggtgggggtaagaagtgaagcccaaggtctttcttcaaacctaggctttcctgttgtacctgtctttcctccagtgagtcttgctgaacctagagtgtgacctggtggagctaggtttctttctccttgggtgcgggtgggtattgaatgaaagagcagagatagaaagaggagttgtccatctgatttgctgctgaacagggctttctcttgattactgccttacaatagatcaatgggagtctgtagggtgccttttatatggcaggctattcaaaagatttggtctgatcttggctaggccttttccctagcagcaagtcccttggggaaatagtttgtgaatctccaatcttgagcagaactgactgc

SEQ ID NO: 23269 - DNA, 1228 bp, Mus musculus
acaacaaaacatttgaatgatgagactacctccaagcaaattaggtccatgctgcagtaagagctgtggagcaagcccctactgcagatggagcacacagtgttcttcagtgaccgagaatgcacagtcttagtgaatgccatcaaatctccttattcttgctttggtttctttcctctgttcctcttcccactttttaaatcatgttcttgttcttaagacttcttttctgtgccaaaatcagtaaagttatactttgaaagggattttgtcctttcaaaacaggccatctaaggcagctaattacgcattgcattgaggtctctactgagaaaagttctgtgacttgaactaaatatttttaaatgtggattttttttgaaaactaatatttaatattgcttctcctgcatggcgaaactgcctattctgctatttaaaaccctcataaatttattttctactgccgctttttcatgtgcagccaaaatggaaatgtttaaattaactgtgttgtacaaatggtacccaacacaaaaccttttttaaattagtaagactttgtttaaagttttaagtttgcaggttgactttttttttaaggttgtatgttgtgtgtttaacatttattaactaacgttaaaaactgtgatgtgtgcgtagaatattacgtatgcatgttcatgtttaagaatggctgttgataaaataaaaatcagctttcctttttctaagtgtggcttggtttactgaggtttctggaagttttccctgtatatatttctatggaatgcatatacacattacataatttttctttctcttaggcaatagctatgtctttttcagttgttttgctttactttttgtctatgtacataagttagactgcttttaaaactgttgtgtataagatgaccagtgattgtgtcgacattaacttgacttctgttctgatttaatctttgtgagcgtagtcatagaaggaaacccgtactttctcagctctcggtttcaggaatgaaagggcggtgacaggaagcacatggtgtctcgaaggcacgaggagcccttgacattggaggagagtgagcaataagagtacttccagaggaaataaatgaaagtccgagatctcactggtcgtaggaagtgacatgagttacaatttaaaatcataaagcccaaggcaaagaaatgtgtctcagttgagagaagctgcttgaaa

SEQ ID NO: 23270 - DNA, 1251 bp, Mus musculus
attcagactgagatctagctgctttcaaagtttaggttaaatattttccacctttatgttggtgctgttcaatataagtatgtattgaatagggtacaaaaagttgaagataaaaaggctctttctgtcatttgaggcctgtggattcctgctagcaacaagacttttgaaggcaactatgtctagaaagctgtggtataaagccagttttgcttgaataaggggtctctgaagctcagtggtgcacacaacttttcccaactaaacaggagtaatcctggaacctgtagtctgggctcatggaagtagtggcataaatgatgcccagttcccaagcatcctctctactgccatgggacacaatccatgtgatgctgagccctgcaaggatttaaattaatagagagtaaaccaattaaagtagatttgtgctgttttgaaaatcaaatttagataattttcatgaatttgtcttccttcaataatgtgactgttatgctttgaatgtaaaatgtcttccacagactgaacactggtcccaagctagtggtggtctttgaagagattgtggaatttcaggaagtggagccagtctggtgggggtgggtcactgtagggttgaggattgagggttatcaaccgaggtttgtcacccaagtcctgcctaccttgagcaccaatgccagacaagccactgctgccaccatgcacttcctgccattgagggtttcaccatttaaaatagtgacaataaaaagtttctgcctttagttgtttctgtcagatatttgtgatgatgaggagtcagtgagttctcacttagttcttggggtttgcctactcaagtaaagagcactgacaagaaaaataacagatgcaagaataactgtacagccaggtaagactgcttgggaattgcagagatttcagttctctggtggttggagtccaagagcaaggcctactgaaaatgggagctgctttaagttgaactttaagggcaaaaatgttttagaaggaaggtgctgctttccatgaggaggagacgaatgtgcagacttgaagaagcgtggctgttagagagggtcatatcagcctttagaatgaggtgttctagaaccagaggttcttaaccttcctagttctgcaaccccttaatacagttcctcatgttgtagtattcccccaccataacattgtttttgttgctatttcataactgtaatcttgctaccctaatgcattgaaatg

SEQ ID NO: 23271 - DNA, 1146 bp, Mus musculus
cctcagaccttcccatgaatcctgggatatagtagaagggatagcacaaaacgttgattgaacccaacagtttatcttaatgttataaagatttattcattttcatttgtgtgtatgtgtacatacacataggtgtaagcatgtggatacaggtgcctgtgaaaagcctgagagtgtcagatttcttaggagtggaaaatggaaggcagttgtgagtggcctgatgtgagtgatggatcctgatacacaaacacacacacacacacacacacacacacacacacacacacacacacatacacattaacacatgcacgcacacaaacgtgcacacacacatgcacacacacaaacaggcacacacacacacacacatgcacacagacatacacgcacactcacacacgcatgcacacacacacacatcctctgtaagaacagttaagtgttcctaactgccgagcgtccctttagctctgtcatcatcgtcgtcgtgctttgaaatttgagaagtagacagagtgtagtatatatatgtggagaatcagacagatctcggagctgacagattgcgttcgaatcctggaactgtcacatactgaaccccgcattcctcatttacaaagcggacatgaaaacagtaccagatgggtgtctatgaaaagcaaaggaggaaatgcaagtcaaaggctgcgtacaatgcttggcaccgtgtaagtagtgagaggattccagagatctgaggtagtggccctgactgcagcgtctctgactggccaggcctcttttgccaacgtcttcccggtgtccttctgcttgcttttgtaatctaaaacttctaaacctttggcctcagctgaatgaaatgtgattgtggtgaggcagaaggggggagaaagaactgtggaagaagaaatttagcctttcttgtagggggcttgtttcctgagccagctttctgcacatgggcaatggtggagcttgcttgtgtttctcgctatgtccagaaaatgggtcctgggtcgatgagggggaagctgctcagaaaggagccttttgtgctctcagcagacctgtctcattgtttttagtcaccagccaactcttttcagagtataagcacctcagggccaatgtccacttctg

SEQ ID NO: 23272 - DNA, 1175 bp, Mus musculus
gtcagactaggactttaaataactaatttggaagtgaggtgatacttctaccttcctgccccaggtaacagtagcagcaaagagttctgagccatagactcatagtgtgtagacattacccaagtcacagtagccctaccaagctcaaattcacgggaaggaaggaccttgcccccagtcgttctgtgatgaaaggcagagtcaatattcacacctggcttgcaagccggttaaccagcgtaatttttgccctctgagggcgcctgtcgtgggggaaaaccattctccttgagctcaggtgccccctggctggcagggcacgggcattttctgtcttcttttcctgtgcctcttggttgcctcaccacattccacgtggctggccagctttgtggtgatgcgtcagcatggtaaggggccctcagcacagtggcccatggcaacctctgctctggcgtgctctaatggttttaatgttttgttttgtttttttaatggagttatgtgtgcagttaaacacaaatcttattctttacagctggataaatgtttactatcctacccaagttaactgccccgaatcaggaggctcagtattcccaccatgctaggatgctccctagaactgcctgatgagtcagcactttatcatgtctgtgttttcagcttatacagatgcaggcatagttgttcaacaaagcaaactgaaggcaaaaccaccttaaatagcataggtggtcatatcatttcacccggcaggcctctgtctcggagtgagtatgataggaggcctggatctgctattccttctgttagtctttgttctcagtgccttttaaaatttgagcatctcatgccatcaagtgtctcctgtatttatagactgtaattatcacacagcatgccccctacatccaaaccatctcttccatatggtgcttagcttaagacagtcagtccagtgctaaaagaaagacgatgttgtatgtcataaaagacagtcggccagtcttcagtgtgaggccatatgggattttcaaaccattttggagttttcagtttttatattacattctgatgttagaggctaaacctggagtgagatgcattttatagaaatcttacatttattattgagtggggaggggacagtgtcacggggacaaagtttggag

SEQ ID NO: 23273 - DNA, 1616 bp, Mus musculus
gatgtggggtgggctctcatccagtacacccatcactgggtgctacctgccgtctcctgtctaactactcctttctccctacagatcgggcatatcgaaggacagcctgaaaggaagggtgtctttccagtgtcctttgtccacatcctgtctgactagcaaaaaagcagaaccttctgtccgtccgtccacacccttcatgccagaccgctgtctccatgtaatcctgtgtacaacatgtatatagctgctgttacagaccaagaactcatggaagggccactcaggaggggaatatagtatgtattgtaaatatcctgtggtcttctgccttcaccagtattagggtaacctcgggacctggtgcgccttaccggtttgccaaagccatccttggcatctagcacttacatctctctgtgctgttttatgagcaaacaaaaaccaggagtataggaactgctggctttccaggtgaggagtctccagcagccgtcgaagggtgcagtaccgactcctaacaatgcagtattctcaatggcgttactgaacgtgcgacatgagcagaggtgggttctgcgctcccggtggaacgtaaagttagtccctggccagccagcctgtagttatctgtgtacacagtttacagctacaaaaacctactttggtatttattacagagaagtgttcagttactcgtgttattccttcagcaaatactcactgacacaaaaccctctgcagcattttccagcatatgcagccttgtgcaagtttagatgagtgggtttgtacatcttatggcgagtggccacccctgagatattacctcattatgcagaagtaacatatccttcatgactattttgacaaaagcttaaaaccatgtctgatgaagtccaactttcaggaaccaaggactgccagaaactctctgcctctacgttatgcatgcatctagacgcttacccgaattctgccttttataaaggaacaaacaggatgaagaagtgaactgtacagttttaaacttgattgccattaaagcagaagttacaagattgcaacaatgcttgtttctggtcactcatttggccttttccacagtgtttgcacatggtgtggacgcagcacccccagcggtgttgaaaagcgtctaaggggtcagttcgacatgattttcttcactttgttcttgattaagccttgactattcaagttggaaaacttgtaaagtcggtctttccgttttctcgtgcagaccaggtgctgatctcacgcttttctccctcctcttctcttccttaaactccaatgctggagtaatttcataccctcaacttagccagtaaacacgtgcccttcaggtcagtttataaccgagctgtgggacgctgctatgaattgcactgtgataaagctctctgcaagccatctctgtctgtctgtctgtctctgttgttgcttgtgttttgattcttttccctctgcccattcagcacattgcatctccacctttggcttcagagtgagtttggggaaaggatgcagtagctgttttactcctgggtccaggactgttgtgattctgaggtgtgctgtcatgccatgtcaca

SEQ ID NO: 23274 - DNA, 1241 bp, Mus musculus
aaggaccagatcggtagccactggatatcagcaggttcctatgatcttagaaacctaccaggggcagactgctcaccctcgtccttaggtagcagtagaagtgtcagtccagacactgttgtggtttttgttttaacacaggaagtacatgctactctgacagagatcttgtgatgctttctggaaccttcaggaggccagtttgttttccagtgtctctcatgtccatgactgaagatataacctctgactttccttgtaggtaatgatgtgggcccattatcttcaagtaagacggccaacaagtttgaggggctgtctcagcaagcaaggtgagccgccacccctgccttcctctcctgttgtgactcatggttgctatgagtagacttacagacttggctcttaccagtcttcccaacactacccagtgcagtacctggcagcatcagttaggaagggaaattgggcatccttgctcagtctacatggtagctccctgctgggtcccagtggggacccttgcctgaatgcacagccgcctatctccctgcagtaacaccaggagttacccaatccctgatggtcacacagttatagaatgatctagacactatcagaatgagacttctcttcttgttttgttttgtgagacacagtgtcacactctagcctgtgttggcctagacttgtgtactcctccacccccgcttctcagaaacacggggttataagcacaagccagcataaccagctcattttttcttttctcttttctcttcttttcttttgggaaaaaaagtggggggggggggtcttacaatgtagccctggctgtcctagaacttgctgtgtgtaccaggctgacctcaaacacacagagatccacctacctctctgccttcccagtgcttagattaaatgtgtgcaccaccatgcctggcctacttctcaccttttaactgagcaaatcttttaagtctaaagatttcttttaacataaaaatgagacctcgtgtgtatacgtgtgtgtgtgtgtgtgtgtgtgtgtgtgtgtgtgtgtgtgtgtgttaaggagagaagggcttatttgtttgtttttaaacttttaaaccaaaagtagtgttttttctcccctccatgccctgaaccgtaggccctttgggaacttcctgaggacacggttttccacctctctttcctctagaacttcagtcaggttgcagagctacctccacacc

SEQ ID NO: 23275 - DNA, 1178 bp, Mus musculus
gtatggcttttgtttttcatcttaatgaactgagtatagtttacagcacaaaccagaactgcgtaagacctattcccaaactctgtgctctgtggttagctggttaaaagacctttattggctgtgactgctcagttgcatccctttgtctctgcctgctttatagtgtgcccataggtctgtgtatgatctgctaggtgacggaaaaaaagcatagaaaacacagagtgtagaaactgcgtttaagcatctgaagaacttcttaagacatatacctcatagatgagagaggacctgtggtcacagtctttctaataatgctgcaatctttcagtgggaacctggataagcaaacgtctgtggggaatacagttctgcactattgcagcatgtacggcaagccggagtgtctgaagctgctgcttaggagcaagcccaccgtggacatcggtaagtgtggccgctctcagacatcccagagggccgagactacacacacatgcaacttagtcactgtgcctcgcctcttgaaatagtatcctagataattatttgcatttattctactgtttcagttaaccagaatggagaaactgccttggatatagcaaagagactcaaagctacccagtgtgaagatctggtaagcaaaaccaggatcagaggtgtgtcagacatcagcggccatgaagtgttcttctttctcagagggtggaattggggaaggatgaagcattttgtttctacgtagctaaagaaatacagataagtgctaaagtgcatttgaaagagtgctgaggtcatggctttgccttctgagtgcacttgtcacactggagacccacgcctttgtgggagtgaggattaggatcatgctgcgtgtttgccaggacaccaggctgctttgcagctaaggggagaggataggattccttaggcagtcagttcaagagctgagaagagtgtagtggttttctgcaagcttagcaccctccctcctgcctccctcctgtgcacactcacctttctctccctacttcgctaatctcctgctggaccttcacgtgagcggggttctcttaaccacagcgcctggtgtctgccctctgttgcagacagcatgtaatatacagactgagcgagttgtaaagaaaacaggtgtgtgttgactcgtggtt

SEQ ID NO: 23276 - DNA, 1188 bp, Mus musculus
tctctctttctttctttcttggacatttttttatttacatttcaaatgctatcccctttcctggttccccctccgaaaaacaccctccctcatcccctcccctccccctgctcattaacccacccactcccgctttctggccctagcattcctccacactttgtcctatgaaggcatagagccttcataggacaaagggcctctccttccattgatgtccgactaggccatcctctgctgcatgtgcagctggagtcatgagtcccaccatgtgtgctctttgattggtggtttagatacaattcacaaatcacatgaaactcaagaagaagaaagatcatagtgtggatacttctatccatcttagaagggaggaacaaaacacccatggaaggagttacagagacaaagttgtgaagtagaaactgaagaaatgaccatccagcgactgactctcctgaggatccatcgcatttacaatcaccaaacccagacactattgtggatgccaacaagtgcttgctgacaggagcctgacatagctgtctcctgagaggctctaccagtgcctcacacatacagaggtggatgctcacagccatccattggactgagcataggatccccaatgaaggagccagagaaaggacccaaggagctgaaggggtttacagtcccataggaggaacaacaatatgaactagccagtacccccagagctcccagggactaaaccaccaaccaaagagtgatccattttctgtgtggtcatagaaataaatttctgaggttctttctcaaaataaactgaaggtgagcgccacctagagtcaagtttgtgcctggcaaacacatcacccgcagcctggtttggcttttacatctcttgctgcagcatttaactacataggttttctgggtagtactttgcttcgtattctgccatccaatatttcatccaaacaacaggctcaggcctgaacctctgtgttattcaaagagcaaacgtagctgtctgttctcggggtaaaaaagcaatgatttggctatggatttgtttttatgttttgtttttggaaagcttttctctcattagtgaaaataatacaagcttattttatctttgggaaattgcatgtcccccccccccatgagttttctccataaaggggggaaaacattcaaaag

SEQ ID NO: 23277 - DNA, 1814 bp, Mus musculus
tgtgcttatagatgtttctcactgaccctcacctgcccttgcctcaccaaggagcccagaagtcatgtggagtatatgtatgtggtctacaggttacctttaggggacatcatgtccgcagcacaggctgctgtatcttctatccacatcaaccacgagaggcaaagccaggcccagaaccttccttcaaattacttcatttctccttgtcctaccagagaggttttacactctgcagacatagttgatttctggtttagactagcctttctatagtctgatatacgtgagtgcaatgatgttttgctagtacaggtgggtggggatggagacagtgagctggtgtattattgagtgatagaatgaaatggattaatatatttaaatgcctaactagggtcctgtgtaccgtagttgtctagttgacggccatccatctggcggtgaaaatgaccagtattcttgaaggaacaggaatggagcatgatttaaaatcgtagtttgaggaagatagtgcttaaggtggaagacggcgtaggacaggagctgtgtgccagctctctggaccccaggtagttctgggtggacagtagcgcatcattttgctgctcatatctgtggcatcagtgagcacaaagcaaaggaaactagtgaagaaagaaagggactctgggtcttgtggaagggaagtttgatggatagatatgtattgggataatctggggtggaggttgcttacttgtgacaaaggcactccattagtgagatgatgctgttaattccatttctctttcacattgtaacagagctgttgggattggagtgatgtcaaaacttcccagtttccaaatgattttaatgttgatattatggcacgaaaagtagcctgtgatccatggctgaagaagtgtgaaagaaaccagatatttctgcacactcgaaatataacagatcctttcattaattttggtctttgattcctctgcactatcaaataaatgtttgtttttgtatcacattacagtgagagtaatctttgagcccttagagcagctgtgaggaactgaagaataagtattgagataactttatagcttgacatcctttgtgcgtatggttattggtatcctgtcatttaaaaagtcaagagtagactatacgtcttggcttttgaactctggctggatttgagtgcgacgggtcaggtttctgtgaggctgggaactggtagatgactttagtaacaaacaagaagctgctttggtgacagcgtttcatgtgttccctttccgctacccagaaacatactcaatgccttagatttttttaatttggaaatgagtgtgttccttcttttgtgtgagccttggcagccttctgtgggcggtggaatcgcgtccattcctcttaacagctgtactgagggccccgtgccttcccatttcctccactctgtgaaggagtctcagtgcaaaccttaggcactcgcttctcctgtgtccctgcatcctctgcagcaggaaaacacagatcccttttctctaccaaggtttgacagcaccttgaaggaaccgtttttttgtttgtttgtttgtttgtttgttttgttttgttttgctgttgtttttgtttttttgtttttgctgttgtcccttgtccctgcatcttgctgctctagctatgctgactacacaccctgctcctgtgcctaggatgctgagcactagtgtctgcagggaaggtatggcatcctactcagtactgtgcatggtgggcctcccagaagtctccaggaatgtataaatatatctcat

SEQ ID NO: 23278 - DNA, 1153 bp, Mus musculus
ttgttcgtttgtttacaagaacaactgtatggtgtcctcctgaaagaggtctttggtgcatggatattttctgcaaattaataactcaagcagtgacatcacttccagaatcaaaatgtgcgtgctaagctgaaatcgagagggaccgttttggccaagccacagaacttttgaaaagggaggtttacggtttacaaaggaactgcagacaggtcattaacacggctggctgcagcgagctgggctacagctcatcgcttctccttttcattagcagcgagataattaaccgttaggctctggaactggggctcctggctgaggtgagctggcctggagctgtattagaaacttccagacagtgggaatggagttttttcttcagggcagtgatgagaggatactgtgtgactaccaggttccaggcaatggtcttagttagctcagtgttcgaaggatgtcggccacgttgctgtctgagttctcgtgagtcccactcagttcttgggatggaatgaccaagttgaggttgagagagctgcagtcttacttgtgagagaacctattacctgtgtgtgtgaacagttttggatttgggggacagaagtccaaatgcattattacttttcgccttaatttgacaaaatatcagataaaagttatggaaggaaggaagggttgatttttgccttgtggcctggaaggcatggtagcaagagtgtgaggcagctggtaacactgtgtccactggcaggaagcttcctccattttgttcagtctgagaaccgagccccaggtggagccactcatattcagggttggtcttccttcctcagccaagtctgtctggaagtctcacagacatgtccagaggtttgtctgctagctgataccaaatccagttgattaacattcaccgcatctcgggtccgcttaagcaatttagttgttcacgtgagcgttcagggtggaacagccctggtagccattggattccaaagtttgttctcacttccttttctgtctgctcctttcctgcctgtgttagttacttttgtatcactgtgcccatggtacctgggagaaaccggttggtttctggtttctggagtttaggtctactgtggcagggagggtatgtatgctggagcag

SEQ ID NO: 23279 - DNA, 1231 bp, Mus musculus
taggtatctagggccagaattgaatttgtagcttctctgcctgttcctgtgttcttacagttgtagaggtattttagaattcagcactaacctatagtaggaaagaaacgatcttctctggaagcattaaacgctgtagtctggtaaattctctggtaggcttttacttctcattttgctgctgtcttctgcatgtttgtgtccctggagagcaatggcaatgattgtttaagcttttgtaagctcccaaatactttaaatgtgttgctttactcttcaaattagaccccctcttccccaggctatctcaggatatcagtagagtagacagccataatcaagagcacaggttaactaatctaccacatctatgcatgactttgcacagtgtaccattctgtctccatatttgtgaaggttcctatcttagggttattctgaagattaagtagggagaacccagatgtagtggacactcagacatttgttgaatgcagtctgaaagaatgaggctgggggatgagggatagataggagctgggatgtctgggtggattaggttctggagtcagttagaacccctgagactttacttctgtggaacactggctgtactgatgctgtgttagtgtgtcatggctgctgtaaccaagtaccacaacctgaagagttcaaacaacagcctttttggctagcaactcatggactagaaatctgaaataaaggtgcaggcaagattggtaattgtgagccctatgagggaagtagctgccgaaggcctgtctctggtttgtaggtggttatacacttgtaattctcctgtgcctttaaatttaccgttttcatgagagtgaacactaatcaactggactacagaccaccttgatggcttcgtctaattagatgacctttgcaaagacctaatctactaatttgggtacattgagaaggaccagaagttaggggctcaacatagagattttagaggaagacttatcccatatcaagtgtatttcagatgcttagtgaagcaaatttgtttgctcaacagtgcttttatttattaaactttggtatgaactgatggtatagtatttttttctttttctaaggtagtatatatttatttatctaagttaataaactatatctaacacttatttgctagaattgagcagagtcctattttcttgcctattgctttgtttgctcctaatggaatgggaaagga

SEQ ID NO: 23280 - DNA, 1211 bp, Mus musculus
ctcttttcatttgtcccagctatggttacgtagggagtgggcctgtactcactcagatctgtactggtgtggatgttgatactgtctatgaaagtgagcagataggagctgctacattctgctgctttatttttgagacagggtctcacttactctgtagctctggcaggcctgacattccttatggagaccaagttggccttgaactcagagaacttcctgctggggttaaaggtgaatgccaccacacccagcctctgagtgttttactggcataaaggacatcctattagaaacaagttcctacctactggaaagattgtatgcttagctctgagcatgctaagttcatgaattaactttgagttaaggtttaattttatttagggataaaacaaaaacaaatatttttcacatttctgagaagtaaagtttattgtttaccctttaaaactaaaatagactttttttgcattggccttttttatttctttttcagtcgcctaggcccaccttcttccccctctgcagctgacaaagaagagaaccctgcagtgctggcagagagctgtttcagagaactgctgggccgagcaacttttgggaatatgaataatgctgttaggccagtttttgcgtgagtacttgctatttttctagttatccatgaaggtcacattgggcatccattatgtgtttatttgtttcctttaagtatgaataccatgtactacatcacttgccatgcatatctccttacatcccttgaaatacttatgtggagtgagaaattagacagtgtcaccaacatgtgatgcacattgctgccctcccttccctctctatttctttcttttttcttcaaattgaacctagcaccctcccatagagctaaatcttacattttctttctgcctttaatgggagcttaagattctgttgacttttctgaataaactcctattttactcagagtctaatcaagataagactattgaagacctcactgatccttacttacatggtgtcttccaggctcttatgcagtaagtttctctgcacaatcagtatcctgcaggcaggccttccaggtcttgtgctcctaatcccatcatagcatgatagatcagtgcactctgagagcctgtataagtactgggtggttttgctgaactcttctttgttacaattcagcaccatcccctcttcac

SEQ ID NO: 23281 - DNA, 1133 bp, Mus musculus
cattaggtactgctcagtatatagtgtctggggaattgaggttttctggtatttaccagatttaacagcacaggaatttaggttcacaatcagcagatctgctaaaaactactaacaagttatctaaatatttatattatatttggtgttagatagaggaaattataatttatttagcattatatgtagcttgaacatagtcattgttttaatctacttagctctgtttaaaagttcaactttgtgggctgaagagatgttcaggagagatggctcaggggttaagaaaactgttcttccagagggcctaggtttgattcccagcactcacatgaaggctaactaccatgtgtaacttcctcctgtgacctcctggattccaagcatgcaagtggtacctagacatttgtgtagacaaaatgcctatgtacacaaaatacaataaaataatttttaaaataattttgggttatgtgggaaaattatcactttttaatttattaaatttgtctttttttataggattttttggaagtaacttaccagactatcagaggtcagagatcatgatgttcatcatggggaaagtgcctgtgtttggaacatccactcatactttggatatcagtcaactagggtaagttctcagactgcaaatgaagtcagtgttagattacattttcttttaactcaagaaattgttagtgttttgaaattttggtaataaaagcagcagtgttttctttggtagtagatcattaagctattaaagcaatggttaacatactttttggatcattttaaacataaattcttgggatttttttctcttttattgaagaaatggaagattatttggcctgtgcattgtgtgtctgcatgtatgcatgataaaactgaaagttttctgaaatcttaaaacattgatagtgaatcaagaattcagacttaggatgttaatgatccctctttatagatttgatctggtaatatacttaaaccttagttaatgtgttaaaatgatctcattatgacttataagtgtacataattattcgattgtcataaaaaattcttaaaacttttaaggagatggaaatccacatgtacagcacactgtagcccattggtcc

SEQ ID NO: 23282 - DNA, 1139 bp, Mus musculus
ttcataacattccactgaagaaaagttctttttagtgaaataaatatcacttataggaaagtatgattatttatgaacctgatttttgattagcaaggtttttggttatagattcaattacagtgaatataagctgtgtactaaagtcatttaaaacctttcagcacttgatgaaaaagtctttgtacttaacttccggtctactggaaaggatagtttttaataattgttatgtatttgtaatttttaaattatctcttaatttattttatgtatatgagtgttctatctgcatgtacaccctcatgtcagaagaggacatcagatcccattacagatggttgtgagccaccatgtggttgctgggaattgaactcccgacctctggaagagcagccagtgctcttaaccattgaaccatctctccagcccagcaagtggcactgtttagttggatttgagtcttacgtaataaaggggcagcatgtagtgcatttgcacagccaccatgtgttaatgtcagctatctagactatcttcagtgtcccagtggaatcactgaggggatgatgcagtgtgagaacttgatctttcaaatgtgtttgttttctacttaaggacagtgcaattatcaatgaagataacctgtcaatgtttcatcgttgtgggatcatggccctggttgcagcttatctcaactttgtgagtcagatgatagccgttccagcattttgccagcatgttagcaaggtgagagatttagaaaagttcttaaacctagttttgtatataaacagctaatttctgagtagttaaatagataaatggacagacatatgggtggacagatacatggatggatacatacatacataaatggatgaatggatggattgattctgtgaaaatatgaggttctaaatcaaaagtatggttaatgttgtcatatttgggttgcaacagcttttaagttgttgttgtatagaatagagtattttcctgtttcacgttgagccattgtgaatcttgacatcttcagttctacttctttgttgcgttagagctagaggtggatggttaatatgcctctgaattatgtcatctttcagcaccgtttaactttcttcagtggccattac

SEQ ID NO: 23283 - DNA, 2981 bp, Mus musculus
tgcaccttctgatgacaccatgttcttattttacagccctcctcccagtccatctggaacattgaccgttacttctgggcatacccaataccagtccgtcccagtctatgagatgaagtttccagatctgtgtgtatattgactggctcatgaagactacagcattttaaaaggaccttaaagcctgcaaaacagggccaagatgagtttcaggatttgcatagtgtttaccggaatgtcctgaagtgttatggggcttgtctctaccaacacttgtcatgctgtattagaagtttcgggaccctgatttagagtacctctggagataggcttataccacgttaatttgtttgaggttcctgttatcttttaagattgaacaggtattgctttcacattatgctcttgttaaatagtatattttaaactttgcacaaacatgatttttaaaaaaatattgaaaatgtatgaagtgtctgcataactgcttagaaatgggttgcttttattttctttttttcaaaagtaaatatattccgaattttagggttgcaaattctctcctgctttctaaatccgtgcttcagatggactgtgcacacgtcccttcagtcctccatagtaacatgtggcaggcattcctagggtgtcagtgttagggaatatctactggacagtagtcccacctaggttcccctctggaaactggccagatcatgctggtcttgtgatactatgttttctgcttcaggttaagctcttgagccccttcgagctcactcttagagtgggaaaaggtgcagtgtttctcatatgtgatgtgttagtttacagatacgctttgaaactatagttgtattttgctgtgattccattaagtaaatgaaatatatatttaccatagaaaagaaagacatttaaaagagctaccagttcacctatgcagagtctatgcatttcagttttttagtgaattaatttacattttatattgtacgttgtgtgaagtctttattgtacaaaaattctcccagtgaatcttttaatttgtaagagttgaaccaaaacttgtatgcatctctatgaagattagttacatacttcaaaacagtctgtgtgttcttgctaaggtgtatgagtgagttgcctttcactagtgagacttgtaagactacaagagcgatatgtactgcacatgctagggacaccaccacacgctaaacagaagcattctgcaattagaaaattctctttgaaccattttgtggaaccactttgtataactctacctgttcaaattcagtttctttttatataaaacagtactcctatcaaaaattgtagctcaaaaaataattaagttttagttttgtgttaaaaaaatgagataaagtataggatgttttatctgtgtgtttttggttatttgggcaccattagttcaaaaagaaaaaaaaaaaaaaaaaaaaaaaaaggaaggaagagagagaaagagaccaggcatgcccaaagctttgactatttacagcagagtagaacatcttgcagagggggtctatttgctatcacctctgacaggacaacccaggctgctgattaagtgcagatacaccagaccttgttctcaagaaggacaacgcagctgccactggaagaccagtgccctgtgcgagctcgcactgtagcttccctcacaccagggatatgtcgccagctaaggaaaacctcatgcactttcggttccctttttcttcttcattttaaaagaaggatattattttttgactgcttttaaaatcttaacagggggacatgcaaaaacaatcatcatccacttggatgtcattttataaattaacactgtgtgcttttgtatggaaaaatatataatttaatagtataagaaaagatatatattcacttgcattcatgcagaacacaagctttgctgtacaaaatgttgtgtttcttagtgattttaaaaggcatgctttgcatgcaaaggaaaaccattgcagttagtcttttctcatacctgtatcttgggttttataaactgctggtttgagttttattactcttaagccacagtacatgtctgaatatcttaggcccattagacccaactggttttattgacaagggttcccaaacaatggatgtttgtctgattcttccacatttgcagggatcacatttggatgcgtgtgcaagctgtgctgtagctagttcaggtactgaatctttaggacttgctggagttcattgcattggtctattttggcaggtacgggttactcaacgcatttactgttctcctcacggtatccaattggttctattcttttgtatgactccaagaggttaagttacacgttcctccgatgcttgtgatcctgtgcgttctgctgcttccgtagtgtcactgaatcttccctgagctctcatactcagtctctctcacttctctttcctcctcctggtcctcttgcttccctccagcctcctttagaactcattttcctttagagtaataccacccttaaccagcagtttaactccccgctccctcaaacgggactcatttgtctcactaatgcttatacatgtattactgtaataaagtaagtttttttaatgtaaatttttcattgtgcaatcatatgtaagcaataaaacaaaaatagcatcgcctatgtataagtgcatttttattatagcattatgtatgtagaattaagcttttgcagcaatcaggttactcaggtggattcttttccacgtatatgagaatcagaaccataacttaggagcatgaagagagcctagattaaggggtgcctcatctagaaaaggctaaagtcatgcaagcaagttttctggagatggcccactgtttttgcatggctgcaatgggtaagctctgaattgcagatcgttcaaagatttcatcccatgattgcttcttactactgatatgc

SEQ ID NO: 23284 - DNA, 1178 bp, Mus musculus
tatgtttattccaccctttcctcccctctctccccccaacccccaacagtttataacataagctactccatttgattctgacatctgcctccagggaattttccatccacgagaaaaatcttcattattttattctaccacttctggctcttttaactttataggggcctggaagtaaagaaccctgatattctctataggacatgatgctacttataaccactccacttaaagcaggctgtcattcttagtggtgtagctgagaaacctggcctattaacgaccactggctcttattcctcttaaatgtagtggacaaatcactcagccatggttatgagagtgggagatggtgaagggagcagggtgggtgcaggatgggctctgcaccttctactgcttggatgcagaggagtgggctgagttgtgtgaacaccagtgtctctttacccagattctggtgtttagctcaatccactcatgtttggaaaaattccatcgtgtctgtgaaggtaaatatgtcaatgaaatgggatttaaggagttcacctcaatctcatgtgtatgttttgatgttgggagggctcaccattttttttcacagccttaaagcatgtatttaggtctcaccttagtttaaaacccacacgatgttatatagactttgagtatagttcttggttgtttgatgtccatcagtcaaagcaatagtgatagtctctgctcaatgagattttgcacaagatgagagaatgaactgaattttctcatgctcagccatattacctgggtgagtactgaataagtactgttttaacactgctcctgcttacactgtagaaccatagatctgacacatctacatatctgtcttaatcattttatcatcaccagtaaggatacaactaggatttgttggcctctgtataatcatagctgggttgagccaaaaaaaaaaatagttttaaaaaataaatgccaagatttcctcaggagataccagaaagaaaagcaggggaaagctgggtcctaactgcagcaacaactaacagctccttaatttggtgtgatatgttccatgtctttgtctccagaacaattagctggatgaataaatatctgtctgccctcagaaagggaacataatatgcaattaaaattaaggactttctattgag

SEQ ID NO: 23285 - DNA, 2247 bp, Mus musculus
tcctctttgtgagtgacacagaaggtagatggctcacaggatgaagacaatagagaagtggtgttcagctgggctcttacgattaactgtcatggctggcagccaggggtagagtcccacacctgtagaggcttcctgtatcctaaccatatttgtcttctgtgttcccagtgccttctgccagcatgactcgcctgatgcggtcccgcacagcctctggctccagtgtcacatccctggagggcacccgtagccgctcccataccagcgagggcccccgaagccgctcgcacaccagtgaggggtcccgtagccgctcccataccagtgaggatgcccgtctcaacatcacccccaactcgggtgccaccggaaacaatgccgggcccaagtccatggaggtgtcctgctaagcaatctgtgcatcagtcaccctggactggtggcctctcccttagcccccaacccttgcctgccaccctacgctaatgcggtattaatctaaagctgcttttgtaagaatgaactctggcggtggcagacccaggctgttctgactgcctcctgggaccagggtgggtggtggtggaccaaaggcaagaagcagttcagcgtactgttctgctaacaagtggcctggtggaccctctctctaccctcagacaccaaactgccaaaactaagaaatagatagctgtaacactgcctggctccaagcccaggctgatccagcattctggttcataggcgttttgccaacctgcctacttcctgtttcctccccactaaactcattcctggaaacaaacttctgttttgaaaggagagagagaggcaggaaagttgggcgccttattttaagtagagaaaccaagaaaggaagagaaaaaaaggcagggtctagggcaggtagaggaaaaacacaacaagtctactaggctcacttgaaggaattgattttaaagttctggacactgaaacccacaacctgtttttctggcaaccttttaacgtgcaagaaaaactggtaacaaaccccaggctttatagagaaagtgatccagcaaatgtggggcatcagtgatttaagactcttgctatgcagtctactgtaccccgctcccattccacagtgaatgagtggatgacacctctgtccctcgggaagatggttttgatttgttgttgcattctttgaggcagagggagaacccagcaggtgacaggggtccttgtctgggatgagtctttaggatgggaagggtggggatagaatggccctgggattttgaggactcatggtagggccaagtgctagaacctggtgggtgtgatttcattgatctggaatcttgtgtgactgagtcacaccttgtctcccataattgatgtctggcattgatttgaaacttgatagctgaatgtctcttaactggcccatcgctggttcttcagagagaaccgtatgttctagtgggggaaggactggttttgggttctgtacattccacgggaacttgcttccctctcctgcccctcctgctgactgggtttgtagcattggcctcttaagcaatgccagcctaatgcccatgctccatactactgccttttgattcttactgtggctaaccttgaacctttcctataggaaatgtgatcagatcagagacacttgatcgttgggagtcagccctcaaggcctggcgacttccaggatcttggagttgctagaggaaaagtagttatgccctataggcggcatgagagacaagggatcagtttacctgccaactcctaccgtggaggaggagttccactgaccttgtgtagaaagatcaggaatccaggccagggtgattgaatgctgacaagaaatcactgtatatgtctctccagggcagtttcttaataagatgtttgtatttatttccagaccaataaatttgtaactttgcagtggcttgtgtcttttcctctccctatgagggtgggtgtggcattgtggagcaggaaggggtggaactttatccttgacaccagagcccctgctgcgtgccccttacttttggagttctttgccacagaatgacactgaccagtagaaatggcactgtctgtcatataggtttctaaactttctggtagtgatattgaaggaagaagaatcaggcgaaaataagttaggcatccctgtagcctaatatatcaactaacatcatttctatgcaagcagtcaggcacatc

SEQ ID NO: 23286 - DNA, 1169 bp, Mus musculus
gtatatagcccaggctgtcctcaaactctccatcttgctgctgtcttactttcctcggtgctaggattataaatgtgcacaaccacaaacacctagggtaaggtcttggtgagatgccacactggggactaggcatgtagcacagtggtagaacatttgtctagttagtaggtgtgaggccctgggttccaaccccagtatatgcacacagcagaaaagaaaatatagcattcagagactatactttaaaggtgggaccctggaaggagggttcatcccttgtgttttgtactagtgaatctatgtgcgttcttttatccgggtgtgctatactagtacatccatgtgcacttctgtgcacatacagacatttgtgggtactattcactaggacatcagtgtgtactgttctatttaagactagtatatccatgtccatgtgcatgcagtgttgtggtattctatttatgtgtatcatgttaccagtattatctatgagcactgctattccaggagatctgttattcgtacatccatgtttactgctgtgcttgtacatccatgtgcattgctgtaattaattcccacctgctcgactgctacaaacatgtgttctgccatttttgttacacgcatgaggactggtatgcaagtacacccatgtgcactgttgtatgtgtacgaatggctgtctgtgctgcagttgtgccccagttggggaatccctgtcctcatgggctttacagccttattctgaccaccccaagtcttgtaggatggaggctgttcatgtgacaggttagggtgacttttccagaacacagctcctgagtgggtggccctccctatctattcttctctcacattagactatgggtgctgcctctcctacctcatgagacacatgggtcctagattctggaaggatgtttttggcacctgaaattttctgtgcctgtgtcacctgcatgattctgaccaccagttgtagcttggaggtgtcacacagccctttagggcttttgcaagagatgaaggatctggagagaaatggcccagctacacggaagtcctcagtgtccccagcagacctcgggagggcagccaagagccaaccacagcagaggaggaagctgttgctttcagacgaggaaattgctcctgggaca

SEQ ID NO: 23287 - DNA, 1193 bp, Mus musculus
taggccaggaagagaaagaaagaatggggttgggtctgaggatagagggacggaggcatctcctttgctatcacctctggtaagaggcatatttcctttccagctggtatgaatggaaagcttatacattttggcatttgcttcctaggtaacgagtcagaccttgatctagaaaagacatacaaagaagatgatcgagaaaaggcttcaaaaagaccccgggctcagaaaacagagaaagtccagaagatctcaggaaaggaggcagggcagctttctggagcgaagaaacccatcatcagcgtggtcttaactgctcatgaagcaattccaggtgaccgaggacaggctgggaatgatatgatgagagtgtgtagcacagctgcccttggggtagcctgaggaaggaggcccaggtcagagtgtacgtgttaggtattttagtggagtttcatttagtcacctgagtaagaccacagacctctttatcctctggagctgtcctctatctcctcgacctactctgttgtcacccaggtatgcaagaacagtcccttctgtgcctctccccatcttctcaactggtagtgccccatcagctacagtgactgcctccttggtgggtgctgcccactcagcaaatgtaagagaagcagctgttctccaggcccaggcagacactgcctggcttcttcacattttagtggtattcattaaaatattttcttagtactataagtttctatctatttttccttttccttgtagatctgttatattttcttttataaaaggtctcttgtaggaaagactattttaggaaaacgaacaaacaaacagtgccttaagagtttctattgctgtgctaaagtgtagacataagtaacttgaggaagaaagggtctatttcagcttgtcactctcaggtcataggccatcacagagggaactcagagcaggtactgtaggcaggaacccagagtcagggactgaagtggaagccagggagggatgctgcttactggtttcctcactcctggtctgctttctttttgttttttgtttttcaagacagggtttttctgtgtaaccctggctgtcctggaactcactctgtagaccaggctggcctcgaactcagaaatctgcctgcctctgcctcccaagtgctgggattaaaggcgtgcgccacc

SEQ ID NO: 23288 - DNA, 1177 bp, Mus musculus
acaaaaacaaaacaaaaacaaaaaaccaattcctgtaggaaaagggcatcaggaaccttcatgtgagttctgaatattgaagatatcaatgggctccaggtagggattctgggaagacttcttgaagcatgaggtagtggaattggatcttgcagagtgaatagatacccaacaaaaatggaagggtgggtgctaagacatatgtcgcacgaaaaccccagctcacatctttaagggaataaggcattgttgattctggaatcattttgagtgaccttggcccagaagcagagatttaggtcactccaaattccatgttccattgtagaagcagtttcacaaagttcctatagttttacggaattgggaaagtcataaatcaaggcaaggttaaagtacgttggtgggtacatcaaggggggaggtgcatcaggatggggacggcttcctgtcgctcagattctgattgcatgccaagcttttggactggtaaaagctacttacctgctaagtcaatagattctaaaaggtttttatctgttgccaacagatgttagttccgccacacgtgtgtgtgtgtgtgtgtgtgtgtatgtgtgtctgtctgtctgtctgtctgtctgtctgtctgtctgtgtgtgtctgtgtgtgtgtatgcatatgtgtgtagggaacccaggaatggttattctggagaggatggccagaacttatcccatgagaagggaattagtttctggaccttcagcattccaatctcttcacagtgctgaaattctaagcggccgattggtcatagccagctgcggcttcttttcaggagttttccttctcatgtacctgcaggtgtgtactgagcattgagaccagggggccttcgacagggagtctgagggctgggaagctgttgggaatttagcttgaaagccaggagaacagtgcctgctgacttgcctttaggagagagctctctggtgcctgccaggaggcagttttgtagttgtgatttaatacacagaagcacttggatcttttttatagacagtactcaggtaagccacatccctaatgatacataggctttttttttttttaaattttaaattacccaagaaaatcttctcctgcccctccacacccaatccttatcccttaggccaaacaacctccagtcttg

SEQ ID NO: 23289 - DNA, 1232 bp, Mus musculus
atttaggataaatgataacacagtcacttgtctgtcttgttttcatttagataataaatgaagaagctcaggagcaagcagacaattactgcccggtgtgataaatactcaacagcaatttgctctgaaagagtagagcacagccttactatggtctgtggtcaagcaagctttctagaaaaagtaacatctgagcaatatctgaagaaataatactacttcggagaggaggatggctgttttaaaaatgaagtgatggcggcggccgagcgggcatggggagcagcggtcggtgtagcccggctgtgcaggtggttctgtcatgtagcgactccacacacctttaagaaacaacctctgcaccaatatgtacggagaccacttttcccgctgcgcgcatccttgtgtaacatgtttattcaaacacaagacaccccaaatcccaacagcttaaagtttataccaggaaagcgggttcttgagacgaggaccatggatttctccacccctgctgcagctttccgctcccctctggccaggcagttattcagaattgaaggtgtgaagagcgtcttcttcggcccagatttcatcacagtcacaaaggagaatggagagttagactggaatttactgaaaccagacattcatgccacaattatggacttctttgcatctggcttacccctagtgaccgaggagacgcctccgcctccgggagaagcaggctctgaggaagatgacggagtcgtggcaatgattaaagaactgttagatactagaatacggccaactgtgcaggaggatgggggcgacgtgatctacagggcctttgaagatggcattgtgcggctgaagctccagggctcctgccccagctgccccagctccatcatcaccctgaagagcgggattcgaacatgctgcagttttatattccagaagtggaaggtgtagagcaggtgatggatgatgacgaatcagatgaaaaagaagcaaattcatcttaaataatctgcattttctttggccacaaccattggacttatctttactgatcctgtaattatagtctctgctatggaagtttattaataaaaggtttccaaaaaaaagtgatgtgctatgtagcataatggtatgccttatgccatggtctgtccttagtaccagatgtcgtgtctcatcttaattttccagggatttttttcttcagtctagcttccacctta

SEQ ID NO: 23290 - DNA, 1164 bp, Mus musculus
agacacaccagaagagggcatcagatccccattacagatggttgtgagccaccatgtggttgctcggaattgaactcaggacctctggaagagcagtcagtgctcttaaccactgagccatctctccagcccatctgcaaagtttatacagttactgtaactatttcttttttcatttaaaaattattggagctaaagagatggttcagcagctatgaacatttacttcatttgtaatggactggaattacattcccccaaagttatgtcaggctgcctgcaactgcctgtaactccagctccaagggattttgatgccctcttctggcctccatgggcacctacattcatacacacacgcgcgcgcgcgcgcacacccacacacacacacacacaagccaaaatacatatatacataaataaaaataaaatatcttaacagacatgtacagaatggactctgtgctgagatttctttgaccacatggtatgtatccctgttccaggagttggacacatagttaaaatctctgaataactgatcctgatatcacaagacattgctcacagactatctaaatatttttaaaatatttcaatttgatgaatccaaagccactgggtaattacactgtgaacatagaaccagttgtaagacaagatacattgcttttgtggcctaatttaccagtggggaacatgtctgattccacttatttagaaaattgtttttcttgtctgttttgaagttcagagtcttatagaaacaatagtgagaggcagaggcaagaggatctcttatgagttggagaccaagctggtctacatagcaccatgtctcaaaattaattaatctacatggagtgtgtatcccacagaatgacaaaagtggatctctcttgtaatcactgtcttttcctcattgagttatgagttctttatacattctggagagtagaccaaatcacatgtatcatctgtaaatattttctctcatgcagtggattacctctttgtctcttttaagtagcatccttgaaagttaaaagctttgactatttctgaacttccattttctgtattcctgtgcttttggtagcctaccaaaggaatcagtgatccgaggtcaggagaacgtgtagttatccgtgcttactctgttct

SEQ ID NO: 23291 - DNA, 1221 bp, Mus musculus
aaacaaaaagataggtttactaaatatgttaatccattctttaacataagtctcacctttcatcttaaaggtttccatagaatttagttattttatctttcagccatatgctagtttttttttttctttctttctttcttgccaacttgcgtaaaaagggagccgattacaagtgcagacaatgtggtattcttttgtaactgagtcctgaaatgttctgtagtgttaggcaaagtctcctcttgcttgatactaaataaacttttgaaagaaattttgtgtgtgtgagctaacgatttcatgtttttttttttttctatttaaaaagttcttcataaatagctgtaaacagggaaagggctcctctaacagcgcttgtcataaaagggtcacactaaatattgtacagcttcctttaaaagtggtataaaattaaacgtgccatggtatactcaccataggttcagatgcggtctaaagagtccacacggtatcaagctactcactcaggtggcacgttaaacccatgcaaaccaaatctgactttaaaaactggttctaaaataactactggcttttctgaaaaggatgtgatcagatttcatcttgtcgagcgttttttcactagtgcaactttggattttttatgagacttttggtaccttaatgaacacctcgctccatgctggaagcataaacagagagcttttaaagacattctgacttgcctaattgaggtcgcactcgccaaggctgaggatgtgtaagccttaaacggtcttcattttcaaaggtaaataaacgaaataagattttaatctcacttaatttatcttaatatataactaataaagccagggagattacaacttagccggtttcattatccattctagaaaggttttaagatcacctaaattctcattttaaaaagtttaatttgttttagtcatctaaaaagccttagtctagccagtttaattggggccaattcttccctgttaaacaactgtaaaacctcataactagtcgtgtgtaatacatcttttggttaataattgagggcattcttaaaagtgacaagggtttaataaagttatttgttaatcatttggcttaagttttaatggtagattatgtaaaatgtttatctttagtttcggaggggggctccttatatttattttgagtaaacagatttcttcttttgttaggaaatgt

SEQ ID NO: 23292 - DNA, 1165 bp, Mus musculus
gtcaatggaagcaggcagggttgaagctgaaatgggattgtgaaagtcagtcatgcatgtctatagggatgagagacacactagagttgacaggctgacgtaggtgtgaggtgctgaaggcactggctgcatggtcttcttgtgtggttggggacttagtagctatcgctggaacataccaggttgccaggagacatgtggagcaagatgcaatagaaagaccagaaggtgctaggtctctgcaagctatgagcctgtcactttgtcccctagcacaggtgtgtgcagttggagcatgacacagggaccccacatgctggggctgctgtattccttctgagtgtcacctgggtgtggtgtttattactaaaggggttattcaaacgtgcagtctccttattagacaagaatgaaaggcaagtgcccaggacagacccacgagaagtttaccgtctatttcccatagttggggtgacacaagcatggcctttctgaattcagccctgaacacagtgcaccaccaatgttttctgccctcacttcagccagtctctgctgcactgcctctgccactgtgtgtcctgtgtgtgtgccgaatccccgcctgggtgctctggccagaaacccaccatttggcccagatgttatcattgttgctttgtcgatgtgtacaaacgatcttcatctttctcttttccaggacctgcttctggggaggccgcttaaggacactcacctcaccatcatgcctactcggcaaatgaaccactggctcgccaacgtgacagtcatcaatcgattattgttgttttgtcccagatttgtgtttttggaatgcttttatgaaacagtgtggtttttttattttaatttagaaggtttttatttctttttaaagaaaattctattttgttgtgtgagaaacaaaaaaaaaaaatgctttgtattgtagctaataaaggctccccatcaaaatctcttctattttaatatagatgaagaccaaaaatctagttatttctacacagctctataaagcttgcatactggagagccttgtagaactcttggtcctcacaagacttcaaggacctacacagattgcatatgcatgaataacatccatctctcttatgggccagtcaatgggctaggcaagagagac

SEQ ID NO: 23293 - DNA, 1195 bp, Mus musculus
tttgttatttcagtctccatttgctataggaaactctgacttttatccactaatcatatatctcggagagttttaactattactgacagttcccagggggaacatctttgttgccttcctcctcttcatcttccccttcttccccttctcctcctcctcctccttcttcttccccctcttcctcttctccttcttacttttttctttcttctttttcctccttccttttccttcttctttcttcttttccttcttttcttctttatcctcctttttcatcttccttcttctccttctttcttctttctcctctcttccttctcctcttttcttctttcttatttttcctcctcttctctcctcttcctctcttttccatcttcctcctttcttcttctttctcttcttccttttctttttcctcatcctcctctttctctccctcctcttcctgcttctcctcttccttttcctcttcttcctccttcttctgtcttcaggggattgttgaagggattgactcttttagattttctaagtaggtaatcatgttgtgttcttcagggttctctaaaggcacagaactgctagaatgatagccttattagattagcttatgggatggtctgggtagctgagtaatagctttctcatgtcataaagatggagaatcctgtagttgttcagtccatgatactggatatttcagtagtcccaatatggtgctggaagcctggaggatttttggggagttgctggtcttcagtctactttggaattccaaagaaatggtttctaatccaggcaaaggaattctgtagcaacagcataggtggactttcagtgagagtaaggacaagtaggcaaaaagcaaagcttccttcgtctatgtccctttctgttgctgccaccagaaaatactgcccagatttaagatggatcttcctgattcaattaatctgatcgagaaaagtcttcacaggagtgtctagaagcttgaattttagttgattcagtcaagtggacacccataattagccatcagcgatgtcacctctgaacaaagacagtctcttctgttgacataatagtgataattgtttggctcttgctagtgaacacttagaaattaaaacatatctataacttatcacagactgtcttaaaatggcatcatataaatgtacacacacta

SEQ ID NO: 23294 - DNA, 1182 bp, Mus musculus
aaagggtctcttctagcccaggctggtctccaactcactgtgtaaccaaggataactttaaactcctggtcctcctgcctctatttcccaaatagtaaaataacaagaagagcaaccatacttagattatgagattatttagctcaaaccaaaggctttgtacatgccaggcacaaactctgccactgagttacattctaaaccccagatagttttttttatatatagaattaataattgcctgtttcttcttgtttgttttttctatgagttttgcataatttttccttgaaattcccaaaagagccatgatgcccctctcaataccaccacacccattagctaagctatgacgagtgcctgtttcatttgtagatctctctcaggttcccccaggtctcaatcctgggtagctgctgtccttcaggtctgccagagggatgctgcccactaccaccgccacatgccccctctctcattctttctctttgtctttccttgtgccagtctccagtggttcactctgtctctctcctaggcttacttgttctgtctcgctggagcgcatcctttgatgcatgaaaaaagtatacttctgaaatgttggctatctgggaaaaaagtactctcatcatctcccagacttaatgaatcatttggctgagtctagaatctggaattctttctcacttaggattttgaaagtgttgcccatgccttccaaaaattacatctcttaattttcaaaataaatagcttatataaagatcgtctaacactgttgtggcgatgtctcatacacccctcccctttctgatgactgaggctctataaatgacctgctctctttcctgggggagtatgtgttaccacctcctcactgtccagtattctatttcacagaaagtgtcctgatgatagccttttgaaattcacctttcagcccacagtgggttattctacaaaagaatattttctttcatgatatctttattttcctccctcttcctctttctccagtgtctatgatttgcagttggatcttcttgactataccttaaatttcttttgcttttccttctctgtctttcagaaagtttattttgccttccacatttaacttctagtgtattaaattcccacaaagtttattcttgttctctgttccccttttctagtggt

SEQ ID NO: 23295 - DNA, 1206 bp, Mus musculus
gtatggaaggccagacagagtggatggaggtctgctcaggccaacaggctggcaagaacccagtctactaatgttccactctcctgagatgacccatctctgcagaaaaggagctcccgaaggggagctactcaaggcagatgagcgtctctggtcatttctggagccttgcctactgaagcagtacctggacaagatggtagtattggatagatacagctccccaactcagcccagacgagggcctcaaagtgtaagcgtgcattttagctgacatggtgtgcctagagtaggctaggagccccagttactaaagctaactacatggtgggatttgctgagcttagagtcatcttgccactgcttgagtctcacctctttcctgggactgaagcctaaactccttagcatggcgttctagatctttctcattttctctctgagctcctcacccacttctggctataggttcccctactcaccctgagtttttacaagtactctggcccttaaccaggactcaccccagactccctctggatccctgatttcctgtctccatctgccccttccctctcttctccatgtcaggccacttctcgaacctagtactgtctttttttttttaatgagaaatgaagtcctgtcattatatctttgagttgaccatgcacaggagagcgtggctatggactaaaggtttccatcccccctaaaaattttatattgaaactctacccaccacagttgtatttggagaacaggcctccaagaaagtgtctgaacttaactgaggtcctaggataggtctgtcaaccaaaagaattagtggccttgcaagataaggcattcagagctatacaagcctcaaggagaggcccagcataaagtgagcatagggtgagctaaccttatgcaaaccgagggggaggggctcaccagggacacttgccctgtatcactttgtttgaacttcagccttgggaaccacagaggcccatctgtgccatccagaccttagtctatggtgtgctgtgatggctgtccaaggtaagcaagacaggcagcataagatgagtcctctgcagcacatggccccgtgtctgaggatttagtcctgctggtgaagaaggtaggtgcccatgagaggacaccagtacaggtagtttcatgttcatgcgcagtgggctgccttggcacatgaca

SEQ ID NO: 23296 - DNA, 1191 bp, Mus musculus
actgtgccatcttagcagaggatatacccctcaccttgaaaagtgtttccaggccttctcaaggggaacactgtgtagatcctggggggtgccaaagatgccaagcactttcatttctgccacaacagatgcccaagaagagctgtgactccagcttatatctttttttgcacccttaaccttgaaaagcctcagttttctgaatctgtaaagtggacatgatcttacttcatgccactgaaaagaaatgatgtaatccatgtaagattcagtcctggtacctggtacctggtgaatgctatactcagacagagaggtatgaagtccagcttagatcagaggctcctggggacctagcttctttttctttcccagaaccaactttgcccagtcagtggaagtgctgagtgtctctgggacagtgggaagttggaattgctgcttctacaagtcagagggctttcacagcacctagtcacttctgacccttgctgagctgggtcaggtataaaactgggatagagacaacacctgcgagagaaagaagtgaggggataaataccaccggggctctggagtgggtgggtggatatttgggtgaacgactggaatattctctgtccaccctcaccatttcgcccatgctttctttttctctgctgtctgctgtccgtggcagattttgttgtgggttagaatgagccccaagcctgttcccatacacaagggctattctagctatagctgctcttgagttgggaagcccaggactttgtttgcccacagaaagctgggtgctttgctgctgctctgtgttccaggagaacccagggccgtgatatgtggaggagggtgactgtggggtatttccaagggcacctggtgtttagtggataggctgcctgatcctggcactggcgctttcactagtctggatgtcaattggtcccttttgtgtcttgcacatgagttgggacaaaagcctagcaggagcgtgagaccttgcaccctgtgctagtaggctgggagcatcaggtaacgttagttcttgaccttatgctccgtgtctgtggggcttgagctgtgctagagaacagggaggaggactggatgaggtcagtccccaaggccatctcatccctcctgatcctagaagttctctgaggcccctctttcaggatagacaaatgt

SEQ ID NO: 23297 - DNA, 1767 bp, Mus musculus
cttgtgtgccagggacactgctgctgcccaccttggttcaagtttttaataaataagtaatgtttcaccttatgaggttttaatctcatgtcattgactataaaccttggaatgagttatgaaggaaagctgaaagaaacaaatacaaaagtgagcattaaaaaaaaaaagcaaaaccacaaatgtttaaaagttttgcagtcaaggttccctcctttcagactgggatgggacactatgggacccacctttgcccacacaccagctttcattcttaatgcggcccactaacaaaactactaccttggtttaaataggtgcacatagttagaaacttctgggaagtagttggtttacccacatgccctgtccccgcccctcctcccacagggatctccttagtctactccctaagtaaactttgagaactgctctcagacatgagcaatagccagccttattttctaatgtagcagttttgatatatatggtggcaccacgagacatatacccatgctttgcctggacagaaagcatacttctcagcttcagctttggccagtgcacacacctgtgctcccaagcaagccatttccctttctgtagatgccatatggcgacagctcagatgacagagcagaatggctcatcgtggccactgtgccatcattaagcagcctagaactgaattcctgaactccctggcttctggtttttccagtataagcacctcatacatctgattagaaggaatgggtagcacccttactgtagccctaaccagtgtccttccccattggtgctcactgggtcaccattgcagcatctcccactacttcttcctcgaggacttgaggcatgagcccaacccaaaagctgtagttatgctctttctgccagccatcaactgcacacaacatcaactcctgtctttgtttagagtagaccacagcacatccagcagggatttggtcaggagcttagaaactggagaactctttttgctgttgttgttttgctctttgtttactcatttgtttgtctgtttggttggttttggttttcttgagacagggtctcgctgtgtagcccaggcaggcatggaagaattcttgaccttcctgcctcagattctcaagtgctgacattacagacagccatgtgccaccatgcctgatgtgttggtgagtggtcacaggaatgcttctgacttctatagtcacgttgtatggctggggaatcccacatgggtacctgctagggactgcgcaaggggttcactacagaggtggcaccctcagccaaactgttggttagggcattgtggtagctagggaaaataaatttggcagtgggctactccaggaaaaacaacgacccctcagagccgttgagttgtgtgtgcagtgaccttagtgtccttggaccaagcaatgaccagcagcacagcttcccaagtggtctctgaacctctcccaagaaggggagcttcagtttttactgtctggcggggagttctctcttccattgctttttgggctcatgcctctgcttctggagccctccctctccccgtttccctcccgttccttccagcgacttggctcagatgtcccttccgctgggcaagttcccagtctctgcacctggcttcagcccctcatattccctagctccttctcttaattgcagagtcccttccttccgtcagcatgtttttatttatctttaatttaccatcttaaccgtggtgaagcctacagcagc

SEQ ID NO: 23298 - DNA, 1104 bp, Mus musculus
attccttgggcaaactgataatgagcacctgcttgccttccacttatttcactgtctcttcttcatagagctcagttgcaggtgcctctggacatctccctggacagggtgttttcagtccagtcggccatgggagctttgccaagatgccaggccacttaccaagatgagaaaaatggaacagattttaagaaattagtgatgtaagttagaaagtcaagcaagaggtttgcttatcacttgtaggagtctctccattagtataatttccctctatgataatttgctagctttcttgagtgctagtagggctgggctgcatccttgcacctgtggcacttcacgcctgagctgctacatgagatagggcccatgctctgagtcatggtggttaggtacaagggaggatgacacatacttatgtgtgctgttcagataatgtgttgcttcctgccctcgctctcacttcctgctgcctgaagcactttgtacctcattttcctggtgaacactccacccatcttctagaggtatgggatctgagacaacttctgggtctaccacactccaggaaatcaacccttcctcttctggctgtcccaacatagtaactataaccaccttgcccaatataaaatccatttgagcttgccatagtctgtggatggcttgtatgttactggagagagccacctggctcatgaagcatactcctgttccggaaggttgacagggaagtctaacaccccggccggggcttggagaaagcctctgtaagtaggcatggggatttgtgttccacagcaaatcaggcatgcttcagcaccacggagagctctctgctgggctttccccagtgagggtgctgacccagctgtttgcaggctctgatcataccccacctgtgggcagcagtgcccttgcagcagagcagaggctttgattcctgggttccaggttaacagcgaagcattcacatgatgtgtctaggagtgtgtaaagcactgtgcagactgaaggcgcagggttaccctgcttacactaaagcctttctgtttcctccacaggcctgaggatttgggggtggtgggggtggtgagcctt

SEQ ID NO: 23299 - DNA, 2005 bp, Mus musculus
agcatgctctatggatgttcagaaaggagctctagtcatgacccagagtgctgtatgagcagtgtgtttcccctaatgtgccacaccccattgtgaaatggaaaccttcacctggggcgatgcaagacttctcagaggtctaaatctgtggatgtagctccttcggagctgtgtgttgagccagctctgcagtcagggccaccttgggagtcattatttcattttctgggcatgaatctgttaggaataactagcgataatggttcatcagactgtctcatgctggcatgtgctgactctccaacagctccgggaagaaattgccctgctgattaattctccactgttttctctctcctctcagaatggctattcaagtggacaagttcaactttgaaagtgtcccagaatcccccggagagaagggacactttgcaaatctgaagcagctggaagaagagagacaggaggcacgaggcctggagatcagcagcaagctggacatccgctggagaattctatccttttcagtgtcttccccataggcccagggcacaccctgatcctgactcgggcttctgacccccacacagggagccaagaggggcttaataagtactgagcttcaactacagacagcttcaaatggcatggcaggatatggaccatagggctggcattttcttagcgtattcacacttcagagggcctacttaatgaagtattgatcctgagtgggtaaaggtcttgttggggccagtggtattcctgactttggatctcatgtttctgttgagggctggtattcatactagtgacaggtcctaatggctgcttatcagtgcaggacttgagccatcctctgactgacagtaggcaatgtgtatccagtcatctgggcaccaacatggtgttgtacaacctagcagatgtaaagaagctctgtagaaggggtgagaggcttttctgtggactatgctgtggagagggaccatggtatgaaatgcttgtgcccacgtgggccatgtggtcagaggtcagctgagtgggtggaagaaccccgagtgcttctgtgtgtcggttgtcttggcagcctctttagagcacccactcagttcgtcagacatttgaggggactgttagcagtgggtggaagtttatcaaaggaccagaggtaatgcccaaaaagtaccacagcatgagagtgaggcttattcagactgtcaggaaaagaaattctaatgtacatgtcttcccatcatctccttcatgtgtagactctgtgactgtcattatggtcagactgtgcatctagactagaatattctagaagatgtagtcatcatgctgtgcttgtgccaaagattgtgctgagtcctaggaacagtgtgaggagcactttcagacccaggccccagtatagactgtgatccctagcacacaggtatggaaactatgaaactatgaggtggagctttcacttcagtgatgcagtcagccaaaaaactgctgcttattgtcccactctggctaccatgatggtcaaatgaagtgatttatagcagcacatttagtctgaacggaaaccaacctccttcagagctagtctacagagactatctatggctgaagcaggcaggggacaagcctggagcacccatgccatcatcccttgtccccactgctgtgcgtttgttgaaagtgtcccatcatgggtggggtctctcatcttagaggattcccttccaccgagcagggtgtttgggggtagcaagcacctcacctgcatgccactgtgagtgtctgtgttgttctggcaaacactagacaccctctgcacattggcagggtcaccagatacttgtggtttcactgccccgcacggcttttaggcacagagccctgggcttgattaactccaggcaggacaacccacctgaggctgtgctgggtcttgttatatttaccctttggggttgctgcttcccatagggagaaggacctg

SEQ ID NO: 23300 - DNA, 1174 bp, Mus musculus
atgacctgatgtcactgccttatagatggctgtgaggatcaccgatccccttggcagatgtccttgccccaaagacggtgaaagtgcagagctatagtgagattccacttgggtgcctcatgctctcatggctgtggctgtgtggaagagaccaggcagacgtccttgccacgctgctgaggcacagtggagctatctgcagacaaggcatcctcgtttgggcagcagtggctgtgcaccgagttcctgggttgatgtctgcataggatggtgacatagagaacctgcagactcattaaccagttggctttctttatgctgtggcttttaggatggatgcttcagctccaaggaaatggttgggtatccttacccagcgaagaatgctgtactttggggtgtttactgaagaccgggcaggtgtttttgtaactctgccaactgcatatattggattatggctgtgtgtgtgtgtatcggggggatgcaccaaggacccaggtgtttagccttcctctttggattgcagcaggactcccagcgtaccccaaggaccacagcagtcttgatcacatcgcttggggaggatctgggagtcgtcttgttggcttgggtttgcagcgatagctgctgcttgtgagcagtgagggactctctgggctcccacccatcggggctgcccgatcctctctgccaggccacacttgcaaggatcttgtggcacactcagctttcagtactgactggaggagaaggcttccgcacggccggagctccaagggggctcagacaggcctactttccagcgtgcagatcctctcctgtacccagtcccttcagaactcaaccaggttccactccagtcttctcaggatccgttaaagaaaacaccagtctcggatatctccgagtcgtgtctaactcttctctttcctctctgtgcttagcactctagtaccttctgtcctctctgtgtttttaatgttcccagtgtttagcagccttggatttacccctaccccacccctgtgcctttaccccccccttccctccctttggcactatccttaccccatcttagctgaacagggttgtagagtagatgggaacatgcccaccttactgtctttgtgaaagcttttccttctgaactgcttttccttagctagctaca

SEQ ID NO: 23301 - DNA, 1099 bp, Mus musculus
agtgtttctacacccattctagccggtttggctcctgaataaatgacatggacacccaataaatttattaacaagctgcaggcactatgctggacaagtttggagctattctaacccaaccatgctagcctggtctactttccagccagtccacagccacgtggcattccctgccatcttggtcttgccctggatgttcctgctccatccatcctctcctcgtggagacctcatggccaatgctcctggttctcctcttcttttctcctcttcttgctcgggacttcctcactgggatctgaagtccctccctattctcttctcctgagctagaggctgaatcagctctttattaaccaatcagaggtaatggaaaataatttttacatatcactgagacaggagatgctccaaatatcatgacagtgccagttcattgggcacagcaatcagcatctgaatacccagtgcacaaaaccatcctccaatattttgatatttaaattgtttcagctctggccagtgggggtgcccccccctccaggctgcctgttcctctccctgtgttgtatttgtgcatgcacaggcacactcgctggcttttggtttattgtttgtctgtgttttgagtcagttatctcactggcctgcaaattgccaattaggcaatctggccagggagctgtaggaacctgcctgtctctggcttgccagatctaggattctaagcattcaccaccactcctggttttcacatgggttctggggactaaactcaggtcctggtgcctgaagcacttctgtgatggagtggagtcacttccctaaccccattgctttccttgtgacgggtatcttttttaaaaaatttatttacttatttaatttattgtatgaatagtttatattcatataacttatttatatgagttattttatgtttatgagtacactgtagctgtcttcagacacacagatgatggcatcagatcccatagtggttgtaaaccactatgtagttactgggaattgaactcaggacctttggaagaacagtcattgctcttaaccactgagccatctttctaccctgtgatgg

SEQ ID NO: 23302 - DNA, 1209 bp, Mus musculus
gataggagttcagttcccagcaaccgtatctcgtgggttacagccaccctgtaattccaattccagaggatcttaggcttccttctgacctccgtggggcacccgtattcatgattcatgtgcacacgcacacacacctctcacatgtcttcagtgacagtcaaatgccctgttgttttgaacacctactgagaactgtagacctttcctaaatgtccacattacttcattttagcctttccagccaccaaaaacattagactatgccctctttctccaagaggcaaaatggcagagctggctacttgatggactatggctcagtgtgctaactgcactgtgctgccctctgctctgccctgccagactgttccaacaacgccaccaccttccttctgatgttggaacgaagcgggtctccgcttactttgcatttggaactggactggtgagctgataccaatgactaaggcctctcagcttgagtgtcttcgagatgcttctgctagaaatttgcataaacatctgggccctggactcagaggttgtgactactcagcctgctgaaaaatcaggacaaggatgtgctgattaatgcccccccccctcccgccgcaggccaggggttcaggcatgagtgtggggatttgattgcatctcaagattttgcctgggaccattttgtactctctcagatcctctcaaggttgctgcccacgttagcccggcacagctttgtccccaggcttccaggacttgtgtcatctggaagtccatggcacacagtgctagaaaccagctgtgcccaggctttctcccgggggaacctttctagggtctgaagtcatttcagttccatctgtagggaaggctcaccatttgccaccatgttacattcatatggcaggaagaaggagagtctagattacaggactgttccagtcttccatctgtgataggtcccatgagaaccatggagcacggtgaccaaggtttgggccctcagtttcctgtctcttggatttagccacaagggccccagctgaggccaccatcacaagtatctgttgtcatgttcaggaggcaggctgtcaggtgaggggctgggggtctcccagtacctgatggaggcagtcaacatgtttgcctctcttttatctctctctttgtcccctgtcacggctgacactagcacacaggagtccttct

SEQ ID NO: 23303 - DNA, 1211 bp, Mus musculus
tagctccgctttgtgtgaaaatgttggaacttttcattgttgaggacagcctgtactcaggtgacagccgaaaggccaggaggtcaaagagactgactaccgtagaagcggagtggccttctgctcattgcaggctgaatccgggggacagatgcaccatcctccttcagattctaatctctagagcagctagtgtgtagtgtcagccctgccttgcggcagacaagccaagcatttagcaccctcccttacctttcagctctcctttttagccacagaagagcagaatcccggatgcatgtagcattttgttacatgtgattgggaccaagtcatttaatctcaaggggctgagtcaggaggattcccatgagtccgaggcctgcttgagctacatagtgagttctaagccagcctgggctatacagcaagaaagtatttcaaaagacactgaagggctaggagtatggcccagtgggtaaaagcattggccactcagtctgatggcctgactttgatccatgtggtgggagaggagagaactgactgtcacaagttgtcctctgaccataactaccacacacacacacacacacacacacacacactcacacactcgcacatgcgaaaagggtctgggaagatggcttagtgggtaagaacatgtgttttctttttctctctttcttttttttttttttaaagatttatttattgttatatgtaagtacactgtagttgtcttcagacacaccagaagagggcatcagatctcattacggatggttgtgagccaccatgtggttgtgggatttgaactcaggacctttggaagagcagtcagtgcttttaaccgctgagccaactcttcagccccgaacatgtgttttctaaacacgagaaacacagcactgggtggcagagacaagttctcttatttattttccctacttgctgcgacaatatactcttgacaaaagcagtgtagggagaagctctatttaactcctaattgcaggtggcagtccatatggggatggagtcacagtcatgtgatgctcataatcaggaagcagagagaaaggactgccagcggtcagttcactttccctgtttgtatagcccaaggcccgcctcagttaacataatgaagacagcgtgcccaggtgtgcccggccagcagcctgtctcctgggaggttctaggttcta

SEQ ID NO: 23304 - DNA, 1113 bp, Mus musculus
gcatgtctctgtgtgctacaagctctcactctggcctggaacttactatgtaacccaggccggctttgaacttacagaggcctacttgcctcttcctctgcttcctcagggctggcattaaaggcatgtaccaccatgcctagctagtgatttttaactgtaaactttgtttttgggaaattggcattttcagataagctgactgtttaagtcatcctgtgccccttcagggtgactttactaatcatctttgcatctcttcaccacccagctgccctggaggggttgtgctcggcttcagtcatttatcattatcccggaggaactggtggcaagactggggctcggagactccaaggcagctcacttccctcagaagcagccaacagacaccggccaggtgagcctgcctctctccagcctgcacccaccgcagtctctaaggagaggagctgtgctgtctttcccttttcactaggcccgatgagtgtttctaggtaggaggattctgtgcattcgcgaaggagacattgtcttctggcttatcggcctgactgctacagtgaaggtttacatgcagtgtctatcactgaattctaggcctgtgttgaaatcccctggcagaatggacttgggtacccatgtaatgggtaacattggtccctggtgtcagttttaactgcagatgcagggaccagggatacttcctgtttcatttaaaaattcctagctattttatcttttttttttcccccagttattgcttccagtgaagagcgaaagacttttctagatgcggagatccacaagtgctcagtgagcttttgatcttagtgtgttactagtcacattgtggaggccgggcaatgatgagcaatgcctaactcaaagccaaagacacttgtgggtctgtgagacctttagaaaacctcagtgaagagaaagccacattttcttctcagtggggacagcacaacgtcattgccagacactctttcttgacagagaagggtatttagtattcattccatttatttatttaacttgttgttagtgttatattatgttttgagacaggttttctctgtatagtcacggttgtcctgggactca

SEQ ID NO: 23305 - DNA, 1055 bp, Mus musculus
ttaacctaatgtgtactttgggcaggtgatgaaatttacacaggtacctcaagtcaagacctgcgcgtgctgcatttggatttttggttttgttttgttttgcttttctatgtatcattatgttttacttaattttgttctggtgttatgctttttggaccccaatagtctgttgaaagaaaaacctaaaaagttagtatccttgttttctcccccctgcagtatgtggttctaaaggtcaccccccccccccattaggaatctcccccaagcacacccgaggaaaagggtacgacgggcgcttctcagcgggccgtgccattgagatcttttatattcatgctgcttctagtcccttctccacatcacctaagggtgggtacctccattgcgatgttgtggcatcttaacttttacacacagacctcatgggtgtccactgaggaagtagtatgagcctaaagacactggcagcgtgcagcctggcctgggagtggcggccttcgcatctctctctctctcagcactcagccacgctgacctggccgggtggtccgcgtggacaggacagctggtgaagcaagccggatgctcagaacactgcgcgtctcctgtcctgttttaagcttagctgggtcctttgttttcacagcttcctaggttaaatagtttgcactatttttgcaataaattcatgggaaacctaatggctacttatgttgttgttcttactgtgtgtataaactaacactaaaggtttgctatagtgttttcttttcacctccttatgtagccccataacatgcacagaatgctgtaaacctgattaagatatgatgtggatattttataaagttattttgtatggtgtcgattttgttttgccgcatagtgtgtcagcaaaaaataaaataaaataaaattcctcgtatttacagctgcctattccgaaggtgtccagttactcactgtctgtctccctggagagtgctgttaaatgcacgggctgagtccagtttccctgatagagtgcacctttcccccggggctgggtc

SEQ ID NO: 23306 - DNA, 3130 bp, Mus musculus
ggccctccatcctgcacagcaggtggcctctgtcctacctccaggcactggctttactatctggacacctagttgagagccttgaaagtctgttcttggtgtccttttagaatcatgctggggctggtcgttagttgaccctgcccagaagctgtcagccctcagctctttcttgcaaactgtgatgccaccttgtagcctacggctgtggagccccgtcctgggttctttgtgccctgaaatgcaggtgcacctctgctgggggttggtggggcactggcaaaggctacttgctggccttgtgttctctgcccctcagcaagactgtctgttgtagtggaagtaggtttagagggatttggaatcatgtctttgtgaatcgagtgtgacgtcatcaggggtacggtgctacttggtcctaatgttttggaatgcttttccgtcgttgttactccattgttactctctgttctatgacactgagggagactgctcacttaggtgtggtgtcacataggactccagctttgatgtgctgtgcgggtggtgtgattatcatctctgaccttctgaagccaggggtggtacccatccctagctcagtctaattaaatctttcctccctgtcaagtgattgctttgggtggttttaacaggagtagtccagtctggatattctattttcttaattacatagaaaaggcccgtgcagcactagctgcagacagataacacatttaacaattttggttcctcttcaaagccaaatagacctatgttgattaaactccaagagggtacaattcagcattaaattaaaatttgagttgtgaatttgagagggaatttcagtatagttgataaagttaagtggcaagtgagtatttataaaagttataagagaataattgtaagtttctgtacaacaatttggctactgcctcataaatacaggaagagaccgtagccctgaatccgactctctcacctcccacataccttggactacctgcctaatatgtatttgagggggtttaacccttggttttatcaaattttctagttttattttatttttataaaataattgaaaaagaaccaaaaaggaatccagaagttccccagtggctcctcccccagtcttaatcccctcccccccacacacacacacacactcaaatgttttagaagacattttgaatcaaaatgtattccacccatttaacgtttgctactttctgagaagtggagtggctacgagggcctgtttcagatggtactctgtatgtcatggacatgtttgtacctgtacagtggatctgtgtgacgacgtcttgtgcttgcggtttagaaaccacgcagtgctgttttgtaaattgacagtttctgtgtaaactattatttatatcccttggcccctctgtataatttttcatttgctacatggattgtataattaattataaaattatagtacctgctaaacccaattctgaggcttcatgtcattgtctttggtttgataccagtctgatcgggaggctgcccaggccttgcgcaataccagtagtgatgttacttaaagttaagccttaatcagacagtgaatttgtgcatttcagagtatgcaaaaaaaaaaaaaaaaaaaaaagcagagtgagtttcaactgcccaggtcaagatgttcaaccctaactaacaggttccttctggagtgaaaaagtctaatgggttccctctggggtgaaaaaagggccgttacccgggttacactcttccctcccacctgcgctctcccatgtggcgtgatgaaactgatcgtgtgcatttctgtggcagtctatctagagacctttgcagggttgtcttcaaatgtctggtttctctcctctggtctgtgacgagcgagcgtctactgccgggagcacagctggggcgtaggtttcaccaacctgctcagcggccaagctctccgctgttactgccacctgctattgcttctgcatagattataacagatttgtgtcgggtaaaagcatcttcaatcttgaggtaaattagaggggacccagctttcttttacaatgtggatctacctcagttaaacagttgggtgctattaactaagtctgtcaaattaaattggaaagtaaccaaacagtgggacataactaactccacgtgaaacttgaagacatcatttccgtttctttaataatactttttatttattttgtgccttttatgttaaccctaatgcgttttttaaaattcagaatagtcatttttctcttgcgtgtggggagcccaactgaccatacaagcagccatctaactgctagagtatactgggatcctaacctaccctcttgggaaacggagggggaaaatgtgtccaagagcaaatttcacacatcacataccccagctcttacatgcttaccttcatagctttcgcttcatttctgtgccatctgaaggggcaacccccaaaactgacactcgagtgctttgtctctgctttttcagctgtccgtgtctctcttctctggcatgttttctataagactttctttcataaacagcaagtggactgttgtcgatcccatctcctggcttgcacagtgaaggtgctaaacgccaggagcagaggcgggggcaagctcacggttgtctggaggccaggccggaggcggggaggatgtgcacgatgcggcagcccgcggtttatgaagtcaggaacactctggtaagaaaataagatcggagatcgataactttccatgcctttatatttggcagtttacaacttttcctactacggcaacctttttgccataattctttggaggtaacacaatattttgaagtcttatgaatttgattttataccagtgagaagtcaaagttttagcggtctttcctgtagtgtatggttttactcttttaaagtcatctctggattttagaagagaacctattgtacttggtggctccaaaaggtgatttggggagccctgtcccttcccttcttgctctgctcccccccccccctttccctttgcagggtctcaaaaaaggaaaacaagaaaaaaaaatgatggttctagttagatttgtgggggttttt

SEQ ID NO: 23307 - DNA, 1094 bp, Mus musculus
ctacacagacagtggacaatcccggtggccccagacaagccataagcaacctttctgtgacctccccctgactcatctctcacacccatgagaaaaggaatgtgccctgagtagaagctacacttccttggtgttcatctgcctcacttgtgaatgcagatattttgtttgttttaagcccttccctgcagtaaccatgctggctggctctcacataggcagagcacacgtgactcttgtcacaagcgccccgttgcaggcatgccgactcctgtaagttgcactgatctctcaacagtttcctttattgcgtccaactccccatctgctgtactcatttgaagtgattgtaaacagattcacagtggcaagagtgggacattgcctcacgtctgccatcccaacacacatttcagtattacatgctcgagtgtgcgggctgggctcttactctctcgagcattgtgggctagccttgtctcaacactctgacaagaagttctccctctctatacaggacagcatgctctttgagacctgaaggcttgaatgtaacagattagttaggagtctttgtggcgctttggtctgtttagttttcttgtgatctgcaaggccccccaaaagtatgtccttctagttccgtgtggcctttgtcagcatggacagcatatgaatagcccagtcagtgttaacaggccattgctacattctttggtcagcccctcaacttaaagttgtgaggtcactgctgtgtcagactgtcatttgtggtccatccatgggagacctaaagcctggtgcagccctttatgccatgtgaccttgctgggacctaagtacatggtctgtttagccccacgtggactgtctgtagtcagggtgcccagagtctgaaacaaaaggaattattacactcaaaccgcgggggaggggggtactggggacggacggacagacagacagacagacagacagacagacagacagtgccattgcagacattgcagagccctccctcaccttgtgtctttggatttgttcagccattttatttgtctcaagttgaatgtaccggcttagccaaatcacta

SEQ ID NO: 23308 - DNA, 1146 bp, Mus musculus
gcaacagggtttgaggtcacgtaagtacattgtggaagctgtcaacacagctcttgcagaacacagcactagagactcggccagaaagaactgaaccagacagggcagtgtactcctagggcaatgaatatctgttctaaagaggagaaagttgcagcttctgccctaaataggaagcaaatgtactttattgcatgtcttcagcctgtggtcaaggcaagtaagtcgattctccagcacttcagatcttagaaaggcccagggcaggtaaaaattcccagtctgccttcatatcccctggcctgactgaggctctatcctcacccaggtctccactgcccaggcctatattcaaaacttccctcctgccttcccccatcctgagacctgacacctcctaagacacagaccacaccaccaccatccgccttcccactctgagcagccgactgacagaggcagagaggatggcagagcggcccacctgctggaactggccctcggagacgccatcgcggtagaagatgatgcgggtgggcttgaagcgggtggacttgtagaactgaatgagcaactctcgtaccatggcagccaggtcctggatgatctcctgtcggtgctgctgcacgcgcacggtggcacagtagcggttggggtgtgcgtccatgctgcccacgacctgtggacagacacggtcagcaggggacaagggctccaggtgtccctcttttgggtccagctggagattggcctataagaagcatctcccagtgtccctcacagcagatagtactgctagctcccttctcaagatgggatacttgccccatggtacacgggaaaaaggcaaccttgagccttactgtgtcagggggttgggttacctgtaaaaagcaactggggggggggggtgcctctagattttttaggagcaaacacgtctccaaattgccttatgcccatcaaagagttagcatccccagtcttagatccctaggaaggtcacagccccgtgaagcaacttggctgttttagggctcatctgaaggagcaaccagagagtcagagccccacaatgctgccaggattctgaggttaggggaccaaaagtaaacggatcagctacagctagggcctgcccacttc

SEQ ID NO: 23309 - DNA, 1236 bp, Mus musculus
ggtgtttaggtgagatgagtgttgtccctagagtccgcgtttctagaacagtcctaagagcagtgaccagctgcttcaggaatgaatgtggggatggacaagtgtggatccccacggcactttgatgttctgtgtttgccaagggttttgacaagaccggtggttttatttttagccacgtaggcatttgcttaacatgaggtgtcatttctgctgaggaatgctgaagccttagttatagctggcttctgcttgccacgccctggcccaggatcacaaatggctggtatgagatgtgcttcccggttcctgtcctgagggagacaggcacaggtgcctggcagtgctaaagcaggattccgccaggagccctgcccctctgtctgccagcatcttccctaggctgactgcaggcgcctaacgcagctgctgtggctgaacactgcaccggtgcagtccaaaagggtgcagaagacagctgcttctatttgggagttgtgacatgtgcgcctctgctccacagcggaagtcaagcgtgtgggagacacagtgctggggatggccacacagtgcgtccagatgaagaacgtgcagaggaccacgccacagaccctatccaatctctgcttaaagatcaatgtcaaactgggaggcgtcaacaacatcctgctgccacagggcaggtgaggtggccacaccccatgcatacaccagctggcttaaatggtcagtggagaggtgctcactggtagtttatgtgggcataagtcctgggctcctcagaaccaggggcatcagggatgagtgactgttagggctggagtccctaacagttgaaggctggtatggggctgttgtcaccctgctccttgtgccagggccagcagtctccactgaagagttgggagagtgagtggcctcgggacaggtcaggaatgggcttccacagacttggcagcgggtccctggagctttactgcagtgtagactccagtgttttctactctgcttacttggggctgggagcttactgctaggatcaaagctaaagcacttggggctggaaagtccttccctgtaggacctgctgttgatgggccaggaactgaggccaagtgctggcccacacgccccatagggctaagggttgggaatgtggaactgtgccttcctcgggtgcctcccacagtcagtgtgctaccctaggtgttagaggacaaggtccaagttaatgtt

SEQ ID NO: 23310 - DNA, 1101 bp, Mus musculus
agcatgcatattatatctgccattttatcccatcgatgacccctgtgccttccatggttgtatggtgtactcaccccattcatgggctgatatgcctttgactttatctgagattagattctagcataccatggtacctaaccctaggccccagagggcgaggcagtagaattctgagtttgaggccagcctgggctaccgaaagcaaataaaaaacttaattcttttttgttgttgttgttttcttttgtttagacagaatcttatgtgtcccaggctagcctcaaactcaatgtgtagtcatgaatgaccttaactgtagaccctcctgcctctcccaaatgctgagattgcgtgcatgctaggcaagatctttgaccttgttaaactgtactcggagaccctggttgatatgacctccttaccatgtattatacatcttagcaaagtggccttttccctcaggtccttcacagagcaactgaggaagatctcgagagatgctgggatgccgatccagggtcagccctgcttctgtaaatacgcacagggtgcagacagtgtggagcccatgttccgacacctgaagaacacatacgctggcctccagctggtggtggtcatcctgcctggcaaaactcctgtgtatggtaggtgttggccccctgcaggcttcagggggcgaggaggtcccagtggccctgagtggcctggaacagtcccctttgtgctgactgagctgaatggttggttcttgcccattcctgaacctgagaaggggagagggaggtgggttactctcatatacgtttggtccatcatcatcttcttgagtgaggccacaaccccatgtatcaagcaactcccagtgacccatagttgcagatagtctctgcaattgtgcaatgtttggaattttaggaacttttcagagggtgtatacatgactggtcccctctgtgttgacaccaacacccccaagagagggtgttagtagttgttagtcattcagggaggttggttgcattttattagtaatcatggacaataaagaaaaggaaataaatgggattcagggatctctcccacctctatcttcct

SEQ ID NO: 23311 - DNA, 1093 bp, Mus musculus
tgtgtaagcctgccaatctgaggtcagtccctgggaccacgtggtagaaagagaagcaacttcctcagctaatcctccaacagtgcatgatggggtggacagaagcatatccaccctgccgcacacacaaacaaatacatgccactaaaatttcttagccagggatagggcacacgcctttaatcccagcattagcagaggcagaggcaggtagatctctgagttcaaggccagcctgggtctacatagttgagttctaggacagccagtgagggctacatagacagtgaagtttctacagtctcaggagctgttttctctcacacctaatctggccttgtcacatctcataaatggcagtcaccctgggtgagtgctctctgttagagaaaggctgccaaccgctggtattggaaccccggtgacccgtctgaccaacagaaacgaggctaggcacatggaagcctcaagcaggcttacttgagatggacttctgtacactggcgctggggagcgaagcaggcgatggcccacaccttgatctcgatgcccgtgtggaactgcttgtttcgcatgtcccacacaccctggacaggggtggcaattgctttgttctgcaaagaccaagtcgttcagtggagaacaaatgaaaatattcttgctgctggttccctgaccaacaatgactcctaaggcaccagatcaccacaggtgtggcacctccatggctctagcattccttagcactgtaagtaacccccctgcacacaggcagaatggtgagttctggatggatggtggtgagaaatgacaggatggctgggccaatggtgaacctcaatgggtgggagtgaaggccaggtgaatggatggacggggtgaggaaatgagtggatgggaaggatatatgaatagagacagataaaggtaccatgggatgggtgagtggatgaggctgagtcatgcacgggcacagttcacacagccacccacatccacacagcacaagagcacttggccctgtctgcacctaccctgcccccgtagaggatggagggcggctgcagaacccgcccagtcacatctgtcatct

SEQ ID NO: 23312 - DNA, 1102 bp, Mus musculus
caggccgccgggtcacattgcagacacggtacttcctcttcatctgaccacagtgcgttatctccacctttagacctggtgacagacagcaggcatcagagctactcttgctatgcacttacagttccaggcacacacggacggcagctttggccgcggatgaagctgtgaggttctagagctgagaagtaaggaatgtggaccaaccacagaatacgttggctggatacacctcatccagggaagccctctgccagaataactcagcacttaagacttgggtgcccttcttgaaacctaacatttgtggaccaaacaggagacccagctcttcccacctgtgcagctgtactcattagagtcatgggccctcggtgcctgggtcccaatcgactcagagtcagtgtgtcttgtgttcactcttcccacagcccacacctgcaccaggagaggcggtcccaccccctagcctgacgtgctgggtacatctttacctttgatttctttggtaaactttaccctttgggaatctgtcagaggtttttgttgttcttcaatacttttaaaatccaaaacttcacaaacaaactcgatcactggctgtgccttgtaaaacgctgttgccgatactatgcgcaggaaaaggaagagacggacaggtttaacagaggtatctgaagtgatacacacgactaattagtagctgcttaggaggcccggtcctgtttctcctctgtggagtgccccttgatgttttgtggtgagaaaagcagtccactatgcccgtggctccgtactccaaaggaggcaccaaccccaggagactgcatgcttcctccagccaaggacaatggttagggactggctgaatctgaagaagtcactaaaagaattagagatcttgattgaacaagtctagcatggtcagggcattcaggaccttggatcgtgtcaggttttctaaataggaatttctaaagtgttccattcatataattcttttgcaatcaaggtgcatcctaccaagatgtggcctgcggggcattgttggggggatgctcctggctgtcagtctctggcagaaggaagacgactcagcaga

SEQ ID NO: 23313 - DNA, 1099 bp, Mus musculus
atacccagctatgtgcactgcacagtggaaataagaatgaggggggagaatggaaacaccagctagatcttgcatggcccataggccccagttagaggtagagcctgctcccagatgaactctgtcctttcaagaggcaaggaaggctcgatcgatgcaagtgtggaacggtgaggttgtgagctagaagcacagcgaggcttgtctaacactgacaccaagccttgaaacaggccccctgcattctgtcagttcctatgtttaaacatctgatagtcttaagtccacggggttactgcttccacagggaatgcaggctagaactacatgtaatgagcatctacagaagaaacctagagcagtctctgagtgtagctatgcctgctatgatgatgggctgattccatctgattaaaagaggccttatccctgttgcaggtacacccctgttggccgttccttcttcactgcatctgaaggctgttccaaccctctgggtgggggcagagaagtgtggtttggcttccatcagtccgtccgaccttctctttggaaaatgatgctgaatattgatggtaagagaagcccatgggtgtcgctgcagggtggatgagggcccatgcagctgccattgaagtgggtggagatttgaaagcatgcagaggagcccagattctcttagccacctttagcacagctctgatgtgataccagcctgtttcactgggcaccaaagcccttagagtactccactcccagggacctttagccagcctgaagagctacccttgccagaccctttgcattcctagagcaccccaggtgtggggcgggggccacacccttcatcctctccccatgtttcctgattacttgtgttgctgcttgaactaaggaaaagacatcattaggtgccagtggctggccactgcccagtagtcttccagctttggagtatattagacctattattgctgtgacaagtccgtaggagaaaccatttaaagctgtaaagattaacttgggttcagaggtctcggctcaccgtaagctcataccatcatgctgaagccaagcactgtggcaaagaggctgtgat

SEQ ID NO: 23314 - DNA, 1169 bp, Mus musculus
cttaccatcctagcattaggaggccagggcagaagacccactccagctaggaggcctgggctctgtagagttgtatctttatgtggggttcagggttcacattccggttgttgggtggtaggctattttgccaacccagcttttaaatttaaagtttttattatatttatttatcatgtgtgtctgtctgtgagggaaagagcccacatcctgcactgtgcatgcaggacaacccaggagagtccgttctctcttggcaccatgtgggtccctgcagttgaacaccctttgtttctgaggtcaagctgggtgttgtatgcctttaacctcaacatttaggcacatctctaagttgaaggccagaccagtctacatagaaggttccagaccagccagggttgaacaatgactttctttcaaacatatacacaaaagaaaaaaaaagttggcaagttaattttatttatgtgtatgagtgtttggtctgtgtgtttgtgtaccacctgtgtgcatggaaccagcaggggccagaagtggctcccctgggactggagttacagacagttataaactgccgcgtgagtgttgggaattgaactggatgttatacaagaacagccaattttaactgctgagctagttctttagtaatattaataatattcttatttttaatattacttttccattatatgactacagtgtgcccatgtgtaaatcttttgggattcatgtttcttggcctttcgaaatgcatggacaatgctggcctcagaattgtggctctatacatgctaggccagggatagtttatgtcaagggggctgtgagctaagaagcaaaatactctgtgaattgggataacttttattgctttcccttaaatgtggtgtgtgcgtgtgtgtgtgtgagtgaatatgtgtgtggaaatcaggggtcaactttctgtgtcgttcctcaagcgttgttgtccttgtttctgtgtcagggtctgtcacatggacctgaagcttacaggttacaccaggctggctggcgtttgagctcgtagaatccagctctctttgtttctccagcacagtgatcaaaactcaggccctcagcctgtggcaagcacttccctgactgagccacctcctagaccccttgaagattccttttggtttgtg

SEQ ID NO: 23315 - DNA, 1198 bp, Mus musculus
gagctgtagacaaggtgttagagtcagaggtgttaaaacccctgggcctacccaaggttcctgtgctgtgcatgatcacatgggagcgcagaggggtggtgccagaggggatgagcaggggaagtgaggtgcaccattgagcttggggaagggaggctagctgtgaccacagtgtgaaagctctgagtctgggtgagagagaggtgaaagtccccagcagaggaatcctctcttggtgatctggaagaacaagaagtgtgggtggggggttggcagagtcacgggccagcaagctgcctgtccctgtcccttgttggcccctggtaggtaggggtccctgtgatgaggtggagctgcacagggatgccatgaggtggtaagaaggtatgaacagaggggaaacggaggtggtggagcccatggagaggcttgggcctcgggatccaaagggcgtgggaaggttagggtgcaccatgactctcaggagcaagtctgagcttgcacgccctgatgcctgctgtctccctactgttttccagttcttgcttctcctgctccgacaacatcacccatcccaggatatgccttcaaacctccacctcggccggacttcggcaccaccgggagaacaatcaaactacaggccaatttctttgaaatggacatccccaaaattgacatctatcactatgaattggacatcaaacctgagaaatgccctcggagagtgaacaggtatcttctgaccctgtcccaggaagttgttaggatgtattttttcattggttttggcattgagatgtaatttgagtatagtagaaccccaactttgtaaatgtcctgccccagagttttagtaggtgtgtgtatccatcacttctgagttagcctgaccataagtcacatagttccaccttttgtccgcttttactatgtcctgcctacagaagccatgcaatctcatttctttggtccagaattgtcttttgggatttatctatattgttttgtatattatagtagttacttttaggggatattacattgaatgtgtgtgtgtgtgtatgtgtgtgtgtgtgtgtaggcaggcaggtccatgtccatgtgtggagtcctgggtttgacgttgggcatcttctccatcactttccacctcgtgggggtaaggtctgtcatttaaatccagagctctgctggg

SEQ ID NO: 23316 - DNA, 1202 bp, Mus musculus
gagaagatgcccaacgtcaaacccaggactccacacatggacatggacctgcctgcctacacacacacacacacatacacacacacacacattcaatgtaatatcccctaaaagtaactactataatatacaaaacaatatagataaatcccaaaagacaattctggaccaaagaaatgagattgcatggcttctgtaggcaggacatagtaaaagcggacaaaaggtggaactatgtgacttatggtcaggctaactcagaagtgatggatacacacacctactaaaactctggggcaggacatttacaaagttggggttctactatactcaaattacatctcaatgccaaaaccaatgaaaaaatacatcctaacaacttcctgggacagggtcagaagatacctgttcactctccgagggcatttctcaggtttgatgtccaattcatagtgatagatgtcaattttggggatgtccatttcaaagaaattggcctgtagtttgattgttctcccggtggtgccgaagtccggccgaggtggaggtttgaaggcatatcctgggatgggtgatgttgtcggagcaggagaagcaagaactggaaaacagtagggagacagcaggcatcagggcgtgcaagctcagacttgctcctgagagtcatggtgcaccctaaccttcccacgccctttggatcccgaggcccaagcctctccatgggctccaccacctccgtttcccctctgttcataccttcttaccacctcatggcatccctgtgcagctccacctcatcacagggacccctacctaccaggggccaacaagggacagggacaggcagcttgctggcccgtgactctgccaaccccccacccacacttcttgttcttccagatcaccaagagaggattcctctgctggggactttcacctctctctcacccagactcagagctttcacactgtggtcacagctagcctcccttccccaagctcaatggtgcacctcacttcccctgctcatcccctctggcaccacccctctgcgctcccatgtgatcatgcacagcacaggaaccttgggtaggcccaggggttttaacacctctgactctaacaccttgtctacagctcaggtatgtgccagtgccgggtaactcagcctttcacatctcagccctccctacttggccatt

SEQ ID NO: 23317 - DNA, 1136 bp, Mus musculus
gcaatatgtaaatagacataaacactaagaagaaggaagtctagccagctcgggggcagccagcatgtggctctttcctccctacctgctgtggttggggtgggttgatttataaatgtctagttacatgttgtgtgtctattttcatgtatgtatgtgccaagaggcagactcctttctggaaccatagtggaaccatagtgctatgacctgtggcaggtcatcaactgtgcattggggactcgggtgtcccatatcgttgaaagtgtcctttcacttgggtttgtttaagtccgcattgtacacacaagaaacctccccagctctccagcaatcgaagctgggaactgaactcaggtcctggaagtgcagctaatgttctaactgctgagccatccctcagacactgattccagttcttagagataaccttccagctgggagagagctgccccatgcagataccacgttgcctaaaagtttcccatttcccagtgtaccttgaccacagcttaaagccatcccattcttcactgtgcctgtgtttctcgggcatctgggcattggcctgccaagtgactcggctttagttctctctctgtctaggtggctccgcctgtctatgcagtcggtgctctgcttcccccgcccccaagcaggtttctttcacgtgtccctaagggctgtcattcgagggacatcacccgaatttggaaggagtgatgatgtccagggctatagccctcaagcccgaagctccagcataggtacagcatgggtgtgcctctcaagcgcatcaatgagaggccaggaaatggtttgcccgtgtgctcccctttactgagagaggcccgagcaagcagagccttgggagcagatggagtgggatgagagtggaatgcaggagctacccagtgggtctgtggtgtgtagagtcaaggagagaagtgatgaacacacagaatctaaacgtgttaggacacattgcacactctgcagtggctaaggtggtacatttctatgactaacaggaaagaggccaccctgaccaacctgccttcaaacggcccatctcttccacagtgtggacgcttttcactgtgagatgtgtttgtagccagctggttccttggtga

SEQ ID NO: 23318 - DNA, 1162 bp, Mus musculus
ggagccaggagcagcacagcacggcacggcacagcacagcagagcagccagcggggtccagagcagccggatagcacataaaattagtgagtagtaactcaagattatcatcaggagataatggagggtaggcagtggcccagctattgtgttgtttaaggcatatcaaaacataaggctagctgtctttcatttgggaactaaagttttactgttgaggcggagagtgaactcatcgccaaaaatgtattaatgtgtgtttcaacaggtcaccctggcatataaaccaaggcctcctgaaggggagagtggtgctgggcctgcatctttgacttctgtcaggtccacagcataggacccatcttaggaactattttggggcctccaaggtctttgttaaagagcaaatggattttgtgttttcttttttgtttttgtttttgttttttgagacaaaaaagtgctgggactaaaggcgtatgccaccaccgcccggcgattttgtgttttttaaaacagtcttatcatgtagttctggctgacgtgaaattcactaaatagatcaggctggtttggaactcacggagatccgtctgcctctgcctcccaggtgctgagaataaagaaaggcctataccaccaccacacacttgaatttttgttttgttttatttttctgagacaaggtttctctgtatatccctggctgtcctggaactcactctgtagaccaggctggcctcaaactcagaaatctgcctgcctctgcctcccaggtcctgggattaaaggtgtgcaccaccactacttagtttaatttttttttttataaggttcgtattttgaattctaagcgctggtttggctcatgactgtgacctcatgagtgcaagtgtcttttcttggcctgtattcccataggtctttgctgctgctgccaggctcacgggcacactgtcacactgtcacactgtggagggttaaagtgtctgatgcttaccatttcttgcctttctgtgagaatggaggctctcgtgggagtgggctgggagcctgcttctgtaggttgctttggaacgtcccctgattttggaccctttaggtggtaggatggtggcccaccagggccatttgcatctagtccagttgtgtgttctggcct

SEQ ID NO: 23319 - DNA, 1127 bp, Mus musculus
ccacttttaaaaaattttatgaactgttatcacacaatttaaaaaaaagtttctaccgtggactaattttacaaacctgaaagcaaggtgtcaaaggattttgtttctcctgcgcttgtcaatgtcccggtcttgtcagctgtccctttcccctttacatccttcgactcattccagaggacatgtttgtgtgcgtagaatacagggaatcgcgccgcccctccctccctgggctataaacaggctggtctcaaactcatcttcctgtctctgcttcctgagtcctgggatcacaggtcactgtggtgggctagcgaaggtacgttgtgggcaccacccactgccattggtatactagttctcttggcttcagaaacatgattgcaattggcttgctttttagatctatttgtatttatgtatgttagtgtttgcatgtatgtatgtatgtatgtatgtatgtatgtatgtgtaccacatgtgtacattgccctaaaggtcagaagaaggcatcaaatcttctggaagtggagtcacagacaggtgtgagtttccgagggtgctgggacttgaacctgggtcctccctggaagagcagccagtgctcttaactgctgacccacctgtccagcccctaaaattgatgttagaatatgaagttagtagactatgtacattagctttcctgtcttctaaatctttcttgttgtttttttttgtttgtttggtttggtttggtttggtttggttttttggaagcagcatcttattatatatcctgggctggctctcaacttgctttggttcttttttgggagatccgaatgtatgccatcttaccagctttacccatctgccgggccttcagagtcctcctgcctgctttcctgttctgtgaggggctgatggagacccacccgctcatgtccattctgactccctcgtccagagggtgggttttttgttttttttttaaagatttatttactatttatttatatgagtacactgcagctgtcttcagacacacactagaagagggcattggatccctttacagatggttgtgagccaccacgtggttgctgggatttgaactcaggacatggcagagagagcagtcagtg

SEQ ID NO: 23320 - DNA, 1289 bp, Mus musculus
accagcctgcagcaggagtataagaagcagatgctgacagctgctcacgccctggctgtggatgccaagaacctacttgatgttattgatcaagcaagactgaaaatgctagggcagacacggccacactgagcccctggccattgaacgtggctttctgccctttgggagatcttctctagcattccaccagcagcgaggaagtaaccttagcctctgtagcccgtgctcacggctccaactgaatgacagctagctgaaagtctctcttgtataagtttcatcacttatacatggttttgattttgttatttttctaaatagtgttcagaaaactctggatccaaaatgtggcatttttctgagaatgaagattatacattaagaagcttttaaaatatacttggtgttcaaattgggatgtgtgttcctagaagtggtaattcatactgaccatgacttcaagttggaagagaaatgtctgaggagggagggttccctgagaccatggagactggttatccttcctgccagaattcctatccagactgtgttgcaatatgctaatctcatttatagagaaagtgcataaaagctatattttgaagaatgagtggtttcaaaagaaaacttctgccctccctgtctccgccttctctcctgtggatactgaagcattgggttgcgaactatctgtagaactgacaaaaacttgcctttcctcatcagaattctgtgccagttttgtaccagagcactcccaactgcatcaagaaattccaggaccagccctgttctccatttttatataatttataagaataattaaagccatgttgactcttacagccactggagctaactgaccttcattgcgtctgtcttcccagggaggaccccgcaggacaaacagggatgtggttttctttagatgtccagttggtataccatgcattctgttaggtgattttgagagcataccttccctttagtttgttgggggatataaattattctcaggaagaatataataaattgtacagttcctctgacctattaaaaaggtggcgccgggaaaggttgcattgccttttttttttttttttttctttaatgggggaggaaattcttttctttcaaatcatttaaaattgttcaggggatctgtaagaaatggtcacttacaggagtgctcacaactcaccagtctcttcctttttcttgtataaagtggaggactccaccagagataatcgctctgcataccctgactttccattctgtcaggg

SEQ ID NO: 23321 - DNA, 1103 bp, Mus musculus
cagcccttggggaaaaaaatgtggctagaaagaatcaggcttcctgctgcttccataaattctttcttagtcattttatctggagaatacaaacctgactcctcatgctttgactgagtcgttactcatcaatgtcatttggattgattggttttatatcaacttgacacaggctagagttatttggaaagaaggactctcagttgagaaaacatctccataaaatttgcctgtagacaactctgtggtgcattttcttaataataattgatgtgggtggacccagcttacttggagcagcgccatccctgagcaggtggtcttgggtggtataaggaagcaggctgagcagttcatagggaacagatagcattcctccatgtctcaggtcctgtttccaccgttcctgtcctaattccctcagttctagagcctgacccaaaagttacaatctttcttcaccaagttgcttttggtcatggtgttttatcatataaatagaaaccctaagacaccaccttagtgttacattttgtgctaagagacaaaatacagagaagacaggaaccaattcgggtcctattttctttgaagtctgtggcaggaagcatttcagtcaacctgtgatggtattgtaaggcaatgttttcaaactgtactctgcagacttcatcagggtttgattctagctttattcattataaataaatagctttcttttttgagaaggggtgtgtctgcactatcttgacaattgaacccagagccttgttcatcctagctaattgttctaacactgacctgtacaggttaaagcacactccacaagtttgagtgcaaaggctgttctctttcaactgaagtgaaaacattgaaagtttttgctttcaggatgatggagcatgctttaacaggcagaacattcagttgtactcccgggtaagttctggggtcaactctgagaatagccaacagtgcattcatgggagccaggaagtagatcacattggagaggctctgtttctcagtgtttgctttattattattattattacatttatttgtgagaaagggactccagtgtgccctggcatgcatgtgga

SEQ ID NO: 23322 - DNA, 1442 bp, Mus musculus
tttttttttcacttttaaaaattctgttcagattagtctttgcccttcagggcttggttaatatcttcattccttttggaatggatatgtgtagttttgtgcagacaggatggtacatgcctttaatcacagaatttgggaggctaaggcaggaggattgctctgtgtttatgaccagcctgggctacctagtaactttctggctaaccaggatttcatagcaagaccctacatcagtataaacaagaaaaagtaatggaaagtgaatgtgttgtgggaccctacataagcttctttttatgctatcccaatactgtttgcatttgtctgcttggaaataacatgttaatgtattcaactagtttttgtttttctgaaacatcctacccgattctgcatttcagattgtaatgtcttcattgataattcatgttgggatatgtgtttttcttacatttctcttgtcactaacatgatctagaaggaaataccacagtgccagtttagtgttctaagtctgcccatactgtgtctgactgatacttctggagaacaccatctaggttgtgttgtgttttgttttgttttgttttgctttgttttttgagtttgtctacttttttgtcatgattatattaaggttatttgtcttttaaaacttgtatagtcaagatgtcctggggactggtgagatggctcagtgagtaagagcactgactgctctttctaaggtcctgagttcaaatccctgcaaccacatggtggctcacaaccatctgtaatgagatctgactccctctctggtgtgtctgaagacagctacatgtacttatatatataataataaataaacaaatctttaaaaaaaagatgtctttttgttttgtttgttttggttatttgggacagaatctttctgtgtatcccttgctgacatagataggctctgtcagataggctggccttgaactcaaagaaacccacctgcctcggcttgagtgctgggattaaaggtgtgtgccaccactactggccgatcaagatgttctttactccattgtattagtcagggttctttagagtcacagaacttatggaatgtctttatattgaggggatttattgtaatgacttatagtctgtagtccaactaccccaacaatggccagctgtgcatgggaagtccaagaatctagtagttgctcagctggtcttctggagctgggacctgcttaggttccaacagatgtgctggcaaatgagtgcaagccagtgaagagaggatcttccttcttctaatgtccttatgtagagctccagcagaaggtagttgtagactgtaaatcgagaaaattatttatttctaatcattgtattttgtgatttgttctttagatatgagttgagaattcgttacttgccaaaaggatttctaaaccagt

SEQ ID NO: 23323 - DNA, 1245 bp, Mus musculus
cacctagttaaacgtgtttctctttccattccttgtcttctctcatggtctttgttgatctcagttgttctcagtgcttctgctatgcttgcacttctgctctaagtgatattgctgctttatgagccagtgttgacttgtccaggagagcaaagccaatggccttatcagtgggctatctaatagcatacttttccagtaatctacattcatctgaaaaaaatggtacacatttgttcatacataggatggctgtgggagtgagctctagtgatccctgctcacagggatgtaactgaagttattttaaggggattcaaaagatttcccagcagtgcaatagtggtacatgcctataatcctatagcactagggaggcaggtagatctctgtgtgagtttgaggctagcctggtctacagagtgagtttcagtatagcctgagctatactgagaaactgtcttagaaaaacccaaaataaaatagtaaaatataaaaacaaattaatgttttatagaccctgggaaaagaattttcagcaaagtacaaaaatttaaagcattcctttctttaattttgtaatcctttactgtggaatagcttgggacatcagctctgttttaaggagcagaactgatgactgagcaaagaaacgtaatttggattataaaattcttgctttaataaaaattccttaaacagtaaaaaaaaagaaaaacccaaaataaacaaataataaataaattaataaatagaatattttcagtcttttgtcctttcctggttaatgtttattaatttttatgagtaagtgaatcctttttagctggaaaatcttaaatctaaaatactaagttttgagaggaatctatctttcaaaggtgaactttccatgttgtactctgaggcatgcactcatgaaggtcagtagctgaaacaaaggccctggtcaacactggaagctagcttggttagataaagcttgaatacatacagttttgtgtcagttgggtagttcatcagagaatatagttgtattttcaaatttgtcaaatcactggggtgaacaagctatttctggagagtataattagattggttcatagcatctggtagggaacagaaatttgaggttctaaacacttaatcagaccatttaatgtttaaaaattaaatatctaaatgtcaaataagaataactgcaggtttctgcttgctgcagttaggttccattcttcttcttct

SEQ ID NO: 23324 - DNA, 1139 bp, Mus musculus
agagcctactttctggtagatctggtaataatccaaggacaaagatggtgataagagatccaaactcttctcgggttggcatcagtgaatatttgtttttattttttaatagaaaatttacatttatctcttttgtgtgtatatgtgtatgggggtacatgtggagatcagaggacaacttgttgaagttggttctctccttttcatgtaggtcttaaggaatgaactcaggttatcagacttggtaacaagtgcctttacccagtgagccatcttgcctctgaaaacatttgttttagcaaacttaaacttcatggagttcaaatgattgacagtttattaagtgtgatactggcaagggtttctagagtagaggttcttcctctgtctcttccatttccatatgagggttagttcactttactcctcagttatttcttgtctcctgaaatcagttttctttctttgtattaaagaaaatttcccatgcatgcagtttcagctttctagtctaggtgtagaggtctctaatctcaattctgttttttccagttcctcttgctcctgtgagtaaggggaggaatctgttctatgtctgcctgtgccagatgtgagagctctgtgtcatctgtggtatcatgcctgtttgacccaaggttagttttcattcctgctgaatgaagagttctttgtttattatggtgtgtgtgtgtgagtgtggactcaagagcaggcgcgcatgcatacatgtgtgcacatgtccactcattcggtgtaggtcaggacaacattggtagccagttctttccttatacatgtggtttctggggatcagacttaggtcatgagctttaatgacaagtactcttatatgctgagccatctcattggctccaggcatattggtggggttttttcctcttttattttaagatttatttattttatgtatgtatgcggtcttcagacacaccagaagagggctttggatcccattacagatggttgtgagccacaatgtggttgctggaaattgaactcaggacctctggaagaggagcagtcttacttgctgagccatctctccagcccctgttttttgttttttgtttttttcagacaaggtctcactatgaagc

SEQ ID NO: 23325 - DNA, 2165 bp, Mus musculus
cttgcagtatgtccaccacagtccggggaattccaagcgtggatttggcattgactgcgccatcctctcctgtcaggtctacatctcccagatcctggttgcatctgcccttgggggcgtggtcgacgctgtgaatagtatcgttgtcatccccatagtggcctctgtaggctctttcctgggcttcttgacagccacattcctggtcatctaccctgaggtgtcagaggaacctaaggaggaacagaaaggcctgtcctcagggcccgctggcgaaggcgagggtggagcgggcagtgagaagcccactgtactgaagctgtctcggaaagggggccttcgggggctggtggagacggagtccatggtgtgagcccccgctggtacattccacactggagggcagggcgcactgggggctaggcttgcccataccatgcgagctggagttccttcccagagcacagtccaagttcagtaggtgttaggtgtagggtaggtttgagctattagacaaaaatatcacactaatttacctttcccacgattaaaaaaaaatcatttgaaatctttttttattgaaaaagaacttaatttcagctgtcttttattctgcaggtatatcattctgcatgttttaaattgtgaaatattcacagcatagtcaataagcaatttagaaaacataagggtctgcatttctaaaccagtaattggaagtgcagaaactgactcccttggcagatatcatctgaaggcagcagacagcagcgtagtttccagattgcccagcaggtgtctgttggagacaccttcagcatcagtctggtattgcagcgcctcagagtatttttctgtttattttagaaacagtattttctttttcacaactgtggttttcttagaagaacatcatctctggcgagttaggctcgcaatcctgtgcacagctgagaccacacaccaaagctggggaaaggtcccagaggtgtttgagcagaaggcagccattccccagggcagcctccagacatcccacccagggacagcaccaaccagtagggctgaatgtgaactctcagtgtgcctcctgcgtgcttgtgtgcaagtttgtctgtccagtccctaccctcgtgctcttccccagaagccaccacagggcagttgttggctccgtgggacacttcagcttgtctctacacgtttggctggaaatcaggcacagagctcctccaggtgagcatcggctcccgagtcctgctgcacggctacctcgagagtgggagacagtggcatcagagcagggcgcgggaaggggccgagcctacctcctaccacattgctgacattgatcctcgctggaacctaactgaagtcttgcaagctcatcacctgcttctgctgatggtcactggagtgggatgaaggcaaagaacagcaagcatccgcctgagcaggctgctgacccaagatcctgcctgagcaggcgggctgctgacccaagatccgtgcagtgtccgctttctgcacacgagcagaacttgggcttcagggaagcaggctcagcaagtgcggctgtgggtaaagactttccaacgacgtctctgtttaacaactccagtctctcggtctgcactcaggagagggagaacctccctggatggtacccagatgaagtcagagccgtgctcttgttgcctcggttggtgtttttacataaagtactttaaagtgcatgagaatcatgctgcaatatgagcattctaaagcaaatatatatacatatatatttcaagatgaaagtaagcagtttttaaataaattacttgaattttctgtgtcttcaaaggaacgctgtgtttatgtccttggcctgggctctcttgccacattccccacacaggtggcactttgtcgtctttagtgttttatatctgggaagcagaggcaagctcaggatacaagggtaccttccccttgcctgggtcttccctcgagcctatgcctgcagagaactgtctccaccttccagtgttttctgtgttccccgttgagaatggaattgcaggtctctttcttgggtaggggaagttggactcccaaacacagtcccagtgctaagcccccagccagctcagccccatcagcggggtgctctgtctctt

SEQ ID NO: 23326 - DNA, 1098 bp, Mus musculus
ccagggttaaaagctgtgcagtgcagtcccctgagttgttctgttttgttgtctcagctgtcctttcgttctccatctcactgattggccacataaccctgtgtaagggacagccctgtgctggggctgaggcttactgtcccctctctatctacaggccttggtggggccattggctacgtgctgggtgggctggactggacgcagaccttcctaggtgactggttccagacgcagaaccaggtgctgttcttcttcgctgccgtcatcttctccgtgtcggtggctctgcatctcttcagcatcgaggaggagcagtacagcccacagcaggaccgcgggcctgaggatcccaccctgcccggcaccagcgttcagcctggcgccccagcccctgcctcccgcctcagctcccttggtgggggcatgcaggacggcagccccccattcccagatgaggtacagtcagagcacgagctgtccttggactacctcgatgtggacatcgtgcgcagcaagagtgactcggtgctgcacatggccgacgccacactggacatggagccccagctgctcttcctgcatgacatcgaaccctccatcttccaagacgcttcctaccccagcaccccccagagcaccagccaagagcttctgagggccaagctgccccgcctgtccacgttcctcagggagtccaccaaggaggacgacaccttgcttgataatcacttgaatgaagctaaagtcccaaatgggagaggctccccaccaatcaactccctcagccgctccaaggtagacttgaagccctcagtcacatctggttccatgaggcggcgtaggcacatgtttcacaggcaggcttctagcaccttctcctactacggcaagattggatcccactgctaccgataccgccgggccaacgcagtggtcctcatcaagccgtcccgaagcatgagcgacctgtatgacctgcagcagcggcagcgctcccggcaccgcaaccagagtggggccactgcctccagcggggacacggagagtgaggagggtgagacagagaccaccgtgcgcctgctgtggctgtccatg

SEQ ID NO: 23327 - DNA, 1211 bp, Mus musculus
aggtgtcagtcagtgtgttagtgttagctagagagtgagcattctttttcctgtctacttcccttctgactgcactttgtaacgctacatcaggtataattctcaggagcttgagtgccgttgatgatgagcaggctcctgggggtcgagtggcagctgtggtgggcagcgagaccacccctgactgcagcttgtctttgctctcttgcagatcgtctagccgctcgatggggagtcacagaagaccgcctgtgtgtgtcagatccccacctctctgtagcaagagaagtaactacagcgccttcacagtcatgatgatgaaactggtattaactgagtggcccttatggatttttaactctaactcacagtgagccagcaagccatatgtttacagttcaaccaaaaacccttcgtgttgctgcacttcttgtgagaggttgagacgcctgttggtacagagtggaatacaagagttacttgccgtggaacgcacctgcagcagagcgagaagacgtcttaatttatcattggagagagatgatagtattatttatataggtagaataaatatatatataaatatatatattttggtggtaatgaaaatggctccgcagaatgccgactcggaatctatgcaagtacaagagctgcctgtgcccctgccagaccctcagaaacccagagacccagaggcggagacccaagaggagaccacaagcgaggggtccatagacagaatccccacacgcctatgggtcatgcatggggcagtgatgtttggcagggaattttgttacgcgatggagacagcactggttacacctatactgttacagataggtaagtcagcacggagggcctggcaaccgccgagcgtgcagctttagtcacagctgccgaaactcagggtcctggggagcactgccatgggcccttgtcctctgtgacagttttctcctgttaacctggttcagggtttgttccttcctgtggtttggacattgcattgcaggtcctcatggcagggcacttgagaaaagctgggcctggccatggtgggcacactgactgtggaggtctctggctggacccccatggcaagccatcctgtgtcacacttgaatttcacacctatagaatgaggctgaatgtaattccaccccaaaggttctgcaacctccccggttgccactagagtggggttg

SEQ ID NO: 23328 - DNA, 1192 bp, Mus musculus
caacttaaatagactatacaacagaggctatctgtgactttacaagaaagttggccatacttgggttggagttgattcagatttctcatgctgtgagtggatatcaggtgacggcttctccttctaccttttgggtcccaaggatatcaggttgtgctctctgagccaactagctggcccaggctcaaccatcttatagaaacccttggaccagcattactcagccttggggctgatggctgggtgctgcagactgccacagagtgtgggagtgtccctggccagtagataccctggtacattgtgactagaacgggctgcctagaatgatttgcacatctgtatattggaggttaatttttgtcttatttgatttttgttttgttgaggtaaggccttatgtagcccaagcttgctatgtaaccaaggacaaccttgagctccaccctgtaaagagctgatactataagcatgcaccaccgcttggtttcagagttactgcctcattttactgttgctgcggagccaagtcttagcactgcatttcaggcacaccttctctgaggactgagcagcagtgggtcaaaggccactgagcttagctgaatgctttggtgtttgtagttatgtatctagggctgcttgcaaaataatcactgttgttctgtccaacaccagctgatctgtttctgcttcacaaacttcatggacacatgtcctgaaaatgtccctgtcacgaagagccctgtttgacataagactggcaggttgacatgaataaagccatgatggtttctcttgacagtgacgggacaaaagtcgagatcaagagtagcaagctgggggttaggatcagtttccccactgcttttaagcatgtgttggaagtggctcctgataaaattttggaaatgttataaagtgggtaaataggtttttgttgttttatttttaattatgtgtattaatatccatgtaaggttatgtgcatatgagtgctagtgtcctaggaggtaagaggtgttgaatcccctgaagtgttacaggaagttgtaatctgcccaacagttgctgggaactgaacttgggtcctctggcaggaaggcctctcgactgttgagtggtctggctatctctacagtccttgactgaggtttatatggaagaggggataggtaagggtgagattgca

SEQ ID NO: 23329 - DNA, 1229 bp, Mus musculus
gctgaaagggaattactgccttaaactgaggcagttgtgcttgacttctgattaaacagttgttaacagatggaattgttttggtctcacttgtaaaggcttctttttcatgtggatattgtctgttgtggcgggctctggctgtatgctcagggctcagacctggatttagaccaggaacactgggagcttttgtgatgcatatatccaggcatgcttttttttttttaaataagatttatttatttttattttgtgtacattggtgttttgctgcatgtatgtctgtgaggtagtttggtccctggaactggagttacagacagttgcaagctgccatatgggtgttgggtattgaactcaggtcttctggaagaacagccagaattcttaaccaccgagccatctttccagcccccaggcatgctcttttatgattggcaggcttttcagaaatgcagacttttatactagaagcccccaactttatatgagtttaaaacctgggaggatctccttccctctgagtgtggtggaagtgaccacagatctgaaggctggggttggttttgaactcctttattctgtagtaaagctagccacagctggcttccctctagtgcacacccttcacgtggcaattccctggactttccgaatgggtgggtgtgaggctgtgaaatgcctcctggaaggcaggaaggagccaggagcttggcatccagggcacttccactttgagtagctcctgctttctctaggcactcggaaggtgagtgagggtgggctggtatggtctgagattgagagatgggttctgtcctcaagagcacgaagggggttgccagtgatagtacacgtggagctgagagcggtggtaaggaagtcagtggtgaggcccagaggccaggaagttaaggacagaggtgactgtcctggaggctcgagccattcccccacatcttctcagtctctccagttcttgatgtgacaggttctgggctaagctctgtctggactctcctgaccttgttaagaccctagtacttcctctttggtcagctgattccattttcttgcaagcctcttgctcttttcccttgcccttgccctggcctggcctgtggccaacactctgagctctttctgtaacttgaggcagcatacacagctggccactgtctatccccttgggcatcaatctgggtataaaactcctgctgggttgt

SEQ ID NO: 23330 - DNA, 1127 bp, Mus musculus
atgtatggctctcttgtcaccacaggggcctggggtagcccaggcaggagttgtctgtctgtttctgggtttcacgtggagaatctgaggacctcccatttctttctcccctcccatagattgtgccttctgaagaccagggtgggattgatggagaagccccaggagggcagctctgactactgccgttcccaacaccgtgggtgctgccgctgaggagacctgtacacctctggccctcaccattgtccttgcctcccaatggcctctgctgccaggccggaggccagcactgctgcctgagcccgctgcccctcttcaggacttgccgttccctgatggggtaacgtgacagaccggatcagaggctgcctgcccaccacggcccagggccgctagagtttggttgagttcaagttcattttccctttggtcctgacttctggggcccaactctgaccaaaggggacactcctccgtccacccatgcagagagggtgtctccagcgacggccccatagaggacactgctctgcggccggagtcaccaacccgaagttctctctgctcagttttttttggttgttgttatttttattttgactccttgtaacttctccactctgagggacaggactttggcgctgcccgtcttgctgcggggtggggggagaagtgtgcttgtttcttttcttttttagaattggtttttttggaattatccgccacgaggcagcttcctctccctctcccaggtatttgcacaatatttgtgcggggcgtaggggcgaggttttaagaagtcttttctttgtggacaagcacggggatctcactggacttggtgtggggggctgggggaccccccgtgcagcccttgctggctagtcccctctgggtccccggaggaggcatggcccgcatgaaccggcctgcgcctgtggaggtgagctaccggcacatgcgcttcctcatcacccacaaccccagcaatgccaccctcagcacgttcatcgaggtgagtgggccttcagggccgggtgggtgtcctgcacagctcagggtgcgatgggtgctcacgatccgatggctttcctggagggctgtcagcatccgtgcttcgggga

SEQ ID NO: 23331 - DNA, 1111 bp, Mus musculus
atttccctcattaagaggagggaggaagtatgtgttcaagctgagtgggccagggggaaattcaagagctgagctggggctgtagaggccatgacctttcccaggagggaactggatcatggtggtgataatcaccacgaaggatgacaaggtgaagttgacactgccctggaaacgcaacatagtatccaacagtcagcttcccctgcccatgggtgtgatgcaggcaggacctactgagctgtagtctggtggggcaggtatattcttggcttttgaggccagaagccaagattagggacaaggcagaagtatgcaggtgtgtgtcttctcatcatgtcttctgctagtggaaggagcaagagccaatgcaggctctggtctcatcttaaaagggcaccagtactagtgaaggtcctacttcaacacctcccaatacctttgcttgggagggcttactactggtgagtttcgtggtagaatatagtgagaagaataactaggtgcagagttgaagagtgttgtgccccatcagtaccactggcaggagcaatggatgtttcagaagttaaagactttacctttgacccccatgtaggtgaacagtggaatgaggagctggaagccagtgtatctagccccaagtcctttactgtggccctttaggacaggctgagggactcaaacaccacaggtcacaaagctttgtgtttgagagtgctcattgcctcattacattcagtgaaactggcctggaggttcaccccaggaaggtgctgagatgatgtgagggtgtgacatgcatggggatggatgatgaattggagtcaggaggaatgccatgaagaagtagagaggaagggaaagactttccagtgacccacgacacatacacaggcaatatccgctctgtgaccatcacccgtttttcctctgcagacatcatggctgtcttctcatgcagccaggtgggcgccatgaactagagtccaggccaatagaggtgggtagatgtgatggtaaacactggtaggtgtgactaaacatatctgtcatgatggggtagcctatggtcacccaggtgcctgaaaccctagccccagaacacaga

SEQ ID NO: 23332 - DNA, 1210 bp, Mus musculus
aaggctgaaaagagcaagaaaaagaaggaagaggaagatgatgaggaggatgaagaggatgaggaagaggaggaagaagaggaagacgaagatgaagaagaagatgatgatgatgaataagttggttctagcgcagtttttttttcttgtctataaagcatttaacccccctgtacacaactcactccttttaaagaaaaaaattgaaatgtaaggctgtgtaagatttgtttttaaactgtacagtgtcttttttgtatagttaacacactaccgaatgtgtctttagatagccctgtcctggtggtattttcaatagccactaaccttgcctggtacagcctgggggttgtaaattggcatggaaatttaaagcaggttcttgttggtgcacagcacaaattagttatatatggggacagtagtttggttttttgtttttttttttcttttggttttctttttgggttttatttttttcatcttcagttgtctctgatgcagcttatacgaagataattgttgttctgttaactgaataccactctgtaattgcaaaaaaaaaattgcggctgttttgttgacattctgaatgcttctaagtaaatacaattttttttattaaaaaaaaaaaaaaaaaaaaaaaagaaaacaggctgagaaaaaaaaagaaatggaagttttattggtggctgactgcctgttaatggaaaaggagcaggaagaggtgatgaggtggctcagtggatagacacttgcccctaagcctggtgactcgattttgttcctcaggactcagctggtaaaaggatctaactcccacaggttgttctctgaccttcacatgtgtgtcatggtatattggcattcacacacacaactatgcacgcacgtgcacacacatacacacacacacacacacaaccatgcacgtacgcacacacacacaaacacacatacattcacacatacacattcactcacacacaatcacgcacacagacatcaaatcaaagcagtcttgaaaacttcaaaagagacagaagaactcatcgaaaagctttggaaacctgtgagtgggcagcaagacccaggatacaggccactacacagaactctgtttcattttttgtgttttcaaccacctttgtgaactctacatacattctcagaatgtactgaccactcagagcagccagggagaacaacg

SEQ ID NO: 23333 - DNA, 1180 bp, Mus musculus
gcatgataggagcaagctcctgaggctaccaggtcctagatactttgtaaactatcagcagagcttcagtgttgcagcctggtgggtctcagcctatataacaggatggcacaggtaggagcctagagacaacatctccagttgcctctgtacctatcccagaagaggagagctattcccagttggaggtgggcagaagggtaatggccaggcttccttttatagtcctcgtacattggttttcaggacacagaatcccacagggacttccccatctctgtgagcattagggaagggtgcctccccatttccattcttcatccagagtggcccagacagctgagattttcctctgtgtgatttctgcaaggagtccacttaccgaggctgggaacccagtgctcgtagcggctcgacttgttttcttctggtggtgtcatgcataaacatgctgaatctccttggttatgcatgagtgtgtcccagggaagcaaatactagacatgatgggggctaagctgctggcttcacaccgctccagagtttcaaatcgctttcacggttggcagtggctgttgttcccacaactgtgctcagcaagcccctcccaagcagagtggcctgcagttctagctctgagaagaagcccaagtgtccctgataccagccccgaggccttggctttgaatgccctgcctcaagaatacaaggcaataactgtggttgtgaggttgcctctcctatttggtgaccaatgtaccagtgtccagctctttgttggcatactgtgtgctgttcacacctccatgtccctgggtcctagagagtgatgtcaggtttttccctgtctgtctgctgcgaataggcagtgtgatttgcacctccccaatgaaggggcatatgagctgagcccttctagatgtagggagcttctaataagcagatttgtgtatcagatcaccctagggatgggtcatttgctccaaggccagcctgtctcaagtcctcctgtggaagagtttagcatggtcaccaccaccactgctgctgctgctgctgtgtatgttggaaaacaggctcagcttgttttctgaatttaccctcaaggggagtagctgggcttaggtgcaaatgcaccgacattccagagtgctggatgcgatgatgatgatgacaatga

SEQ ID NO: 23334 - DNA, 1144 bp, Mus musculus
aacccggaccctcgtcgttacacgctctacatgaaggtggccaaggcacctgcaccctgcagcggccccggccgagttcgtacctaccagttcgactctttcttggagtctacacgcacctacctgggtgtggagagctttgacgaagttctgcggctctgcgattcctctgcacccctcgcctttctacaggccagcaaacagtttctacagatgcaacgccaacagccaccccaagacggtgacctcggaccccagggcgagttccccagctctagtgacgacttctccgtggagtacctggtggtgggcaatcgcaaccccagccatgctgcctgtcagatgctgtgtcgctggctggatgcctgtctagccggcagccgcagctcacacccctgtggcatcatgcagactccctgcgcctgcctgggtggagatgttggagaccctgcttccagccccttggtcccccgtggggacgtctgcttgagggacggcgtagctggtggccctgagaactgcctcaccagcctgacccaggaccggggtgggcacggctcagcaggtgagtggaatccagagaaccttgtacagttctgcagcagatgaaatgagagcgtgagggagagtgcagtccccgaggctggggtctgttcggggcaactcttttgtcatccgggttgagagaccatgtgtagaattcaaattgccaatggctcttcgttcccaggatagaaagcccagcccacatagggcgtggcatgtgagtgagggagggaagaaaggatccgtagccagtttcctcaagccacttcctcggtttaaatcttccacatgggagcacactaatcttcaacaacgacattttccagcatccctagggtacagtacctggtgtctggggactaaagtggaggtcagcacctccccagggtggcgcatgggagcacgcatagacagagtactcacagggctgttgccaggaggtaaggttttggggctcagtgtagcatgtctatagcagctgccactgaggtgtgatagtgagagcagggacacaatgccatccttggccagtgaccacaggaagaagacacactacccaacagtatgtagccatcccaggcagaaccagggtatcaag

SEQ ID NO: 23335 - DNA, 1161 bp, Mus musculus
ccccactctttggacactctttggattgggggctgtaggaacctccatgcattggaggtccctggccctgacctggctgtgacagcatgaagctcttttctacttccccagacccgagaacacctggcaaaggctcagcgggggctgccaggggagggggtctcagaggtcatccagacactgctggagatctcacaggatggcaccagctacagcggcgacctgctctccaccattgatgtcctgaggaacatgacagagattttccgcagggcttactacagccccacgccaggggatgtgcaggtggctcggggtgggggaggaagggacagctccagcaggggacacttggggaactgtcaaaggaaccaacctagacctcagccagagattaagtccccaatgctgagtgtgaactgggctgtgaccacataccataataataagctttaaacatggtcacacactgaatcccggcctggtcataggatggtttctgttccaggtcatgtactgagtcctgattctggtcacaaactctgaccttaatgaaagtctgggtcctgtccttcgtcaaaggttaagccttgacccatgtcatactggccgtagattaaatcaatcatgctggaatctgctcacacactgagccctggccttggtcatatatacaccctcactctaatcgcataccgagctttgatctgtttctgtctacactctgtgctctaatcctggtcactaactgagtcctgatcttggtcattggttgagtaatggtcctagtataaactgagcctttaccctagccataggctcaactgtgatcttcctcatgcactgatatcttgttccatttctctggttctaattccagaactttgtccagatcatcagcaacctgctggcagaagagaaccgggacaagtgggaggaggcgcagctggtatgtgtagaggtctggcgccctcagtgctagccacaggatcaggataggaacaggcagctcctggccctctacaccccaggccagccgtggtggggccttgctgggtcttctcaaccctgcttcctgttggctgcatgaccttgaaaaacaccctttaaccttgtgggtcttgtttctctatccctgaaaaggcacagtggctattccct

SEQ ID NO: 23336 - DNA, 1099 bp, Mus musculus
gataccccgcatatcagatatctgcattacaattcgtcacactagcaaaattatacttatgaagcagcaacaaagtaatttgtggctggggtcaccgtaacatgaggaactgtattaaagggtcgcagcatcaggaagattgagaagccccgctctagggtttgatctgctggtatcatggatggtgtccaggggctttggagagctaggcaagtgagcctagggctagggacctaggacaggaacctcatgtcattcagggtctgccagagactctgagaggagagccagaagtggccccactcccagagggcagaggggagccccagggcttctgccttgctctgggacatacctccatttgtaagtggaggtagcagtgtctgcaaagggactactgaggatccaaaacaaaacaaaaaaagaggtgtatgcaaatttccctatatctgtcatggctgccgggctcatacacttctccctgacacacttgttgcctgctctctgttgggcatggtgctgctggtttctgacagcttgtttctttcccagttgctggctctccctggaggggggacttctgtatgccttcgtgggaccggcagctgcagttgtgctggtactggcccacccccacccctcctctacctcctgggctggacccctgggtccttacctgtcccttaaggtggcctgtggggatggatctctggttaccagcagtggcagctctgccaccctgccccagtcactcagtgtggtaccctgtcaccctcttatctccatgagcatggcttgcctggatattgggcattgaatacgtacctgccgggaggtctttgtgagtttgatgagtaacagggaggtggggacagacagacagatggatagctgaagctacagggattgagtagacttggctcaggtcatgcatgttcacaactgtcagcaagcacccagagtgccaagagctgaggctgcttgcttcctggtgtcagagggaccttgctttttcctggtccttcagttgacacgcccatttggagaggagtccagaactctagctaggggctggcccagagccaggactggcctggct

SEQ ID NO: 23337 - DNA, 1319 bp, Mus musculus
cccaggggtaccagctgggagcagggtaacctggtgtccctcctggatctagtggtgagcagttctctcaccatcttgctgcttcctgtgtccttcaggtctcaaggctgctgagaagtctttgctgccatgtctggaaagggcatcaccacaccaccagcaccagcaccatcctctcttctcctgaagctgcctacatgggttccaagacactttcaaggcagagaaaacaagattacagagaggaggtgcctggcagggggcagcaccccagctcagcccaagagctgaaggtgaagacaagccagcatgaaaccacgggtctgccatgatgcccgccccgctggccgctcactagctgcctgccattagcctctgcagcttgagcagggtctgtacccttggtcctcttggcacagagcccagctcgctgcatggcctttggctccccgaccagacccttgcaggagccttaaggcttgggcccctgcccagcctgatctttcctgctgtgccctgcctgccaggtcaagcccagtcccaggagaccccaggccttggctcctaggctgttccatgaacctccctgacctgcctggtgattgcccagctgaaacctcagccaagccccagctccaattaccttgtgctggtagctgcttgtgtctgcagtctgagtaggccttgttgcggttcctccatctgcctggtctattggtgttctgagaccaattccactgatgttctgacagatcctccaccctgtgcccctgccagcccccacaagtttatttttgcacaaaagccatgacccatactcatttggctggcatagggtgtgtaggtaggccctggggactagggagaccctggagatctcaagagagtgtggctatcccctattttcaccaagccttgaatatccagccaggctgtctgcccataccatcttacctcaaagacagatatatatctatatatgattttgttaataaaactatgaaacttattggagtatgtgccatttctcgagggtgtgggatgggctgaagcaggacctcagaggacactgctcaaggaggtacaggaacacccaccgcctatgtaccccagaaaaacttctaagtctagaatcctcggccttaaaggcctcagggacctccaaagaccaagcccatggcctctaggcctggacaggcccttgaatccccgagctgtggtggcaggtgtgctgcaggggatctcgtctgcagaactgggctcgcccagcctggaatctggagacagggtcaatgtcctatctaaaagatggtgcacgc

SEQ ID NO: 23338 - DNA, 1160 bp, Mus musculus
gctgtgccaaagagcacagttattgggaactgggaagtgagaaacacaagtgcagacaggaatttcttccctccctttctactttgtgtgatttctcactcccatgggtgactctggctcctctttgacccctgcaggcttcctgatattctggggctcctagtggccccagcctgttccctgaagcttcctgtcccatttccagactccagagtgaacacttcctccttgggtctagctggttaggccacatataccatgaggcaccattccagccatcactgtatttacagttgtttggtcatcattacacatttccaaaacagaacttctggcttcattaaacagcagcttcccacctgccaagccccatcagcctccactcctctttatgccctgggaagcatgtctttctgagatgcctcatagtcagtgaccctccacagcttcctgtcaggtccttcaggattcaagatggaaatgacccacaaccttactgcagcaacatcagtgccagccccattcagccttatagggaatggggtgagaaagcctcagacgaggtctggaaaatatggttgttgtcaggtcactgagagaggaggtcagagaggacactggaggtcttcagaggttaacacaggattagatgctgagcatggtaatgggcagaactagcctttcataaagcttttaaagtctcacaatgacattctgattccatttatcaagtaagaagttaagcatgtcagcccacagtgccacttaatgtcagcacataaaatccaattagtaagaaaggctcagaagcccttgaccaggacagcagctgagggcctggctttcccaccacaagagaaactgcttagcagagtgtgaccttgtggatggatggcacagtggccaagctacagtgtggagcctgacacagagctgatacagtatatagggaccaggcagccaaagcagggcctgtagaaaactgtagaaaatgggcactgaagagctgtgggtcccttcagccacaaatactaaatacccaccagggtaggatttcctaggaagggggacaggtaggtggctggctgcagaattttcagccttcaaggagtctcagcatgctcaggtttgcttgtatagttgctactaaaacagagatg

SEQ ID NO: 23339 - DNA, 1196 bp, Mus musculus
gagaccagcagccagctgctccgtgctgagagcggcctcagtgacagaaaggaccagtgactgccacatctgcatcctccctgccccgcctgtcagccagtccgttccatgggaatgggctgcctggggtgggtgcactcctaaccagaatggcctcagacaagcctggcttcttttacccgcttgacactcccctgtgcttgcctcatttttgggcagctggtggggtggatgttgttgtcctggcccggctctgcctcctgggtccccatagcgagactgttctagtgtgcccagatgcacagggtcctggagcacaagggccagcagaacccaaagtcagggctgcttgtggccaagcaggccagagtagtcatgggtgtggctggggcctgcagcttactcagggacagtgggccatctggagggtcacctcatagcagggaagcaagaccagaaccaacccaagggcccccgagaacacagaagggcaagtgggtgctggtcattggctaagattctggtgatacccaccactcttaagaggatataccctgttctaggctggtcgccatgacgtctggggctccatgactatgcctagcacctgtcctgtcagctcagggagaggccagctgcttgaagctaggaacggcctccttgctccctctctgggaaccacacctggagccagagcccaaagcttcagtgatgccctgcaccccccccccccgcaccctcctcacccccatccccacccccacctccacctccacgctgctatgcttgccttagtgctgtcaaggggaaagctgcaacccgttttatttaaagaaagcacaagattaaaagagttctcaaggcgcgtgtgccggggaggttctccttttcgcagccctgccaccccggcacagaccgaccagctccctggatgtgtcttctggaggaacatggattgacatagtgtgcccaggcttgtgggcgcctctgcacttagggctaagcctgatgagtcatgggattgaggccaagagtgagcagctggctagagccccagctggccttcctaccatggtccccctccttgtccacccgccacctggagcctatgaaccttgccacccaagtcacgtgcacctggcctgtcttttctgttgccttccttagagtcccaggagggccctaggaaagtgggg

SEQ ID NO: 23340 - DNA, 1334 bp, Mus musculus
atcctcactttccatgcagggaatgtcaaccttggctacaccctgaacaagggctgctccccgatctgccccagtgaaaatgtcaatctcaatctcggtgtggcgtccgtgaacagctactgctgccaaagctccttctgcaacttcagcgcagctggcctcggacttcgtgccagtatcccactactgggccttggactcctgcttagcttgttggctctgctgcagctgagcccctgaccatcccccatgtgttctccatatccccccagctcaggaaaagcccagctccttttaggtcccaggggaccctaggaaccttcagctcctcctgggtgtgtctagttccccctccacactctctcaacgtcagggctaagtaccaaactcacccatacctgctctgttgaagtggtactggctacccttgcttccagagccaatcctataacctcccttggggaaccagcgaaggggtgaagatctccttggagtctcaagagtaccagagtcagcgccgaatcttgtggacacactgacaaggatgtctaatccaaatagatgtatatctgtgtgctcagtgtatccctgtgtgaatgaagccacttggattctggggtgggcaaagaagacctgaaaagattctacagcagaaggcctgtgtcgccaccaaaacccctccccctggtatcattgtacccaccttgtactctgttcaggaggctgcccatggaggactgccacccctccagatgaaggctcccactacccgatgcagttgagtcccatcctgccctctctgcccacactggcttcctgctgctattctagtgcctcaaataaaccgttcacaccctttcctgctatgtcctggttgtccttaacccgtcttccccctccggtccaaagggacctggggatcctgcaggcccacagccctgcttaagcgattctgaaagaccaaccccgatacagtgatacattcctatgatgccatcatagcagaagcagaggtctctgggaggccagcctggtgcatagcaaatcccaggaatctaggcccatttagtgagacaggcctgagagaaaagagagagagcaaaggcagagagaacttgaaagtgtgctgtctcaggctgaaagctgagaagtacagctacccataaaggcaggcccatcaggctggtcacacattcccaagctttgtctgccccagagacttcagaggcctgctgttgccacttgtccttcataaactaccctgtagtctaagccatgggagtctggcccaggcaagtgatacttgtccaccctataactggctttgctttgct

SEQ ID NO: 23341 - DNA, 1152 bp, Mus musculus
tttctttctttctttctttctttctttctttcttcctttctttctttgtctttctgactttctgtctttctgtctttctattttttttttttcgtttttttctgagatatggtttctctagccctagctgacttgtaagccagggtgaccttgaacgcagaaatctgcctgaggttaaaggtgtgttccacaagtgccccagctctactctaattctcttttaaaaaatgtgtgtgtgtatgtatgtatatatgtatatatagtagtaatattaatccattaatatctctttttcctaaaattcatgtctgtctgtctctgtctctttctctctctctctttccttctttattaaatttattcttttcatacatagtttcttagtgtaagcatccctgactgtcttgaagacactttgtaggcctcaatcctgtaagagccttcctctgcttttcaaatgctggcatgaatgttgtacctcactatgaccggctgagattctcaccttttcttttctccccccccccctttctttttatgattctagctttggccaggcagtggtggtggttgtggtggcagagggaggtggatcactgtaactttgcagctagcttagtcttcagtctgagttacaggaaaggagttccaagaatactggttatatttttcatttattatgcattttaattaaaatttaattacaccaaaagaatttagactgaccaattcagagtctgctatttcaaagcataaggaaaaagtaggagaaaaacgtgaggctgtttgtggatggtcgaggctgctttagggagcctcctcaccattctgcacttgcaaaccgggccactagaacccggtgaagggagaaaccaaagcgacctgaaacaataggtcacatgaaggccagccacctccatcttgttgtgcaggagttcagttagcagacaagatggctgccatccacatgtcacctttcatcttggtgaggtcaatgtgcagccgagtgacaggacaaggaagtagacatgcagacaacagacatgcaggcgaaccacctcccttctgtgtttggataaaagacatacaacaatttttattttttacagtaagccttaaaaagcactctgacagccactcagatatctacct

SEQ ID NO: 23342 - DNA, 1306 bp, Mus musculus
ccttctgtttctgaaagtctgtagctccagagcacgtgcagactcctttcctcctgaccttggatctgtcatcaagacactgacttcctgtgccaatgagttgggacatcaggatgccctaaaaaggaaggcagaactggggctcaaggaagaaaggctgtgtaccctgactcaagggacagatgctctgtgccttctaggggaggctcaggggaatggggtcacctctggtgtggaccccagctacagtgcagacaagaaaactggcctatgtgccacatttacctttaggccaagcaatggtgcccaccttcagcttaccctttccagtccctagtgcctgtggagttgggtgtttgctttctcctggttccttctcaaggaagacaagtggattgacctcctgactcagatcctgtaggactaatgcttgcactgggcagctcccagaaacacctaagtgtgtctgtttccctgcatctgggcctgcagtcacttggctttggacctgcagagggtccccagcacccgcatactggtagcactcagctggcttgtccacatctcacctcagccacctcatgatctggtggaacctcctctttcttgtttctggctggtgcagacacccgtgtgtcctaatacccatctgtacactgcagtgtgtggtgcattcctcttaaacagctgcagccatggcttgttgtattgtagacgctgtccccagtctggtgtttctgtttgacatttgtgaatgcttacgtccgtgtaatacccttggtgctgtgtcagtgttgtgcacattggactagacattctgctttgttgtgcacttggtggcttccttcctatgtgactcctctgctccatggacagtggcactgatgctccacgttgccttccagttgctgccatggtgctgtgagcagatgctgttggtgctgctcccggacatctattttctcataaaagtaaatgtgtttccaactcgcttcctgtgctctgttgggttccctacagtgtggacaaatgtcctcaaggaagccaccagctttctttactggagacagctgcaagaccagggtcccagctggtcactgctacttgggaatgtctaggatacttccagtgaccaagctcatgagaatataactcgtaattgaaaaaaagtcatcactgctgtaccatgggtgagggtggaggtttataaaagcaagacatcgcctgcctttgtgaccccagataatgggatgccaggttacggtttagttagttgttcagtacctgtagtggggaccgtgaggga

SEQ ID NO: 23343 - DNA, 1220 bp, Mus musculus
gtccccgtgcgccctcggaggtcggcgagtgcccgcatgtgccctcctcgctcattcgctctgaggggtccggccctgcctgccttccagcccgcttgtccccaccctgttcgctgctccctgtagaggaagccgaggaacttacctgcgtgttggtcccactgtcctgctatactcgactgggggaggggggtggggggtggccgtgctcagccgggttggggctggcccggactcccgcgctgctatttctctatgcaccagatcgtatttatgactcttggggaaatatatcttattttaaccttccagagaagcgaaagaatttaaaaagtaatgcacagttctagaagaaaaaatttttaaagaggaggcttaggcctgaacctcctggcatgggcgggtggaaaagtgtttttatttaatttaaattgtgtttcgtttgtggaatcttgtttaaagcttggtcgcttttttggactagccggaagagaggcccggtggagggtgttataagctgggcgtatctgcgccggctgagatctggttttctgaggcttggccccggtgctctgaggctccgaggctccttccccttccgtcctctgctgctcccaggtggctctcactgagtcttctgaacaggacgctagacaaatcgttgggaaagaaattttgtgttgttggtttttgttgtgttctctctctctctctctcactcactcactcatttgttacgaaactgaggaaagaaaaaacattaaaaaaaaataaatgtttagatccaaaagtcattggaacctggctgttgtgtctgtggctttcgttcttgtattcgtttctcttggaatagaaaaatatgaaagtctctggattgggttttacgggaactggtatgtccagataggcaagagcaggaaggaactgaccaggaggcagtgtctgtcagttaaccaagacagcattctgtggctggccttggagcaccaacgaggcagggcagggcagaggctccaggcagccttggtggtgactccaagtgcattgcagttgtatcctggtggcccaaacagtcccagccattcttggcagctgtgcctccccgaggggtggcccagctcctgttctccaaaggatgcaaacccaacgtgggtagtaagagatctctgaaaaatctcaccctgctctctgggccgctgcaaacttttaaatgacagttc

SEQ ID NO: 23344 - DNA, 1170 bp, Mus musculus
tgtcttccttagcatctctgtcggcatcttcccaagcttatccacctgctggcttacatcgtccgtctttctgtggctgtctcagagctctctctagtctcttctttattctgtcctgagttcagctactgtgtctttcttatactctcactatttcccagaatcctctctcttccagcgagtgtcccacctcctattccctgcctcagctcattgcccatcggcttttttattggcaggtgttgcttataagaggttttctctacatatatctattatataatacatattatatgtaatatgtaatatataatatgtatacacatattcacataccatatacattgggacaacagtcttattatgtaatcctggctggcttgtagtgggctggttttgagttcacaaaaattcacttgtttctgcctcttaagtgctaggattaaaagtgtgtaccaccatacccagcttgtatatttttattttcaacttatatctattcattgcattttaagtgattttttttgtagacaggcgataactaagtcatgttctaaaatgcattctgacaatatcttttttttttaattaatgagcctgtaccatttatatttagcatttaacatgaagtctcagcactcaggaggctgaagcaggaggctcacttttgactacacagtggagctctgccctgagacaagtaaataacagtgaaaagcgcacacagtcagcactcgagctttcatttcaagcacaattaagaaagctcaaaaagggacagaaagctgggcatagtaggacacacatttgattccaaacactcaggaggcaaagtcaaggctgatctctgagtttgaggccagcctggtctacaaagcaagttgcaagacaagcagagctacatggtgagaccctgtttcaggaaacagacagacagattccagcttagctctgttttctttttgtcatgaaggttatactgtttctctttggttctttctttgtctttaacttttatgagtctgatcatctgtattctaggaggagttcttagtctgtccggtttggagttcactctgcttcctggattgagagttggttgtttgttcccttctgtgtcttctactacagtacagttaggtcctggcttacagactccagggtcctggt

SEQ ID NO: 23345 - DNA, 1646 bp, Mus musculus
gcagctgcttcttcctccctaacagagctcaggccctggagcctccagtggacctggtggagaccacagtgagctcattgtgaggattaccagtctggaagtggagaaccagaaccttcgaggcggtgagggcttgcacctgacaggtggggctccagctccaccccctactatctgactggtgtgtttctcttgtgcccacagtggtgcaagatttgcagcaggccatttccaagttggaggcccggctgagctctctagagaagagttcacctactccccgagccacggccccacagacccaagtgagtcttcccgcttgggaaggagccttgaacatgtcctggcttctgtccctaccttctgactgtcccaggcagtctgagatctgaggctgtctcctgagggctggctttccggcagttagctggaatttagaggccggatgagtctcagccttcctccctccctctgtggcagcatgtctctcctatgcgtcaagtggagcccccaaccaagaaaggagccacaccagcagaggacgatgaggacaaggacattgacctgttcggcagtgacgaggaggaagaagataaggaggctgcccgactacgggaggagaggctacgccagtacgcagagaagaaggccaagaagcccacactggtggccaaatcctccatccttttggatgttaaacctgtgagtggcgtgtaggcctctgggaggctaggaatggaaccttacagctggagatggaaggtggagtgttgagtggccggcccataggctcagcctctgacacaccctcctgggtcttggtggatgtttaaagatcttgaatgagaacagaaatgtggagtgaggcatgtaaacctgggactgtttctaagggctctataaagaaacaaaagtgtgtcctgtagtttagagggtcatgggttacttcccctagtgttctagaggtttctgagatggctcactcagacccccacccccaccccacattctctcacagtgggatgatgagactgacatggcccagctagagacttgtgtgcgttccatccaattggacgggctggtttggggggcctccaagcttgtgcctgttggctatggcatccggaagctgcagatccagtgtgtggtggaggatgacaaagtgggcaccgacttgctcgaggaggagatcaccaaatttgaggagcatgtaagtgggcatgggcacaggggtaggggagaccggatgggcccgggacactggctcctgccaccccacatccactgtggaacatgaacttgccctaggcggcagcctgcagcagcagcgccctttgtctccatccacaggtgcagagtgtcgacatcgcagctttcaacaagatctgaatgtccgagagagtgtggtttcatgtgtgtgaggacctgctgagattaaagactgagactctgcactccgcctcttgtgttacttggtgtacagcgctctgtgggctctggctcatacttgtcccagaaacaatctattaggtccacatttgtccaccgtgtctctcctgtccctgctgttgtcaccgtgtacacctagacccagtctaacactcctcttcacactccttacctctggagggatacatcctctt

SEQ ID NO: 23346 - DNA, 1234 bp, Mus musculus
tttttcttttaaccatctttatcaaaacagtactaaaagtacttaaaacagaaagagaatgacaaactgctgcgtactgggataacatttttatggaaaatgactttagggaacaaagtgggcttgctcatttacaaatctgattggctaaagggtgggtatggctggttcccgctgagctgcttttgtgcttcagctgctgattggatggttagaaaactcagggcctggaggacgggatcacccttcacccaggccctgggatgggagcccactttgttgacagaagggctgttgactctgtgtgtggaaggggctcggtgttgaattgagaactgtttgtggtcattggcagcagcaaggtagttgatggaccgagctgacccagtatgtgatagcctctgagttgcctgattcttgacgtctgacctgttaagagtgttcgggctggggaggcctggagcctgtggggaaggtgaagccagaggttgaccctagccatgctgacctagccactctttcccatctcagcagaaaaatggctacaaactttctagcgcatgagaagatctggtttgacaagtttaaatatgatgatgcagaaaggagattctatgagcagatgaacgggcctgtgacctccggctcccgccaggtaaggactatactcggaacggggtgggctagagacatgttagggccaagtggctcctggggcgcttctgctgctagctcctgatctaacacctgtgccacctgggggcagcaagcaacaggttgtctcagggtggtgtgtggccctggcctccatcaccttgtgcttgtcactgtcttgggagctttcgttctgtgtaatacactcctcttctttatattgcgatcttgctttttgagttgagggttcttggggcttttgtttttctgtgtggggcttttttttttttttttggtgtatgtgtttaaaaaaaaatttttttttaaaaaccaaaacaaaaaagcctggttctttctgcactgtctgcaggagaatggtgccagcgtgatcctccgagacattgcaagagccagagagaacatccagaaatccttggctggagtgagtacccgcggcccacgtactcatgggctcgtgctcggccaaacagcatgtctgattggttttttgaggttttttttttccccctttaaaaaagcaacaacaaaaacctttagtactgctgactattttggcctt

SEQ ID NO: 23347 - DNA, 1148 bp, Mus musculus
gtggcatgccaccatgtaacctgggggatctgggtcaacaagtcttgctttgatcaagccgagcgggcttttgtggagtggtctcagtccttgctgctggctgcagaggggagccataggcaggggactcctgacacaggccagcaggctgtcactcctgacctggccttggcctgccagccttgcccaccagccaatggccagcctcctctgggcagcctgcaggcactggtgcgggaggtatggctggagaagccccggtacgatgccgctgagaggggcttctatgaggccctgtttgatggtcatcccccagggaaagtgcgcctgcaggagcgagccagtcaggcagagggtacccggaggggccgcagagaccatcggagctgcaataacgtaggaaacaagagagctgggtcaaaacgggccaacggggaggctcctcctgcttttccctactggtacttcctacacaaggacgcagaggccccctggctcagcaagcctacctacgacagcgctgagtgccgccaccatgccgttgaggccctgcgcatagcctggcgcctagaagctgcctccctggctcaccgacccacaccccgttctggcccatccatgtccagcctgagacccaagtaggaaaaatacggctgcaggtgttgggtttgacttaggctacaaaatagagacagctgtctctagactggggtccctcatactcctctgtgtagggttagcgtgggtatcattagtgctctgtccttgaaagttatggagttctgaattgtgttggtggggaaaggggacaaagggcacagaagacattaactgcagggcaagtaggaaatcctgtagctgggtctctggtccctgataggtcttgatactcatagccaaggtatatatgcccattgaggtaaggtgggcgttagatccaagagctcatgtctgatctggcagcctctgaagggtgcttgtcctttgggcctccctatggggaaagaaccctgcctagctaccggcctccaagggctcttggctccaacacaggtggaatcctaagattagtttctgaaggccaaggagtgactaactatatggccatgggaggtggtctcttaggcagataggtataatgaataaac

SEQ ID NO: 23348 - DNA, 1141 bp, Mus musculus
gatggatcacaggacccccaatggaggagctagagaaagtacccaaggaacctaggatgggcctctggacttgcctttggggaactattatagttgctcttgagacttttttttggtttttcgagacagggtttttctgtagccctggctgtcctggaactcactctgtagaccaggctggcctcgaactcagaaatccgcctgcctctgtctcccgagtgctgggattaaaggcgtgcaccaccacgcccagctaatcttaagacttctagtttatttctctttgtgtccatgacaggcctttggctcaccaagatccacccacccatccctcagccaccacacccaactgggagattttcttaattggttagatgaagaaagttccgccttgaatgtgggtagcaccacttcactaactgggccctgcatcaaatgaaaaggagagggaacagcctaggcagccttgagggcttggtgggtcagttctagcagtgtggtgccctccctcctgttggcaatcaatcccattatcactgcagtacacctgcttgttactgtgctgtttgcttactttgtagtcctgactacagaatcaagattatctctctcttggtagcagtgggatgatctgaaaggaggatcatgccacgcagaagccgaaccacaacagtagctagtgatggttccttttttatttcttaccatctgtctgtcttctgtccttattaattatttatttttttattttttatttttcatttttttattattattatttttttttcaagataggggttctctgtagccccgggctgtcctgcaactgtctcattagatcaggctggctctgaactcagatccacctgtctctgcctctcaagtttgggattaaaagtatgtgctactccatcagactaaactggggtgtgacgcgctcagcacagtagggatgttttctttatcagtaatttttctcattgctgtgacaggcagcttaagggttttgttaggcttgcagtctgaagggatacagcccaccccgctggcaggcatgtgagctgaagctgggcggatcacatccttgttcatgagacagagagggtttctctgtgaaaccctggctgacctggaactcact

SEQ ID NO: 23349 - DNA, 1235 bp, Mus musculus
ctcctcccagcccatccttgcctgtcccctgcctgtccagtcctttctgtgcttcctactgtttcctgtatgtggggcctccctacccaccttgttttcagcccagtgtactctgaccaatgacctaggctctgtgagcctagccccagacagccacgcctgcatgggtaagttcaggcaggtctgggacctgccctgaccagcctgtctccccatcagtcaccagatttcgtggaggagctgaggactttggaagcatctcccagtcctggtgagtaggcgcctgtctgggttgagtgccctccacccagagttctggccgcccttggctcacagcctaccctgctcaaccaggctcccaggaagaagatggagaagtggccttggtgctccttggcaggccctcacctggcgctgtgggccctgaagacatgacgctgtgcagcagccgtcggtctgtgcggccgggacgccggggcctgggccctgtgccctcctagggccaggtgcctccccagacttagggtgggagcctgccagcttcatcacctcccttatcccaagtctgttagccttggtgttagcattttaaagagacccctcaggagttctggcttctgattaactgccccgtagccgggatctcgtggcgagactgtaactagtgatgtttgtacaaccaaagactctattttgtggtttaagaagaataaagttacctacgttttaccttctcttgtccttttgtcctgcctgctcataccgatcctcctgccctgtgagccccggtggtcaaggctgcctttccatatcatcccttacactggcaccagttccctagggcatttaaaagccactgtcctctagcttgggtccagactggcgggggctgtggaattgtgcacataaatgccgtgggcacacgctttattggggtgtgactagaaccttccactgggcatctgcacacgcactgggagcagggtctgcagctggtcagctgggggccacttaacttgggtgacaaagaagaggcggaagttctctaggcgagcctcttggaactgggaggggtcatactcaggtccatctgttggccgaagcagtgacagatacccttcctttgccagcagcccacgattcaacagggcctgtgccaggccagtctgcacgacctccagctgttgctgtactactgggaacaggttcacttgacgcaggtcaaacaccagtgg

SEQ ID NO: 23350 - DNA, 1208 bp, Mus musculus
tggcctgcgccttcccctgctccagcctgagactcctgtatccctccgtcagcgtcatgctgcctgtctcgtgcgcagtgaaaaggggctgggcttcagcattgctggtggaaagggctccacaccttaccgggctggtgatggggtgagatagtggtgtgtggggtatagagggggctatccctgatgggcagaggcatgtcaggtctccagtatcatggctttagtgtggcttctccatccttacagggcatctttatatcccgcattgcagagggaggggctgctcaccgggcaggcactctacaggttggcgaccgtgtcctctcggtgagtggggccgggtgtggcctgactaatgctgtttgtttgtcctgcttcctatctctgatgtgagtgtccctgcagatcaatggagtggacatgactgaggccaggcacgaccatgctgtctccctgctgactgctgcttcccctaccatctccctgcttctggagagggagactggagggacttacccacctagccctcccccccattcctccccaacccctgctgctactgttgctgctaccgtgagcactgctgtccccggagaacctctgctacctaggctgtcccctagcctcttggccactgccttggaaggaccataccctgtggaggtaagacacccacccatgtccttctcagtcccagggccctctgtcagaagtggtgtggtcactctaggcagaacgaagtacacagcctttctttttaatttcagggttttttcttatttattcttttcatatattacatcccaagtgtagttccctctcctcccagtccctcccctgcctcttcctatctcccctccttccactcctcttcctcttcccttccgaaaagagcaggcctcccatggttcgcatctgagtatacatggcatatcaagttgcagtgaaactagattcatcccttcaattaaggcttgaggaggcaattcaggagaggatggggtcccaaaagcaggcaagagtcaaactcagcccccactcctattgtcaggagtcctacaaaaacactaagatacacaactacagcatccgcagaggtcctagctcaggcccacagaggctccctgggagcccttctgagccctggttggtagattctgggggctgtttgcttgtggtgtccttgacccctcagtacacagcct

SEQ ID NO: 23351 - DNA, 1190 bp, Mus musculus
gaggaggagctgtttcctgagtcagaacggccagagatgttgagtgagcaggagcacatgagcatctcgggcagcagtgctcgccacatggtcatgcaaaagctactcagaaaacaggaggtaagtaggtgggctcgtgccaggcccgctctcggcggtatgaatgtgaagtagtgggtgataggtcgcagcattcaggtgtctttcccacagtcacagcagtcaattgtctttcctacagtctacagtgatggttctccgaaacatggtggaccccaaggacatcgatgacgacctggagggagaggtgacagaggagtgtggcaaatttggtgctgtgaaccgggtcattatctatcaagaaaaacagggcgaagaggaagatgcagaaatcatcgtcaagatttttgtggaattctccatggcctcagagactcacaaggccatccaggccctcaatgggcgctggtttggtggtcgcaaggtggtggctgaagtgtatgaccaggagcgttttgataacagcgacctctccgcgtgactttggcctcatttcctggacttgcacttgccccttccttcctttgggttttgtaaagtgttaaccgtggtgtgtccctgggaccaggcactctgcccaacccaccctgtagtgtacataaagatgcagataccactggccctgaagtccctgtgtctgaaattggtcctgtgacccaagctggttgtgtgtggaatgtcttatcagggttccaaggcaccagggacaaggagggcgttcagcctgctgtgcaggggtgaacaggagggaccggggtggacaggccttgctttatcttcctttgtggggagtgctggcttgcagccttgctcacgtggatagctctgagagctgtctggccctgagatctgtaggatccaggaccaagagagcattttgtgggcgggcgggcatctgagttgttacacctgctagtatgggttacgccagagcgaggccggaaatcccgacatgccccgcgcgagaccgctacgggtcgtcggagacgccacgccgcgtggccctttgggagctgtagttttgagcagagagggcgggcctaggcttcccggcgggctgcgcggctgggcggttgtcgcgggcagcggcggcggttccggctgcggtgctgcgggcggatgagctgcta

SEQ ID NO: 23352 - DNA, 1190 bp, Mus musculus; identical to SEQ ID NO: 23351

SEQ ID NO: 23353 - DNA, 1183 bp, Mus musculus
agtacgaggtcccagaagctgcgcagctcgctttggagcagatgaactctgtgatgcttgggggcaggaacatcaaggtaaggacaagaaagtttggtcttagccgggcagtggtggcacacgcctttaatctcagcacttgggaggcagaggcaggcggatttctgagtttgaggccagcctggtctacaagtgagttccaggacagccagggctagacagagaaaccctgtcttgaaaaaccaaaaaaagaaaaaaagtttggtcttggacctagaataattgttccgtgaagttacatacatacaagcagtcaccacaggcctaggctgatgtttcttcttgaccttcttcaggtgggaagacccagcaacattggacaagcccaacccatcatagatcagctggctgaggaagctagggctttcaaccgaatatatgtggcctctgtacatcaagacctgtctgatgatgacatcaagagtgtatttgaagcctttggcaagatcaagtcttgtacgctggcccgggaccccacaactggcaagcacaagggctatggttttatcggtgagtttgggaagggccaaggagaagagggagcccgcctcttactggggctggcttttctcactgctcatcctgccctgcagaatatgagaaggcccagtcgtcccaggatgctgtgtcctccatgaacctctttgatctgggtggccagtacttgagggtgggcaaggccgtcacaccccccatgcccctgctaacacctgccacgcctggaggtctcccgcctgctgctgctgtggccgcagctgcagccacggccaagattacagctcaggtgagagctggtgcagtgatgagtgtggacagtgggtggacagacccactcagcctttgggaactggctcttagatggtttgggtgggaacaaagaactgactgtgagaacagactagaaactgactctgcttgtcttttggttgcaggaagcagtggctggagcagcagtgctgggtactttagccacaccaggactagtgtccccagcactgacactggcccagcccttaggggccctaccccaggctgtcatggctgcccaggcccctggagtcatcacaggtgagtctgagttgatcaggttctcttccattcctttcccctctcctctagggtc

SEQ ID NO: 23354 - DNA, 1984 bp, Mus musculus
caagtacctcacgtgccccaagaccaagctcaagatctcctacaaggacgctctggaccgtagcatggtggaggagggcacggggctgaggctgctggaggctgcggcacagtccagcaagggctactacagcccgtacagcgtcagtggctctggctcgaccgccggctcacgcactggttcacgcaccggctccagggccggctcccggcgtggcagctttgatgccactggctctggcttctccatgaccttttcttcttcctcctactcttcctcaggctatggccgccgctatgcctcagggccttcagcctctcttgggggccctgagtctgcagtggcctgatcccctcagcctgcatcctgccttcccgctctgcatgtggccgggctccctgtggaggcactggggtcttctttttttttttctttttttttcctttttaacatttaaaggtgtcttcctcccaagcggtgcctaaaatctaaccaaaaagaccagactaacacattaatatatgtatgcgatgtccagacagcctgtgtcttggggaacagggctggcccaggcccagtgaccacttcaatctcctgggttctccctaaatcctttctacctgccactcaccacagccaggtgccttggagaatccagagctgggcattcagcctataccactcctgtctctcctgggaggattctatctgggaaaggcccccagacctctaagccaaccccactggatgtctacctgctggtcctagctgctgaggggaactggggacagtcgtgtgagcagacagctcttgaggcctctgtcctgagccagctgcttctccccagtctatctctgaatgtcctgtatattcagtgggttttgctggccaagggaagatcccaggccaaccatctcttccagcctacccagagaagccccttccccatgggaagataaggcctggtcctggccccagcctcccgcctggctcctgcagctgccattggagctatgctttgtagctcaacaccccatacttattcccctgagacctgagcctctgcttcagccttccagcctcagctccccttgtaagtgccttctgtgtccttgtacccaggccctaaagacccagacccagggtaggagatggacattctggctgggcggggctggagggttctgcagatctgagacttctcctgctccagaggcccagggactcttcaagcctgtggaacccctctctgggtgctgctgcccacctcactcccagggagccctggcccctccatggcccagagacaccggctggcccatctatgctaacagaagcatttggccagtgacactctcccttccttcctgtccagccagtcccgggccttggtggctcctcccctgcctccaccctctgagtgagctttgcatgttccactaaccttgagctggtggcaggtggagatgccaggcagaacactaacctgaccatgggcggggccctgcggtgtccgcccctcaataaaagcaattccaaccttcacctgggtcttgccttgtgctttgttcctagatcatctgtgtatccgtgagagggtagaagctgtggttcccggctccgggccctggctcaccagatgggtactggccagagtagatacatgaggccttgcaaagatgttaggccaaggctgggcatcacaaccaggaaaacccaaggggtggctagagagctagcaggcagagaaggcagagtggagaagggagcaggctgcactgaggtgggcctgctgtgcccagcctctcatctgggtgatgtcctgtcacttggcacatccctatgacagccacagggttgggacttctctggagtgagtgtccacacactccctgggggttgggggaggggagggtgggttgattcctcttggttaagggcagctattttaggaaggtggctttagtactggctgctgccgggg

SEQ ID NO: 23355 - DNA, 1185 bp, Mus musculus
tgtgcctgtggacgtggcctacaaacgtggctacttcgatgaagagatgaaccgcatcttgtctgacccaagcgatgacaccaagggcttcttcgaccccaacacccacgagaacctcacttacctgcagctgctggagcgctgtgtggaggaccccgagaccggcctgcgcctcctgccactcacagataaggctgccaagggtggcgagctggtgtacaccgatacggaggcccgtgacgtcttcgaaaaggccaccgtgtctgcaccgtttggcaagttccagggcaggaccgtgaccatctgggagatcatcaactcggagtacttcacggcggaacagcgacgggacctgctgcagcagttccgcacgggccacatcacggtggagaaaatcatcaaaatcgtcatcacagtggtggaggaacacgagcggaagggccagctctgctttgagggcctccgtgccctcgtgcccgccgcagagctgctggacagtggggtcatcagccacgaactctaccagcagctgcagcggggtgagcgttctgtgcgggaagtggccgaggcggacagcgtgaggcaggccctgcggggtaccaatgtcatcgccggtgtgtggctggaagaagcagggcagaagctgagcatctatgaggccctgaagaaagacttgctgcagccagaggtggctgtggccttgctggaggcccaggctggcactgggcatatcatcgaccctgccaccagcgccaggctgactgtggacgaggcggtgcgtgctggcctggtggggcctgagctgcacgagaagctgctgtcagccgagaaggccgtgacaggctacagggatccctactcaggacagagtgtctcactgttccaggccttgaagaagggtctcatcccccgagaacagggcctgcgcctgctggatgcccagttatccactggtggcattgtagaccccagcaaaagccaccgtgtgcccctggatgttgcctatgcccggggctacctggacaaagagactaacagggccctgacgtcacccagagatgatgccagagtctaccatgaccccagcacccaggagccagtcacctacagccagctccaacagcggtgccggtctgaccagctgaccggcttgagcctactgccactctcagagaaggccgtccg

SEQ ID NO: 23356 - DNA, 1139 bp, Mus musculus
caagagctgatccgcctgcgggccgagacagagcaaggtgagcagcagcggcagctgctggaggaagagctggcccggctacagcacgaggccaccgcagccacgcagaagcgccaggagctggaggctgaactggctaaggtccgggcagagatggaggtacttctggccagcaaggcgcgagccgaggaagagtctcgctctaccagcgaaaagtctaagcagaggctagaggctgaggcaggccgctttcgggaactggccgaggaggctgcccggctgcgtgctctggcggaggaggccaagaggcagaggcagttggcagaggaggatgccgcccgccagcgggccgaggcagagcgggtgcttactgagaagctggctgccatcagtgaggccacacggctcaagacggaggcagagattgcactcaaagagaaggaggccgagaatgagcgcctgaggcgcctggcagaagacgaggccttccagcggcggcgtctggaggagcaggcggcactgcacaaggctgacatcgaggagcgcctggcccagctgcgcaaggcatcagagagcgagctggagcggcagaagggcttggtggaggacaccctgcgacagcggcggcaggtggaggaggagatcatggcgctgaaggtgagctttgagaaagccgccgcgggcaaggcagagctggagctggagctggggcgcattcgcagcaacgcggaggacacaatgcgcagcaaggagcaggcggaactggaggcggcccggcagcggcagttggcggcagaggaggagcagaggcgccgggaggccgaggagcgcgtgcagaggagcctggcagcggaggaggaagccgctcggcagcgcaaggtggcactggaggaggtcgagcgactcaaggccaaggttgaagaagcacggcgcctgcgagagcgggcagagcaggagtcggccaggcagctgcagctggcccaggaggccgcccagaaacggctgcaggcggaggagaaggcacacgcctttgtggtgcagcagcgagaggaggagctgcagcagacgcttcagcaagagcagaacatgctggatcggctgcggagtgaggcagaggcagcgaggcgagccgccgagga

SEQ ID NO: 23357 - DNA, 1603 bp, Mus musculus
tcccgggagaactgatacagattagtctagaagcgtgctaggaagatgtgtgggctcactgggagggaaaggagtgaatgagaatccaaggctgtgagccacacgggaccttgatttttaggctgggggaaggggtgaaggggcagcgttggttgagaaccctaggcagtgagtaggagagttagccaggccaagtcactcaggacggtcttgcaggatattcggctgctggcctcaggcaaggtggctcagcgagctggggaagtcgagagagacctggacaaggctgatggtatgatccggctgttgttcaatgatgtgcagacccttaaagatgggcggcatccacagggtgaacagatgtaccggaggtatgtaccttacctgggaaggctgggttaggaggtctgagacccgcctgacctcccaactcctgtgcttcctcagggtgtatcgtctgcatgagcgcctggtagccatccgcactgagtacaacctccggctgaaggcaggagtgggtgcccctgtgacccaggtgaccctgcagagtacacagaggcgcccagagctagaggactccacactgcgctacctgcaagacctgctggcctgggtagaggagaaccagcgtcgaatagacagtgctgagtggggcgtggacttgcccagtgtggaggcccagctgggcagccaccgaggcatgcatcagtctatagaggaatttcgggccaagatcgagcgggctcggaatgatgaggtaagcggtatgcctgagggaggcagtggctgtgcgctaggcccaggccactgcagacctgactacccactgatctctcctgcagagccagctctcccctgccacccggggtgcctaccgggactgcctaggtcgcctagacctgcagtatgcaaagctgctggtgagtggggactgcaagcggctaggaggggctgggaggggtaggcagccgcagtcactgactaattctttcctccttaaagaactcctccaaggcccgcctccggtccctggagagcttgcacgggtttgtggcggcagctaccaaggagctgatgtggctgaatgagaaagaagaggaggaagtgggctttgattggagtgaccgcaataccaacatggcagccaagaaagaaagttactcggtaaggcagcgtttcctccttaggatgtcctccctctcccttcccactcacacccacccatactgttccccaaggctgggagtcccttgagttcagccccagggctctgagaagatgggcctgggacttggacggcatgggcagtgtccctgagactgtccctgagactctcctcccttctgtcaggccctgatgcgagaactggaaatgaaggaaaagaaaatcaaggagatccagaacacaggggacaggctgctgcgggaagaccatcctgcccggcccacggtggaggtgggggcacagcggcagggagccctaggagcacctgtgggggtagggctatgggactgatggctgggagtgggttctaaggcccgtgctgtccacagtccttccaggctgccttgcagacacagtggagctggatgctgcagctgtg

SEQ ID NO: 23358 - DNA, 1171 bp, Mus musculus
tgaatgccagcagcttcctctgggaggtgcctagagcagggccctgcctgtctcctgcaaggcccttcagaagcacctctgtccttccggcctggtcatgcccacacagatcctcagaagaagcctgatgggcagggagactataggagcccaagctgatgctgtctaacctgtgccctgctcctgtgctgatgcccaccataggctctgtgggcccccgttgctgggtgtggtagtgcgtgcctttaaccctagtgctccagaggcagacacagaggcaggtggttcagtgagtctagtctacacaggagttatagtcagccagggttacaaagaagaccctgcctcaaaaccacaacaaccccccaacccaaaacaaaaatcaactccctcagggcaggattggagatgttagggaagtaagagggtatgggctctgtttgctaggatgtacgaaggaacgtttatgtagccctgctcagtgggtgtctctgttatcatcccaacttgtccacaggcccatgctcatagatatgaataaagtgtatcgacagaccaacctggagaacctagaccaggcattctcggtggcagagcgggacctgggagttacacggctcctggacccagaaggtacgatccgctggctttccccatcttcacccttgctgcctggaccccactgagccaacctctccctgcagatgtggacgtccctcagcctgatgaaaagtccatcatcacctatgtttcatccctgtacgatgctatgccccgcgtgcctggtgcacaggacggagtgagggccaatgtaagtgggtggacgggtgcccttgacgggtgtccctgactgacggtgcatagtgtactagatcccgagaccctgaaggttgctcactcaggcctttgctcctaggagctgcagcttcgttggcaggagtaccgggagcttgtgttgctgctgctgcaatggatccggcaccacaccgctgcttttgaggagcgcaagttcccctccagctttgaagagattgaggtaggcctgcctacttgggctggcatccttggattgtcttggtgtagctgctgacaccccttgcctctacagatcctatggtgccagtttttgaagttcaaggagacagaacttcctgccaaggaggcagacaaa

SEQ ID NO: 23359 - DNA, 1113 bp, Mus musculus
tatgtctcctacgccatcttcttcatctccctcattgttctcagctgttgtggggacttccggcgaaagcatccctggaaccttgttgctctggtaactctcaatccctgagcccagttcacctaggcctgtgggacaggacagggaggttggacagggttggaccaagagcagctccccacacccaaggccccccctgtgatcctcttccgcagtcgatcctgaccgtcagcttgtcctacatggtgggcatgatagccagcttttacaacacggaggcagtcatcatggccgtgggcatcaccacagctgtctgcttcacggtggtcatcttctccatgcaggtgagggggacctaagacaggacggttgccccagagccctcaacacccacagtctcacctctctccttccctcccagacccgctatgacttcacctcgtgcatgggcgtgctcctggtgagtgttgtggtgctcttcatcttcgccatcctctgcatcttcatccggaaccgcatcctggagattgtatacgcctcgctgggcgctctgctcttcacctgcgtgagtgagggtgttgggaaggcctttcctgggatgccggccgggatgagtgaataagctgtcgaataccgaccaactgtgtctttacccgctagttcctggcagtggacacccagctactcctggggaacaagcagctgtccctgagcccagaagaatatgtgtttgcggccctgaacctgtacacggacatcatcaacatcttcctatatattctcaccatcattggccgtgccaaggagtagaacaagccccagctcaggtggcatggttggctcagacccatgcccctggcatgacaatgccatctgtgcttccctctctctggtccccaggcctggcctggtgcagagggagtccctctcgccctcttgtatgtacactgcaaatacttaacgtctggaccctctatggccacagcatggccccctttatcccttttgcccttgccaaggggcgacagggctgcatttctgtgccaccttctgtccactcactgttgcatgagccctgtctgccagccccatcccagggtcagggaccaacac

SEQ ID NO: 23360 - DNA, 1106 bp, Mus musculus
tccaacaacccgggagaagcacaaaaacccgttcgcctcgggccttccgtttcccggaactgaaaggcttaagtcgaacattcagaaagccggggatgccacaagccgcagttccctttgaccggaaagcgactaggctaccggaagctatagttcaccgagactgaaaaggaaacgtaccgacggaagtcgtagtcctgaaggtccaggtcgagctgtcggaggcggagtcaggactgtacatcatggccgggctggagctcctgtccgatcagggttaccggatagacggtcgccgcgcgggggagctgcgcaagatccaggcgcggatgggcgtgtttgcgcaggccgatggctcggcttacatcgagcagggcaacaccaaggcactggcggtggtctacgggccgcacgaggcgagtaagcggcggggaccgggggctcctggccgcacatcaagggaggagacctaagtcgtacggcttaactcctgagcccatgcagcagtatactacaatcccatctgagtccctgtgggcctcccggcagaaagcatctcacacaggttgtcccaacgtgttgtagcggggatgatgtgagaacctggcttcttttgacttcatcttacgagctctttctcttggccgacttccatttcagtcctctttgtgttgcatcctctaagcagtgaatataattatgccctgagttctcaggaaaattgcgtccctaacatggccctcaaatttgtgtgttaggccccgtgaggtactgagaatatcggtttctttaagaacccagttatgttatgtgattatgtttttgttttgatcccacgtgtggggtatggagctgcttcagattgccctcagccactatgatttgtctcatgcagggaccgggggcttgtgatcccacctcgagggaatatacctgtgtcttacagcttaagtcctccgtctcagtgggccctctgcttagccttttttttttttttttttttttctcacgggctgcccgcttcatctctgaggtgcctcagccagcctggcgaagctccactcactccctgttccttcagctcattcttcccacatcttgtcagg

SEQ ID NO: 23361 - DNA, 1103 bp, Mus musculus
ccgctggaccctctgggtcatggtggaagccacgagctagcgttccaggtcgggctaattccgagcccactctgtactctctcgcagtgtgctgagctacgtggccgggatcgcctggtttctggcgctggcttttccgccgttaacccagcgcacttacatgtctgagaatgccatgggctccaccatggtggaggaacagtttgtaggtggagaccgcgctcggagctttgcccgggacttcgctgcccaccgcaagaagccggggtgagtgcctagcagcgggctggggatttcaggggcggccgagaccagggagctctacttagaggctatcttttgtgtctccagggctctgccagtagcctggctggaacggtccatgcgatccgtagggctggaggtctacacccagagcttctcccgcaaactacccttcccggatgagacccacgagcgctatgtattgagggaaaggggtgtgcctgggagaaaagcacattggaagggtggcctgggttgggtgtcttgttgaagtgccctgaaaccaagaaactctgggagggatggtctgaagaactttagtggtgggcattgaagtgccaggaaaaaagacaggcttcaggctgtccgctggagggtctgctgaggctttcccatcaactctttgtgcagatggtgtcaggtaccaacgtgtatggcatcctgcgggccccacgttctgccagtaccgagtccctggtgcttactgtaccctgtggtccagatgccaccaatagccaggctgtggggttgttgttggcacttgctgcccatttccgaggtgaggctctggggctctggtccgggaggatttgaccaatgccccaggccctttgctgaccctgcctttggcttccagggcagatttactgggccaaagatatcattttcctggtaacagaccatgatcttctgggcaccgaggcttggctcgaagcctaccatgacattaatgttacaggtaggtgtagccctagtcttgctccccatctctttcaaagtaaaccgcggtcccttgtgccccctctagtgctcactgcttgctcctacaggcatacagt

SEQ ID NO: 23362 - DNA, 1108 bp, Mus musculus
cttgtctgggtccttgacttgctctatgctctggagctgtggatgcagttacaccaggctggagtcaacccggaggaggctgggaaggcccctagtcccgggactccactcttgccaacacaggtgatgctatactctactgctcttaggatgggggttttaacatacccagcagtgctttggtatgcgtccttgggggttctcctattcctctggcctaactccaagtacccatgtgtcctgcagggtgtgggcctggcctcacttacggcacccctgctgatctctcaggccatgggtctggccctctatttcctgcctgtgctgggccaacatttagctactcagcatttcccagtggccgaagccgaggctgttgtgttgacgctgctcgcgatttatgtagccggcctggcccttccacacaacacccaccggtgagcagctgggccggacagctggagctgggtccctgaatactcaaacggattcccaactacccttgagtttctttccttgtagagtggtcaactcacaggtcccagacaggggctggatggcactgaaactagtggccctcatctacctggcactgcagctgggttgcattgctctcctcaatttctccctgggcttcctgctggctgccaccatggtccctgctgctgcactcgccaagccccatgggccccggtacgtgctggtcagcctcttctccaccggtacctttgccccttaccggatggctagccctcatttattcacttgctggcatcctccatggtgcgtacttaaatgttgcccttctccccaggacactgtatgctgccctgctggtagtgaccagcccagcagtcacactcttcggtagcctgttcctgtggcgggagctgctggaggtaccgctgtctctggcagagggttggcagctcttcctcacagcattggcccagggtgtgctggaacactacacctatggcgccctcctcttcccaatactggccttgggtctgtatccttgctggctgcttttctggaatgtcctcttctggaagtgaggtgtctgggaaggggtcccccaagcctccgttctacctcctccctggga

SEQ ID NO: 23363 - DNA, 1152 bp, Mus musculus
cggctgtcagaagctcatcgaggtggatgacgagcgcaagctccgcaccttctatgagaagcgcatggccacggaagtagctgctgatgctcttggtgaagagtggaagggttatgtggtccggatcagtggtgggaatgacaagcaaggttttcccatgaagcaaggtgttctgacccgtggcagagtgcacctgctgttgagtaaggggcattcctgttacaggccaaggagaactggagacaggaagcgcaagtctgttcacgggtgcattgtggacgctaatctcagtgttctcaacttggccattgtaaagaaaggagagaaggatattcctggactgacagatactactgtgcctcgtcggttgggacctaaaagggctagtagaatccgaaagctttttaatctctctaaagaagatgatgtccgccagtatgttgtcaggaagcccttaaacaaagaaggtaagaagcccaggaccaaagcacccaagattcagcgacttgttactcctcgtgtcctgcaacacaaatgccgacgtattgctctgaagaagcaacgcactaagaagaacaaggaggaggctgcagaatacgctaaacttttggccaagagaatgaaggaagccaaagaaaagcgccaggaacagattgccaagagacgtaggctgtcctcactgagagcttctacctctaagtctgagtccagtcaaaaatgagtctttaagagcaacaaataaataatgaccttgaatctttaaaaaaaaaaaaaaaaaaagaagcagattggggaggaaagggtttcctcagctttacacttccatacagttgttcatcaccaaggaagtcaggactggaactcaagcaggtcaggaagcaggagctgatgcagagaccatggagggatgttccttactggcttgcttcccctggcttgctcagcctgatctcttatagaaccaagactaccagcccagagatggtcccacccacaaggggcctttcccccttgatcactaattgagaaaatgccttacagttggatctcatggaggcattttctcaactgaagctcctttctctgtaataactccagctgtgtcaagttgacacacaaaaccagccagtacacttgacctacccatgttca

SEQ ID NO: 23364 - DNA, 3277 bp, Mus musculus
aaagggcagcaccaagtgccacagtgatcagtcccttacatccagagggagctgcagcttatctttgtaatggacgggtacccccacttagatatgctctcattaagaaaattgaattatggactttatatgagggtttaaaagaaagttagtcaggggaagtttctatgctgggtcgcctgtggagcaggggagagctgctgttaatcccacacaggccatggatgagcaagctctcagaagactatccagtggctcaactggagggcgtgattcgcggggccgaggtgaaggaactggggatatagtagagaagccagaaaaacaaacaaacaaacaaagcagatgttgtcattgtaattagagttgcggccaggctcaacccggactagaggagccgggcaagggacagtcctggtccactgatggacagctccctacccagctccgcctaggtccgcccactgtgttgctctcgcgtggtctgagctctcgtcggcccgcaggggccgacgggaacggcggccgcactaaagggggccgacatggcggcggcggcggcttcgcttcgccggacggtactgggcccgcggggcgtggggcttccaggtgcaagtgctccgggtctgctgggcggcgcgcggtcccggcagcttccattgcggacaccgcaggtgagtcctggcgcgggccccgaccatcgcgcgcccctcagccctgaaggtcacggcggggaggctccgggcgcgcgccggcatcggtctcctgcgttcctcctacaactcgacggggtccccgccgccgggccggcacacccagaaagccggtctgggtgcccacgccttggagtggcagggcattgttgctctgagcccagggtcccactgtgatggggtcgggacgggagattgcagcgaagggctcgcccggagcgactgccgaagccggctgtccggacctggcggataccctgcagtgaccccagcctgacctcagcggcctgcaggtgaccttggtccgctgcagtactctgggtcacttaggcttgtctcctgggttaagttccacgagcattctccatttgccctccagagccgagccgtggccgaggagttggctgcagtaagggatccagcaggcattgggcacggtgtgtgccttgggcgctctgcgtgcggtggtggccagtgcggggtggaggtggagcggaagacatgggcgttcattcagatccccaggtgggctgctggggtcttggcaggtgctgagcggggctcttgcaggcagtgtccttgtcctcgaagtctggcccttctcgaggccgaaaggtgatgctgtcagcgttgggcatgctggccgcggggggtgcagggctagctgtggcccttcattctgccgtgagtgccagtgacctggagctgcacccccccagctacccatggtctcatcgtggcctcctctcctccttggaccacaccaggtgggtgtgttgcggcggggctgggggtggaagttcccgggtgaattcgaatcttcagttcctctaattctttatctctttagcattcggaggggtttccaggtatacaagcaggtgtgctcttcctgccacagcatggattatgtggcgtaccgccacctggtgggagtgtgctacacggaggaagaagccaaggcgctggctgaggaggttcggagggtgggggggtgggcacgaaagaaggtggaggatacagggattgtggtttcaactgtgagggactaaaaggttgtgatggggttcttggtggcaggtggaggtccaggatggccctaatgatgatggggagatgttcatgcggccagggaagttgtctgactattttccaaaaccataccctaaccctgaggctgcaagagctgctaacaatggagctttaccccctgacctcagctacatcgttcgagctaggtacttgggctgcccagagtatggggctagaaagggagggaagccagcttctgttagagactaagccctgggtctggttctaggcatggtggtgaggactacgtattttccctgctcactggctactgtgagccccccactggggtgtcattgcgagaaggcctctatttcaacccttactttcccggccaggccattggcatggctcctcccatctacacagaagtcttggagtatgatgatggtgagtgtcctttgccatgggttctctcctactcctagcatgcttccctgatatttctgagtctggaggtccatctcccttctcacctggagtgcttattgactgcatacttaaagaggctttggggatagctttcttagtcctgtaaggttcctatccatgtgaagtcatggatatggctaatccctgcctctgtgcaccgagggttacccttgattggcccaagcccccaacagtagcctcgctatttgttcttggcccaggcaccccagctaccatgtcacaagtagctaaggatgtcgccaccttccttcgctgggcatcagaaccagagcatgaccatcgaaaacgcatgggtctcaaggtaaacggttgggcaagggtcacagtgggcagttgggggtctttcctgtgtcttttctgagctctctttgttcccagatgttgttgatgatgggcctgctgctgcccctgacctatgccatgaagcggcataagtggtcagtcctgaagagtcgaaagctggcttatcggccacccaagtgaccctgttcagtatctgcttgtcatcttgccagaacaagctctcagcagcccaggaacagtccatggccttctcaggcctggcccttttcatcagatacaagggccaggagaccagactcttgcttctgatcttccttcagccctcagtgtgggaataaattaagtttctcaacatacacattttagctggtcaatgactaaaacattttttcagtggaaccctggaacccatatttctccacattattgtttcctgtactgcccagtatctgggagttattgatatgcaccagaatgcaaaacctggcagcactgtttgcatgggagagatggctcagtggttaagagcactggctgcttttccagaggacctgggttcagttcccagcactcaacatggtggctcaaaaccatctgtctccagtcgcaagggctctaacaccctcttttggccttcaaggcactgcatgaatgtaatacaaagctgtccgtgtaggtaaagcacccatggtgtgttttttttaaatctcaaaagg

SEQ ID NO: 23365 - DNA, 1154 bp, Mus musculus
acttgctctcggcccccagagaagtttcaggttagtacttaatggggtaagaaaggtggggtgtagtcttgagatggccctgagccttctctattataggacaaagccttcaaaactccaagatggaccggaaattaggcttgtttcctcagtcactggggctgcctcatgacctccagccgtccagttccagtctcccaagtccctctcaggtgggcaaataaccagtctgggtgtgggccagatatgggcagctgtgggcattggaagaactagaaagcatcaacagtcttcccatcctcctagcctggctggtcttgcccttcctgcactttcatcaatgcctcaaaccgccctggctgtgagatgtgtagcacccaaaggccctgtgcttgggatcctcttgctgcagcttccacctagaagccaccaaaggtacaagagtctgggggggggggtgagggggtacagtgtagaataaacaggagtaacctatctttttcctcaggttacagagaatatggccctcctgtcacaggcccaaccaccaccacttgaactttgcaggggactgatgcttgttggggacagagatgccagtgttaaacaacaggggctacatacaagctagtaattaaagacacatacgagccagcctgtgttctgttcttggatgtggagttgtactagccccgctccctgagagcaaggaaaccaggttctgcccaacagtagctggcgggattccccaagccacaaccaggagtctactgaagagtgagtgcacttagaatcaagtcccagtggtcatagaacataatactgggatcactttacaggcctctagcctcctgctaggagttcctgtcactatccctggccccattgttgcccttctcaaatcctcctatattgcaatcaccattatttttagctgcttcagccagtatcccaacagtaggattgagtaattttccttccccacttagggtgtttgagcactgggagtcttgagtcgcctgcctttgtgatcctcctgacaatcagctatcacactgccctaggcaccaagatccttcatggatctagtgactgtcaatttgtcctacatgtactatgtagctgcactgtagactactaggtattgttccctg

SEQ ID NO: 23366 - DNA, 1174 bp, Mus musculus
gtccgctgtctctcccatccagtggctccacgtacacaccctcagaggcaggcaatgcactggacttggaactgggggcagaggaggctgatgaagagagtggaggtggaggcggtgagggcagggcagaggagaccagcaccatggaggaagacaggtgtggtggtggctgtggccatggactatcctcgggagcctggaatgggtgggacagatcagggttccttctgtctggtctgggtgctatctcctaaaggcctactgtgtgccaacttctgcctagggttccagtgatctgtatgtgatgagaagaagcagaggtctcagcgtcatccagctctgaccaatccctggacctgtctacctgaggagctccagagcttccccagatgctggctatgccttggcactgacaccgtcctggcgctgcccaaggctatacctgtgtagccctttggattcagcctgtggatgtccactcatccctgcaggctcctactgcccatgctgtggctggattaaacagcacggggtctgatagaaaacgggactgctctgcaccaacagcctgtcacagacaggacagctggaccacagagtttatttttgtatttcttattgggcctgtacactccagctctaagggccagtagtttgaagccctataagtggtgcccagtgttcatggggtctggtctttgaccggcctctggtgcccacttttgtctcccactttaccaggtgggccacatgcactgagtgtcactttgctgcagctcatttgtttccaataaaagtttctgtgacttagatggaacctgggagtttgtgggggcggggcctgcgtcgtggggcggggcctgcgtcgtggggcggggctggtagctttggtatcttagcaacagctgctggctgcttttcagttacttaagtctcagagctgttactatctctcacctctgggactgtctgtggtagacatggaggacaggctaatagaaacaggcaacctctattcatcagagggtgaccacttacctctggatgtagacatttatgatcatgacatctatgatatcccagatcctggggtgctcatagaaaaaaatggtgagggcacctagcattattcgggcacccctctagaaaacagatgttcctcaggctttatcca

SEQ ID NO: 23367 - DNA, 1198 bp, Mus musculus
cagacattatgggcacgctctcagatagtagatctgtttcatatggatatgcttaatctcttctgtgagaagcggcgggtacagcagcagagatcatcgatgggagaggagaaggaggaggaggggaaggaggaggaggaagaggaggaggaggaggaggaggaggaggaggaggaggaggaagaggagcatttacctgtctcactcctacgacgccaccagctaaggcccaatgctgtgctgcggccgcgccgggaacgctggtgcgcatgacagtgggtctgttgggctgaccctgcatgggttgcaccgaaggaaggtctgaactaaatcctctcccttcttcaggctctatccaatcctccgtcttcaggaggccaaggcaccagactttggtgtgtttctcaggagtaagtagacgcaggcgtaagagctggaccctaatgctcccctgtctcccccacccccacccccaacctcagcctatagctttgtttgcctggcttcccacatccaggtcacaagatgcagagcagggagctgactactgatggttctctccgagtgctgaagctgccactgccaagagtggacttgcagcccttccccccaggctggcccacacccccacgggcactgcccccgctcctccttcagccttcacttcaacgctactttctgctccaagatacataccctggtgccttcagttgacctgggggacagatagccaaggctccatggccaaaacctagtcctacccccttggcaaatcgcaataccatactttgtctaaattaagaaatatataaacacacacatatatatttatttacttattgtgtatctatatatgttcatttgtgtgcaagtacatgtgtgggcatgcttgtggaggccaaaaattgctgtcaaagtgtttattgttctgcaccctatttttattagtccttggttttataaaacatctctctacatagtcattgctggggctcgctatgtagaccaggctagtctctaactcacagggatccacttgtccctgcctcctaggagctgggattaaaggcatgtgccaccgtcccagggcctattttgatgcttcagttgtttgagtgttttcctttatgtatgtaccaagtgggtctcagcagaatattctctgcagttggtataccaatgattgaaacaggtggca

SEQ ID NO: 23368 - DNA, 1173 bp, Mus musculus
cctgcaggcggccgcggcgcagcacgtgctggcgctgactggtgcgggctcgggccgcacgctgttggccggacagccagagttgttgcgggccttggtcgaccttgcggtggccccggccccagctccttcccgcgatgcctcccgcgcgctcgtgaacttggctgctgatcccaatgtgcactggcagctgctggcggctgacccggagctgcccgcccgcctgctgcgctgcgtgttggaccctcagtggccctgggctgaagaggcggctgcagtgctggccaacctgagtcgcgagccggctccgtgtgctgcgttaatggagaagctgatggccgctgagccggagcggttgggtctggagcgacttgtcaacgcgctgtgcacgccgagctacaacgcggccgcacccctgcattacctggggccgctgctctccaaccttagccagcaggcggaggtgcgtgcttttctcctggacccagacaggtgaaacccagtcgcctgcgcgggcgggaaggtggggaagtggaagtgaacaaggacagcagtgaatatcttctttcaacaggtgcgtggtccaacggctgctgcctcttacccagtacacagattcttcggtgcgcaggggcggggtggtgggaacacttcggaattgctgttttgagcatcgtgagtgacaaggagggggtggtgccattgccaaggtggggattggaccctagggaacccaacggaccattattctgatctccttccttgtccgcacctccaggacatcacaagtggttacttggggcccaagtcgacattctcccctttttgctactgcccttggctgggcctgaagagttttccgaggaagaaatggaccgtgagtgacttgggtggttgcctcagggctgtctggtgctagagggaagactacaagagggagatggagaggtgtgcaggtctggagtccctcagtccggcagcctttaaggagggggtcgttacagacacacacaaggctcacccaggcagagcagggcttgggtgttcagcacagggaccaatagtctcccaccctcactcctagagctgcctgttgacctgcagtacttgtcaccagacaagcaacgggagccggacgctgacatccggaagatgctcatcgaagccgtcatg

SEQ ID NO: 23369 - DNA, 1135 bp, Mus musculus
ctggctggggctagggagcactcagatgaggtcagactggcgccctgagttttgtggccgggctgaacctgtattgtccagcactgtaaccgtgatggatgttcacagctcaggacaggagctgctaacatgccctgcatctcttgctatccagggctgagttcttactgtctgctaagtcctggctcattagggcacttgaggcagggtacttgcttatgactagggagccctggtacaccatggtatctgactcccgcatgctggtgctggcctggttctgtgcagcaccctgggccacagtctaagcagaagttgagacctccaagagagatgcagcagtgccatctaaaccataggataaggccaccatcttcccattccgactgccctaggtctttcctgttcaggttatctggctttggtaccttagccagggacacttggggttggacagcctcagtttaccccactgctgtcatcactcctgcccagatacacagtaaagtatgaacaagacagcagacctgagccttgtgtgctcagaaacagctctcctacctgtgaagactcctgggctgagatctctttgcagcacgtagttgacaggggtcaccaaccatgaccatccttcaaagttctatgcagataggtaccaattgctcatatgtccctaagcctgccttcatagatgtggcagtggcctgggaaaaactgagcagttctcagttgggctataggccccagtccactcatcctgtgaccagcggtgggtggctttcaggtctgggctaggcccacactcagtcctcatctggcctgtggttggccctgcccacacagaggatgttccttgcaggtatactgttggcatctacccagtcaccacagcagctgttgtgccattttctcggtctgcagtcagagtagactaccctgaagcaactagatcttcccctggagcccaggattcccaggagttgccttctagctcttttcttgggggatgagcctatgcaggatagaacctgtagatgcccattaagggctgttaatagcatgtcaccaaaagatattcacaggaggtaaaaccattccatatctcccacctgtccctccaggctgcagccctcta

SEQ ID NO: 23370 - DNA, 1177 bp, Mus musculus
gccgggtgaggcgggcacatgtgttcggactggagtggggccgccagccgagcagtgcctttatagcagtcagctcctcccccgcgcctggcctccgcctccctttctggcctggaggagtttactcagagctcgtgcgtgcaccttttcccttttaatagccgtgcctagagggcccccgagcatctttctggttggagcgtttctggggtgctactagtgccccaagacaatggtgcccatcccacccattctacagggcagaagagaataaatcaagaatcaagaggctttctctcctggcatgcctaagttcacccagctgccctggccctgagtgcctggccacaccctgtctgactctccttccatgtgcacttgggtcttttgtgccaggccgtgtgtgtgtgtgtgtgtgtgtgtgtgtgtgtgtgtgtgtgtgtgtgtatgtgagagagagagagagagagagagagtgtgtgtgtgtgtgcactcatgggggtgactccagcagtagcagtctagaaatgggtgtgtgtggttggcatgacttgactccatggcctgtgccttgtgccagatcttacccctttgacccatcctgcttgggggccccacccccatccttgctgtatgcttcatggggcttctcaaagccagtgcacacgtggataagagctaagatcggcacctctccatccctccagttcggaagtggccctcaaggtggagagcgtacagcaagagcatggggcatttctgggctggtgtggacaggtgcagtgggacgaggcccaaggggtcttgctgaggggctgctggcactcatctgtgctagttatgtctgggcccctcctccctgtggctactgttgcaggaagtggccgcctgggcagcagtccccaggctgggaggagtgagggtggtggtggctggcaggggctgaaaccaggaatgtgtgtccaggaatgtggctgctctgcccactgaaatgggagggggaggatcagtggtgctggaagggggtccttgaccacctgccgagcagaacaggtttgtctccctgaggttggggtggggtcttcccatggttcctgccttgtaaactacccacttgtacctaaggcttttgccaggggagggagcccataggcgatgaggtcatccctgtctgtgg

SEQ ID NO: 23371 - DNA, 1051 bp, Mus musculus
tttggaggagcagtcagtgctcttaacgtctaagcaacctctctagcccttgtcaagctttttatttgctttgttttattttgcttagacagagtctttctacataaccctggcatccttgaaattcacaatatagactaggctggccttgaactgacagacatccacctgcctctgcctcccacccaagtactgggattaaaagtatgtgccaccatgcctagcagtgggtttgtcctccttatcctttcaaagaccccctcttttttttttttttttttcattctatatattcaacttttttggttttgtttggcctttcagatttttttctccatttcactaatttctaaactaagattaaataaacatttgaggtttggctttttttttttctggggctctaaaatgtatcattaagttacttatttgaggtgtatactaatgcctgacattttgttggttttgtggtatttgggttttttcctttctgtcttaactgctcttctagtctgctgtggggtattccttcctttggcctcacggatggcctcctttcccttgagggactccttgaagtgtgttctgtagctgtcactgactgtgagctcctttgcacagttttgtttcttcttcctctgtgccacatagggttgctggatagagcagtctggactgacttgaaaacttgaaatacatccttctagctgggttgtggtatacacctttaatcccagcataggtgggtctctatgaggtcaggtctagcctggtctacagagagttccaggacagccagggctacacagagaaaccctgtcttaaacccttctgctccccaccccctggccaacaaaacaaaacaaaaataactccttttatagttgctcaagtgaattaaatactaaatacagcctccattggtattctagagtagtgttttcatggaagctacacacatctccccatgtagtttacactattcctggatggtttatagtaactactgtgacataaatgctatgtggatactttgtgatgatttggatag

SEQ ID NO: 23372 - DNA, 1051 bp, Mus musculus
catggtgcctcacaaccatctgtaatggggggtctggtgccttcttctggtgtgtctgaagagagcaatggtgatgtgctcatatgcataaaatgaataaataaatctttaaaaagagaggaaaaaacatttcattgggggcttgcttacagttttagagagttagtctgtcatcatcaaggcagggagcatggtggcatgcatggtactagagtaattgaaagctgtgtcctggtgcagaaacagacagacagactgagtgtctgggtctggaataggctttttaaacttgaaagcctactcccaatggctatcttcagtctataacctcagtcggctcttctgtttttaccctcttgagtccccaggtgaattttttacctgatttgtgctttacaaatccagaatatcaacttggtgtttccttttcgcttcttattgctttactgagactctccattagtaggacatcatccttatacctcgtccttcaagtacagttcttcagatctttggccatactaaaagttagaatctgtattctcatgagtccaacatacggagtttattggttgctcttttctttcctattataagctgtagcttttctttttaattaaatttatctaaaataaatgggattcataatggttaattcataatccaactgtaaactcaagaccagggaaggcccttgcaggcagcaaagtcatatccatatcagtttaagtgtgcacatacatgtgtatagaagttagaggacaacttgtgaagtcgggtccctccttctcctgtgtgggtaccagggattgaacccaggctgtcgggcttggcagtggttgcctgctgagccatcacaccagtcccagccgaagctttgcttaaatgccttgttgtttttgactcagtgggaaagcgcattgtcccctcatctctcacttttgtcattgtgtcattgttggttcttgtgacttccctagactaattatgtcctaattgtgttcttggtggccattgcactttgtccttctgacttaataaagtcgagcgg

SEQ ID NO: 23373 - DNA, 1188 bp, Mus musculus
cctgatttcattattaacagaagatttcctccattctaaacgaaaaagataaaccattatatttaggacatttggaattttgttatatatatacacacacacacacacacacacacacacacacacacattatataaatgttcaatcttcatgtacacctcatgtcagaagagggcatcggatcccattactgatagttgtgagccaccatgtgttgatgggaattgaactcgggacctctgggaaagcagcagtgctcttaaccgctgagccatctctccagccccgattggtatatttctaattaataaatactatactaaggggctggtgagatggctcagtgggtaagagcacccgactgctcttccgaaggtccgaagttcaaatcccagcaaccacatggtggctcacaaccacccgtaatgagatctgatgccctcttctggtgcatctgaagacagctacagtgtacttacatataataaataaataaataaataaatctttggggggtgggtatgggggacctttgggatagcattgaaaatgtaaacgaggaaaatacctaattaaaaaaaatactatactaatcatccaggaagtgcacacctttaatctcagcactcagaaaggagtgacagacagatctccgtgaattccaggacaacttggtctacatagtaacttccagtctagctatgatacaaaaatcagaccacatctcaaacaaatacaaagtgaggggctggagagatggctcagcatttaagagcacttgttgctcctgcggtgtaactgggtttgattcccaactacatgatggctcacaatcacctgaaactccagttccaggggatctgacatcctcttctggcctcttcaagtcatgcatgcgcataatgcatggcatacatgcaggcaaactcttgcacataaataaaacaatcaataagacctattaaaaagatgctgatgggctggccagatggctcagccagtgagaacactgactgctcttccgaaggtcctgagttcaaatcccaacaaccacatggtggctcacaaccatccataatgagatctgatgccctcttctggagtgtctgaagacagctacagtgtacttacatataataaataaatctttaaaaaaaatcaagtgttttgtcctagatagggtcacta

SEQ ID NO: 23374 - DNA, 1212 bp, Mus musculus
tcctcgacgagatggaccagagccaccgcaaggagatgcagctctacaacagcatcttcagcctgctcagctttgagaagatcggctacacaggtgaggcatcccacagtcctctgcatgccacacggatgctgtttgggatgaaagggctggcagccaagggcaggggaggcagtaggctctgggcagtgggcacaggctgcgccgatgggcagggaggtacctcgggaaagaagataggttggagattttgcagaaggagggatgtacctgcatggctcctataaatgtccttcccacctgtcccatccccccaccccctctgcccaccaccctagcaagatgacccccccttcgctgtatggggctccacatatttggggtggtcaggtctaattaggaaattgggtatgttttgggcagtctgggtgtttgggccttacctttggagcacggagcaagaagagcattccatcaagtcagatcctgtctacagatgttcactgaaggctacagagcctcccgaggctggcaagaagctgtttggagacagggttccagaacaagctgagggtctgagctcaaactgtagaactgggaatggatgcccacaaatgagtaagctggaccaggccaggcccactggatctcatggctcccgggcatctgtcaccagctctgaacatgtcgggagcaagagccaggccacaccttgggccagagaacacgaagcacctgctgatactggggccactcagggaaactccattccctctactgctcagcctgcggcaggtggccagctcagagcgcccagggcaggcttggacagccagtcatgccatgctgcctagactagcccaaacaggcctgagatgcaaagggcccaggggcctgcagcagcagaaaactatggctcttggttaagagtagccttggttgagatctcacggcctgcggggtctgggtaggccaggccatgtggctacagcagaggctgggtgggaagccccgtccctgaaagaaggactggctgcctaagaacccacacatccacggcaggacatgccagccacaggactgcagaggcaggtctgcctgctaagcgacagccctacaaacagccgggcagaatccacatcacagtgcaacattgaggacttggcactccccttgggcaggaccagataccatatacccacctgctggctt

SEQ ID NO: 23375 - DNA, 1183 bp, Mus musculus
cacatgaatagccttttgaaagccaagaaaaaaatgcctacttcatcagtaaccatgatcccataaacagctgctggctgggtgcctctatcatgtcaagccaagagcctgttagtcttctctgataggtgaaaaagccaggttccaagcccagatgtggtcaggtcagttgccagacaggcctgctttagatgtacccagggccccatgacctgataagaccccgctcttcacaacaccagagctagcatgacatctgaagcagctctcagtgtatgctggataccagcaaggcttgggaaccatcaggtactcctcacctagcatccctctggacaactggtctggctggagccatcacgagtgggagggcacatgtgcgtgcaagcatcccacaggtctgtgagcttcacctccctttccttcttcgcagtgtactaacggtcacttgatgtgcgctggctgttttatccacctactagcagatgcccggctgaaggaggagcaggccacatgtcccaactgtcgttgtgagatcagtaagagcctctgctgccggaacctggctgtggagaaagctgtgagcgagctgccttcagagtgtggcttctgtctgcgtcagttccctcgctccctcctagagaggcaccagaaagaggaatgccaggacaggtaaccatggtgaaggtgtggccttgggatctggtcagccctcaccgtctgggccctggagagcacatatgcagcccagtgataaccgtgtaggccccaggtggtaagagcatacctttctacagaagacaattagttacagtttccactagttgctttctggatatgatgctagccctgtaggattctctgtggctattgagtaggcccttggaaggtccactacaccaggatcagttcaaaagctgtagaaagcttgtgtgagactcttgtttggcaacccagtcccaacatatagaaacagccacttgccgggcaaggttctggcaccacaagctgtcctggaatgaggctctgtgaagtctggtactatggtcagcaaccagctaacccccaggcagaacaccatgagtactgggcccaggaggcatattgactaccaactatagtgcttctctctcctcagtctcttatgtgctgctgacatgtgctctaagtggctggcctcaca

SEQ ID NO: 23376 - DNA, 1232 bp, Mus musculus
ggtgggtgggctctctggcgtcctcgctcgtccattggaggtggccgccgcgtcgtcttggccctcgcggcgcttccattggcttgcgcgaggcccacgtgatcaggagggcgagggggcggtggcgtggggggggggtccgcagcgaaaacaaagatggcggccgcgccggggttggtggccggggcggctgcgggccgacgggcgggccaggcccactgaggcagctgcacggtgggcaggctgcggggtcgccgcggcagtgagaagccggcaagggcgcgcggcgaccctaacttccagccggcgagcgcgccggcacccgcccgccgggccggccggccgtgatgtccggcgccgaggaggccggcgggggtggcccggctgcagggcccgcgggtgccgtgccggccggggtcggggtaggggccgggcctggggctgccgcggggccggctgcggcggctctgggcgaggcggcggggcccgggatcccggacgaggcggccctggccggcgctcggcagctgcaagaggcggccggcgaccccgacgcgccgcccaagaagcggctgcgggcggccgaggcagccgaggcggcggcggcggcagtggcagcgggcagtggaaagctggaggagcgtctctactcggtgctgtgctgcaccgtgtgcctggacctgcccaaggcttccgtgtaccaggtagggccgccggcccggcccggcgccgcgttgcctggaggcctgtggccggtggccgggaatccttcctatccaaacatccaccttccaggtctacgaaaccccgctcctgtctctcgaggctccttatcctttcttgctctgaatctcattttctgtgttcgatggtaccctttactccccagtctgaatttccattctcctccgtagatctcttcaccttctggttcctccagggtgcctccttgatagattccacattcttttcagctgaccatgtagagatctgtgaacaggtacccacccttttctactgctcatcaatactgtccctcacttctagacccctgggtgaagaaacttctttcctggagacagggctccaattctggcagccacacccccaaaagtgtccttccatatctgaacaactaagtaaatcttcttttgtgccctggggagtcagtcctgtgtccttctgaagacctggaagaaaggagggcctctcatcccttctcagttctgatc

SEQ ID NO: 23377 - DNA, 1378 bp, Mus musculus
ggtaatcaggccttctcccgtcaccccagatcaaggctcctggcccctccacttacttgaggattccgcagattccaggggagtgcccaggagggggagcagagcctccttgtggggacagctacccacttcttacttgcccatctatacgcccaatgtagtaatgcccttggccacactaccgaccacctcttgtccccagtgcccatcttctgccagcccagcttactggagcgtaggcactgaatcccaagggtcccaggacctgctctgtgatctagactccctcttccagggagtaccacccaacaagagtatctatgatgtgtgggtcagccatcctagggacctggcagctcctgccccaggctggctcctttcctggtacagcatgtaatattctagggcagaaagggctgcttctctcttccacccatgaatatcattttgatgaaccagagctaggagcatgtccgcagcgacagctttaaaacaccaggcacagccttgctgaaaacccacagctttaattaggttactccagaaagggttgtctctgctagatagggaggtctggccaatcgtgccaggagcggagctcagcctgtagagtgcctcctcttgatcctaccttttcaggccctcaagccatccatctatccatccctctgtcaccatgccttcctggctccaggctggggggagggagagccaaaagtgggtccgatctgaagtcttgccctctctcaaatgcctgggtagagggtagcacctttcagggaaagggttaagaaatgaaagactggaacggacataattttggtgtaatggaagtaggggagcgattaatagtaaaggaatttacaacattttaattccaagtctggtattgggggcagggtggcgacttgggaaaccacttggtctggggtctggttcctgcagctctggccccctgctgtgtgctgtgataagggcaaatggcgataaggaaggggggagaactaagggcctgtggctcagctgggggtggaagggtggaggcgatcctttctcaaagcataacattctctggccagatctagaagaggaagggggacactgtagggctctgttgggggcagttagggccccagagtttttgttttttaaaggttgacctgggaagtggggtataggattcacagctgcctctgccagcagaggtacattctcaagcccagtaccaggggcgttgacccagatctagggaggcgggtcccctggaggttcaagagtcaagccagaacagctgttagggctggtactgggagggcttccgggagatggtgtaggggtgcaggaagttccagtgagtggggtgtcagtactgagagaa

SEQ ID NO: 23378 - DNA, 1159 bp, Mus musculus
tcttaaatctctttgttctccttcccaatgtagccatattgaatacatcatttttttgctttttactttttttttttttttttttggtttctctgtgtagccctggctgtcctggatctcactctgtagaccaggatggccttgaactcagaaatccgcctgcctctgcctcccaagtgctgtcattaaaggcctgcgccaccaccacccagctgctttttactcttaatttggctcttttagttgctttattgagtgcagagtgcaggcaagatggcttagaagatgaaggtgcttgctgcccagcctgatgacctgagtggtatctctgagacctatgtaagctatactcttacttccatgtgtgcctattatatagcgctggctggcccagacctcactatggctgtgtagactagccttgccttgagctcacagagatccacctgcctagagaggagactcttgataatgcacagcatacaagtaagatgcagttcaccccagtaattgactgtttgccagtgggaaacaatggagtctggaatggactcaccatggctgtgggagcatcacaacaccctgagtggccaaggtcggggtgcagagatggacagagtgctttgaagtctattgtcaacattgagccaggtggcagctcaagcctgtaattctgtcactgagcagggtcagacaggaagattcctgtaaacttgagctcagctgggttccatagttagaggcctgagccttagtgtagaggccctgtctcaaaatattgggggtggggtggaagctgggctaggggtgcatgcctttaattccaggactctggaggcagaggcaggcagacctttgtgaatttgaggccagtctgggctacaaagtgagaccttgtctcaaacaagaacaaacaaacaaaaatctgattattctgaagcctttgtgtcagggatgtgagaaatgctcagttgtctggctctggctctgttccatgactgtggtcacactgccagccagggctgtgtcatctggaggctcagctgcggttgaggactagcttcccagagggtttgttcttatgtctgtgaggtgggggctttgtgcctccactgggtctcccctaggtctagaggtgtctgtaggtcagttgacccct

SEQ ID NO: 23379 - DNA, 1224 bp, Mus musculus
agggattcagggctgagtggtctgcctgcagctgcacatcgccgctgctaatgggttcagtgaggtggctaccctgctgctggagcaaggcgccagcctgagcgctaaggaccatgatggctgggagcctctgcatgctgcggcttactggggccaggtgagtgtgcacaggagcagggagagggtaggttccgggctctcactagagcccgcagccaagcagctactgctggctgcctgcaggtacacctggtagaattgcttgtggcacatggggctgatctgaatggaaaatctctggtggacgagacacccctcggtgagtgtggggttgcctacatctggtggaagggagtggccatgaacgtgcccatgacacctctgtccatctctcctcagatgtatgtggtgatgaggaggtgagagccaaactgctggagctcaagcacaagcaagatgcactcctgcgggcccagggccgccagcgctccctgctgcgccgccgtacctctagtgcaggcagccgtgggtaagcctcctgctgtggtcactgtccgcttgttgagacctaggctttgcccctagggacatcagctggcggtgatatcccagtaggatttgtgggcattggttgtaagatgggtaatgacgtctcaactttctctctcccaggaaggtggtgagacgagtgagcctgacacatcgcaccaacctgtaccgcaaggagcatgcccaagaggccattgtgtggcagcagccgccacccaccagtccagaacctctagaggatgaggacaggcagacagacgctgagctccggctgcagcccccggaggtgagcacgcagcctctgtactgtcccaggtgtggagcagtcctggtgtgtgatctgattatttagtgcctagtcctctatccgcactagccctctatggaggcagtaggcccagtgatcccgtgggcaggtatctgctgctgacatggccccccactcttatgtctgtctgtctactaccacttcacacaaacttgaagcccaaggctggtgtaggcggaaacaagcacctcctgatggcttctgggttcctggctctgttcacaggacgatggccctgaggtggccagaccacacaatggccaagtaggggccccccccgggagacacctgtactccaagcgtctagatcggagtgtctcctatcatctgagtcctgaggagaacag

SEQ ID NO: 23380 - DNA, 1197 bp, Mus musculus
gcggcatacagacgcgcacgctcggatccttggagaaaacaaaaagcccggaacatcaactgacccgggcgagcctggagccacaggccgagaccggcctcgcccgcccctaggtctcccttcgcttgcggcccatccccgcgcgccggcggcacctcccgagaatccgcctcagccgtggtcttcaagcgccagtccccgtcgaacctgccgtccaagtgccctgaccactaacggctgcttgactctcagctcgactcgaatcccagccccgcggcccccgctcatccgcctccccgactaccaaggcctgcaacccttcctcgcccagcaagcctcgcccagctccgcgcagcgccggggcgcgctgtgatgacgcaacaactcataggcccgccccctccccggggggctcagagcatctgcagcaccgcccggcggccgctctcattggctaaggacaggactttacggtggcggcgggagatttcccctaaactcacgttcgggctgccatggagcggctcgcgaccgttcgcgcgcggctacaggagtgggaacgcgcttttgcacggctgcacgggcgacggccagcgaaggtgaggtggagttagggtccggacaggggcggcaagtgggggatcctggcgcagcctgttgctgacaagcttctctcctagggggatgtggaggcggcacctgaagagacccgcggtgagcactgggctggtggaccagggacagggcgaatgttagtgggtatgcccctgaccgccgacttctgccttcccagcgctctaccgtgagtaccgtaacctaaagcaggcggtgcgtcaggctgacgacagacatcgtgtcctagagcaatcacttgccgaggcagctgaggaggtatcagtgaatcccactctcagcggtctgtggtccaaatggcaggaaccgagagcattttgcagccgtgcctccatggagcacagaagttgggtggccaggtcctcccatgggggttaggggaagctttagaggcacttctgtgcccatgccatcttttaaactggtctaggttgctactatctactgcaggcacaggagccaagctgctggggtccccacctgagtcgagctgcaacgcagaatacgcagtctatgccaaaacagagcctactgagttctgtacaagactatgggaagaggctc

SEQ ID NO: 23381 - DNA, 1241 bp, Mus musculus
aattaagactccccctcctgcaggtggctgtctgcccagtccagcaccatgcacacacttgtgttcctcagcacgcgtcaggtccttcagtgccagccagctgcatgccaggccctgcccctgctgccccgggaactcttccctctgctcttcaaggtggccttcatggacaaaaagacgcttgtgctgcgtgagctggtgcacacgtggccctttcccctgctcagcttccagcagctgctgcaggagtgtgcccactgcagtcgagccctgctgcaggagcggctcagcacagaaagcatgcaggctgtgatcctggggctgacagctcggattcacactcaagaaacagaggctggcacgcagcccttgtgcaggtatgcatttatctagggggcccataggctaggggtacaaggaagatcccctgagttgtggttctgagatcagaaagagctccctccatatggggatatctgttgcttctgtacaaagtagctgggagggatgctggcctttctccttcactccctccctctgcccatccctgctcccaggaagcatgcattgcgggttctggacatgacgggtctcctggatgatggtgtggagcaggatcctgaaaccatgagcatgtgggactgtacagccgctgtagccagaacgtgcattgcccagcagcagggtgggactgccgagccagggctgtcaccagtccccgtggaaatccgagtagaccttcgggtaaaccgggcctcgtacacattccttcgtgaggccctccaaagcagtgtggccagcccgctgcggctgtgctgccgggacctgcgggctgaggatctacccatgcgtaacactgtggccctgctacagcttttagatgcaggctgtctgcgccggatagacctgcgcttcaataacctgggcttgcgtggcctgtctgtcattatcccacatgtggcccgctttcagcacttagctagcctgaggctgcactacgtgcatggggactcaagacagccttccgtggacggggaggacaactttcgctactttctggcccagatgggccggtttatgtgtcttcgggagctcagcatggggtcttctctcctttcaggcaggctggatcaactgctcaggtgagtgggctctcccgctgctctccctcttttatgtgaggccattcttggcctacctgcccgtgacccttgtgtaacctctttgtccctgcagcaccc

SEQ ID NO: 23382 - DNA, 3016 bp, Mus musculus
agcctcctctctcccgcccttcctccgtaagactcttgagtcggtttcttcagagtctgcctctccccaggacgacaagtttcagcaattgccttggttcagcaatttggtagacacacaggacacctgcatgtgactacaagacccgacaggcattgcgctggggaaggggcggagttatggccccgccccggaagataaggctgcgttgacccgtctatttcctctttcggccttgcttgccggcaggtaagttgtgctctgtccgctgcgggttttgaaattatccaccgccatccgccgccgttaactacttggcggtctgtcatgcggcctggcccactcgtccaggatcagaagggagggatggcgttgctttcggccttgggggctggcaggaggctggggatttttttggacgctgaactcgaaccatttccagactcgccgccatgggccgtgtgatccgagggcagaggaaaggcgcgggttctgttttccgtgcgcacgtgaagcaccgtaagggcgccgcgcgcctacgtgctgtggacttcgcggagcgacacggctacattaaaggcatcgtaaaggtaggagggcaccggcgggagttaagcaggcggggaaccgggcgtctcgagcaggccttagaatacaatacaccaccctgacccgtaggacatcattcatgaccctggccgcggcgctcccctcgccaaagtcgtctttcgggatccctaccgattcaagaagcggacagagctgttcatcgcagcggaggggatccacactggacagttcgtgtactgcggcaagaagggtgagcctccaggcggggaaggaaggaagggttgggcccgggactttgggtgctgagctgagcttcgtgggttgggatcggtgtgggtttggcatggcttttagcgttaacagtcgttttgccccctctctccacagcccagctgaatatcggcaatgttttgcccgtgggcaccatgcctgagggtacgatcgtgtgttgtctggaggagaaacctggggacaggggcaagctggcccgagcctccgggaactacgccacagtcatctcccacaacccagagaccaagaagactcgagtgaagctgccttcggggtccaagaaggtcatttcctctgccaacagagccgttgttggtgagtgcgggagggcagtggggccttgaagacgcgggtggtcggcatatgaactgccagctgctgggcctaggccatagaaccacattgcttattttcttggtcatgggagaagactaacagaatgcaactggggatttagttgtagagtgctagaatacctacttcgtaaacaactaactgattcctgtcctggggatttgattcttttctggtctctgggcactgtataaatgtgtatggatacagacatgtaggtaaagatgcctgtgtatacataaaattaggttaaaaaaagattacaccgcttgacacttttgtgcactgtgacctaggaattctgatcctgcacttgagtttagttggttcattttagaaaagataggaccagtagtggctgttaaaagatgttcaagtcagtgaaaaggggccatgacttatctcttgtttagttacttggaaacatcttaggatctgctaacctcatccttgcataggataagttctgagggcacgtggtcaaagcatgctgtgtttggtaggtgggtttgcccatttgtgggaggtgttttcagaggttgaaggacctgtcttgaatatcaggcactgaatattgaggtgcaccccatggaaacttgggctgagtcaacagtttgctttaatacaggcatggtccttgcctcacctgtcaaagtgtcagtttgcagagggtaaggggtttcctaggtagagcttgctggacttctgtggggttgtagatttctgccatagactaatggtgaatggtgcatgtctcagaggtgttgtgtcacttttcaggtgttgtggctggtgggggcagaattgacaagcctatcttaaaggctggccgtgcctaccacaagtacaaggcaaagaggaactgctggccacgtgtgcggggtgtggccatgaatgtaagtaaccaagaactgagtgagtgggcttttcttgttgctgtgctgggaggatctgcagcagggaggtcctgggctgtcggctcttcccgtgttccctacgtaggtgagatgacccttacactaacctaacttcattctctttttagcctgtggagcatccctttggaggtggtaaccaccagcacattggcaaaccctccaccatccgaagagatgcccctgctgggcgcaaagtgggtctcattgctgcccgccggactggacggctgcgtggaaccaaaactgtacaggagaaggagaactagagttcaggagctaataaagtacgtcctttggctaatccggcgtgtgtgagcctcttttgtgagggatccctggaagtgaaagatgcttccaccctacaagggagcatggcatgctgcgcctgggatttgggtagatgacttgagaccaggtctctacataatccttgactgtctggaactcactgaagatcaggctggggttgtcatcctgcccagctgggaagctcagtttacaatatgcggtactgacgtaaattatgtggaccacagttgctggggttagtggtgacagtacagtgagccttggtctccactcagcccatacaaatgggtctgtgtaattgatacagaattttccccccattccttctcaacgtgcagtagaagctagtctccaactcctaattacaggctgtcttgggcactagtgtgtgagtgtagaaacttctttttggaatgtccaagtactttttagttggttgtatcttttgcctagagaatattagacatccaatgtggcccccaccccctgggagtgatgacgactgcagctgttacacattaagatttgttccatgcagaatagaggtgcttctg

SEQ ID NO: 23383 - DNA, 3640 bp, Mus musculus
caagccaaagtttggtttgttgttgctattaggacagttttcattgtatgtacataaatattttagtaaggggaagggatgggctggggccttttggagttctagagaatgggggcagaggggtttttctttctcttgtttctttttgagaaaatttactggctaaaggaacagacattttgggtctttgtttaataagggccattctcacagaaaggcaagcccttcacctagtggagacgaggccagtctctcaacagttgtatccacagatggtaggaagggagagagagttgaagaaggcttcttctttcctagacaggaaagggtggccacgcagggtgaagaggacagtcccatggcccatgctgcagggcctgaggggccttcatgcacttcagttcagctggttctggctgaggcctccaaggccagtctgtttgccagtgcatctctgctgcgtggacaaggacactctccgatgccacttcctcaggcccttttccaaggaagactagatggagttggctttttatgcaaaggtcgttggatttcagggtgagcactgagagctggctcccccaagtgtctggatttcactatgttggcctcatggttgatcctcaaggccactgtgctggcttgttggactgatttaggaagcaggctagaggagacgggcattttatgactctgttagaggattctgggtgatgatttcaaaaagatggctgacgctgaatcgcagtgtgagaagggtgtttgcagttttgcaggcctctgtggcctgggctttctatgctgcgaatattactagaagctggattcctttaaggagacttgtagtgaaaatgtttgtctggatgttcctctttcagcccggagagctgccttaggtcttttctagaatttctgtgttacttagttcaacctcagcccagaagcaccatgctccttgtcattttaaggctctcaggtttccaggaacctccaccaccgccaccctgcagcagccgctgtctgaactgagccgtgtttccttcccttggaaactgcctggcgcttggctcttagtttaaggagagcttgtggcttttcctcaagcatggactcctcggggctgaactgtttggtttaggctgtgctttctttgaggcacagcgggcaggtccgcgaccacctccgtcctgtacctagtcatgtagcttccagacactgagatgagaaggatgtgagcctatgcaagaagagcatagtgcgcccctccctgcgccaggcgaacaaggccaatcaagggcagtctggaactcgggtgtgccaggaagggggggagggggcgggaagctgcctggccaaccttcccctctggcccagccagttctccactactcaaacctctagcatggcaatgtttgcaaaattgcagacttttctcccagatattaggaggaaagggactttggggggtggggaaggggtcttggtgtttaaagcataagttacctgtttgcactgttttcaaataggaaacaatagtgggcacggtgaacatctaatgtaaacgtgtgttttcttttgtcatgctcttgagaatgtctgatcatttgtagtatacaccagtgacacttgattctctgtttcataaaacactatatttttggaaatgttgctgtccggaagcctcttcccacccatcccctctcctgtgtacctcctttctccttgcttcctcatcagccaggcagttgccatccctgggctagagcgggaaacagggccccatcccaagcaggctctgggtgtcctaagccagcatgtgccctctagattactgagtgcaggacagtcccttggcaactttcctttcgaaaggctcaccaactaccacagattgccaaactcttcagcgaggcaatagaagtgagtcagggggcgcgggtccctgaagtattgtggttggctgtggaagccatgttcttatgcaagttaccgaaactgtagccagttacagtgtactcaggaaaaaacggtagatgagttcagccatggcggtgctggctggcagggattggtaactgagaactgcccatcagccaaaactcacccttgcctttgcagagacctcccacctcgggggcagccctctgtacttgccagcgctgggtggggctgctttcaccctggcaggcaaaaagggaacagcgatgctctttccttccctccctcttccggttaccaatgccagattcccaggggcacgcgagtttttgagtttttcagaaaatgcttttggtttgtcttttccggggactgacgcgctttagtcgctgtctgtccccatcaggactcctagcttaggtggtttcttgtattttctgttaacagtatttcttgtgtgcgtgcttgttgggcagcccgtttggctgcgttatatagcgagtgatgagctgatcctttcccctaagagacatgacttccctccgtcagcattcagcctgtgaatagctagagccaccctggggcggacacgtgcaagttagagctgcagagtgaactgaggctctcaggttttgagtctctctcttttcaaggctcaaaagtaccacagaacctcgctcttctccacacccctgtggcagggagtggcctgcctggcacatgtggcttccccatgcaggacaggcaccactgggacatggggggcacatgcggatgcttgtccagctgaccaccccgctgtgtctccttccctcccaccatcctctcccagaatcacctcctagggcacccgagctgcttgcccagggtcctgtttccctgctaactccagagaagcacccagggcgttgtgacagtctctaactccctccctccctccctccctcttcctccttaagaatcatattgtatagtagctttcagaccatacagtattcattgggttactcctattatcaagtagctggaattgtgaaggttgagtagttagatctttagcttttattcattattttttgtattactctccatgtgtataaattattgatcatgttgctggcttttataaactcttagcaaaggaggggccctgcctcagcctttgcaaatggtaatgaagcactgtttttaaataaaagagagaaacaccacccctggcgttttggctccttctttcttgcctgaactccaggctctaacctggaaagaggaagagaacccatagcacttcttcctgaaaggcttctgggtggccaggagctaggagtgaggtggctcctccagctgctctgctggcagcaggctgccatccgtctgaggtgagcttcaccctccagctgcagcgccactttcagggcccctggcaccatttgccagctccactgaaccgctgaacactcctgaggtaagtgcctgcttccctggcttctgctgcctgtctcctgatccccatcaccgtggggaatgcctctgctgttagactggccgtcaaccaccactccctggtcgtttctctgccgatatcccagatacctaaagtttccccgatcactgcctttctaagtcacaggaagcatggagatcctcccagactcccaagtggatttctgctgccagatatgtaaccttggcgtcttccttc

SEQ ID NO: 23384 - DNA, 1098 bp, Mus musculus
aaaactgtggttaaaaaaaaaaaaagatagtgcatttccacgtctgtatgtccacacttagcttattctgttggtcacagaggagacagtcgaggaggaaggagctgatacatgtatttgatcagaagccagcagacagaattaccaaagtggatctggtgctgatggctggggggataagcagagtggaggccagctctgcagcagtgtgccctcctggcctggctgtggctggaggctctgactggctgtggctggaatccacatgcctttaggtaggagtttgtgcttgcaaaacaggagaatttaaaagattcttttctctcctcttccctcctgccttcatattctttttacaatcatttacaggcacagcctgagagtgtttggcatggtttttggagttacagtgctggtatttccaagcacgctctcagactgtggatgagaaacacctcagtacaacagtgatcttggagtgagctccagaataggaaaacacttgtttcttttcttttcagaaacctcagcattcctgctgggctgctgcccctttaattgagccactgtgcaactcctctgttcttttattaacatgctgctcccatgtcctcaagattcagggatttgggatccaggaaccgaagaatgaatagtcagtggccagatttccccccaggtatctgggcacagtatgaggattaaaagtacaaattgttcagagccattaaagagtgtgtagaagagaaaaggggggtgttcaatcgatatcccttcgttttcttgcagcacgaagtcagtacagagtaagaaaggcatcagaaagcctctgctggggcagggtaaggaaccaagcccctaggctggctgtcctaccagtgtactgatgaggaccagtaagggcaggcagaggcagtttgtcctcactccaaagccataggaatttccatcttccagagcctctgtgagtctccagcccttgtggtcactgcatccagcttcacagtgtcctctagagtcacagccaagcacctggacccctcggggaacgttaagaagacaggccgtggactttaagccttttaaccttggaaggag

SEQ ID NO: 23385 - DNA, 1188 bp, Mus musculus
aaagatggtgagcagtgctctctgcaccctcggctcatcctccctagaacttcctgtggagttcactgtactccacaaagcactgatggcctcctgtttgactgttgccttttgctttgcctgtcctttgaattatgcaaaggataataggctgtgacatagtatttcttaaattactccgtgtgagttgattgtccttttattcttttctctataaaaacagctgtgtctaaaaattctgagcagctgaaacaaagatagtctttgccttttaaaaatgtgtaaatcaaatatatgagaatactcctgtccctaaaaaagagctcatttccccaacggggatctagacaagtgagtgtgaggtacacatagctttctggagtctcaggtttcactgggagcagcaggatgttaacataatcatgaggtaacctagatagatgatgatttattttagattagcccaagtttattcctgttatcttacagctatctgtaatacccatcttccttaagatgtttcattgaaataataaactacagtattactctccttgtaggttctttaaagtatctttttagaggaaaagcaggttcttaatgagaagtagaagtcaaaagcaaacgtaccagagggtgcccacccgtgagtctgatttttattcccaccctggcgtctcacagactcttcagaactcttgagtgatggctgccctttaggcccaggatccttgtgctctagttgtttgtgctagcagcatcccatgcccgaggaccttctcctgagttcgtcccattgttgagcgtggggcttcccactctcttcactcactgtcaccagctaccaagccgtctctgtggtggctgccgtatgtgttgacttgtgcccgagctgttctccttccctctctcaggtggatccctcaggacaggcccgagtgtggaagacgcacactcttctcctcagacacaagagccattgccttggcttttgattgcacatgaagagaaattattacttccaaacatggtcaaaagattctctttgaagaatgctaagtgggcctatatgattgtcagtaaaactgatagataatgatggcatgaaatgttttctactgtacttaaaactgaattaataatgtgtatgtccagaaggcttcatttatttttcttgttaccacttta

SEQ ID NO: 23386 - DNA, 1867 bp, Mus musculus
tagactgtcatcagtatgttttcctacattaataagtaatatcattgcagtacttttttttggcagcagcataataaactctaaaaccaataagagtagaatagagtgttaaaagttctgccttactggtttccttgacagtctgaggtgataaagctgaagagtcagtgacctctactaccaaccacaaaggatgctttgttttcaaaacagagaggtctcaaaatagaaggctctcctcagagcctgagacaagaagagctatttttacatctccatgtgggcttcagcaaacgagagggccactgcctgcgccccattttgctaatatactaaaaataaacagaaaacccaaattttgtttgtagactagaagcattttgaacatcaatgacacctcgggccttttctcctttaaaaggacagttaccagtgtttgcttgcagtcttctgtttgacagttactacagtgaagcagaaatacactaagatcatcttaggagatcactgtaggttttcattgttccttgtatttacttatttctttagcagacagaaggtggagcacagacagacggacaacagtcacagacacaaagtagtgaaaattcagagagtaaatctacgcccaagcgactacatgtctctaatattcccttccgcttccgagaccctgacctccggcagatgtttggggtaagtctcatttttttttttatggatttaattaaaacaatttaacccatcagaggtattactagtcattagtaaaaccgtagggaagttaagagagagccttgagtcactgttgttgtttgtctggaaacctttcctggtccccttacctgccgcagacatttgcatttctgattgtcacatggacacacaagctgcttgcggttgttgtctaggactgaggtggttcttgtaagatgtgacatccactgaggtggccaccttcttcacacaccaaccttaataaacatgtcggtaatagtcttggtttcactagaagagcaaacatccagtcttttatagtgtgattcctaaacctgtgggtaccttggaaatcctctgtggcgcctaaagaatactgcacagcccaggtgtgctgtggccaggtgtgctgtggccaggtgtgctgtggccaggtgtgctgtggccaggtgtgctgtggccaggtgtgctgtggctggcccagagtgcagtgtgaacctgctcactgtacgccatcctcacatgattctgtgtggctctcagtagagtgacatgctcattctcctgacgtcagcacctcccaccctcactgtcctccttatgtctctggttcaggatgactagtgccactctctacctctgtactgtctcccagcacgtgaagcgtgggtaattcaggtctgcaggaggctcgtttaaatgaagcagatatggaatgggattttaaagagcccgggatcaaatcctggctgcttaggaccttaggagattcatgtcatctctttttaaaccttgatttgaagtttatatgagattaaatttatatttaaaaatctctaacttgagtgtttagaagaaaatgaagtagcacctgtagaggcaggtgattctcagggctttgttttccattccttcccctcagtagtgtcaaggccagcatgtaagatatgctgtggaacactggttccctacccatcagctccttcagctgttagcaccctcccaaatcaccagcaaacacaaaactctaatagcacgaattcatgctgttgaaggtgagtagctgctaattttttctaagtctgtttgttgctgtcttttattttagcgaataacttgacctgggacaagaaatagtcaatagttccct

SEQ ID NO: 23387 - DNA, 1196 bp, Mus musculus
tgtctagttgcatcactcatgtttgaactgattgtgtccaacactagaatcaggtgctggttgttcattaccagccctgcccggccctgcctcttgcagcaatctttgtgagtggtgatcttgcttctaggagaatgacagagagattccctgaaggcaaatacagagagtgtatgctgtacactccagtttagacacttgggctgggaactccctgagggggggggaggagggagggtgagagggaggagagaacaacagaacagtctgcggagaggagggaggaggggggaaaactggtagggatttttttaggggatttttttaaactcaagtgatttgaggggttcgccccacttgatcccttgcccctcattctactgtcccttttcctctggctcactgaagtgcctttttgtagtccaggctcaacgccagctgaatctgcagcggctctgccatgatgtacctctgggtgagtagagtgctgtggtgaggctcgcacttgcacatataaggagtggaaagctggggctctgctcctgcacagaggctcgagcacaggccccggcccttccttacacaggtgagggccttccagcctagcacatcactgtgtcggtgtttgctttctgaatgttgtttatcttgttagacttcatgcaagggctgagctcccagagcagtgctgtcccctgggcttagtaggtttggagaaggcaagtgggcaggtgacatgagctagaggcttcaggagtagcagtccctcttgagggtcgggatgggcttgtggtatgtatttcgaacactgaccttgataatatggccacatctgtagagagcaccagtagatggcacagtccttaattaggaataagcttttgtaagtttttgtccaatagctaatgtccttcacagttgtcttgtgaagtaggtcattgttgttattaaacctatatgagggaagtaattaagccacaacgtgacttgctcatagttagaaataaggcctatggcaactgggataataattaataaccagccattataaagcattttatatttgtaaatcaagaacttaatatgtaccttactttactttaatttactggtaattgtggcattgtaatttatgggtaaggagaatgttctatagttagagaagtttataaatggtgaaatataaaatctttgag

SEQ ID NO: 23388 - DNA, 1191 bp, Mus musculus
atgcagggtaactcaagggaaatcccactgagctgtcagtcttccagttttcagcaagtaagggtgttgtagagacggtcagatcccctttcttatctaaaaagctttccttgatgatgatgtgggtgttggtcgtgggtagcatgggtattctgtcagaactgctattttaagctgagaggaaataaggtaagaagagactcattactttgagcttttattaaaagtcaaattcagctggaccttcaatccagtatctctagcttacttttttttcttttttctttttgaaggtaggatctccttttttgtagccctggctggcctcaacctcttatctgtgaacccggcctctgcctctaaattgctaggattgaaagtgtacatgccatcgtgcccagccatctagctttctctgttgtagtgaggtttattgtctccaggtgaaaatgaatacacacacacacacacacacacacacacatagatatttgcctcaggtacttcttaaatctcagtacctgattttttaggtatgttcttgacaagttatgttgcctctccagatgtagacactttaactcagattttcgcagtcacaggaagcttacaaaaactagtagtttcttacaaattttgaaaatccaaaatgtgacccatcagacttcctggtactgttggaaggaagcagcagtcacgatacaggcccatggtagtgtcgtagacgacatccacaagccattttggatacctttctttcccagagtcaagcctgcgagagatttcttgagaccttccctggatcaataaagagactgataacatttggagtacagacacacagtctgtgtggatttttaggtagccacatagtgtggaatcattatgtccttgtgtggtggtacctagggtcccacacatgttacccaagcagttttactgtgctgtgtccccaagtccttaacgagagtcttccgtggctgtaaccacaggcttccttatttgactctggtgattgggaagactttgccctgctctttgtttcttttgttttcaggcagagaatgtgagcatgcatgggcatgagcacaggcgcttccctcagttcgcttggctgtggccttcctgtttgtgaagagcgacacagaagagtttgccttgttactgtccacctaattggaaagttacaat

SEQ ID NO: 23389 - DNA, 1176 bp, Mus musculus
ctccatgggacagttagacagtttatagtgccagcctgcatatttcatggtgaaagatttcaggtttgttaaaccctcataacagaatgtagatttaaaaaaacactctgaaaagtactccttaaagaaggctttggggagcatgagtcacaggactgcaataagtattgatcattgtacacaacacagatgtctcatggtactcaggggctcctttccctgcctcatacacaggtcccagattcccttatttaaatgcacagtggttaatgttaacctgggtatcttctatatctcttcagtggtctctagatcacttaatgatttctagtacattgtcatgcagtataaatagtgactacactatattgtttaggaaataataacagaaaatctatatatcttaatagtagatctttttttattgttgttttggttttgtttccctcagatatttccagttgatgcaggtgtggaacctgtgactatggaagactaacttaactaatgaacagtgtgaactaaaattgccttccaacacctgtgtcactcctgtagcctgcagcctcctggggtgtagggctgtttcttagtcggctttcttctgagtctagtcttggtctattcaacccttaagtgattctgttatataagaggcttttaaactgtgaacaaaggatggagttctttctgcagcttacttgtaaacttagctcttctggtcttggtgctgtatgtctctgatagttgctgggtccagggagtttagacagcacctcttcctttcacactacccacctgccttgtttgctggtctctaaccatgatggcgactggtacagctttactgacaggcaggcagcgtctgttctcccacaatacactaactctctatgatttggaggggataagagacggccttgaagtgaaggtttccacctgtgcttctgttttattaagtatgtggaattggagggtttcagtgggtgctgggagaaatgcctatgcacattttaaagggttaaagatagtgaagagaaagttaagtatcagctaatgaacggcttccaaatgtcaagacacacatttcccaagctgagtcccaggtttgcacactctaccaggattcccgttttttagtagaaaacgtcaataaaaatggacctactggagaaa

SEQ ID NO: 23390 - DNA, 1207 bp, Mus musculus
tgtgttcagaaatacagaggctttctttgcttcttgttcttggcagcagattgtctgttcctttgaacttatgtgggctggaagagaatggaatggaattggcccacctgcatggagggagagggtagcattagggatgtgggtgtttaaaagctcttggcatgcttggctctaagtgcgatggctatttgtgttgccattattgtagctgctatgcctacattccctttggtgtacctctcacagggataattgtagggccctaacttatatctcttcctgctgccagataaaatggatgctgaagtgttatgtgctgcacaatatacagtgaactctgtgggctgtctgctgctgctccctaatcttctgggactcctgaacagaagagaaaaatgttgcatttttacagcccacattgttgaaaacataaaaacaaatatattagattttactgatggatctgcctccaaatggagccaaattaactttggtgaatgtttgggatttaaaagtgttaaataggaaggaattgaatattgaggggagagatttgttagtggaatccaagcagcctgtcaggtctgagaataactctgaggaggatagagcaagaggatggatattccagtcaggctgtctctgtctctgtctgtctgtctttctttctgtctgtctgtctctgtcactgtttctccctccctctccttccctcttcctctctctctcttcctctctctctctctctctctctctctctcctctctctctctcctctctctctctcctctctcctctctcctctctcctctcctctctctcctctcctctctctcctcctctcctctctcctctctctcctctctcctcctctcctctctctcctctctctctctctgtgtaggtgggtgtatgtgtgtgcatgcatatggaggatcgaggtcagccttgagtattgtttctcaggggctgtccacattgccttttttagccgtagattctcattggcctggaggctaggctgactggccagtaagctccaggctccacctgccacagtacaagtgtggaggtcagatgataaattgcaggggttggtccctcctgctaaatgaatcttgaggattaaactccggtccgttaggcttggtagcaggtctctcacccactgagccatccttgatatttttgaagaatctggatttga

SEQ ID NO: 23391 - DNA, 1139 bp, Mus musculus
cctgcctgtcctagaattcactctgtagaccaggctgacctcgaactcagaaatccggctgcctctgcctcccaagtgctgggattaaaggtgtgcgcaaccaccgcacagtcaaatgtccataggtatgtggggttatttctgggtcttcgattcaattctgttgatcaatgtatctgtttctataccaatatgggtgcggttttaaacttcagttcataccttccatgtagcagaatcttagtggttgttgaatgaatcacttaaaggtagtgtttgaagggtttttgaaagacagatagtttggggacaaggtaaagctattccagagaggagttagcatgcacaggagaacacatgaaaatgcatggtgtattcttgtgccttgttggggttcggtttgtacatgtaccacaagaagctatttttgatacagaaagaccatctgggttcttggtttaaaaaaaagaaaaagaaaaactagatgtttgagtaaaaaaacctcccttgcagccctttctccttctgtgttctgttagtttggtgaaatgctggccgtttgttgtccccgagctttggaactctacagacagacttgtctgagtgcagcaaggcagtgtgtccagtgggcctcccttctgtctggagctgcactgccttagtgcagtagtctagcagtgtacacgtgcagaacaagtagtgatgtgacgagtatgtgatgaccaaatgatgggcttctgaggtgtcagggaagggattctgtctttgctggctgtgcattagaacctccttaggaccttaaaaactccaggccttaggctagctatacctcaccagaccaatacaaccaggacggtttgcgtgggcttaggaatatgcattttcaaaacttggctgggttttattgtgccattagcttatgaggccccaaacaaggggaagggaaggctcaggcttcgggatggttttcttagttactctgaggaggaattccagaagagaagattggttaatttaagagaactattggaagggacttgaatggacaaagagagatgttttaatttaaaattaaaatttcaatgctgtttttaaaggatttcataagaggactgtatttacctcagccccttcctctc

SEQ ID NO: 23392 - DNA, 1158 bp, Mus musculus
taatgaaatggctaatggttgtatagacaagaattcctattgtatagaacacatccattccacattttgggggcaagtgatatgttgtttttggttcctgtgctagagataatcagttcagagtcaaaggcccaacactgcctattaatgctcgcctctggcaccttgtttctatcgatgactaatttgctttaaggtttgttttttgaccaaaatttctcaaaatgggagggcttattagtgttgtataaggagctttaaaacaggtactgctgggctgggtgacacaacagaggcaggctgatctttatgactttgaggccaacctggtctacaaattgagttccaggacagccagggttacatttgaggctaccctggcctacatgatatctttgttttctttaaaaaacaaaaacaaacttttgtctcaatgtcaccacatgaatggcagaatcagttttattttgttttaggaaggctgccacccacttttttgtgtattagaagtcgtcaccagtagttttgtttttgtttttgtttccctgaaagagcaggcaagactgctttatctcatttttaggtgcagtagccaataagcatctggaaatttggggctcttttctgtgtgtggctcttggatctttgctttgtatatcttggatgttgatctgaacaagtttccatcttttgtcttctctaaaggggctctgagggttgagtcgctgctgttgtgttacatacagcataatgtataatgtataatgtataatggactggcagattcattccctagaggctggctggatgcaaataggacgacttgttatcatcagaagaagcaggttttatttaatttcttttccattttaatgctcttctttgcttttagggctgaaatatttcccagtcagtctttgaattttgagaagttctttatggccattgataactttggggaatctgatttattttcacaatggtttctaaaaggatgagctcacactaagtatgtttatttgtgacattaattgcttgacaaaatacatttcttgtctcttggctagtgtggtagttaggatctgccctttgctatagaactctgtctctttagagtctcaggatttgaagtgcacccaggttcatccttgattgttg

SEQ ID NO: 23393 - DNA, 1196 bp, Mus musculus
gcgaggattaaaatagaaaataatgctagaaaattgaatgtgcatgcaagtgagtcatttaacagttataaaaggccaagtgcagatcaggaagtgggtagagaagaaaccaggtaagtcagaaccaatgcataaacctctgcaggcacctgtattttcattggttggttttcttgttggcatttatgagcagatggacttgggagcagccttttgttcctgaagctgagctgatggtagatagaggagcttctgtgacctgacaggagagagcgatcacagtgcctacaggagtgggatggagagttctcaagagcgttctgctggagctgttactgagcattgccagggagagcaaggagcagtccatcccaggcagaagcaatggcatgtttatggacagggctcgcaaggctggggctgggactgagagtgggtttttctcacaatgtcctaggcatgctcaagacagtcttcctctgaccacattgtgccagtgttcacaaagctaactgcatgtggttgtcctatcctatccctcaaggagtgtgttctgtagtggggctatttgtaggttattaatacaaagctagggctggctgtggagctcagtagtaagacacctgcctagcacttccaaggccctggattttgccccctgcactgtatctggtgctgatggtgggtgttcttgtgaggcctccagcagactcacccattttcatttttctcagctgtcgttgtcatagaagaaaatttccatcagtttggaatcagtttgctatgtagaaacagcttggactttgccatgttttacttaattcatgtgaagcccttgctcccatgcaggtataagttttgcacttcatatccctggatgctacagctgggtttatcctgagaaactttgagatgctcctgagagctgagtgcttcatcgatgtagaaccgagtaggtgcccgctaggcgagtggtgtgtccgtgagccctgggcaatacatcgtgcaatatatctcagtgactgtctgccccttttagggaaatctgttcctttggagctgaacgttccatgctttgaatccactctgagacagactattctggacaacaaagcttgagctgaacctggtcagagcctctgagttatgagagagggattgaaatcaacttttccagctaaaaataattttgctca

SEQ ID NO: 23394 - DNA, 1192 bp, Mus musculus
aacacataaaaaatgctggcttactctggttcccagcaaacagccagccacccagaccaccctgtggtaaagctctaagtggacagcccatgtgtgctcagagctgccagaaggcctctaggcattgccctgaggagagaatcagggaacacctcacagcctggggaaacatgagagccaaagagagaccagaacaaaaaacaataggcaacctggaagaaacggatgaggtactgggaggggtgtgtgtgtgtgtgtgtgtgtgtgtgtgtgagagagagagagagagagagacagagagagagagagagagtatgtgtgtatatatgtgtgtgtgtaagaaagtatgtgtgtgtgtaagaaagtatgtgtgtgtgtgagagagagcatgtatgtgtatatattgtgtgagaaagtgtgtaggggaaagagagtatgtgtgtgtatgtatgtgagacaaagtgtgtgtgtgtgtgaaagtgtgtgtatgtgaaagagattgtgtgtgtgagtgagtgtgaggctaagtgtgtgtgcctgtgtgtttgtgtgtgtgtgcacaaagcttttgtctttagtcccagcacacagaaggcggaggtgggcagatctctatatgttcaaagccagtctgagccacatgttgaattcctggctaaccagggctacacagtgaaacctgctgtgttcccctgcctctgaaaaaagtaaagatctgagcagggtgtggggtacagctctgtaattccaaaagtacaggatatgagcaggaagatcaagaattcaaggtcaagaccctacttccaaaaaaaaaaatagagagagagagagagagcaaaggagggaggcaggcctgatcactttaaaggaagatcaaactgagtgggaaaggagtgaaaaagccagagactgcaagtaggggaggagaggaagtggagtccagctgaagtgacatgatagtaggtcatcggcattctagaagtgagcagaagacctgagaggaccattggttaaacaaacaaacaaacaaacaaacaaacaaacagaaaaatagaacaatacaaaaccctgcaaactggagtccaatgagggctgagcatgatgggtaaaaactagttcacatgaaggcctgaggaatgaagagggagggagatgaggagtgaggaggaggggagaaggcacagaaggaaaa

SEQ ID NO: 23395 - DNA, 1959 bp, Mus musculus
tctgctggtgctctgtagtaaaggcacccggcagttaaggctggcaattgctctggtggtccacttcctcgggcagggttgctccttggcctccttccctctaaagaccactttgaagtcttcatactgggctgcccatttctctttagctgggccccactgaccctctgcctctgcccacaggcgtggggacctgccatttgtcgtgactcgccgaattgttcggaaaggcactggcgactgctcagacgaggaggtcgacggtaaagcagatggggccgatgccaaggcagctgaataggagcttctcctgcagcccaggcggatggacaaacggctctgcctccctcccccaaccctccacacccctgccttgagactgctctgaccatgtccccctcctcccaaggccttcccgagggcattggcttcctctgctgcagcccttccagtcctccataccctttgagaatctgataccaaagagtccaggctggctcaggccggatgacccacagggtcttgtcctccttgcctgaaagcacgggtggtgggcaagaagggcggccattggagtaggcacaagagttttctatgaatctattttgtcttcagataaagattttgatagctcaggcctctagtagtgttaccctccccgacctcggctgtccccgtcccccgtcccccctgctgttggcaatcacacacggtaacctcatacctgccctatggcccccttccctgggccctattggtccagaaggagcctctgtgctgggtgcagaacatggggcactctgggaatccccccactcccttctgggcagcactggtgcctctgctcctccgactgtaaaccgtctcaagtgcaatgcccctcccctcccttgccaaggacagaccgtcctggcaccggggcaaaccagacagggcatcagggccactctagaaaggccaacagccttccggtggcttctcccagcactctaggggaccaaatatatttaatggttaagggacttgcagggcctggcagccagaatatccaagggctggagcccactgtgcgctctggtgcctctcctaggactggggccaagggtggtcgagctgtgccacccactctatagcttcaagtctgccttccacaaggatgcttttgaaagaaaaaaaaaggttttatttttcccttcttgtagtaagtgctctagttctgggtgtcttcactgccttgccctggaactgtgtttagaagagagtagcttgccctacaatgtctacactggtcgctgagttccctgcgcactgcacctcactgtttgtaaatgctgtgattaggttcccttatggcaggaaggctttttttttctttttttttttcttttcttttttttttttttaaaggaaaaccagtcaaatcatgaagccacatacgctagagaagctgaatccaggtcccaaaggcgctgtcataaaggagcaagtgggacccgcacccctttttttatataatacaagtgccttagcatgtgtcgcagctgtcaccactacagtaagctggtttacagatgtttccactgagcgtcacaataaagagtaccatgtcctactctttggtgtctgggtgtttggctacagcgggagaaggccgggaagggctgggccagcggtcacaggagagcacacttgactctgcttagttagcagtttgagagggggtgttccaagacatcctgggcagcagcagggacctcctccctccctgcaggccaagaggctggacagcaatgggcccagggctggttcaggaattctcctctccttccacatgctgggctcgcctttctcctctaggaggaaggaggctctggaggagatgctgcggttccagaggcagaaagtgggaggagtgggtggtgagcagaagctggggaggcgcgcagtgtgcaccgcaaa

SEQ ID NO: 23396 - DNA, 1015 bp, Mus musculus
agagggaggaagcacagggtgttgggagaacctcctcagttgtacgagcactcacttctcccggtcctccccagggccctagcattagaggagaagcggcgactggaggcccgcattgcccagctggaggaggagctggaggaggaacagggcaacacggagctgatcaacgatcggctgaagaaggccaacctgcaggtgagtgccagcaccatagcaggccttgcacactgggctccagactctgtctgagctcctcgtggtgaagcaggccgtggcgggcagaagtaggatgctctctgattgcttctgatcctgtgaaggcttgcgcctctgagactaggttccaggaagtttctggggcctagtcgtggacagatcccttcccaagagagctggggtgcttgttggtcctggtgtgtgaggaggagagggtcctgcatagccctgcagctgggaaccaaccttccttgaggtaccgtactcccttcctacagatcgaccaaataaacaccgacctgaacctggaacgcagccacgcacagaagaatgagaatgcgcgacagcagctggaacgccagaacaaggagctcaaggccaagctgcaggaaatggagagtgctgtcaagtccaaatacaaggcctccatcgcggccttggaggccaaaattgcacagctggaggaacagctggacaacgagaccaagtaggtgccctacccagactgaggacacagtgttggcactaggtcacctcaggttgggtcaggaaccagttctgtctccaggccccacagccattctcacttgctctgagaagtacgtgggtttggatggaaacgcataggccacttccagaaccagggctctgtgggctgtttgtttctagcgagagactgagatttggttcagcaaaactgagacttggaggtaatgcgatcatcctgcgccccaagcctcagtttctccgtagacgagcttcgccactgacctcatgggtcagcccaggtgtcagc

SEQ ID NO: 23397 - DNA, 1158 bp, Mus musculus
tgcagtctcaggtaggtgtcagtctccacccatcaatcccagctgcgctcagtgctgccccctgctggtcaccgtcaggccggctagcttactgcttagaaaacctttgcagtcaagtccagtgggagagcagttgtcagccgggagcctgagccataagcacccaccctggagctacttgaggggtacacaccagctctgttgctgtgacagtgtgcctaagataagtcacttaaaagggctgaagagactcagcctgtggtcaggcccctgctgaggccgagtgccacgacagagagtggcggagcagagcggctcacttctttgtgctaaggaagcagagggaaagaaggggccaggactccaatattccctgcaatgatgtgtgccagtggcctctgctctacagctctcagcagctaacagtgccagccactggcaaacaagcctttcgtgccagcctcgggggacatttcttatctggactacaaggaggccgcagggaacttagcctttgcacgtgttctttgcagctcatggcagagaagctgcagcttcaggagcagctgcaggcggagacagagctgtgtgccgaggctgaggagctccgggcccgtctgacagcgaagaagcaggagctggaggagatctgccatgacctggaggccagggtggaggaggaggaggagcgctgccagtacctgcaggccgagaagaagaagatgcagcagaacatccaggtacccctgctcctgccgggcagggcgggcacagtgtgggcagccaggggcacaagataggcacacaggttcagttaccacatcagccttctttgtccacctgtttgcgacaatcactcagtgtccacggctcacatctccgtgagcgctacccattgaacgttgaggccactgagtttctctctctggtccttcctccatcagccttggcacaggcctctttgtggcaccctgggaacactgttgagactatgtcagtcatgtgccccagttcacatgctggtttcctgaagagggatcagacgtgtgtgtgtgtgtgtgtgtgtgtgtgtgtgtgtgtgtgtgtcctccgtccttctcacgtctcctctccctttaggaacttgaggagcagttggaggaggaggagagcgcccgg

SEQ ID NO: 23398 - DNA, 1167 bp, Mus musculus
ggcagccgctgccctgtgggctagagggagggaggccaaggtgcctgctgctctgcctgtatgaggctcggggatcctctacaatggaagtaggacttgtgttgttgagaatgtacttggaaaggttagagcaatgcatgcagttctaggaaacgtgggtgttccgaaaagacaagagaaagcagaaataacgttagttaacaggagtgtagtctgtgatggacatcaaaaggacttttgcttgtgttcttactactttaaagacaacagcattctgtggctagctgtgacatcattccctcagctgtaccatgtcagcttgtgttgttcttaatggccggcttccatttgcagcccctctgagagtgtcttgttgcctctgtcccttgtcacttgattcttggggatggctgtaccaggtcagaggttgttcacaccagggctctccgtgtccctttagcagttttgagagtctgtgtccccagagcaactcatggccggtctctgcctcttgcaggtggactataaagctgacgagtggctgatgaagaacatggaccccttgaacgacaacatcgccacgctgcttcaccagtcctcagacaagtttgtctctgagctgtggaaggatggtacgcctgccctttgccctccagccctgcctcacactgggcctgtcctcctcccagtctgcacaggacccagccaccatacaaaggaccatgacactggtcaggtgtcttttgtcctttgtgacgctcacaaggaagacctgtctgaattgaaagggacagtttgccccaagcggcaccctaggcatctcctcctggctagaggctccgtaggcttggctggctctctggccaggtggccaggccccttccgcaggtagccccagccataaccacgcgggcctgcagcccccaagcgtccctgcacttctgcctctctctcctcctcaggaggctggctgccttgaagctgttctttttctgcctctcattttcccctctcctccgcctgggtcttgctttaacctctctgttgcagagatgcagagcactcagagagcctatttctatcgccgctttcccattctccacctagaatcaggtgactggctgcctgcctgcactggggtgtcgtgtgtggcgtacccagggctgt

SEQ ID NO: 23399 - DNA, 1201 bp, Mus musculus
ccccccccaataaaaatgctaaaaacacttcagaaaatacaacaaagtcagaacaagcaacagtgtttatttattgtcttacccatgaggattattatttcctgcagactctttttccctttaacttcgtttcaattctggctttttattatggagctttagaaacatgaaaaacaatagaatggcccttttgtgcctgtcccaaggaacttgagcagatctccagtcttggtcagtctttcccctcctcatctgtgtcatttcgaagcaagccttgggatgttacctctttttactttatgcaactgttgttttaacaaaggtctttgcagatatctgggttcactgtgctgtggggcatggggcattccagctgttgtcatcgtacagaacgtcagtgaggatctagaatgccttccccatcttccatgcctaggctgtctctggggaaagcttcacagtgaagtcactggggcagaggcacacagatttcagactttgtatctaaccttcatgtccccggatgtcgttcctaggctgactttgccattgaggccttggccaaggctacctatgagcggatgttccgctggctggtgcttcgcatcaacaaagctctggacaagaccaagaggcagggcgcctcatttatcgggatcctggacatcgctggctttgagatctttgatgtaagctgtggccttcacactcccaggcttccccctcggcttcttggttggcatctccttgagtcccgagtcttgttttggtcagggtcccgtggctgctcacactggcaatcttgtttgcatcggaaccctgttggtgtgcgttaaaccccccaggcgcgtgcccacggccagccgacaggtttagaggggctggcctttgaggtcaagctcctggagatttcatgggcagatgctgcctgactgctagttttcccagccagagtttgcactttgaggctacacattgttcctgttcgtgaaggctttgaggtgcagtaggaagagctggcgagagcctacatctgcagctcacaggaggacctcagagaacccaggagctcactgaagagttgtaacttttccccttgtggcttgagtatagcacgctgccatggtggtatcagcagagtcacagagatctgttgctgtcactctcattcatctgtgtgtctttggagaggaagcccgca

SEQ ID NO: 23400 - DNA, 1152 bp, Mus musculus
ctctgggagagcagtaagtgctgagccaattgctccggaaccccttccccataactgttttgaagaaaagattagaagtaaggcaagctagatgtggcacacaccggtgtcctagcattagggtggccagggcaggagaactgaggtttaaagctagcctgggctacatggagagtcccagtatgggcaacttaaaaagatcctctctcaaagaaactttaaaaggacaaaaataactgggcatggtggtatatgccttaaatcttagcatgcccaaagcatggggtggagaatctcttgtgaattcaagaccagcctggttgactcagtaaatttcaggccagctagagttatatgagaccttctctcaatcaatcaatcaatcaatcaatcttctctcaatcagtcagtcagtaagcaggaataattatggtgaagaaatggttgaaataagtgagagacacaaaaaggagttatgtaacttctcatgatcatcccttgagggtgtagggaagggctgaggagttttccccacaacactgcatacgatgtggcaccggtgagggggcagcagctgcttgaagctgtgatgataggaaaccacggtggctctgctgggactgtgggacaaggttctttattcctctttggatcaaatttgtgtttatttttcgaatgtgattatatgctactgaaataaaaaatacatttatttttaaacaatttctgctctggcattttgggatggctgggaaagagtagacatgggagtcttgcaagaggctgtgctctactgtgctggtccttgtggtggccagagtagaggcgccctagaaggaatcactaaaaggaaaggagcaccctgcattatgcattgggtgcaagcgtgcccagagacagagtagggagagacacttgtaatcctagcacttgggaggtagggggtagaggcaggggggtcagaagttcaagatcacgctgggatacaaaagacatctttttttgttttttgtttttgtttttggagacagggtttctctgtgtagccctggctgtcctggaactcactctgtagaccaggctgtcctcaaactcagaaatctgcctgcctctgcctcccaagtgctgggattaaaggcatgcgccaccacg

SEQ ID NO: 23401 - DNA, 1217 bp, Mus musculus
ataggaagccctggggccccatgggaggtgccaccctcacccagtaaccagctttcttctgcagcattgtaatggcgttgactggcgtcagaagctggactctcagcgtggggctgtcatcgccactgaattgaagaacaacagctacaagttggcacggtggacctgctgtgctttgctggctggatctgagtacctgaagctcgggtgagactcctgtgcgggtctggggtgggcccggatgagaggccgctgctccggctctactctggggaaagagcagcccaggcgtaaccatggtactaaccccaggctttgccgtctctgtatggcctagtatgaccacccatcgtcctccccaacaggtatgtgtcccggtaccacgtaaaggactcctcacgccatgtcatcctgggcacccagcagtttaagcccaatgagtttgccagtcagatcaacctgagcgtggagaatgcctggggcatcctgcgctgcgtcatcgacatctgcatgaagctggaggagggcaagtacctcatcctcaaggaccccaacaagcaggtcatccgggtctacagcctgcctgatggcaccttcagctctgaggaggacgaagaggacgaggaggaggaagaggaggaagaggaaggtgggcagagcaggcctctaagcctggggtggtttgagagatgctgaggaagccaggctagctctggtcaccttcaccagagaactggtgaacacgcagcacatggagaactccctggaacttgatgtggggtggcactccagatcagcagaggggctaaggagcgcatcaagggaaggcgtgggcagctttgagaggaaccgaggccatatggtcagttagactcctgaaagcctccctggtagctacagaaagttactgagccctgcaggggttaggagggctcagcaaagcggacatcttcagcactcaggtctcttcagggtccagaaggagagggtacattgcatcatggggtgaactcatttctcttcattgttttctttcagaggaagaaacttaaatgagttggcctggcgcctgcgtgtgttgcacccagctgtgcttgggcagcgtgtgtccagctcctgttctctagcagaggaaataaaatttcattccctttggtttcttccttcgtcctgtgctcccgttgtgatccacagccccgggagagggagaccaaagg

SEQ ID NO: 23402 - DNA, 1109 bp, Mus musculus
gctctgagtctcacaccagcgctgtggctgtgtgttatacgcataggactcttcctcctcctacttctcctcttctccttcctcttcctcctccttttcccatttatgaactataaagaaaatgcatatgcatacacacagtcagtaaaccacagaattacagcttgaaaacaaagcagtctaattctgtttgagttgcaagcctgatttgttaaagtatcaagagagacacattctcttgaggatccagaaagaatgagaaggaatggctggctttattactatatggccagtgttgttgggtcacacctaatgttttctgtgagccacccacttcctgtgcatgccatgccctgggggagtcctctgtcagcagaaggcagttatttgcagatgggcccctatgatgtaggtctatacatctccccgtgccgctgtgcacactgccagtggctcggctgcatgagcaggtgacatccatgcttgggtttttccagacctcctgactgtgagtgagacagccaatgagccgcctcaagatgaaggcaactccttcaactcaccccggaacctggccatggaagccacctacatcaaccacaacttctctcagcagtgcctgagaatggtgagttcacaggagcggatgcgctggcctgctgggttaggtccctgctgctgagcctctgctctgcactagatggtggtgcgaggttggccaggctcgcccacctggtagcagggatccgagccacaaaaaggtctaaaggcatatttcctctctgtggagttattgataacgcctgtgtcacagatgggctgtggaatgcctgtggataaaaccattcgttaccttgaggatacagcactgaacaatagtcccaccttttactgtgatggaggagggagaaaaggcattgcttgctgtcctgttagctacagtctgcctgtagtgaggaaggaagcagggagtggcatggtggctcttactcagtgattgtgttgggcttggtccttaatacacaatgagcctacatccttaaggacagaagtaccagccagggcagtcaaaagcaatgctgggtctgccgacttgaagtcaaccccag

SEQ ID NO: 23403 - DNA, 1374 bp, Mus musculus
agcactgtgtgccggtgcctttgtgtaactgagtggtaattgtgcagggtgacaatcaccaagactttgaccgaggccctctgatggagactgggtttagagacatttgctgttgggtgctttggtgaaggtgtttcggggaattcactactcttacctccttgaataattgaagacacctttatcatatgttctactgagaaagacgggacaccccatcaaggaaaggcacagcttcattgcaaagatgttcaccaaagaacctgtcctagaatcagtgagacataggaaaatgtcgctggtgttggcagggttctgcgttttgagtgttctttgaacagtttacaggaaaaccctgtccacagtgctcgagagccagggtgcacctctgcagtgcagcttcagtggagggtggagtgtttggaacttggcggccttccttctgaaacttctcacactgcttgtgttcacaggttttagaagatggcgaagttcatgacacctgtgatccaggacaacccctcaggctggggtccctgtgccgttcctgagcaatttcgggatatgccctaccagccattcagcaaaggagatcggctgggaaaggtattgggtcccttcagctggggcagctactccacagttccccactgcctttctagtctcttgatggatatccttcctttggggctaccacctaaggaaggccctgacctccagaatgagtcagagccagggtagccacgtgcagagcatcagaggcgacactgatgccttttgtcgctgtcgatgtcagcagaagtctactcgcctgacctgttgtcttccttgtccctcacaggttgcagactggacaggggccacataccaggacaagaggtacacaagtaagtggtcctcggcggcccgtccacatctgggtcttgggaagctcattacttttttcagtaagccccacatgaaaggtttttagaaaggaaaggaaatggtaatggtagttattggaagtatattctggaatagagtgtacacaaaccatgatttttagtcccaggatggccagagattcctgaaagctactttgcattctgttgcttgggacttctggagccatcaatccatggactctcggctctgagccttagttttaaggttctggtaagggaggccgctttccctggtgccagttagatgtttggaagtggctgcctagagtaccaagttaaagtggatgaggtccaaaagaggctgtcggggtggaaggctgtgtccgcagctctgggtgatggctggggtggtggtacagctcagattcttacatgaccacgcagaggtacagcggggtagtggcatccttgggctcttggtaagttg

SEQ ID NO: 23404 - DNA, 1176 bp, Mus musculus
gggccttctgcaaaccaagcagtctggccacacggagagaccagatgatagatcaccaagaaaggcaatgtggggcgggacgtgctgtccgagcaacaccaggacaagcgcagagcatcccagccctggctccagactacagctcccggcatgccctgcacctggtactcgcccgcggcgtgcggagggaaggatgcagacaacgcggccggcgatgaggatggaggccggggaggcagcgccaccggtgggggcgggcggccgccccgggggcggctggggcaagtgggtgcggctgaacgtggggggcacggtgttcctgaccacccgccagacgctgtgtcgggagcagaagtccttcctcagccgcctgtgtcagggcgaagagcttcaatcggacagggtgagccctgagcccgctgacaggggggtcctggccccgcgctcccgggctgtcccgcctgcgcgtccctcggcctctggctttcctaggattctgaggcggggagccgaggcaggaggagggggaggaagaggagccgagaggaatagctatacccattgccgtggcaacgggacagcacaggccgcagccatttagagctttggagagctgccccagatccgggacgcttccttactgtggagcgctggggagggaccaacaaaccgggcctgccttactgccctggctgactcttaaaggagttgatgcggctgcttctccccgcccttagggtgtgggcagctgaagggtacaaggaactagatggaggaggcctgggtgtcttggagctgggcttaatgtagggaagagcactggctttggagctatcacttgtgggctcaccctgctctcctgccaaattcccaaatgaccagggaggaatcgggaggagaggggaacttccctgctctctgactttggcctcctagtgtgcaaggcctctggagttggcttgtcaaagtcccctgtcccccattctgtggccctcttacactgtgcccttgggtgagtcccctgtcccttgatgtctccgtcttctgtgctgggttgtccagatcccagtcctccctgcaggctgcacttgtccaatcagagtgcagcttctttggaaacttgcaaacatctagtgaatagtggggttggctgggggtgggggtgggcgcggtaca

SEQ ID NO: 23405 - DNA, 1454 bp, Mus musculus
ttggattctaagatgggggcggacagctgtttccagtgacccctttttgcctgggacagcagagatctgcctctcccattcctgccctgccaccaggctgccaccaccagcccaagacctcagcttctccccccctcggttctgactccaccttctttgggcctcagccccacccctcctccagagccagcctgggactcacttgcctttctctctccctccctcccccactctccccaactttcctgtcccggcattaccctgtcctcaccacccccccaaccctggatctctgaccccctttcctcttcctctgtcccccccccctcttattttctagctattacaagccagaggcacccggatgtgagcccccagatcacctccagggacttggggttccgatctgaaatcctttatttttgtaccacggggtgggcccctggcccgaggaggaagacaagccctctaccttgtcagtgctgcctgcatctgccgggctgagactcactcctgccttggggcccaggcctggggccctctgggaccttggaaggcctgacatgggtcctggggtctccaggcagagacgccaaggccaaactgtggcactacctacccatatcttccaggcccttttgtcccctcacctgggcgcccttgctgcatggcggatacactccctcccagtcccatcatagcacctcttagagcctcagtctctatggcaccatagggtcatcctctcctcccacctacctcacagggttgttgtgagaatcagggaggatcatggggttcctgggagccctgagtgtgttggggctacaatcattaccttcttaggggaagggctctagccccgcccctgtatgggacactatggcctcagatactggtgggggacaatgtgaggactttgccaggcaggaaggaagttacaggcttaacagcaccttggccaccacttctctgtgccaccgtgtgtttggcagcagagtacagtgtccagggacttgggatggggaaggggacaggtgtaacgggttgagctgtcccgcccgtgtcttgaccaccccgggatgggcacatgtctgtcagttgtgtcccacccgccatgaaataaagctgaacaaacaggcttggcctggctgccaccctttttctctgggccacttcttcgaacagggcttaaactcaggtgaggtagcacgcaaaggaatgggggctctctcttgaagccccgcccccttgctgtttgccccgcccccttgctcttgtctctttttcccagaggaggctgggatgtgactaagtcctgggctcaggagtcagagttgagggtatcctgtgtcccatgcccggggacacccctccacttcttgcttggatacctggccactgcactctcctgctccccttatttgtgaagctgggctgccagcttctgagta

SEQ ID NO: 23406 - DNA, 1187 bp, Mus musculus
tgtgcctcaggagaaggttcgcctccgctacaagctcatcttcactatgggcgaccagacctacaatgagatgggagatgtggatcagttccccccaccagagacctgggggagcctctaggacagaggggctggagagaggaggggcagcaggacctggacctgttcatcctgtgcttctctccctcctgtggcccccagtgactcttccccctccctcttcccctgctgagccaaacccagcaggaggctgcgcctgggtctgccatagctgctgggacctccatcaccagtgggagcctggagcagggaggggccgtatgccctggaaggactctggggtgagggaaggaggggggctgtgaggcccagccctgaaccccagcctgaggtggggtcgtcctcacctgtcttttatgccttatggaaaggcccagccataacttggaggccatgctggaaactgggaccagcccaggcctcctctgcggggacccagtgactgggtgggggtgacgcccgcgccctagctgtgtgcacttggtgtgtggtctggctcgttgcttttcttttggaatggccctgtggtcacagagctgaaggagctctccactcagcccccggggcctccagaggcctccctttgctctcaggctcccacgggccatggaaacttgaaagcagagccagaggacatgccccctggagggccatggaactcccagagttccatgctccattatcaccttctgctggggcctcccgggagcacctcacatctgcccaccctcctgtggtcaagtagggtcaggatgggtggcagtgggagtatttatgaaaataaagtgacttttttcctggattagctgctcttgtcacccttgtgggttaagggaggtagggaaggttcgggaggtgggggcctagggactgccctatagatccatgcccagctcccacccatcccagcccctcagccctgggccagaagaggccctactgggggcctgtggctgctactgagtcactcaggaaacactggtctgtggtgcccagagctgttttcgctgaggatgaaggggccaccaggaggtctggctgctgcagaagtcaaggggaaggtcccagctgctcgcttcctcctgcactctgcagccggtcttgtgtttctccctgcccgacacacg

SEQ ID NO: 23407 - DNA, 1193 bp, Mus musculus
gttgttccctgatcccacagatggaggcgacgggccatgagtcacattcgggaccatgagctttctggagtgggtgtctgtaccccagtgaagggaggctgggatccaggaaggtttgtgggctttcacacccccctcctagccgtggctggacactctgctcttcagaagctgtccccccacatcttgaaggttcaccctggcctgaccccaccaggtggccttatttcctgccctgtcacctcccttccttgggccccgaagccaaatgaagatttttttttttccaaccttttaagttcctcccactctctgggatctctagtgctctgtccctagagattgttggccaatcagagatctagggaactccagcccgttcctggcctgaccaggcctctgggaagagctgctggcactgccggcctatgtctcagagtgggcctttagtggagcaagtaggagcttaaagaatgccttgcatatcctggaaccccagagcaccagtcagaggctatgcgtccatcaggacaattaacgatcccactggcctcttagatgccaattagaacaatttccaagtccaagagacttgtgaacttttgacaatcctagcctgactggatcctgggaccagatgctggtagcacagggtgatgaatgccggtatgtatagcactcgggaggttgaagcaagaggattgctgagtctggtgaccgggatggcagagtcagacctcatctcagacagagggtcatccttcaagtcaccccactccacagactgctcagtggggcacctctgtggccctggggtagtgtggagaggttcccactcataccttagcaccgtccagtgttgatggctttttcggcttggagggggccctccttttgtccccacctgcagtcagtgtttgcagtgccaccctcacctgcccattcccagctatttatttatttattgtgtgccagtgaaggtgggggtagggaccttcccaccccctccacctgttgtaaccggtccttgaacttaataaaatgtgaattgaagtgtctctctttgtgtgtgtgtgcctaagcctgtctccctgaagcaccgcctcctatacccatagcccacaagaaaggatgcctcccatctctgtgtcctcagcctcagcgcagatacattttgcccattgagcttttag

SEQ ID NO: 23408 - DNA, 1209 bp, Mus musculus
caagcacacacaggctccttccttccctaaacctttccctcactgtctcctcttccacagtggaaaaagcattggtttgtgctgacggattcaagcctcaaatattacagagactccacggctgaggaggtaaggtgcctgggtgggcaggcccggggaagggcggggagccgtggctgtggctggggttcgtggagtggggacccacggtggatcttgttgctccaggcagatgagctggacggtgagatcgacctgcggtcctgtactgacgtcacagagtatgcggtccagcgcaactatggcttccagatccacgtgagactgcgggtagacccgggaggcagggggtgtaactcgaggccctgggcaggtggcggcctgactcactcactcatttagtctcagactgccctctgccagtcagcagttctgatgcccatacttaacatacctagagagtcctggagtgaggcactttccacgcccactcgaccctataccccttcctgggagggggagggaacacagggctggccgtgtggcgagctacacataggatgtccctgcagaccaaggacgccgtttataccctgtcggccatgacctcgggcatccggcggaactggattgaggctctcaggaaaactgtgcggccaacttcagccccagatgtcaccaagtatgtgtcgggctgggctgggaccctcgtgggggggatgaggatgttgtgtccctgagtggggttctgtgcactcgcctgagggcctggtggctgtaccttctggggctcagttaatctagtgacacattgcagaaagagcagcacgtgtccttggccatccagagatgagagctgagggtttgacccgctgtctcattccgtcctcctacattctaagagctggaaggggtcctggggatgtagagaggaggcttgagagctcttctgtctgctagctcggcaccgaccccggccccggtcccggccccggcccacggctgcctctagctgcctcagttaaagggataagtccccaaacctgactagaccctgatcacgcagccggaggctggtggcttttccattgtctcagattcctcacttgttgtgttcgccattgtgtctgcacccacgaaggcatgtgtccagggcccttggtgaattctgcagacctgcactgtcaggctgctgcccagttgcagact

SEQ ID NO: 23409 - DNA, 1213 bp, Mus musculus
gggcctgtatgtctatcttttttttccttcctctaaccagtgggcatagaccctgagcctcttcctcaggctctatggccttcagctccctgtgacactcagctgtgtccccaggttccgcagtaagatggaagctgctggttttactgtctcaggagccgatcaccccatctgccctgtgatgctgggagatgcacggttgtcttctcaaatggcagatgacatgttaaagaaaggtaagaggattgggggcagagttgtcctcagagaaaagaacacctgtaaactgtagctcctccctacatccacgccctgctccttgctgcccacatctccttagatcagccatcatccagacttaacaaaccacaggctatgaggtggtctcatgcctgtcagcttaggcatcccttgttcttgcgggtggaccatgggacagcaggcccttatatgtcatagccccaaagcctgtctgcctctggtgtacccctgctgttttcccaggtatctttgtcatcggatttagctaccctgtggtccctaagggcaaggcccggatccgggtgcagatctcagctgtacacagtgaggaagacattgaccgctgtgtggaagccttcgtggaggtggggcggctgcatggagctctgccctaagctcttggtagggacctgcagagccaaagttcctccactgccgctgacatagggctcctctggtcagcccagatcagaggctgtgactcaacccagacttctagagcctggttgaaaatgggcctgtacttgtcatcagagagacaacaatgtggaatttggctatgacacttcagtctgctttattctgggtaggcgtacctctggctacctgaagaaccaggcaggggctggatctcgcatgaggtgcatcttcccccaaactaagtcgggatgctgtgtctgggagccaccgtttcgtacataaagcattctgtgctgctgtgcagggcagtggagaaccagccctgtggaccctttctgcagcctaagctgggtgggcaccttgtctcctgtgccctagcagaaggataaaatgtaactgccaaatgagaattgttcctagacctgtgttccctaggagagggcagaggttcaggccccagaaagaagaaagcagatcacccctgaaggacatcgaatccttgttttccagagctctttgtccttaaccccgt

SEQ ID NO: 23410 - DNA, 1193 bp, Mus musculus
cttctgcgtgcacaccatactccacaataatgtcctttgaaaagcccgttttgcagggaggaaggaactctgatagtttaggaactccgtccttccaatcagagctacttcgcttccccggcgaccccggaaaggctttcgggcaggttgggctgggcgggacttccggtccggccaagcaggcgcggagttcttcttccgctctctcccacgggcttctggagcgccgtagccatgtcttaccccgctgatgactacgagtctgaggtaatgaagcggtgagcgcgtggcggggtccgcggtgggcacccggttcggtgggatctgtccccgaggtgaggcggcgtccagatcgggccggaacaagcggacctcgatcattccggccctcccggccccgggtctcctccccgggtccctcctctgccggccgtatgtccccgcgtgtagtcgcagtcagtcggaggcgggctgaagggtgtttaatgctgagttcttggctctcatggcgtctgcttcagacggggctattactgtgtttttcttgtcttgttgcacctgtaagcgtgttttgtgcttgcccggggtcccttttctctcacacatgtgaagccctccgaggtagcgactgtcagtcttatctgagtagtatgttttgcctcctgcttgacatggaggcccgaggacgagcatttttggagtccccatttggcgtgtctccctaactttgtctctttccttgcaggctgcttatgatccctacgcctacccgggcgactatgatatgcacacaggtgaggctctcagtttgcccggctgtctcttgccttccaaggattggcacttttttctttgaccatctcagcgttgactcccaacagggacctgttaaaaactgcgtcctaatggagtggtggagtcggccattaggtctgattggtagggttgtgaagagtctaattaaaccaggccttttttgtggtctacctgcccacgtcagaagaggaccatcactgacccggctaggtttttcttacttggggcagattttatttgttatactggggtggaacccagagccccatgcttgtggacggtctctgaaccacacccacagccctcctccctgagctgtctggccaaggtcaaaaagctttgtggctttgttgtttgggtgccggagatgagattaa

SEQ ID NO: 23411 - DNA, 1223 bp, Mus musculus
acaagatctaaaataacatcattactaataatgacagaagtaccaatttgtacatgttaccatgtggatgaagcagggttggcatgtgtgtttattgctttgctcttaacagtaatcccatgatgggagttgtgtgattttttttttttcttcttttctcctgttgtaatagaactgaattgcatagctagcactgtgcgtatgccgagttctgaacctgtgtactcttgacaccggagtctaattttgaactatgtaaccatccaatacataccagtgtgaaccaagctccggagtagtattgagggatgccctgaaggcaatgaatgctagctatagacaggccagctagggatgggataggagatatttcaagcaaggatggatgtgtgtgtgcaaataaccagccgcctattggatcagtgaacaggagttgaccgacctctgctcccacattgctgagggtcaggagaggagagctgggttgaggcaaggcttatggaagccttaggctctgtttctgtctctgtgctgtctcccatgtctctggatcgagggttgggtcttgagtccttcttgttctgcagttgtgaattgtttacatttggctttcagctggaccaagctaactgaaaggttcttcaagaatacaccgtggcctgaggcagaagcaattgcaccccaagttggcaatggtaggtgtaacactgtgtctcgcgtgctggataacagatgtcaggactggactcatcagagaggtcaagagggcttgcgaggttttctttggttttttttttgttttttttttcccaagactaggcttctctgtacctggcggctgtcctggaacttgctctatagtccaggctggcctcaaattcagatatcctcctgcctctgtctcctgagaggtaaagataaaggcctgtgccacctcgcctggcttgcctgtgtttcacttagcattttgtttccccggagcttggggaattacccagtgagagagagctgtgtaatgtgagcttccccagatctggagtcttgtcttccatgcgggtgggctgatccttgagtccctttgccttcagcttctttgcctctcaccgctcactttcatggtctgtgtggatgaggtctgcagatgtggcttctctttggcgtgtggtgtgaccaggaccttaggcatgcaagacaggctcccgttgagctgtggtctgtgtttg

SEQ ID NO: 23412 - DNA, 1099 bp, Mus musculus
cctgaggttctgcgcgcgcagtcacagaacagctcctgagtgcccttatgtgctcagtatggcatgctccttttagcttttttccaatcatcttagaagcagactacaccaccggccatggaggcacagaagggggaagcaggatcataccacgttccaggccagctaggtctacataatgagatcctgtctttgaaaaagtttagaatttagaaaaatccaggggaatcggtgtctttgttttaatttgctttgatacagtggcttctataactctggctgtcttcgaacctctaatcctcctgcctcggctcccgtgtcctggggttactggcaaacagccaacagaaaggttagaaatcagtagtgaatgatgttgtttgaacgaagtcacaaagcggggagcctcagtacagagtgttggtgagtagtggcggctggaagcaccttcaccatgccctaaaggaggcaccagtacctctctcatggtgcaaatctcaggccagggtcaccttgctctgtccccctggccctggcttctcagatgtcagcctgtgggcatgatgtgagaatgttgtctgacctgttgactcgggagagaggaggagactcctctggccaagctgcatccctcttaagataagcataattcctcagcttagctgctgttctttagttaagggctttctaattccatagagcccaggatcagtgagagactgggagccttcaggccagcacgctagacacagtgggagtggctcccttcctcagcacgctctttttttttttaaattgagatagggttttactatgtggaattcactttgtgaaccagactggccttgaacccacagacatctgccttctaccgcttaaggcatttgccaccattttgcggagggttaagtgttttcaatcctcagataacatgaaagtgcctatttgtatcagttaatttcaggggacattggtgcataagtgtttctttgaatctgttcctatagcgctgtcacttaatatcatgctttttctcaaaggtttgtttattgaatgtacaagtgctctgtctgcatttagacctttgtgccagaagagg

SEQ ID NO: 23413 - DNA, 1099 bp, Mus musculus
caccatgtgattgctgggatttgaacttcggaaaagcagtcgggtgctcttacccactgagccatctcaccagccccaggaaactttaacaacaaaaagtttaacaaaagtaagatactgggttatctgaagtaataaacccagcctattccctatacctgggaggagcacagaggctcatctcaagaacaaacccaggtttagaaggagcaggaatgtgaggatagaaacagaaacaaataacaaatgagctgccactctcaaagctgttagtcagcaggtgagaacaggtccggatgcttgagactcctgggtaggggtaaagtgtgttccggtagctgtggcagcaggtgggagagactcttactgagcagcattcagtggtcaggccgggcctgtttatcttcccctgtggaagcatcatagcgtccgtccttcacaggtgacccggaaagtgtagctggggagtatggacgacactccctctacaagatgctcggctacttcagcctggtggggcttctgcgcctgcattctctactgggggattactaccaggctatcaaggtgctggagaatatcgagctgaacaagaaagtaagtacacctgtctgctctgctctgacttccaagaacacagacctcctgggacgagtggccaggaagcagacagggtcgagcttgaggagtctgcacaggatggctgacaatactgaagtgtgaactctcagagtctgtgtcctgtctgcagaacacaagagtgagagctctttactcgtgtagagttaaaagctgggcatgggggctggagaggtggctcagcagttgagagcactgactgctcttccagaggtcctgagttcaattcccagcagccacatggtgccccacaaccatctgtaataagacctgataccctcttccggtgtgtctgaagccagcaacagtgtacccacatacatgaaatacatagattaaaaaaatctgggcatgggtgatgcatgcactgtggggagacaaggacagcagaaaaaccacaaattcaaggccagccagggttctatatcattaagaccctgtctccaaaagcaaaaacaaa

SEQ ID NO: 23414 - DNA, 1569 bp, Mus musculus
ttactaatagttttgtgatacgggccatttagaggggtttggggcttagcttgatggtagagctttgtctggcattggcatgatcaaagtcttggattcagtcctcagcactgaaaataaacatctgaagcagtgagttaggcaggatgggctccaggcctgtggcgttgatggggggggggggcattcctaggcagcgtgggtgacctaagaacaccggcccggtagatctgaagaccagtgtaggccatgggtgctaacttaaatcttagcaagtgtttaggaattggctttccagtactgtgaggccaactgggaaggtcctggggagggttctagagaagaatcaaagaacccaagaagactaagcactgagtgggagcttgggggttggtgttgtagactgtctaggagaatacacttactagttggtgtgtgcgaggcaacacgagacacagtgctgtgtgccagtggggctcacagagtatgtgttaccttctcccagattaacaagcagaacgagcagatgcatgctctgctggccattgctctcaccatgtacccgatgcggatcgacgagagcatacacctccagctgcgggagaaatacggggacaagatgctgcgcatgcagaagggggacccccaggtctatgaggaacttttcagctatgcctgccccaagttcctgtcgcctgtggtgccaaactacgacaatgtccatcctaactaccacaaagagcccttcctgcagcagctgaaggtgttttccgatgaggtgcagcagcaggcccagctctccaccatccgcagcttcctcaagctctacaccaccatgcctgtggccaagctggccggcttcctggacctcaccgagcaggagttccgcatccagctgctcgtcttcaagcacaagatgaagaatctggtgtggaccagtggcatttctgccctagatggcgaattccagtcggcctcggaggtggacttctatattgataaggtatggtatacccggaaccagtcactccgcttatcctctcaaaggtgtgaacaatagatgatagccttgcatcagatgcgtagtaggttagaagtgtgagtagtgggaacaggggaagggtggtggagacaagcacacgcaggagaagtgggggataaaatgctgtgcatgcagaagtgggacgtccatgtctactaggaactattcagctatgcctgccccaagttcttgttgccgtggtggtttcaaactgcaacagtgtacatcctactggttacaggcataggatggtacaacggatggtacaacactttgtttagaaagtgacctgtaagctgaaacagagcttagcgttagctgtgagagaatgggcaacactctcactgtgtatactcagtttacccatgcctgccctgaggtgtgtgacacatcaccgcccctcgcctcctgccaagattgttgtgcagttcacctgctctcctgttgctgggtttgtgcctgactttggattgttaagtaaggacacatgatgggcttttttttttttttttttttttttgattttt

SEQ ID NO: 23415 - DNA, 1097 bp, Mus musculus
ttgaaactcatgtcacctcactcaggagctgtatttatgagggttgcaagtccagcccctcagagcgctctgtgctgtgtcagaagggaatgggctgaagacagttccgtttcctctccctcatctcctttgctctgtgggaacccaggattaccacacagggagctgctggctgagctggggcactgactcaggtcagcctggaagggatgctttgggtgggtgttctctcagtcaggctttctgtcttccccacgtccggggatgatgggcccattcctttttgtggtctgggcagtctgtcactggggactgtgccaggcagcttatggtctaagcactgttcttacactcggggacttcagagtccctccctttgtgcatcctgggaaggaactcactgtatctcagttgccagtgccccttggtagtctctccagattcacttgctgtcctggaaccagggccaccacctcagaggtctttcagaggagccctatgacccagttgctgtaacccaggagagggctctaccaggctgtctctgtgtcaaggaaagtttgtatctcagtgaacaggacaacctttctcatagtcacctgtgtcctgtcaacatgggcccatcagaagacatccagaatccagttctcctacaggcacaagttgtaaatgctgacatcaaagttgagtttgtcacagtgggctacacttgtcctgggttttccattgtgctaggcctgcacattagagggcttgccccgactgattgaacccttatctgctggctgctgcagagtagtcatgtttattctattaggacaagaacacaggtcatatgttctaatagagttatgggaaacttccagcaggtgcaggaaatatttatggggacagggaaatgaaaatattggtgaaggtcaggctgcttagtgtcaacagcccaaagaaaggacactgatgtgcagtgtaccaggtggggtaccaggtggggtccaagttagattctcatctgtgctggacaagttctgattccgaacacataagtgttatccctggggaaacaaggtggcacatgtcaggggcaagtgaaatgtgtt

SEQ ID NO: 23416 - DNA, 1121 bp, Mus musculus
cgtgttctctgtgattggggtgcgggagccgcagccagcagcaagtgaagcatttgtgaagtttgcagacgcacaccgcagcattgagaagttcggcattcggctactgaaaaccatcaaaccggtgggtctctcagagtacagcgtgccccactggccaaggcaggagcgatagctagcacaggagggattctgggctggagtcaggtgccagatgcagacactagctttgtcacctctgtggccatccatccatcagtcactgctgccctgggtccctgttcaactcaagactggtttgaacactgttctgttgctaggtcacatttcttgacgtagtcttctaaccctgacacatgtcctttgcccaagtccccaggaagggataacacattagtgacatttgtcccaacctcccagatgctgacggacctgaacacgtacctcaataaagccatccctgatacacgcctcaccatcaagaagtacctggatgtgaagtttgagtacctggtaagtggactgcagtgtctggctagctgaggtgagctcaccctggaggccagccctgaggccagcaggcaggctgggcccagacctcagctgcgtcaggcctgtgggactaaagtcctgattagacaattaggaggagcctagactctgcattcccacaccaaggagctcctagctgccctcccattctgtatcatttctagcagcagctcagactaggtttaggaaaaaggtgttttgagtcctagatgataatctgatgctaaaggagctaagaaaatggcctgttgagtattcaggctttttgctgcagctcttagagtcctgacttagtaagcctatacccagcttgtcttcaaggagctgccaggatctattgtgcagccagtgccaccacacacagtatcgttgggttttggttttggttttagccatttcctattcttgagatagagccctaggccttattcatgctaggcaagtgctgtccccagagtctcctgagacttggatatgactgctttgggatttctcaagccttcaggcctttgtaaccttccagaggggagcctcatacccctggttcccctttcctgggtctccgtcca

SEQ ID NO: 23417 - DNA, 1192 bp, Mus musculus
cttgcttcaaacacctttacctgctgagcccaccagccagccctctcttgaattttctaccattttttccccttttctctcaccttttttttttttccaagacagggtttctctgtgtagccctggctgtcctggaactcactctgtagaccaggctggccttgtactcaaaaatctgcctgcctctgcctcccgagtgctgggattaaaggtgtgcaccactgtggctggctttctaccatctggtctctttgtgttgcagtctgaataatttcttacctgttttccagactagtaattcactctgttgctttgttatttaacctgtgttaatttaacaaacaaactcatatatgtgtacatatggttatgtatatttactccccaagaaacactctttggtccttgaggtccttccatataaactcctgtcccctggaaaatatcacgaggctggcactctagtcactgctcagagggagagcacttttgtagtacgctcccagcatcgtaaacacacacacacacaagtgcgagcacgcacaccctgtacacgtgctctggcttgtgtcactgaactccagtcccagcccttgcggtgactgctcctgtaagcctcttcctttttatatgtgaattgcatctgctgcctgtcatagtggaatctttgacactcagattggctgcccttcctgcagagggctctgtgcctccatccccagcactttctccctaaatagttgccaggaaaacttcaggactttctccagatgatgtggacacggtgggccatccagcagggctgcacatcttcagggtcctttcctttcttgttctaccccagggctctgctccctgtaacctccaggggtgaggaaggtgccggttgggcctgggaagatggctcaggagttaagagcatttcctggccttgtggaggacccagatttgattcccagaacccacagcagctcacaaccatgtataacagcagtccctgcaatctgatgccctcttattctctgcagacactgccaagtttttaaacaaaggggcatgtttgtgtctggcctgtttctatcctgagagtgttagcccttggagccccagtatggaaagagcctcccattggatcctcatctttggttgatatcctgtcctgtcaggtggcccatgctcttaaacaatattt

SEQ ID NO: 23418 - DNA, 1247 bp, Mus musculus
gtaaaacatgaacacaccaaccaaggtgaccctgaacttctttctctcccaggtctccagcccagaggtcatcttctgcgaaaatggctgtggatcccttatctagcaaagccctgaaggtgaggctgctagctccttgtagtctctctctgctgctgctcctggtagagcaccgacatcccaattcccctttccttcctggaagccccaaaggcgactcagcagcagaggcaggttacttcctgttgagcgcgcttcccccattgcaaggggctttccaggctgggtttctcagctgggtccaggacttgacgcgtggttagtttgagccttgggtgacctcctgtaggctgatgctggtcctgctaactttcaaggtcttggctcaagtccagtaaccgccgaaacggggagagtgggggcgcaatgagaaggggggcgccatgggaagtggggcggcatcctcaagcacgggccccgtgcctctgtttccccatggccctcaggtcaagcgcgagttgagcgagaacacgccgcacctgtcggatgaagcgctgatggggctgtcggtgcgcgagctgaaccgcaacctgcgcgggctgtcggcggaggaggtgacgcggctgaagcagcggcgccgcacactcaagaaccgcggctacgcggccagctgccgcgtgaagcgcgtgtgccagaaggaggagctgcagaagcagaagtccgagctggagcgcgaggtggacaagctggcgcgcgagaacgccgccatgcgcctggagctcgacgcgctgcgcggcaagtgtgaagcgctgcagggcttcgcgcgctccgtggccgccgcccgcgggcccgccgcactggtggcgcccgccagcgtcatcaccatcgtcaagtcggcgccgggcccagcccctgctgctgaccccgccccctgctcctagtacccgcccccaccccaccacacccctcggaggccactcccttcttcaagtgcctgagttccttctgcttcccattcctttcctctgccactcgttgtagtgacttcacattcctttcctgggctctgactcttgcaggcccccaaactgggacctgatggccctggggaggggcaactttgctaagttgggggtggggggaggcgttagggttctaagtttccctgggctgaaagtccggctcaaattgaaaatgaggtcgtgtggccagaaggagagctggtggaagaggctttggattgtgcc

SEQ ID NO: 23419 - DNA, 1147 bp, Mus musculus
ggcctcttccctcactcccggacttgccacatacaagattcctctagcatctcttgtgcttttaggttttgcagcccttctggcttttctagactagtcctctatagcaccgttatagtaaagtgacccctccgggggtcggccaatcctttcataggggttgtatatcagatatttacattgtgattcataacagcagcaaggtgacagttatgaactagcaacagattatggttaggggtcactacaacatgaactgtattaaaagatcccaccattaggaaggttgagaaccagtgtttcaaagtaaactggagctataagaaaccaggcagtaccacccagaaaaaccctactgccctggctgaagaccagaggagtccacccctcaccaggatggcagagtcagtgagtatgcatacaaacccatcccctgactgagactgaagcctagctcccagaactcagtagttctctctccctggctcaaaaacactgggatgtagttcccacagggctgtagaaaatcagacttggggctggagagatggctcagtggttaagagcaccaactgctcttccaaaggtcctgagttcaaatcccagcaaccacatggtgcctcacaaccatctgttatgagatctgacgccctcttctggtgtgtctgaagacagctacagtgtacttacataaaataataaatcttttttaaaaaaaatcagacttatgtgaaagtagaaggaagacagttttcaaagcttaggacctgtctctccctggctctgtacagtctgagctcatttcttgcctatctccatccacacctgcttgtgagagctagcaatgggatatagcctcccctcacccataagtcccttcccacccatccgaggccactcatttagagcacacacaaaatagtccaagacatacacttctcttgtggaaaaagagaacttgactttattcagaaagtctacaaaatactcaaggcagataactggctcacttgaagtcagaaaataaataaactctgggagctgcgcaaatttttttttttttttaaaaaaaaaacctattgttgccacccagctctccctaaatataagattaaatgtgatttatttgtagatataaaatataagt

SEQ ID NO: 23420 - DNA, 2308 bp, Mus musculus
ctgcactagctggggcaggggcagaggacagcggctgtagctgtcacatctctgcgactcatcctgtaccgtgtgttggccagaagctgcatcctaagccccctccccaacaagatatctgccgagctgtcaggcccagcccaccctacaccgtgcaatacccagacccagcctggtctttccccaggcctttgcccgcttctccctggtcacccttgtccagtgtgagttttgtcacattctgggcaggtagagacgtgaatgctctgtggaccctccccctctcccaacctaggcctgtctggcatgctgcaaggaccagagccagcccccaggagcctcagggcccacttaggaaggatgccttgtgcctatgggccctttggtgacatgtggggctctggatccttgggtgtcctcactgtggccactctgcctgctgaggacagccagaagcccacactgccctctcacttgggtccagttcttgatagttgggggcagagcccccacactcccttatacttcctgactgtgccagggcttgggttccccaccacctcctcaatggagcaaagactcctgctaggccctggtctccctggggtttatccctcctgggtcatgggaaaagtcagtctccacattacagatcacttccagagggaggctggagggatggtcatacagcggggccaaggtaggggtggtctcagaccctcctgggtcccctgaccatacagggcctggtggtctgctccatctggcccctggcccatctcttctgtgccttagtcacatatgaaagcccctccccagttcccgtctgctccaggcactcctcgttgagctgctggcactcagggttccgcagcgctgggttgggcatccttgggaccacccaccctctccctggctccctctacacgcacatcccagagctgcctcccagggctgggatctcagaggtagggtggcaggggcctggtaagcagaattcaagcagcacttggtcttggctccagtagcctcttgaggtggagagtggtggggagccctaccttgtagccttcagtggatgctctccccttggtcacctctggaacaaacaggttccttccctggggtccatagggagggacctcatggggctgtcacatcctagcaaccttcttagcctccttccttccttccacacggcccagaggccagctcggccccacccagagggcctggccagctgctcccaagccacccagggaggcagcagacaggtgggagctcctggggcacggccgtgggattgcttccaccagtgtgtttctgagacttctccttatcttccaggccaaagtatgttgctgcttcctgtctccactggtccccacctaccctggcacttgccctgtgacatgatgggtgaggctgtgggggaactcagtggcaggaagctagtggtccctgggaacaggggacaggaatccgtacccaactgccccgttctttcttcccattctttcttcctaggatgcataaactatcttgtctcatttattttttaattttttttcagatagagtagctctttgtacataaaaaaaatacttgaaaattgtatgatgtatgagaagacagagccccctagttttgtattttgtcctgtgactgccatgcgttccaccagaaagccgctctattttggtctctgtgatattttaaatgcgtgacagaagcaagcaaataaagtcaggaagaaatatatatatgagataatatagattgtattgaaatctcttctgcctgccagcgaggttttttttttcttttcccctcttgtctgggagaagtgtagtggccgtgggcagagacgtccaccctctctcttcctgtgtgtgaagtggatgtaggtcatgggggcgtttacaccgtctgggtctaaaatcaggtcccacatccctatttgacagtttcttctctcttcccagacagcctaacacggggaatttcctctccccatccctgagagggctgggcctcagtccttgtttttttccagaggcaggtggtcacctcttctgtaaggcatctcccagaagacttgcacacctgcctcatcttccctgagccaaccctccatccttagggaccaggagcctagggcaggagctcctggtcatgggtaccttccctgcatgcaccatgcctttccaagagcctggcctatgggtgacaggcatgactggaatgcacgtgggggagggaacttcctaagcagcctataacccgaaggtaaacggcctacctacat

SEQ ID NO: 23421 - DNA, 1179 bp, Mus musculus
tctgtcctgccagggggaggtcctgtgagagccagtgtgagcgtaggcctgtggcctgccctggcctttgccataggtgataatgctggagagccagaggccacatccagcccctgaccttcatccctgcagtgctggctgcaggtcccaggccttcagcttgtactggggtaggactcagcaactccctgcagggtgctctggagtgagcgtcacaccactcactgagcgcacgggagcatgtccagggaattcagctgtcagcagggcctcatatagttgctgctcttcgccccacagcaggctgaggaggccattgtccccagttcacagctgaggaaacaggcacagagagcttgagaacccggcctaaagccacacagctcctaatcggtagagccatggtccacagctggacagtctggcccaggggcatgtggttcttcaccccagctctatgctgccctgtatcctgaaaggtcagaggtcatcagacgactgcagggctaagtgtcactgcagctcagcccttggcttgccgctctgttctgagtgaccgctctgctgacttttcgcagcctttgtcatctataacttcctgagcttgtgctatgagtacctcgggggagagagtgccatcatgtctgagatcagagggaaggccattgagtgagtatgacagcttcctgagccccatgtgggcaactcccagcctcacccacaccctgggtagacacatagaccatacccacgcaccccctgggtgggcacacagaccaccccagcccctggccccagccctctctacttgtcattcccaggtccagctgtatgtacggcacgtgctgcctctggggaaagacctactccatcggattcctgcggttctgtaaacaggtgtgtggccagcgacagccccagcttgggagcaggcaaggggccctggttcagacctttgtcctggagggtgattcgtgttgcatgctgacctgtgccatacctgtggaggtctccaggcccttgagctgtccccaagctattctggagacaccatgttaatgtcatctgctgagactggcagtgaacatcctggaagtctcaggggcagcctggggccggagaagctggcccagagtcttactgtgttcaagaaccaggaagcacacagttctggaccat

SEQ ID NO: 23422 - DNA, 2165 bp, Mus musculus
aaagaccctctggccaaagctagttcggggtggactgcctgcggctgtctgtggcttggggggcagtacctagaagcctggtttgggaaaggggccacaggctcttctggtagtattggctggggacccaagctccctgcagaacatggatattagcaggcagtgtcccacccattgagacgtgcagcttcacaccgtggtttcttaagcagacttcacactgcagaaattctcccaacaaatggctaatcagttcagatagacatggggctgggatggccgctcagcccaccagagcagaggagcgcattggctgggtaaaccgaggcagccaggcacctgaccgttgtcttttcttccctcctagtgtcttcactgcattttctttaaaaaaaaaaaaattaaatacaaataagagaaaggacagaaagaaagaacagttcacatgaacaaaaaagagaaaaacaaacaaaccacaaaacccacaacccagcacaaagtcgacaatggattttgtttctttgatttattttgccaatggcaaaaagacaagacctcgttagcactgaggattcttgttcccttgccttgcccactgctcccgacctgaaggctgccaacactcctctaaggacactgggtcacatgccagccacctgttctcgccaccggccaccacgtgccgggccgccatcggaggtgcctgaagagcttgtgtcagggagcggtttggccagtcagagacaagtcccaagagatttcatggagccttggatgacacacacgccatcagcccttgggtgatgacagtgaccagtgttgtatggggctttcccagaatccccttccctgagcatcctggtctcccccacacacacctgtcacctctctacagagaccctgagggtgcggtgagatggaggccatgatgccttgtgtgactgtgagtgtgtgtgtgtatgcatgagagagagagagagagagagagagagagagagagagagactgagagagagagagagactgagagactgactgagagactgactgagagactgctgacttgtatttttcagagctgcaggtggcctgccacgcctgcctggccaagtttctgttcccctcctcctaaagtcaaggtggggtggacaatgacttccacatccctcagggcatagagtccttgccaccacctgtccccagatgccagtgtgtggcacccctccccccccaacttccattcctgatcttaggcaagttcttggagtctgctcccagatggcatcggctctgagataccggttacttccctggtcctgagagtcacctgtggtcacccctcttcccaggcctgacttctgagtaggaccctgggtcagggctaagtgttgaatttacccttcctggttaacacctgttttgttggtttttttattattattattattattatttttgtttgttttctcagtgtgtgtatttcctaatttatttacctctttttttcccctttctttcttttttttaattaaagagcaaaactttttattactttgtaatttaaaaaactgaaaaaaaaattactgaagaactttggggggaattttgtacttttttcctgtgtaaatattggacttttttgagctttattgtggttgttaatttgaagtaataaagtagaaaaggacaaagtgatatagataccctctgtctgcctctttgctcttggggtttctcatcgctgacttaccagggactgtacatcacaaagaagccatcagcctcaggcagctgtggctggggccattaggacctgtcctgtggtatatcaagccttcagagctcaaggtacacagtgtagcctctggcctccgggtgaggagagcgctctttaggtggtgcggggcctaggtctacacagtgaaagatgaggcttcccccaagacatcatgttatttatagaagagttctgagggtttgggacacttgcttccctgccagaaactggccttgggttacagcctgggtcaagccatcagacacctctcctctggttgaccatgcagttctgtgaggtgatctctgctcaccctggtgagcaggaccctggtcccttggccagatcctgatgtggtagtctccactctcacccactttgtctcact

SEQ ID NO: 23423 - DNA, 1164 bp, Mus musculus
atggagtagacatactcatctaaaatgatgtaagaacaccagtaaccaaagtggggggaaacagcataaaccccacgggtgacccgcaacaagtaacaagggaggcaaaggcaggcgatctccagttcaaggccagctaaagtggagggaggggggcaggaattcttctttaagtacaacacatagtaaaattttatctttttttccttagtccttaaaggaaagaaattaagcctcccggtgccagtttgaagagaagggccacccctatggcagctaaagcaaaccatccggatcactgcttcatgacttcaagccaagacttgggacttcatgttagagtgactggtgtgaatttgagcaaagcaccatcttgggataaacggcagcacctccctaatccaccatggatagaatgggatacctagcccatctgcccaaggatggtgccctacaagtgccaagtgaagagaagcagtagatacctccgtgagtggctcaactccttgcttccttaggactatacaactcatgcccagggctgggaagatccattcagagaacctccctaggtcagcgtgctgaactcgagccacatgtccacctggcctgcaagctgtaagcagtccaaataaccagctctgccaagtgcttaggactgcttagctcacttgttagctgagatggacaccatggccactgtgtaaatccattctgtgctaagaaccaccaatgtagccttcccctcccagcctgaggtgctaaatagaatgcctaatacactcaccctgcttaatgttttcactgcttggaggaaaacattaagagtacacttaaactctttttaagttttaatgtaataaaaaattcacacctttattgtcaagtatttatttatacctacaaaagaaaacaagatggtatcaaaaggacaatttacaaactaagaatagtagtaacatagctctgagcatcctgtgcataacatcacacctacaattcaagtctcaatgacaggaatgtgtggagagaccagcaagggcgttagcagagcactgatcccaagcaaaagccaccaacctttttagatgagaagtctgcacaatggatggttagggagaagcagcccacagcctaacacctaagccctttccctaagtgagt

SEQ ID NO: 23424 - DNA, 3184 bp, Mus musculus
tcacatactcggcattttcttcccactaggaggccgctcacgataccggactacttcttcagccaacaatcccaatctgatgtatcaggacgagtgtgaccggaggcttcgaggggtcaaggatggtggccggagagattctacaagctacagggatcgtagtgaaaccgatagagccagttatgctaatggcagtggctatggaagcccaaattctgcctttggggcacaagcaggccaatacacctatgctcaaggcacctatggggcagctgcctatggcaccagtggctacacggcgcaggagtatgctgctggcacttacggggcgagcagcactgcctcagcagggaggagctctcagagctccagccagcagtttagtgggataggccgatctgggcagcagccacagccactgatgtcacagcagtttgcacagcctccaggagctaccaatatgataggctacatggggcagactgcttaccagtaccctccccctccccctccccctcctccatctcgcaaatgaaactgcatggcaggagtgactcgtgcagatgaattacacatctaaaggaacactgtcttttacccttctagaccttttcatttttattttttcttttctcaaccattacggtttatctttttttaatgcagatagttaaaatttcactgccaggtttcttctgcccacccaaaagatccagtctataattacagattttgtaagaaaaaatatatatacacataactgactggaaagaattaatttctttcccccagcttaatgcatgttgaggatattgagctatttttcatcttaaaggtattaggcacttttgttggagcctgtttatccatgggagggtgggtagggaaggagggactgctctgcaggaagtggtatctgttctttagactgctctccttagggaggagccaagagggatttccatgcacactgcccatggtgggtttaagttactgaagttcgattactcaggcctgatgaatttttaagactgctttgttggtcatttggctgatggcttcttatgtgcattcaacagttaaaaattcctaatcgattctgtcatcatgccccctccccacttgttcctgcagttattaaatattaaccaggttagtgttgagttagaaattacatttctgagttcaagcgttgtctttttaagtttaaaaaactataaagggttgtttttactaggtagactggcatctgggtagaggctgcctgggatttttatccccacataaccaggggccatctgaaagtcattttctagccagatcagccactgagcggtaagcatcagcgctcagcagagccttccgagcagcatttagaaagcacctttgggaatgatggactgcaagggagtgggcggatcttcctcttaaacagtattcttagagtaggattgacctcatgggctgctctgcccacttggtcaggctctcctgagcaggactgctaaagagcttgcctcctcaaagcctggtctctgaggtgctttctaacagctggaggcacttgttctgggctttcctttgccctcagtttttcacaggtaggtagtagccatggagggctgaagcccaggctctccttactctctggagtgtgaaggtaggggtgagctcgtctcacccctttattaaatgctcctggaacttggaagagcagcagatgaagttggaaagaaaattctgctcttatcacctaaacaggacaggagagcagatgccccagcgcctctagtagatggtagtggtggggctagtgtgtggctgttacctgggccgctcaaattcattccagggaggaggctccactgcattctttggctgtgccctgagggtgcctgctcctttgtacggtaacagtcaattttgaggtttctttcaggaagagaaagggatggttttgaggggctcagaaaataggattcagtgtgtaacataacaggtaggttgtcagcatgcttggcattcttctgttttccttaccgttttacagactatgaagctgaggggggatggtaggcacagatgtgtggcaaccctgctctgtgctctgaaaccaaagtgtgtcctgtcttgtctgtctctcaccctgccaaaagcaagtgtctaatcactgatgctgaccagcctgttacagatactttctacaaccaaattcagatttattttttattaagcattataccatgggctgtcctgtgctcctgtcactcttcaaaaacaccccttctattactgcctccggggatgaagcagtagctaggttgcttaacctcccctctccagcagaggcataatccagataagtagcagatgtcatatttcataagctcttttggcctgggtacagcagaaaactagcagttttcctacttggcgcaagtgacttgtgcctccttgtctgtcctttgtcagcacaggtgcaggcaaacccttccagctgggttaattgccgtttatggtttactcacttagggaaagggcttaggtgttaggctgtgggctgcttctccctaaccatccattgtgcagacttctcatctaaaaaggttggtggcttttgcttgggatcagtgctctgctaacgcccttgctggtctctccacacattcctgtcattgagacttgaattgtaggtgtgatgttatgcacaggatgctcagagctatgttactactattcttagtttgtaaattgtccttttgataccatcttgttttcttttgtaggtataaataaatacttgacaataaaggtgtgaattttttattacattaaaacttaaaaagagtttaagtgtactcttaatgttttcctccaagcagtgaaaacattaagcagggtgagtgtattaggcattctatttagcacctcaggctgggaggggaaggctacattggtggttcttagcacagaatggatttacacagtggccatggtgtccatctcagctaacaagtgagctaagcagtcctaagcacttggcagagctggttatttggactgcttacagcttgcaggccaggtggacatgtggctcgagttcagcacgctgacctagggaggttctctgaatggatcttcccagccctgggcatgagttgtatagtcctaaggaagcaaggag

SEQ ID NO: 23425 - DNA, 1190 bp, Mus musculus
ttggttgtattgttggtagactgtgccaggcttctcccaacagagtaaaagtgatttggccctgcactttaatggtggttactaagttcttctacattctagcttcgaaagggggtggcactagattttgtcattctgaactctggtctcagtgtagctcctgtcagcatatcattacagaagaggcaggagtttggggtattggagggagctcccatagggtaatcacaaaccaagatgcagggcctgcctgtgtcctgagtggcactgatcctcttttactctgttgggatgagtcttttttttgtacctactcagggcagttactaacttcatcttctcccctcttgctgtcatctgcattcgtgctctccacctcttggcatgtctttaccttctctttctctgccacatcaacctacacaatgtctcctcattgacgtggaagatgtggaagatgtcaagtttgtcatcaactacgattatccaaacagctcagaggattatgttcaccgtattggccgaacggcccgcagcaccaacaagggcactgcctatactttctttaccccgggcaacctgaagcaggctagagagctgatcaaagtattggaagaggccaatcaagccatcaatccaaaattgatgcagcttgtggaccacagaggtggcggcggaggagggggtaagggtaagtcctggaattttccaggtactgccaaggacttgtaacactaattgtgccatttttttctgctggtttttctttgttggtgagtttttagttttcctttttgtttgttttgtttggatgacaaggctcttgtttggagttggaaagaaatttgtggctttgaataatctcattttaagtgaaaaagtaagtctggtcattgtgttactgttagaacccagtgttcttgtagttgaggatttaagacccattatttatttaaatttggggttacatggtacatgtccaaaattaaactagtagtacatgcctgtgaatcttttagtttggtttttattctttaagacagggtttctctgtgtagccctggctgttctggagctcactttgtagaccaggctgttctcaaactcagaaatcaacctaacaaagctgtcgctgtccagccaagcttgggttttgttttttcaagacagggtttttctgtatagccctg

SEQ ID NO: 23426 - DNA, 1189 bp, Mus musculus
atttgaccctggtgtggtgactcacatttataatcccagtgtttaggaggctgaggcaggaggatttcataaagaaggctggagaggaaaggattacaactcttttattctggctctttctttagagtaaactaaacacactagaccctgatgtcccaatagtttgctttatagagtagcagagaagtttttgcccccagcataagtggggaaattggctaagaagctgttgtaaatttgaaggacttgcttgaagtacatttttttcgatgtccacagtcttggtcttgcagtttaaaagagtaccacttctctgcaagagcagagaccgttagtttttattgtatccagaatctctagtgccaattaaaactatacttagtataaagtcggtatcactaactttgtcagagagctaaaataggtgggaaactgaggtgggaggaatgctgttcctttcctgtcacatgagatggatattaacaaatctacattttctggtgtctctaggtttggagcaagaggtggtagtgggcttccccctaagaagtttggtaatcctggggagcggttacgaaaaaagaagtgggatttgagtgaactccctaaatttgagaagaatttttatgttgagcatccagaagtagcaagactgactccggtaagaaaggggggaggggggagtgtttaaatatagggtaatatttcaagtattgttttatatttgattttatattatggcagatctttttaatgtgttgtgggtttgcttgttttgtttttttgtgggggtatttctttgtttgttttctgagacagggtttctcttgtgtgttcctttgatgtcctggaactcgctttgtagaccaggctggcctccagctcagagatcactctgcatctgtctcctgagtactaggactaaagaattgcatcaccatgccttgcctctgtgtcttttgtaggatggaattattgtatttgtagaatagtccactgtagatccaggctggtcttgaacttgctgtcctgctactttagctccaggctgcaggggtctttgggcagccacacttggtcaaaccctgagctttgtccatgaagacaggtgctcagccacatgacgcaggttttcttttagcagctctgctctccagcctagcaccacatgcatgtaaagtttacactg

SEQ ID NO: 23427 - DNA, 1409 bp, Mus musculus
agtgccggctttccttttcatgacgcctcatccactctttccctctgcagattttccagggcagctttgtggattgggaccacttccttcatgatcctggttcttcccgttgtctttgagacagaaaagttgcagatggagcaacagcagcaactgcagcaacggcaggtgagcacatgttcttcttggcggtgggccaaccgcagagccccaggagattggcacttaaccccaagtgggagcaggtccctgtactttcaggtacttggcagtgtagaatttgcctgcccctcatgtgtgacagaagggaccgacgactggaactatgcagtatcttaacagtctttttttttttttttttcttttccagatacttttagggcctaacacagggctgtcaggaggaatgccaggggctctacctccacttcctggaaagatgtagattcttccttcggtatttgtccttgtgggagaactttgaaattcatttgtgtttgaactgctgattgttggaactttttattcttttttttaaccttggcacatggatctatttgaacatagtgggaactttctctgtttctcatggagagaccccaggtacacctgtgccctacataatgaagtccctcacttacttcttcctgttctcactccaatgctggagtacagccatgtggaaggttagcctactctctaataaactgctcctaaggaagttcttacatgcccattgtgggaaagaagtaagtacccctgaccataaggacttttttttaatggaaatgtctaggacatgtaagcaccgtggcactgacaaaattcattatacctgagtacagaagtcaccaggaatcccagagagaagggaggctggctgtagctttagccagagggggactgggcagagcaggcactcatttcctctgcagagtttggctcttagacctgcttatgtataaaaaagaagtcagcgctcactttttgtatttaaatattaaaagaactcgaactgaaagtgttattgctgtgtttgtggtagtatttcacacctaggttgttttagaaagccaggaacactgcctgccaaatttcctctggcttcagccagcatctgtttcaacctcatttcatagaccagtctgacctcaaaaagctttctcttcttttccttgtgtgtgtggtatgttttttgtttgttttatttttttttttttttcaagactgtttctttgtgtagccttggctatcctggaacttaatttgtagactagagctggctgagaactcagacctgcctacctctgctttccaggtgctaggattaagggcaggagtcaccaattcctgtttagtgaagtttccaaaaaggaaagagaacatttattattgaacatagtagtgat

SEQ ID NO: 23428 - DNA, 1761 bp, Mus musculus
gaacacttagggcaagccattgaaccctttgctatttcagagagggagccaagaagggcgtcctttgagggggctgggttatttctccctttccataaggtcttgatacaggctctgctggtagtgtcactgatgcttcaggcttacggaaaggccgccccttttctctcctgtggcaccatggggtctgaggacacagtacatgcagagccaagaaactgtcaagactccagcagtcacactgcatgtcacctgcagtccattaggcctcttcttggtccctttaaaccccagccagccttggggttttataagaggctctgctattccaaaataggtgaattgcacatcattctagcaagacagtggtgaaagatatgcctaataccacgtgggtaaagccagagtagggtagtcactggtggctcttcactctaatcgtgtccctatcatttcactacattgactggggaggctttgggacaagacaatgaacagggagagtactcatagttggcccatttttagcaaaatcaaacacatctacactgacctaaaattccatagtttgggacagagttgggcgaggaactgccatgaaggtaagcttcagggtttgagcccggtaggcacgtcctgagctccagagctgtggcagcaatctcaggttggctgtatgcatcaagctagagcctctgagtttggcgtctgtgtagtttctttgacaaacagggttggcttgccccacttcaactagttctagatcatttttttcttgtaattttggaaaatgaggggaaataattaccatacccccataccaatgtgtttgtggtggccttcaaggcaggtgacctggccagcccttaccgatccatggtctctgcaggtctgagagctgccccactggcctgcttcttctcccttggcagcagagctacctggggcttgcatgttaatcctgagcaagcttgttggggtgaaggggggctgtctccccactgtgactggagtgcatgtttacaccagcactttttctgcacatgtatcttcaatccaacaaggccgttttttattcaagtggcagaggcctcgagtggctactgcactgcgctcagccatggtcatctgcaccattttctacaccagatctgcttggcaccatggggaactctgcccctgcacaatgacattccaatcactaccagccagaagttacagccgaccttgctgattgtcacaagcaggaccttgggtccattggcactgtcggtgatagtaagccatttcttgggaagaggagactcttccctacagatctgcttgggcctgtgcaaatggcactgcaaacgagccacacacacgtggagtccatgagctagtgggatgtacaaagacgcttaagcatttcagggctggttctgttcatatccaattctggtgcttaggaacagggacccatgttaatgccccagggcaaagccccactcctgtgaaggaaggggcagcctgaccctgacgcccagcaaggggcagccctaggctttgtttttcttgctttattcccttttctgttggccttgtgctgggtttgtttacaaagatgtattttgtttaaccaaatattaaaaatgaaaagctgaacacaagtctacttgtctgattatgtaaaaacctttggcaggattttgtcatagaagggatgtcaccactctgagacacagtaatcagatttcctagctgaaaaaccaagagaaagta

SEQ ID NO: 23429 - DNA, 1176 bp, Mus musculus
gcatctgggctcagtgctctgaattgagctcctagaggaactgccatgaccaagcattactaggggcctcccatcattctacacagctacagctccacccacctggggaaggagcttccttacacaattgcttcttcccagaaatagcctcaactccacctggatgtttgattctagatccagtccccaattaaccctcacgctcctctgagggtgcttgggctctggacgtcctgggcaatgaaggcagcagcctgtggccagctggtagaaccctatctttttatgactcactactttttatactgtttctcaaaagccttctaatcccaggttagctcagcatttattcagggagtcttcattgctagatgcttatcgggcacttgttgtgccaggctcttcttttggatgttaatgcatctagattccagagattaccgtgaacccaggtcacagctcctcagctcaggggtccaagatcgtctttgctgctgttgttattgttgtttgtttgagacaggtgacttagggttttagtgctgctgtgaagagacaccatgaccaaggctactcttttttttcttcaatttatttatttatttattatttattggatattttcttcatttacatttcaaatgctatcgccaaagcccccataccctccccccactctgctccccaacccattcactcccacttcctggccctggcattcccctgtactggggcatatgatcttcgcaagaccaagggcctctcctcccattgatggctgactaggccactgtctgctacatacgcagctagagacacagctctgggggatactggttagttcatccaaggcaactcttataaaggaaaacagttaacagggcctggcttacagtttcagaggttcactccatcatcatcatggtgggaagcatggcagacatggtgctggaggagccaagagatgtatgtcttgatccaaaaggcagcagaagactgtcacactgggcgtagtttgagcataggagacctcaaagcccacacccacagagacacactcaaagccacacttactcaaacaaggcaacacttcctactagtgccattccctgtaggccaggcattcaaatacacaagtctatgggagccaaacttaaatcaccacatggggggttc

SEQ ID NO: 23430 - DNA, 1103 bp, Mus musculus
ccacaattagtccacgataccaagccatgggtaggtgtccaaggtcctgccagcccagaggttctgaactagcaccctcccaaaagagctccacaatccaagaccagtgtccccagcttcaggcaagacagctctctatcctgttcagccaagccattcctatagttcatgccctgagcagtactggctgttcagtcctgcagatgctctgagagccactcttgtcctcgggcacctcacgtgccagtattcatttagctggggttgttgagcatagctgtgtgcctggtggtatcaaggaacagtcctgtgggaaggcgtatgtgtccatagctctgccacgtaggcctgggaaggagtgagtgaggaagagtcaggaacagatctaaaagtaggctgccctgctgtgcccggctctcagaattcttgtcctgccctggagctagcgctcaaggcagaggccacagggtaggtctcacatgtcctgaccctggttctcttggcagtacactgtgggagcatccggcaaacagctacaattctgagcatggataaagactgtctgcgcacaggagacaaggccactgtccacttccgcttcatcaagaccccagagtatctgcacatagaccagcggttggtgttccgggaaggtcgaaccaaggctgttggcaccatcaccaaggttttttgttttgttttgttttgttttgttttgtttttcaagacagggtttctctgtatagccctggctgtcctggaactcactttgtagaccaggctggcctcgaactcagaaatctgcctgcctctgcctcccaagtgctgggattaaaggcgtgcgctaccacgcccggctatcaccaaggtattatggggtagcctcacctgcccaaggaagcttcagtttgctctagcccagtaaccatgagttgtcttcactgtgggacagaggtgttgtccctgccctgggagagctgagccagtactcagggtaagcttcagggatgactttgctggccccagatttgtccctaggcctgtcttgagctgtggaggctgtcttgaagaaggtggcactggagtgtagttcttctccatag

SEQ ID NO: 23431 - DNA, 1592 bp, Mus musculus
ctgatcaggttagggctgctgcctgctccactacccggccctgcttcagaggaccagcacgtctcaagtgcctgctttctttcttttagcccaagcccagcagtgggggccggcgacgagggggccagcgccacaaggtgaagtcgggagcctgtgtgactcctgccagcggctgctgaatgtcccccaggtccacttgaccacccatgggatcctcattgctcactggccactgctcaccaactgggcagagaatctttgaccaccaccggcccactccagtccacagccagagagtcctcgttgccacagcccgattttccatggggggttgtatttatagggtgaggagggactagatgtccgaggactgactgtcacatgccaccttccttactcacggctttcgtacatctgggcccttaatttctatctttttattatatatttgtcccatgtgtatgtgtgtatctgtgtgtctatgtgtgtctgtgtgagtgtgtgcatgcacacgcctatagcaggtgtgtgcaggagtgcagctgaccctgtcagtctccgtttcggtcctagctggacaccagcctccaagagctgactgcctgcctgtccttccatccgtctgtatttgtctcagtgagatcctcagaacctttagggaacctcagagcctaaggcacctgtcttccctggccaatggcccctcttagctagcagcccttctttggggccgacctctgggcttagcagcttctaccagagcagggatcccctagtctgtgatttggggagtttaatgggaagtggtggtggcctctcctgtctcccctttttcctccaagctcttcagtggcacctgtgatgtgtggaggtagtggggactacattgtaggaccacctactctgactcttgacccttgccatggatccaaagaactaggtgggctcatctttagagacaatcctgggcttgcctggctggccctggctgctctggcttctgtgcccgcaggaggctcttcctgtttctacttagatctctggctgagcctcagagttccgggctactagactgggtcttcctggttttgtagtacctcctttggtgggggcggggaggtgctcctgagttcagccaggactagaaatgctcctttcccaatgtcacccaacacaaccgctacagccatgccacatagcagtgaagggtctgagccctgatgccccatttggggtatacaagggcaggtggcaatgcagacccttctaggccatcaaaagccctgctactgggttagggtgcggtgggctgcccagagcagtgtgggcacagccctgcaccatcgcctcaggctagggtgctccttctcagccaggacagatcctcagctggctggagccctctacagccccacctcttctcccaagctctcttttgtcctctgctcctgactgctcttccctctctccctgtacttccagctgtttctagttaccactgccccatggccatggactgacgagaccagcattcacaataaaagtttgttttaagttgacagtgtcatgttccctgcccagccctctaggtg

SEQ ID NO: 23432 - DNA, 1156 bp, Mus musculus
acaatcctggtttggactgggatgtcaccatgggaggagacatttcctgcctgactataagggtggcccctgagaagcaggaagtaggttgagctcctggggttccaagacaacatggagtatttattagaaggttctctgtaggccccttgaacttcaaaggctatacccctctagctgcctattctccttggttgccatggatcccgtgaccaagtccttgccatctgcctctttaggccagtcccttagagccctccactctcctgagaacctgtgtctcttggtctttgtggtgcccacggggcactagatgccattctctgagatggctggtaccagtcactgctcctccaggcagggtactggcactgggcttcgaactgtgtgtgacaaagctgtccacttcccttgaagactccgaggggaccgaggtgttccctgcactacagacaatggtggagaactacaacgtaggtggatgtgccttctctgagggcagaagtagctaagcaataggtgagccaggaccatgcctggaatgtggagcccctcaggacagaggtaaacagaagcgctgagaatgagcaggagccaggaggaccctgaacctggcagcctaggcctggtcctggctggaattgcatcctggctagatcttgggctaactagtcactctctgagccttagttcctctacttgtagatgagggaaggcaattcttgactcaaaggtctactgaggattacatgacatgtcacaaaggaggaagcccaggggctgtcaaatgcaagactttcacagaggaagaaccttcccccagaaaatgctaaggcccagttgggtgtgacctcttcaggcagcctccagtcttcctccctgggcagtgatgtgtgctttcctgagccccacactgttcctggccaatgacatcctccccgctctctattccactggccagcaagcactgcgctctttgtggttatactttctctccttcagctgtcagccaccttgaagggaagttctggctggacctcagaacgcagacctcctggggtcaagaaaagagacccctccatagagcctcagtgagctggcccaaacaaacctttaagaaatagaaatagagccaggtggtggtggcacacgcctt

SEQ ID NO: 23433 - DNA, 1156 bp, Mus musculus
tttcccttggcctcagtgtgattgagaaaaagtaaagacctttttaaaagctaacaagacagcttttgtatatgtagaaaggtaactttttttaaaggctgaagttaccccctccttactgtcaacctttctctggtttacagcacatgatggctggccagcctccctgtgtctgcttgcctatccctgcctgcctatccctgcctgcctatccttgcctgcctatccctgcctatccctacctatccttgcctgcctatgtctgattgcctttgcatgcctgccctccttccatccttccttctttttactttaagaaacattttttaagacaaggtgtcatgccagatgttggtggtgtacacctttaattccagcactctggagacagaggcagatctctgtgagtctgagggcagcctggtctacagagcaagtaccagaagagtcagggctactcagagaaagcctgccttggaaaaaccaatcgggaagggtttggggaaggtaggctctcagtctgttgccttgtttggtctgagacctaccatataggccaggctggcctcggagtgctgagattacaggcttgtgccaccacacccagctagataacagaaatctgacgttcttacagtcaggttggagaatggcagcccggcagccctggctttgcgcctcactctggcctgacctgggtaacccttatcctctcctgacctgactgttggtgtccctggacccttttcctcatcttgttagctttgttctcatttgtttgtagaggcagagggtgagcatgtcagaaaaggcagttacgtgatgaccaagggacccgatgcatgtccctcgtatgggcatgtgggaggcctggagaagccagttttgcaaagagctgctgtagagtagctgttgctcaagcatagtcgccaagatttacttggagcatgcattgctttaatgtgccagattgttctcatactatcagtggctaaattaatgttctgcataaagcgataagcaacatctctcaagtgatttttgaatggccagcatggttgggatggctttccccttcccttggtcctctgtagctagccttataattaatatgcttgtctataatagactagctatgcaggcaaggcattcaaat

SEQ ID NO: 23434 - DNA, 2428 bp, Mus musculus
gagagagagagagagagagagagagagagaacccctaggttcttatgacttgctgtgtggctttcagtaagaacctaccctctctgggcctcgctttctcctagtccctaccaacttccccaagagcacagaagaatgtcagagctgagaaaaaccatccattgtaagctcttgctggtgagagatggaaaagagcacagagagggccattaacttgtctaggatcaaacagcacaacatagcaggcccaggccctctgagtccctccaaagtgctcttccctgtgaaccacactgcctgtccttgagccctgcttatacctgtgcagggaggcacttgagaggacacgtgctttcacacagggtaccaaaatatcttctggggacaccccaacaccttgacagcctgaggaggtgagaggaaaagcccagacagacagagttccaacagacagcagaggatgcaaggccctgttggtcctctcccatggattggaacagtagcaggttgggtgaatcactgggcaccggtgcctcttgccctaccccacccaccacttttgtccgtctgtgctctccatggccactcagcccgagacgtgacgcaggagaggctgcagcccatgtcagggaagcatggccgagactcgcctctgggctgcagatctgcatttccattttgagagcaactacacggcacagcaccccccatccccatcccctggagagagctgcagaggcttcacccagaacctgctgagatcccggttgcccagtaacaaccaatgacatcagccccagtgctaggtcaagtgtcttttgtgaggacaccggttgttgctgggtgacagctggattcagaacttagacctgggggactctaagctgcactgggctcctgctattgttctagaagaggcctttgctattgatttagaggaggccttgggaagacagcatcttaggaaggatgtagcagaaactgcctgctcactggagcccaccagacacaccatccccatccttttgctttgtctcagtggtgatgagaaacagcacctcagtcacatttccatgccaggtcaccctggttaaactgccacctccccaccccaaccccacccaggaggggaaaaaacagaggcacctggtcaaggctctgtgtatggattactggggaaggggctgcctctctatttcccaagtccccacctgctctcatctattgtgctgtgaacattctctgagcatgtggagcccccactcaatcttctgctgtctccccaagcacatccaacaagacagctgcggccctgagttgcccctgggtctgacaaagatggaactaggctggttaggtagtcttaggcctggagacagcacggagcacggtatccgcaccatctggtttatcctcacagcacaaagcgagactgttcttagccctgtggtgcacaagagaaggatgagaggtaaagtaacttgcccagtgttgattggccagccgggaacagcgcgatttccatttggaggcaggttagatgcctaaaggtccacgccacctccttcagagtgcagaaggagcagaggtgggggtgtggggcgtgaagccagggagggaggggtctctcacctatgcccagcctcagcctcagcctgagctgcagtctaagggcaagaaaggagtatctttagaggtcgtcagaaaaggcagggtggaagtggttcttgctcggcccctgttctgggcacgacctatgtcaggttctctaagctgttttctgccagatctcctatctgtgaggcatggagtggccactcccatgtcccaagggtcatcttaccacagttacatgtgaatggggaccacagactgaagtatgaggatctgttgggggttggggggggtgtaactcaacccttggcttgtagatgagggagctgaggtctggccaggaagctcaaatgaccctggaagttcccttgactgtccttctcttctccaggacccggtggtcactcccttcccttgcaaactgaattcctatctactagtcccagcacctttggcctgagagaaaactggagaaggttctcctcccaaattagggactagtatcctccttaccccttaactccagctgcctgccacccctgatcccgccttccacccaccctattccctgcccctgctggatggagaacagactccttccctggctgagccgccagcagcgagcatgtgaagtcatctggttggacactttggaacgaggaccctccactgccctcctcccccaccttgccctattttgtacataagtaacacgagatgctctgtatgtgtgagtgcgtgtgtgatctgtgccatggcttttgttaccatttcttgtttttttgtaaatttgaatgttcaaaataaaacgtgg

SEQ ID NO: 23435 - DNA, 2428 bp, Mus musculus; identical to SEQ ID NO: 23434

SEQ ID NO: 23436 - DNA, 1191 bp, Mus musculus
agcaggtaaggctcaagagagcccttcctccaagtcattgccccgcccactccagggcctgagagcggtgagcatcctgtctgacccaccaatttgccactgggcttagaagcaggtagaacctgggatcagaccagaaccttggggcggagctagagctttgacagtgaggctagagccctggaaggctagagccccaggaggtagtcgctgtgggggcagggcagccttgggggcggggctagaaccttgggaaccaggctttgtcaagttcaaggctgcctggcttgattactcttcccttcctccctcattcaatgtttctctcctttctttgttgctgtcttggcccaggataccttgggaggccgatttgacgccacacaggccttcgttggtgacattgcacagttcaacctgtgggaccacgctctgacaccggcccaggtgctgggcatggccaactgcaccgggccactgatgggcaatgtcctcccctgggaagataagctggtagaggcctttggaggtgcgaagaaggccgcctttgatgtgtgcaaggggagggcaaaggcatgaggggccaccttgttcagggcccctccattgcctgtcagtttcaggactttgaaggggcaatccctcctcagcctgtctacacgccggccttcccttctaccccactcctggctatacctcccacttctcctcatgggcacccactgctccagagtgccctgccctggatgggtgtcccctcagccacctggatagggaccagtatctcacatcaatgtaggggttgaggcagtcccgcctcctggcaatgtattggcttggtctctcccatcatatacactgtcctgccgatcacatcggaccccactaattccaaggacatcccctaaggagtcgtgggtagaggtagcctttgaccctcaaatcccctatgctccaggcctacctcgggctgcagaagggatgccagagatgtataaagatcagacgctccttctctatcttcctgggttactcacaggggctgcggggtcatcgctcccactgcccctgccttgccctccctcctctcaccagtttctctgtgtgttgtggtttgaatgttggtttcatgtcggttcaagcctcacctcagtttccaggatgttccttccccagcccctaccctaacag

SEQ ID NO: 23437 - DNA, 1191 bp, Mus musculus; identical to SEQ ID NO: 23436

SEQ ID NO: 23438 - DNA, 2945 bp, Mus musculus
cccaaataagggctggtatttcgcctctgtccccagaggtgatttccccctccccctcccccaggtgaaccaccacctgggtgccagttacaggtgtttgcagagaccatagaaatgtgttttcctgagagtctgtgtcatttgtgacctttttttgtaaagaagttgtgttttcagaggtgattttatgacaggaaagtgaaagttagttttgcaaaaaaaaaaagaaaaaaaaagaaaaaaatttttaaaaaggaaaaaaaaaagaaaagaaaaaatagaaaaaaaaaaaaaaaggaccattgtaggactcctaagagcatagggtggggagggagagagctatttaagaacgtattaacgcagcgattgcacaggtgagtggcaatgttggggtgagggtggaggccttagctagctggtggattccctgggatagaaggcgccacagaggtggccacagctgtcctccttccttgacagggtgagtctgttgtgacataggaacatgcttccagttgcttgaaaggaaggacaaccagccctaaggtgactagcggggaagtgcaggggacaagtggacagcggtagtgggacccaacttactgttgttgcctttcccccaggaaggcacccatcccatcacgggtctttacgcttcagctctctgggtcacgtggttcccagtggttcccagtagctccccagacaccctaacgccctgggcacctttgagcatccctgattgggaaagggatgcaggctttagaaagcggctgacgggtaaaatcgctgcatactctgcacaagcctcaaggtgcacgggcacagggaagatgcgagcctgccaatgagcagccctcttctctctcctgaatggtctggagcaggaggcccagaggctgcacagactccttacatagccctgcatcatcagcctactgaaggcccctcccctacccctgctgcttttcatttgcctaattaccaagtcaaagttgcagtccaatttgctttatttttgtaagtgaaatgacccccctacgccccctgtaggtcgtgtcctgtaagcgcacccttccctcctacttgtcaggaactaggagtgggtgagtcctgggtcttgggttttgagatggagggttggcatccatccctgctgtggttcttgccctgatctaagtcagtccctctgtgaaaggctggacagggtggcaaggcagcatgaagcactacaggtgcccagcctgagggggcaaaatgagcctccctccccaacttcagagggagctggtggatcagagggcgttgcctcgtttcaaaggaggctgagatacttcactggagtatggaggcttcagagcccaggctggcctggcatttaaagggaaatgtgggactcttgactggccatggcagaaacaaggtcagtcaaggatggactggcctctggggacctaagagggcacccccaccttttctccttacttttctggttggttcgggttttcggggtttttttgtttgtttgttttattcttgttttttgcacttaatggatggtggaacccagcctggtcagttctacccttgggttccggtgcactagaccaaggtggcctgcctggggctcctgtggttcaaggaatcactttttaaaagataggagaaaacttaagggttttagttttgctctgtctgcttctcttcttggttcaggaagcccagagagacacttgagaagcaaaaataggcacctggtcaggtgggggctcaggaccccacttcccaacctacagttcccactgtccttaaaagagtcggggctctgttccagccatgtgcagtgcaccggctgtgtgatggaccagagggtctgaaggggccgagtggcggggtcagacgttgggcatacctggctgaggggggaagcaggcatctttttgttggttttaacttaaaaacacaaaggcctaaagaaatatgtatcttataatttttttaatttttaagaagctcgtttgatgaactgcacgaatgaattctatatatatatatatataatatacgtacatagctctatatttggggacgggcactgtctcttttctctcacattttaaagatgaagtgtctttgcctttgcctgtggttcaaccatccagcccccagctggctaaactttgcctccagtggttaatggcaggaacctaatagagccggccagcggacaaaggggcgggcccccagtctgccccgcccctcggggaggacttccagtggggaagatagcttattttggacgtggattcggtagatctgggccaggggagggcgggctcgtgctgatcactctgtcttgtacgttttgttctgctgctcttcaatattgtatcgatgccaggaaagggggtgaaacctccttcacccccaaataaattgtcacattccgaagctatatcccagccccctggatggggtgtgtgcctcatttcttctggttcccgtggcggcttttcttttttttttttttttttgaagtgttatctaacccactctggtgttactctctagagttataggtgtgaatcactagcctgtgaggacttcagacctcagggcacagcagataaaggcacctgctgtgaaatttagcaacctgaggtcaagtcccagagtccacataaaagggaaagaagagtgagcagccctgcacagttgtcctctctccacacccatggcacggcacgctcacgcgtacttcatgcacaggcacggagacacagggctggagaggtggcctagagttaagagcacttactgctctcgaagaagacccaagttccagtcacagcacccacgtagggtggccgtcggtcgcctgtaattccagctttgcacgcatcagacgcctctggcctccaaggacacctgcattcgcttgc

SEQ ID NO: 23439 - DNA, 1465 bp, Mus musculus
tccctgccctcagacccgtatgcctgtgcttagcttgcctcagatggctcagtgttgacccagggatagggctggtagccctggacttggttagggccttggtagggcttagaaaggaagatctgctccctagtgtacctggcactgtccctgactgtgcaggtggggcccactagatggtttctgggggatccccagaacatggggttcacctatcctatctacatccccccaccctgcctctcctagcttgcttcttgctctgtgtgcagtgtttggtctcggtgctatctcgccatctgcagggcccccaggagatcccgcctagggtgggcacaggctctcaccaccctggcactgagtgaaggatgaggccaaaatgggtccctccctcgacaccattgagggtggcagcagctgggccagaggtccgcttccctgcttgcctacgtgtggaccaggcctatgcagatctcttgccccacacactgtctatcccaaaccccctttttgaaggtggaggggctggcagacatggcaccctgccacagcctctgggtatctgaaaaccccttccgttttctaccaaaggtgctgcaagaacctgctgtaggaacttctggctgtgcatgtgtgtttgccccttggctccttcttgtgtagatccgtgtgtgtgtgttgggtgcagggccttagttttccctgcaacaccctttacggttcctcagaacagggtcgctgaaggcgtggcctcccttgccttagccaggcctggcacagtccagtctgtgcggtttgtcgtggaagccacaggccactctgatcccaggttgctgggggacgtggagccacctcaggcccttcttgggatggtcatcttgaaggtcagatcttcactgcagatgtggtactgtggggactggtagaggaagagcccagctacagcctcctcttgcagatgtttgtggaggaaagaggaggcctagagacctccccggggtcttcagtttcccccacccttccagtttgcttttaactgctgaggtttcctaacagcctagcctgttggaagacttcgggtgccttgggcagcgtctgttgccctctgctgctagggaactgaggcatccatgccaatggcagagaccaaagccccagattcaggccaggcactgggagactagcagggagggagggaggtgccggtccccaggcggcactggcctgcccttggccactgcctgggattcacctgggcgttgaccagagtgttcctgtatgtggcctgagctggcttctggtgtacacagcccttggtagcttgctcagaagcatgggaagaggcagaagcagtgaccttaggacaagtattctggtcttagaggaagatactcttcctttcaccagcctgcctgccagggtctgcagcacagccccagccctccttgccccagggtataaaaca

SEQ ID NO: 23440 - DNA, 1166 bp, Mus musculus
aaacccagggcttcttgcctgctaggtaagtgctccactagctaagccacatccttggtcctatttttaactttttttttggtgtgtgtggggggagcactgccactctgtcttccaaggcaggtgtctgtcctcctgagcagctatgtatgtacctgtcccttgactctgtcccctcccctgttgtccatgagattgttctctttttgagacctctccgccctttttctttaattgagaaaaggatctcactgcttagtgctggctagtttgacgttcacaaggtgaaccaggctggcctcaaactcacagagctctgcccatctctgcctctggagtgtggtgcttaaggaagtgtgccaccaggcccagcttgctttttttccttcctaagacattctcttaaggatgtaaaatccctctttatcccaccatctgatcaatagatgctcaagaaggccaatgtcaccagaagacctggagctggagttacaggcagatgtgagtggcccaacgtgggcctgggaacctctggtcctttgcaaacagcatcatgagctctgaaccctaagccatcaatcgagaacctccctttgttaagccaatgagctttcaatgtgcagtgtccacaacagttttgtctttaacatacaaatgattcatgagggctgtgtgctggtttaggtaaaagcaagaatgttccaggggctggggagatggctaagatcatatattgcagagaatcagagtccagttcccattttaggcagctcacaactacccgtgatcccaactccgggggctctaacctctctggcttccatgggcacctgtattcatatctgaacatgtctgtgttcagatatgatacacacaatcacgaagagtaaaaaataaatatttttattttttttaaagatccgccggtcgggaggcagaggcaggtggatttctgagttcgaggccagcctggtctacaaagtgagttccaagacagccagagctatacagagaaaccctgtcttgaaaaaccaaaaaataaaaaaataataaaaaagagatccagggctggagagatggctcagtggttaagagcatcgactgctcttctgaaggtcctgagttcaaatcccagcaaccacatggtggctcacaaccatccgtaa

SEQ ID NO: 23441 - DNA, 1892 bp, Mus musculus
tgagaaccaccttgctgcaaggccccgcctcctagtgcagactccgccccttcaaacccagccctattacaggccctacaggttgcagcagaattctcaatcgcgggcccggctttttgctacatgtcccgcctctctccatattccttggttgcccctcccttcacccgcccctgggcccagcccctcatctttggttctcttgcaccagggcttccgggtcctgccttctctccgtcttgagttctccatacctctctgtccctgttcttacctagaacattcctgttgcccatcttcctcacatccattggcgcgcccatatttctttcccaacagtcctggggtctgcaagatttggtgaatgactttggaaacctacagcttggacccccgatgtcttgagaggcaagaagagattcaagaaggtcttttggtgacccccccacccaaccccaagtctaggagaccttttgttctcctgtttgtttccccttttgttttatcttttgttgttttgctttgttttgaagacagagtctcactgggtagcttgctactctggaactcactactagactaagctggccttaaactctaaaatccacctgccagtgccttctgagagccaggcttaaggtgtgcgctgcccactcccagccttaacccactgtggcttttccttcctctttcttttattatctttttatctcccctcaccctcccgccatcaataggtacttaattttgtacttgaaatttttaagttgggccaggcatggtggagcagcgtgcctctaatcgcaggcaggaggatttccacgagcttgaggctagcctgatctacatagtgggctccaggacagccagaactacacagagaccctgtctcaaaaataaatttagatagataaatacataaataaatggaagaagtcaaagaaagaaagacaagattaagttgtgcatgattgggtcatatgtgtttgaggcaggaggattgccacatcctgggctatacaatgagaccctgtctcaaacaaaacaaaacaaaacacaccaaaagaacagtttttaaatccccaaacctgaattcttttctaataaagtggacaaccaggcaggccccctcacccatcagagtgtgaacatcaaggaagggagccagcaaactggctcacaggtgagcaagctgactgcacctgaagatcagagttcagatcccagcacccacctcctgtagctcacaattgatctaactctagctccagggtacctggtgccctctcctggactccatggcaccccatatatatgtatgtgtgtttatgtatgtataatgtgtacattatatatgcatacatgcaatatataatttatatgtgtgtgtatatatatatataatgtatatattatatatctccctgtagttgcaacccaacccagttccctctacatagggtgtctgtctcaaaaaaaaaaaaaaaaaaggagtttgattgaggaacaatgacctggtctccacctaagtatgtataacacacacacacacacacacaccacaaaaaatggcacacacttttttggaaacgctgttagacatagccaaaagtgtgtccaaatccagtcaggctaacagtgttaactgtcctttaaaagtcttcctcaccgggcggtggtggcgcacgcctttaatcccagcacttgcgaggcagaggcaggcgcaggcggatttctgagtttgaggccagtctggtctacagagtgagttccaggacaaccagggctacacagagaaaccctgtctcgaaagaaaaaacaaacaaacaaacaaacaaacaagtcttcctctgttgctcttcaatagactattccatcttgatcctcaaaga

SEQ ID NO: 23442 - DNA, 2953 bp, Mus musculus
ctgggagcagggtaaatatttttattttttaaaaaagtagaagcacggggaagaccccagcacccgcccttgctccccgacggttgtttacaaagaggcctcagaaacagggggggaaggccagtgttgtctgggtctcatctcctgggcagatggggacaggctaccctgcccagtacgcctctgtcattatctttcagaggctgatccgtggagccggaggagcccaggaggtccagaccttgcctcaggcagtcaccccagctttctggtggtgtcccttccctgtcccttgccgtgggtctttactatgaactttccactccagccttgtggtgggacacagaggccggccttggccaccggggacaggatcaggacaaccggcacgggctggaccagggaagaggctgcccaccaagcctcctccgagtgtgctgtctccctgccattggcctgtgtagagatgcccatgaacacatccggacaccccaacatgcacacctttagaaaactgaccagttgaacatgacaccattcacagcacaaacagaacttgccgcggcacccttgctccgccttgcacgtaggtcatgtgacaggatctgtcggctgtcatctccgagccgccaattggaccaggctttggtgtgcaaggtgcagatgcttccacacaggctcacagccacctggcccacccttcctcccacaggagttcacattctttctgactcaggtgactttccagccccgccccccaatttctctgccctctcctgccaatcagccgatctgggcacccatgggtgccagtggtatgtgggcagtcagggagggagtgtcccaccactttctcagggcagtccttgtcttctttgtccccctccccacccaacctgaatggcatggctaaggatggatgacccctcccaccttgtgggggttgaacatgaatcaggttgcacacaagtgtgtggtcctgatttggcaagggggggggtgcggtttgctggtttgcacaggtgccctataggctgacagcttcctacctgaggacggctccctcccttgtcgagagcacattgctcacacacccgctgctaccatacgaacctatatggctgggtcctagcagctaccaattctgctgtgtctttaggaggccagcagagtcagtatgaacaagggcaggatgacttctaaacactaccctgccccgtgtctgtctgcgactctatcctcttccttctctagtccctggtctccccctcctttagtcttaatggtccagggttaactcagtgcttccgttggtggccgtcatctgtgggtgacctgaatctagaggatgtctgggtgggccagagagaggagagacaggaacctcagccagtaggctacaggaacctggaggtggggagaccttggtgttcttgaagccccagctcccagagaggtgagggtggctggagcttttctttgctgctgggtttgatggcccaccatattgggggacagaatcccttcggtgtcatgcttcccatccctaggggcatgggactaaatgcctgtacaatttgaattttgatcatgagaccccagggggggctttccaagcagctgccttctgtcttttgcagtaggcggtgaccttttatctcacggggccctttatgaaacccaccagtccctggagattgtggactaggctggatatccctcagggtagccatgtagctctgaactgctggaaactggccgcctagggagaatggcagaaggcttcgagtggctatacacaggcttctcctagcctgaagctacccaagtggacagtaacacgccccctctccacccacatacactaaccccatacagggccagtactccatgagccagcagtggcgaccacctgcctatctcttaacccctccccctgcatatttgaatgtagaggttgggttgaacttccccctccctgggttggggtgaagatgtgcctcaacctctggtgtggacacttgtgcagtgccacagttgagcccatttggcccacgtggttctcatctggtaagatggtgatcttattgccaagttccttccacctcctgcctaccgaggaagtagctcggtgtcagcgaggtggtatcgattttgctttataaatggcgggccagacctggccaccaggtctttgcgcaagaccgcttcctttgcacacagaatgagctacgagctttgttcagacgacctgaatgtattgggaggaattgggcataggccttcccccggggggagtgcgatgggaagagtaagcaggtgtaggctgcagttttatttttgtactgatattggtaaaagactgtatagcatctatttatttagatgatttatctgatagatgaggcaaaaattattaaaaaatacattaaaatgtctttagagacttctgtgtgtctggttgtttgttttgatggtgtgataactgtgtgataccccacccttaccctcaaaccgtagcccaggactccgtgcctcccaactatagtccatggtatgggactatagacatccagtcttctgaacccaattaaaatcagctgaggagagaaatgagcctagcgtgtcagggctgggcctgtggccgtgaaccttgcggttcctctatatcttctaagagtagctggttctagaagactgggtgtcagcagcttgagtgttcagtctcaggctggagaaccaggtcagtcatgaggctgacgcgcacttacatggactctgcacacctgacaagctcgacacaggcagtgcagaaagcatgcactgcttagttctctcgatggcctgccctgcgcggctgtacaggcaggacttgacacctgcagaggaaccttgggtatgtccgtccacagccaagatgagaggtgatgtcaggagagcctctggaggtatg

SEQ ID NO: 23443 - DNA, 1134 bp, Mus musculus
tctcggaagaagccctcggcggcttgagcctcgcggaaggtgacggtgacggagttggcggtgatgtcagtcacggtaacttcacttgaggggagcgtgggtgtccagggaggcggcccattggtcaggtctgcttctgctgcagccatggaacaaagacacgggtgaggtacaggcaccactcggcaccgagtgggcagtcagaagtcgtgaatggtagcacgctgcccatccccccacacgcttgaagcaggatgctttaggagggcgcatgtgcacctgcctagctagctatagcagaatgggcaggggccaggtccagtcagtcctgcctgctccactgttgggtttccaggccccctggacaggggtcagggaccttcccggctttgaggtctcaggatggctgacttaccctcctcctcgggggcttgctccataggctcccagtctccgggggtctgcacaacgtctggggctgctgactcctgcagggagagctcccgtcgatggctgtgactctccaggtggggcccgcgtggcgggaacttcttgcgtgagagccgcaggtacttgtgggctttgcgcgccttgcggagcgggaatggcagggtgggcaccaaggggcccttctccaccagctcagcgacccctgccttgaccacccccatggggctcccgctgcggagcgggcgcgccagagagaagcagagcttctcattgcccttggctttgtgggagctccgcaggtccatgctgtacagccgctgcaggggcaagccagggcgtggcaggtcagcccgcccccctccactgcagtaccttccctctcgctgtaattccccggatatactcagcctcattggcatctgtcccaccctcccctatccacgggccacagaccatactagacataacctaccctcaaacctgctcagctcagttatctctctgggtctcaaacgtgggccttgtctccctagggctgagggtcaaggctgcaggggcttactcctttgatccacagcagaagggcatcaagcatacacaatgaaaaccaacacaacaggggtagggccacagctcgggcctgggttcgatatcaagtgctatttaaaactaggtttctaaagt

SEQ ID NO: 23444 - DNA, 1099 bp, Mus musculus
tggtctctgtgggtccacaaggtgctgcctcagccggttgtggagtgatgttagtctcaagtccagtcacgctgttttggggctggggcaggaagcttagctgcctggttgcttctcagggtcagtgaaacagtgctagaggttgacaggtcctgctgtgtggggggacacacagcatgtctatgagtttctgtgtcaagtgggtaatcagagtaagtaaggaatctttatggctttgcccgaagtcacactgcagaaaagcccagaaggtagtgttgctggacacagcctttgatgaggtgctcaggtctcatcaagacttgggagtttgcctgggggtcacacaacaagtagaacccagctctgatctggagctgtcagggtgagggctgggcccagggaaagccttgaggtcccctgtgtcaaccttctctgcctgccagtaacccatacttgccaggtgatcagcagtcagggtggcacgtgggactgtcatgtgtcaccactgcctcagggggcaccatgacagtgtgtgctctcgaggctgcatttgatggtctcttgatggaacttttggcctctggtggcatggggcagaaaatgcagactactgtgggaccttcctcacactaggttgctgttttgttttgtttgttgttgttttttaatctgtgcaaattttacccaaagttggaaagacaagactccccattctagagctccagccccttaggtatgtcagcgtaccctcctgctctccttcaccaaggctaagctggcagaagagactcggcccctagagtgggccgaaggcagccccagagcccaggaacggcttgtctgcagtggcaggtggggtgctgtttgtgcgagctggattgcccccccccccactccagcagtgccttctcccttcactcctgcagtcttgttgaagggctactgtttcagctttccaggctccttgggaggcaagttttctctcctaaaaggcaggaaatctatagtgtgtctactttagaaacctagttttaaatagcacttgatatcgaacccaggcccgagctgtggccctacccctgttgtgttggttttcatt

SEQ ID NO: 23445 - DNA, 1098 bp, Mus musculus
ggaaaggaaagagataagtgggtagatgatgggtagacaaatgcatgatgggaagattgatgtaggatggatgaatgtgtagacgatgggcatatggatggatgatgacagatggacgaatggatagctgagtgaatggatggagtgaatggatgtctcactgctgaggctgaacctgccattcccaggaccctgcgaggacattacaccatggtcaggtctatctaaagctgaacactgtgaaggcctggctgcttcttaccagtgaagacccagaggagtgggctgagagtgtgcgaggatgcagagattctcaggatcctgtgggattcatgagttcaacaactgtacttatcggtgcctctgagttcaggacgctgcccccatcagtgacggtggctctcacagctctctacgggcttgctggagagccatggagcagaaatatggtcccctctgactggagtgggcacagcagcaatggcaggtctggggggagagataagaggaactgaacctaaatggcccactgtcctgaagcaggccaatagtctgaatagcgcatctggtgcataaatgcatcgtgacggggagggagcagaggaggcctggctgaaagtggattttgacatggacacaacctgttgagaccaactgacaaagccattatccatatgggccaggctaaagaagcttgtctcagttggaggatgagtgcttgcggttggtctggagttcaaagatgagggactgcagcttcctccaggatgtttagtctgagattgctcacctacagagacctcctacccagactaactaacccccccttctgaactgtttctaataaagaagctgaggttccaggctcagaggtagcagtagcagtagagaacaataccagatcttagcttcacggtatatgtgtctgtgcgtctgtcctttccttattacctcaaaaggattctgggtccccaaggtgttagggcttcagtaacaagatacccgaccccgtgccatgaagattgtggttgacaaggtacccagcagtctatacggacatatcttctagaaagagtttcttgttgctcagaaatctga

SEQ ID NO: 23446 - DNA, 1176 bp, Mus musculus
tgggtgataatgtgagaccctggaacgtacactggacacagcaccaagtgatgcggtggcagcgtttccttgcctgcctgccttctgggaacagcagtcagctggtcaagttgaccagcttttagagaatgagctaagaaaaggagtaacacctcaaatatgtggacccagtcagttgacctcacccttaatgccaggtggccatgaaggacaaattgggctccctagagtacatatctgcctcaaaccaataaacacatggcaacctctggccacatagtgacacatgaagctgcaaataactatttaggcagacaaccatccagtctgattttaaaataggacaggaatgtggggttgggattgaattctgatattcagatttacccattgttagataattttgtaatcagtgaactaatcacaggtattttgagtactcattgggaagggacaggaacgtgcccagccccatgaagttaacattctttccaggggtaaccagtcgttggcatacaaagaaactgccccgaaagacccatcgaggtttgcgcaaagttgcctgtattggagcctggcaccctgcccgtgttgccttctctgtggctcgagctgggcagaaaggctaccatcaccgaacagagattaacaagaaggtaaggctgattggggatcctgcaaatgagagagggtattgggttcatagaacagtcagtcctaggaatccatgacactgcctaacccaggtttaattaatgccctaaccctttcccaggaaatttttgttgttattgttggaaatttttaaaggttcaattataagtagtttaaaaaaatttgagtatactgtagctatttcctgacaccactgagggcatcagatccctgtacagatggttgagagctctaccatgtggttgctgggaattgaactcaggacctctggaagagcagttagtgctcttaatcactgagccatctatctctccatctctataagcagtttttatgcattttgagataacagcagcatagcatgcgctgccttggagttgtagcagtcctgtgtctgcctcaggattattaggattacaggcctgagttgctaccatacctagatttagtagtttaagatgcttggtaatggccgggcggtggtggcgcacgccttaatcc

SEQ ID NO: 23447 - DNA, 1176 bp, Mus musculus
agtcttaaccactgagccatctctccagcccagacttctttttctttttgaggaccccaacagccatcttctgggggcactctatacctcagtattgggaactaagagttttgtggttcaggtcccagaagccagccatggtcaccgtagagctcttgataccttcaggactaggcagaaagatcaaagtggcctcagggagctcatttaggaagaaggtaccctaaaaagtaggacttcccctattcctgcccttggctaagacggtgccgctgacaggaacatagcgattggattgagggaaaacaccgaatagcttggtgctgctgcccactgccagcccttcctgaggcagctctgcccttcggcttcctcagcgacctcacccctgctctctctggcagagcctgacagcagccctggccgtacgcagattcaaggagcttaccttccaggaggaatacaacacactgttccctgcctccgcacaaccgtagtccctgaaggacagggagtctacacctcaggagggcccagtgttggagatgtgtgatcactaggacaggaggaggctggctggggaagtcagctatggctcaccattggctagctcatgcagcatcgcttccttggtttattctttgtgtttgttccttcagtaaacatttattgagcagctattttgtgcctgtgtggattagacagggccctggccccaggagcctattggctggggaagagaacaacagccaaccttccacaaagtggggtgggctgttaaaaggtctgaagtgctgggcggtgctggcctacacctttaataccagcactcaggaggcagaggcaggcggatttctgagttcgaggccagcttggtctacagagtgagttccaggacagccagggctacataaagaaaccctgtctcaaaaaaccaacccccccccaaaaaaaaggtctgaagtgcctccaggaagggggtatgctacagacatggtgtgaaggaccagcttggtgtctccctaggctggcttcctacagagggctagcctggagtgttggaggatctgtggcctggctcaattttcccatgccatgtgactgagagcaaatccttgcaccatgctgaatcttagtcaattttcctagcctgactgataatggatcaatgacttc

SEQ ID NO: 23448 - DNA, 1154 bp, Mus musculus
acctcaccccatgccctactgggctctgccgggcagacttgctcttctggtacccgtgttagtgtgatgtcaccaagggtgactgtggtccctgtcctgtaggagcctctgaagaacatacaggcacagggtccattacggtgggaaacgttgcgtgagcacgggcctgaggaagagtcagggaggggacaagggtgtcagaggcctagaagcagccccgcagctcctcttgagcagaaggggaaaccaggaagggaaacaaacccttccgagtcctcgggaagtttccagaaccaggagcacagagagttacagttggatccagactgggggggtctccaagtttgctaggaggtcacagtgttgggagagagccccaggcggctgagtgacagctggctgttgctgacttccatttttcacacctgggaaagggctctgtgtacagccctatgcccccgaccaggtggctcaagtagggacggcttggggatggtggacagtgaccagaggagagactggctatgggaatgttgcagtgccaccctaagtcacaaaaagtctttgctactcacagccccaagccttccctgcctgtgggtactaaacacccaaggactgcccatctgtttctccctggacagcaacggacggcaggggatgtcaggcagagggcagggtgctggttaaactctgcccagctttgggcatctctcatagactcttcctagtgctcaagctggagacatttatgggaccaggaggcgggtcttgagcatctccccttgtcccatgcatgccaccatcatggtagtgatatcagatggtgggtgagtggtccgagcaggatttgagtaagatccaggcttctgactcagtagtttaggagggatcacacccccacagacataacatagcccgtggaggacccaaggccagcagcaccctggatttcctttccctctccacggaccctgctttcctcccacattctctttggagagggtcccccacagccatgccctatggaactggggttcccttttccctgtcaagcacaaaagaaggtctgggggaacatgggttccatgcgagtttagagctgcagagatcctttgagagaatcctatttcatccacggtcatgcacagagt

SEQ ID NO: 23449 - DNA, 1137 bp, Mus musculus
cccaatgagccatctcgccagccctcccttattttctcgagacagggtctcttgctgattttggagtttaccagttcagcgaagattaggcgatcaatactggaagagttccaagggtcctcctgtctacatctatccagtaccaagctctattttgcattcatgctgtgaatccaaactctggtcctcatatttaagtaataagtgctttgccagctaagccatctacctttctcatacaggctccatgtcctaagtgctagctaggatcacaagcatatgcctgcactcctggcttatactctacaggagagaggatccagggccctgggcaagccaagcaagcactgtactgactaggctatatccccagcccaaacagattttttttttaaacatttacgtatttactagggaggaggtgccatagagcccatgtggaggtcagaggacaccttttgggatctggttctttccttccactgtgtggatcgtaaagatcaaactgggttatcagtagctgatctgatactcaatacttagactaggctggctttgaactccaggaggtctgtctgcctctacctcctgactgctgggattaaaggagtgtgctgctgtgtctggctcattgtaaatattttaataattcgtttatgcaattacaaatacctattcgtttttatgtgtatgagtgttttgtctgtctgtgtgtcactccctgcaaaggttagaagagggcatttgttcccttggaactgaggtaagccatggccattaagcactatgtgggtattgggaattggacctgggtcctccgcaagagtagtaaatcttcttaactgctgagttggctcttcagcccctaatttgtttatgcaattcgatttcctcaatgacaaagagtttattgtaaaacccctttgttaacatgaagcatcttgggaacacacatgattctcttcatctagagagggttgtaaacttttagtttgatttctgggtctgatgtttgttttttgttgttaataaattcatttaagaagtctttcctgggggctggtgagatggctcagtgggtaagagcacccgactgctcttccaaaggtcaggagttcaaatcccagcaaccacatg

SEQ ID NO: 23450 - DNA, 2918 bp, Mus musculus
actcgtgtcagcccagaatggcgacttcccccgctggggtgactatgaggacaagagggacctcaattacatccgcagcttgatccgcactgggggatggttcgacggaacgcagcaggagtaccctcctgcggaccccagtgagcacatgtatgctcctaaatacctgctcaagaactatgaccagttccgctacttgctggaaaatccctaccgggagcccaagagcactgaagagggtgggcgccggaaccagggctcagatggaaggccatctgctgtcaggggcaagttggatacagtggagggctagggctgtgcactttcacagggctgggtaggctgaaataatggctaagccagtgctatcttaggcctcctccttatcccggggcacttgagagagccaggagtccttgtagatggatggtcctctgtgctcaggcctctagaattaagggtcaggcctttcaccctaaaacagaaaaaattactttctagtagagaagagcaagcccggacatctatgcagcatttttgttcccaagagtgctgtgggaaagaggtgttcctggagggcataaggtggtgttctgggactgggagtgctatggaacttcagtctagttaaagagaagccccaccgttgacacctgggactgttgtccattacaggacaaggaggtataccatgccaggggttcccagaatcttgtaaataaatgcatttgggtccaggagcaagaagagacagtagggagggactagaaactgtatttgctcttgatgtgggccaagaagctagggaagcattggaaggtaccctggagagaacacactttgtagcttcctcagacatgcgggacccaagggatgaggtcccgcatggctgagaggatgaagctcgttagtcagtcccattgcctctgtaagaaggcatgccgggggtgatgcggaatcttcctctggtcccaaatatacccttgatagctgttctcacttttcctgttgctgtcttgtgggagccacttgcaaaggactctaggagtctagtttttggggtgggacaggagctggagaccataaggacagccagtatagtaggcgagacaagagaaggagactgacagaggcctctctacgcctctctccctccctatcactctctgccggcatccagtcccatattacagcgtcccaaatgtaaccagtcctgtgccactacgcctccacccccacacccgtaagagcaggctaggggccaggaagggaccacaaggttctcctgggtccaagaaagaacattaaggtcagtggtatatcaacccatccctcttaatttgccttgtgtgtgggggggtacaggatgtatttcagaagatgctaagctgctgtagaagccccttggcaaccagcaagcaattcaaataagaccagcttgttactaagtaaatagtccaggaagagatggtccaaagcctattagacagtcagcttagcttcacatacaactcccaggtctggatagaggggctgcacctgctcacatgataagaggagaaagtgtgaactcttccctgtgaagggcaggagtcagatgtgtctgttgcttctgatagtgtcttactggtctggacttagctgcatggctataggtagttgcaaggaaaactgggaaatgtagttttgagcaggactgccatatgcctgcctccatttgagagttctgtattactagcagcacccttaaaggaagggtacaaatgattgctcattaccctgctctcttcctatctgccctggggttgaggtacagtggggacttgcaggtgtataggaagagtgggtgcctcttcctgaggcccttgacgttcccttgatgccagtatgcagggctacctgtggaatggtccgtgtttgtgcgtgtatgtatatttatgggcatgggtgcatgcttggtgtgtattgtacatgtctgtatccatgtgtccctgtacaaagatgatactcatgtgtgggcgtaggagcctaggcttggctgtcctcttccttaggacctggatcttatagtctcatctcctatggctccacgagatgcccgagacaggaagtccttgggggaaccttgaaagcaagactagaagggagtacagggtctgtctgtctgtctgtctttcagtctgagaaatggaatcttcctaggtatagggatatgcagctgagagcccaccactccctcagcccctcttggctctctacatcctccccctgccacctcagcatctcttggatgtagctctgtctggagtagtttgccaggtggtggctgctctgacaaacaggcatgaagggctctatggcttctctcctcccattgaggaacaccctccatggaacctctccttcaaagagccttcctctctagttcctctagggattgagaggtggccacagaagtcagggcatcccagggactgatgggtccatctgagccagggctctctcctgagatgtctgtggatgtttctgtgataccttcccccttgaatgaaatccttaccccacactcttggtaccctcagctgcttcattgatatcctgttccaggcatttcagggctcctgcccacaagtgaccaattcagggagggagaaggaccctgggaaagcacaggtctgctgggctggccttccttctcagatagtacaatagtttcaattaggcaggaagaggcctggccatgggctgagagaccaccctcaagaggtgggagctaaagagtttcacatataaccacagcatacactgggaagttgaggggcagggaacccaggaccattcccccaatatgaagagaaaccgaattgaatgtgaaagtgggcacattctccaggaaccactggcctgtgacctctaga

SEQ ID NO: 23451 - DNA, 1196 bp, Mus musculus
gggagtcagatctctttacagatggttgtgagccaccatgtggttgctgggatttgaactcaagaccttcggaagagcagtcagtgctcttcactgcggagccatctcgccagcccagacctttacatttgtattgaaggcaatgtcttgctgtgcagcctcctgtgtagaggtgcaagtggggggtagggaggggttgtgttcagttacaaatgtacaggccggttcttttctttttcaggagaacaccaaatggcaggtgactctggtgcaccctgggcccaggattaggaggccttgatggcttctgcggagggttcggcagaggtcttaggggccgtggccgtggtctaggcctcggggctcgtggaggtaaagctgaagacaagaagtggatccctgtcgccaagctgggccacctggtttaaggacatgaagaccaagtccttgggggagatctacctgttctccctgcccatcaaggagtctgactgagatcattgactttttcctgagtgcatccctaaaggatgaggttctgaaaatcatgccagtgcagaagcagactcgggctggccagcggaccaggttcaaggctttcgtccctataggggactacaatggtcacgttggtcttggcgttaagtgctccaaggaggttgccactgccatctgagaagccatcaccttggccaaggtttccatcatccctgtgtggagaggctattgggggaacaagattggcaagccccacactgttccatgcaaggcgacatgtcgctgtgactctgtgctggtgcgtctcatccctgctcccagaggcactggcgttgtctctgctcctgtacccaagaagttcctgatgatggccagtatagacgactgctacacttcagtcaaagactacactgccaccctgggcaacactgccaaggccacctttgatgccacctccaagacctacctgacccccgacctctgtgttcaccaagtctccttatcaggaattcactgatcatcttgtgaaaacccacaccagagtctctgttcagctcgagctgtggctaccacaaaagggtttttatacaagaaaaataaatgaattaagtctgttagaaacaaacaagcacacaaacaaaaaacaaatgtacatgtgttcatgtgtgtggagaggttagaggtcaacatcagaagtc

SEQ ID NO: 23452 - DNA, 2957 bp, Mus musculus
aaatagacgagttgggatataccctctactgctcgctgtctgagccggaggtgctgctgcagacgtagggcaggtaaaggcccagtctctccgttagaaacacttggctacgtggttggtgcctcacagggtccctaggtgcctcctgttttgctggtaattgtcctggtcacttcatgctgatgagattgacgtccctgcggtttccccacccacccctatttttgtaaccaagcactgtgctccccacttgccgccttactctaggctgagtttttttgttttttgtttttttggttttttttttttttttttttggaacaaacagagggtgtggagtgctggcctcagcctttgggtgttttgtttttggcccggttttcttgcttttctgtctgctatgtccggttctgccccttggcctcttgtttgctctcttctctatctttctctttcttggtcaccctggtggctcttgtccccagagtacatttgcctaatgaagatgttgcctgtagttgatgtcacagaagagtgattgcatgtttccaggctgagctctgcagaggaataagacagtatttaggtttccagggtgaggctggcaaagagcctctgccctggcaaatcagcctttgcccatggttcctggaaaacaagcttatctcctctccctaccctaagcaactcctctttatctgagctaaggcttttgatcgtggggacggggcattgaccaacactggaggcgccggctgcaactgttttatcagaggcttatgaggtgcttccttatggctgtcagcggaagctcagggctagcacgctgaagctgatttggagagcctgtgtctcactgtttgtttctatgtgtggtcatcagagtcacacagacaaggcaggtgtgggggcttcacaggcagcacctgtaagatgctggtttccccttaattgctggtagaaggtggccttgctttagccacggaggccatgggaaggcaaaaggagggaatgccagccgaaacccagtgaccacatttgctttcttgtcaggctttatctttcttaggtgttgccttagagcaggaacatacccagggccagaacctcccacctgacccctgtccttgccactataggtacctccacaggccagagggcacatgaccatgccagccctgctccctcacttgactcctgggaagattggtgctacctaggaagagagtacatagataagacccacagaaaagagttggggcttcccaccttgctgctaagattgctatatatggccatgtaatcatcctatgggtgggggaagggacatttggaatgtcatttctatgtgtcctttttcttccgttcatgacaagaggctgacagtaactctggttctgatttgccattctagtattgtgttctcccatcaggtctttctttatctgttcttactacctctccatcagtgtgattctggtgatgcactctgtggctgtgttgttcctaatgagggtgacacaaaatgactataaatagcactgactctgcagcaacccatttgaaattagggtagagacacacacccctctccacaggttaggaggttgagctaggctatatatttagccttttttcctgttctcccacacatgtgtaaagacttctaaaggagtttctttttgatttgtataagatagtatgagaaacgtgataaagccaagaaccttaactgaaacatgccctcctggtagttaataaaaacaaagtaggagctgaaaacatctattgctaagttggactgagtaggcatggaagggctggcatagacagtccaaggttcttgctgctgcctgttggagggagagctggtagaatgctgcaaaaccagattttagagaggagttagatttcctgtcagaagtattataagactcctcagctgccatctctgaactgattccatttaggatgccaggcagagtgcaaatgaacccccagaacttgaagatgctcaagattccaaatgtcctaaatcacagccatatgttagtgaacttaggaaaagcaatgaatttatcatttgtcactgtgaatttaggaaaagcaatgaatttattgcctgtctttatgaacagctttgactttggactatgctttgcaatccaagatcatgacttggccatcttataagcaggaacctcttagaagtcctcagaacaaggacaaatgggaccagctctaacctggtgggtttgtggattagctgggcatgccttctttgctgtcattctttgtcataaagtatgggaggcggccacatgctctgggatgcttggatggaagaaaagatgctctgccctgcttccctctttgttgaaagacccagttggctgtgccactgctctgcctttctcttcagttactcccacttttgcctgcaggaaattccactgttaggcccctacttctgtttgggaggtattttgagagtgtcaagattagcagactatatacttgatgcctaaaactgtacacattaccctggtaaccaagtaaatccaaatttatttatttatttattttttggttctttgttgccctttcccaaaaatggaattcaggatagcagtattcttctaagtatcaacagttggaatttaaaaaaataaagagaaaaactgttggagtggcccatcatctcctactccactgtaatccactgcagggctggctctgatggttaagatgaatccgcttcaggctgggagatctgagagcaggatgcactgtgtgttcagagccttctaccaaggtacatttccttggcattatgacttgataaaactgagagcatttgctacaactttagcttttttagtataaaagctcaagccaaggtaaatgaggaggcccttgggaacacagtgacccttgtaccaggctaggaggttaca

SEQ ID NO: 23453 - DNA, 1201 bp, Mus musculus
ggtctatagaaatctgtgcctgatgctgctgtagatgaagggatgctgtagacgtagggatgctgctgcctggggtctcactgtacatgatgcctgtactctgtgcttggtggggtcaccccagctcaccccagtagcagctctgcctcagaacaatcttctcatttcgtcggcagggagcaagcaccaccaggctgtcatgtgccaaggtgggctggggtcagagctggcactcgaacacaggttacagttctgagctctatgctcccaaaacaccacactgaaggttctcattccattacagtaaggtgagcccttcttgttctaatgagagcaagagcccatgattttgagattcccgaactctccttgtattccctgaatgatttttattgcttgtttgagcagtgacattgtctgctctgtggttgttgactgaagaacaaatagattacttgataaaaatgcccccccccccattggctggccaggataggcctcaggtatttactagggctggagaacccttggtgctatctggaatactccagaaggtaggcttcctactgctttgggggactgagggcctagtctggaccggctgttgtgtctccactgcctcttgagtctgcctggaggggaaacctgttttcacggcacccactaagttgttgctgcaataatttgggttttggacttgggcagacttgagccaggactcatctcttccaccactgccccgtgtcagctgggtgacattgggcactgctggactcctttgggtcctaatcttttcctccaagaaggaaaatattcatgaattgtgggattggcacagggccctttgatggttgcctgatgatgatgatgatgatggtgagggtggtgatagtggtgctgatgttgatagtgctgatgctgatgtggtaatggtgatgtgataatggtggtggtaaagtcagtgaagttattgttggtgatagtggaggtggtgatggtgatggtggtggtggtggtgatttcgatgacaatgttgatggtagtggtgatagcaatggcagaggaagggctgaggtagcagcccctacacatggtacacatggtacacatggtcacatgcatgtttagacatttttcccccatgggttccatcatgccttccatccacagcgcattgcttcttcacaggggcttgaaggaa

SEQ ID NO: 23454 - DNA, 1205 bp, Mus musculus
gagaccagaagagagagagagcacattagagtcccagaagctaggcagaggtggttgtgaaccatccgtgtgggtgctggcatctgagtactggggaggctgcaaagtgctcttaatctcttagccatctctccagccacttctctggagatttttaccattcttattgtttttattaaagatgcattctcctttgttgtccaggctggcctggaatatctgggttcaagtgattcttcatccttagtctgctgactagctaggagtacaagtaacaggacactgtatcagatttaatgtcatttcttctcatattattttatattgtaacagtttacagtcaatttgtgttgtaatcacgggtgataaggcacaagcactgactaatggttatctgatgaattagagccagtgacagtagtacatagcctccctcttcttgtcagcgtgtgcctgccgagtaacagcttggttgtcctggactgtgtgtattgacatcttcctccttggatgctctgagaacagagctttgccttcctcatttttgctcctgacctggcttgtgctaggaaatctatagatctgtatgctgatttttgtgtgttttgttgttttcaagacagggtttctctgtgtagactttcctggctgtgtttgaactcactttgtagaccatgttggcctcaaatccaaagacccacctaccactgcctcttgagtgctgtgattaaaggtgtgtaccaccgtgcctagcccacatgtactatttaaatatttctagttagatagtagttaacactctgtcctttgaagacagaggatcataaactgtgagaggcttttggttcagtgctaaggattgattgaatcaggggctttgtaaatgctgagcacggacattttgccattaggctaaatctctagctctccagcatatttttatattcctccttttttgagtgtacatttatgtttttcccctttattgaggtattaactgatgttcagaaagctaaggatatttagtgtatgtaacttgtatatttggagtagatttgcttcttaaaacaaaactgttcatactgggcatggtgacagatgcctttaatcctagcacccaggagacagaggcaaacagatctatgaatttgaagccagcctgatctatgtagtgagttctaggatatctggactatacattgaga

SEQ ID NO: 23455 - DNA, 1195 bp, Mus musculus
attcctctggcccagggtatgtcagtcaagtctggcgtgatgttttggacatgctgcaggactatagagcagtcaagctgcacaactgaggacagatcaggtaccagggtggctgggtttagggcagaagatgggttatagcttatgtgagggggactcaaaagtagagcttgaaagtgtaccaggctggcattggacagccatcagataggtggaatcttgagaactacaacctattggggggggggggcgttgataacaagttactgccccatgttttgttttgttttgtttggtcgttatccttgactaacagctatgatctggaggtaggccagccatccttggactattgggttcagcttctttttcaatggccccaaagtttaaatgagcacctcctttgctatcccctgtttctcaaccacatacaagtggaaaggtttatgaatgtccaggagctccagggccagcactaacagtaaggcttttcttaaagtcttaaaagccatctctatctcaggggttgattctattttttttcttcttggcccctggtggcctcatataatggtttggctatctcagtgaaccctggcacacagagtctgcaaaaactggcagatctcagaatttcctgtatttgccttcaggttgatggaactgggatgttaaggatggtttgcttccaggcttctgacagcatgtcttggccccccttgagtatttaccccagataggtgacctcaagttgacaaatctgggccttattagcagatactcagtagccaagttgactcagctcctatagcagagctcacgcggcctcctggcatgtttccaagtctggggctgcaatcaggatatcatctacatactggaacatatgtacttcggggggatgggtccattggtacttacccaagtcctcatgggtaaagattgtcaaagatggtggatgagttcttgaatccctgaggcaggcatgtccaagtcagttgtcctttgaaacctctctccaaatcttgccctttgaaggcaaatagaggccagcatttggatgccagaggcaagcttttccccttccttgagctaggctcttaagctctctctctcatcaggaccatcatggcttatggtagcaattaagtagcactttcaccagtcctctgctctatccatccttggggtgtct

SEQ ID NO: 23456 - DNA, 1066 bp, Mus musculus
gtgtgtgtatatatatatacatatatatatatatatgtatgtacatatatatatgcacatacacacatacatataaatatatattttagatgaagactaactctgggagcatttaacagtgtttttgttttttatttttaacattattttcctgctttaaaatttgcaagcattctcaggaattctagggtaggaagccagttttttgaagatggtttatttaattgtatcttatcctagatagacagctgtttctttcctgttagtaaacttttacaagttcctgaaacttcaaaaagtttaaacgatttttacttataaaaatgtaaaaagaaaagtctccaaacgttattatcatacaggggatcacacattttaaaatacatagaaatattttttaaaaattaccaatttagcagcaacaggtaaattcattatcttaacaactgtgggagaaggctcagccattctgagtgttgtcaccgccttgcttgacattgtgcatggcttactgggggggtgactgttgagctcgtaggagtgacaccacattgttccttctgtatgaggctggactgacgtctccccgtcatgtttctgttctccagtgcagcccttcttctccctggctctccagccccatcaacaaaagcaaggaataaagaaagaaacagtagcttaagcaaaaggatcggctctaaactgtggcagtgcggttgctggattgctgagaatctctgtaaagagttaggaaatataggttaataattttttaaacgaattttaaatatgagcattactaaaggaaaattacctatggactgttctgttggtgaaaagtgtgtgtttcgcctcccatctgttacaggaggaggaaacagaagagtctaataaggaacaagtggttttacttttcattttttatttagctcccagctactgtttgcttgttttaaatgctgttttgaagatctgctgcttactccccccatcctgggaggcagagatgtggagtgtttccttttgatttgggtgatgttgaattctgcttttgtattccctcctg

SEQ ID NO: 23457 - DNA, 1335 bp, Mus musculus
aagccagaagtgttctattttaaataagaaagaaatagtatttccctagggctctacctgcttcccttagtgcttaggtttcacagtgtgagtcagcgctggaaacaaactctccattacagttgacccttttcccagtcagtatccgaaagttgagatgacctcttctaacagggaaatcccttcttagatctctcgcccttctccctggcttcctggaccttctggtggggcatgaagtttttcttgggccactcgtggaggttgtaaaagggacttgaggcagatggagcagccttaccttctgtgcctggccttacagcaggaaaaggtggtggagtgctgaatgtgtatgccaaaaccaaaccaacccttgggggatctttgaagaggttacataccttgtaaaggtaggatggtcgctcaccaagtgatggcttttagcatgaaacttctttttgccagaagtttggggttatgttacaatgcttgtgtttaaaacactgcccccctttaattctttccaaggaatctctttaagtgtagtacttctgaatgtgcctttgtcagcccagagaccaactgtggtctgtcagaggttctcctggcagccccaggggcagctgttggatttccatgagcacccattttgcacagtgtgagttgtatggaagagattctgggtcttggaccaggaccttataagcaaggccagggcccagcggattccactgtagtcagctgtcgacatctgcattccttagtgttctctctctctctctctctctctctctctctctgtgtgtgtgtgtgtgtgtgtgtgtgtgtgttgtaagcactagagatttgggattgggaaagggtgattttttttgtgacccgttcattcttgtaaagaaggcatttctggctttgtgctgcagaaggtgcttttttttttttagtttaattttattttatttttaccctctctgccttagaaggtcatgattttcccaaatgcaagtcacatcatgttgctatttctgtgaacagggtatttattgcacataaaggaaaggttttgaaagaattgagaccggtgtttaaaaaagaagaaaacctctgaaatcacgttgtagtttttgagaactgttgtagttaaacttggaagtctatggtcttttcatgtttcatgtttgttttcaacgaccccacctccactcctatttccagtttctaaagaagcatcttagtggatgcccaggggcctgtccaccatcctcagtgctcccctcccccaggaaagtgctctctagattccttcagcttcattcaggaagacactcactcctc

SEQ ID NO: 23458 - DNA, 2141 bp, Mus musculus
aactaaatgccatctcttccaccaccaaggccccagggtgggcaatatctgaatttctctcttccatatatgatccataccctccagggacttcaagaagttctttgccgtgtgtgtgtgtgtgtgtgtgtgtgtgtgtgtgtgtgtgtgtgtgtttacatgtatgcacttcttgctctttaagtgtggtcctttaatccccagtggagtttagtccctgattttttagtctgtcccgtagcctttttagcaatgttctggaaatgtatttcttacttagaaggaaattgagcttagagctgacatccttaaaaatccttgttggcacatgctgcctgtgagggtgctgacagccgctgccctcctagaccgtgggctcccttgaacaagagtagaagattcattttatctcattttaactcaaatctatatctgttaagaagctatagtcaagagtgctttccttgatctgtttaatgacgacttcctttgagggaggaatctggttgaaagtgatggacatcccttgcctatcttctgcgtggcactgttcccttggatttgacttctgtagtttgtctggaggtccttgcttatcagtgtgctttctcctatcgacggggttctgcctgcccttgtttccctctctgatgttcccaaagggctttgctgatgtctgcacctctttcttggggcattcccctactacaccctttgcacacaccagtgaccaaagtgtatgcagtggtctcaacacatgacatcaaatggtgcacgcacctctagtgtgctcacagatgtgcacaagatctgcacccttggccttaacttcagcacgacttaaggtgcaggaacatttttaacaggtttaaaaataaccttttctgggagggaaaatcaagcagatccaaccgctccccactatctgcttgcaactcattctgcatccagcccagcccagccctgttttgcgtaaccaaaaccaacaacagaaagcaacctaaggagaggtctctggactgttttatctttctccctttcgatggagatacaaatgctgctttgggttccataatcctagggggctatgtttacatagtgaaactaattctaccaaatcaggaaacagtgagtagtgagagacccttcagtaagaaatcactgaggctgaaccagaggtttaaagacctagggatgggacagaggaggagagagatcctgtttaactcactgcaacaccagggtcactccctcctctctgctctccctggccctctttgcccctttaatcaaaaggttcagagaaagacaccagaaagaggctgaagtttttaagaggcagctttccaactttgcacacaaatggaaggtaccatgaaaatcctctcatccgaaacactcggcagaaacaacctgtcaaatcaaaaggactaaactgctgcccacgttgatgcgctctgcgagttacctataagtgttttgttttcttatacttgaaaacacttttacaatattatgttggtggctttcttttctctcttctgttgggcaattgaaactgcagatgacaaatgttaaggctgtttgaggggagaaaaggaaggctgtggcattgtcgttttaacatagaggttcagtcagactcccatagggtaacattgttcatcttactggtttaacatggacacagaaactaggcactttggtggttcacttgcacggcaggccgaccccctttctatattttattttacttttttagtatagtggtacttaaaatcactggttcacttaaaaaacaaatgttaaactctactaatgtacaaataagctgaaaagttgcattttatgtgtatttttgccatagcaggtactgtatttctcatgctggatttcaaaaaaaaattatatatatatatatatatatatcaaaaacaaacaaaactgaagggtggtgttttctcagattgtgacaggttgattggtaaggattaaagtcgtagtcatttcattaaaactgagagatgatgtaatgcatatataagagttttctgaagggttttttgggcttttaaacagcttattttgtttttttttttagtttttattttattttattttggaaagatatgattgtatta

SEQ ID NO: 23459 - DNA, 2141 bp, Mus musculus; identical to SEQ ID NO: 23458

SEQ ID NO: 23460 - DNA, 1106 bp, Mus musculus
ctcacccagtgggagtagctgagactggagactgtctgtctactaaactaggtcataacagtagctaccgttcattaggcaccacctgcttacgttggtgtcccaggaccttatgtgtgtctttactgaatcctgcagagcccaaagcccctgtacttcccacacttctgccttttgagctttgcttccaccggtctgcacaactacccatgtcacgtgactttgttagattgcaatttcttcctgttgggattcttcattatactgccccaccaccaccaacttctccacaggtgccccaggctagcctcaaactcactgtggtgatctgaccgagactgtctcccataggctcacaggcgtgaattcttggtctccagttggtggaactgtttgggaaggattaggtgtgcccttgttggagggagggagtccctggggccaggcttcaaggtttcaaaagtctccgcattttcagtatgttccctgtctcctgctcttggatcaagatgtgagctcttatctgtccctccctctgtgcctttgctctgccatggtgaactccaattccctccccatcccctccccagggctgaattaaggctaacgaaagcccttcttttccaagttgccttggtcatggtgttttgtcatggcaacagaaagtcaagaataaccttgaactttggctccgcctccctcaccctctgaagtactggagttactgttgggtcgaccatgaccacgcctacgccttgtttacatggtgctggggaacagagggcttcgggtgtgccaggcaaacgttctaactgagctgtctcaacccctctttctcacctactcatctctgatccatgtgtttggtaatgagcctgtgtagaaagatgtgtggtcacgaaggttatacatactaaggagttttacaattatgatttccgactttatagaagagcttccttttaagagggaaaactgcccgagtgctgggacttttatggtggttatggttgttttctgagcttttgttttgtttaattttactgttgtaactaaggaaaatacttcaagccaccagagggcattgtagttaacgttgggtgctg

SEQ ID NO: 23461 - DNA, 1214 bp, Mus musculus
acctcttttccttttaggcgctttggaataatgggactctacaaaggcctggaagctaagctgctgcagacagtgctcacagccgccctcatgttccttgtgtacgagaaactgacagctgctaccttcaccgtaatgggcttgaagagcacacataagcactgaggcccgcccacaggacagtgtggagacgcaggtgctgcacagggagaagaggaacagttctcctttcccgttggtcccatccacaccacagacattccagtcattggctgtaaaggcatcaaaggctaagcagggagtatagccagctaagcctgtcacctttatggggttttttggtgtttttatggtgtttggttgtatttgggggtagaggttagactgatatgaaaatattgaaaccctgaaaatgttagtttgtgggtgttcattcatttttctcaagggggtggactttccattgaaagcttttctcaactttgccacttgttttcttttgctaaattctctcccaggttctagacgattcagtaccataattctcctcagatgcttttgtcttaatcttggtaaagagttcctctgagaataacatcatgactgtgccatgggcatgactttgtttccatctgactcttttcctcctgctttaagaaagctatttattttgtgggggaaatgaaaattactaacctaaatgattttcttaaaatttgtaaatgtcaattattcattggtgtttgacataggttttttttaatacatatttatttcgaattgttttatattacaaaaaaaagccttgatgttgtatgtccattcgtgcaagctccaatcacataagcctcaataaattgtcagcacacatacagaaaacattcatgaaagttgctcttgattaaggccttaaatgtgtgtgtgtggtggtttgactgagaatggccctgtggcgtgcttagtttcagttggtggaactgtttgggaagggttaggaggtgtggcctagttagaggaggtgagtcactgggggctgcctttgaggttttaaagcccacatgatgtctctctgacacaagactgtgcctcaagatgtaagtaagctctcagccactgctccagcgcctgcctgcctacctttctgccatggcggtcactgccctctatccctctgaaaccctaagctccaaatcaagtgctttctttttgctttt

SEQ ID NO: 23462 - DNA, 1193 bp, Mus musculus
gggtttctctgtgtatccctagctgtcctagaaatcactctatagaccaactgagaaaaatttcacccgtttctaccatccaagtgctggtattaaaggcaccactgcccagctaaatttaatgtttaataaagcaatagtgttgttgctcaagagttgaggatttagctcactgatttcatattagggcctggtttcagtgccagtagcacacattgcacaagacacacacatacagagtttgttcctatcagttgcatccagacagattgcattatttttcttcttttttaaatttctttgaatttttattttgagataatttcagagttgcaaacaatttcaaaactgaaattggtacagtgcatcactgcccgctttacgcttttattgaccatttttacgtttccacttgccctccctgtgtttccgtctttagcacacacacatatcataagacttttttgagtttgtcagttatgtgcatcagagcatttaacctctatgacagtttaaaataatatattctcccctccactttcttttcaagataaggtctccttataaggccctggctggcttgggacaagctatgttgaccttgaactcataggaatccaccttcctttgcctcctgagtgctgatattaaagatgtgaattttaattcttgttttaagtttgcctgcatgccagaagaaagcaccagatctcattttagatggttatgaaccaccatgtggttgctgggaattgaactcaggacctctagaagagcagtcagtgctcttcacctctgaaccaatgtattctcaataagaataatgagtgccgaggtagtacaatggtgcgtacctgtagtgcccgctctgtaggaggctggggaagaactgcttaatgcaggtgttcagggtcaggctagacagtatgatgaaacatccccctctttcctgctggcctcctgtggtccatgtgtgctttctgtcgtatgctgtagctacttcctgcagctctaagcacctgtggggagaaccttttaaggtgctgcagatgtcctgctctttgtcataccgtgagattgtcagtagaagccagacttttcctggcttcatactacttacttctctcagttctatgtcaagcaagagaagggagggatggtttattctgacttccttcacagtccatcatgat

SEQ ID NO: 23463 - DNA, 2209 bp, Mus musculus
aaaacccagatgaagctaaaaattcaaacctctcctcttttttccgtcaggatccagaagtcatggtggctttccaggatgtggcccagaacccatcaaatatgtcaaaatatcagagcaacccgaaggttatgaatctcatcagtaaattgtcagccaagtttggaggccaatcgtaatgtcaaagcccttgctgaatgaagaacagcttagctcacttcctggatgttgcaataatacaaaccagtgtacctctgacctcaccgggagagctggggcgcttcgaagataatccctaccctctacatcaaatgcggctgaggcattttacagtggtttgccattagcgtgttcattcagataatgttttcttactaggaattacaaacttaaaacatttttcaacctttaacatattttgtaaaaacttaggggagtcaattcctccatttttctttactaacttgggcttttccttttgaattactgggcagggaggtgagtggatgacttaatgatttcatgaatgaaataaagatttgttagtgggaagcaaataaaacacattaagttgattgagttggacatacggttcctgaagtatcttgatttgtgtttttttttttttaatgttttatttcaaaatgatctatttcagtaaatctcttgggaccaccagtatttggatctgaccttggtaggactaaagtattgggcagagcagcagcagtcccaggttttgtttgacctgtgtaggctgcatttaaatctttaaaactgctttggtgtcgtttttttttttttttttttttttaagtgttacagcttcccctagattacatagctctgctgttgtccattgtttcaaataaatgttctgtagcattcccacatagagaaaaagagtgctttctgtttttgtcagaaatgacctttcctattagaaaatgccctgtctgcttgtcaccctctgaatcttcttgagctacaggtagtgttttcagtaccatcatcacttctgtcactcacagcataattgtggaagcagattcattgctagtttagtttcatatataatatatacagtaattgtagggtcatacctcaaatgctggtatcttacttggccatggggttgcttgtttaaatattaaacttacccttgtgacctctgtccacagtcatttgaaggaaggatttcctttggttttagctatgcttatgaaattgagaaacaattgcaatgttaagagtttatgtgaagtatacatctttgtacttggaagagtctaagttgtttatatttggtaaaaggttcatttgtcccttttagctcttaaatatctcgatgtatttaatgccttgttttctctcctgccgcaggataaagaaaatgataaacccacaaagtgcatatttcaaatagcatatatctgaaatcgtatgtctgtgcaggtttaactgctgcatacagcgggcacagatgcatcttgttacatgtaagaaaaagctgtatttgaacagagcatgcgtttaaagcccttaacaaattcatcacataatcttaaattggaactttgcacggttcttagtccaagtgtgctctcctttcatacagtttccatggtgtgagtgctttactgaagatctgtttcttttgtactctgactacacatgacccaattatattctaatgtgaaaatattagcataaataggtgaaattgctcttctgaaaattgtgtcctgtgcttttagactttggagttccacagatagtaaaaatatagccttcacaattttttaataatcagtatcatttctacaccaaaatattgtttttttccctcactaaagacaatataaagaaaaataatctaagaagataaaggggctttctgcttaaagatatgtagataatattcctaagtatgctgaaataaaatactgtttcaaactggatcttgaccttcccccatttgttagcctgttatttatttatttttctttgtggagtgtttatctgaagttatgtgataggtacagtaggctgttgatgttagtaatgatgtaaatgttagcagggacccctgaaggtgagcatagcagctcacatgtgtaatgagaggattctgaatttgaggccagtctgaactgcatagcaggactaaaaaaagactttttcagtagctttttagaagttctgccat

SEQ ID NO: 23464 - DNA, 1194 bp, Mus musculus
gtctttacacggtgcctaaaaccaccattctaccatcagctgtcagttacctatagcttctcaaattagagtagttagtctctctctccagtttccatgagtttggtttttatttttctgttaagatgaatctgccatttcttagagatatatattaaacaagtcgttgtttgtttgtttgaagtgggatttctctgtgtagccctggctgtcctggaactcattttgtagaccaggctggccttgaattcaagatctgcctgtctctgctgcttgagtgctaggatcaaaggcattcaccaccatgaaggccatgaagtaattctttttttttctttttttcttttctttctttcttttctttttcaagacagggtttctccgtttagccctggctgtcctggaactttgtaagaccagggtggcctccaactcagagatccacctgcctctgcctcctaaatattgggattaaaggcgtgcgccaccactgcctggcctcatgaagtaattcttaacaaaacttcagtttactttatcaaacattgcaggtaaacttacttcctttgctttttttttcaggctcaaaaaattgctgaacatcggagaaagtatgagcgaaaacgtgaagagcgagagataaaagaacggatagaaagggtgaagaaggctcgagaagagcatgagagagcccaaagggtaaattcctgtagaatcaacttgagggtgtttttctttgcctgatggctgcaggggagtcttttgttttatttacttttattttatttttatttatttcttttaacttttattttgttctttttgcttttcatcttacatgagcttatatttcactaatttaaatgtttgttcatttaaaatttgcgaatttgggctaagagtgtaatttatagactgcttccctagcagtgcagactcctcctccatccacgcccagactctggccagacttattacagcgatagtactgtgttgtgtattagaatccctgtaggattcttcttcccaacagcaaattcatgactattgaaaaagttctagctgtgcattgtggatacgtctgtaatccctacattcaggaggctgaagtgggaggacttttaccttatattaaaaagttaaaacaaaaacaaaaaccaaagcaaagcaaaactccaaaattggttacatagt

SEQ ID NO: 23465 - DNA, 2037 bp, Mus musculus
ttaagaacactgactagaggtcctgagttcagttcccagcaaccacatggtggctcacaaccatctgtaatagaatctgatgccctcttgtggtgtgtctaaagacagctgcaatgtactcattatacatcaaataaataaataaatcctttaaaaaaaaaaaaaaagcttgtgtgaactgggcatagtcccttagcacttgaagcaggcagatctctgagttcaaagtcagcctgatctacagatcaaattccagaacagctacacagaaaaaccctgtctcaaaaataaaatacgcttatgtgacagagggaagccctaagagctagtgtgtaaacttcttttaaatctgagtatgtgtagtcccatggtaaacaaaacctgctaactgctacaacataaatccaagggttttgtgggatctgcccctactttccatatttctgttagggaagtgcaagctagaagattagcaaacagtctctgcagtgcaggtagctgacacatcttaagaaatttcacagtacacctagaaaccagcaggggacaaaggtagtgtgagaactaaacattaggacacaaatggccctctgactactcatcctcaaggccttatcagtctctcctgagggctgtaacagtggcggctgcccgcccagtctgtcctttctgcccgttgtccgtcttctgggtctcagacctaacctacttttaaagaaggaagaataaatccattaccatggcttctcacccacctggctctgtgcccaaacagccttcgcttggagtgactttcctttctttctgtaagacaacgtcgtctgcagttctcacctttgtagctgaaagcctgggccgcttttatgtatagcagagttagagaggaaactgacttctgcttacattacagtcaagttctgcagatgtaactggtggttagggtggctttgatggagttgtggtgaatttggtctatggtccaacctgctacccattgagtcccagattaagccaagcatttcagttggactgttagaaccatccagaaaacagtggagatggctcagctgcctcagatgtgtggccaggctggtcttgctgggattccaggtgcaccagcacatacagtaagactcactgagcgggtgagtaacttactcacagggcaacttactacacatcgtgtttctagagttagtgttttgtgcatgtgtgccccagtctttcctcttaaaagggctttttacctgtcagcttgccatttagtgtgcttgttggtttggtttggtttggtttggtttggtttggtttggtttggtttggtttttgagacagggtctctcctggaactcattatatagactaggctaataccatactgaaagagatccacctgcctctgcctcccaagtgctgaagttaaaagcgtgcaccaccaccacaaccagcaacttttttttttatgatgctgtaattgaatacaggaatgctttagacatgctaaataagctctgcacctctgaatgaactacatcctcagctcaattctctttcctagattggagagagatggctgcatcattaatgtaagcatttaagtgaagggtaccctatctggtacccagtgtcacatggttttatgtgattagttcagaatctggtatatgtctcctgtaacaaagggactgcacccaggcattgtagctcacacctaaaaccatggcacttacaagactgaagcaggaggattgttatgagttataagactagtctgggctacagattaagaccctgattcaaaaatgaaaataataataacatagagaaagttttttataacagtgttccagtaatccctgccaactccacagttgaagctgagttggaagcggctgtcatcactgactagaagataagagatgaaagcaccacttaccaagccaggaggtgacagcacacaccttcaatcccagcgctcgctcatagggcacacctctgagtttaagctctacagcctgatctacatagcaagtacca

SEQ ID NO: 23466 - DNA, 1554 bp, Mus musculus
agcaaggaaatatgggacaaatgggtcagcttccccaggctctgggggctgaggcaggagccagtctacaggcctatcagcagcgacttcttcaacaacagatggggtctcctgctcagcccaaccctatgagcccacagcagcacatgctcccaaatcaggcacagtccccacacctacaaggtcaacaaatccctaattctctctccaatcaagtgcgctctccccagcctgtcccttctcctcgaccacagtctcagcccccccattccagcccatctccgaggatgcagcctcagccttctccacaccatgtttctccacagaccagttccccacatcctggactggtagctgcccaggctgccaaccctatggaacaagggcattttgccagcccagaccagaattcaatgctttcacagctcgctagcaatcctggcatggcaaacctccacggggcaagtgccacggacctgggactgagcagcgataatgcagacttgaattcaaacctctcacagagtacactagacatacactagagacaccttgtagtattttggaagcaaaagattattttctcttaacaagactttttgtactgaaaacaatttttttgaatctttcttagcctaaaagacccattttccttggaacatgtaagaactgtgcagtagccatttatggtttaaagtaaacaggccagatgaacctgagggataatagattacaaagaatatatttttgttatggctggttaccccagctctttttccccttgtgtgtgtggttcaagtgtgcactgggaggcaactgaggtctgaagccaaccatatgctcctgccttgccgataggttttattattttttttaaattaatgaaaatatgtaatattaatagttattatttactggtgcagatggttgacatttttccctattttcctcactttatgaaagaatttaaataaaaaaaaagaacatttctaaaaccagaggacaaaaggggttaatgttacgtaaaattacattatatatatatatatatataaatatatataaatatattaaaataccaatttttttctctgggtgcaaagatgttcattcttttaaaaacatttaaaaaataaaataaaaagcctcctctttccatccctcaagtcaacttttgtgctccagaaaattttctattctgtaagtctaagggtaaaacttcaagtattaagataatttgtacatgtagagaaaaaaatgactttttcataatatacaggggcagctgccaaattgatgtattataatattgtggtttctgtttcttgagaaaaattttttgttatttttacatctaacagaggaaaaaaaatttaaaaagagggtaagaaatgactccagtggggtgattttaacatgcaaatgtctgagatttcttcacttgctttcttccttactctgccccacacacgtacactttctgtaaaacttgaaaatagaaagcaaaaaccctcaactgttgtaaatcatgcaattaaggttgattacttataa

SEQ ID NO: 23467 - DNA, 1947 bp, Mus musculus
cagcagtaatttcaggagttgtttctccctccatagggtctcccgcaggctgtcagcttggctgcaagtgctagtttctcaccagctgtgcctgcagccttgagccttccctgtggctcccagcaacttccaaagtcctctctgaaggaagctaacttcctcagcagcctctcatcctacccccagcccgtcacaccttcacacgctcattcccacctctctgcctccctccctctccacagttatcgctgtgtgtgtgaaggaggagcaccaggacatttcctcgcttgacaggtcgcccagtccacagctgcctcttcccattgagagcatcaagcaggagaggaacaactgagacttccctggcatcagcctggaccctaactgaagccaagcatggagcagagaggaggcccggctttactgctgtgcagtgaatggacagcctggcgttccagggctgcctctgccctctggctggcactcattgcaccctcagcacactggaaaactagactggtccccatggtctacccaggcaagtggtagaagtaaggttacggagcagccgacgctgggtgaggacggagccacctccgcccaaaataaattgagggtcatgtacctcctgggggcaccctgcaccgcctgatgtcccaggggccccactgtggcagggaattgaccaagtagcgggctcgagagatttgggtttgggccttgacctcagggataacaagaacactgacttcctttctgagagggaacagctgggaagatgtacagggacctgagcccctaagggagactcgggccaggctacttgctgtcaggtacaggatcagacagtagtttggtccatgtagtcggggaactgcctgagagagaccatccttctctagagcggggcttgggctaactaacattccctctccctgcctggctagcccagccactgctcagccccttcacagcatctggcctttggttttctcacttggacacatttttgttttatttttgagacagggtctatgtagtacttgctgttctggggcttggtatgcagcccatgcagattctaaaccggtagggatccccctgcctctgccttccgaggcctgtgcacccagcccccggctagacagtttggcctggccctccaggatcatcctgaacagccctggggctcctgcagtgcccctgtgtctgactgggatttggactgaagcagtgaggccagtggctccctacggctgtggctgtgccgtgtggccatctctgggcctacgccagtcaagtcttgttcatccctgaggggagatgtgagtggccagtcatcatggactgggcaggttctgagagaagttggtcttgatctatccgctaaagatagcccaccctgtgcagaatctaggccatgaaagaggcctttgcctgcctgctctcctcaaagggaagaagatgaaagtccacagtaaaaggcaggttcaattcccagcacccactcacagcacctgcatcgtgagcgccaagggagcctgggcctctggtttccgtggatacaaatgtgcacatccttaaatgtaaataaaaataaaatctttgaagaaaacaatgtgatgatatcagatgagtgggcctcggcctctaggagcagacattgagagggaggaaggtggcccaggtgtgccttgagatagacatctgagcatgagacccctgacaaaagagggtgcagctggatgtttgccctccactccaggcctgcctggcccccagactccccgtcctttcacagatgagcggagggaggctgtgggctcattgataaaacttgagagctggggctggccaggcttaggctgactgcagattctcgttcagttagaacaacagaaacgggctctcatacagcctgagccaacctcaatctctgatctcccg

SEQ ID NO: 23468 - DNA, 1842 bp, Mus musculus
tttgccccgctctgtgggtcactgagggaggaagcagggctcccaggtgaccttggagcttcccccccttatttgcagagtgaagacaagatcaaggccatacccagcctgcatggccccctgatggtgttgaaccacgtggtgaggcaggactatttccccaaggcccttgcacccctgctcttggcatttgtgacaaagtaagtatcgaggccttgtgttcccatctgcctgagctaaggctcgtgggtggggtcagtcccaagagtcccaggccagccccctgcagaggccggaggacaccccacccccaccagaaagtggacctttctgacaacagagctttcgggatcctaaggtgtccttgcaactcactgagctgtcttcttcacaggcccaatggcgcgctggaaacctgctcctttgcccgccacaatctgctgcagacgctatacaacatctagatttaaaggcagctgcttcttgtccctcgccctgccccagtgactgagggtcttggatggactgagctcggccagcatctccattggatattttgaccagaggaagggagagggtcttgtctcctgtgtcatattggtcctttgatactgtgttggtttggtgtgtgtgtgtgggtatgtacttcctgtctggattgcagatcttcatctccctgctggactaacccaagtccactgtggggaattgatgcctaggggaagggtagaaagctgctttgttattaaacttaggccaacttagccataggccccgttggctgtcctgtctgccctgccttcctgtcccaccaaagcctggggaattctgtgtgctgtgtccaccgtgcctaaataacagaggctatcagagatgggctatcattagaaagtaaaactcagccgggcgtggtggcacatgcctttaatcccagcactcaggagacagaggcaggcagaattctgagtttgaggccagcctggtctacaaagtgagttccaggacagccaggtctatacagaggaaccctgtctcaaaaaaacaaaaacaaaaaaaaaaaaacctctgcccttaaccatgtgacttggaggagcagccaggggagtgggagctgtctggggtaacctggctctaggaccaggtggaaaaagcaccttggctggcccagccctgttcttctcctggggagggaagggcaggtcccctaatgcctgaaccacatgttgggcctactctctgagggttttctaagacaggagtgtgtaatagggatggagccgggtaagagatgctctgtgacttcccgaagtggctgcttggccacctcctacttcccgttgtgttgtgtgtctgggctgtgcctgggagcttcacaaataaacgtcatctgtgtagttgcagaggcccggaagcttctttcatcaaaagcggggacgacccagcttaggacagagcgagcaaacaggaggacctgagctcacatctcatgagccatgtgcagagtggaaggaccatgtgtgtgcacaccaagtgtgtcatagggatggagaccctagggcgggcggggtcccgcctcagtcagaggggcagccaatgtctccacctgggccctcagtgctgcctctgctctggatggtgtgggcaagcatctccctgtgagctgcagtgctaagctggttaagccaagttctatgaacgtgcacttgaactctagcctggagacttcacagtactgtcacaatgtgtggacaatggggcagtggggagggaaaccaagtactgaagactctaaaacgtcttgaggttcagatgggaagccagcaggatggcatgggacagaga

SEQ ID NO: 23469 - DNA, 1176 bp, Mus musculus
gggagacctctaacatgggagcggggaggttgcgggttagccagtgggcagtgatgagaagtgtggcgatgctgaggccaggccattgtgtgtaaggatgatcacatcacctagaccctcactccctcctcagactctgaagactctgcgacaagtggaagtgatcaattttggagactgcctggtgcgctctaagggtgccgttgccatcgcagatgctgtccgtggtggcctgcccaagctaaaggtgctagcttttccccttgtctggggggtgggggtggggggagtatgagttcataaggggtctggtgtgaaggagggtgggccaggtctcagccttctcactttggtatgaacatgtcaagtactttgcactgggttcatggtattgtttttcttcaacccccaatgccaaaggtgagagaccaagcctgttttcactgctcaaggagaagttaacgagagcaaggctagtctcctggctcaggtttgacatgcctctctactgttccacttgcttttaggagctgaatctgtcgttctgcgaaatcaagagagatgctgccctggttgttgctgaggctgtggccgacaaggctgagctggagaagctggacctcaatggtaggctgtggggtgagcctcagctcagctctgagcctggcccctcactgtcctccctgaccctcctttccttcctggatcaggcaatgccctcggagaagagggctgtgagcagcttcaggaggtgatggacagcttcaatatggccaaggtgctggcatccctcaggtaggcaactctgggaatgtggctccagagagcaaaggtcaggcctgctcttttatttgtgtttgttttggtttttggtttttggagacagggtttctctgtggagccctggctgtcctgatactcactctgtagaccaggctggcctcgaactcagaaatccacctgcctctgcctcccgagtgctgggattaaaggcgtgtgccacccactgcccggcataggcctgttcttctcttatttctctttggcttgtctcctgctacctgccagcctagtagctggcaccttgtgctgggtgttggagaaagagatggaggagagcttttgtgtgttcagtaaaggaccatcttaaagacctgtctgtggggaggccctgaa

SEQ ID NO: 23470 - DNA, 1204 bp, Mus musculus
aagccggcccggcaaaaccccgctccggcttgaacaaatcaaatcgaaggaaagaaactgccggctttcaaaaatcctcctccgccgccataatcgctggggatcgtggagcaggtggtgtgcacgagctaaacgaggagccgcggcagcaaggagaggcaagcagactggtcactgggcctggcccccacgcggactctcaagcagtgaccgacgcgcgcgttccgtccccccacgccgcggtgccgctaatttgtggtgagtcggggccctcacgctcttcctgtcacttgcctgggccaccagggtctgggtggggcgaagcgatcgccttgcttctacccttttgatcacgctgcgcccggctttgggggatgggacgctgggcgccgctgccccttgtacgtttggggaaactgaggcctagagtggccactagccacagcttcctctcggcggtggcgcctcccgttgccatccatctcacctggaggcggtaggaagccggctggcgtgccgggtggggctacgcagtccatcgttgcctacccagtcggcccacgtccgcgcgggaagcctggcatgagtcactgctgacgcttggctgggtcgatggatggccgtgcacctgaggacgtcccccacgcggccgcccaggaggagagggcgtttgtgtattgaccgtttgtgcctgctctctcccaggccgtctgctgaccttggatagctcaataccatccctgttttgctttggttagtcattctttaaagtgaattggggagggcttgtgtgtgtgtctgtgtgtcccttccacctggagccctacctaccaccaccagtttttaatctcattgtcccatcgtggaactgtaagaggtggctgaattccagatagatttttactcatcttcgtgtttgttgggtttctggcccgtgacagctggctaaggtgcctatttaacctaccaaagcggacatggcctccaggttctcccagaatccctcagtccctacttgaagtttccagtcccggggctgggcttgcttctctcccctgaagctcttcactatataatcctgacattttggtcttctcacttacccttccattcctctgtctgcatttctctcactttctgcatatgtgagctcgtttttccttctctcccccacccctctgtctccctgtttgcaaggcgactt

SEQ ID NO: 23471 - DNA, 1197 bp, Mus musculus
acagaaagggtggcaggagggctggaagccacttgttctgcagggcctaggctgcactgtccttagaagcattcactggggcctcctttgtctcctctcgccacccccacaccccaagcacgtgtagccctggctatcctggctccatccagcctgtagatcaggctgacctagaacccagagactgacctgcctctgcctcccaagtgctgggattaaaggtgtgggccatcattgcctggaccccctcgcctcctttctgtatgtaaaagcagctctgtgaccatcctggtagccttggtctatgcaacttagctgtgatatacaaacaccgcacatgttcactgtgccatctgtggacaggctcgggggtggggctgaaagagctcctggctccaaggagtggacagaacagacagggtcagggcaggcgttagacagccctactctgacctaggaattgcacttttgaccaatatttgggccgtggaacatctcgtggagtgctggccaagcagggtcggtgatgcggggctggatgggttgtgttgcaattgttgctactgctaaccttcaagcggtgactaacagtgagtgtctgggccttctcccagtctccacagagacaagaaggacacagggtcagcctgggcctcgtaaggatgataaaggcccggggtcggggggagagcacattctgggtagaggaatgacttctgtcccttgtggctggaacaaggcagaggagttcattgcaggccaacctcccggcagcacatgttattcacatggttagtgctgagcatgccaggcactctgctgaggtgcctcatctctgccagtttcaggcagtgtgactgctgaatccttactttacacccgaggaaacaagtccagataggttgccgacttggccagaccaaagagcaagctccagcatttcccatcccagacagggctctgaccccagtactgtgcggctgcagagtacaggctctctggaacaaccccccacccccgcaccccaggaggagccggccaggttgctgcctgacctgtgaattctgttctgtctttgcaatggggatggacttcccacctaagatgacgttctccttggagggagattagcttcctgtgaggctgggggctgagccggggaggggggggcacacattcctctaagaaaccatctgt

SEQ ID NO: 23472 - DNA, 1167 bp, Mus musculus
agggccaggtctcagctatggcaaagtcttggggtcgggggtgggttgggggcaggggactaccccatcaggcaggcgccagtccgctgggtccctgtccatcctttccacccccagtaccccaggtgtgtatacccaggtcatacactgcaaccccaagtggtcccaggatccttggcctgtcaaaatgggggcagaccctccccaattctagttctcctggttggagagggaggggcctggccagcttcagcctacagctttaaattctgtctgctcctaaatgggtccaaagctcagtactggggagcctggggtccccacttgaatgtgcagcaggaggtccttttccttctctaccttcctcttctccctttccctggggccagatcaggacacagcacagggcaggaggccctgcctagcttaaagtatagtcatgagatggagttgggagcactatactggtcacttaccacctggggcctcagtttcctgatctgcgaaaggggcaagggctaaggcagatgataatctgaagctagattaaacagtctaggtgctcctaacaaccaccccctgcccgggcctctcctttgtgagccacagttgtagaccgtacctcagccttggagtcaacacagcccacagcccattttacagaaaccaaaactgagttctaacaggaggagtgatttgcccagggtttttagccctctctggtacagaactgggatgtgaacattggtcagagaccccacccattagtagctggagcctctgggctcctcagtcccatgcaacatccctgggacctggggaagggatgctgagacacaagcaggtcttcttagctccatgttgggagatgttggggtaagcaatggaggctatatcctcaagagctgtcacagacaagtggcagaatacaggcaccatgagctcaggttctgacaaggtgcaaagcgtggggaggctctgaggaatatgaagagtgggaaggcggcctaggctccatgggccactatgagaaatagcctctctttcctgggaaccctctgtggtcctctctaaaagacccagatatactgttatggccatctatcccagccccttccaccctatgctcaaccctgctggctgcctaggaccccagcggacaccccc

SEQ ID NO: 23473 - DNA, 1234 bp, Mus musculus
accacatctaaggtgggggccatggccgtgaatgtggatgacacttgttctcctgacccgtggtgttgcagtctgttgtcaccagccttgttttagtgtgtatatatgtcgcccctgtgatgcatatatacacaggtattaaatatatcgctctatataatattatatatgtgtgtggtatccaaggaatctcttctattgagggctaaagataaagaatttggcacacaaaaaaaatgcagacatccttgtgaattttgagtgcttatggggtcatctggttatttagggcattgagactggagccgtggctcagatgattggggcagaaaaggcagggtggcccacacctgctctgactgctagcttcccacagatccatgtctagaataccagtgtgctcaggaaaaggaagtcatttcgtgtttgtttcccaccaaagaagaatgaatccagggtttttctactgttcgtctgtccaggggtccctgagatctgggctcccttacattctagacctatgtccccccccatggaagagaagagaagaatgatagggatgacctggggtggggggacagcaaaacatcttaaatgatgactgtagttaatcagatgtgacccctctagggcccctggttggaaggctcagggttgaagcggggcctaggagcaagaacaagattgcacagtagacatggggtgagggtagtgggagggaatgctgcatttctcagctgggcagtaatcaatctaatggtcctttaaaaatgtctgtattaaaatttaagaataccacactttaatattaaatatcataaggtctagtatcttgataataatgtagatgttttaataacaatttttgtccttcttaaaataaaatgagagaaatttgcttcttttagcctttgttctatagaatatacgtgtgcactatgactcttgtcccccaggtgtcactcctgctcctccccaactactgcatggattcaggggaccagggctcctgggacagagctagccccagctggctgtgcctggggcagacattccaggggttgaggggcaatagccctgtgtacacatggagacccagctgacccagctgagcagcacttccacagcaaggacaagttgtgctctgtacaagtggccctgcaaggcacgctctgtctggcagcttcctcacaactgcctgcctgctcacagcactttctgtgggactgcccgt

SEQ ID NO: 23474 - DNA, 2580 bp, Mus musculus
ccttgctctggctcaccaatatacccaggccagaatctagtgtccctgaaggcagaagagggcctgccacgtcacagattagaatccctccccatgggtatcagcaggccgccgtatatgagttgtatttgctgaagttacttacagtgcagctctcatgggacagcaggctctggagacatttacactggcctgcagtccctgtggagtcggagggtgcccacacagctctccccgtggggcagagtgatttcttgcagttttggctccctcacagctgcacttttctcttctatttggctggattggacatcatggaaccctctactcatgtgggtcatgagggcaccctccaggagggtgtgtttgtttgctcagggcgggcagcctgtgtgaaggagacagaggtgatgagggtgcttcattatacttaacactggctttattttaaatggtggcttagtttggggcccctatcttttaagacttttcataatgatgttaagaccagggcagactgtctactggccatggactgcagccaggagatgccctgcccctcctgggacctgcacaccacctctctggggaacttgacaaaggtccctaaggctaagggaggtctccctcctactaggtccctgactttgactctgtggttctctaggaaccgtgtgcacacttgtctctgttgtaactacaaagggcagtagcatccagcatgtcagtgtctgcccgggctgcctgcctcctacccacccagcactattctctgggctggctgttcacccagaggcagttctcattttgtttctggtggacaagccttgagctgaaaatctcttcgttttctttgactagaaaatgtaaggtttctgttttttaagttttagttttaaggaatggatacttatctctggatgccatctgtgttctgaccctagtgggtgggtgggccttaccgtctccccttagtccccgttctgccttgtggtgccctcctttccttccagaagtagggagtgggttctggctcctcctaagtgcttacagagtcactgtctgcttgtttcttggagaagcctctggaatgaaaagcggcagggaaacaaaccggaaggagcacgcctagaggttgacatcttggagaacaaagtgttcacataagcttggctcctctgttggctttaggacccaaggctgcacagaaagagttgagctctgctctttatcttgctgtggaagtctcctgactccctctaggagctgacagctgaagcctgaagctcttgcacttggatccttgaattctaaggagtaaccaggctccagaagccaacttctatttggctttccgtgggtttgtcttaggatgagaagtgtcatcacttcctaaacatcctgttctcagctatggcagcctcagaaaagacacctgaatgagttagaaccctgcaggaatgtacattcaagagatgtcttgataaagaactacgtgcttttggaaagagccaccctttggaggacctgttagtcacctttatcttcagcccaaaggctaagttatgtgggtctgactcctttggttagggacagcactagacagtgaccctaacccttggtccatactccctgctgtgatggtgctgtggtctgctttccactcaggcagctcctacagtcctccagcctggggacagatgggaagctttccaggggccccccgagaggtgtgctccctgtaagaggggcctgtaagaggagctcttggtttccagggcaaagccctacccacagcttctttaacatctgttaattaagtgcaataaaattttctagaaaaaggcaaagatgatttccaggtagagattgctgtcttttggtgttggatgccagaacaccacttggttttatttttctaagtgcatgtgattggtagagtgtgtgggctctgcatcctccctgggagctgcattccagcagcccctctccctacctttgccgtgggaaagaggccaggagaaaagccctttgtcccagctgcagaggtggaagcagacagcagccctttggccttacatgtgtgtgtgtgcctgtgcgagtgtgtccctgctggtgggccggagtgatgtgttatggagggaagttgggaatgtatccttttcaaacaaaattaaatattttgagacgagaacttggcagtggtcttttctgttattccctcctttattttctgtctatatatgcctgcatgagaacctagccagagaacctcctctcttcggaatcccaggcaacacctctgtacacaccagctagatgcccgagtctcctaactcctggcctacagaatgagttctagaacagccaaaaaaatctgatctgcaaattaaacactgagaaactcacaatcctcctgtgtactgggaataacaggtgttgcttttttttttttttctgagacagggttttttccatgtagctctggttgtcctggaactcactctgtagaccaggctggccttgaactcagaaatcctcctgcctctgcctcccaagtgctgggattaaaggcgtgcg

SEQ ID NO: 23475 - DNA, 1098 bp, Mus musculus
ctgtacttactgtccacctcacactagacctgtactcactgtccgcttcacactagacctgcacttactgactgtccacttcacactagacctgtacttactgactgtccacttcacactagacctgtacttactgactgtccacttcacagtagacctgtacttactgactgtccacttcacactagacctgtacttactgactgtccacttcacattagatctgtactcactgtccacttcacactagacctgtacttactgactgtccacttcacactagatctgtactcactgtccacttcacactagacctgtacttactgattgtccacttcacactagaccgggtcgccgactagtgcagttaagacaagtgatcacctcacagtgagctttttacttataggtgaaagacagaatcagccatgggtgctatctatccctctgagttttcccctgtgcactataagggacaggtgacacctaagcaaaaggtactaatgactgcctgtttatggactgggagagacaagaaggtcactactccgatagtccatcacagtaagctgtgagtgaggagaaagtcttgtagcagcctctgggaacctggaggtgagtaggagaagaatcctaactttgtagagtcctcccatcctttcttgttctgggggcagagatctaggataagatgtggcccacagtcactagagtaccatgctgtgtctgggaagcctgggcctttccatgtgtgtcagccgcatagtaagtgtgagcaaccagacaggttcatgagggcagatgtgtagtggggccaatgttgagctgtttgtcagtactcttgggtactcatgttcaacccagtgtaacagccaccacattgaaccgccactaaaccctgacgtttgtgttttgttgttagggacaactgactgatctatcaaatgtcctaaagaaatcacactgttcttaccaagcttcctcactaatcacagccaaaagtacctggcaagggagactttagactttggacattcactaactctgtgtcaggtttttgctgcttacgagtagtgtgtggagagtttaaactgtgtg

SEQ ID NO: 23476 - DNA, 1099 bp, Mus musculus
gcctcatttgttcatggatcaggtggtactgacaaggacttctataggccacaaggactggagatggacagaaactggtagtgaagatgttaaactaggatcatggttattaggtttttcatccaggttcaggaaatcaggtatacaagccaggcgtggtggctcacatgtcatccctgtgttgagaagaagaggatcatcttgactttgaggccagtctgggctgcacagttgtagagctgcttgagcgacagtgtgaaaccctgttttaaaaataagaaaatcaggggctggagagatggttcagcggttaagagcactgactactcttccgaaggtcctgagttcaaatcccagcaaccacatggtggctcacaaccatctgaaatgagatctgacgccctcatctggtgtgtctgaagacaactacagtgtacttacatataataataaataaatcttaaaaaaaaaataagaaaatcagccgggcatggtggtgcacaccttcaatcccagcatttgggaggcagaggcaggtggatctctgagttccaggacagccagggctacacagagaaaccctgtctcgagaaaacaaaacaaaaaaaaaaagaaaatccaggccagtgaaatggctcagagggtaaaacagtctacacagtgagactctgtctcaaaaacaaacaaggacagtcagtgctgaatgtgactgtactctgagtccctgcacgcaggaccagaggcaggtggatcttctctgagtgtgagaacagcctggtctaacactgagtctcctgccagccttgactacgtaatgagaccctgtcccagaaagaaaggaagggagcaggcagttggtcaggaaaatgtcagccaagatgttacggtgtgtggaagtctgcgtgtcctgcagtgtgtccactggctgtgttattgccttaaggctgtttggtggagctgtaaatgccagcagacttggagataagcctgttagtaggaaattgaaaaacctgatagctgtccttagagaggataacaggacagattgttgtcttctgatagctggggaagccccaccctggagactgagccatcttga

SEQ ID NO: 23477 - DNA, 2267 bp, Mus musculus
ctatttggtaagtggcaggtatctggctcaggcgtacaaataaagtcttaaaaccagtttctgcttcattctcttcccttgtggattccagacattgccaacctagcagaagaattcaaggatcacttagtgcctgatcctggctgccagtatgaccaagtgattgaaattaacctcaatgaggtgagcggagaagtagagtttgggggactgctgagggtggggcttttattttttggcactaggcaggatggtaggggagcaagtcctatcagcacatctagcaaggcagttggccctttattcctagggcctaaatcaggcaggagttggggacagacagaaggacatgacattcagccatagggaaagcaagtctgacatgagtgtccatttgccactccaaaactttagtggaggccaagctctcgccctgggggctcactttgagttcttaggacaagctgcaatgagttggcatcctgacacctgcaggacaggtattcagcgagctaaggaagggctctagagcaaacagaagccaggctgttcatgccagtcttggctctatggatctgtgctagctgacctgcctctgtaggcatccttttcctaaggggggtgtgagtggcatgggttagttcatggagtaagagtctggtgtgttggtgtttgtgtgccaggcactctgctgtgcatgtcatatttgttagtcattcctcataaaaaagcgtatgctgtggcctgtctgtcgcaagattccagtaggaacgtttatggtctctcccaacccttggtactagatttgaactctaggcaagcacatctgtgtccccagccctctttgttgttgtttggttgggtgatttttagttgttgttgtttttgagacagggtttctctgtgtagccctggctattctggaacttgctctgtagaccaggctggcctcaacccagagatggcctgcctctgcctcctgagtgttgggattaaaggcatgcgccaccaatgcccagctatgtcttctttttaagaaggtctcactaagtttcttgtgctctccttgaactttgttaactaacccaggtggactttacctggcagtcccctgcctcagcctctcaagtagctgaaattcagtcctcaccatcaggcccagttccttcaaaagcaatgtagtttcagagataatggactcgtgaggcaggtggctcagattgtttctgtacctctgtcatctccttgtgacctgaaggaggcccgtcactctacccttcagttcctgtgtgtaccatgttgaattgagacagcctgactgggggactcaagtgctgggcgaccccaacctattgcccacttgtctcccatgacaaagtttgagccctgaggacagaagacagttccttctatagatatgagaggatcttagctgggcagtggtggcggacacctttagccccagcacttgggaggcaaaagcaggcggatttcttgagttcgaggccaggctggtctacatagtgagttccaggacagccaaggctacacagagaaaccctgtctcagaaaaaaaggaaaaaaaaaagaaatgggagaatctgtgaagagcatccatccccactctacttcttgtctctctgctccttgaccctgtcttttcagctaaagccacatatcaatgggccctttacccctgacttggctcacccagtggcagatgtggggactgtggcagagaaggaaggctggcctctggacatcagagtaggtgagtgccttccactttatgggttaataggtacctggggacagtcacattcatggtacttcttgaggtctctggttattgagatattacctgtgcttgggatagaaagaatgcatgcttattgtacttcacatggagttttaaaatacctctaactctgacttttagccagaaatagcctttgagaacattcctgtgttactgtatacatgaacatgcacatctctatgtaaatgtactttttgtttgtttgttttgtttttctgtgtagccgtggctgtcttggaactcactctggagaccaggctggcctcgaactcagaaatccacctgcctctgcctcccgagtgctgggattaaaggcgtgtgccaccactgcacggcctgtaaatctactttggtacatttacacagatcatgcgccatgctgctgtctgcacacgtcacacatgcagacacactggcacactgctactgtagttcagcctgagtgtcc

SEQ ID NO: 23478 - DNA, 1137 bp, Mus musculus
atgactgggttatgagtagccttctttattgctgatatttaggttgcttccaacatgtctattagaaataatctgtcccagatcagttgatctctttgtgccaggtcagatggagatttctggttcctctcccctgacctttgaccctaccatataccaggtttgattggcagctgcaccaattcaagctatgaggacatgggacgatcagcagctgtggctaagcaggcattggcccacggactcaagtgcaagtcccagttcaccatcaccccaggctctgagcagatccgtgccactattgagcgggatggctatgtgagtgttcacgtgcccctgcccctcgcttcccatcatgcctgctgatgtgtgtttcaggatggaacaagctatggactgttgggctaaggcaatgcaggcatagcctttcatgctccaggctgctgccttacccattgccatcagcattgtacctggccctgacagttttctgtcttctttatcctctgtaggcacagatcttaagggatgtgggtggaatcgttttggccaatgcctgtggcccttgcatcggccagtgggacaggtaagcagtgcatcctgagagagcagcctctgctccttggtaaatagtggagactccagccggagccagagaaggttccagcactgctacacattagcagtccttgtcagacgtggacgggcacgcagagagccctacagaagccccgagtagccagaaactgagtcctgtctgacaggaagaagccaaaaaggctgcatcctagaagccaagctggtggctctgatggagccttttgagagcaggtagctgcctaagtgaggagactgaggcctcagtgtggcctgtgcatcttctacatactcttagatgagacctggggagcttgaggttgtaccctgtgcagtgtgcttgagtcccttggaggacacagctttttccttgtcattcccctcatcatgaattaggcatgtaccataacaaaccagacaaactggcctctgggcagcccatgtgacaaggctaggtatctaatcctatcccctctgtcctggcagaaaagacatcaagaagggggagaagaatacaatcgtcacctcttacaacaggaa

SEQ ID NO: 23479 - DNA, 2483 bp, Mus musculus
tttctgctgccggcccctggctcaagttccgtgggcatctggataacatctctaacaacctgctcatcggtgccatcaacatcgaaaatggcaaagccaactctgtacgcaatgctgtcacccaggagtttggccctgtacctgacactgctcgctactacaaggtaggccagcattgactcacacctttaataccatactaggacttgggaggcagaagctggtgggtttgagtttgaggctaggctaatctatacagtgagttccagactgggcttagtcccttaatacttggtctctgtgagacctgtggctcttctctgagcttcaatttccaacagactcctaaagcaattctgtaaggtttcttctaaccttaggtctggggccaaacacatgctgagactcatctgactcccgggcagggttctcctgggtgttgggatagcaatttcctctagtttgtttctcatgtgtacctcaccaccaccaagccctcaggcagcaccctccgctgcctcactccttgtccctgttgcctgacagaaacatggcatcaggtgggtggtgattggagatgagaactatggtgagggctcaagccgggagcatgcagcactggagcctcgccaccttgggggccgggccatcatcaccaagagcttcgccaggatccacggtgagccagtcatccccattgacaagtgctgctccttcactcaaggctccaggtcactactttgccatggctgacttggagtcggccatatttcatagcctgtcccacctacccaaggccaaggtggcactgcccaagtctgatatccataacactggtcttggttcttagtttgtcagttgaaatctaagggatgcagcatgtacatccagactaatgcagacctgcttggagtgctactgtggaaaagggtcactggcacacagcaggcttgggtgctggagccatggcctgcttgccccacagtaggactggggtttcgggtggggtctgtctcatatcccttgtgttagagaagagtgcctggggctcctgaggagccttgggtagaggaaccacactgcaacttcatatttgtctaacagaaaccaatctaaagaagcagggcttgctgcccctcaccttcgctgacccctccgactataacaagattcatccagtggacaagctgaccattcaaggcctgaaggactttgcccctggaaaggtcaggctaggaagagggaaacaaacctgggatctcttgggtgggtggggttgggcaatcgccttgtttcctgtcctgctacacccattcatacagctcttgtaaatccgtgttccagctgaaagccaacccagacatgagccctggcctggcacttagtatccaacagcttgcctgatacaatcttgggttttaagaggccccagtgaggactgtgttcctcggagcaccgtctgctccccagcccacacccattcttctattgcagcctctgaagtgcgtcatcaagcaccccaatgggacccaggagaccatcctcctgaaccacaccttcaacgagacccagatcgagtggttccgtgcaggcagtgccctcaacaggatgaaggagctgcagcagtgaggagccaggctggctgtcctgacccactctggaccctgctggatgtcacttttgtcacaggtccatgtgcatcatcagagcctaatctggtctgtgcagcatgacctcctgctctaagatggtgaccagacctgcttcctgcctagcctcagcccagtgaaccaccattgagggcgtttaagataatgttccagccccgccttcctgttcagtttggtttctctttgagcagcccatgcaactgtatttatttttgatgacagcactccctctacagaagtttttattctgcctgatcatttcactggtggctgaaggattttagagaaacttgttcttaaaagaaaaaaaaaaagatccatatctattaatgttctgcctgagtgattgatgtctactattaccagcatgagctaatggagggtttttcaagcaaagattccatcaggccttggtcacatctggaccctggtcacaagtacctgcagtagaggagagcttcagagaccaagagctacctcctctgttcccccggggctacagtactagacctggtctttaccttgagagtaggcacagcgcctaccttaaaaacaaagctgttgttgctgctgctgctgctagtggcacacactttaatcctggcagaggcagatgggtctgagttcaagtccagtgtagactacagagttaaaacagcctgagaaggaatctgccccaggacacagctaataatcaaatgctgcatgctgtctgcccctctagcctccgcagcagagatgtgaggagacaggctctctccattaggctgcatcagctaaatctcacatgtaaaggcccaggcaggccatggc

SEQ ID NO: 23480 - DNA, 1215 bp, Mus musculus
tcagctgaccatgagggcagccccaggtccacagatgactgtctagtcctactgtccctttctcactggcacttgtgtgataaatactgttttgtgacatactgccatggcctgcctgggcctttacatgtgagatttagctgatgcagcctaatggagagagcctgtctcctcacatctctgctgcggaggctagaggggcagacagcatgcagcatttgattattagctgtgtcctggggcagattccttctcaggctgttttaactctgtagtctacactggacttgaactcagacccatctgcctctgccaggattaaagtgtgtgccactagcagcagcagcagcaacaacagctttgtttttaaggtaggcgctgtgcctactctcaaggtaaagaccaggtctagtactgtagccccgggggaacagaggaggtagctcttggtctctgaagctctcctctactgcaggtacttgtgaccagggtccagatgtgaccaaggcctgatggaatctttgcttgaaaaaccctccattagctcatgctggtaatagtagacatcaatcactcaggcagaacattaatagatatggatctttttttttttcttttaagaacaagtttctctaaaatccttcagccaccagtgaaatgatcaggcagaataaaaacttctgtagagggagtgctgtcatcaaaaataaatacagttgcatgggctgctcaaagagaaaccaaactgaacaggaaggcggggctggaacattatcttaaacgccctcaatggtggttcactgggctgaggctaggcaggaagcaggtctggtcaccatcttagagcaggaggtcatgctgcacagaccagattaggctctgatgatgcacatggacctgtgacaaaagtgacatccagcagggtccagagtgggtcaggacagccagcctggctcctcactgctgcagctccttcatcctgttgagggcactgcctgcacggaaccactcgatctgggtctcgttgaaggtgtggttcaggaggatggtctcctgggtcccattggggtgcttgatgacgcacttcagaggctgcaatagaagaatgggtgtgggctggggagcagacggtgctccgaggaacacagtcctcactggggcctcttaaaacccaagattgtatcaggcaagctgttggatactaagtgccaggcc

SEQ ID NO: 23481 - DNA, 1417 bp, Mus musculus
tcaccttccacaggaggcatgataagcttcgatgtcttccccgagggctgggataagcgctactgcctggacagcctggatgaagacagctttgacatcatccacttctttggaaatgagaccagtcctgtgagtgtggccctgccccgtccccctcaacccaacacctgaggtctaggccaggacacatggcaacagaaaacagtcaccgttcccactctacagttaggaagattggggctcaaagaaggccagacacttataccgtatcatacagcaagtcaggacaggtctgacaagtcatcctggcaggtctaaggagagggtttgtaggagcccgtatggaaagggtggctcttgggccccccaggcctgggctcctgccttgtagacatcacctaagatcttccacatcttctctttttttcctctgagtgcagggcgggaatgactttgagatctatgcggacccccggactgtcggccatagcgtggtctcccctcaggacactgtacagcgatgccgtgagctcttcttcccagagacagcccacgaggcgtgactgggcccacagctgagcactgggaccttcaaagagctctgaccaggcctgaagatagaaccattgggtgccacggttcccatcccactggcccaacacgtagcatcctgtgggggcactgcagggtcacccacacaggaccaacgtctgtgtgggaactgtccccagccaggtggctcctgacgagacgcatacctgctctctaccctgatggtcctggcctctgatgctgctggttttggggacagaacaggtctcaccacagggtggcatgggagttgtgctatggagcctgctggccacagactgacaagggacagaatggcagagaaggggcattacttaaaggactctgtcacagatattaaagttcccaagacaaggtgtggtgtttgctctgtctgaagacaggatggttcctgtcacatgttaaggcccccgctttgaggcttgccccaggacatctatgattcactgaaccaccagacatggaccatatgttgtgtccttcctcagccccttccacaagaacactcaagacaggcagctcaggggcagggtgggtcacagttgagtttattgccagtgtcaggagggatggggaatccgtggctggggtctgagtggggaagtttctgacttggcgctgcagggcccaagagtagggaggaggtctgttgtccctatcattcggggagcctcaaggtgatgactgctaaggacctgctcacaacagagggctgatggccctggggttccttgtcaaaggatccgcctgtgtctttattaacacagttctgggttacaggcttgctggagatttgaactctggtcctcaaggttgctgaggactg

SEQ ID NO: 23482 - DNA, 1300 bp, Mus musculus
aggtttgattgtttagcatattaaaacaccatctacagcacacaactagattatttgtgttgaaacagggggaaatttaagagaataagcatgtgatctaattcacatgtactaatgtctcatataggggttgttattaaacacaataatcgggatgtatgcgtgcatgaaattatagaagatataaaagcatgcataaaaacaatttttaactcatctttgggatattgtcaatctatttaaaatggtgctatgggagacgacaatcagaaatggcgcctcgcaaggggaaggaaaagaaggaagagcaggtcatcagcctgggacctcaggtggctgagggagagaatgtgtttggtgtctgccacatctttgcatccttcaatgacacctttgtccatgttaccgatctttctggcaagaaaaccatctgccgagtgactggcagaatgaaggtaaaggctgacagagatgagtcctctctgtatgcagccatgttggctgcccaggatgtggcccagaggtgcaaggagctgggcatcaccgccgtgcacatcaaactccgggccacaggaggaaacaggaccaagacccctggacctggagcccagtcagccctcagagctcttgcttgctctgggatgaagattgggcggattgaggatgtcacccccattccctctgatagcactcgaagaaaggggggtcgtcgtggtcgccgtctgtgaacaggacttctcattattttctgttaataaattgctttgtgtaagctaaaaataaaaaataaaaaataaataaaatgatggtatgtaataggtcaattatcaatatttggtaataaccaaataaattgctgtattgaacaaggaacatacacttagtcaggtttttaagacacaatttttgttataggttttctaaaaatatacgaatatattttacaattctttattaataccacagtggttctaataggacattgaaactgtgttttgaggtgaaagccacctcaaccttggccgtctaccctcggcttttctctcaggtagaagaggctgaaggcagcccaatttattgtaggccagaaaacctactccgggtcttagtgagaacaatatggctactctggtcgggacatgtggaggctcatggggcaaaggtgaacgcggccctctcctgagtttgctgtaaagctgcccgccttttggtggcttcttgtaccactatagctcagggaaactgtgtgtctcaaggccccgccccacagcagccagcagctagctgggtccatgtgggc

SEQ ID NO: 23483 - DNA, 1100 bp, Mus musculus
gccctggtccttggcactacctttgtggcttatgtgccaaactataagatgatcgagtgggcccgccgggaagctgcgatgctggtgaaacaccgagaggccagtggcctccccatcatggagtccaactattttgaccccaccaagatcaacctgctggaggacgactgagtggggcttaagcagcgctaccctgctcactccccagagaatctacccaagggattgaaagaagaaaagagtgttactccagctaggcctgtcaatttttttggccaagggcccacacctcagtaacactgattgacctaaatatgctaaagagatgggaggaacaattatctccttaatgagagaatgtattttccttggccgaaactctgtgggctctagtcacctgtggggccttcaccttgtggtctgcttacttcctggagttctaagttccaaaacgcatctgtttcttttccccatcttttgaatacttgccaatgtctgggctccctccccccaccattgatgtactgggctctcttgctttatttgtatccccctcttctgcttctgccatggggctgcttgggagcctccattactaaacttcatatgtaacccaagaaggcgtggctttctccgtatttcttctggaatcggcctggattttcagattgcctgccccgctatgtttcttttaaactataataaaatggttcttaagcctccctctgagtgcattcttaaattatcttaaattatttttgtttggtttactataagttatgtatatacttgtgtctgtgtgtgggtatatgtgagtgcagatgggggtggggagaggggcagaggcctcagatcctctgcagccgagttgaaaatagaacttgggtcttctacaagagagctgtatgctcttgcattgagccatctatccagccatgctctttttttttttttttttttttttttagtaagatttattttatatgagtacactgtagacacaccagaagagggcataggatcccatcacagatggttttgagccaccatgtggttgctgggaattgaactctggacctctggaagggcagttagtactc

SEQ ID NO: 23484 - DNA, 1608 bp, Mus musculus
caccttctagcagtaactgaagcaaaggacttggagtacatggggcagctggaggctcctcactcaagctaagtgacctctttaaccacaagtttaccctcctcccgagacaaggccactcatcacagcccagccggagcagccgcagcgtcaggatcaaaggagactggcagcaggtgtgaggccagagaaaacaggagaaagccattcctcctcctcctcctatctgagtgccaaccctcgatgcccacccctaagctgctcttcctcagcgtagcttgacctgtcacctttaataaaggtctaggctgcagcagcagagacacaggccttctgtctgagaattagttatttatagtcaatagagccagccactcacacccttatgggtttgtcagctagggactagggggacatgattgttctcccaaaacaagtctctgatgtagaaaataccataatgatgtagattcatggtgggaagaaaatttggagttgtctccagtagggactttcacattatccttaatacgtctccattgtcattctgaccttatggggtgtggttggggtgtgagtgggcgttttcttaatgatatgctgctaggatttcatgggcagcaatagcctagaagtctatgatctagactccagattccagagggaccttaaggttcccttctgtggtgtcagtcttctactagctaatatgggaaactggatatggagaagggagctcagagcaggcacctgagactcagctccacacccatggggagccccccaccgtggcttcctgccacttctgaaacttgagcccacttgttccttttggggtaggcctttcctccctgaaaagcccctattggctcccttgcccctaccctgcaggctttgccactagccatagcagtggcatcatggagatctctgcctcagagctgacctgttgtctgaccagagagagctatgtccacctagggtgtcgagtggtgtttgggaacttgaaggtcacagtcagaaaggtctcaggactcaacagtgtacaggtgtatgtggctgtcacaacgtagagtggaaaccaacagagactgtttagtgttggtctctttggcagaatagggcttagaaggttcagtgtttaaagcttggtatctgggaaggcagaggttgctggaagccatcactttttcctttgcctggccccagctggtagcatctctgcccagagctctgtccttagggtgctctcacatggccattctctgtttttctcctcagcagtaaccatggtattctgagacatttgcctgaggattttagtcacttaattgcttgaattatctcctgtcatgtctagcagccatccatgccaacgtctgtggccatggctagcagagagatgggaagactggacagtctctctggtctcctttccctatgcaagttccgttgtcaccagaatcccaggccaggaaccccacatcccacctttacatttctctgtcccagtacctcaggagcatactgttcatgagcaggtgactccccctgggcatgtacaagcaagctgagaggaaaaggagtcacgtggttcatgccacatag

SEQ ID NO: 23485 - DNA, 1597 bp, Mus musculus
cttcaggcagaaaattgctgttcttaagctttttgttttttgagacagtctcactctttggctttggctgtcctggaattcactatctagaccatgttggtctcaagctgctaggattaactcaagccacctcacctggctttttatatactgccatttcagtacacctgttagcttttccttgctttgttgtgactgctttcaccaaaccccatgtcatctactggctacatgtcctatctccacagccaccaaaaccctcaacagaggcatctctgagttcattgtgatggcagcagacgctgagcccttggagatcatcctgcacctccctctgctgtgcgaagacaagaatgtcccctacgtatttgtgcgctccaagcaggctttaggacgggcgtgtggcgtctccaggccagtcatcgcctgttctgttaccatcaaagaaggctctcaactaaagcagcagatccagtccattcagcagtctattgaaaggctcttggtgtaggctgtggcctctgccctttcctgtctactgccaccctgtttgtgtatcatattgtctgttagcatgtactattttcaaccagttactattatattgtactacatctgcgttttatatttttatttttgtcttaataaggttatttttcaccatctcttcattctcttctaccataaaaaatgaaatgatagctaggacaggtgaaaggcagaatgtcaccatttaacaacaggaagaaccaggagaaacttaagccagggacagtgtatactttcatctgcaaacttattccactgcgcagggtaggatgacagtgaccctggtcccttgtgcctttgatataagagctccataaatgttactgacactgaggaacttcctttgggtagcagtctctccctccccttatcatttgaagaaatttgatgttgggcctatgtccgggagccatttattaatgtcctgtgtgtttttgatgtatgtagtctgatattctcccatatctggggcagtatcagtacaaagggattctgtggagatcgtggcaatttgctggaacttacagcagagacagtgctagcaggaaacatcctctccttggtaaatggggatgtcttattgtggaaccatttgatggccgtgttgggagcccttatcctgttcttcccacagcgtgggtcaggtgtattctccctcacatgaagaaagtgataacatgttcattattgagcatcctaataaatatgttcatatttcgttttaaatgaaatatggcagctgtgcctgattttcagttttatcagctaatattttaaatgcttagcatttctagataacacgggttggggatgaaattgagacatgttctgggtatataaaccaggttggcctgaactctgcctctctccaagactaaaaacattgtgttttgatgtgttggtgttgggaatcaagctgagggctccagaagtgctctgtccccagtccagctgttttactttgtgccccctatgtgtgctaaagtagcaagcacattcctaccacagagctctctcccacttaaactcttcactaagagtttgtaaa

SEQ ID NO: 23486 - DNA, 1943 bp, Mus musculus
ctccttccaccttgtaagtcctggggctcagactcaggtcattaagcatggtagctggcacctccactgatgaaccttctcaatggccccaaactaacctatcttaaaaaaacaaacagaaacagacaacctgagcttgccattcttccttcctacccgtgcccctggctctcccgaccctagccaaggccagctctctcagcctgaaagccttaaagccttaccgttctccttagctgtccccttcctccctccccttccacacaggatgcaagctgcacaaaatagccaactttgggaattgtctgtaagggatttccttgtttgtttgtttgtttgtttgtttccagtttcaagaaaatgttctcttatgttttcgtgattagtctacgcagcaaggaagaaacaaaaacaaaataataatcatgctcttttttgtcctcctccttctaggtcctggtgcaacctcagatcattaagacagattcccttgtgttgaccacgctgaagacagatggcagccctgtcatggctgcagtccagaacccggccctcacggccctcactgcccccatccagacagccgcccttcaagtgccagtaagggtcgggctctgcttcctctgggctcagagtttctaaagcccgctgctgagtacatgtggggagcttagtagaatgtgtccatcagattggaaacatcaccccacttttagtttgtttcttcccttgaagcagtgttgtggagttgtgctgtattaagtcttgggagcttgtaagggagtggaacagaaccctagatgagccctgctgctggacggcagctcctcacagagccgtcatctttttttaccattgttgccgtggggtttgactgctaaaggaccctagggccaccagacagggagaggtatgaagaagacagacaaggaaagcaccatccttcagttacaggatcccagccactttgagtaaaggttatttacattttggaagcattaacattattcataaaatctgagagctagagttggagaggtaggcagtggataagagcgcttgcttagcacactcaaggctctgggttcagtccccagcaactcataaacagggtgtggtggacgggactggaatccccgaactcgggagatgcaggcagaaggtgcaaaagttcaaggtcatcctcagctacataggggccagcctgggctatgtgagaccttgtcttaaaacaaaatagaaactgctaagaactagaaactattcaaatgtccgtccatgggagagaaacaactcacaatacacctgtaaaataaaagtattcccaacagtgataggaaagaaaagaagcccgacccagacggtcacactagtaatcccagtagtaagacggtcaagagttgaagcgtgggctggtgagatggctcagcgggtaagagcactgactgctcttccaaaggccctgagttcaaatcccagcaaccacatggtggctcacaaccatctgcaatgatatccgatgctccgatgccctcttctggtgtgtctgaagacagctacagtgtacctacatataacaataaataaatctttaaaaaaaaaaaaaaaagagttgaagtgtgactgtgctgtgtgacagagcagggttatagggcaggacttaagggacattctgtatggtaaggggttatagggcaggacttaagggacattctatatggcaaagtgttataggtcaggacttaggggacattctgtatggtaaggggttatggggcaggatttaagggacattctatatagcaaagggtttttgtcttggatgctacaagttgcatgcatatgcaaaacttcgaaagttctaaaaatgatacttgttatatgtaaattattcttttcttttgtttattttgtttgtttttacatagggttcctcagtatag

SEQ ID NO: 23487 - DNA, 3157 bp, Mus musculus
atctcaacgcttgtcctgagtctgaaacccagcacctggtactatcaccaccccaccaaccaaaaaaaaagaaaggaaagaaagaagaggtccagagttagggcgagctctgtgtccaccagccagccatgagccgggccctggcacctcgcagctgtgcttcccacgcgtggactgtggggctctgctctctcagctccacacgcacggccgtaactgtgtttcgtctgccttccttccagatgcacaagtctggcgttctgaggaaggccattgattacatcaaatatctgcagcaggtcaatcacaagctgcgccaggagaacatggtgctgaagctggccaatcagaaaaacagtaagtctgcctgccggagggccagcagacctcacaggggaagtcctgtggcaggcactgagaggtgggacgcacatgtgtgtgaggcccctctcatgtgggactttataaaaatggagggacttgtctttgcagagctcctgaagggcatcgacctgggcagtctggtggacagtgatgtggacttgaaaattgatgactttaaccagaatgtccttctgatgtctccgccggcctccgactccgggtcccaggccggcttctctccctattccattgactctgagccgggcagccctctgctggatgacgcaaaggtatgtgcttctgaaatgtctcaccctcagaatctctcattttctgtaaaggaatagtggccacagagcgctgacccaaccagcggtctaaatggtgtaaggtacagggggctgaatgccctgtgccgttagctgtctgtgaggtgggagctgctcagtatggtccatgcctgtaacccagcctggcagaggatcttgagttccaagcaagctgaggaagaccaccctccccccaccccacccccatccccctagaaaagggcctctggatgaagaagccacagaccctcagaccctcagacttagcaagtcagacagggaatgaggacacagagcagctgtcatgcgggtgggctctgggagcccctggacgcactccattactctccctgcctgccactaatgggcctggcaagaccactttctaggctgctctgctcgattagagcaaggccgcctcttggtgctctttccggaaacaactacaatttgcaatctaacagttagcattccaccaactgagggctcttaaatggtccctgaacaaaagagcccttggcaattgaagttttaatggaattagtttgcagaggccctgagcacagtgatttcccagaacctttggaaacactgaatcctgtcctgcgtcttgcaactggagtctttctgactccagaaacatgtggttcgttagtatctagtttgttcatgtgagggttaccatgttgctctggctggcctagaacctgctatgaaattagaatgaactctgtcggcctcctggtcttcctgtctctacctgcgaagtgccaggattgcaggcattgccagtgcctttgatgtgtgtggtactggggagccatttggccttgtccgtgctaaatacattcttttttctttcaagacaaggtctcactatacagtcctagctggtgggctggaactcgctctgatctctatgtagaccaggttggcctcaaacttacagagcagctcataactgtaatgtgagttccaggggggccaacaccctcacacaggcaaaacaccactgcgcataagataaatgattttaaacaataacaattacaaatcatggctgttctgactcggagctgcttttctgaaggtcaaggatgaaccggactctcctcctgtggcactgggcatggtggaccgctctcgaatcctcttatgtgtcctcaccttcctgggcctctcctttaaccccttgacttccttgctgcagtggggaggggcccacaacactgaccagcacccatactcaggctcgggccgcagtgtactgtcactggagtcaggtaggtgggtcccctaatgctggcttgggttgggtggcctgctgtggcaaaaggaccctgtgcaaaaatgggcttcccacctgcttgctgctgacggggcccagcctgagttagatataataagacaagcatgagtttgttgggacaagcaaaaccagtctggcacctgcttttggaagggactgggtgggagagatggggaggtgcttgtttgaggggccgtatgtcagaagtgagaccggtgtcctaatttcctcttaactgggggttttgtggcactcagcaccatggtgccagggtataaaaggactcttgtttaggctgcggaagtgtgtacaatttcctctgaaactgtcacagaaggctcacactttgatcttgcaccctggagtccgtcaggtgcctggctgtcccgcaaggctcctctggtagtctcagccgagtgcccctctctaggtgctgggggctggtttgactggatggttccaactctcctcctgtggctggtaaatggtgtgattgtcttgagcgtctttgtgaagctgttggtccacggggagccggtgattcgcccacactcacgcccctcagtcaccttctggagacaccggaagcaggcagacctagacctcgccaaagtgagttccgtcatccgcctttcttcacctttctctatgctcagggaatgttgttgagtccccagtgtgaatcaagccctgtggcaggtgctgggtgactgaggaaagagaagaaccaccccccaccccccccccgtatctagaacagccacagggcagtgaaggagggtacccctgtgtgtagatcatgctgtgcacacaaaatgatctctgcagtgggacatacgaatgctgtgagtcttgaggcgtaagcagggctaccctggacaagaggatgggcaggcagacgtggcagggcctttcaggcgaaagtgtcctgagaactgtatcagccacttgtctccttactgtaaccaaatacccagcagaagcaatttaagggatattatttgagttcatagtttcagccccacgcgggaaaggctggtggccgtgggacaggagcttgtggcgtggtatctcatgtcttggcagaccaggaggcaccagagcgacagggagagatcactcacaagacctgctg

SEQ ID NO: 23488 - DNA, 1207 bp, Mus musculus
accacacacctgacttctgtccagtgaccagcactcctagcagctaatcctaacagtaaccacaagccaagttccagtcggtaggagaggcagggagccacatagctagtaacttgctgagcctgcatcccgtccgcacctttgcacctttctgagcacaaaggccacttctcgtctcctctggcacctctttgacacaaataagaggagatgtttgctttggttctcggtttgcagagtatagtccttcgtggccaaaggcagctttcagccacagagagaatgcggagtcagcctggatctggaggtgtgcggtagtcctcaaaggcccgccccaatagctcccatctgtcacctaggcccaccttataaaggcaacacagtctgcccaggtggggagtgccaccaagtgcagaccccgtgctaaaacccctgagtctgtaggtgacggtttacaatcgctgttaatgattgtactggagaggcaatgagactgtcgtcttggagactgttgacatgagtgtctgtttctgcccgccctagggaagcttccggcgggatctgcctgttcagatgtgcacatggctctgtgtgctgtgaacctggccgagtgtgcggaggagaaaatcctaccaagcacactgattgagatccacctgacagcggccatggggctcaagacccgctgtggaggcaagctgggcttcttggctgtgagtactgttcagttcctgtattattggcttactttcccccgtccctgtggtaaagtagcttttggaaagggtatggtccatcaaggcagagagggtgtggcagcagcgacaggccatgcctaattacactgcagtagcagttaggaatcagataaaccaggaacaggggccagcctacacccctcatagtgacctctgtatccctatataattcccaattataccatggccaaaaagttccacagctccccaaattggggaccaccagctggggaccaagtattcagacacacgagcctatgggtgacattttgcagtcaggccataatgtttccctgagtgctttcccatcctgggcctaaaagcagaatgcaccctgccacttgaaggatttgggggggggggtcacttgttcttccacaaaggcaaagagtgatgaagaaaatgcagcaagatgtcccccttgctgggcttttcaggcagagagcctt

SEQ ID NO: 23489 - DNA, 1208 bp, Mus musculus
gaacaattctacgcagagcaccaacaggctgaggagtgggagggggcggcttgagctgtctgtttcattggggcaggccagatttcaagcccctatctggtaaatacccagccctacaatagcactcctacctgagtgtgtctgcctctgactcaggtgaagatgccgaggctcaacaagtaggttacctcaagttactgtgccactgagcctcagagccacaatggacggcaaagctgcctggcgggcatccctgcttgggttcttcttgctcctccgcccttcacaacccaacatcctgtccccaggccagagacttgtaacactgaatctgagtctccagtcacctccaggaccagttaaggactgaacagaaaaaggcttgactcggctcaaagccagcgtttcctgtctggggctggctcaaggagaccacagtggcagtatcgcagtgccagcagatgccacagcaaggagggtgtgacgacgctggcacagctgacctgtgctcacctgcttgccttctcctactcactgctctaggagtcccttggtgaaggccgtcttctatacctgtagagccatgcatgcctccctctctgggaaagctgacgggcagcagaactccttctgtcactgtgagagggccagtggtcacctgtggagcagtctcaacgtcagcggcactacttctgatccttcacttaaccatgtgagtgggagcccctggagggttcggtgtggtctgtatgaacagttccgcccaagcttacacagcctgctgggctctctgagacacagaggccagatgcacagatgaagcctactcgggcaatgtgccttttgtttccccgggcaaatgtgtttgcaccttttcttctcccgagctctcttactctcaggtcctgctagctggcagcttcctctaagtcccaagtgaacgggccagggctctgcgtttgctccaggtagtccgctgctcccttgggcctgggcccactgacagccctggtgcctctggccggctgcacacctcctggcgggcagctgtggtgcattgtagttgcattgcatgttctggcaatacctgtgcaatgtttccacagtgcatcacggaggcctgccctgactgcccacggtgccgtggccaaagaggatctaagggcaccgctgagggcctacctaaccatcgtggggaataaggacag

SEQ ID NO: 23490 - DNA, 1208 bp, Mus musculus; identical to SEQ ID NO: 23489

SEQ ID NO: 23491 - DNA, 1104 bp, Mus musculus
gcatcaaggaggtagcctggactcatcaggggttacacacaacgcgcagtttctgcggtgcatgcgcagagggctgccttgtaaaaggctcataacagctaagctgccattcccatttcacagatgaggaaagtaaggcttagattaagtcacatgccagggttctgtagctgccaagacaaacgtgagaataccatgtgcctctgccttcctggtggcccacctccttctcttccctcctcccactgccctctgccccaggctccgctgctgccttagtcagccccttggttcctctagaggagaaaagcctggggacctctgggtgacttaccctccaggcccatcatgggagacggaaaatgtgcacctctccccacgctgcttcctcagagaggatcttctcctgcccctcccagccaccgtgatgtgtcccttttaaagctttggttttcttacctgcagagtgatgagaacaggccacacccagcttgggggtgggcagtacagggttaatgctcccggcagatactcttctcaatccctgcccctgagttttccgcctgggttcaggccaggggctgctacctgttgggctgagggtctggcaaggggctggggtccctgaattaggtgtgggcgagtcacagtctctccctgcggtttatccctaggtgatccagctgttcacctgtgacctgctactgtcgctgaggacagcactctggcaaaagcaggccagtgccagccagctcctgggtgagacctaccatgcatccggcactgagctggccggcttccagcgggacctgggcagccttcgaaggctggcccatagcttccgcccagcctaccgcaaggtgaggcccagcagtctggtgggatgtgcaggctagcgggggtaggtctcgggtccagcactaagatgaggaccatgggttcctttgcacactgctgtgcacccggcccagagtcatgtgtcaccaaccagacctgcaagagaggtcagaggacagaggagaggctaagcagctccctccccagtcctggccacaagggcgctcaatagttgtaactactgtcagatggcagccttgcccaaga

SEQ ID NO: 23492 - DNA, 2347 bp, Mus musculus
gggaggcagcaaaaccttgttagctgaggaatcagcacacggctctaaaaacttcggatgtcctcccagtgcagcagcaaggtagaagttgcctgggtttgactatctcagcccaccaactgccaagttcatcttcttctgccctttgagaaggacagggaagagggccgaagacacctccacaggatgagggggtgtgttcaacaatcgaggccgcacaaactccttgggacagtgcttatgtaaatgtcattcccacaggagaggtagacacctggcctggccaacgagagcgagctactgccatcctgctggcctgccgccatcttcccctctctttcctgtcttccccgggccagcgggcagtgctgctggctgaagctgcccgcaccctggagaaggtgggtgaccgccgttcctgcagtgactgccagcagatgattgtcaagctgggcggtggcactgccatcgctgcctcctgaccaccgtctggggcctggtccacttctttccacctttttgtctctttctcccaggatcttccctctgtctcccagactgtctcccatctgtttctctccctcctcccagagctgtgaggatgaaggcaagactgattgttctgagctgttacctgccaaggcttttggatcatttcgggccagtaggaccatgggcagagctccttaacactgctgtggtaaatccacggtccaagcccaggcgggctgagaagagagatggcctgagcaggaacggagctctcctcagttggaagcaatgtggggcgctgcgagcccctcccagtcctctagagactgtctcctttctgcctctggttctctttgttgttgttacgtttcattccagtttttgtttttaatcaggctttctctgggaactaggtctttgcaccagagagcattttgcattctggacttgatagacgcacccctttttatacagatgtttttatatgtgtgtgctcaggcctgccgagatgcagggcaaagttgctgtggcatctttgttcctctccctgggtctgcactccctcccctgtgcctgactaagccttgttcattgttctttcatccttacaagggacagccagccaaggaggaaaggagcccagccctggggaggtgggtgggagggaggcaggggcaggtctagggatgggtgaaaaataatgtcggcattgttttttaattttttaaaaaataaatggtatcttatttaattgtcctgttccttcccactccttccccccctcccccagacggccgcctgagctcagggtgggcccatggggctggacaggatgaggtcaccattgggcctgagggccaggggtctccagcatgacttgtttgctctccctcccccaccctcactcctacctcccatagaagtgtattcttatccctagttcctgtctgagtaagccagggtggcagacgctggtcccaaacctcacccagcaaccagcctctcattttcagggcaggcagcagagacccgggtctcttgccttgagatggggggagtcctaggaagaagagtggtctggtcctgtttctgcagactgcttggctcagggcttcctgagagacttgagaggaactgtccctcctccctcatgcttctcctcatcccttcaagctggttgaagagagtaggcaggggcggggccccgaggtgcttcaaccccacctactctgccttccacctctccccaaccatcactgtaatttatggcccccgccgtggggcagcctagcccttgtgtctgtgtatatactgtgccttttctccttgtcgaggggtgggaggggttggtttttcactgaacaggggatatgcctatgtcttcatcagtgttgaaacattcaccatgtgctggacgtaggttttcaataaacacagattggtaccacctaacacaaggctgtgtgagtctgtagtatgaccattacgctgatttaaccagatggcagcatttcttggccaatactgagctagggcctttgtgggcagcctgatggctgctttccggtggccctttcttgcccacaggtgtacctgacacactctagggatgggtgagagtctgggataaaagggctttatccagattccagctccttgcctggccattcagctctctgactggctggttggtagtagtcgtttttttggaacttgaggtgttaagtcactcctccgtcaggtgagcccttgcttcatttccacttcctgtaggtgcggccctcagcaattcaccggcttctggacacataccacgtatgttgttgtatttcccagctgagtcactttggtgaac

SEQ ID NO: 23493 - DNA, 1178 bp, Mus musculus
ttctgcagatctgcgctggccatgtgccaggcgtctccgcgctgaacctgatgtccttgctgcggagccccgagaaccccccatccaaggagctgtgagcattactgccctccacacgtttgctgccagttccaaaagcagccactgttggtgaagaccagtcagggcctgacaggcccagaggcagcctgctcactgcaggactgagctccaccagggaggtctgctgggcaggagtcgggagagagcccagcgagaccccagcagcctcccgtttctcgtctcaccccacagaggtcccatctgcacctgtctaacatcataatccacctaagattttggaacaaagagccatggctttaaaaaaaaaaaaagaaaggaaggaaggaaatgtgttgtagatgcagaaactgactcagtacaattgcgggggcaaagtgtggcttccaggagcccagggaaaatgtcaggtccaggccctgcgtttcttacagcccggctgttgtattctggtgcctgtttttcctcgtgtaagtggagctggttctactcacattgagagggctgaaggaaatggcaggtggcttgctgcccaagaccacattgctccctacaacttgttggtctctcttgtagatcacacacagtgtcatgcctcacactgtaacagcaagctaccaatcacattaaaaaaaaaaaaaaaaaagcaatccaggcagtggtggcgcacgcctttaatcccagcactcgggaggcagaggcaggcggatttctgagttcgaggccagcctggtctacagagagttccaggacagccagggctacacagagagaccttgtctcgaaaaaaacaaaaacaaaacaaaacagactgagctattgggtttctctgtgtagccctggctgtcctggaactcaggctgtagactaagctggcctcgaactcagagatccaccgaccattgcctctcgagtgctgggatcacaggcatgtgccacccctgccccgcagtgactgagctgatttgtaaagccactctcacatcaggaatgacagctgcaaggtcggagtgtgagaagtgacaagctgactgtggcattgcacactggatccaaagagaaggttgtaaaagagctgggttggtcctgtcagccccgtcaaagtccccaattcttca

SEQ ID NO: 23494 - DNA, 1099 bp, Mus musculus
cataagaacccacctcatgctctcattaaagtggcctagctgctgggccgacactagtgaactggctacccgtttccttctgttttatctgtagtggaaaacctcaaccactgtgagtttgccctgctccgagacttcgtcatcaggtacgatacgcccccacactcacccagctggcacatttaattatttatgatcaaaggccatctgcccagattcacttcctgaatgtctgccctctctaacagagctctctatcccagtgcatctcagaggggttgtaaaattgacattggtcctcaagggtgggtcccagtcattgggtccagtctactgaggagatgtgttagcctctgaggtggaccaccttttcctcttctgatccctaatcatatctgcttctctttttttactctgtgtcccttcaggactcacctccaggacctcaaagaagtaacacacaacatccactatgagacttacagggccaagaggctcaatgacaatggaggcctccctccggtgagcgtggacacagaggaaagccacgacagtaacccgtgatgagcccttctctgtgttatcatacatatcccccttctccaaacacacacacatcctagataccacctccagccaccacctcctctcagctctgtcccccaggcctgtctggtatttgtgcagtattttgtctagtgtgtgtgtgtgtgtgtgtgtgtgtgtgtgtgtgtgtgtgtgtatgtatgtgtgtatgtgtgtgatggagagtgcctgcgtgtatgtgtgtgtgatggagagtgcctgtgtgtgtgtatgcatgtgtgtgtatgtatgcgtgtactcaggggtgaggtattttcattgccctctttggaaagtcctttgtaagtctgctttctccatgactctccattctgtctccttttttcttgtgctccagaacaaaaagctgtgcgcctcactcaagaggtctggggaaggttttaatttataatgctgggagcaggtgagccacaggcaactctttcttacttctgacccacccacaaactggggctgcaagtattcttcatggactggtggctgagctagcctg

SEQ ID NO: 23495 - DNA, 2277 bp, Mus musculus
cagcgtcctttgcctcctttcttcatatatattcatgcattcaccccatttcctgcctgtctctgaccttttatctccttttagagtcatctatgttagcttcctttctatatttagaaatcatgcccagactttctaaattgactttctattaccctaagatagaatcacagctaggggctgaagagatggctctgtgcttcgggggaccttttgctcttgcagaggacccaggttcagttcccagcaccttcttggtagcttacagttatctgtgactccagttccagaggacctgacaccctcttttagcctctatgagcatggtgtacatacatacacatagacaagcactcatacgcataagataaaaaaaaaaaaaacccttaaaagaataagatcctaagtaaaagcatggggcagggcatgccgagattgcaagagaattcagttatagagaagatgactaggaaagccagtttctgcagctgaccactgaaatttgctctgacttgggaatagcctggggaaatgggagaatttggtagcttgggctgctctgggtgttctgttcaagaagcacatctattgggcaaatgaggcaaactttaggtggaggaaattatattcacaaactaattctgaagaatcggaaaaaatatacagagtttcttaggcggctggacttgtgagacaaactaacacagtttcccgttttctagcagccttctgtccatgttaagctggcttctctgtggctttgtttcttacaaacccaactcactctttctctgttctcatttgtctgtctgtctttctcggcttctcccctccctgcattctctcaccatccaatcctgtagatgttcccaggaatacccacagccatacatttagccttctcttgccttctcaggagccttgtatttattaatgcatactttaactgctccttgcacattcaagttttttttttttccctacagtttctaaggctgctttaaggaaagccatttagccataggaaagggaagataccacaaaattctgtttagaactgatctatccactatgccacctcccggtccagcctgggtgtagaactggtcttcactgacttcagccctttattacccagtcactaggaaaacaaacacacagacaaacaaaaaacaaaaagagatggaagacccacaattcagtggaccaagcagaagtggtcctaatcctatggtcttagcctttcctggagactgctctgtctctagtcctcatctataacgtcactaaagagtggccagctgtcaggctagagtggtagcaacatagagctcgctgacagctctagtgagctgccctgtatggtgacatgggattgggcacctagggccagcaagggataagaatggtgggtgttggagagtctaagtaggagaatgctgcctgtctccactaagctgtggtctcactctccctggagaagctgttttatgtgtctgctgccggctgccggtctccacaccctcaaccgttctcaactccccctgcagggagaaggcctcctgggcactgtccttccacctgtaccagccaccccctgccccactgctgaatgaaggccatttcaagtgctgcttctccctcatccctcccagctgttattgctgcagggccacgccccttttagcgctgtgcttgtctagcccaccagcacagcccctctcagccctcagtaggtgggaggggctagctgcggctttaggacagttgcttcctctgtttagccaaactactcctctcctcccaatggaatggagttcctgccagcaccaccctgctccatcatctgtgtcagcagcaccccagtccttgtgtagggaggaggaactcatgggaagctgctcctgcccttgcaagcgcataccagcgacttgtaactgtctccaagggaaccggcattgctctctagccattcattctgcatgagtactttcttggctaccttaaccggtcaagaaagcaactttcctgcttgtcagagtcactgaggtcagccgtgtgagcccctgtgtgggacaagggtgtctccttcattgcttaaaggtattttataagggtgattcattatacatggtggggagccagaggctagtgtcacttaaaaaaaaaaatcaccactggtggctggcccagtgagtatgtgtgtagacaacctgtttaccccaaaatatggccatctgggaagtgggttttgctgaaaagaggttgctggagttg

SEQ ID NO: 23496 - DNA, 1109 bp, Mus musculus
atgatggaggagaggaaagggaatgcagaagataccagtaaggagatgggcaaagggtgatccaggaaggcataccacaggaactctcacttcctactttacattgttaaagctgctttgtatggtttctcctcctcccccgctgtttcttgagttacccacatccttacccatctccaagtattggcccatcctccttccaccgtgtaatcctgtcatcttcctttaccctatttggaagtgactgctgctaaagcctggtgtgggatcttgagcttttgtgatcccagcactgcagaagtagaggcacagctcaggggttaacaggagaacttatctcagaaaacagaaatgccccaggcctggtggcacacagcagtaatcccagcaccggggaggtggaggcaggaacaccagaacttcaagatcctccttggctacagtgggcttgagactactctgggctgtgcgaggctgtcttacaagtgactgatgcacgcctttcttacagggcacagggagcacaggagaaagcactgatgatgtggtggcatgctcagctccctcccgtcggcagaagggtcaaggaaagccctcagcctcacctcctcatggtttgtgacaagagcccagagtcctgtgctttgggaggctccctcacggctgtccacagagtactggaaataacaagcaagcaaattaggagtgtataataaatgagtcatgtatgatgagaggtcgtccccatttctcactcccagcaggcttggttgcactttattgtctcttccgtgtccaagaagcacctggtgtagagccaggacatccaggctattgtacaaccacagaggcaattgaggaggactgagatctttcctttaaaatgattaactatgtatctgttttcaggtgctctaggaggcagcattccccctaaagctggagttaaaggttattatgaatcccttgatgtgggtgctgggaactaactctggtcctctgcaagagcagcaagtgcccttaaccactgagccatctttccacacacaccctcctctgacttgaaatttttctactttccataagttcaggagaaacttgcttcaaag

SEQ ID NO: 23497 - DNA, 1624 bp, Mus musculus
ggaagcacccagtgcctactgtttgttttccaggtgagactgtggagatgagaaggtggaggacacacgtgacggaatggaatcctcctgctgtgcaaccacaccccactctgccctgccctgccctgcaccccccgctgcgctgcgcctgcccatgccagcacttccttcctatgttctcacatcacactcaaactggtgacaccacaggaaaagaaagatacaagatgttggaatggctgtttccatggacacaatctccatagtgacaatgtgggggaggggggaggggagggctgatggggaaacggggagttaaaagggagggataaaaaatatatatatataaatctatttttagtctggaaagactttgtttaaatgaaaggtgcgctatcccttttgattctattttaaaattatctagttaattcaaaatttgttccaatgacaatgaaatttaaatgtgaaattgaactgaacaaactcatctcataaaggatggggtgtggctttgatctttagcctgtctcacaattcagtgaacactagaccctggactgaaagagtagacaaatgacaaccacccttcccttggttagaatctgtctcacaggggaagtttgagggagggggacagaatggggatggtcattttcaaaagtgtggggaatgatgtttaaacacaaataaatttttttctttccagaaacactatttatttatttttattttttccctcctttttttttttttttgcggggggtggggtggtagtggtgaaattggcagatgccccaacatcatggctgtatcctggatcactgtggccccaccaagtatgtagagtagccccacagcagtaggtgtacccaaggaatggcttatctctggcgccctctttccttggcacattccatgtagttggtacccttgtggggacccacagcatccatggaaaccatggaggcccaggcctctgctgctgaaacaagcagagtctaggagagaactgtggcgtgagccatgtgggtgcactaagctgaccagagccagccactttaacacttctctattgcttttattttttagagtggaaaggggacttgtcagatatgttgcccatgctatgtgattctttatgttgtattgttttgatttgtaaattgtataatttttaaatatgagttttaaaaaaagaaaaaagtacaaaaaaaatcttgttaaggccttaagaagggatatgtgcatctttcaggggtcactctgccgtggggataaaatagctgttttacaaacagttttatttaaaaaaacaaaaatcaaaaaaattaaaaaaaaaacaaaaccgtaataaacttcattttaaccttgtgtcctttttcatttactcttaagtgaatgtgtctcttccttctccagaatggccctcccaggaagtctttggctctattccccagggggctaccatcagtcccaatccctttgttccttttcctctggaaggcaaggtggtccttgccagcagagcctgaaaccaaaccccagggttctttgcctcctgtggggcccattctgactttctgcagttgacttgaggacatattctgaatcagcattgatt

SEQ ID NO: 23498 - DNA, 1148 bp, Mus musculus
tgtaaatgtaaattttttttcttgggttgtctgttcagctgttacattgaggtcagtcagtatccttcaagtgccaagtatttgctgaaaccttatggtcagagacagaatcataccactgtcctgtcctcaaggaacactcatactcaggatcagatcgagagccaccattaacagggacctacacaaggcaggaaagggacagtgagtgtccatatgtgtgtcctgatctactggtaccccactttctcacacagaatggtgaggaaggggctttgaaactgaggttaaaactacttagtatctctatgcttctgtttcttttgtaaagaaagaatagtgatgaactcaatgaggatttgatgaggcctcagcaaatactaagcatgctgctgctgctgtccagctcagtgtttctgagagctacaactgctctgtctagcagaacgtgccagagctagaggacagaagatgctctctggcatgtgggggttatgcacttgtcaccaccaggctaagaggataagaaaagtaaagtctttgaacagttgcccagtagaccacctcccatttctggggatgagaaagcatcacggtagctcagtgatactaagattgttattctcgggctagattgcaggtgtggatagggaccatagcttctctgctagatcctgagatgcagtagacagggaacagaaaccattatttgaagtgatgctctgtcctggatgctaggaatagcacctacccacatgccctacacagaacagccatggaaagtaaagggatggcatcctcccagttccctctggggcagcagatggcccatccacagatgagtgtcactccaaccctaggttcatccagggggtgctactgggattactcctctgaaagttaagttgatacggagtcagaattagatctctctcggagaactcttccactttatgtagagatcacatgtgagcttcagagaggagactgcctctgaatcctggcatagttgagctgggtaatgcctgttgctgttgagagagtcaggttgagtgtttggaatagaaggatacaaagggaaccttctcaggttcaggccacagggtatgttggggacatcagaacgaaacccagcgctctatctacct

SEQ ID NO: 23499 - DNA, 1188 bp, Mus musculus
gaactcatattttctgtaaagaaatatacttgtattgggcatttaggataagtagatcaaaattaaaaataaaatcttataaatataaaaactagaaaccaagtcccacttttaattgtaaaaagtttctatatgtgttgtgtatatatataccttcactctcctcctacacaagatttctgtggcagaaatagaagcagggtctacagacaacacatgatagcagaaagaaatttcagtagagcagggagtgggtaaataggcaggtttggggtagcacactcactggtgtgtctgccacatactgtagagtgtggcttgccctagtgtgttctgcttgatgtgagttcatccataaggcctagcctagaacagtgctatatctcttccattgtgtggtcagcaagtggtagagacctaccaacctagcctaccaccacagatccctccaaccacaaaggccatgctgagaccgaactaatgaggtagggaaggcctgcaagaaaagggctggtctagagttactaacatgccttattttcctttcagaaatgctcccactgccaggaggctggcgctactttgggctgctacaacaaaggctgctccttccgataccattacccatgtgccattgacgcaggtaagttggaccacacaccctttttgagaggatctagagagctagaagatacaaattcattatctccccttctgtatatttttattgtctcccttatttttctcctatttgtaagttctaaaatgtagagaggaggctacaatgacagagcaagtttaaaaatacctgttttgttcatctagttcatttatgagttacctacttaagtgtacatacaattcagtggtttctatgtgtttgtggagttgagtagccattactccaaaatatttaacatttaggttttcatcacttgtgaaatattaacaccttccttcccctcactccagctgttggcaattagagattcactttcaatagatgtttctaattcagacatttcatataaatggaacattttgtggccgggattttcagttacactatttctaaggttcatccatagcagcatatgttagttagtacttcattcattttccctgccaaactatctgttatataggatgggctggttagactcacctttcatcagttgatggctgtgg

SEQ ID NO: 23500 - DNA, 1146 bp, Mus musculus
gggggtggacaaggccagtctgaggtctctgggcctcacggaggccagagatagcaggttctcagtcttgggtgtcctagacactgctggacactgcggaagagctaagaacaaagtggaggccccaggggtgtctcagtcatccctggggcggaagagaggagagggaagggagaaagggcgcattctggccggaggttagatgtggctctttaggggaaagcctatcccatcgttcaagtatgacaggccttgatgagcagagacagtctatggttttagacctttattgtagaaaggcagagagaaagagagaagatagagaggccagccttggccacatgggaagaaggagggaagggagggagaaaaggagagctagagatgagagtaagaaaggtgagagctagccgggcatggtggtgaacgcctttattaatcccagcacttgggaggcagaggcaggcggatttctgagttcgaggccaacctggtctacagagtgagttccaggacagccaaggctacacagagaaaccctgtctcgaagaaaaaaaaaaaaagaaaaaaaaaaaaagagcttaagagagggaaggaggggccaagcagttccttttatagtgggctgggctaccttgctgttgccaggtaactgtaggggtggagtctagccagaatgccaggagcttgggacattgtctgtatgacttatagtcacaggattatgtagttaggggctctggtgttaggtgcctgtctctgggaccacagctcactgttctgtcccttgtagagttttctactgggtctctggagcaagcctcactcaaccaaaacaggttgcctttcatggtcccatacttgtactttgcctatttcttagaaaatcaatcctcccctcccccaagaaatctagattctatttaataagacatatagaaacctgaaaatggctgtgcttggtggcacatgcacataataccaacactcagtgtcttagggttttactgttgtgaacagataccatgaccaagtcaagtcttataaaggacagcattaactggggctggcttacaggttcagaggttcagcccgttatcagtaaggcaggagcatggcagtatctaggtaggcatggtggaggag

SEQ ID NO: 23501 - DNA, 1148 bp, Mus musculus
tgggctcctgggggccattttcattcacaccaccacagaagcacacagcaccttcctgtaccgtaaaagtctccaggagaattccagtcagattcagatcttcaggagccctttgtccgaagtgcatggtgcctttagcaagaagatcttattatttccaacttgtgggaggctaccaaagataacaataggctatattgttttgggagtctcttgaacgcccctgaccaacaatttgaaaaggaatttcttgtgggtgttttttcaggggtttgttagtgttttactctcttccttttctccacctttcctttgtgtattgacttccctcaccctccccaatgaaaacctccttcctatttcctccttcaaatcacttaaagatttatttttattatttctactttgtgtctgtatgtctacaggtgctttgggaggcaaaaggggtcagatcctcttgcaggtgttgtaagccatctggcttgggtgttacgaattgaacttgggtcctgaaagaacagtacatgctcttaaccacttagccatttcttcagtccatcatacttgatcttactgtgggccattcactctgttattttctatcttgctctgtttcatttttttttcagtgttgagttcaagaccctctgatttgaatttacaacctgcttcaggtggtctcattcttgctttgaattctttgttctactgtctttaccccgtattcccacctgagagccagtcatgccagctgtctatctgacacttctctctacttggattccagtgagaatctctgagatgacgtgtcaggcaaagcatgattcattcatattgtgcttccattgttcccctgtcaacaatggtgcctggttttttggtcgcatcgtagatgttgctacacaagcccactgccaagctggtacgattgtacagattgaggtttaatctctaaaggatgtaaagcactggtattcagctaatattgctatattgtttgtgtccctcacattcactagcaattgttggctctgaattctaaatatggcctgtttcaccacatccaccaacaccacatgatctgtgcagtcaacatcccttacataaattactaaagtagcctcttaactgaatctacttcagccctg

SEQ ID NO: 23502 - DNA, 1200 bp, Mus musculus
tcaggacatcatcacatcagaggactcaccagttgaggggatgctaggttttatgctcactgctcctcagacctctggagaaagaaagctaaaacagttatcaggagtttttctttatttctttgtctactacatttacattcctcctgcctttttcccttagtaatacgagaatctaaactaggatctagaaattgcagcatttgtgcagatcttatgctgctgcatttatttgcctttttattttttaaattatattattatttgttatgtgcaatgtatttgtgtgcccgtggcaggacagtcagagaaaacttggggagttattttggggaataatttcaggtctatttcaggtcttcttgctggttccttttgtgtttcttcatgatcttataactctaaattaacctgccaattaatttttaaaagatttattttaaatggtgtatgtgcatgtgagtgccgtgcctgtgagactagagattccctggggctgaagttataggcagctataaggtcatcccttcccctacatacacccagggaacccaacctggtcctgtgcaagagttatataagcttgtaactgcttagcttgctttctccttttttgtctaggtctctgttcctctctcctcctttcctcttctccccctgttcccccccccccccccccttttctggtttttcgagacagggtttctttgtgccgtcctgactggcctccaacttagggatccacctgcctctgcttctggaatgctgggaccagcatcttgctgcttaattatctctttactctccaacttgccaattgttggtgcccttcttgaacagttcaaagagacgatttcttcttcttaatttgaagttggagttttgtatttctgatatgtttttaataattctttgaactagttctaggtgtagacttgtggatttgagagctctatgtatgtatgtatgtatgtatgtatgtatgtatgtatgtgtgtgtgtttgatatatatatatatatatatatatatatgtatatatatatatatatgtatgtatatatatatatatcaatgttttagaaatatctttagtttactgatactcaaaagaactctaatgccggctggggagcctcagtcaggaatgcacttgtgttgtaagcacaatgtctgtagttagatactcagagctcttggt

SEQ ID NO: 23503 - DNA, 1213 bp, Mus musculus
ttccctagctatgaaatgggagtggttatcatgctgagttataatggcacttaactgtaaactgggcaggcatggcccaattgcctactttaatagtctctccctgccctgagagagagctctgttagggcagcatgaaggtataggtaaggccagagctgaaagtgcaggggaagggctctagaaacttggcattttctagatgaggctgaacctacatctctggttactgtgggcaagaccagggggaagtagtttgctagggtgtgagccctggagatcagcaagggcccacccaccattgcaaatgagccactggttggacacatggcagagccactgatacactgagtagccctgaatgtggcatgacctcagcctggacctcagaccccttttttgtggagagggcttaggtctacttaggtttcctgcttccttgaagggctctgattttcctcttgctgattttcttggatggcttccatgtaggcagtgccttgggcagtatcatctgcccactggtttgtctagaaaggatgttcttccctctcattttgcctggcttgcctactattactccccactggcactgtacgaaggctaggagaggggcccaggagcgtctagcttccctccaagaaaacagagctgctcagtactttggcctgtaccatatgtgaatacatccaggtactgggtattgtggggtttgggagctggccacagatggctctgggaggtgactgactaccatggaggatcccagaggtcatgagcactacctcctcccgccagcacaagcttcagaaccagccactcagttccactgagcctgggctgggtaattgtggcacctcacttcctcagaccagccgtccagtccgtgtgaggctactgaggaagatggaggagagaagcaggttaagatgctgggaggccagagactaccgacaggagcttcaggagacacaggcgcgggatgaggttactgtgcgagtctgccattgcttgctgcggggataaactgataatcgggtgtacgagaaggtgtgcatcacatggctgtggctcttcgggaacattcgttacctcttgcccaagatgtttctgtacacattcacacacatggagttgcttaggctcagatactgtctcggccacttgctacctggcatcctcaggctatgtgctcaccactgcctgttgcctt

SEQ ID NO: 23504 - DNA, 1175 bp, Mus musculus
gctaaggtcagagtgccttcctcaggcgggatgttatgggagtgcatagcaaatgctctgtgccttctgcccaagccctctctccaaatggagcagtcaggaagagccacattcagcaatattctcagagactgagccacaccacagccatgccaagctggagccagatctgcggaaagccaggctcagcccccagcattccatctcagactcagggagagggagggctgcctttcttccccaggggtgtgacagagtactcactacaggctgaatggctgtgtgaggctgggaaggtatatcccaccctcagaacagcacccatcaggagagaagggcagggagtttgctgctctctgcaaagtctgtctgaggtgcagttgccagaagagcacaacagaggtagaggtgccatgccatctccagtctgcagggagctgggctcgtggtggcgttgtcaccagttagcttcagaagagggtgtttagaaggacaccatgaggtgaggagtggggtcaggagagccccacagccactagagctgttcagatcaagacagagtgcaacatctcaccctgtcatgactggtcactatcacagctgtccctagggacagaacctgcctgtgaaggggctctctttttaccgagagaagcccttgcaagtcttggaagcttgggttctgggtggggcatggctgctctggtatccacagccagaattagatgtgtaaaggaacaggctttaccaccttgcctcaagtccctaccaaccctgcattgcacgtgcacttggcttcacacactgcttgtcaccctcagcctcatctcctcctacacttttagaccctgggctgtactcaaactggtggagaactggaaccctccttgtttgttcctacagtgcctttggccatcccctctcagttcatagcatcaagcttcctgcacccacaggctctgctggaaacctatgcaggccagtaaaccctgtcctcccatccccgggggctctgtactcgagactgtcccagttcgaccccactctgatgtgaaatctttgaggtccaggacttggccctctttggtgtcctatccacaagggtcacctggcaggatgccaagctccaggctgctgcacgtcagatgaagtgatatctcagaccctgccctccc

SEQ ID NO: 23505 - DNA, 1324 bp, Mus musculus
agcttccgccccataaccgccctccggccacttagctggacctctgtcctccaaagccccaagctacttctgatcgttgggcctttgcacatcctgtgtgcccttccccggtcctgtctgccttcagctttcctttgagggtccttcggagcacctgctggacctttgcagaccaggcattggccctcctggtggctgttatccagctagtccgttgcctgtgtcatttgtaattaattatcagttgcttggctgttcccactagacagactccaggaggcagggtgagtgtctgccgagtgagttcacggctgagtccctagcaccaggcatccattcatgctctcagccttgcaggcatctgttcattcagggagttctgagtgcccaacccagaggccccattgtctcctgcaaatgggtggatgaatgagtgaatgtgtgaatgaatgacagtcctctgcctcaacagcccacatttcctgctatctaccattgcctctgacccccctttgctgggccttggtttccccagctgtcactagacactagatctgtcactctggcctggttctgattgtggggtaggaacatctgcctgggggccacccagctgagcaaggtgggggccgggggaaagggacttgctctcaaccgtgtcagcttgggcactggtcccactgtgttcccacatctttgtcaccagagtccccaagttgctattggggtgcagggctgaagggacttgcttgggccactcagcttaccccaacccttgaaaagcagaggggcaggtggtggggggtggggaggggtgggaacactacgatccacgagcttgggtttgagcctggcttcatgcctccctcagtatggccttgccacctaagctcagtttctggctgtaacaaaagaagaagtgggctaggaccagctgtcctgacagctctgaggctccctgggaccctgggagcgtgcagcaggactcccaggctgtctgtctccagggcccagccctcctgccacctcgtgagccgtgctactcaaagtggctccgcggcttagcggcttgtcagccaggcgggtgggtgtcctggggccgggtttgattagttcaggttgacagtcgcgctccgcagcgctgccgggaggggagcccgtgattaccctaatgaagcttgaacgcagtttgtcatccaaacagctggttcggagctgtgctgctgccagctgcccggctcagcagtgcagtcgggcgcctggtgcttctccagcctttagccacccgcagacagggtgatccacaggaccaggcagcccccag

SEQ ID NO: 23506 - DNA, 2259 bp, Mus musculus
ggcctctgtgaccacacaacccacagaattcaaaatcaaactttgaggaggggagcgaggcagccagaaacagggcagaggagggtggctctgtttcccaaggcaaagttgagaccaatgggctgtcggactgaagccccctgaacaagggatgaggtaccagggagagcttcctcgctggacgggacccacctttctgtgttgtttacaccttgcccttctgtgcgttccatttctgtagtatgtttcctctttcctccattcatcatcaaggtaggctgtgtttgtcggtgtgcctcccctgccctcggcccctagctgatttctcccctagatatggtgcactgtttccctgggtggccttcttgtggccccatgggccacagggtgcaggaacgtattggaaagactgctttttttttttttttaatttttttaaaattttttttatgttttgttttcaagagttttcttgttctgttgaagttttcacacaaaacggaatgaatgggacctcctgccattcagtgagcactaggacagctgggacctcctgccattcagtgagcactaggacagctgggacctcctgccattcagtgagcactaggacagctgggacctcctgccattcagtgagcactaggacagctgggggctgcgtcaggctactggcttcctgtgttctcaccactgtccctctagccctgactgcaagtatgcagtgctggatgacgggcagtgtgcaaggcatcccagcattcatggtcccttgttagtgttgtgccaaaggccttgggtcagttctctcagcttccatatggaagtgaggaagggacctgtgcctattagccctcttgattctcacctgatagggcaacatcaaagcttggtgtgggtgtgggtgccagctccaagttggctgagcctttttccaggttctacccgggcgcctctgtgtgttctacagcacagaggacttcggggagattgattggatcagagccattggctggctctggctctgcttttctgccttcagttatctacagaacagcaggtttgcctgaagtgcagccttcaccagggcattgtctctgctggtgtcagtgacccacattgatgagtggtctgagcagctggtgggttactttacccagtgtgttcctgcattgtttagtgtggaactgtgggcaggtgccgagtgtcagatagcatcggtccagagctcgtcagaggcccctgacagtggaaacagaagatgctaagctgtcataggtggagcaggatcctaaggacgcacaatatcagttgtgcgtgctgtaaagggacaaaccgaggaagtagaggaagctgcggcactgtgacccattcaaggctagcacagttaagagaacttcagctaattcttattttcctgagttagatcccagcccatgcccagctggaagggtctcttttgggtcaaaatcagtccttcagctctaaggttgcccagcaaaggaatctaggaatgacaactgcagtgtccactcctaaacacctccttctcttacacccttcgaaatgggtacaaacttaattcttctcagaaactggaagacattcctctgtgtttgccccttcctgacccaagagacaccctatacatgagggcccagctctttacctctggggacagctggcatgcctttggctttgtgtagagtagggtggtgagacccttcctggctcccctgctttgtgagttaggcgtgctggggcaccctcctggccaggtggtactttggggacttgggtgtttgcatcataatgtcatcttgggaaacagaaaagaaggtgggccaaccctcatgtcccccactcccttgcattatttctttgtgtcttgttcaggagaaaagagggccttgttactttccacttctcaataaatgtttgttattcctaactttgagctataatgtcttttttcatggattttattatatttattggatgtctgtacatttcatgacccatgtgtggtggtcaggggccaacctgagggagtctattctctccttctgccacatgggttctgtgattgaaactcagttttatcaggcttaagggtaaacacctttacctattgagctagcttgttggctctgggctgttcccacacacacatttctgtgtgtgtgtgtgtgcatgtgcatacatgcgcaagtgcacaagtgtatgggcatacttgatgcttgaagagaactagatggt

SEQ ID NO: 23507 - DNA, 1132 bp, Mus musculus
ggtctgcatgtccctcccaacctcacgtgtcctttgcaggagcttttctgtgtgtgtggcgctctcaagcgggctcgactggtccatcctggggtagcagaagttgtcttcgtgaagaaggatgacgccatcactgcttataagaagtacaataaccgatgtctggatggtaggttaggggaggctaccatcacgctcccctctgttttaaagcagtgagcttttggggtaaactatcctcaacattggtacaaagacgtcttggggaactcaccctactagggcttctggataccaggaagaggcagtgctgtgcactctctgagtagtgtgtctcagtggatgagtctcttaaagggtctggttgggaaagccgattgccatagctctcccttcacatgtgggcgggcttgcggtctcagaggccgggagtcttggcttctggggaagatctaccagtgaatacacagcttcttatttaatctcaagctccacagttgggagccctgggccatgctcctttttcgcttgctcattatgagtgtgctgtgggcctgctgaggaccagggctctgtactagaagcaaggaaggagagaaaagcaaagatggtttacattcccctgttggctggtggtgttgaccatgttttgtgtgcttacctgctgaatgcgtctgctagagaaatgtctattctttgctcggtctacccgttggattcttttttgtttgtctctgagttttgaggcatggtttttctgtgtagccctggcgcgcactcactcactctctctctctctctctctctctctctctctctctttctatatatatatatataggctggcctcaaattcaggtctctgtcgtccagtttctgggattaaaggcatggggcactttaatcccagattaaaggggggtgggcagcgcataggttaagtgcaaggataaggacccaggatgagacccctctaccgtgtgggaggccacatgctgccgtggtgccgtaactgttggtgcggtagcaaatggattcccctttgtgggcctcccgtcctttttttttttttttttttttttgatgggagtgggtgtatttgcacacaacagggtctccctctagcttagcc

SEQ ID NO: 23508 - DNA, 1200 bp, Mus musculus
gtacttcacagcgacattgtactcagtgatagactgtctacagaggcatataccagactagctatgcaaagctctattatcttatcatctaggtttgtgtacgtagtataagtatactttgttatctattcacaatgacttccttcctcagactatgtctctgactgaatataaaatgttgtagagtttctggatatacatttgctacttataaaaaggtatttctggccatatgcttgggaggctggggacaggaggatttagtttcaggccagctgggctacatggatgttttaccaaaaaggaatttctgagctcctgtacatagaagtagtttttagcaggtgttattggtctgtggtaggagtccccgtgaagcctttggtcacacgtctctcgacccctgtactcgtgtgtcgcactccttcctacgtccttgttcatttagcagccattgctctgctcttggttgagatgtgtgttgagggcctgcatgctgtcttagcatttatccagctgatggatttgtttatttccgggtgctagggatcactgagcaatattccctagcccagctactgtttgtttcctctcagaacttgtatgacctggatgaagatgatgacattgtggtgcctgtccctcccaagcagatgaagtttgcagccacgggcagccttgttcaccacatggtatgccgatttttttctttctcttgctgcatcagattaagtggacggatgggtgaggttgtggacaggcctctcattaatttgggctataagctttttagagctgtaactagccagctccttgatttaacattgctaatactggggtgtcaaggtcctatgcagtgacaatgaagagctgcagtcccaggggctggtttgaatcacttgaaggaaattgtgtcttagtccattttctgctactgtaacagtacagcagctaggtaaactgtaagcagtgtaagtttaccaggaagtcaagaaagttggctgcatcagttaagggtcttgtcagacatcatgcagagaagtgagaaagctgagtctgggagcctgaggaagctcctgctgcagactcagctctggccaggatcccaacggtaatgcaatctcctgggtactgaataaggcctgacagtgctcgtgacgttgaatgatgccagctcatttacttacagtaaggagacga

SEQ ID NO: 23509 - DNA, 1224 bp, Mus musculus
gctccctcctccgcccccgaaccccaagaagcagcgaggcccctacgagcctcgaggaaaagggaaagggccgctcaccgtcccttggccgccgtcccgcgcttccggatgagctcgtccagcgagagatcggccatcttgcggcgcgcagctagcggagaacggaggagaagccgactgcggcgagcccgccccgcggccggagtcaagagcggcttccggcaacccggacggccaactctcgcgacagctcaaacgaaaagctcgagacggaaggggtggagcctctctccccgtgagcctttgcggtgctcgcttctaatttgcatggaggagtccggagccttatgggctctctctcccccctcctccttttgctaatgaggaattagaattatatcgatcataaaccattaaaaagcattatcaagaggacaagtcttttagtcatacagccgatcggacactcaccatacttgtaatgagaatataatttcttacccctgaggaacgtagacacgttcctcatgccttaaacttatgagtaaggaaaataacgattcggggtgacgcccgagtcctcactgcttatgtgagaagaatttttgagcgggtataggttgcaatctgaggcgacccgcctactttgcgggatgcctgggtgacgcgatctgcccgaccccctaattctacaagaatagaaagcttagcagctcctctgaatggttgctctcaggtgctagtggttgcaagtcgtatgttgatgcctgcctttgccctacctggtgtgtgagcgtgagcgcgccccacctctccagcctctctcttactgtttttcagacaagatgggactgttgttctcctactgctatgtacctcaatttcaattgatcatgcctggacataactgcccatgttgtaaggtcgtctacgttgtaaggtcgtgctcagtttctgatgcctagactagtcacctttccgtttgcctcctgactgtgtaaatgaggcaaatgaaggtggtctcttaactgacatgttagtgtttgacctatgggatagtttctcattgttgagacagaatttctagaagctggtccgctgagcggctaagagcacttgctgatattgcaaaggatctacctgggtttggttctcagcactcacatggaagttcacatgtaactccagtgccaggagattcaatgccttcttgacctcccaggc

SEQ ID NO: 23510 - DNA, 1139 bp, Mus musculus
tgggcacgggggcaggtgggcagggggtcaggggcaggagggtcaggtgggcaggggtcaggtgggtagggggtcaggtgggcaggggtcaggtgggcaggagggtcaggtgggtcaggtgggcaggggtcaggtgggcaccaggtctcactttgactcatctggtcttgttctacagcctgggactatagccagggcttcgtgaatgaggagatgatcagggaccaccttccaactcctggggaggagccgctgatactgatgtgtggacccccaccaatgatccagtttgcctgtttgccaaacctggagcgtgtgggccatcccaaggagcgatgcttcaccttctgatggctggacgctggccaagcctgtgcctgctgctcacgcactcaccacaaccacctgtccaccccttccttccccaccactgtcgctcaccctgacatatgcccacatccatgctggggcctgggttcagcctggcctgcccagccctggtcatccagctgtactggcccctggggggcccctttgggagcaggcctgtgtatcaggtgacttctgttgaccactctctgaataggcttctgtctggtactaactggccattaccagagatgtcctgtgactacccccttacacatagacacacacacacacacacacacacacacagagacaggagagagagagagagagagagagagagaggagagagaggagagagagagaggagagagagacaggagagagagagaggagagagaagaggaagagagagagagagagagggagagagaggagagagagaggagagagagagagaagaggaagagagagggagggagagcgtgagcgtgagctgtcagtaccatgtctacccattgccatgaactgtggtctatagaaaggaagtgaaaggtaaatagtcacctacggtcctaggaaccatgcctgccacctaaccacctacctgccttaggccatagcctggcctgtgcccctaaacactacattagacagtgacacccaaaggttttcttaggagggtgtctggcagagacaggccagcccccacttgctggccaggggtcccttggggcagcacgtggacccttccaaaactatacacactg

SEQ ID NO: 23511 - DNA, 2446 bp, Mus musculus
taatcctggtagggacagtctgaatgtcaaaagctgattcttaacctgctttgtcaagagtatgttgagtattgactgccatttttccccctcacatttaggatgcaaatcaaaatacccagagaccatcctttcagctgtggactttataggcacaggcattaacactgaaggtcccctgggaaagaaaggggctctgttctcatctttttttttctttcgtggtctttaccaggttagctttttgttttgttttgccttttttttttttttaatcgttttaactgtttgcttggctaaccattgagtatttctctctgcttgttcttaatctgaagcagcagttcggagctgctaacaagaagaaagctacacgctgccatttgtgattggtatctgcatgagcaaaagaccccccccccccaagcaattgctgacatctttgatggccaccaagggaacttagagggcctgaagtagaggatcagccctggtgatggttcatgtaaatctgcttgtgtggttgcctgaatcttagctgctttgtcagccatttctagtagactggctcttgatggtttgtgctgtgcacccctgcccaccataatgcaatcttctctgcttgtctgccttggggacagttgatataatctgcctttgtagttcagccttaacttctatgttactcatatccagtaggttctcttttgacaatttgcagtgtgcacccctgcccaccataatgcaaccctctctgcttctctgccctgtattctggtctggtcactcactgactgtcatgagatatgatggcccccgctagatcttctcttgggactgtagactggttgcagcactgtaacaggctttaggctttgtctttggttcagaaatgcatttgtttgagactgctgactagttacgaaattccagtagactctgacttcagaaaatttcatttgagctggtctggtggctcgtgtctaaaatcctagcactcaggaggctgaagtattagcattgtcatgttgcagtcaacctgagctaacatagttccagaccagcttgggctacaaagcgacatcctgtctccaaaaatataatgaaaagttgggggtgtggaagaggaagagaccatggatagggcagatactcgcacctgtattgtgccttgtccatttctgaaatcctctgggatctatgttcatttctgatactcggaatttggcacagctctgctttgtgagcacctataattctagttctcacacccatggtacctatgcctggtaccattagcacttcaggaatgccataaagagcatctctgagggccctgaggttccagctgcctctcatgttaacaagttacatccttttcaggctcctagttaaagagtaggcctggaaatcaccccatgggcatctgagtgttaattaagggtcattcatattcaagaggttcaagaaaatgacttgctgcaatgcataaatatgaattagattagaagaacagttggctggacattgggatttgagttactagttaaaactatgtgtaaaaggaaaaagactcttatctaatcttttgtgaaattattccagaccctcatctgagactcccaactaagcccctgggcctacagaccctgtgatccagacagctgagggaaggactagaccctgggcagaagaaagaaaggatagataaaagccagtaccttgtggcaaccacctcagggtaattcaaaaatgcccccaaaattgatctaacaagaaccagggcacctttctcagaactagtgtatatttggccaaaaggaagggtactaggaacatgactgctttgtaaagggccagccagacagcagccccagccccagtgtggctgtggtctccagataggtagtagtagcctctggatcaaggaagcccagggacttgaatgtcatcagtggaactttgtgtgacacttccggtaggtggtcatggttatcacatttgggtatgaaatatcaccccaaagcactgataggttgaaggttcctcagcaagtgctactgttgaagaattattgtatcataagggtgatgacatcagaggtttaatccactgattatttcatagtttgacagttagctcatcgggcctatttgtaggatgtgggacactgaaagactgtatcttgccctcaacccagtctccattctatcatgagggaagcactcttctttgccaagtgtttctttctgtggtgttcagttttgcctcaggcctacagccataaggccaaagaaccacggaacaaagccatgagccaaaataaatctttattcatttcagttgtctcaaatgtttgtcacaacagtggataccacacacattacgggtaatggttttttgtatgtttgtatgtatgtatgtatggatggatggatggatggaa

SEQ ID NO: 23512 - DNA, 1192 bp, Mus musculus
atgatatgtggttaccatcaagtatttgttgtcacaccacatgttttatgtggcacaagtcaaaatgtccttttgagtcaaatcccccttttcttatcctctcatctagaaattggtgttttggtatttcagtgattgtaaaagtatctgttttaggtagattttcaaaaggtgaatttgttggatgaagtgtgtgtttatttttgtcattgctgtggaccaaatctctaacaaagacagtttaaggagaggctcacagtttcagtgggtttgatgaatagtcacttggtctacatgcttgagcagactgtcatagtggcaaggacaatgtggtagaagctttcaacccttgttgacagaggagataaaagggaatgagcactggagtgacctgtgcaggtcccctataacaggatactgtctgtgttcaggtcaacctttatatatgccttggagcctccagaaacctctctcttccttggctcaatcagaagggtcagctacaaaggccgctgtgccagggacccatttcagtttgaaacctgggggtaaatggcgtagagcagagagattttggtactgtgtggatggtgagctgtgggttgtctagggacagaatcatccctctagttcccttgatgaccacagtgacatagcagggttgagtgaggtgctttggcaccagaggtgaagcaaacacactctgaaagccagcatatctgtgccatagagtgcttttactgcttccaaattattcattagccattagaacttgcatattgtgaattatggaagagtgctgctgtttctattaagcaagggggacatatccttgcatggtgttcgtagtgttctttccagactgaaaatgatgcattattgtagtagtgcattcagaataatgagaacgactgccttgctgagccccatggtgtccaaatgacttttggtgggggatgtgacagacagcagggcaatgtgctgttaggggctttgacaggaactgcaggggtgcgttcagaggggaggaagatgcagggtgagggccagcatgaaggaaaagctcgtggagaagaagggcccagaaatcaaagcccatgccgggtgaaggtcggtggcagggaaagctgctgggtcctggcatgagactgatgcctgggcagactggctggcgtagagtgttgtctgtgag

SEQ ID NO: 23513 - DNA, 1099 bp, Mus musculus
ttcatatccacatgggatttgtatgcacagatgacttgctgtggtcagtgttgccccctgtcactaaggccaccctctttttgtcttgcaggggatgaactgaccaagatagaggatgaagatgaacagggttggtgcaagggacgtttagacagcggccaggttggcctatacccagccaactatgtcgaggctatccagtgacagcccatgggcaggctggcggagagacggaaatgggcagttcaggagctccgttagccttggcctgggcagtgacacctctagtgcccccagcagccatgtaggcatccactccacctgcaaaagacgatggctctgttgttcttggcttcctggtgtgctttgaaggcagatgagctggtgatttcattgggcacttggcccttttccaagcacatctgggcagatatagacacaggaagatagggtccaacagcgagagccaggcccctccccacccccaccagctctctctatcatggatctgcaccttctcgcccttgtctctcctgagtcatgacgggtcatactgattcttgttccactgatgattttctctgatgaggtcctatctgcaaggtcaatgagcagacttacatgccatcttctgagtaaagagtttgaggttttaatttaaaggcaatgtacagctatacttttttatatgctcttccagtcagttaaattatggcctacactgatctgagatgttctccacgtgagctgtcttcatttctctgtgctatgtccagatgtggggttgctgcagccggggttctatggcaagtgccagttgcagggctaaccttgtgcaacgttccccaacacttccacatacagaaattattttcactctatccctgcttcagtttttgcagattaacagttctattagtgatttggaaagttaacagtaagaagactaacttttcaaaacagttgcatctgtagattaagatgctttacattagaccgttgtgtctcgatgtatatctgtatatattatttgataatcagaaaatctatagagttcacccactgttgaatgagagctggtggcttctgacagcagatc

SEQ ID NO: 23514 - DNA, 1172 bp, Mus musculus
tcagtttctccggaggaattctgctaagtatcacttccggcgcaccaagatgctgcctgtaagtggaggcttccatacctgcctcatggagccagccgtggatcccctgatgaaagttctaggctcgatcaacatcaagaagccactggttgccgtccattccaatgtcagtgggcagaagtacacacatccacaacacatccgaaagctgctagggcagcaggtggtgtcgccagtgaaatgggaacagacaatgcactctatctacgagcggaagaaaggcatggagttccccagcacctacgaggtgggccccgggcagcagctgggaagcatcctcaagtgctgcaacaggcaggcgtggaagtcctacagccatgtggatgtgatgcagaacatcatggatcctgacccctgagggccttgggcttagaatggccccagtgtgagcctctgtgcctgcctcttttcctcagacttgaggacgatggacactgcagtctcagctgtggctcaggctccctcagagcatagtctttgagtgcctatcctccaactgacaggacatcgggctgctggggaaagggcgcctgtgcagacggcctgcccggccagaatgctgctctgcctctgcacccaaccatgttcctcggtgaacccagaagggctagcctgggcagtcttagactcatcctgtgggtattgtggacacactgcttggcttcaagctaggcctggtgccagaggatcgtctcagctgcctgtgacgtgctcctttggtcttgaatcttgaatcaaggtgtggtggccttgttcttcactcacttggcaggtgggagattgagtcccgtgtgccatacagacctcagaagcacttattaagtgcctgtgtatgtcctagaatgggtggtcctttgtataagaaactaggagaaccgtgtaaggtgtggagtgggaaccctgtctttcctaggccagcctgtgttcattcacacagagacaccaccaacagcaggtcatccatgggacagtgtgtctcatactgtgtttatggcttcctcagagcagtctgctccacagcaggagtggggcaatgctcctgggaagacatataataaacatgagccattctaagctgccagctggctctctctctctgtgtgaggagtctt

SEQ ID NO: 23515 - DNA, 2140 bp, Mus musculus
tagccaggtggtccaggttgggtatcctggcctgatccctgaaggaaacacctgcatcagttcagggggaaaggcagccaactagggccaagagaactcacgggactggaaagctggagccaccctgccagccctgcatgccactccctctgaccaaactagccatcgaagcctgaagcaatgtgcccttatagccccaggggtaggggtagcttcagcctttctttggggagcaggtctcaagctagggaatgtacattctaggtcacaccctgtgcgcacacactgggaattagggcctaagtctgtacccatcacagtcccagcctgtcctcccaaccctgctaccacagagccttcccaactcttgtttcattatcaggaaagcgggtgatgcagccccaaatcctggaggtgaacttcaaccccgactgcgagcgagcctgcagataccacccctcattcttcaatgatgtcttcagcactttgtttctggacgagactgacaactgccatgtcacccgcatcatctaggtgcccagagttctgcctgttctcatagccagttccagccggttccagccggtccagcctctgctcacagaactgcctttgcagtcccaggcttctccctccctccctctctcccctccttccttcctcagccagagccttggcctaagttatactcaaccctcctgagccgtgttcctgctccatatgtgggatatcaggtccatgtgtggcagagctggacagtgagtggtgtcccaaggactgggctccgaccagctgtacctggtctctgtacctcttaacgccctctcttctctgaagagtctgcagctcagctaagggcttttctcctggcatccagaaagttcgcagaccaagaaatgttctgcagaaacagggttcgacgagggaagtgtttgggaacccggtatccacaagggccagggagtactctcagaatctctgccctcctgtcccatggctgctgcaagcagggtacgggaaccctgtgttgcacccacaggccccagaacagccaaggggaaacatttgccaacccggccttatgcctcggcatcctccgccagagccttcaccagcagacttctcagccatgcctaccctgggtgtttcccttctgggaagctgggctatgcagagtcccatggtctctgcatgttggtacctcaccaagtcccactgtgctcttgtggtagacagggtgctaggttgctctagggctgtgacatttcatggcagaatccaagcaggagtggctgtggaaatgccagagcggctaagatggctctggagagaacttcatgtgggaatcaggctgcctcttgccaaagttcagagtcctagtgttaaggttttgggtttggttttccttcaacctgcaggaaagacaatgttacgtggagttcctaattttgttgctggaatttgaagtcagccaccattgcttctgtaactgctgggcgctgggatcctgcccccaggaagttaagagtgggcaggagctccttccagatgtcctactgttcgggtgggacactgtggtggctgttgtacttgtgaaggtaaaagtgaccttctcttagcatgactggacatggttcttcctgctcatctctgggcttgtaggccacctgttagggagcctgcccccgccaccatcagggtcagggtagagacacttgtggtggtcgcacccctggaaagcggctggcatctgcccttttatactgcagtaaaatacgcctcctttccacctggtcttttctctttggggccctagaggcctgggctgggctggcagggcggctgtgtccctccaaggttgcaagcagacccaacatgtcaccacgtgtgctttgagaaatgagaaggaaaagaaagacctccgagctccctaaggcagtctagcttcctagttagagtcccagttccaagctggagaagagatctgacctgaccagtccacactaccaacccaagggggcgttgggggccgcagggtctgaggcttggtcccacctggtggccttgagaaatagcattctctatgttacctccttgttctggagtggggatgagaggccataattcatgaggtagtcaa

SEQ ID NO: 23516 - DNA, 1165 bp, Mus musculus
atactaagctctccctatgcttgcctgactcctacccatccattctcatatgagaaaccagcatctacgaacatctaagccatcctgctgtcctgatggcagatgtgaggcaagctctgtggtcccagctcctatagggaacctgggaatatgaatgtcttcctacagctgggtagaggagatgggtctaggctcagactgccaacaccaagtattccttggggcttgcagacacaggagaggggtgggcagaagcacctgcccgcaattgggccgctgctcactccagtctctccacagagtccactgcgacgtgcagcaggtgctcggccaccttacccaccctcgcttcaccttcactgatagcgaggctgatgccgacatcttcttccacttctcacacttcaaggactacatgtaggtacctcgaagccctgtaccgcatacccagtgcctctgatgactgccaccctccccgggatgctaagctgacctctctggccatacctgtctccacccacaggaaactcagccaagagagcccacaggtgctactcaaccagttcccctgtgagaatctgctgactgttaaggactgtctggcctccatcgctcgccgggctgggggtcctgagggtcccccctggctaccccgaaccttcaacctgcgcactgagctgccccagtttgtcagctatttccagcaccgggagaggcggtaagtcccctaggcttcaggcagggcgaacagatactgctggtcagttccattatagtgctgcagctctgtccccatccttagcccatgcccagcctctccttagctgagcacctaccagcttctcttgttgctagttccaccctgtaaccttccttaggttctattacactcctaacccaaagacacgggctggccagtctacctctagaacctcaggacacattgtctgaaaggcaggtatggctcaactgtcttcccgtaggggtgaagacaaccactggatctgcaagccctggaacctggcccgcagcctggacactcacgtcaccaacaacctccacagtatcattcggcaccgagagagcacccccaaggtaggcacacagctccccagcctagctgctccagatacaggcagagactctaaggagagtcagctgtgac

SEQ ID NO: 23517 - DNA, 1194 bp, Mus musculus
ccaagcccacattttacagttcccggctgccctgagggttgccccagaggccacactttctgctgcacgagtgtgggaaggtacctgtgggctgcctcagctgtcctggtgtcagctgtcctgggatagctctagtaaaaaggaagtcagggtgcgccacccccaccctggaccaactaccatcctgagcccaaatccacctccaatgccatagagccaccctctgcctttgggcctcatttcccttgtaaagcaagggatgtagacatgattctcgagtggataccttttctgcctttgccaacatgtggtgtcttgagaacagtggcctaggagaccctggcatagattacgaatgaccccaagatgtgcctatcgaggcctcagttcttcagttaggtgttgctaagaggctgtttagtaactaggacttgctccttggaggtggagggctcgggagtgtggttccctatccacacccctgattgactgtgctttggctgtaggttttcgatgccggggagatgtttgggataatgcaggtggaggaggtggaggaggctgaggacgaggccgccagggaggctcagaggaagcagcccaaccctgggggcgagctgtgctacaaggtcattgtgaccagtgagagcggcgtccgggctgacgaccccaacaggtaggatcggggtctgggcattggtttttagagaggtttcacctagaccctgtttccctgtgacatgtgtggccagtggtgtccccacaggctttggggctgtttctaacctatgctgttaacaggttcatcgggaccaggaattgaacttgacgccccacaagagcgcatccctgtgacttcacagtgctgtagctcctggttttgctaagggcgaccaaacccagggaaggaaggacttgcatggggtcagtaggctaaggatatggctgctgaacccagcaagacctaacagagcctggctttgccgaggacctttgtcccctgtccctgaaccatgctgactcagtcctggagaaggttcccaggaagcaggaagacctgagacctgacacaggcctgcctagtgttaaccagagactcagccctttccatctcccagggacctgggtaggcctgtggctctctctgcaagaggctttgttgaagcctaaggaaggaacttcttgagtttccct

SEQ ID NO: 23518 - DNA, 1191 bp, Mus musculus
gcagggaagctggcccgaggctgcgggtggcatctgaaggcactggtaggtgtggaagaggccccacagatgccagactgcaccaagaattagtatctttcacagccttcacgtgctccccaaggcagcgactgacacactcctgctggcaagagatacaggacatagcatggttctaaagtccctagtcgctgtcccatctgctccacctgtgccaagcgaggctctcacccaggagacccagtctgcaggttgaccgtcctccgtgcagataggattggcaagcccacctgtgtgagtggggcaccttagacctcaagagtgtctggggggagccatgatcctgtgtgctgcccacccccacacctatgggcttgaatttgaccagatgagcggtggaccaggagatcgctgcttgtggggaccgacttgttctgttactcaccaggctgggaagaacgtggtagtgggaggctgaggctgtggaaggggcctgctctgggccgtctctgaagcgggtctggttgtcgtggcattacctctgtccagagagaagcttgtgtaggtctggtgcatggttctctggggtgggcatggcggcagcgcctttcctgtgtgtctggggaggaaggctgctttctgtgaaattttctttctatttttctatttttagtactgtacggatgttctggaaccacacatggtaatctctgcttgcctgcatctttaataaaagacacctcccctgtttgtgtgttttgtctgtgtgctgggtggagggggggagggtccctgagcgttctcctcaaaggagtgtgagccccattcctgccctgtcccctgggcgtggctacagtgggaaagcgccaggagtgggttctgatgaggcagaatttggttgttttaccccaggcaaacttcagtgagagttgaagcctatatactacttcagtgacctttgacctggaagtgaaagtaagggtgagagattccggtgttcctgtagatctcttccacctctgcagtctgggtctgcctctggctccagcccagggcatggtgggatggagactgatcaagtccttcctggctctcttccccagccttatgggagcaaatgcaaactccggatagtcatctttgtgtccccgtgctgtgcttagaagatctgtccttaagtcatttccaaac

SEQ ID NO: 23519 - DNA, 1096 bp, Mus musculus
ccacccttgatgctttcatgagagcttcctcttggcccttggtatgatattatatttgtgtgtgtatatatatatatatatattcacttttgcaaattctccagaggcaaccaataatacccaacagcagttagtcaagcactcctcagagcgtgaacttagcccacagcacttcctctctggcaggttcatggcaggaactcctgctgtggtaggttctgggagctaacctggagtaaggaggtgaagtccttctcagatcacaggtgctgatctgtgtggtgcctggggtgtagttgacaggaggagacagaaggaaagctctcccaccaacccccctccccgacttagggcagttggttccattgagtctcaccacaagcaagactggtctagctcaagtagtccatcccacctggcagaccaagttcagagttcaagtcccgaggctgccttctgttctgaaactggtggatgcagccagctctattctggtctgtgttgcaggaagagttgggctgtggaaggacatcttcaccgtctccatgaacgagaagtttgatctagtgtacaaacagaagatggggaagtgtgacctcacgtttgacttttatctataataccagaatccgagaacttgcatgctcacggtccccggacgctctactagctaaaagtcctgtttgcgttcttttattcctcgctggacacacttccggaagctgcttggaaacagcagggggcgagcctggtggagagagccgaggaggagtgagaggatgctgtctacagcagccgcctggcctggcccatagtgttttgagtctccacatggtggccaataccacacgcacgggcagtgcaaatgtctgccccacaccccgtgttattcactattttatagcgcttttcactgaaagcggaaataaatatctgtcagccaaatacaagtgcatttccaggggggagcaggagcgtgctgtgccgggatgctaggaagctctcaggggtcactgtaatttttgtagtcttttctctaggcacagccatcctaccttgttcggagatcaaagaacgggtttggggggtggggtga

SEQ ID NO: 23520 - DNA, 1130 bp, Mus musculus
ctcccaggccacccacacctggtggcagctcaggtagcaatggaggcaggtgatgacctaagctgttgctaggtctctgttgttaggtccctgggaggaaaccagaatcacctgtaagccaatagtgtccttggcttccttcccacaggctggtgacatggctccctgatatccaggatgatatccagtggctacaatgggcgacatcccaggtttgtgcccgaatgacgatgtgcctgctcccctctaccaggtaaatacttgggcccagggtgtgtgggccagataggcatccctcccggttgttcccagagctcttagggtcagagcttgggtggtgacagccttaacaagccaggctcagccgcctgtccccagcatgccattaaagaaaccggtagcagagaaagcaggtttattcgaatataaaaaggttcaagcccccacccggttaatctttaagataccaacaggaggcttaagtttaaacagagttacacataaacagtctgaatcagggcgtggtcctgcccaccattgtctgggcttcaaggttccttctttctctccctagcatgagattcctgggacaatcccaattccttggcctccattgtatcaaagggctgaaaaccaaagggaaggcacagctgtctcttcagcatgcctcttctgccagaaccactgcaaggtttggtgctcaggctgtgcaaacattctagcaatgtttgactcagtgtcaagcaggtgacaaggaacatggtgctgtgtggggggaacccatggcccaggtgagggcttattggtgggtgaagctgtgggtgttcaggtggtggagaaggccttaagggatgggactgacacctcagcactgaaggcaggaggaagctgtggctctgggttgcacccctgcctggctccaccctctctggcatctgtagaagttacagctggttcttcctctcagccccatgctcccagaaataagactcagacccaaattatagttacaaataccttggccatatagctaggctcttctcagactagctcataacttaactcattaattttaacctccatcctgccacatggctggtggcctgtgctcaggtaccatgagtccagct

SEQ ID NO: 23521 - DNA, 1238 bp, Mus musculus
gccttggctacacagggtgtgtgaggagagacccaatctcagaaaactaaagagaagtagcaaacaaggttgggagtgtagcttggtggtgtagacactgccagcatttgggttgtgtaaagtgcctgcttcctggcccactgacaagcatgtacaagggcttcctcccacgcccccagggtttctctgtatagccctggctgtcctggaactcaccttgtagaccaggctggcctcgaactcagaaatctgcctgcctctgcctctgcctctgcctcccaagtgctgggattaaaggcgtgcaccaccactgcccgatgtacaagggctttttgaaatctttgtttcacttactaattacccagtgaacatgcttattaagcacggtccccaggacctgcacctgcccactggcctacaccagcctccctatgtatcccatcctgtccccagctcctcatcctcacagggagcagctgtgctggaattcgtgacaccacctgaagcctaaaggtggaggcctggctccttttcattgtaagctcctctgtcccttgcagagtctggagcccctcccgtcgagtggaactgactttggagcactgggggaggaagccgagtttgtggaagttgagccggaagcgaaacaggaaatcctggaaaacaaagatgtgagtattctgtggaacatcttgatgcttttctggaatgttctcttggtaaggccctctggaaagtgaagcagctaacatgtcaccaggtacaaacagagaaccttgacttgaggacagtagctccttgttccttaggttctcctgggtgacagtcgatgtggctggtttaggcaaatacatttgttcctactgaaaaaaaaaaatagaacaaaaattggtttttcatggttggagagatagctcagacggcctaggtttggtttccactacccgtatggtggctcaaaaccacctgtaactctagctctagattctagagtctagaagatctgacagccttgcacacatgtacaggtacatacatgcaggtaaacactcatacatctaataacatttaaaaagtttttcaaagatagactcaaattatgcttaagtctatatacatatatatgtttagatggatgtatagatggatggatagacaggcagataatattaagggcgtgtcaccagcagaggatggcatcccagacaagtgccctaccacagagctacagccccagc

SEQ ID NO: 23522 - DNA, 1159 bp, Mus musculus
tgtgcaacctcaactatggtgagtcagccccggccacgcatccttccgattcagaacggtgccatcccttacaatgccgttatgtaaaggggaggctgcggcttactctagaaacaagcttcaagtgcttccggggcccagagctcagcacagctctgtccagaggatgctcacagggcactgagcagttgggagccctgggccctctctgaggtgtggcatgggccccgctgctctgctagaagagcctttctaggccaaggggcagggtagccaggcccagagagtcgaaaccttcagctggctgtggaagagtcgggtgcccatgatgccagccccatacctgtctccaccagctagatccagctgtaaggggccctgtcagggagggccacacctctgctcaccaccttcactgtttcaggtgagggccccaaagcccatatccggaagctagctgagtgcatccgctggtcctatggagcaggcgtcgtcctccgacttggcaacatcgctcggctggagctgaactactgcattcctatgggcgtgcaggggggcgacaggtgtgtgggccactgtcagctctgcagctcatcggagcttctgttgcaagtggttccgagatggccacttcagtataggtctgaacttaaagagagaatggagtcaactaaagaatgagagcatgcggtccgctgctgagctgctcttagttggagggggaagggaagacccaccccttccctggagcactgctgctctgcctcaggggctagccaggggaagtgttgaccctgcttgctggatgtgtaaagcaggagagagcttccctgtgccaaccctggcctggggctgcccacagctttgctctgggctggaggactccacccatggacatggagccatgtctgtgttccttgggtgggttagaccaagggccattcagggttatagagagagccttacattaccttgtaggcattgtctggaggcccagagggattgttatgagcagggagctttagtaacaaagctcggaaagtcagaggtccagacatgatggtgggaggcagttgctaggacactgtacctggcttccatgggacgggccacctgctgacaggcaggcagcctcacggggagccaatgcaagcac

SEQ ID NO: 23523 - DNA, 1168 bp, Mus musculus
ccactggggacaagtgccgagcccagcagctcactcatcaactcacacagtgtacctgggagaaaggcatgacgtgggccaagtgaatatgcaatgtaatcaggtggcaaggaggtttctccaagcctcacgcccttctgccattccctgcagagaagtcagggaggtagcatttaagcagacctggtcaggaccgaggcaaataccatagccaactgcccaacagcaggtgcaaaggtcctgtggcatacatgcttggcatgttctagtgattactgcgatgggtagagtgacaagagcctcgagcatgccggggagtgaccagagacacggtggtagatgtccaacgtgtgtaccttccacatctgcacccttctcagcctaacacccatgacgggtaactgcccttgtgggcagggactgtactacgtcactcttcatccttactgcccagcgtggcacctggtgtggacactcattcatgttttatcctcaggggagaccctggcaatgaaggctcagcagcgttcgcagctggaggtggggcaacaaatcaagcacatgctaccccgcccccgccatcttggcaacaggctgagaagattcatccttccccgacgtctgagggtttctgttgctgtgacggacaccatgaccaacagcgtctttggagaggaaaggcttacagcttgtagtcattatctaggaaagtcagggcagggactcaaagcaggaacctggaggcaggagctgatgcagaggctgtggaggggtgctgcaccctgacttgttcagctcgatttccagggctacctgcccaggcgtggcattattcataatgggcggggcccttccatgtcaatcaccaatcaagtaaacataccacaggctggtttacaggccaaatctagtggaaccattttctctcttgcggttcctcttccaggcgactctggctctgtaagttgatgtaagtccagccaccacagtaaccacggcgacctcatcacaccatcattttttttcattccttgtgaagttgagatcttaccgtttttgtgacttggaaatccttgctgtggtttgcagcccccagtgtgagaacaaaccttagacccttgagcatgaggacaagcaggcatccaggatgtgaccctttgcaacctgt

SEQ ID NO: 23524 - DNA, 2920 bp, Mus musculus
gatcctccagggacaagtgctaggccagaaaaatgggtgtatccatccacacagtccttgctttcccagaaaacacctccctggggaggcctcaggcttccctggcctctgctccctgtcccctgcctggtttggttttaacacccccccaccccacccccttccgccgtgtggttccctagctggttaggtcattgagaacttggtgcttcaaataccctctcccgtttaagtttaaggcctcacttcttctttttctctgcctcccctccccctccccccccccccccccccccggagaaagatgaaaaagagcaaaggcccagcctagccctcggctggagagggctgtccacctgtgctccagcccacagagcaattactgcaacagccctggctccagggactccgccccatttgtcctcaggaatcccctgggctggcctctccttggaagcaagggtctcagtaaaaaaagatcctctcagtttttcactcctgagtctcagaagatttagactcctgatgtgtgtctccacacaccccatccccatccgtcttgcggtttgctgcttttaacggaccttttacatgaactctcaggacccagaatgccttggggccccggggtagtgtgtacggtgcatgtctgggtctcttgctggctctgaatgtgcagcttcagagccggcttggagtaggaacctcctgtctcggaggccctgttagggaatggacacatttttagagactttacaagaaggtagggatccattacaagggctgcctgaccacaggctaccagcgagcagccagaattacagaggccgtgtgtctgactgctctggaggctgagggtagaaggtggaggtgctggcaggctgcctttctctgccttcacaccattcctcctcctcctcctcctcctcctcctcctctatttatctcctcttcattccacagtggaaccatcccctgcatgacctcgctgaccccatgatgtcagcaagccacccctccctccccccgccccccagtcgccaaatgcagcctccctccgaccagccaggaattggtttgtgggctgtgtctcagctggcagtgggacctaagagatgtccacatccctcctagacactgctggtatcccctacagcatgacctataagagaaaatcctgctgctccctcaagcccttcaccacccacttcccttgactctggaggtggtgccatggccggctggctccttgtctcaggaatcctgcttctgtggttcacccccacccccacccccttctcacgttcctcctgcctctcacctgccttacagcactgttcatggcagcttacaggaaaccttcctttcctgattcccaccttaccacaagacccagggctgtggggtgaggtgttgctaccgagctgaacgccagcaatgatgttccagaaaacattttaatatcttcccttggttccactgctgctaagctggggacgggtcttggaatagccgctccggtggaggaggcttcccagcaggggagagagataattaaaatggcattaccgtgtctccctgtgggatgcggtgacattaaagagccacactgacaaaatacccgggactggaaggttctgtgctgccttcctcgcagacacagaaccacagcagtatctgggagctgctgggaccgctttgctctgctcacaggcggtctggggcggggatcctagatgcaaagacctaccgtgctgaagggagggaaagaattggtctgggacgggcggtggcttcctggggttccctatctggagggcacaagtcctgcttggaatgtaagcaggctcctttgcctgaggcagaacttgggaagccagggttctatgaaggtgtgacctcccccattgactgagcgtggaggtgtggttctcacacaccagtgaagggctggccttaccgtcccttcactgcggagctgccattcataccatagcctggacaaaggcaccaataactaagatgtctaggccaacttcagggccacccgcgtaaggcaaggctttcttcgtagaaaaaaaagagagaacccccacccagatgacctcaggtgaccagtgcccacccccaaactttcccacagttctctgggtggggggctgggatacaaatacttctctttgagctgttaatttgagggcattctggaaccttctactgcttggatcttcattctctcctgatattgttgagaggtctggccactaaaactcttagaaatgtcatcatctgtcacttccatggggtcttgaggaaggggcaggcaggtctgcaccccctgcccccaggtctgcaggccaggactgggttcctcccttctgccctgccctgattggcacatcccctccagctctccagccttctgtggacctgcaggcagctcttgtgccaccttcacactcagttgtgcaagtcctgagctcaggccccctgcatccttcctcattggctgaccaaggggaatcttatatccaagcagccgaatccgttacgtcccctgtgcggccgcgctttattgtctttttaattgtttgaagtaatgtgtcctttggatttctggatattaaataaaaaccactaaacccccggctgtgctttgatcagaccctcctggcagacagcagggacagcgtgcttgcaacagctcaaactcgtggcttcctgtgccagacgttcaggcgggagatgaagctgggggtgtcacaatgtgctctgacttacgctagttatgagctccgatacataccagctggcctctggctccttgcggggctgcttctcacacatttcctgtccgttctccctgcccagagctggggctgcatcatttcacattgccaggctggcttgaactctcccc

SEQ ID NO: 23525 - DNA, 1182 bp, Mus musculus
ccaggacaggagtcttcgctgctcgctgggctcccggcccatagccacctgcttcttgttaactctgttagcctagcagcctcactgaacagccagggcaccctgctggcactatggtgctataagcaggtggaagactcctggggttccactgagagtactcacctatccccagcagctgagtctcatgcatgacctttcggtggaggggtccccaggtgaagctacagctgcaccagaaaaaatgggggatagggaggaggtgtatgtggaggcaggtgacaactggaaggtttctttgtggctttccacgttgttgtcgaggcccatccaccggggaggcaggtcacctgccctggctcctcggaccaatgggtgctggctgtatttgcattaggttttgcttcagagccattcaggctgcctgtctccaggtgtggcttcattaccttctgctgcatctggtctgacccacctgggccactctgcctcagtggctccgtccctacctctgctctggtggtggtggcttggcaatggttttgtttcttgatgcatgtatttaggaccgacatctcaatagctctctgtggcttggagcctggagcacacaagagagggttgaggcttgccctctgcgtcggacctggaagagacacttgggattggttgctgaggggcccatggtggctctcgtcggggccgtggtttgtccccagccaagacgatgaggtgcaaggcccatgtagctccagagggagactgtgataactggacctaaagctgagcaagagggggaggctttgtacatatcttaaggttctagttgcttgagctcagaagagaacagggagaggggaatgggggagttggtctatgaaggagttgtgtcactccacattgacagtcgcggcggtactgtgcccgctctccagactctgtgacacccatccggtaggtggggcttcactgtactcagcgtctaatggacagggggacctggcatttgggtgacttcccagcccaatgtttactgtgatcttggaattatctccatgtcccaaagcattcagtgactttgaggaaacagcaaagatccatctccttatccctggctaaatccatgacagggtgcgcatgctctgtatgacagggtgcgcatgctctgtgttagggcatctg

SEQ ID NO: 23526 - DNA, 1193 bp, Mus musculus
caccatctggttgctgggaattgaactcaggacctctggaagagcagtcagtgctcttaactgctgagccatctctgcagacccatctaccaccctctcaactcccctccccatgcccggaataaactctattctatactatacctgtgtggctgcaccagcctgggcccacagaggcaccccctccccccatacctgaccgcacctccaccatctttatctttttataaacacatcaggtgggcctaggctatataaaagaactaacagcgggagccagtgagcaagcttgtatcagcatttctccttggttcctgcttcagttcctgctttcgcggtcctaccctgctttccctcaaagatgaactctgatctggaagtgtaagatgaaacaatccctttcctcaaagttgcttctggccagagtgttttattgaagcaacggaagaacaaactgaaacggatgtctgggcttgatcattgagggtagggtttggggttcagcgtcctctggggagagtagaaggccagggccccagcccagcactgaacatgggtggtgggacctgggacagaggtaccagctatccccccagatggtgataggaggggccccagactgttagagtgagactggacaaagagaaaccttgaactggctcctgccaatcagccacatggacttcacccatctcccaccccactctacccccagtctcacctgaatctggattctggtgactccttatatctccccctggataaggaagtagtctctgtgtgccagccccagggactgtatggtgtttgtggtaatgagcggtcaatgagcagacttgtggccacaagtgagactgagacaaaaaatggtcccttggctgtggtgtgtctgaggcacatgcctctttctttctggaccttggagggctaggcatggtggcatggggcccctctcctgaattcagagagagcctggaggtgtgcacatccccggagctctttatccacgtgtcccacctcccccactacgggctgtgccgcttaaggtaaaccctgcattaatttgcccgaagtaagtaggtactcatttgtagctactacattaagataattgctataagggtctgtttgtgtaatatgcaaacacattttgacagcaacaaaccattttgctgtgaattataaatagaccc

SEQ ID NO: 23527 - DNA, 3565 bp, Mus musculus
cacaagattttactggagaaaaaggatgcctgagcactgaggctgaccaaggcatgttgccacgttgctgcttcccctccgtccctaacttagtcacattctttcctcttctactgtgacattctgagaacttctaggtaacttgaacttttgtgaggaagattaaggccaataaatcctttcagtgtgtcgaagctcttctcccttcctaagaactaagcaaaatacattggagtgaaaagtgtgggaagatggtttttaatgttgattcattgagtaaactaacctaagtgattcttaatggactataatcagggtaccagttagctctccaaaggctccctcaggcagcagtggtgccgctctctgccttccccaggagacccagtgttcctgaagacaccgcccgtttccttcctgtgggcttgtctgaccatgactagcactcctgccagacagcacaccgccacactgtgaccgaccgcgcttgcccattccttctgagctgactgggtactgggaatctgtcgtcagcctgtctcggctggtgctggcctttgacctggagctgcttgactgaaccaggaaccgcctttccatgggaaagaccatgagtggtggctcgtggggagctggcggtggacagactgggtctggagtttatccatgaggtgctcttactagctttcctccctagttagcatggacgggggctgtcaggaataatggattttattaaaagcacaaatttggtagtgtttttatatcatttctataccacaaataagcctttattttaaaagaaaaaagtgaaatcgtgctgaaaagggttgtgtgctcatggccgtttgtgccctgctgagccctggtgggcacagtctgaatggagttctctcacgagccgtgtgctcatgagaagcaagagtatgggagtggaagacggctcatttggcccgtagcttcagacagcagcatattatttggcgtctgaagaaaacatttttatctttacttttttaaggatgaggtattattgagtatgtccatttggaagagagccatggttctacacgctggtcatgttacctcagagcggtgaggttgctaatactagtattctctgaagaccagacatgggttaaattcgagatttgatgacgagctggtcatggttcctgtctaatcccggtgctggaaaagctgaggcaggaagatcatttgagttcacagcagcttgagctactgtaagacacctcccccacccccaataaaatcaaatagaatagaaagtttgactctttaaaagtccacttgcatttctcataaaaccatttgacactaggaccagatcttgtctgaaggctcagggtcagtacccaggggcgcacacttgtgtgatcaggttccgacaaaagctgggtggcacagttgctttcttaaagctgccgtgctaggtgggatgaaacctggttaacttttattttcacatgggtcttagtctcactatgtaaccctggctagccttgaactcagatccacctgcctctgcctcctgagcccagagatgttcttgaggtggggtgacagtgctctgtgcattttggcacgtatctgcagatgcatgtttgtgcttcttgggctgtggacctaaggagatgctgtgcggtttggtttggttttgccttgtagcatggagaattggttcctagcaagcaggttgctgcttctgttggccctggccctggcttcttcacattgggcttcccagctttccaaagatgaaacaaggggtgtgcatttcagaacagtactgtgtagccacgtgcctgtggggctgacacgtgtcaaactcacaggcactttcaggaacttgtctcttcatggtggcagtgctctgtgagcatctgcccatgccttgaatatttaccaaaagaataaaagcaaaaaagatcatgactggactgccttctagagctccccggccaatttcagttgtaaattagtgagggtggcttgcttttttttctaacattccagcaatttgctgctaaagactatcacttttggaaacaagaattacaggggagatgtgtggggtgtgactgtaactcggtgtcttgtctttatgctttaggagctagctcattgcatctgacctgagtatgggaatcactatgaagtctgagtgtcacagggaggcccccggagggcactctgttcttcttccactgtgtgtgtagctggttccaacccatggcttaaacttcatttatggtttaacgtgttagaaacttgcatcttgtctgtttaatgtgaactgaggtgtgtatctccagtttgaaaatctcacgttgtgtcttacatttgcctgaaggaagtgtgtgttctctgtggtcagggtgcatctggcagatgctaagcctgggccttcccacactatagctcacactatgacacattcccagccctgccatgtcctcctcagagagccacactgtacaggctgtgtctgtgtcagtgacaggtccgactgttggtgggctgatgctctgttttaccatttcagttctgaatcctgtttttttacatgctgtgtgccaaaaaccaaaacaaaccaacaacaacaacaaaaaaaatacctcctatggcatagaggggaattcaccttgctgtcagggaaagccgtttccctaccttttgaacattacgaagtctgttcttgccagtttcttcattatgttactatctctgaagatgagaaacagccccttgaggctgcagagtacccacttagaccactggagtgggattttaaggagatggcctgctctgtcacttgtaggtgaggttgggagttcttcagggcgtctttctagccacatgctctgtacacagccaccaagtgctctccagaagcaatcacaagcctgaggactgtcccttaacacagatttgtaaaagtgacgtcagacttcgtagccagcacatggagtgatccgccttctactcggaacgggaacttgttttctccagctaaaatacttgaattgtcaggcagtgtaatctcagtgtgtgttagcttttgaatgagcctttaaggaagtgtaacaatccatgaaatgtgaataaatggaaagttgaaaaaccagcgttgggtactgttctgttctgtgatattcttggcagatcagtggggaaagcagcacacagtagtgtgcacagacggatctgaagtgggggctgaccagctgactgggatgtagggtgagcagcttgaagcttggcccgggcctgcctgcactggattacagtcggctgcagagccagagccctgttctaggcaggcagtcctccagcctcagacaaattccagctgggagaggttagctttcttcttcagaagtaagttattcatactagattcttgttcattccgtgatgtacttactggagttgtgttcagattctaaagtttcctaagagacactgcattatctgagttataaggtgttttcctggttaggggaaaaaagctaaaaggctgtccccggggttccgaactgtg

SEQ ID NO: 23528 - DNA, 2449 bp, Mus musculus
ctatcagaaatggtgggggtgtgtggtagctgtggctccctcccaagagtgtcctcacccggcctgcctccctcctgtcaccctagacatcctggaagtacggcagaaacccatcttgatgacctagtgtgtgtggagcctgcacggagccccggccctgcctggccctgggaatgctgccaagtgcctacctgtcaccgccaaccggggtcttctgtgacaagccagcaccggagctacagccaggcagggccactcgactcccggggccagggccgactccatgaacaccagcccaaactgaagtgcctcgtcctccctcgctggctctgctcccaccctgtgcccgcgctcagccccctctgcctatctgagagccttctgctcccaaagagggccagagacaccaagagatcatagagagcgtgaggggctgccagcttccagaatgttcttagacctcccaacctcggctcccgtacccctgctggggctctgtgccgagcaactgtccacgcatcctacacaaagccagtggaaggttttgtaatgcagtactgacgaacttcagctcgagagtcggtcccaacttgttcccccagagttcttgtcacagtgggtcccagctgggggtcaggggacatgagctgtttgtcagctgggaatacctcgccctatgcccagctccagaatgggtctcaacccccagctgggcagacagtccccgatcccccagaatggcctttgcttccatccaaagaacaccgccaacacacacacctccgaccccgagacgtcctgcgttgatctcggctctccggagggacgcagaattcggttctgaaggaaagtgggagggtacttctgctgagggatgtctgatggggacccgggtggaaccctctcgggaaggttgtaggcagaaccaccctggggccagagcttagagcgaggctggtgctgtcccctttgccccgtgctttggtcagcatgctggtcttgtcttcagcctggctttctaggcagagaggagaccaggcttcttatgagtctgcattgtcctcagtgggtgcaagaggccatgtgggtcatcagcccatgcctcaccctggcagtgtgctctaactgaggcctcctctacccaactggaataaactggaagctgagcctcctgttgctgctgggtctagtgccccagatccagagaactcagctgtgtatgtcgagctcagcccctctgggttggagagcaggcttgggagcgtggctcctgtctggctccattccttggtctctgggagtgggcactactttggggctttctccagattttgtatgttgttattaaaagcgagctattgcatttcattctgcctcagtttgcccacctgtaaaatggggctgataccacctacctcactgaagtggccagggttcaagtgcatggctgggtcagggtttgctcacctgtcattcttcatagctcggttgggtcttagctgttaggcagtgaggtagcttgcctctcctgcctgctctgaaataactccttccaaaagcacggacgagtagtgtaagcttagacactggtactgtgctggagcctgggtcctgatgctaatctaaccatcacagcagattcacatcctgttccggaatgccagagtacctcaggtttatgggtgtggccctcctttctaggatagccattcctcctgtagggcatgtgaatgctgtccccacagttgtatctagggaggtcacagggcctgccacttcaggaacctggccattctgtggtctgaacacaggggaaatatatcttaggggaaatatagcttagtgtggcttctgtggaagactgaggcagtctagggctcattgtaattccatggcttctcttctgggtgttccctctagcagagctcagccatactctcttggctggaccaactgtgagtacaagcacttcccaggctgtcggaaggtccagggtctgtgtcacaccccttgactctgtgtggcactcaagcatactgatccccgctcaggtaccaccattccctatgtagaggagggaagcaccctagagacactgtacagcggcaggaggcaagcttggtctgcgccccagcctatggtttgaaccatacggctgtccccaagtacacaactagacatttatttggtcgcatttcctctttctccagagggcacttttgagttccaaacatgttcagaggccccttgagaactgggttaggattctgacatcagagggcatgacatggtggcacttgtgtgcaatcctagccctggtgccgaggcaggaggatagtttctggatagcctgggctacttagcaagaccctgtctcaaagtgacaaatgacagcagaagcacccagaatcctggggatgacagtttggcttctagggctgtcactgat

SEQ ID NO: 23529 - DNA, 1202 bp, Mus musculus
cacacgcacacgcacatgcacaggtccgtgcccctgcagaaggtaactgttgcctcttggagttgaatctgctggacttagttaggaccctgggcttaggacctctacaggacgggctgcttctgattccttaatgcctgtccggcctggtgtaagggtagatgggctctggtctctctctgatgtgtgtggtatgtggtttgtagcttgtttgatcctcatcagttacagaggcattagtggcatcttccttgcagataaaaggttaatcatttgtaaaacatgtggactagcctctgctgcccactgtgagcccagtagacgttactgtcattgggaacttgggaaatatggtcttaattatcacaacgttgagaggaaaacattttttctattgtacaggtcagacaactagggttccaaggaaaagagagatggtacaaaggatggggagggggagggtctttgtgtgttactaccagcctggtgcagtgattagggggcaggaggtccctagagtctcacttgtgtcctgtgccacaggctgaggctgagcctgaggtggaggtagaagtgtaccggagagactctaagaagcttccgggcctgggagatcctgacatcgactgggaggagagtgtctgcctgaacctcatcctgcagaaggtatgggtggtgatgagggatgctcttgggaccgggaggcagcagtctccctctgccccccactgactgcatttccttccagctggactacatggtgacctgtgctgtgtgcacgcgtgccgatgggggtgacatccacatccacaggaagaagtcccaggtgagcccctccctcctgccagcttcccaactcctggagagcacttccctggctggggacccattgagcatcaagagcccctggcccgtctctgtggtggctctaggcctccatccaggccagcttctcagcccttccatctgctttcttttagcaagtgtttgcctcccccagcaaacaccccatggacagcaaaggagaagagtccaagatgagctaccccaacatcttcttcatgattgacagctttgaggaggtaagtgctcaccgcgggccactctccccttcctcccctcttgggggtgccaggctgagggcctgcaaagcctcctaggagacatgggcaactgggaggggtgtgtctgggtgatggcca

SEQ ID NO: 23530 - DNA, 1174 bp, Mus musculus
atcagggcagcctggcttcctaggacagcttctttgtgctttgtgccccagggaacgagggccctcagtacccaggcacaagatgataaaaggcctattgaggccacaaaagcctattcatcctgctcaggggaccaagggctacccttggactcttgtcaaagacagtcggcctcctgacctctgctgttgggaggtatccagagcccagcagtgtccattgctgaccaggtgcactctccggaggaccttgtccttgcagcccacagttgggtccaggccaggtgctagcatgcacgtgccacagcagagagtgcccccacccttcaccagactgtttagaggtttatccttggagggtaaacaccaaccagcagccagagtgcccgtgaggtctgcccctcgtgttctgattcctcacttctctggcttcccctgccctcccttggtacaggcctctctgcagtggtcttgagtgcagctccagtcacttctgcttactctttgcctacctagcttatagttcagccctgagctgaactctcctcactgtagagctgctggcagctagaccagggtggcctgcctgtccagctcttgtcccctgcctggctacgagcgccacctgacagcagcctgtatagcaggcgcttgggatgctccacaccatgcaggggtgggtgctgggtggatgctgggtccacagtcctgcaggggccaactgtgttcctgggtaccctctccctgatgcagcatccttgcctgtacggacaacaaacttgcagacggaatgctccagaaccactgtagacacttggatttttttccccccagtcttcctatgcattacaaacaaacccaaaaagccaggttctcaatatatatatatatatatacatacatacatacatacatacatacatacatacatacatacgtgtgtgtgtgtgtgtgtgtgtgtgtgttcagtttctgtgttctggctctcctgctgtaagcaattttctagtaattatgtagcactaaattctggcatttgctaactgtagttgctagaactgtctcggtcccttgttaatttggctgtgtatgcatggtgtgtgcaggttgatgctgcatgtctttagtttttgagacagggtcccctcactgaatcccaggcttgctgatctag

SEQ ID NO: 23531 - DNA, 1177 bp, Mus musculus
tgaaagttgtcctttaaccttcacacctataccctgcaggcacacacccacacatacacaaaacaaatttttaagtaaaaaaacctgagccaagggaatagagcaacaattcaaggctttctgtttttaagctgttccactttaagctgagataaaaattaatttactgggccaggtgtggtgatgcatgcctttaatcccagcatccaagtgcctgaagtaagtacatttcaggacaaccagatccacactgtgagttccaggacagccagggctaaatagaaaaaccccgtctcaaaaaacccacacaggataatgaatccttttaaaaatgcattgttagattaactaatgacctaactttagtaaatactgttcctctgatcagaactgactaaaactgccctacctccatttcagcacaatgagtgcatgttcagccatgtgttgactctggacctttccaagtatccagacaccgaagaccaagaaggcagcaggagccaccggaagcccagagtaccacgagtatcaatgtctccaaagtctccccagtctcgttagaaatgagtatactcttgaacagccaccagctatagaagctttaccctgaccctgtggaggtcaggccagtctctgtttagacccatgtgtcatagaagaaaaatctcttaccattttagtagaaaaaaaactatagcccactcagctaaggagtgctcagtgtcattccaatggaggttcctatggcatcaatgaatgaggtatatggttttcttttgcttttaagggcttttgttttgaaacaaattggttataaaattttgaattctgcaacatctttactctggtcttgtcttgcgtttaagggaaacagctggtctgggggtctggtttttttgtggtgctggagaaggaacccagaaagaatgtctaagtgttgtaccactgagtacctcacagccttaatagtttctaaaaatgtcagtcatagtacagctaataaattgttgagcctggcttacatgggagattatttcagagagaatgtgtgtcagtactgaaaacaaagtaatttcacaagttttaaaaacagaaaacttgtgagggtgaaactgagtcatagaacttcagtataacgctaatgtttctaagtctagtttcttgtaagggtaca

SEQ ID NO: 23532 - DNA, 1149 bp, Mus musculus
gtttttttcgagacagggtttctctgtgtagccctggctgtgctggaactcactctgtagaccaggctggcctcgaactcagaaatctgcctgcctctgcctcccgagtgctgggattaaaggtgtgcgccaccactgcctggccacaaagcacttcttatttattgttttgttccaacaagctagtggcagttgaatctggaagttcttgtggcttttaatgaagtttctttatttttgaaaaatattacatgacataatgtgggaaacagtttctcatgttttaactgaaagtacattgcatagaagagcattttgttaatccttggctatactttggaaagaatataataagcatttagtttttattttagtgtagttaatataccaattttccttttaaccgttcagatcaagccaatcaatgaacgactaagggaaattaaaggctgtaagatgatgatcgatgttataaagacccagtttcctcagctgaagaaagtgattcagtttgtttgtggaaatggccttgtctgtgagactgtggaagaagcaagacatattgcattcggtggacctgaaagacggaaggtgagagacttgatcactctttcaactaagttgaagtttgttcattcatttgtttggtctctaccctctcccttttactcgtgtgttctttttagtaaggaaaaccagcatacaaaagcctaagatgctttcatttgatgattattgttttgagatggggtctcatgtagcccagacttgccttgagcttgttgtatagctgaggataactgtgataacaatgatcttcctgcctctgcctcccaagtgctgggatcagagacatgcattatcatgtccatttttgtatatactaaagattgaatgcagggcattgtatatttaggcaagcactctaccaactaagctacatcctcagctcttcagttgagtttataaaattaacttctgtagcattctctatatcacaaattctaaggcatttgagtttttccctttgtgtggaataaatgtccttgttgattcctgtattctccctgcattgttttacctttaaatagctggaaggattttgttgttgcttactttacattttttgttcttatataacttaatggg

SEQ ID NO: 23533 - DNA, 1163 bp, Mus musculus
ccctgtgcttcggagcctctgctgagcaggcctgcgtggcacaacctttgttccattcctggaacacagctgggacctgcgtgctgcctggacaaggctgtcttctagaagactatagatacagtgtgggcaaagggctgcattggggttcacctgggttcaggatctgccgtgaggccttgggtagatctttctttctgcctttcccgttgtctaagagatggggatgatgcatgcgacctcctttgtgggagtcttgtagacgccatgattctagggtctggcccttactcaaagagatctgaaacttaacagagcttgatttggtgtctgcccctctccagatgtgcccacagcaagactcagctcagtttgattgggcaacttgatgaatgcaggaagccagatccaccatggcttctgggacattccttctgctcaagcttaaggcttggttgttcttgctggttacttctgcatcgccttaatctctctagatatcaatgaatgcatcacaggcagccataactgccggctgggagaatcctgcatcaatacagtgggctctttccgctgccagcgggacagcagctgtgggactggctatgagctcacagaggataataactgcaaaggtacagctcacatccaaacctaaaactcaccccttccccagctgtgggtatggcctagagggaagggcccattgggctctgtggtgctgcccccatgtggctgcctcaggtactgcaagaaggaggagggtccacctccttgcaaagtacacaagggcaaatgaaggaaggtctgtgatgagcaggtttacttcaatatgatgctgagttagtgacactagcccatttgatttagaaagctcggagcctgatctttgacaaacaagtccagggtcctcgtttgtgtttccgtacaaacagaaccaacccagatgaagttgaagatgcttgctagcgcaggtcttgtgtaaaaatgttgatcattgaattatacggggtgacccaagagccagatgccttctcttggcagccaagcccttgagcaatcccgctgccccaccctgcactgctgcctgcctgagcctctggactccagagcctgggagccaggccagctgagtagatacacttgaacctttgacagccgtg

SEQ ID NO: 23534 - DNA, 2276 bp, Mus musculus
ggagaggcctcagcccttctacctgagacatgaagggagttaggggtagaggaccatgaactgctgccattggcagaagggtgggaccgctccagtgaacacgctctgagctgactgcccctctgttttcagatatcaacgagtgccagcgctatcccgggcgcctgtgtggccacaagtgtgagaacacgccaggctccttccactgcagctgctccgccggcttccggctgtctgtggacggccggtcttgtgaaggtgaggctggggtcacagaggaggccagccatatctctcctctgctcataaactcatttggggtttcctaggcaggcgttttaaagacgctagaatccccaccctagggatatgactgtaagtcagggccagccatgctgaaacttggccagtatccctggcagggtctggtcagtcatttgagttcatgagacttgctgtgcacagataacagagtgtcttgtattatcagctgtgattataatttctggctgtgcttaggcatctgagccttgtgcttgcataatccagaggatacggtgctgaggcccggctggccttggctctgctatggataattaagcacatgcaatgtgggtgtggcaagacgtggttccagtgtcaggggctttgtctatgataggaaaccacactgagcgtagattgagcaggtaacctggccaggcatgtgggggctacagataggaaacactgactaagaagctatccctcctagcctcggagacagtagtaaatgaatgtaagaagacaagatttttctctcccagatgcgcgggtgactgttttaaacctttctggccagtctgtagagagtaccttactttgctgtagaagcacaaaagcagccatgggtcccagccaaatgtgtttgtagctctgtgccaataaaactttatttacaaaaacaagtggtgggccaaacctgtctaggagcttgctctaggtgaagagaatgggtgatcaatagctgggttgctgagtagctcctaagtccagagatttaggagtaccagggctaccatcccacctacgtcaccgtggtcttggagatgaagtggggagggcaggaacacttttcactgaaagctagaagggactggtcctggtgggactctagatatgccatggtgctgagcctgtgccctgtggtgaccggattgaacagagccaagcctggaggctgttgctgccttcttaccaggagatagtgtggcttcacggaggcagtagcaggagtggagaaactaaagatttctcagctacagtgggctggagtggaggtcactctctctgagcatctcagtcttgcaacttcaacagggaggtgatgaagaagtattctgctcagtgtgttctcagtcaagtctgccccggaggcagggacctgaccccacctcccaggaacctcttctcttctagatgtgaacgagtgtctcaacagcccttgcagccaggagtgtgctaatgtctatggctcctaccagtgctattgccgacgaggttaccagctcagtgacgtggatggggtcacctgcgaaggtgagggcaccctgtgttctatggggtgcaccctgaccttgctaccgaacagtagcatttcagaatccatggccgggggaggtttccccacctggtgaggttcccatttgctcccacggaggctgggctggctcctggcttcccctctgagagagcttgaagagcttctacagggagagagagagagagagagagaaagagagagagagagagattagtaggagagcaaatgagtccatggatcgctcttaaatgcacatgccatggctgcaacgcctcagtgtgctgacactctgggccatggagcacagggctcagcatcacatgtggctgagaggtgaagggcaacccgagagccacccaacccctgagacccaactctgcactggccttgtgagcttcacccttactaggcctgactctcatcttctctgtcaaaggcaatgctccctccttggactgttggacaatccaaccagatgacagttcaggagtacccaggagcttcaggagcaaatgttactgatgctatcacaatgctgtgtgtgtacatgtgcgagtgcatgtgtgtgtgcctgactgcgtgtgtgtgtgcgcacatacgtgcgagtgcgtatgcacatatgcatgcatgtgtgcaggtgcttaggatccagcctagggccttgctcagcagatgccattccactgagctctga

SEQ ID NO: 23535 - DNA, 1102 bp, Mus musculus
acatttgagaagagactcacttcctggcacatctcagatgagagacttctattttacaactcccttttctcctcattagaaactgagctctctaaattccctgatctttacaaaggaggctagtagacggagtaaaccagatgccgcggcagaacgcttgtgacctcagccttggtgaggtagaggcaggaaggtcaggagttcagaatcagctggggctcaatgagaccggtctccaaagagagaaaaatgaactgggctgaggaaatggctcagcagggaaagctcttgccatacaagcctgatgactggagttcgggtcgccaacacccacatagaaatgcacagcagcccacctgtaatctcagcatggagacagaggattcatccacacaaggtggctgggtagaccaactaaattgtcatactccgagttccagtgaggtgccctgcttcataacatatgtcagagatcaaagaagacatcagacggcaacctcgggtctccacttagacgtgcataccagatgtactgaacatgtatgaatgcatatacatgcacacaaacactgcatgcatatatacacatacatacatatatatgcccatatatatatactgggcatctctcctgaggttcctgctctaggggggagcttgtttggaactttagtgggtaagatgtgagaatcagtctcttctaccctctgtgtgctagtgtgctctctctgtctctctttctctgtctgtctctgtctctgtctctgtctctctctgtctctctctctctgcctcaggccctttctttcctcatgtagcttccttctctcctgtgctgttcctggctacccaggagcctgaccaagcaagccaggaccacaagccaccaatgagtctcgtggacacactgaggtcccgacctctgagtgcttgctactcctgtgttcagggctacctctggcacccgatgggactgggtacatcctttttcctgcccacagagccactcggatggagtatggttgtaaagctgtcatgaggctgggtagctttggatactgagtcttaggaaagtagctaaagtgaaaagctatggtcacag

SEQ ID NO: 23536 - DNA, 1110 bp, Mus musculus
tccctgttctcctataacatgagggcgcacatgttaatgctaccttacctatctcagtggatgggtaagagctagaggtggggctgtcttctcacaagcaccaaaaggaatcccagacactgagtcagtgctgcgtgctgcaggcgtgcctgctgctgcttactctgctctgtgggtggtttcctagtgctagcgttcttgattctttttttttccctttttctgtcttgggctcctactatttgatttagaaatcctcttttaaatacatgaataagtcagttatctggtgtgacagtgctgtgattgtggagcgagcccttctccttaccccttggattccagcctgttgccctcccagaagatttctcctgacgttatccccagtgtcctcagcatcacaaaggctgccctgcaccgcagcatccttgtcatgtcgtgtggtctcctgctccccaccatgaaacccgctttccttgactctgcatccccttctctctctctctctctctctctgtcccaatctcctgtgcgagatttattttgtttttccaacatatgataaataattgtttcatcctttcttcattgagatggatataacctaagaaaaatagaaaaggcaagatgcctaaaaatgcttttataacatagttatgtggtgaaggaataccttgattgatgtcagaataggtccatgtaagtatgtttcgttttgttctttcccttcccttcccttcccttcccttcccttcccttcccttcccttcccttcccttcccttccctttcctctctttctcccttccctttcacttttcctccctcccctcccctctcctcttttcctttgcccttacttcccatctgtctgtctgtctgtctgtccatccgtctgtctgtctgtatgtatgtattttgagggcactgggaattgaaccttgggctgtagtacgataggaaagcctctcctgctgaactctatccgtcgccttaggctcagggtataagggctgcattaacagttggttataatttagatagcttcaatgccatcagtttagcaaattgatttttttttctggtagtgtggggtaaatttagtgccttg

SEQ ID NO: 23537 - DNA, 1180 bp, Mus musculus
ctaagtttagttccctgctcacaactgtctctaagtaagtaagtgcttttgggttctgtgagcacccgcacatacacacacacacactcccacacacatacacacatacttatatatatatatatatataattaaaaatattaaaacttactctcttgaaactagagtaaagctagggctatggagataagaactgcttgccattttgggacctgaatttgattcccagaactcaatgtgaaaaggcccagtgtggtggtgtgctcttgtaatcccagcactgaggaggcagaacacaagagctttgctgtctgtgtgctccaagaagacacataatgacatacagccctgcccctgtgatggggccgatagtggtccttcaagaccattcgagcaagtatgtttctctctgcacatagatgtgtcactcacatggcatttgttagagcattttattctctcactgctatttataatggtcaatgttgaaattctggttcctagcaaggaggttttcttgtcgttttaggaagccctggttacgattcggctcctggatgtcttgtgtgaaatgacgtccaacactgagcttctcggctacctgcaggttttccctggcctgatggaacgcgtgattggtgagtgaactggcacacacaggacttccagttaggaaatctttgacatactctgtggcataagttcaaactcaagcccttacctttggtgttttcacttgagattctttgaacttttttcttggatggaattatggtacaatgatcacagctcagattgctcaagctgaggcctcattgttccttctctgatgtggtcctgagttgtagtgtgatgactaagcaggcccttctgcagatacctccggtgtcccctcagaggaatgtttgccatgaaactgaggataggggtttgcaaatgagaaggttgagttttgtaaacttattttaccaaagttttatttattaaatctggtaatagattgtctccagttatacttttgagaacaaagaacagtgtttcatttacattatagatttactcttaagacacgaagccttttatggctaggaagacatcatttgaatcattactgactttactcaaaagctgtttacgaattaagtttactagaaccttggtttgtgtggatacccacccc

SEQ ID NO: 23538 - DNA, 1175 bp, Mus musculus
atagtatatagcaatattatttcttatgattatagctaatgtcaatccacggctgagttttattgtttggctgttgagaaagctataagtcattactgaaacctgttgtgatttacgcttacttctaagttatcacattagcttttgtgtagataattgaaataaaaaattattttgtaagaaaaaatagttgcaaaattttagctaagtttcctttgtggatagatagaaaggccaagtgaggctaattgttatgatcagactttaaaaacatgaatgtaaagggaaagaagcggtcaggttcttgttactgctgctgtatttctggcgtgaggatgaactgatgccgccaggcaagggctctcctttgtccccacacgaatcactattgaagacgggtggcacatactttattttaatccattaggtgtgtttatagagaacttagatactatgctaatttcttatggaaaatgaattatactcatttgctctagatgttttacgagtgattcatgaagttggaaaagaaagcacgaacatcttcagtccctcagactctctaaaagcagagggtgacatcgaacacatgactgaaggctttaagtctcatctcatccgtctgattggaaatctgtgctacaagaataaagaaaaccaagacaaagtaagattatttcttggtgtgccacatataattgttgaaaataggccgtttagaatttagactattttctctctgggcaagggggcatataaaattcttatgtgagttcttagaaaattgattggaaagaatatctataggttaatatgtaacataaatagaatattacatattttttctacaaagaagcacggtatgtcatacttgaaaatttttaccttattttagtgctgtgtgtgtgtgtgtgtgtgtgtgtgtgtgttacatgtatagtgtgagacgtgtaagcacacgtttgccagcacacgcatgtgaggttgctcctctcctttcatcatccgttacggaaatcaagcttaggttgagaggctgtgcacaagtgctttttatctgctgagccccgtacgtcacattttttttccttagggtctgtatttttatagtttttgcattgttgttctcatgagtgtatttggggcgttctcctttcttgtaagttagtaatgtt

SEQ ID NO: 23539 - DNA, 1161 bp, Mus musculus
catccgaacctccggtgttctttcatctgtttcttcttcacttctccatcagctgtggatgtcctcaaccttcagggcattctttggttgatgaaagtttgcctcctgggaggttccattctaggaatgttgtgagaattcctttcctggggaagcagctatcttttctctacaagctcctgagaacacaccaaagtatgatcctggggaatccacagttcacccagagaaccagggaaatttgggggcttactttgggtaagagactactagtaagagtggggggactccaaagcattagcacccagaaatcttggcttccccatggcttcatagatggagttcctaccagtttgctttcccagcctatatactctagcacctccggaagctacttgcagttagggcagaatttcatacaaatggctgggagacacagggggagaagaatctccctctctaagggtagagaagtcatcttccctctaatgatcccgtgagggctcttgcaagcaggcacagcttgtgaaaaatacagttgttttgctaaaggattgtgttctataaggaacatctggggatcttgcctctgacccaccaagctattggcaacaggaactttggtagaatctttatacaatgcatggaagccttttgaaccctactcgatttctgcttgtcacataaagtcattcattggaatggcatgtccagcagctgagtaaggcacctctgtggcctttcgagtttcctgccttttgcatctgcattgggtcactagagcttactctgaaaaaggttgacagaagaattgttaccattagtttctaatggagaaaccaaggctcagggagatttcagtgtgatttaatttaactgaaatttgaatcagtttgaatgcaagcttgatgctgtaggttctgaagatgatgttgtcagtaggggctaacatgtgcactggtactattacttaacaattgtgttacagaggcctgccagagaggatctgaaaggctgtcttgtactctagggtggccattccagaatagttctttctggcaaagctggaacacgaggacatagagttagtgggatgggagatcatctccctctgtttctgcacctttggacaacctgctcagaaatgtatggagctcagcc

SEQ ID NO: 23540 - DNA, 1199 bp, Mus musculus
taaagtacatgtacttgttgcttgtggggtgcattctgccaaaggctccctgtcaatggcggtcagttcttccttctttccctcctgctacctctccaccttgtagcaattcccagccttggtgctggtgcctggtcatctctgttgacatatgtgcacacaaagctttcgttgcctgtatcagttcatttaaagacaagtcaggccgggcgtggtggcgcacgcctttaatcccagcactcgggaggcagaggcaggcagatttctgagttcgaggacagccagggctacagagaaaccctgtctccaaaaaaaaaagaggttcagggtgtgaggaaggtgtaactcatggccttctgtccagaactgtcctttaggaaagaggttcttaaacatttgtgaccataaaagcacatttgtcaactttttgttcattgtgttatgcctttaaaacttgtacctgggaattcataagtgaaggtttatcttttgtgatctgtaatttttaaattagaagtgtaggttactctacagttgtacagtgctataggtcccaaagtatttccagacatgcatgttatctgctttgtccttcgtcacccccttccccactgtcctcttccagcctgcactcctcctgctgatcccacccccttcttccccatgatggttcctttaaatgtgtcctctccatatgtatgtaatgtcgctctcgatcagacataggctctcgtgggtggtaggcagactctacctctgagcggcatcagttgcccagtaacagtttatcgtaaaagctatttgttgtagggctggacagagatggcttgacagttaggattgcactgctcttgtagaggacccaaattctgttcccagcacccatgttaggtggctcacacctgcctgcaactccagctctagggggatttgagatctctggcctcctcagctccttcactcacacacagagaattaaaaataaagtaaatctttaaaaagttgttgtatattcactacaacaatatggagtgtgctccaggaatcatttgttaaacaaagactagataaaagaaacaactttacacctgaaaactaaaattcctttaaattctgaattttgagataacttacaagctttttatgtttgagatttatttgtttgcttagtcagtgtgtatgtatttgagggcatgtgt

SEQ ID NO: 23541 - DNA, 1150 bp, Mus musculus
aacacatgagaatctagtgtttatcatctgctttcagattcttcaccaagagggaaacaagggctgaatggcaattcaaagaatacatttcagccatgtaacagacagaacccttccgctggaggagggtcaggactggtcatgactccttggcaatagctgcagagtagtaaatgactcaaccctgaaatgttcggagaccaatgacccacccgtcctgttaaaacaagaagggattggctaccagccttttactcagtatgactaagccctgctcccttcccttagcccacattgcatcaactagcattccaattaaagtataaaggtaaagttttcagtaagcctgtttgtcagattttcttcactgtaactaatacttgaggtaatcacattatgaacagaaaaagattattttgattcacactttcagaagtttcggcctatggtataattggctctgccactttaggcttgtgttggtgaccaacaagcaaaaaataaaaaagagattgcaatccccttaaaataacatgtcccccatgatctgaaacctgtccctgtgtcccaactttaaaaggttcaatttctcagtggtgccaggctgagaatcaaccctttaacacatgggactttggagttactgatctaagctgtagtgacattgttttgctaaagcagcaattgtatggggtacagacagacagacagacagacagacacacacactgctgaaattagtccctatagccttccaagaatcatatatatgaacattcataattagtcaaaaactagaagcaaccaaaatgtctctcattgaaggaatgggttagcacgtggcacattcataatgtggagtagttaatacacaagagtgtcagaaggagttaccaggatgtcctccgtgtgtcctctgaaacaaaccagacacagaaagtctcagaagaggctgaggtaagacgaggcggtagagctttgagtggtgcttactgctctgtcagctaggaggggctccagggcctctgtgtgccactgggtttcctacctacgctgccgtgagtagaggaagagatgcatgcagagcagtacacacatgcgtacatcagtgcacgggagcaaattacagttcaagcgatggtgtatatgt

SEQ ID NO: 23542 - DNA, 1287 bp, Mus musculus
ctgtcctcagtccctcccagaaagctgcccctgcatctctgtgacttggaagtgagaggtctcagtagggaacatggaagactagagaagctgccttctgacacggttactgacagagctgaatagcactgcagataactttttgggcagactttatgatgccatttgcttaaaactacaactcatgcagagcatgacatacaaaagatgctgaagtgtattcatggcagaaacaagttcctgaccagaacgagactttcctgtaaggagcagaggtcactgcaagagtttgtgtgctgatgcatgcgtcctttaaggatcttcccagtcccccagtaccatgatacctgcagagctctgatttctcctttgtctgatggttcttgtaaatagatgtgctgtacctatgatgctgtttctgttttttttccatagtgaatgccatcttcatatgaacacattcagattccatctcacggacctctcatctctgcagtgtatgaaatcacaagtattggacatgtagggtacagatgagggagcctcctaatcctttagagtaaatgagtgtaagctacaagtggacgttttctttatttctttgcagtaagtgttactgtctgcctcacctttgtccctctgggtagaactcgctttcccgtcatatacattgtgcttactgttgtagtaataaacgtctctgtgggcacagccctcactcggcaaagactgggacccttgattggattctgcacgccctttcagatggcaagtgtgcttcatccctttgattctctgcttctcattggatttctgaactctggcgggcacttgaagtaagtttctcactgtgattaattctaccaatctcttttctccccttctgcctttccaaaacattgacatgactcatttccagttaattaatttgagaacccaccctcttcattccatgcactgcgttgtcacagagccctgtcttagaaaggccgtgagaatgggtgagagaccatgtggccacttaactgtttgcatcccaggtggacttagagttaagaattccttaaaagtgatgctgacatcttgcccatatccatgctgcctgacacagaaaggaatattgtactttttttgatgtgcagtgcctctagtgtgctgtgcctcatgtgaacggggcgtccatagcctcttctgcttaaaagtgtggctgtcacagagacaagctaatctggaggagcgaggatatattggtatcgagctttagttctatttttgtagcaggtaaaa

SEQ ID NO: 23543 - DNA, 1165 bp, Mus musculus
atgcagtgagcgggacccacacccaaccatccctaaccaagctccatgtagacagagggacagcacacacggggcatctgtgcacacacacctgcgggctcccataccgcccatgctcctgcagaaacatgcaagcacacgcatgcatacagaagcacacgttgctgagcacagcccctaagaggcgcacacgcctccgcgcagtgcctcccggagatgcgctctccgtagcggtgtttctcgccaaaggttgtggcgagggtatcccggccaaggcaacttgggcaaaccctgggggcggcacccgccgcacactctggtcaacctcccctttaaaaaaaacccgcccgcggaggaggcggatgtaggggcggcctgtccaatggcagctgcggcgctttgggagacttggagacttgagccagagtgagcgacagaaccggttcgcaccgacagacggacagaggaccagacagccactaaggagcgcttactgcccccctccgggcccctgccccgaactccagccccagcgcctgttactgccccagatacagcaagatgcgcggtcctggcagcgagacacgggcgagcactgtcccccggtccccgagccctggcccctagcgcccagcgctgctgccctgcatcagggagggccgcggagaccccagcctcagttggcgcaggagccctgcgggtggggcctgcccagcccagccaggcgcgccagcccaccatgctcctcctgtcgccgcgcagcgcgctggtctccgtctattgcccgcagatctttctccttctgtccagcggcagttacctgtgagtgccgcgggtggcgggcagggtgggagggaggagagcccctggctaccactgctgaaggagggagtggggaggtggaaagatggtccccggtggggtgctggatgccctgcgcgcaaagaaactgggggcctttgggtcactttgctggcctaagccgccgaggtagatcacctgagggacagctgtgacaacgagaaattttagcttaggggtcggagaaaaggtggccgaagagcggtctgactgcctttgcaaattaggctatgtgcactgagcgcgagtgtcagagctagccagtcgcgtctcagcgtaatcctggaccatccagagaccctct

SEQ ID NO: 23544 - DNA, 1140 bp, Mus musculus
agtattgcaatccctacctaaggtgaggaagtaataatgattatcttctagattttcatttgtttttttctattttgtatgtgcgggtgctctggctgtgtttatgcctgtgtacctcctccttcctgtgcggtactgcacaggtcagaagaaggcatttcattctctgggcctggagctacaaatggttgtgagctgggaatggaaccagtgtgttctacaagagcagcaagcgctcttcccccctgagtcatctctccagccctgacaacaatcatcttactgacttacactgttagctttctgcaaaatcttacgttgtctgagtttgaaactgtccaaggatgggactgcactgcacgtgtacttggaatcatcctaccacccagcttggcgattgggacacagtagctgctgctggctcattgatgtttaagggggactgcatagtttgtcatagaattgtcacttgactaactggaccaccttcccttgtagccttttgtcatacatgacatggagaccttgtgtatggccgagaagacgcttgtggccaagatggtggccaacggcgtcgaagacaaagaggcagaggtccgattcttccactgctgccagtgcatgtccgtggagaccgtcacggagctcacagaatttgccaaggctatcccaggctttgcaaacttggacttgaacgaccaagtcaccttgctaaagtacggtgtgtatgaagccatcttcacgatgctgtcctccttgatgaacaaagacgggatgctgatcgcgtacggcaatggctttatcacacgcgagttccttaagaacctgaggaagccgttctgtgacatcatggaacccaagtttgacttcgctatgaagttcaatgccttagaactggatgacagtgacatttccctgtttgtggctgctataatttgctgtggaggtaagtggatctgtcactcgcaggtgttcaccggcttccccttctgtaggaactcagtggttgtcaatatggtgccaatatgtatgccgatatagtgacgtgagctctggcagggttgggtgatgtcttgagtaacttcaaatttctgtggagtggaactgagtgagaacagtatagctatgatacattgtagc

SEQ ID NO: 23545 - DNA, 1154 bp, Mus musculus
ttctgtgacagggacatccctcctggaagttgatgcagttcctacttaagtagggactgatgggcaggtgggagtggggagtgggttggaggtctccaaaccagatctttgcttagcctgctcagagtccctgcagtctgctgaggactggacaggttttgggcattcattaaaacaattggtcccgttgactaccctctcctatgggaacctctgagcagctcccaagtgccaggtttgggttgcgtcctagggagatgggcttctctaatcttagctggatgaggcagcaagtcaagaaattgtgtaatcgccataggatttgaagaggtactgtctccatatcagggagcctggggacaggtgccaagggggaacctcctcattagtcctcattatgtatatgattccaaataatacatgattcagccagaagcggagtcttgctctctgtctctttcagaaagccttccaccctgcctgtgggctggtgacagtgccttctctttgccccatagcccttggcacttgcccttgctattgaaccactttgtgctgtgatctctggtattcaatggcttccattgaatgccttgtctgtaaaagctggtatgtgtaggctttcatgaaagaaggcatgcatctgccagggacaggcgactgatcttaaagggaaatgtgtatgcgtctggagagatggctccatggctgagcacttgccgttcttccagatgaccagagatcagtacctagcgcccacgtagagcctgtaaatctagcctcaagggacctgacactctcttctggcctctgtaggcacttgcatacctgtacatacgcacacgtcggcaaaaaaaataaaataaaaatatttttaaagccaagagaaaatgtaaatagcagtgagttactatgggtatgctttcctgaacatctactatgacctgatatgatacaaagagaagtgttggtgaactttactgcccagtggatagccccagggatgcagggatttcatgcacaggagctaaaggcttggaccacagatgtgactgccaccgtggtcttgcgcccccccctcccgcccccggtgtgaatcagaaaagcctggcccttaaaattccagatacacagaaccggtcaccatccccagc

SEQ ID NO: 23546 - DNA, 1183 bp, Mus musculus
caggcaccccagaagagggcatcagatctcattaggaatgattgtgagccaccatgtggttgctgggattcgaactcaggaccttcagaagagcagtcaatgctcttaactgctgagccatctcccaagccctgactcagggatcttaagcctgggcatgataggccagtggggaaaaccatcatcaattcacttcttagccagagtctgataggagcctagatgtcttctatcacaagtatctctttaattcccttctgaccctcaatggagggtaccttgaatatagccatgttcaaagatgttctagatacctaggggacagggtggagtggactaggatggaggcatcattgctgaggaacttgacactcatccaaggttacgtgggggggctgcaagcgccttgagtcctgcccatgctggagcccttctcaagaacagagcccacccaggccccctggctgccctttcaactacagtggtctgtgttgaagacctccatgtcttcaccagggtggtcagcagcactcctgtgagacgctcatcagggactactccacaaggcctgcccggcagtatgaggacccctctgagcacaagacggatgtcagtgttgcctacacctgccagtcggcgtctctccagccttccattaatggcacctcagtccatgcccagggctctggtgtccccactgtgtgtgcctgcccggcgactctcatctgagcccaggagaagatctacagttaggtaaaaataagcttgtcttgagtgttccccagacttcaggggtctccctgtgcttggaaggtacaggcagcaaataggagaaataggaaaagaaggtctgtggagcaaaaggctcagagtgcaaataggcagtgtgtgtgtgtgtgtgtgtgtgtgtgtgtgtgtgtagggtggggctgtgttgtgtcatgtgaatggtgtgtgtgtgtgtgtgtgtgtgtagggtggggctgtgttgtgtcatgtgaatggtgtgtgtgtgtgtgtgtgtgtgtgtgtgtgtgtagggtggggctgtgttgtgtcatgtgaatgttttgtgtgtgtgtgtgtgtgtgtatagggtggggctgtgttgtgtcatgtgaatggtgtgtgtgtgtgtgtagggtggggctgtgttgtgtcatgtgaatggtgtgtgtgtgtg

SEQ ID NO: 23547 - DNA, 1179 bp, Mus musculus
ggaagctagtgtggcccggcgcagcagagttacaataaggcattgcaagctgtggctcgtggtggtggaggctcatgattgttctttttaatttgttttaattgaatttgtcctcctcctcttcctcctcctcctcctcctcctcctcctccttcctcctcctcctcctcctctttcctcctcctcctcctcctcctcctcctccttcctcctcctccttctcttctcctcctccttcttttggttttttttcgagacagtgtttctctgtgtagccctggctgtcctggaactcactctagaccaggctggcctcgaactcagagatccacctgcctctgcctcccaaatgctcggactaaaggcgtgcgccaccaccgccgggctgaatttgtcttcttacgactacatttctaccaacatatcccctgcctggctgcctagtctctggcggaagctaggcttgggatgggtttgtgagctggtggccagacagacacacacatgacggtgacctgcatgaacctggaggtggggatgatccatctttgtggtccttccccacagctccatgctgaggacggccttcctcctgctgctgctcgtcactgccacctggctgctgggactgctggcggtcaacagtgacactcttagctttcactacctctttgctgccttcagctgcttgcaggtaggtgccaggacagagtcgcctgttgtgacctctgtccccaggcagtggcagtgaggtggtggtgggcaggaaagcctcagtacttacacacggagagggtttacacacggagagggtttacacacggagagggtttacacacggagagggtttacacacggagagggtttacacaccgagagggtttacacacggagagggtttacacaccgagagggtttacacacggagaggggaagcctgtgctctccacccgccccagccctgcctcaggacttgtcagtctgtcaggattttgtcactggcttaggcaggacaaagcttggtccctgctccgccactgcagggtggcccgttggtgttctcagggaataggagcatcctttatgtttcaaaccaagtgctgccagactcctctgagctgggctttcctcggtggacagccaggagcctggtggagcagcatcaggacccagagagtc

SEQ ID NO: 23548 - DNA, 1205 bp, Mus musculus
gtagctgcagccacagcaaaatggcttcctttttcctaaggggtagcagcattgagatgggaccttcaggtccacaacctggcagcttacagacttttagactcctgctctacagagacgcgcaaggcaggcctagcgcccaggcccagcaggcaccagtaacaacacactaacttttctgcagctaacacagtaacttaggaaggaagaactccttaccacccaggcatgataattacgaaggtagggagtcagaacagttttttcctaggtaggtattcatatgggtgtgtgtgtgtgtgcgtgtgtgtgtgtgtgtgtgtgtgtgtgtgtttagttactttgtataaaccgtttggtgactggctcttttcactacaagtctaccgtgaggtttcagtgactaagtctcttctgttccgtttcacatggtggaatggcatctctctgggctagttttgaactgtgcctaggatccgtgggggtttctgtctttccccttcaggaagcttcctaggagtggaccaaagtccggggcatattgatggttttccattctggctttcttttcccttccttccctctccccttttgagacagggtctcatgtagcctaggctggtgtcaaattcactggctaacctcgcggatgactttgaacttttgaccttcctgcctccacctctccaatgctgggattacaggcctgtgccgccatacctggtttatgcggtgctgtgaatggaacccagggctctgggcatgctagcaaaatatctgccaacaagccacatacttttttttttttttaagattttatttattttatatataggatgagtacactgtagctgtcttcagacacaccagaagacagcatcagatcccattacagatggtcgtgagttaccatgcggtggctgggatttgaactcaggacctctggaagagcagtcagtgctcttaaccactgagtcatttctccaaccccccgctccccccattcctgctttcttaacccattgactttgccatggaagatagttgatgctggggacctttagagtgggctgactgttctagtcagtcctgttacaagggctggtctgcccacactggctgctgtgagcctagtaattacttagataatgtttaccttgtggaggaggccccaacacgatatacaaggtgtggccagcacctat

SEQ ID NO: 23549 - DNA, 2153 bp, Mus musculus
gcagacccagcccctgccatcctgagaggctccttggtcttatgacccctgttcttcagaggctttttccaccaaagccatagctgggaatggttgtggccccttcctgcaggggtggtaagatggagagaatggtggggaggcccctctccagtgaagaaatggccagtcatctcacccagccctcagaccctccttccacgttggacctgctgtgggcactccgaggctgtgggtagggcctcttagggcttggtgttttgggggtacctgcccctccatcagtgtctgggcatgagttatcactcatctggctcgtcttggcctgacactccagctaagaggtcaggccagtggttggtgtcctgtgagggcccagactggcgtagtgtcggcaaaagcacacctttttaacacttggctctttggaaggtttcggggcgagcattctccaccctgctgttaagtgagagactccatggtcatctggctggcgtttggcctccaggctgcagtcactctggagttatgggaggaccctgtgccacagcagacagctgtgggcagagcctagaggttaggggccagagttgccttgtcctctaacatctaacagtatttattgtctcttactgcacgctctgcaggggtaaggcacatcccatcccacccatgctccctgccccgacaaaggtggagacttcacaggtgggcgatcttgcaggcctgggcctctggggggggcaaccacgacgccacctgtgaatctcccaggtggaccactcttgtctccttcagcttgtcccgagtccttcagatgtcactgagattgcttttttgaagaaacagaagattatattttttacagagagcaagctgtctttcttatttttgtaccatttttcaaatgtaatttttacctttgctccaacgctcgtttgccggcgtaggtgtgaggcccggtggcttgggctcatgacacctcattcccaggggacttcaggccacacactgggggtgggaagggcttgccaggcaaccagatcaagcacacataccactccagatgcgtagcagaggccacacagctccaggtacatagacggaggagtctggatggggaggcgggaccctcgacccagggccgtggcttgggcccctggaatatgcttgtgctatgaagagcacggaatcagagaaggagcaccccaacgtgccagagggaaggcaacatggcctctgacctgtccgtgaggatggcttcatgggtgatagccacacatggtggctaacacttcatggaccctggcggtgcctgggttgtgagtgttgccaccccggtgtgctacagagaggccttaagcagggaaggctttcagggtggaatacgtggtttagtttgagtctctttctttgggaaagagagatgaagactgaccatgggtcagggcagtaggtcagggaggtggccccaagttctaccattagccaccggcagatctttgagtagagcttagggggtcagggctgggccaggggcctatgtagcttctaggcatccttacagagacactggggtttgtactggattgtgtgatctgggcaggtgtttaattgctcactaatcactgacctagaatgttcaattttgtatgtgtgaagcttgagtctgttttggatctgtacataattgttgctggtgtaacttttgttctacaaaaggatcatattctataaagaactgataggaaaaaaaatcctctgtcacttttttttttaaaaaaagaaaaccttgtttagatacaaagtcttgtataaattataatttttatttaataaacctaaaatgctctgtgctgagtctgaggaatcctttgttcttagctgagtgtgtagatgttggttggtagatcagctgggtaactctcaggtctataccataccagagtcttcgtggccactagtgccatttgggtcgagcacaaaactgtctatgagactgaaggcttgggtatgaaatgggatggggagtgggtgctgattgctctactgcgccccctggtgtgagggaagctaggagcaggaggtagtcctggggatcccagaagacagaccggaaaagtagctggccctgggtgtgtgagggggagtct

SEQ ID NO: 23550 - DNA, 1663 bp, Mus musculus
ggccccatgtttaggttgacttggtttaaacagggctaggtcaggagttagatcctgggagactgtggaacaagaggaggccagggcaggctgaggcttctcacggtcaccttactttctgtttttaattaactggttccctgtccgggtgaggaaaagggtcaaggaacccccaggtgggcaggggtttttgtcagtcagggttccagagattgtctcatgggcccaaacttgaccgcaacagggcagaaattagtggttctaaagtcccagccatgtgtagggggcttcttcctaacaccacccagatggcaatagccaggagctgctgggctggcctctcttcatgccctactgccctttccagagccactgggttagagcctttgccccgttgctggccttctccagggccctcagactggcttctcacatgtatatcccacagatgcccccaccaggctgcctggcctctgtgatgtgggatccccaaggaccaccaggccacctgtaggacaagagcctagactcctagagcagcctcctgtcctcagttacccactgcagcccactctgacctgtcccttctttaggagcagcgcaacactgcccaggcactaggactctgcccagaggctgtggggaagacatagggaagacgtgtgcctgcttctgttcagatgatcctgggtcaggtgggatgtgacatcagcagagtgctgtgcaggcaatccgatgtcctggatcagcagagggacatgctccctcagaccagtgcctgtcctgggtgagaggcacccagttataaggaaagctacctctgtggctctggagaagcaccatcttccctgatccttccatggtgcggatcacccctcagccagaagggtaggcccataacgatctgccccatggtgtttttatgagatgacaaggacccatgaggttaacttaagccctgaatgtatttttatgtgtgcaaatgcttgactgggtgtacgagacgctggcgacagtcctgtgtctgagcccatgagctgagccgggcaggatgtgtgctttgaatgtgatgtgttggaaacacgaaataaagatgcttcatatggcctgtggtctttttattgcatttatttgatgatgggggctggggtacctgtgccatggtccaaatgtggcagtgagaatacaacttgccgaagcctattctcatctatcatgtaggtatcagagatcaaacacaagatgttaggcttggtggcaagctcctacacacactgagccatccaccttgttagccctatggtcttgactcactttctcttcaaggcttaggccctgtcccaacactgagccttgtgctctaggcctagtcttgatcacagcagtgctgtggccttgctgacaaggttgggacctcaggagaggaagagtacgtgcccatggcacgggcatgccactttcctggctctgaccctctgaagtccagacttggtattgtcaggagccagaagaataagtgtcagggcctccaaactttctgccagcctctggacaagagacaactccaagtttcctttgtaaaaagcataaactgagttggcgctgggatctgggcccctctgccatacccccaggaacccagggcatgtcaccctaccttcgg

SEQ ID NO: 23551 - DNA, 1126 bp, Mus musculus
cagagtgcccatcttcccagacatccaggtctacaatcttggtccaggagatgttaaacttgcccatggtgggcaagaaggaatgtgtgtgttgggaatgtgactctggatgacctcagtatgaggctgacagctctctgtctttgctcttcaggtctcctgacaatcgcagcccctgcggtgccccctgggagtggctgtggctccctggaaattctacacctcagccacagtcctgcatcctatgtggacaccgctcattctcccccatccacccactgtttcccagaggcctaacaaagacagcccaattcctcggagctctgagctcaagtctgtccagctgaacccaggaggctgggactcagacacacatgtcaagggtggtacctggaatcagcaatacctggtgtgtggagcctggctgcatccatcctcactagccgcttgctccctggagttggaggaccggaacaaggaaattgtggcccggccagctgggccacaacgcaaggtccggggactgtcaggtgcagaagccaccaccccctctgtcccagactgtctgaatcgcttttattttcttatactttcagtatactcaatagaccaaagagcaaatctattttaacgtggacacatccctgctgccaagagttccctgggtttgattgtggggcaggggagggcgcagtggcagacatgctggtggcccaggcagcatggagagggcatctgaggccaagacccccgccccacgaacactgcagcgtgccctaagaggatggctttgcccagaaggacaccaccgtggtgcacctgcaggacccagcaggggcatggccggcgacggcccccagcggacagcaagggccccggacacagaccctttgcccctgtgcttagaccaactctatcgtactaaaatcactttctgttttaaccagttagacatgcctcttccacagctccatttttgatagttggataatccaccatttgccaagagcatgctgggtctcctgtgactgctatctcatctgatacaccatttagctccagaaagcaaattaaagaaaactgaagtaaccctgtttgaaagagatcattaaatgtattttgcaaa

SEQ ID NO: 23552 - DNA, 1365 bp, Mus musculus
gtttccagcaaaggcggtggccaaagcctcagccagccgggagctctgtccatagtgttgataagctgtacatgtttgtatattgttcagaacttaacttattctggttttctaggcgtagttctttaattctttttcccctggggaggggaggtttcacttccaagttttctatgaaaccatctggtcttggctttgcaagtgaggagggtctgttgcgagcagtgtggtgttggggtcccactgcaggtgccgagggccgaggcctcacttattctaatctgtagggtttttttttttttttaaagacttttgaatgtttaataattttgtagatcatgctctttacacagagtaccgcttatttaataagacgggatgtaaatttacaatgacaaatgtgtattttaagaaagaaaatgacattattttgaatggtactttgtgcaaagagggaataaatttatgctgtgtgcatcacttgcaaatcaccaaaaaatgtcccgccagctgctgccggacagggcccgttctcctcgttgatctgactgccctgagtctcctgctctgccctggctcctgcaggcgtgcctcccagcgggttatttattgtagaaagtgtactcatttgctttataatgaaaaataaatttgcaaaggtatattgatatgcatttttatacaggcacataaaaattcaacttggtgtgggagcagaatgtgttgcgaggttatatacacgactggcctgtgtgtactttgattttgtaacttgtaatcttttgtttacaatgaggagctttctgtaacttgttttcatttagaacactttggtagcaatagactttggatacattttgtatggtacatgtgatgtatatagaattagtcctttatttttatttctaagaggtaaagcattatgttaggggaaaggcagggtgggtttccaaatttgcatttttatattaaaaataaagtgaagatttggacagtgtggccctctcattcctgcatcactaggaggctgggtgagctgtagcctgagggacgtgagggactcggagcaccgggcctggagtgggtggtgtgacacacttgatctaacagctgactcgggatggcattatttattattttgcctaatcatatttttattttaaagctaaatagttactaaaaattttaaatgttcttttaaatctacatgtttgtaatatctccatagaaacttgaaaataaaaagtcttcctttggtagtttttgtcccgtgtttggcagatggtcatgtacccagcatctctttccagctctgaggaagcctgaggtggactgaggcagtggaactgtgtgctgacggtgtgc

SEQ ID NO: 23553 - DNA, 1276 bp, Mus musculus
cttgcttctgaggtcatgcattgagaaggcagctattcattagttgtcatatttcagctgagaagcaaaagcaggagctaatgttggctgtgcctctgatcctctctctgggatgcttgcaggtgtttattgagggcccagccttagcctgcttctaggacatggcctaacccttctaactctccagggcaagcttgtactctgggccccaccgtgcacatgctgttgtgctcttcattaatttcttccaagtaaggagctgtttttaaagataaggtctcagtgggtagtcttgactggcctggaactcaaaatgtggatcaggctggcttggacttgacagaagtccacctgcttctgcctcctgagtgctgtggttaaagatgtgcattaccataccacatctggcctccaatcatttcttgtaagcttcttgcccctggattgtttattctgtaggtaaatgtctacagtaggtgaatggggtttggtggtcaaccttggaacttttattcacaaaacccaagatcctatgttcctgatttgacctaccttttctcctgctattgactgttcaggaaaatggtggaatcgtacggacttaggttttatccggtacgtttccttctcctggatgaccagctgcctggtcactgtggcctgactcgtgaggtcagagcccttggagactcctcacttctggcttcctgtgtatctgacccagagaaactgtctgtctcaggcatctctagggcatacaggatagggttgaattctttttttctcaagataggatgtagtgccacactcaggaagctaagacaggaggttcaccacaaatttaaggtcagtctaaactatagtgatttctaggctagtgagttacaccctgagaccctgcctaaaaaccaaaactgatcctaacagtataattagaaagaaaagcagccaggccagagtgtggcttagtagtgtttctttgcatgcacaacatttgggttcaatgtcaacacagcataaactgggttgatacaaagattagaatttaaaggtcatattggctatagagtgaattaaggctagcctgggttacatgagaccttgctttgaaaaatagatatgcatgcacccacacaggtgacaagatttctgaaaccctagataggtccagcaggaactgagcctgatagccaccaggattacagagcgactctcagatcttcacctgcatccatgttcttttctccagattgtgtgggaggcaagggtgggctcc

SEQ ID NO: 23554 - DNA, 1187 bp, Mus musculus
agatagaagacttttgcttgcttcttgttgtttttttcaagacagtttctctgtgtaatggagccatggctgtcccagaactagctttatagtcatgagctcagagttctgcctctacctcccagtgctaagattaacagtgtgcaccaccgctcccagccagatacaagatttgttaacaatttaaaagtcaaaaaaaatagtaataattagcaatttgctttaataaagcttccaacttcatactagacccacaccttccccagtgcaagaacttgggaaactgtaaatagcttgcaagttgtaaacaagatttatagaaaatacatttaatgccaggcagtggtggcatatgcctttaatcccagcacctgggaggcagaggcaggcggatttctgagttcgagggcagcctggtctacagagtaagtcccaggacagccaaggctacacagagaaaccctgtctcaaacaacaacaacaacaaaaacaaacaaacaaatttaaaatatgtcctctacaggtatgtatccaaacactacataagcagagtctgactcccccctggtgagcaattgcacactgtggagaaaggtagacaacaggcactaatactgtaggtcctcagaagcagaccagccaaaagcaagcatgtccaacaagttcatcccacactcatcaatgatcaggccaactaccaactcagaaaccacaggaagaacaggccaaactaccactgacagacaaccaacacagacagacctgagacccacgcacacaggaacctggaagtagacatgaccaaaatggatctctagaaggaaacagaggcgctactctagtctggatactctgtcccagatccctggagataggtacccagcaggaagaccaggctggccactccctgtgctctggagtcctatctcactgcagcatttctacgtcccacacacgctctcgccacgatgccactgccccactgattcagccacagaataagttgatgtgatgtccaatcttgtgctctcagctcctcaaattgtgagctaaaaaaaaaaatcctttataaactccccaatcttatctgcatagttattgcaactaaaatctgatgagtgttatgtcaaaagcacaaataaaccaagattacagagaggaaaagcccatgaagcaagccctacagg

SEQ ID NO: 23555 - DNA, 1202 bp, Mus musculus
agcgtgcgctgctgcctcagtcacatcagtctctcccttgtagggaaaactctacatactccatacagatccatatagaagatctctctgtgtagtcctggagctcactatgtagaccctgctggccttaaactcacagacattctcctgcctcagcttcctgagtgctgggattaaaggagtgcaccatcacacaaccagccttgttcacagtctttgctttccaaagttgccagtcaggggttatgagtattttagggtcttacgtgattcatagagtggcagggatgaggttgccacccagtgtctacaattctactgggtagtacaagcaggctgcaatgtcctctgtgacactggactgtgattgtagagcctgcagtctatgcttagctgttcttatttgaggtcttggttggggaaacagactgtcactggacttgaggtggctttgttcttaagttcccccatgtcagtagggtctgctttgtggtgtgatactcttgcctcaccaaagtggaagtggtctgacatcttctctctgtgtctctagactgtgattctacctgcgtgggctgtacaggaaaaggcccagccaactgtaaggagtgtattgccggctacaccaaggagagtggacagtgcacaggtcagtgagctgtctgctagggatgaactttctggaagaaatacctcacctgcccagggggcccttgtccatgggaacccctcctagacagtgtggtgccaattggagccacacttgcctgagtccctatgtcacaccagcttctaggggtcttggctgtcacctccactatcttgggcactgccaagggcactgggcttcctatcttacgatgagatgtctctgctctgccgttgaggcctggccaccaaggcccatgaagctctcagcaccttactgatctctggtgggcagtcatgatcccatcctgttgctctcattgataaaggaattgtgaatgagcaacttgcgtagtagaaggggtgtgtgtgtagtcacttactgaaatgaagaattttcatttcagatatagatgaatgctcactagaagaaaaagcctgtaagaggaaaaacgaaaactgctacaatgttccggggagcttcgtgtgcgtgtgtccggaaggctttgaggagacagaagacgcttgtgtgcagacagcagaaggcagtgagt

SEQ ID NO: 23556 - DNA, 1191 bp, Mus musculus
tttgtcccacagccaaggctgacaaggagagcttcgagaaggtgtaccaggtgggcgccgtgctgggcagcggcggcttcggcacggtctacgcgggcagccgcatcgccgacggactcccggtgagtcgtggctccgggcgcacccgcgtggacgatcgccacgctcggccgcccgtctgaccgctcgcgtgtcgccccctcttttccccgcaggtggctgtgaagcacgtggtgaaggagcgggtgaccgagtggggcagtctcgtaagtatgcgggtgcggggcgtgcgggtgcggggcatgcgggtgtgggttgccttggctttgtccgatgaccgccttgtcccccagggcggagtggccgtgcccctggaggtggtgctgctgcgcaaggtgggcgcggcgggcggcgcgcgcggcgtcatccgcttgctggactggttcgagcggcccgacggcttcttgttggtgctggagcgacccgagccggcacaggacctcttcgacttcatcactgaacgaggcgccctggacgagccgctggcgcgtcgcttcttcgcgcaggtgcttgccgctgtgcggcactgccacaattgtggggtcgtgcaccgcgacatcaaggacgagaacctgctggtggacctgcgctcgggagagctgaagctcatcgacttcggctcgggcgcggtgctcaaggacacggtctacactgactttgatggtgagcaggtggtgcggcgttccggcgactgttaggcggccacgcgccacgcctggcttacgggaggggtgggggggactggggacaccggggtagccctctgcggtgtgagggcgcagggtctggggacggtgggtggcagccagggagacccgcgatacgcgcgtgacgcagggcccccgccagccgcctcggcgccgtggcccctccctgtgccggggagggcgctcgcgggcctcccttgcgtgcgtgcgtgcgtgcggagcgcgggggcgccgcagtagaaatccccgcattgcggagcgcggggaagccggggctcccccactcctctcctccctcctcccatctctcccgcccctcctctttctaagctcctctcctcccctttccgagccttgcagagctgagcaaggcgagccggggcgggaggagctagaacaccaggcctggttcccagtggcttac

SEQ ID NO: 23557 - DNA, 2054 bp, Mus musculus
ttcctcccctgccctccatgtccctcctttcctgagtcccgcctgcagctgtgttggggtttttccagggtgatgacaagcaagattctcagaggccccatggaggctggctgagagctaatgaaggcccgttgttcagtgtgttcaccccccagtgtgtatatatcctgatgtgtacctaatcccgattcttccctcaggcacccgtgtgtacagccccccagagtggatccgatatcaccgatatcacgggcggtctgccactgtgtggtctctgggtgtactgctctacgacatggtgtgtggggacattccctttgagcaggatgaggagatcttgcgcggcaggctctttttccggaggagggtctccccaggtgtgttgtagaagctggctggggccgtgttgggggcagggcagtgttgcagcaggactctgaccccctgttctctctgcagagtgccagcagcttattgagtggtgtctctccctgaggccctcagagaggccctccctggaccaaattgctgcccacccctggatgctggggacagaggggagcgttccagagaactgtgaccttcggctttgtgccctggatactgacgacggagccagtaccacttccagcagtgagagcttgtgaggaggagaaggggcctgggctcggcctagccagcgctctcccagaattgaacactttctgcctgggatgtctgctgcaaaagcagtgacctctgacccctggtgacctttgctctcggcaccgggcctgtttcctttgctttgagtgcctttttgaacgctgctccacagggcctgggttttcttgagctcttctgtccaaagatggctgcgggctaagcaaggtcctgccctgggtggatacttgaaccagagatcccgaccctgctgctccatctcaggaggcagccttcctgaccaagtgtgtttgacatggagcgccctgtggtgcccacctccaaccctccagtctcctggtgttcatctgggcatgtctgcacaagcaatgcaacgctgggccactgctgcccgtctgcctccccggcacggcacggctccgcacgcaacctaagcgtgccaccacggtctcttatttatggtgtgatcaccctggagggcgcccccgccctgctggggctatttattgtttaatttatttgctgaggttcctccaagcaaccaccttctccaggcccctggggtgttgaaagtcaaatgtggctgttgagtccacagacccccatcctaattcctgcacctggaggagttccccaacccccgtgtttgcgggaggaagcatttgtacagtggctaatttaaggggagtgggagaccctgtcaccctgagcactctgcgctggggaggggtttaaattattgaccttgtacagtctgcttgctggctctgaaagctggggttgggggacagagtctcaagcccttaatttattttagcagctgtgtttctgtgaccctggtgtgactaagcatcaggggtggggttgtataagttcaaaagtgtgaaatgtctgaagatcatattttttatacaggtatttcaattaaatgttttggtatataatggataacttctgtttattggactggggccctgggtagtcttccaggtttctgttaaatctctgtcaagtgggtgatggggagagtggggaggggtagagataagctttcgagaggccagtgccatgaattagccagagggtgtttcttcctagtccctccttaccaccttttctttttgtttgttttttttgagacagggtttctcagtgtagccctggctgtcctggaactcactttgtagaccaggctgaccttgaactcagaaatctgcctcccaagtgctaggatttaaaggcgtgcaccaccactccccggctaccacctttttttctactcagagctagaaggctggttcattaggagtcttggggtgggggtggggcaactgcccttaggaagagtagaagtctgtttcctgtggaggtgttagaacaagtgaggtaga

SEQ ID NO: 23558 - DNA, 1152 bp, Mus musculus
catgagtctgtgtcacccacagtcagaggcgtcccatcttaataaatctctttagaaaccttcaacagtagcccagagctgtgtttcctcagtgattccagtgacatttgaccatcacagccaggaacaagtgcagaggcttgcttgtattgcaccagctttccaagcagttagaggtgaactgcatgttcctcataatggtgctgtcctcataaccaaagatatgcaggggctgttacaacagctcttactctgcctccagcactaagtcagggcttcattaaaaggcatccgtgcagagacgctcaaccgtcaggaccaagatgactcacagaagaggccttcatccctctttgatggttgagagtcatctgaaacttgtcctggcatcagatgtcaagttaagagtgagaaccaggcaggagcaggaggctgccccatggagtcagcattaaggtggtcagctttgcaaggacaacaggggcataatgtggacaggaactgtatggctttgactctgtgagcctatgcctacctcttctccacaggtcacaaagcttgtgaagaactacaggtcccactcggctctgctggcactgccctcacgcctgttctaccatagggagcttgaggtctgtgctgatcccaaagtagtgacttcactgctgggctgggagaagctgcccagaaaaggcttccctctcatcttccatggagtgagggtaagtctgccgtgtctaccgagtacttcttgcatcaggtgataaaagaaggaaaaggaagaggaggcagtttggctcaaagaccatcctgtgtacttctcaatactgtgtgccccctgtctgtactacattattagccaagcattccctaggaacctgggggtggggaagacgggtgctgatctctcaagtgtaaggggcaagaaggggagctgctgagctctcctgacaaagattccatgcagaaaggacttgagagtgggtattgttggccagcacccttgacacttatattagacaaatactggattccaacaggagacccaggccagtatctaggagctcaaagtgtggattagaaaggagatggctcggtggttagggatgtgtctcactcttgcacacttcagttaaattcccaacactcaca

SEQ ID NO: 23559 - DNA, 1200 bp, Mus musculus
gctgagtggccatgcacctccctcctgggtgtgtggggcctggcctggcctggacatgcatgtggcattgccagctgcatctctgcctgcagagagtctggttttgtggggttttgttttctgtttttgtttttgttttttaatgtcaaaaagttttttactcaggtaattttgacgtcaaagagaaaacaaactgaagcaaatatcaggaaatacaagccttaaatccagtgaggacaaagaagtcatctttttatttgtgtttgtgtgccctgagtgggcagtgtgtgtcagagtcggcttgggggtccaggccagcccctgctagacaccactacagctcagagtggcgtggggctgcctcagatatgagcctgcaaggctgcccttggtgttggtaggaccttagcctgattgctgtgcattaggtgagaggcccaaactgcactgagggcagtaggcacccactatgggccacggctggtttgtgtgcagccagccattcatgtgtacaggctgtggctcctagtatatggcacagcctggcaagacctagaccacattgattgtccttgtgttggctgccaaatcaggtgagacacggagctgggtggggacacagggctggctggctgtgtactctgtctcacacttgtggactcattccctagaaagaaataaattttaattttggaagctcccgctttgtgaagtgtatggaaatgggactcaggcgatggggcactggcttcctcttttgtcatctgtccccaggtctgcaggatgctgggggtactcctgcatgccaggggacatactacccaccttagcaaagtatagaggctggaccctggtgctcactagtgcctagcaaggttatctgtgtgccagccaagatgagccttacatgtgctcagcacctgtacaccctctggttcacactttactgcctggcagtgggagagggggaggaatgtaggagtggatcagaagatccttaaggtaggttgttcttgcctgtgttaggagcattgaggctgaaagagttgtatatcattgccaggccagagcaaggcagaccctgagggtagtcagtgacgtctgtgttagtggcagcaggaagaacacatgctctggccaaggctaagatactacaggctctgtcacagaaaacaacacctacccaccttctcaccgccc

SEQ ID NO: 23560 - DNA, 1328 bp, Mus musculus
aggcagaggcatttgtgggtgctgagcgttgcattatgaagacgctgaccgagacggacctgtactgcgagcccccagaggtgcagcctccacccaagcggcggcagaagcgagacacggcacacaacctacctgagttcattgtgcgtgagagcgggagggctgtggagggcctggggagcctctcaggagaagccgccgccgcccacacctgcctgcgctgagccctagcttccacacaggtgaagtttggctcccgagagtgggtgctaggccgagtggagtacgacacgcgtgcgagtgacgtgccgctcagtctcatcctgcctctggtcatggtacccatggtgtttatcatcgtggtctccatctactgctactggtgagtcctgcccccggtaaggctcccctcatccctcccgcatcagcatcagcgcttctgaccgtcatagctgactgataccagagagccgttcaatgccccacaggaggaagagccagcaggccgagcgcgagtacgagaagatcaaatcccagctcgagggcttggaggagagcgtgcgtgaccgctgcaagaaggaattcacaggtggggctgtccccctcccccggcaggtggagccacagagtatccctggatcttctaggccaccccttagggccagaaactgcaggagggcccgggttaagagcagcaggagtaggtggccaggggtcgcctcacccaggcttgcatccccttctcagacctgatgatcgagatggaggaccagacgaatgacgtgcatgaggcaggcatccccacgctggactacaagacctacaccgaccgcgtattcttcctgccatccaaggatggtgacaaggatgtgatgatcaccggcaagctagacatccctgagtcacggcggcccattgtggagcaagccctctaccagttctccaacctgcttaatagcaagtccttcctcatcaatgtgagcagagggggctcaggggcggggagggggatacagaggaggggggcagaaagataaggttaaggtaaggggtggggcaaggttgcagcccaggtgctcaagtgtgcactccctggctgccccgcagttcatccacaccctggagaatcagcgtgagttctcagctcgggccaaggtctactttgcatcactgctgactgtggccctgcacgggaagctggagtactacacggacatcatgcgcacgctcttcctggagctcatggagcagtatgtggtggccaagaaccccaagctaatgctgcgcaggttcgtgggaatggcgggtgggggtgggggtggggggga

SEQ ID NO: 23561 - DNA, 1177 bp, Mus musculus
agtagaaaatgctgactggactctccacaggtttcttccctgtatgtgggcagtgagctgctgaattttgaagagactgtgaccatgcatgaatcagacaccttctcttttaggaccccaaaggtaccactgcttgtcttaagggctggagggtagtgggtattacccctagcactggagcctagcctagcctcctgccctgtgccttgtggtctccaagcatctctgcctatgtccctgaacaaactcatggtcccatggtgtgtgtgtgtctgactcttccccagtccctgcctacctggcaaccatcactgactttgggcaattgagagattcccatggcttttggtgtcagagggacagaaagtacagtttgtccctgtgtgtcccatgcagctatcccatgatggtaatgagacactgcctcttcacctgtatgttaagtcctttggcaagaacattgacagcaagctacaaggtagggggtgggtggggtctggggaaggcgggagagggaacagaacaacagctaactctacgtcctcctccacagtgactctctacaactgctcctttggccgcagtgactgtagcctgtgtctggctgccgatcctgcctacaggtgtgtgtggtgccgtgggcagaaccggtgcgtgtacgaagctctgtgcagcaatgtcacttctgagtgcccaccaccagttatcactagggtgagttttgtcaccgtctgacctgtacccccatacccccttcacgttcacccacccaagccactcatgcacccggctctgctgatttcagatccagcctgagacgggcccgctgggtgggggcatcctggtcactatccatgggtccaatctgggtgtcaaagcagatgacgtcaagaagataactgtggctggccagaactgtgcctttgaaccaagagggtactccgtatccacccggtgagtgaactccgagcagcctgggctcctagcagctgaacagatgcagcagtgataatgagctgacacctgcctgtctgtcaccaggattgtgtgtgcaattgaggcttcggagatgcccttcacaggaggcattgaggtggatgttaatggaaaactcggccattcaccgccacacgtccagttcacttatcaagtaagtgcctgactgagctgtgttgtc

SEQ ID NO: 23562 - DNA, 1185 bp, Mus musculus
attctcaaagagagagtaaatggagtagttggaggtaggtcagcaccccagccccacccatccaggccgcctttaggcaggttacttcctctctgtgacgttccttcatctataactggaaagttacagagcccagggagtgtgaacctggatttgctttatgtttaaattgtaattgtttatggagaataagggatgtttgaggtgatagttaaagtagtctttttttttaatttaaatttattttatgccatgggtgttttgttggcatgaagtatctatggaccacctgtgatggaccacctgtgcccctgctctctgtggaggctaaaaaaggtgttagattcactggggctagagttacagatggttatgagatgccacgtaggtgctgggaattgaacccaggtcttcaattggactcctgacccaggcttctagacagaatattcacctacatgtcttacacacacacacacacacacacacacacacacaggctcttagtgcatgtatccacctctctctctctctctctctctctttctttctctttctcatatgcacacatgcacacacacacataactctgaactggtagacttagagctgctgaccccgccccagcaggcagcaaatggagaaggcgaaatggaggtggggccatcttgcaccaaggagctctggaggtgggcatgaatagactgtgcttacctgggtcatgcgtatgggccttcatttgcagctctggcttcaagcaggatggatctacatgtccacaagtctgcccatctgcaccctgagaccacctgtaggttcttgagaggaatacgtagggatagctgggagtctacctagagctatggataccttagctctaggaaggggattatgtccctctctgtctattgtggacactcagggcagggcctgaatgaagagaagcctcggtttatctgacccttactgtctctccccacagagttctgggggcaatggctctgccactctgggccctgacctttctaggtctcacgggcctagggttgagcctgcggtcccgaaagccggagagtttccgcagtgagacagagctgaaccacctggctgtggatgaggtcacaggtgtggtgtatgtcggggcagtgaacgcgctctaccagctgagtgccgacctgcacgtcc

SEQ ID NO: 23563 - DNA, 1177 bp, Mus musculus
aatgctgcatttggtaaagctggcagtggaaccagttggatgacccagctcctgtctctcctacctgcccttggtccttttggaagacagatggacctggccactccctgtccaggtcttggtctggcaatgaggcccctgacttgcagcttctacctgcaggacttggtgagggaacaagaccctacggtgccagcaccgtcagatgggcaggaagggggaggagcaccaggctctggtttcatctgtactttttaatgcacggaggaaaagccttttttttttttttttttttttttttttgcactttgtacccagctacaatacagggtctctcttggctcacggcagatgtaaaggcctgagttggagagacctgatccccaataataataatacatgggggtctggcactagtttggccatatgaggtcaaaccccagttctagctgccctgaggctcctgggagctggcattgaatcaggctacaaattttgactgccttaaaaacaaaagaccctctggacctgacggagttgtctctgtgctcagcaggcagacttggcagacttgggtgggtgttggcgctgcatcagacatgtaagagtgggcacagaagaccactgggaggctgagagacagggcgggcccatattgtccacgaagagtctaaaagtctatgttgtcttttttttttttttttttttaaatgttctgaccttctgacagggcatccaacccccaataaaaagtattcttattgaaaaagtgtgtcttattgttaggctgcaaatgcagagccccagcctgtgtggacacctttgctatccctaggctcattctcagtagttgggactcatgttgagacagaaatgaaaagctcttccttaacagtcaaaccaaggacacccattttgtaaaggtttgcttcactcaaccccagggcccatcctgggaagagaggtgtatccctctggaagtgagtcagccccaaggctcatatccctccctcccagcagctcctctgcttccttcattgggtcctgtggttctgcccttggcctctaccagcattcaccttatttcttaggtgcgtcagccacttccccagctcttaacacctgaaatgtggcgagcaggaccctccccagagtctattctgatgggtttcttgaa

SEQ ID NO: 23564 - DNA, 1233 bp, Mus musculus
gggcatgaggagggggaggggggtgataggcgcttgctatgtagtgtcatgttgttggggagacagctggtggcccgggccagtctgctgtgtgcagggagttaggtgtccagtgtggaatcacactggcttgtagagcagggccctctgctgctttgccctttttgcagaatggacataggttgtgtcatcggtgcccagtgaaaactagagtgctgaggggtgggactgctgccacctgaaaggcaacacttagctctctttttgagacacggtctcacagtgtagcactcgctgacctagaacttgtggcaagtctaggtactgagattacaggcaaccaccaccacacccagcaaaggacagggacttctgaatctgctttccttgtcatgggtggcctgggatgtgatgggtgggcaggctggagggacagtgcaagcaggaccagagcagagtgggtccatccagggctgtagacactactggccttcccaggattctgtggatgtgtgagcctctgagtcctgattggctgtggtgtccatgcagatccacaagctgctgcagatatcggtgctggtagtggagctgctcgactctggctcctctgtcctggtgagcctggaggacggctgggacatcaccactcaggtgtgtgcaggtgcggggaagcggggagggcagggtcctccaatgtcctcctgacatctgctggtgttggcaggtggtatccttggtgcagctgctctcagaccccttctaccgcactctggaaggcttccgactgctagtggaaaaagagtggctgtcctttggccatcgtttcagccaccgcggggcccacaccctagctgggcagagcagtggcttcacacccgtcttcctgcagttcctggactgtgtacaccaggtaggtagatttccatgtagataggcttgacctgtgctcccctacctgacctctgacccctacgtcttacaggtccatttgcagttccccatggagtttgagttcagtcagttctacctcaagttccttggttaccaccacacatcccgccgtttccggaccttcttgctggactctgattatgagcgtattgagctgggtatgtagggaagacggggatctggggtaactgtctgggccagcggggcctaagctcagggctgttcttgtgtagggctgctgtatgaggagaagggtgaacgcaggggtcagctggcctg

SEQ ID NO: 23565 - DNA, 1233 bp, Mus musculus
caggtgggggtcactgctgctctgggatagagattgcattgcctctcatggctaagctgatggtgtcacagccctacctccaagctgacctcaggcttctctagcctgggagcaaaggagctatacaaacagttaggtgtggtgacggtaccagtcagtacagtgaaccgatcaaggggctctgaacaggagctgtctgttcaacacttgtagaactcactgggctaagaagcactgttgggagaggcaaaggggggtggcagaggtgcctgggaaacctgtgtcgggctgtgagtgttttctgggacctgatactcactgcaccgacctgctctcccaggacaaggagctccgtgctgtctttctgcggctctttgctcagctcctgcaaggctaccgctggtgcctgcacatcgtgcgcatccacccagagcccgtcatccgcttccataaggtaggctgtggggctggggctagagctgtctcgtgaggctgtgaggagctaacttcctggtgttctcccaggcagcattcttaggccagcgtggactggtggaggatgatttcctgatgaaagtattggagggcatggccttcgcgggctttgtatctgagcgtggggttccctaccgtgccacagacctgtttgatgaggtacagcctgcctttgcctacctacctgtccctcccccagcccacttaactgacctcatcaccctgcctcctttccccttagctggtggctcatgaggtagcacggatgcgagcagatgagagccatccccaccgtgtcctgcgtcatgtccaggaactggcagagcaactttataagaatgtatggtgggtgacatggagggcatgctaccactttggtcctggcccactagccaatgtctgcccatgttccctcaggaaaacccgtacccagctgtggcgatgcacaaagtgcagaggccaggagaggccagtcacctgcggcggacccaccggccattcccccggctagatgagggcacaattcagtggattgtggaccaggctgcggccaagatgcagggcgcacctccagctgtcaaggctgagcggaggagcactgtgccttcagggccccccatgagtatgtaacttgaaggggaaggcaggctggtttaagatgggtatggggccaggagttaaggtgaacatgtcctttctctttagcggccatactggagcgctgtagtgggcctcata

SEQ ID NO: 23566 - DNA, 1145 bp, Mus musculus
ggctgctggcctacggcactgtctactactttggcctggaggttgactggcaacagcacatcatcctctcgaaaaccagtaagtgccaacatggggacctaagggaaagggctggctcagtccctgatcacactctcctccctggcagccttcaccttccatcagttctcccagtggctgaagacggtaaccctgccaactgtgtggctagggacagcctccctggcctgggagttgcttgttgtcctctggaggtatgtatgtacccgaagaccgcgggcagaagccgctttcagatcaggtctgaccacacccgtccctctcgtccccaggtggatccaggtacaaggatggtcacggaagttctctgcgggtatccagctctccgtcctgggcacggcaacagtggccttgttcctgatcagcctagtaggtgaccctgtgaagactgggactgggggaagatggggcagcactgagctatcgcctatttgcctgcaggtaccttactcctatgtggaacctgggacccacgggcgtctctggactggggctcatcgcctgttcggttctgtggagcacctacagctggccaactcttacggccttttccgtcggatgactggcgtgggcgggcggccggaagtggtcctagagggcagctatgacggacagcattggacagtgagccctcccaaatgatacaggggtaaagggaccaagtccagccatcccagctaaccatgtgtccctctgtcaggagatcgaattcatgtacaaacctgggaatgtgagccgaccaccccctttcctgactcctcaccagccacgccttgattggcagatgtggttcgcagcccttggcccgcatacacacagcccctggttcaccggcctggtgctgcgcctcctgcagggcaaggagccaggtgagggctgggccgggctgggctgggccgggagaggggccaggaaggtaaagacaagttcaaatccatgttaccctctcctccccggccacagtgatccgactagtccagagccatgttgccaactacccctttcatgaacggccacccacctacctgcgggcccagcgctataagtactggttctcaaagcctggagatcagaggtaaggctgc

SEQ ID NO: 23567 - DNA, 2228 bp, Mus musculus
caacgcatcagggactgggaagataccatccagcccctgctccaggagcaggtgaggcgtgctattggggactagagcctcctcccaccagcccggggtttgcccagacctgtctctccacttgaagctaacatgtcctttccctctgcaggagcagcatgtgccctttgatatccatatctacggggaccagttggcttcacggttcccccagctcaatgaatggtgtcccttttcagagcttgtagcagggcagcctgcttttgaggtgtgccgctccatgctggcctccttgcaactggtaagtggcctgggacacaagggatggggcagcggccctggactctactgacaccttgtttccacaggctaatgactacacagtggagatcactcagcagccaggactggaggcagctgtggacacaatgtctctgagactgctcacacaccagcgagcccacacccgcttccagacctatgctgcaccatccatggcccagccttgagtggacagcactgaggcaggggtggaaagtagtatatacctggaggtctttgcccctaatgtgctatggggccattcactccagtgctgcctcctggctggcctagcctaataaagtgttgctaccccacctgttcaccggacagactatttaaatgagctgctggtacagagcacatgcacagattaagtacatccatttaatgacagggcctaggcaataggtatagttcagggcaagacactgtggaaggcagctatgtgccgacgtatactctctacgatctgctctgctgacctgctgcgaccatagtaatcggtgaaaagaccatcagggttgagcagatagatggcaatggagtggtccacaatgtagtcctggtcctcatccttaggcccagcgctgtagtatacgcggtagttgcgactagcatgggccacctgttctgtagaaccggtcagacctaacagtcttgggtggaattcttgcacatagcgggccatggctgccacgtcatctcgttctgggtccacagtgatgaagacaggctgcaccaggggcaggtcaggctccgcctctagcttccgcaccacctgcactagcttttccagctcatcggggcaaatatcagggcagtgagtaaaaccgaagtacatcagcacccactggcctcggaagtcggctttgcatcgaggctggcctttgtggtctagtaggctgaagtcaccctggcccacagcagcctggcgcagggcctctgtacgctgctgttggcgccactgttccttctcagccctcgcggccagccaggcccagcctagcccagccccaaacagggctgtgatcagcagtctagttcttagcccagggccttggcgctggccctgccctgcccagtgtcgggaatttctatgcagagtttcacctcctgagatcctgaggaggggtttgaactgagagagcttgggccaagctttgggccctagagccagtagcatcgtggacctgaagctcctggaaaagaacaaaggtggcaaaagtcagaaaagaatggacaagatgtctaggcctccgctgctggacaagcatctgccccacattcaagcaggttatctagctgcctgcaccggctcgtctcaactcagaactgctctgccgtaagctgcatgcagtccaggcaacaccaaaagtccatagctggtttgctctaacctacgtctttaaccagggagtctcagcctcatgaccccaacctctggagaacccacgccacaactgccaagcctccctgtggattcttggaagcaccgcgaatatgctttgcctgggcactgggatgcatgtgtctatttacaataaattgttctttatagggaggctgttgatcctctggctgaccacctttaagaggtgatcctttctagctttagggtcacttcagggtaatctggggctcagcagaaaacaagtgcctccagcttgttttctgtaatgtaacacagctcagcccactgtgccttgaactgtctgaccttcaccttcctgggcaggcagactcctctgcacttaactggatgccgtaccctgcccctctgcagtccctcagccctgccatctcccttcatcctcccccccccccctctccccagggaaggttgttacaactagcatttagagccactggcatccagcctactgggctcccccagtatgttgccc

SEQ ID NO: 23568 - DNA, 1109 bp, Mus musculus
tcctctgcccctccttatgtaaaaagctgacaccccccccatccccaggctccgcccacagtgacaccacttcagatcctgcctgtcatgctgccaaccgtctgacggctcatgagcccccactgctctacgacttatctcaggaccctggggagaactacaatgttttggaaagtatagagggggtctccccagaagccctccaggctttgaaacacatccaactcctcaaggcccagtacgatgcagccatgacctttggccccagccagatagccaagggcgaggaccctgccctacagatctgctgtcagccgagctgcactccccaccctgtctgctgccactgcccaggctcccagtcctgaggggactggagaaatcacgggggtccttcaagggtagcccaggacccctagccctgtcctgagtgtgtgatggttcaccagagggacagggacaagtgtgtagtttgtatctggtaatgtaataacaccagctgagacttgagacgtgctaattcatctagtccttgtggtaactctgaggtcagtactattctgctgtgctacaagacaaggacattgacgcatagggaatctcgtggacctttccaagtccgatgccaccttaccagaaagagcttgagctaggatttgaacccaggcaccctgggtttaaaatttgtcccaccctggtgatctgcgtgtgtccatggacacaccgctgaagcgaagacatgtcccttcacagaaaccggtaatgagttcaagtgccaggaactgggggtggggggagtggtgagggcagaggaaccctaaagatgcaaagcacctggaagacaggctttcctcaagaagcaatgccagaggccctggaactggtcagcttggttctttaaagaaatcagctgtctggagttaggtgataaactgatcattccgggtagagttaaaggacctggggaccctgctagatcccaggaaggaccatcagcagcttctgagactgcctcatggggctcacttgtctctcaagctctgaatttctcctttgtgcatacttcaagtaattttctacaaaaaaaaataataaaaataaataaaata

SEQ ID NO: 23569 - DNA, 1189 bp, Mus musculus
agccttctcccctcggagtccagcgtggattccagtgcctgctcggagagaggcagagaagccccctcgggaagagcggaagtcaccagaggacaagaagtccatgatcctcagcgtcttggacacgtccttgcaacggccagctggcctcattgttgtgcatgccaccagcaatgggcaggagcccagcaggctgggggctgaagaggagcgccccggtactccggagctggccccagcccccatgcaggcagcagctgtggcagagcccatgccaagcccccgggcccagccccctggcagcatcccagcagatcccgggccaggtcaaggcagctcagaggaggagccagagctggtattcgctgtgaacctgccacctgctcagctgtcctccagcgatgaggagaccagagaggagctggcccgcatagggctagtgccaccccctgaagagtttgccaatgggatcctgctgaccaccccgcccccagggccgggccccttgcccaccacggtacccagcccggcctcagggaagcccagcagcgagctgccccctgcccctgagtctgcagctgactctggagtagaggaggctgacactcgaagctccagtgacccccacctggagaccacaagcaccatttccacagtgtccagcatgtccaccctgagctcggagagtggggaactcacggacacccacacctcctttgccgatggacacacttttctactcgagaagccaccagtgcctcccaagcccaagctcaagtccccgctggggaaggggccggtgaccttcagggacccgctgctgaagcaatcctcggacagtgagctcatggcccagcagcaccatgctgcctctactgggttggcttctgctgctgggcccgcccgccctcgctacctcttccagagaaggtccaagctgtggggggaccccgtggagagtcgggggctccctgggcctgaagatgacaaaccaactgtgatcagtgagctcagctcccgtctgcagcagctgaataaagacacacgctccttgggggaggaaccagttggtggcctgggcagcctgctggaccctgctaagaagtcacccattgcagcagctcggtgagcagggtgatgtggggaggggcctgtccccctgtcttctattccttttgttcattacagg

SEQ ID NO: 23570 - DNA, 2190 bp, Mus musculus
aactttttttttccgtgttgtggcacctcctagggcccttcaacacagaatcctggatttgcgttataaagcttcatcaagaagagctggaaatcacaccgtctctctcacctactttttccttcttgtcatgtttgccccatccccacgcccgcggtgatggagaagtgggaggtgacggaggaggtctgggtgctactaaggttgttagactttgtaggcagaaggtggcagagccttgggttggtccctcaagccctttcttggcaaccttccccagggctcccatgtggactgcatgggtgctggagagagccgaccagtttgtggccagcctcctgtctgtgtttctctagctgcttctgcctctgccccagggctctcttattactgggtttgagcggggtacctaccacccccaattccccactccttggttcctagacactgttcactgtcagttgtggaagacagagttcactgagtagtgagcagtgcacagcttaaggaagggcttcaggtcttactcagagggcctgctcattttacagtcttccagtttagggtctagtagatgaacaggagcttgggaagctcacattgctctctgagaggttcagggacaggggcattcctgtccttctcacgacccgttcttagactttctccctttttggcctcttccatctcttaagtctgaatgcccttttttgtactgcagtgatgaaggcacccttagaatgggcagtggctgtgagccagtcaggacacgtggctgggtcccaggtttgtctacagaactgggttttcaactttactcggaccattttcttccttgtcttttcttccactatcagcccctctgtttctctctgcctctttttttttgatgaatgttagaagtcacttaaagtacataacatactgcctaccctcagtaatcacatattaagccaatgaacagaggaggcttggtgcaagtgctttgtcctaaggcaaagttcatggaagcacagatgggcaaagatctcttgggcatctagtagcaccttttggtaacactccatctgtgctcagtgatttcagggtggtttgcagaggtagacctttgctgtgtagcacacttatgcatatcttttgtatatgagtgatacattttatcatgttcatcagtcattttaacttcactgaagcaccttgcaccctgctcttccatttgcctctgtattccattctgttcccactcacttttcttccccattttggatctttctttctttctttctttctttctttctttctttctttcttttttttttttttggttttggaggcagggtcttgctatgcagtctgaactggctttgatcctcctacctgtccccacagtgtgagctgtcacatcctcgcacctggatgaaacaatggccatctggagtgtgtcctgccacctaccacagtgctttcctttctggctgcaggcttggagcacttgtggctctgtacacagctagcttatttcagacctggtcttttgtctggtctttgtggacacccttactttgatgtctgtgggggctgtgcctcagctctggctttgtagccagtgggggctggaatctggcatttgggtcttactttggcatacagatcactaatgagcctttcccttagagaagtgtccaaagcgtgtgaagttctgatgtctaggtgtgactgtgtccttctcaggacctgtcctgctttggcagagcacacacccttgagccacatctttggtctgtgcatggttcccgagccttacctaccaggctcatctcatctcctcttgatggagtccaccaaggacatgaccctcttcattcatcatctctgaagatgcctcaggccaggcagcgatgccttctagccacaggtgctctgcagcctgagctttttgtagacaagttaaacttgcccgtgtttcacaggaaaagctcagtaacttggagatcaactcgtttgcacagggcccaatgttgggttttaggttgaggctggaaggtacattgttgttggtgctactgctgaggtctgtgatcccacctgtctctcacttcagcttgcaggtctcgcccctgctgatcagatccctgtctactgagagccctgggctgcatcttacttgttcatcacttagagcccgacctt

SEQ ID NO: 23571 - DNA, 1064 bp, Mus musculus
agctgtggctacttgtcctagcttaggccttttggaccccagagcctccccactgcactgtcttatggctgtcttgtcccctccggttcagcagtagactgctgaaacctaacctttggggcaggtcttgcttagacatttgttcagtgatacagatgcccatgctcgggtcagcatggattcaggggggaaagcagcgaaggtgacattgcctggccttgttgggctctgtaggtggccagagtctgacctcacaactgtgcttccagcactgcctccccgaggacctcaccgcctcacctctgctgcccactgcactttgccccaaagccaggatggctccccgaggccaggttccatgggactgaaagtttcttccggaggctttgtctgcctgttcccttgtatagccctcagatgttcctggaatctttgtgttggtggcactggtttggcttatccgagcagctctgccctgggtctgagcagttgggaggaagccgtagggatggatggctgaggagaaagctgctgcgagtgatcgaaatgaggtctctagggaaggactgatcttgcacggtgcaggggaaaagttgaaagttgcttcagggagcatgcttgctagcttgctcttctcagtgatggatttcatcacctcacagcaacagcttgaggaagaaggatgtactgtggttcctagtttcagagatttcggtctccgtggtggcttggcccccattgctgttgagctagtcacaatagggaaggctcagtgaatcatttcctggcagccaggaagcaagaagggaaaagagggggcaggaataagaccatcaagtcatgaagtcattgatgtttgttgtgatcattattttggggggtggggcgttagggacaaagtctcaacatgtaaccttggctggcctggagcttgctttgtagaccaggctggccttgaactcagagatctgcctgcctctgcctcctgagtgctgggattagaggtgtgcgccaccgccacacccgaccccagtcagtgtattcattcatagattagggcagcc

SEQ ID NO: 23572 - DNA, 1214 bp, Mus musculus
ctgaaggcattgtgggcctggcctgctaacactctctctcattgctctctcctgcccatctatctgcatgtggctgctctgtctagctgcgcggtggtcccgagtgccggctgtgtaagtgagcatgcccatcccatgcctctcgcagtccacatgctgtgcctggctgcgccccctggctgctctgcatggctgtgtggggctctggtgctactgacagctactgaggcaatccttggacacagtgaggggtcgagatgggggattgggtgggggtgctatgggagtaggcttccggtagagcagccgcgcttccggtagagcagccgcctcgggctggccttccctccagccaggcaggctggggcagggctggaagtccaggatcctggcaggtgaggctgggaagcgaggtaccatctctctgccttgtgtgtctgcctgtgtgctactgcgttcctgtgagcaccgctgcatgtccacagcacatgtagtctccattgctgctgtggtgtgctctcctgtgcagggagactctcttcctgttaccgtgttctgttgccttgcacctcctgtgggtgtgagccccgcctggtgtttgtcttccgtgttcatggacctgtcacgtcttgtgccactgccagcctttaccatgactccgccgtgcccgaaactggcctgggttgctctgggtctcttcagacttgagagcagtatgcggggagtggtgaagatattgttcaaattttatagtccagagcatctgtggatggaacccacgcccagaggctgtgttagaggctggcagggtggggcaagcagcttccgtccatgagaaaagtttcctttggtgaactgcccttggggcctccatggagcgcagtgtgtggggacagtcttactccttagaatccagtcagtttgagaatcccccagagcaaggcactggtcctgacctgacccaggatgtttgtgttttcaaaaagaatgaccacaggatattcctccagccctagacctcttggctctgctgccctctctgtccactccgactttattttccatccctcacctggccctcacccactctccctccgcaggctcttcagcagcctcggtgagctgagcaccatctcagcgcagcgcagcccggggggcccgggcggaggggcctcctactcggtgcggcccagcggccggtaccccgtggcgag

SEQ ID NO: 23573 - DNA, 2409 bp, Mus musculus
tctaagcattacacatacctatatttgtctattggtttgaagggagaagaaagtgggtcgaagcccaaatggttatatttagaagatacctcagataataaccattgctttgcatacagttttatttaccagtgccatgtcaatatcagataagttcttacatgaaacatctagtcttttagatatctgaaagtgcttgatacatttaaaggtacaggtaatagaataatattttttgtatatagtttttttaaactggagaaatgctgtgtgtagaagtagaattgttaacccgcctctgagaacagtgtaccggctgtgcttgttcagtggatcaaggaggtgggagggaaggaactgcaaaaagattccatttgtgtgctagacatttctagcttacccatccccctgtgtgttgtgtgcatctcatgtaactttgctatgctgtatatattgtacatactggacaaacgagtcctatgatatctagtctctaggtattaaagaggttgccaatgtatgacaaaagtagttagtaaactcacacattctgtatactctgttagttcatagcaaggttgtcttctgaagagttgtgaaagtgtatcatccaagtgacgggtgcctatgtcacgggacacaagatgggctgaaggggaagaaaggtcggagaccagaatgtcctcaccagaagacacttggagatctaactagttacatgtgcgtggtttcagtactactatgtatataggggacaaattcatgtcctcatctgaaacatctagtccttctaggtgtttagaagtgcacaaagtatgttaaaagtagacatagtaaataatacgtgttgtagattctgtttaaactcatggtgaagtgttgtcttttggaactagaaagagaaactgcttctgagcaatgcagccttgcttgtgcaggtctaggagggaggaagaaagaaaatgaatgaagagcctaatgctgatgcaagtttggtaatacaaggtgtcttagtcagggtttctattcctgcacaaacatcatgaccaagaagcagttggggaggaaagggtttattcagcttacacttccatactgctgttcatcaccaaggaagtcaggactggaactcaagcaggtcaggaagcaggagctgatgcagaggccatggagggatgttctttactggcttgcctcccctggcttgctcagcctgctctcttatagaaccaaaactaccagcccagagatggcaccacccacaaggggcctttcccccttgatcactaattgagaaaatgccttacagttggatctcatggaggcatttcctcaaccgaagctcctttctctgtgataactccagctgtgtcaagttgacacaaaactagccagtacacaaggttatccattgttgcttatatctgtgcatcttactttgcaatgtatagaaaacataggtccaaatttgcagcacccagtcttcctagactgtaaaggtgccagtgtgtgacaaagtagagttagtgaaaagacatatttatagattatgttaaaatttgtaggaaaaaaccttaaaaccacttaggaagtgttaatattccacaaaaacatgacagatgtatacacatgtcccctgggggggagagaactggaagaggggctggaccagaaccttgctgtttagaaggcagtctgagatggcatggtgtattcttggttatcaaaatccctgtgtagtgtggggtttttaattggtgaatattcacaatgtggggaaagcatggtacatactgtataatctcaattacccaagtgtgcgtacgcttgcaggatctagaacaacacatcgagctgagctgcttgtgactgggtgactttgttcttgctttcttgtttcctgtaatgcatatactaaaaaaaaataaacaaaagcttctttaaagaaaaaaaaaaagaaaagaaaagtaagaatgaccatggaaaatggttctaaatatttatttggaacaattaatgtgaaaaatttttaaatgtgagtttttaaatttaaaatatttcagtccgtatctaatgacaagacatagaaaactcataccattctgatcaaaatgtaatctatcactccatgcttgtactgttttctgagtcttcgccgactgctaaatttatcacggccacttaggtggaccattctctgaggcactccaacagctgcactctctgcattgctctcttttttcttcagtttgaaatagttaagagagatttagaccctgaaacttctagcagtctggatgacctctgaaaatgtaattaataaaagcctctcaactcattatttcttcttcttcttctttttcttcttcttcttcttcttcttcttcttcttcttcttcttcttcttct

SEQ ID NO: 23574 - DNA, 2772 bp, Mus musculus
aataggcattacacattttatgtgtggaaaagagtatttcagagacatgaagttgtcaaatatttattagttccagcctacatttttgctggttgggctatagctgactctttaaaggctaagtcaattttctggaatttaatgttttttgtatgcttggttgcttctacagttcctcagaaactactagaattccgttacttcattctaccatacattatttataggcttaacatacctctgccacccatatctagactcgtttgtgaactgggttgctatacagttgttaattttgtaactttttatatctttctgaacaagacttttcagtggccaaatagtcaggacatccaaaggtttatgtggtagtggtaggaataatttgaactttaaaagactgtttctacaacaagtaactgggtaaatagaagtggaatttcttttgagtaaatccagggaagtgagtagaattaagtttgagactagcctaaaagctctgaatagtaggaataaagttgcttgcagttgtcgtgagagtcttttcagcgtttggggaacttttctgtgtgtgtatagatttagggggctgggtaagctgtgcagggcttgaacttactcaccaactctcttttgtaaagaacagcaagtaagttgaaaaccacttacaaataaatgacccagcagtatttctgagtgaaattgccagatattgtcgtacccacagctccgatcttagaatagatgcacatatgtaacaaatagtgcattggaggctttgggctaagagacaggtgttttaatttagggcatagaagtgatgatagcatttgaactaattccttatttgcagtttatgcaggccaaagataaactgtgttgattataatactttttatggattatcttctgaaacaatgccctgttagttatccaggctcctacacaaaaccagccacaaaccttctggcttcagggtttctcctcacatttgtataagggcacctaaactcaagtgttggcaacgctcacaggagctgagagtccattgtccctgtttgccccactccagcactgcttagaggggccttgcttttggacaggtccctccagtctgtctgtgtctcataggactgtctccactggcttcttgtgcagttaatgccattgggtttagggatcctctgattcagggtagcgttatctagagacccttgatattatctagaaaatgtttaaagtaaggccccattcataggtctcacatcattttggtgtggagtgggagggggagggggtgtatgtgataagatgcccttgatgagagcttttaagtaaaagtttgtttttaattgagaaacaacaaaaaagccaaatggccaaggtcatgtaatttacagttgtccctattattcaaaaccagaagaactcaaaaggtgagagaagtcattggtttagtttcattttataatttagtgagcagtactaggtgtgactctggggtttgctttgtttcgctttcagttctgtgctactgttataaactatgtttctgctttaaattttaaaaagaattatcaagtatttttttattaggcgtaattgactttgttggctagttagtgctcctaaggggcttagtggttaaaggcttgggccaccccttgcagggacccccgggggggttcctggctcctagggcagcacaaccacttacacatccacctctagggcacagagtgccgcctctggctctgcagtctcccgtgctcacctgcataaaacctccacccatgcgcatttaagttagaaatgctaacaggtcattgtagaccatatcacccgctgaaggggttgtgggctctgcattctccaccacgcttccagtaggatcttttaaagccttcgtgagaacgcccgtcttttgcctgagctgctctgcgctcagtactcagtttcagcagctctactttatgtgaacatccacaggcctagcctcctctcccagatctgactttgtgtgcagtgcagtgcgtttgcttacatttgtgctttctgtggatctgtgctttccccttatggctgcatctccccaaatgatgtggaagtagtggtttatatttacacttagtaccttatcttggaagaggaatttctggtttcatagacatctctgtttgtcctgttacaagatgcccactataagcaatgccgcttacttctagggaatggtttagggtacgatgtttccagtgtggactggactgactgggcgttatgatcatcacctttgtctagagacgacagaagggattcacagctttcatttataattcctagagactgaacatatcttttaggtccagttcaaactgtattcagataaaatcatgtttattgtcttagagcaattagaaagtcttaatgtacataatatttttcatagaggaaattaaataagatgtagaaaaaaatgtccttgatttttggctccagaataaaaagacaaattgttgaaggacggttgtttgttcctaatctcaaatgagaatgttaggtctgaactccagttagtacctggtgtgactcctactgtgtttcaacagggattcatgctgtactccacatccatgaagcccataaacatgctatgtgatgtatattgagtaaactggtattgaatggcgttttcaatatagaaggaagcagatattctagaaaagtaccttataaccaacttaatcttaggaagtaaattgtgttttataataa

SEQ ID NO: 23575 - DNA, 1847 bp, Mus musculus
aagttcttacagtcacttgaaagcattgttcgttatccattgctttaaatgtagatcagaggtcagcaaatagtttttaactcacaaaaatacaccttttctttttaattatgtagtcttttcaggagaataacccccccccccccaaataagttttttatttactgaaaatatttcatcgggaaagcttcagtgacttgagagagagtagatagaacatagtgtcttttcagggggtttcgcaacctgccaatttaaatgtggatttactgcagctaatctttatattctttggtaagtcaagttcagaaatctcttgaagtattctgcctttcatatattttgtttctgaaataaagtggacattttgctgttgttatcctgtttttgaaattgagttatacaaccaaaccaaaggtggtataaaatttcagtgtactggcaatgcagtagtatttatcttacatacatttgtagttctttgtcaatacaaaaacgtctttgggtttcccctgtagtgatgaacaggaaagtagtgtgtaataaaacttgtaatgaaatgtatactaggtgatgacagtgtgctacgctttaatgtattcctgtaatgtaactttttctactagtctagagtaaactttttatagttttgtattgttttgaaccacaaagatttataattcgcctgtgttaattattgttcgttgttcacgaaggggctcatgatccaggctagcctggcattcgcaatgtagccaagagtgaccctgaactcctgattcctttttgcctctccctctggactgctgcagcacgcctcctttgtgtggctagggatcacacttaggacctaaagctgctaggcaagcactctgccagctgggccgcatcctcggccctgcttgttgtactgtgaccggaaatgtttcctgggttacatgaagtgaagggaaatacgcaaccacaagtcatttgttcacgattgtgtctcagatgacgtgacctagcataccctgccgtggaactgttgtttaacctcacggatttggggtttgtttctgatagtggtaaaaggtttgaaagcaacctgtaccatctacatgtctcactgtttctcagttctcggtgataactaccacacacggagaaactgaggagagagagtgtgcgtttgtctaatattagagactaagcagaaaaaggttatttttctaatgttacaaagtagctatgtgagctcgggtttatgactaggcatcctgacaagaacctgagctcttagctgctgctgattgaccggtgggaaaggacactaaatctaccttcatttctgtaacattttagaaaaatggaaaatagaactccactattcttctaggtcagacagttgaggcacatacaaactatctcttccagagcagacaatctttcatctcccatgtgtcatcactgcctcagattgtgagaacacaaaaaatctacatcgcaggctgaagttgacagccctatttacgaggaagcaaagatctttgatatccaatagagatgtagttgcttacaacttaatttctcaaaagaactttggtaataaatggttgttttaaactgatctgtgatttttaaatctttcttgaaagaacttgatctttattttaaatatgtgaagatatgttttaaatgttttttaaggttttgcattttgttacattaaaaactgcagatgtttgactctgaaattgtgattcatgtcatttaaactcttgaatgaacctatttataagaataaaagcttttaaaataattgttgaatatattttattggtaaattaattcatattttgtaatat

SEQ ID NO: 23576 - DNA, 1236 bp, Mus musculus
cttccatatgcaggagtttacaatgtgcaggcctaggaagaaggtgggttgtggtctaagaaggaagtagagtaaatacttagaataacagctgagttactcccatatacaggaatctacaatggcctagggagaaggtggattataaaatagattaaaattggaactatgggcctccccgtgacccggaagttgtacggctacgcgactttccctcccacaaaccctcgcgcccttcctttcctacttgggcccggcagaatggctcccgcaaagaagggtggcgagaagaagaagggccgttctgccatcaacgaggtggtgacccgagaatacaccatcaacattcacaagcgcatccatggagtgggcttcaagaagcgtgctcctcgggcactcaaagaaattcggaagtttgccatgaaggaaatggggacaccagatgtgcgcattgacaccaggctcaataaagccgtctgggccaagggaataaggaacgttccatatcgcatccgagtacgcttgtccagaaaacgtaatgaggatgaggattccccaaacaagctctacacgctggtaacttacgtgcctgttaccacattcaaaaatctacagacggtcaacgtggatgagaactaacctgctcgtgtcaaataaagttgcagaactgccaaaaaaaaaaaaaaaaaaaaaaaaaattggaactatggcaagggaataaagcccttgaccctggcttctaagaataagctgaccttaggtagggctgatttttattccagttgtaaacactgatttttatcccagttgtaaacactgcctggttcttgttagcttttatgtaatgcatttctctgttttgtgtaaagagtccttatgtatcagatgaccttaatgtatcacctaacttctttgttttcttctgtaatataattctgatgctcgctttgagaaatcacattcagatccaacactctctcttgtgttcctgtctgtttgtcacttgctgactcctgagtaccgggaccctgatttctactgcgggctgagggcccgactgagtccagcccacggcactttactttgcattttatttatatttattttattctgtggtgtgaacgttttgcctgcatatatatgtgtgtgtgtgcctggtgttcactggaggccagaagcagtcatcagatcagaatgtacatagtaggcttataatgggaacttattctcaaatgt

SEQ ID NO: 23577 - DNA, 1099 bp, Mus musculus
ctggggcatctggttggtcttaagtccttagctgagggcaccctgtttctcctgtctcctggcctgaatctttagtatctgggaggcttctgtgtgctcctcctacacccgttatagtcactgagagtacagtgccagcgactcacttctgcagctgttgctcagtctgcctgccccaaggcctttccagccgaggtcaccaagtcagagctggtgattgcacaacacacccgctgcctgtcgatttcagtatcttgtgctcttccatactgagttttgacaagctagtcactccccttttctttaaaaccccatttctttttgtgaggtgtgctggactatgttagctttggtcccttcgaggtttctgtgtatcttgctacctttctggctgcttgaggtcttggacctccagttgttctctaattatctcatccactgtctttctaaaatattacaatcttttttttttaaagaagatttatttatcatgtatacagtgttctgcctacatgtatgtctgcaggctagaagagggcatcagatctcattacagatggtcatgatccaccatgtggttgttgggaattgaactcaggacctctggaagagcaaccagtgctcttaacctctgagccctctttccagctcttaaaatacaaaattcttgaagctggctctatggtgtcccccaacaacacagttgtatattagatatagaacaatgatgttacatttattcttctcttacagattgcatccctactgtagattcccctctctccactcctcccagtccctcctcccaattacccctcccacatatcactcttcctctgtttcccttcagaaaagcctaactacccacccccggatatcaactaaacgtggcataacaagttacaataagcctaggcacaaaccctcatatcaggactggataaagcgatccagtaggaggtaggttccaagaccaagcaaaagaatcagagaccgccgttcccactgctaggagtcccacaagaataccaagctatacaatcatagcatatatgctcagatccatactggctctgtgattcacttcagtccctgtgag

SEQ ID NO: 23578 - DNA, 1209 bp, Mus musculus
ctggatatggtctctacagtttctccctcccctttgttgggcatttcaactaatctcatccttgttaggtcctgggagcctcttgctttcctggcatctgggacttgctggtggctacctctagttccccatcccccattgccacacacctctgttcaaattcctgaccctctgtatatcatccctgtctcctcccatacctgattctgccccctctttttctccctccccttcctctcttcctcccaagtccttcctaccctctatctcctgtattttgttcccccttctaaggactgaagcacccacattttggtcttcttgagcatcatatggcctatgaattggtattcaaattgtccaaattctcttgggtattccaagcttttgggctaatgtccacttatcagtgagtgcataccatgtgtgttcttttgtgactgggctacatcactcagagtgatattttctagttccatccatttgcttaagaatttcatgaattcggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccttccccgaatagaggaggaccggtcttcggtcaagggtatacgagtagctgcgctcccctgctagaacctccaaacaagctctcaagaatttcatgaattcatcatttttaatagctgagtaataccccattgtgtagatgtaccacattttctgtatccattcctctgtggaaggacatctgggttctttccagctcctggctattataaataaggctactatgaacatagtggaacatatgtccttattacatattggagcatcttctgggtatatgcccaggagggtatagttgggtcctcaggtaatactatgtccaattctctgaggaactaacagatttccagaagggttgtaccagcttgcaatcccaccagcaatggaagagtgttcctctttctccacatcctcgccagcatctgctgtcacctgagttttggatcttagccacactgactggtttgaggtgaaatctcagggttgttttgatttgcacttccctgatgactaaggatgttgaacatttctttaggtgcttcttggccat

SEQ ID NO: 23579 - DNA, 2537 bp, Mus musculus
atgaaggaacagtatcggttgtgatggtcctgtatcctctgggaatattcggaagacgggatcagtacagttgttccagcttctgtagttcaccagagacagactgagaaggtctaaaataccatcaaaaggatctgcgcccaggggaggaattgttaactagctcagtactcagacaggttgagggagcagcagccagggttccttggcagaacgccatcgtaaaggcagcccctgtggacggtgtgcagtgtagctcgttaggggggaccgtgagggggaaccttatccgttggctgacgtgatatgagagaacttgccaaagtcagctgtcctgcatctcctacacctaggaaggagtctttaagacaatttttaaatgaagagattaaaaacttacatcaaagtagagtagggctatacctcaatattcagagtgcttgctttatgtggtcagggcccggcagtacagaaaataatggaagatgagaagaggtaagagcctcgtgcagcggctctcactggtcagtctgtcacccgtcagggtcttgctacatttacttcatttattcctttcttatgttaaagtctccggcaggcatcgttctgtgtccctgcagtgagtgctttggtacttacaagtgactagagcaactatatcatccccagcaagagcagcagctggcctttggttccagctcctccccagtccttaacccatttccctgcgtgtcttagctacgcatgggacatggtgattctgctttaaatgagttcctcagaaggatccgatatcagctagtttaggaagcatggaaattattacgctatctttaaggtggaagttaggatgtcacagttattggcacaattgctaaattgtaagtgctgttttggatagaggaagcagtggggtttttgacagagggattcatatgagtaagtcccttcagatgccattttctcagtagctgaagactcagccccacgtgttccactgtgattgactgaggctgtttaaagaaaggatttgaaaatgcaccaaacttcatttgtatgaaaagagtttggaaaaactctagaaagtgttttaagaaaatgcagttttccttcatgaagacgtgctcatgacctacgccacgcctgtcagtgtaatgaggagaacagatggggactggcatggactcccctctttgtgggcttgggaggtgtgctgactgcagtgccaaagaggtgaggcctggaaggggtgactggaggaacgcgtggagctcctcagccatgccagtgttgatggagcccggttttaccgcacacgggctcccccgaggctgggagcattctggtttctccggtgtagatttgttgatggtatgtgggaggaacagatgccaaggaagaggaagtagagaagaaaaggaagatggaaatgagtagtcaaggaagagggaaagagagagagggttaagagaatggcggaaggcagagtgagaggaagatggaaggatagtggggagacaggtgcacgtggaggaaactgcggaaacatggggtcccctgcctaggtcagtgctcgctgtgcactgccagaaccagccttgtatgagccatcgatgctaggcatgtttcttggtcaccttgttcactggtcctttagtggtagttgtcttttttttttctttccctgtggaaacacatattttccattttaatgtcctttagaggaggtctgtgaagggaactgcattgaaatgtctaaatcgcccactggttttccctagcatgataatgagaggccagtctggccatttgtttgtttgtctgtttgttgtttttaagtctaaaagatatttccagcttttatatgaatatctcctctcagggagtactgaaatgttataaaataatccttagcttgtggcgtgacctggaatggtggctgggacaagggttacgtctgctttttcctcagcggggatactttcagctgaaccgttttcagtggactcaagaggacgggagacggtagacatagtaaaagaaaaaccttaaagaatcgtcactgtcagacagagtggcgcagtcattaccagcacttggtgccagcacccacatggtggtccacagctctctgtaactccagtgccaagggatccaacacactcttctaacctctgtggacaccagacacaggtggtgcacataactccacacaggcaacacatatatataacctaaaagcagtaaaaaatactcagtgccctcttcagttgcttgtagtaaatagcacaagcacagccaacctctttgagatgtttttagaaagatggttgagctgtcttttcaaaaatgtttttggttttttggaataaagaagaaaaatagagtgtgcaatatgtcaaatgtggggccagttatccatttattaagtataatttcaagtgtcttaaagtaataatcgccttactgcattttaatattcaatggaggtagaccaaggtgactggttttacagtagtcatctttttctacattgc

SEQ ID NO: 23580 - DNA, 1205 bp, Mus musculus
cctgcttctttcgctacacttgtccacagctcagagccgggcaatctgtaaagaggaaccagcatccatctcaaggctcggcgtgaaggccgggagagcgccagcgctcagctccgcttccgggtgcgctgcggaggcggagccttggccgggcgttggggcgtggcccggaggcgggacaataccaggcaggggctgtggtttgaaacagaggcggggcctgcgccggatgtgggaggggctgtgagcggggcggggcatggcagggctaggggcgtgtcgtgtggggtgctgggcttgggcggcatgggaccgagtgggacctggcggggattcgggcggaggggcggagcggggaggggcgggaaccaggctggtcacgctgcggctgcgcgttgcgattcttcgtagttcgcccgggcgggcgcggcggcggcggcggtgacggcggtgacggcggcagcggcggtggcggcagcgcgggccgggatgcggcgctacctgcgggtcgtagggctgtgcctggcctgcggcttctgctcgctgctgtacgccttcagccagctcgcggtgtccttggaggaaggagctgccgggggccgcaggccgcaggccgcggtagtttcctggctggcggacggtggacgcggcacggggagaggcgcgggcagcgcgggcccgggccggacgggcaggtatgagccgcattgccgggagtggaggtctgggagggccggacgcgccgctccatcaccgagcactggctggctggcttcagattcagtgttagaccagttagaaattgaatcgctttgcaactttctgaaaggttcgttggaagtaagtggtgtcccacaaaatcctaattacactgcggctagtgggattccctcctgtttccatggagtcgaagctgagtaatttgagaatcaggctggcgccctagttgagccctccacctcccaggtgtctaaattttccgcctaaatcttagctttttatcagtagccgtagctaaagaaatctggatgtggcataaagcgagctgtgaatttttattttgaaaatattcgtttttttggaaacgtaaaggaagttcagaaacatgagtgatacttaatatgcttatatctatgggaggagtaaggtatgaagaaatcactttaaaaaaaaagaaatgaatatttataacacagcataatgag

SEQ ID NO: 23581 - DNA, 1182 bp, Mus musculus
acatagttaggcctttcttatacattaaatttaccttagggatggaaaaacgctcttccagaggccccgggcatgactccttgttccggcctgattgtgtgcagagggagtgtggggtgggaggcaacaagctcacacgtggagcacagatatacatgcagataaataacactggtacataatacaaaaaaatgcatattttaaaaaagatttaccttagtgaatgtcaaacaaaattaaagataaaaagtaataatcagtgtaatgtttgctgtatcctaatacagttctcattgtattatttattcctatttatcatggtttttacactggcccttgttgggttcttgaagttctatgtaaatgaaattgttagtgacgggtgtgcccttcatgtgtgaattgctacttacaggaattctgggttgggtcttatgtttctgttgttattgttttatttatttatttatttatttatttatttatttatttattatatgtaaatacactgtagctgtcttcagacactccagaagagggaatcagatctcattacagatggttgtgagccaccatgtggttgctgggatttgaactccggacctttggaagagcagtcgggtgctcttacccactgagccatctcaccagcccctgttgttattgttattttgaaacgttctctcctggtgtagctctgttcctctggcttttgcagttctccgggctcagccttaggttaaagggcctggcactttctcagttgtttctgcaggagtgaaagggggtatggttgctctcaatgcacagtgcttcctgctgttagaggcctttaagaacactaacgaagacatctcttcatttcccataggcgttagacaaacccagcaggctaactgagaaggaacttgctgaggctgaaagcaagtgggctaatgaaacactagagaagtcagacgaaagtaacttggctgaaatgaatgagtttgaggtatgctttaatttcccctctgtgtttcacacctgaatgttttgtctgggttttaaactgatggaagtcgtacgtggtaccacacacctgtgatcccatgctgtaggagatgcagtgcaggcagaggtcatcatcagatggtcagggtcctcatcagagcgtctttgaggccagcctgctgttcatgggtt

SEQ ID NO: 23582 - DNA, 1132 bp, Mus musculus
cagacagtgactgccatgtgagtggttggaactatccttaacctcgggagtacttggtattcttagctgctgagccatctctccaaccactaatgtagtagggctttaaaacctatatctttatggttttctgaatttcataggcatctgttttgcttccttttcatttttaattttactaatttgggttttccttcctttctcttgtttaatctggcaaagcatttgtcactttttaattttttttcatagaaccagctctttattcttttagtttgtgtctcacaacaaattgagaaaagtagcagtcatgtcctctggccttcctcatacacgctcattatgtatcatggcagtatacattttcttaaaattgattaaatagcatttccttttaatataatcttctcttagtgaccgtatacacagtcccaaatgctctatgtccttcaagaaaataaccgaggacttcctctgttttcaaggcgggatccacggcacccttatttattgaccagacagaagaacccgagtcaaacacagtagatggtacagaactgtatgaagacagccagctcagcaaccgctctaaagccattgcctcgaaaaccaaagagattgagcaggtgagaatgtcgtcctccacaggcacggccgctctgttctgtgacgtgaatgtttgcactgaataaatagagtgattgtcttttccacttgaaactccagaattccactgaatgtgtgtagaggccagaggacagcctcaggtgttccgcgtgtctcttcttttctgagacagggttctgtttagttcagaaccaatgaagtggctacccaggaagacccagagtacactggtctctgtctctgggtctttcggttcctttgtgtttcctgttggggtctcatattgtagccttggctaatatggaactaaagccaccttcagactcactgcagtcttgctgcctcagtttccccaatgctaggtttttcgtttgagccaccgtgtcagcatttttttttccctgtaaattcacttcatgtggtggcctccttgtgtttctttactgtaagagagacttcccaagggcaggacttgtgctgcctagtggtttgtctctaccacctc

SEQ ID NO: 23583 - DNA, 1196 bp, Mus musculus
gtcacaaccagtcaactcatccaacaaacatctgtaaggacgccgcgcatctgtctgagggaagcactttgcctacaaatatttaaacaaagccgccaaacaaaaaaatcacgcacgcacagatgtgtacgctacatccatgtatatataaacacacatgtacatgcgttgtgtgttctttaataaatatacttttatttcaaaatatgcaaactttatcactagcaattagatacttactgcccactaattgtgtatttcctctacactaaatgtgtgtgtgtgtgtgtgtctatacacactgggtgttgatggatctgaacacacagaggatggcagtcagaggacagctctgtggaactggttctcttcttccgccttacatgggctcacagaactgaattcaggatgtcaaatgtgtaataggatttgactgcttaaaaacagtgatttaggggctggagagatggctcagcagttaagagcactgactgctcttccaaaggtcctgagttcaattcccagcaaccacatggtggctcacaaccatctgtaacaggatctggcgccctcttctggagtgtctgaagacagctacagtgtacttacacataataaataaatcttaaaaaaaaaaaaacagcgatttaaggactcaataaatttatgttgctaaattttactaaactcattatcatgatcttgaaattaattaacaaagggaggtgtgatggtgtgagttacaaaacctgatgcaggagaaccatgcctcagttttaggccaacctgaactatagaacaggttcaaatccagcctgagacccagagcacacagggagggagggagggagggagggagggagggagggaggggagggaggaagggagggaggctgactgaccagttccaagaaaattaaaacattttacaaaatgatatgacacaaagtacaatatataaaacccatatctgtgatccggtaaggagctgcctgccaagcctgagggcctgagtttgagctcatatggtaggagagaaacaactgctctggattccacacaagcatgtatgcatggatacatacatatcacactcacacacacacacagttatgaaattggcttgttagcaataaaatacacacacacacacacacacacacacacacacacacttttataatgatcacatctat

SEQ ID NO: 23584 - DNA, 1265 bp, Mus musculus
ggatatccctaaaccacatacagattatacttaagtagaaatagaagaatggttaattttaatgagccctaaaatagatgtgtgaagatttgtattatgccattttgaaaatttaaaactaattgacgacatgttttttgttttgtttgttttcttaaattccccaagtgagaacacttgtacgttttggcattgagtctttccatcccttttctgcgcacactccccttctgagcgtgtgctgcgcaatgccggtcacttcagtaataccacaagcgattttccttcttcccttccactaattctcagctctttaaatcaagttattaacaagcatacgtataaaatttgaggagcttccaaggcaaaaaaaaaaaatgttcacttggtagaaacattcatttaaaaagagaatcttactgataaattatttaagtgaaggcccagccagtcatcctcttccttccactcacactgggccttcgaagctgtgtccagcttgccgtccgcgctgttctgccaggctccacagtgttaaatgtttccttcatctttgtttttttttaaatgccttttgacatctaaaattcatgtgtactagagtatgttttataaaatgtttttgattctacggagacatgtttgtaagttatccattgtttttcaatagacctgattcatatgataagttctcattgcctcaccataaggccttgatgatcaatatggggaaagcagatactgtaaatgcaaaataaagcatccgatactaagtaataaattcgtctcctctcgtttttcctggttcctgtgactgaagtgtaagcgttttcatctgtgcctgcacgatgactctagcagtcagctcaccactcgacagccaggtagaagtcggaggatcgaggcgctgttaacttggacggtttctggaattttgatgttacagaagccagtcctcatagtgcctggcccagtgacactaagtaattacagagctgaacttacgaggctgaatgtcttcttcctgagctgtcatcactcctgcacagcagtaaccgggctctctgtaccagtctggttcacagcttggcatgctataggtattggtgcttgtcagcctaaagctgacttcaccttcaagtgaaacttgagaaataggattcattcagactgagaggtgtgaggagctcagaaggaaaggttggtatgtccctttgtggccaaagtcagttttcactgctgtgataggatttctctttttaatc

SEQ ID NO: 23585 - DNA, 1226 bp, Mus musculus
ccagaataccagagtggaagctccccgtgtaacatacaccatccgggatgaaagtgagattagccccgagactgaggaagatggcttccctgacagatacctagagtgcagagtgtggcaaagccttcacggagagctcgaaactaaagcaacattttctggttcacaccggagagaagccgtatcagtgcacgttcgaaggctgtgggaagcgcttctccctggatttcaacttgcgcacccacatccgcatccacaccggggagaggcactttgtgtgtccttttgatggctgcgagaagagctttattcagtcaaataaccagaagattcacatcctaacccacgcaaaggcagggaagaaatgctgaaggtggagacagattgtcctcaggctgggtagtcttaatgacagaggcactggggatacacgcattatgtacagattgttatttgtagggatagattttatggctaaaataattttgcaactctagaaggcatgcttgtattttgtatttacttcattatacagttttaagacctctttttttggtattccatggcatagttccaacaggaaagtcaatggtgaaagcataatccttactatatgagctattgaaggggatggggacttttgcatacgtcggaaaatcagttatttttaactatgcagttcctaattgcctagcttttacctttagaaatatgcttcatggtaaatttgataatcctaaagaatggccaactttggctgtagtcaacaaatgaatacatatttctaaattttatgttttgatttttgtttttctcattgtaccaaactatattaatcatagttaaatgtgaatagttacaaaaaagttgatccatctgaagattttagatgtttcaaaataaaaggaaataaaacactaaaaaaaaatctagggtcaaacataatctcaattgtagaaaaagcagattggtgtatttctattttgtctttcaatgcaggaaataggagagagtctagcagctaaggacatacaaaactaataccacctgggcagggaaagagacactccctgtctgtgatgcccagctaggagacatgggcaccttggaacagtactcaaagatgggaagatacaccatgattcttctatgctttgatccctctaatcacctgtagccagcacatcaaataagctgagtctgaagccacttagcaaaggatcctg

SEQ ID NO: 23586 - DNA, 2469 bp, Mus musculus
ggcgccggcgtacagtgcggcagttgtgaaggttccctgacgttgtttaaccccggtggtgccttcctctcttgcagattgagatagacaatggggatgagctgactgcggatttcctgtacgatgaagtccaccccaagcagcatgcacataagcagagttttgctaaaccgaaaggtcctgcgggaaagagggggatccgaagattgattaggggcccagcggaagcagaagccactactgactagaactgtcgtattaaatgttgcaatatagttttgtaaagtttccagcttttagtacaaggagaactgaaatcattccatgttgatagagttgggaggaaaattgtactttttgaaaaatagcacttttcacttctatgtattttttaaattaatgctatagaagactcatgatttttattttttagttaaaactagacaaggtttcaacatagtgatgtttggttttgtcacactgttttcataacgtgttgattccacactttcacataatcttcaatatttcccataggtgggccagttccaccaagcataaggtcttgctctgtagaactctgtagtgaggtctaacgttccctatgaagggaagcgaacgacgaacaaccctgagatactcacacctgtcgagtgtgttaaggagcctgggaggaggcgggcagctgattgctttgagcatgctcaggaagggctgtctgccgcggtggagaaaggcaaactgcagcagggcttcctgtccctcctctccattgtagtagcatcagatctcagaaacgaagttcacactgaagctcgaaaggtaccagacagtgcaggcttcccatcccatcccccgcccccctgcactggaagactcgcgtccagtaaggtctttgcagaactttcgagctatctatttccaaagtgagtccagagggctgacgccagacgttcatgttcgaaagccaaggatcgctcaaaaaaaaacaaaactaaagaaaaatgttggaagtttcaaggggtttttttttttttttttttggttttgtgttttgtttttgtttttgtttttctctttgaaaccatgtatcttaaagcaaattgtcctgttgcttgggagcaagtgttcagatctaaaattattgatttctactacttagtaggctgacacagataatacttagcccagggatcttgtttcagtgaataatgtctcagaacacgggttgtctgaagctttgtgttttcagttacaacctagagagtttagagcctcaagagttctttgttacttgaaatagagggagttagaacacttggtgatttcatctgctaaacctgctgcagagccataactgagaagttctgaagtggaccatcgtgtccaggacctggaagtcctcgacctgaacttcatgctgcacaagataatgtcagtaatgtacatttcatggtatgaaatatgaagcacccattgcagagccttattatctaatacacacgcctttcagaaattcagcgtgtattcacatagaccataagaggaattacaggctgatggaaattttttaaaatagatttgattattgtgtgttttgtttgtttacaaatacgtagactttactacttacatatgcaggacagtcgacagtgacgtcacacttgtttacgagaggtaaactttttagttgtacgtgtgtacagttgtcacacgtgccatagagtgctgcactgagagtcctggagccctgtctagaccatcaccacagctgccacttcaagcagagggagcactacgtgtcctggatccagagccagtgggggactgttctgaggcatcacgtgcaacgatgctctgaagcctagtacactacatcgaagtcaatgcacattccagaatatagatgtgatcctgtaaccctactaacgattaaaccaatgattgctgagaatcacgtatgcatttgttttagggtataactcattgtttacactatgttttaggtgacaatagatgtgaataacatccccaataaatttatatagcagtgaaaaattacatgtcttctgtggacattttataagtgcattttatatcaataaaatttttctctttgagttgtgtatgttggctttctggtacattttaagtgcttggataattttgcacagtccaatacctgctgattctatgtgatgatttcattagactgcttaattttacaaaattttaactagttgaaaacctcggcaagaacggttatgagcaccgagtgcttaatgtagattaaagttgctctacagaaatgtagcaaggatgaaaaatacatctagttgctgagttccctctatgataaaaagcaccgccttgagatagtggtgggtgcctgaatttccagcacgttccagaacagctttaggtacgcagaccctgtcttgtctcccccacctcatccctcaggacaat

SEQ ID NO: 23587 - DNA, 1120 bp, Mus musculus
cagaaaagtagggtttgagtctaaagcatgtttgacgatcaccacacagactctgttggagctctttgtgagaacggaaggtgtccctaagacaattgtctttcactggtatatattatagcagtgaataatcattctgtctgtctgtctatctatctatctatctatctatctatctatctatctatctatctattatctatctacatacctatctatctacctatcatccttctctgtcaatcctagaagtaatatagaaatgcttttgatttagagaaccttggatgattttatctgattggggaactcttgcttttctgtgtactgaggaattgtcttgtttttaggaaaacttactaaaatgtgaaatgcttatttttttaaaaagcctgctacataaagttctgggaaagagaaatacttgatctcgaatcttaaatgctttttttaaaaaattagatttgaatgcacgcaaagtatgaatattttgtttctttatggaagacctgtggaaagggttttgaagatttgcatggggaggattattttgcagagttatcaatatctaaataatttttgaaaaaaaacaataaaggtgtttaagcagtgtgtgtctaatttctaactcaaatcattctgttaggagaaatcagtccctttgtgaccctgaagcaggccagaattttatgtgggccatgtcttaagtgcattttgccacatgtagatgaatgtgtatatcttccacagtattgggattcactgaatgaaataaattcacaagggttagtgatttcaatgattaaaagaaaagaatggttggtaaatgtgtgttttcataattatttatgaggaagatgagagaatgagggaggacagaggagaggacatatcttaggcagtctttggatgccttccatccagctgccttcaccaggctcaggagattacggctgcaattccacactgctcgtcccccttgccgcctcagcttttgcaatccatttcctcacactgaagctaatgggaacttaataaaatgcaagtgtaagcacgttaataaaaatccatcactcttcaagtatttatgagttacctgatatgagtgatgtgagtggaa

SEQ ID NO: 23588 - DNA, 1139 bp, Mus musculus
aatagttacctgagatatagtctgacatagcaacctgttaatgtccttcttttctctaagcagagtgagttcccacaaaggaacatcttatggttggtacactgatacatcttttgcatgtagcgtagggtccggcatattgtaggtactggctctcatgagatgtttgaagtgagcatgcactctctctctctttattttcttaggcttgatgattgaccccagagtgtacgtctgcttgtcaagtgctctaccaatgaactctttcttcctttttgtaaaaacgtgtttgtttatttgttctgtgtgtgaatatgtatatacctacatgagtttatgtgtactgtgtcctgaaggacaaaagagggcatctgcttcccctagaattagagttacaggcagttgtgagctgtcagggggtatcaggtgtgcctttctaatccacacactgacactgtaacttatctgtttctcaggtttaggcaccatcctttggtgccagcatttagtttgctttcatcccctcctgccccttgcttctcagttctcatttttttgccagctgtaatcatattgtaattgtactgtaatttggatgagatcaatatccagtgtttactttattgcaactgtggaatcttctccacagatgaaccgtttaatatagtttgatttacttttgcctctcatggttaggttgcacggccaatattgacttttttttcattgttaatctttgatatagttatgaataattcaacctcaaattctataccagttgtaaatctctcttcgatataaccagccacacagggattctgtcaaggtcatctttggaggaagagcctctggaaccttccattgctctcagggcagagaatggtttccacttagcaccttcctgccagctcctttaggctctgtcttgtaggagggccttgctatgtgttgtctttcctgttggttgagtgttccatggacacatttcccagggcctcacagaggaaggctggagttgcagagatggaagagacacgtctgaaaatgccttcctcttcctggattttaactgatgaccttgcactcaaggatgtttctccagctagttcttgacaagttctatgcatcagactctgatc

SEQ ID NO: 23589 - DNA, 1235 bp, Mus musculus
ctgattcctcaagcattttggggtgattctgtcaggcctcttctcccacaccatccctttatccacaccatggctgtgctccatgaacacagatggaggactggctgggtttccaaagtactgactctgtgtgtgtgtgtgtgtgtgtgtgtgtgtgtttctgcacgcctctgtgtgtgcacacatctatgtgtgcattcacaaagacacacgcccactgtctaattgtggttgctggctacgtttttattataatatactctagcagaggccctactagattgtgtcactggttaaactattgacagcccttcagcccatattgttagcatctgtcaccccacttatatatcaccccccccacgaagtactgtacataatgtccacagcctaatgtgcacaaaagaaagaagagaggccaccctggtaggtgacaccaagcaggagtgtgccgtgaagtcacttgagctaaaagctggcggttccataaataagcacagctgacattgttgtgctgtgccagagcatctgctattgaagagcaattttaatttattttgatataaatggaacttgtgtgcagaacagcatggggaatgaggcaagctacactatgcgtattcctgcggcatatctcagagtagctcaattcagggggaaagttaccttgtcagaaaaacaaagatttctcctcatggttggagtctttcttcctccctgaagtatatctcgggtgattctgttaaaagatagcattgagttaaatgataccaggaaaatttaatctattgaaatctggcatgagaccaaatcttattgtcttacctcccggctgacacacacacacacacacacacacacacacacacacacacacacagattcttcacatcacagacattgagagagctggctcaggtagggaaaaagccccgaactgttttcttgctttacccaaatcttgtttgttagtttgtagtctcactgcaactaaaccgtctatgtccagaggactactattaaaaatcactttgagccaaaacacatgcctgttcttgggcttcagttaatgattggcctaacgtggatacaatttcccctttgtccctgcaagccgtttcatataccagagtcaaagcctccaattaaagctctttggggaaggtgcatgtagttctaaataggcttttgtcccagtacacttctgcctggcatagacacgggctcataactgg

SEQ ID NO: 23590 - DNA, 1600 bp, Mus musculus
ggatcatcgccgagaggataggaggaacggttgacaacagcgtgcggccaaaactcgaatgagcgggagctttaggcctggagaagcactttaaagagaattagctgtcagacgtgtgtgaagcactagagaggatggcattggaactcctaggcaggcggagtcttgcccatgcccatttctgcctgtgtcatcttccagtttcagcaagcagtgtggaaactggagaacagaaaactgatcaggcagagcctaaaaccacctacctggaggtcctgaacatgctccctcttttgataaattggaattttagtaacaggaaaaaaagccctgaggtgtgcccaagttctccccgggacttcgcttttctgacctcacgtgtgcagagctccttttctgtgcttaattttgcattttgccaaatctatcccagacctattttgtccggacagcaccatcaccaaagaccaggcagacctcagccttaatcgcctctgtgttatcaacaatagccagctcaggattgagtttggatgctgtgttaggtcccaggtaggctcaagagttcacagtatttcagtgtcttactgtacactccaaggaaggagactccgctgcgtatgaaacagcttctgtatcatttcagcctgtatttccacctccaagaaatactcgtcttagattggcatgaagatggagggtattgaatgaagaagcctgtccctgttactccacggtgacatttgctctctagcaatactcccagcatgctctgggtctgaccaatgttgactggctttcagatcttaagggtatataagatgaaaaggtagcagcccttgttgatctgaacggttaatttatctcttcttggtagatgataatcaaatgattgtaactgtctcgtcctcagcatcatgggccgggaagcccatccacttcatgagaacggacttagcagatgcagaagggtggcactaccaatcaccaagcgccttctgccttgctcgctgaaaaaggctggtggcctgacgacactgggcgtagtcagagcaacagccagctacccaatcactagccatatcctgtgatccctctgtggcagatgtcactcactgggaaccctactgacttctctgcttgccacggtgaccagcttccttgcccagctccattcgttgcctgctaactcgtttgtaatcacagctgggctggagacaagtctaccaagattgttgccctttgaggaaggaaaccctgggttgaatttgagccccaagcctcctctcaagccatcagggggttatgggaaaggctggtttatctgctggtggcttgctgcgaagcctcagcttcctagtgccttgccctccctgttgcttggctgagcagtctctctgcagcctgtgctccgcttctcctccagtccatctggaggagacatggcgatacctcgcacccttgactgatcacagaggtcagtgctgggtgaagaagggaggacctgcctcacactgtttggggatcgggccgctgctgactggatgggtgtggaatgcctcggtgcctaggaaccaagccaaggaaagtgagcggtttt

SEQ ID NO: 23591 - DNA, 1149 bp, Mus musculus
aatcaacatgattaatcaaagcagtgttctgggcttttgagtagcccagggggtcagtgtgggagtatttcccctcctcccttgtcctgggagtccagagcccgccatacagtgtctatctgtgctgagataaaaatgactaccttcctccctgagggatgctctcattgcacagctgaaaccaagtgccactccttgcccctacccccagattgccctggagtgccctgctccctctgttacctcttttccagagcctgtgctcacttcctaaggacaggaaagtactcccactccataccatagaaagaggaaattttcccttcctttctttgtagacacaaagaaaaatgtcaaataaaaagtgcatttcttcatctatattccccagccaagaactcccttcacaaagtagaaagtaccactatggacagaagaaggaggaaaaaaaaaaaaaaaaaaaaaaaaaaaacttccttttctgaaaggagcactcatggcatctgatgctaccagaatgctgaatgacagcaaggttgctgtgagctgtaggttcccaatggcgtcagtgtcattcctatgaggcctgtgccaagttggtgatggataggaacaggggacaccttcggtggcagtgaggtagaccccaggcccaggaaaaccaagggcatgactgtggccacccacctgtctagcatgagccactagagaagttccatccttttgtaatgcctttgcattttaatggattaatgtggtagacccagtactcaggggatttttccttaaatgctcctcggatgttttaggtattccgttagaagtagaagaccacaatttttcttgaaattgaaagaggccgtctggtaatgagtttgtcaaggtttcccctttgcagggcacgtgggtcttgagtttcataggacatccgtttgtgatggggcagagcggggtgagttggtctcacaggtcttgtgtgctccttgtgttcgttcctacaatggttgagaagtggagacagtgcagagctcagctgaaaagggactcgtgatgcttcccatacactgtgtccccggtgtaatgtttgtaactgatgtctgttaatttctatgcattttaatattttttaattaatgagcattttaataa

SEQ ID NO: 23592 - DNA, 1221 bp, Mus musculus
ctggagggacagttttttctttacaatggatataacttttaaagaatcggacgtgcttttaaagatttatttttaattctgtgtgtgtgtgtgtgtgtgtgtgtgtttgtgtgtacgtacgcacacagaagagtagtgcccacaaaggccacaagaggaagccagatctcctgacctggagaccaagtagttgtgagcccctctacaagggtgcccagaactgggccctctggaagaatacaatatagagtcttgatttctaagccttcttttcagctaccaaaaaataagttttggttttgtgttgctagggatcaaacttagggcctcatatgtgctcttaccagctaaaatctctctagctaaagttgtgtatttttaatgaagagacactgaatgtttgaagctcaattagaacgattgttatttagtactaacatctagtactgtgatttatgatgaaacaatttttatcaaacacgatatattgaaatgtagctttatttttttaaagctatataatattaaggattaagggttcattaattgcatttctactatttgttcttttagctttaggatcattctcttctgtctttggagaagagtggcgagagaagactgatagagactttgttaaggtaattcacaaaccgaaatgctgacccatggaatatgttctgccaggtcatcgtagagtctgacgggctggctctgagctagtgcacgccactacctttatctttaacagaattgctcccatgcagcctatgtagaggttgtgactggataagaaattgtttaaggtctctaacgaacagaaatgaaattcctgtgttctttagtttatttataagataaggaatatgtaataatagcagaaatatttaaagttttaaatccctcagattaatttaaggaaattagtttagccacagctttctatgcttggtactgttggagcatggttttgtcttcatcagatagtgttcctttttgatagcttgtggttggaccttggtatttttcctcttcacagaatgcaatttttgtccttaagtcagcatgtttcggctatacattttgtgaaattaatgatgtagtagcctttgacctcccaagttttattttattacaatttggactctgcatccatgtttaaaagatttgtgtgtgaatgcacatgaaaattgtagactttggggtcttgtctcagtactt

SEQ ID NO: 23593 - DNA, 1143 bp, Mus musculus
ccacctcgaaagctgggcattaatgacatcgaaggccagcgggttctgcagatcgcagtgatcttgcggaacctctcctttgaggagagcaatgttaagctcttggcagctaatcgcacctgtctgcgtttcctgttgctctctgcacacagtcattttatttcattaaggcagctaggcctggacaccttagggaatatcgcagctgaggtaagcacgtggcagatccttaacatcgcctttctcttatccacattgattttaaaatttgctactatgattttaaaatgttgcattctgttcctgcctgtatttgccagattttaaatggttatatatatatatatttgtagctgaaaggtggggcagaagcctatttttatggaaaaacaatttggaatgatacttgaagttcggtggtaactgatcccagtgacacaacaatgttgctcgtttttctgacatttgaagtggggagcttgggcaaaagcatggtgcactgactgagtcctccctccttccttccttccttccttcctccagcttttactggaccctgtggatttcagaaccactcatctgatgtttcacactgttacaaaatgcctgatgtcaagggataggtttttaaagatgaggggtaagaactcaaatattttgttactgcatgtgaacaaactatcatttatttccagcacaaaaatgtttgtttttgcaggcatggaaattttgggaaatctctgcaaagcagaggataacggtgttttgatttgtgaatatgtggatcaagattcctatagagagataatttgtcacctcactctgcccgatgtgctgctggtgacctcaaccctggaggtgctgtacatgctcactgaaatgggggacgtggcctgcacaaagatcgcgaaagtggagaagagcataggtaagatgatcagcgctttatacactttgctttccagttttaatttctttcatttttttgtgacagggtcttatgtagcccaacctggcctcacgttcactgtttatccaaagatagtccctcagccccactgtgtcctgagtgctgtgatcacaggtgggagcaaccacctgtttggctcagtgctggggatcaaacccaggttttgtgcatcc

SEQ ID NO: 23594 - DNA, 1161 bp, Mus musculus
acaacttaatcccaacactcaggaaacagaaacaggcagatctctgcatttgatgccagcctggtctacatagcaagttccaggccaaccacagcttcataatgaaaccctgtttcttaaagggaggggggtggggccattatagagtggagtgtgcagtcgttcctgcctgtaatcctagcactcagggatgaggcagtagaattgccaagggatcgagcccagcctgtgctgggacatctgtcttaaagaaaagaagaaccaaatttgattgtgtattttctaaggttaatatagtgagagctgtaaaacttctggagttacttttttttttaaactagtaattatttattaagtaatcactaaaactacttagaagtaatatttagaaaatgaattttatctttaattttgaacattgttcttgaagtcatgccatttcataatttagtaagtaatataaataacaaatagaaatgaacttactgtgtatgtgtgtgtgtgcgtgcgcgcggtgtatgcatgacgtgtgtgtgtgtgtgtgtgtgtgtgtgtgtgtgtgtgtgtgtgaaccaggaacttgccatctcggctaaactgccggagagctccccgagatcccccgtcctgcgagtgacaccggcctgctctgcatttatgtgggtcaagtccatttccttgtgttggtgcagcaagcacttagcacactgagccatctcctagccccaggactaactcactttaccccgtttgtgatgctgggtgtgaagcagagggagggctttgcattcaccgagcaggtacagggactgcttctatagatgttggacaaaatcgaatgtttctttctttccgtcagcaagagctgagccaaagccctttgccttcagtcactcagaactcgaagccttgggcactgattttaataggaaagtagttttcatttcttaagagaacagagattccattttcatagcttaatataattatgttagctctttttattttattaaagataattgtatttgttaatttcatatacagggttttggtatggccatgcgtcttcttcatagcctgggggttgttcaagcaaagccagtgcttatcaagcttacagctccacacagcagtggcacatgtatcttgaccaatggcttt

SEQ ID NO: 23595 - DNA, 1197 bp, Mus musculus
gtgaggtttggtcctgcttgagactgcatggggctcctgtctgctgtcagtcactgtgggttcatatgttcagctgctctgctgtgtctggaggacaccgtttccctgcagccatccgtcccctctggtctgcccctcttctgtagtgatccctgagctgtaggagtagaggatgtgacacagctgccccatttaggatccatcagcccagtgtctcgttctctgcactttggccagtttgtgagtctccctgtaaatccccatctattgcacatatacgcttcagtgatgagggtttagagacgccctagtctgtgggtgtaatgggaagacattgagaaatcagttaaatactatgtccaatagtaatagtctctcccctagggccagtggcctgtccaaccacaggttcttagccaacactgataccagtgtaggtttcatcttgaggaacaggacttaaattcaagcagaaaggggtcggttattaccgtgatacccatgacactgttgctcactgagacattgctttctcgcatgttagatggataggtagaatcccctagtgaaactggttaccttggcctgcttgtctttgccttgctggttagtaattagaggcctattcaggtcagatgtttcaggcattgaactcagaacctcaggcgtggcagcaagagtgcttacccactgagccatctcgctgacccttcttcataatatcatttcatagcttgggaatctagcctgcaatttactaatattgattgattggaagattatgcatagaatacagacaattaccaaccgttactatctctttgtttgctttgcttctccgagtggagtcctggctatcacttccttgcctggttctggctctgcctcccagctgctgggattaaaggattcaccaccaacctggatattactcatctcctaaccctcgtttgttttcaaaaattttgccagcatgacaaaattatagtttcagaaatactgaatataaaaatatgccttagttcatgccttgtaatacatttctgcatattaaggtatgtcaggagaaaatcgagcctttagtttagacgcgtggacgcaggtggggatctctggtgcttaactctacaagtctgaaaaatgatgtttcaaagcccattcttagtataaagtggcgttgagaatgtgcctggtgcc

SEQ ID NO: 23596 - DNA, 2435 bp, Mus musculus
gaaattcatacaatcctgaatgtagatagataaatgcgctgtgtagcattctgtggatacaaaccctgaccggctaaagtgtcacctgagtgtgaggtgcagcagttggtcttattttactcatcagtgaatcatattagttgatggctagcttgagcctcctctttctacaaagctgtactagtgtcggcttgggtgtgggactatatgtctttatcttagttgtataatctgtggtaagaaatctcaacgatgaccctggagactgacaatgtgtgtttccttttgttttctagattgttaaagagacatgaaaacaacttatcagtgctcgccattagtaacatggaagcttcctctacccttgccaaatgcctttatgaacttaattttacagttcagagtaaagaacaagaaaaagactcagaaatgctgtagtgaatcctaccccactgacacagtggggtctcaaagtcaaatacatttcacatactgttactgaagaaagcaccaagtcttaatggagcagagaccatagaatgaattattttgtgtcctccatgatgctgagaggaaacttcgtattctgatctctgaacgaatccctttcttttctgttaaaaaaaaaaaatctaaaaaggaaaaaaaaaaaaaaaaaaacaaaaactgctgtgggattgtcaaccagcttatctgcaggatgtctcggatctggccaatcctgatggaaactggtgtgatcagaattctgtaccatccacattggaatatacatggaatagtgtaaaacctacgtgagcagatgaaatagaagcattaaatatttttatctatatccaaaaaggagcacatttttatatttacagaaccatttaagctggtttgaataacgacagagtttgagcacacctatcccccagcttcagaggggccaccaatatctagctgtggattgtgtgttttgtttagaatcagtagcttggttttcttacttgagccaatatattttcacttatttattatcataaaaatttaccagtctgaatagatcttgtaaatatttgtgaatagaatgaacactgttcataccactgcagccactggagatacatcctgtggtgtcctagaagcattatcggtaggctctaaagttttctagactttgctgtcaactgtaagtaattgtgatatattctacgcagtggatggatattctttaaatctgtgtaaatacttctgcaaaggtactgatgctgtaaagtcaaacagttttgtggaactgtgattttttttttcctccttttttggtttccttggcccccacttgggtttggtggggttttgtttttgttttgttttgtattatacaccttgtagaactcattttgctggctgaaagagtatggaataatatatctcatatgtcatttttgtagaagagaaactatttggatttcctttttgttggtttggttttccctaacacgtgtccgctgtacgcattcgtcacgtgcaagctcagcttgtgcagggttttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttcccccaagcgtgaaatgtatccacttataactgcctattgcctgttctattagcatccaaaaatgtggaaggcctcccaaccaccatttctgctgtgtccttaggatgtgcagtaaaaaaatatagacctgacagtttatgttatagaatggctttatttactttggtgactgtttatagtttttaaataaaagactgaacattttcttgagtcctttatttctgagtatgcttaagacattctaaaatttaaagtctagctgaaggcaaggtcaaacggtcacctacttactttatactttgtgattgtagagaacagaaaggtgcatcatgtgataggacaccatggtcacggtaggaaggagaccaggagaccaaatgttttgtttacagtagtatgagtagtagccccagagagcgagagacagttagggctcggttgccttactgtgtgtcccgcatctatctgactgagagctttgtttaccattcgactctaggtttcagtttaactaattcaggggcagcttcttggcaatgagcttcagtctggacagttcaaatatcttgattaatttagtaccaaaaagtaatttctccccaggggtctctgtgctctcagctctaactgtaagaaatgtgtggcgacacccagaacttggtattctcaggttggtggcgtttgacttcttcgc

SEQ ID NO: 23597 - DNA, 1184 bp, Mus musculus
tgcagttacagttttcccgttggtatcaaatagctgagaagatgttcccataatacggggatagagcaggataaacactcagtgaggcctacccattcactgacaagcacagtggtctctgtgagactgtactttctagagtgcaggcaacctcgttctcagttctgcataatgcattccagccagctttgaaaggaaggcgaattttgtgatttttaacccatagtgattgcactaggtaaataataggctttgttaggttatgcttatagtccttaagcatttccaaaaagtttttgatcttcttttctacatttctgtcatttatgatgcaatattttacatttttaattaaagtctgtgtgaacttatgatggcagatgtgtggaagacagttgtatacatccgcggctcaccttgttcctttcagttcaggttcagtggtgcacacttctggtcctgctttgacatttgtgtgtcagatgctgtctgtcctcttcttctgcagcagtgctctgcctgcattgttctactgacccctgggagtaaatggcagtttaagttgtgttttatactgtttagctcttgcaaagcaagttttaaagtttaggggaaagtaggcgttgtgtgaactgttaaggccccgtgctctggcagagctccactcttgctgaagttctctgttctgtatctggtagggcaccgggtcgagtgcttcagaatcctcatttctaatatattctactattagaatatactctggattagaaatacattagaaatgtattcttactgagttagaaaacgcatactttgtgttaaaaaataccattgcttttacattcttggtttctcattttttttcttagaaatccacattcgttttgcacgtatataaacttaacacagtttgggagttgcaggttcctcttgatcatgactcagtatcaacttgacctttggcaccatgggccctttaacttggtagtcacgttgacccatgtttcaggttgtagaaatgcccagtagtacttactcattattttaacattccagaggctttgcagttgtttgttgctgttttggtgatgaccactacatcttcgccattctcttccttcaaatggccatggtgtgtttgctgaccgtccctgcccacgccccacccccagacatgtggcctc

SEQ ID NO: 23598 - DNA, 1345 bp, Mus musculus
tacaaagagatcgtgcggaaggcagtggacaaagtaagtgcggctacagcgtgagtgctgtacatgggaacaagcggcttgtctgttgggttttcatagtgccatctttttggcattgagcatgacccccaccccccttgttttctaggtttgtcatagtaagagtggagaagtaaactctaccaaagtggccaatctggttaaggcgtacgtagacaagtacagatactcgcggaagaaagctctggaagaaccggggtctacagaaaaaacctaggctgaccgggagcactgcccaggacactgtggagatgtttggagactgcactgcagcgtgcgcccttactgaatcacacacaactgtgatggaaatctggttttgataaaattattttttttattgtaggatatgttttgttcaaaatatagctgtgcactgcaacttctatatctaaccctaaactccaataaaacaaattccagggaaaaccaagggtgtaatgggatgtgcgtgtttatcaggagtgtgctctcacgtggatgctgaatgatggaggacagcggactgcataagccagaaacctgtacgggtgctggctgtggaagacgtgtctgtctctatctatgtacaatagtttattctgtcaggctgaaaaagtatggtctttaggaccttgcccctctaactatagaaacttaaacagtgtactgctattagatatatctgatattaatagaacatgccaagtgcaggtcccaaatgcgtatttgtgaagcacacatctgagtaaatggcttagatggaaagcaagtcatcatgagtaaaaattagcctcaaacctgccggtgctcctcacctctttgtcaccaggtaaaggtcacactgtgtgttgcttttgttgtcttctctcctaacctaggaaaaaataaattagtggtttaatttgctacattacaactttgccatttcaaggctttgttgaatttagaagactaacttgggggaaaaaaaccaaaactatgttctttcattataccttctatttatcagtggtagtaaattatttgtgccaactggaaacatgctacttggtggtgaccttcctttctgggggactagcatagattacatgacctgctttggcagctccgggttgcttttcttctgtcatggtgtcagtgaaattcttctcacacttcagaagttccctaatggggctggcgagatggctcgccaggtaagagcactaactgcgcttccaaaggtactcagttcaaatcccagcaaccacatggtggctcacacccaaccgtaatgagatctgacgccctcttctggtgcgtc

SEQ ID NO: 23599 - DNA, 3447 bp, Mus musculus
gtacctgccaccatgctcctggggaagaaagaaaatctgttttctgcattgcttcgcttgttctcatactgctccagagttctgtcctcctcgttcaggcagctgaccacaggtcctagacaggaaaaagggtaaaaacccacagccgcctctaccctttgccctaacgcctcccatgtcacaagaaatgaccacctttgtagctctgtttgtactgtttaaaaaatacatcagtttagtttgcaagctgcaccccccccccttgctggtgtcccccttatcctgtaacagttcagttttacatttgcaaagtgaatccaaaaacgcactaactctgggatgtgttgcgatttttgtttgtttgtttggacctctggattttgtgttggtaaaactaatgtattatttgcagcatatttatttgcaggaagcacattgctgttgatctctgtgatatgtgggtttctttttttttttaaaccctctttgtgtacctgagtttgtttgaatataagggatcttactgtcatttgttaggtaccactgagtaattccatagtttctgtggtaattcactgtagagtggactgttctcgctctcgttcagaataactggcagccaaaacattacctgtatcacagatgttaagtagcactcaacagcacagtcaaatgtaacaggtacttttctgctaaattagtagactcaagcatagtaggccttcgccgagggaaaccgagtttcccttcagcacacaggctctccacactgttgacccagggccagtttcatactttgggtttagcactgttctctggttcttgtaacacagaatactgtagattcctagattagtgttgcttgttagaagtagagtttgcagagtgtgtgcaggtaagaaaacctactcttttaggcctggactaggcctggtcacagggagaccatattccaaagctctgtaacccggaatggatttttcttcattggattagatgtgggggttaggcccccaggcagctggaaaagaatgtggagctgtaatggagtgacaggactgtggaagagccaagttcccagagagactggaggtggggtatgttggaatcactaggaatacccccactgcatctctgccacgggtcacctgctgggtagtggggtcagggctccaccacagtggcctgtagcaaagcccccccccccaagactagagaggctaagttcaaaaccctgagtgtaggtggtggtcaaagaagaggagttcttagggctcccctccttgcctgcagttttaactttatagctctcccaggtaccagctttggggccagcacacggcactctcattgtctcccgtgctggtaaccatggcttcactgcttggtgatcaggtgaaaagtacaaaggctctcgctccttcctgagtacttatggaccctgctgagggacataagggcgtcagggtggcttgcagaggactaaggtctgtggtgggatgcctcactataacaataattatgccaagcattcaagccctcaagctggtgtttctcaaactgtgcaccctcaaggcagcagcatgaacctcatctacagacttaaccagcaaagtgtcagcctcaccagactcagtggataaatcgagctgtcctcagcaagtctcaggtctagcctccaggtgagacctgtgatttcaagcttgggtaccactctaagctttctccggtcagcccatcctcggaaggcgattggttcccggggtgaggaatgagagccaggtagggtaggaaaggaccccagccagtgtgtgcaggttcaggaaagggagggcgtcgtgtgcagcccctactacctgtgttctttcctgctgccaatgcattgcagagttgtgagtggatcttgggggtgctcacactttagggaacccagcccgaggcactagtcttattttcttgcagctgcgaagattccaattgaggctttcagaaaatgtaggtaaatttttaaaaatgccttttgtaaatgcggtcctgaaggcactgctgagttttcaggggaccgtgtccatggtggggtagaattcagtcccggcgctgcaaaatagaaaatattgatacgcggagtgttctagtaccaggtctgtactgctgagggagcttcgaggggagccgagcctggtccgtcttgggagtacagtgtgaagcgacatcgttggactagggcagcgtggggaggtgtgatcgtctgtgtggtttatacttgagagcagagcctccattagtccgattagaaccagcgaggctttgagaatggtactgcctattcaagggagcatccaggcactcttagtttgcaatgttacaatgtttctctctcaggaccgcaggtctgagactccttctgaaacagaaagttgtcctctaaaacgcagtgaattgctggtaatactaaaagacttagggcttcaggtggggttggggttaatgactgaaagcaatgctaagtctgaaggggtgggtccgtggggaacaaagctgctttccaagggacgcaggtgttttaggactttcccgaggaagaaccacaaagcaccgggcctatctgtacacaggcttgaagaatctatgcagcagaggctcactttaggaatccttcctttgtatgtaaatatgttgtaaatacataggaggctgtatatttttgcaggtgaaatagaggtcactagtattctgcatataagaaatccatgttctcagatatgttagtggatttgtttgggaggtagaagaattttaccttctttcccatagttctgtcaatgtaaatctggagtctaaaaccttaattgtttggggggaaataaaaagaactgtctggggaaaaaactactctgattccttatgctggtactactatctgttgtctaaatgctacagataaagatgatttaggggaaaaaatcattgtcatatagaaacagacgtgcccaaaataagaatttttctctgcattacgttttttcactgttaacgttgatgctattgcatagagtttgtgaaaatcaaagttagggagggtttggttttgttttttttttccaaaatggaattgctgtttcccaaactttgggatccttgaagggagagctgaacattaatatgagcacgtatttgaaggagaacatgtgttatttttaagcctttgaaggtcttgcatgtctgccttttagtgttgatgccaacctagactgtctcgtctgtttcccccctcccccacacacttaaatcatactcgtcggtacgcagtgcagtctctagagtccagtgtgtcttagatccccatctgactcagtacatgtagcacaccactattttactaatgtaaaaaccttgtaagtgatttcgggtgggcatccaaagtgaaccacaggtaacaaaacctgc

SEQ ID NO: 23600 - DNA, 1177 bp, Mus musculus
cctccaacttacagtcatcctgcctcagtttcctaagtgctaaggttacagatatgtgctgccatgcctggcttgacctatactgtatgttgacccatgtcttcagattttcgccaaaacaggagaggaacagctgcttgtatttatggtgtatatggtggtgtgggtgtgtgggtgtgtgtggggctctagcagcttcttcaaggaaattaaacacactcagcatattttcagcccaccctcccatttcctctggcttcttggaatattggcagcgcctctgggggattctggtgtgaactagattgatcttgtctttctcttcaggttcctccagctatctatgtctcttctccctccagaatggacctgttttgtgtgtgtgtgtgtgtgtgtgtgtgtatgttagcacaatttattagtaagtaaattaatacagtagaacaaagtcctgttggtgactccactggggagctggagtaaatccttgtatccaatctatcattctagaaagatcaatgatttaattatgctggtctagggatacttgatgtagccggttgcctttgaatttctgaacaaagctaaggattggataaacggtgcttagtgttgaagggatcgggttccccggatgaagccatgagaaatcattttattcgatatgatacatacactcgaagagctaaagaggcacatctaactcccgaggcggaggctcaggaggactggagtataaagactcagaagttcctcacagagcatgaaactttgtagcttcagaacaaggaagcactgacttgtttaaaggccagctgcccctgcagctgctccgagccagccagcagttggcagcctcaggtatcagctgctccggggccctgatccagctcactggccagcagggaaggggcctcccaggctgccgggcttccatagagcctcagctgggaaggctccttcctgtcgccgtggggctgggcgtggagctcttcactgggtctggaaacttcttggtgtgctttctttttcttggatacgttttgggttcagtttttggactagcataatggctgcctttaccatgtgccgtacctaattcaataaaactcaaaggagttctgctctctcagaagaaaaccattaccttttgtattttactgaatttggggtcctt

SEQ ID NO: 23601 - DNA, 1177 bp, Mus musculus
ggggcttgaactcagatacttaggagcaagtgtcttaacttgctgagccatctttctggcccttagcatatcattttaaacatgggttcataaaaacattgtgtatgttgtttgctgctaacttggggtttcatttttcatttttaaaagggtttagttttagttctatttattggttgactgattgattgttgattgtgtcttagtacgctgtcactctccagacacaccagaagagggcaccggatcccattacagatggttgtgagccaccatgtggttgctggggattgaacttaggacctctggaagagcagtcaatgctctaaccactgaacccatctctccagccccataacttgaggtttctataattgtgagctaaaggttatgggatgtgacttactctgtagtagataaatcgagggaaatgtgtaaaagccataaaatttagagataaggttcatgtttttatgtgtccagtagcaacgtctgaaagtgtcatttcttcattatttgttcgcttttcacggcgcttcgtgtatcagtgacactacctcccattcgtttaataactctttattctgctgtttcaggggtctcaggcatctgtatttgctgctgtctgctactaaagagcctcagaacggaagaaatttgggttgacttttgactgcggacaccgaatatgatgcatttcaaaagtggcctcgagctaacggagctgcagaacatgacggtgcccgaagatgacaacgtcagcaacgactctaatgacttcacagaagtagaaaacggccagataaataggtgagcgtcttcccctaagtgccacccggggaaggaatggctgtagaaagccgttctttcaggaatttgggtgaactcttcgttcactaaaattatgctctgtttgaagatgcgatatgaatttcttctgcagcatctgttgcacgtcgtctggaatggcagatgaggggaatataagagtaatttattcatctcaaatctctcagtcgagtctaataaaaaaatgtataaatacattggaccccaaccagccaacacgtctcaaagccttatgcctgtgaattagactgactggaaatttaccacatctcatacctaaacgagtgttgtaaccattgccccacattttaattaagaaaccaaccaa

SEQ ID NO: 23602 - DNA, 1217 bp, Mus musculus
cgcatccgctcgcactgcccttcctggatgctcggtgtccgccagccgcggtcgccttgcggtctggtagcccaggggggaagaggagcaagaaggcgcggcgaccagcggcatgtgacccgcactgctctaccgcacacagctcaactccgccggcgcgcgggcatggagggatgatggtctgaaaggccgcgctcccgtccccaaactgccgaagagaaagggcgacgcgcctcgcaggagccaatgagtcaggttggagcccctccgcgccgggcgtgtgaatgtaagtgctggcgggcagagtgtgggtggggggaaactgatgcaaccagccctgggaggaggaggaggaggaggaggaggaggaggaggaggaggaggaggaggaggaggaggaggaggaggtggtggtggaaaaggaggaggaggaggagagctgtggccacgccactcttcctgaaggtcgccggtaacccggccttttaccttcctccgaaacccgccacgcggatcctccccgcccagtcttacagacctggggccacctttccctagctagtccttgacacaaaaaaggacatctaactgccggggacggcctggaagggcggacactttggtggcgcctttccctttatttctcgaggtaaggtgcttttggagggcagagggagcggcgacttggagggaaggggagtttgaacaggaagggaaggaggtaactcagacagcctccatgtctcgtggacacgggcagagcgtcgcggcgcctttctagaaggcaggagtccggtgcccttccctgaacgcagggactccagataccgccgtggcgtacagtaccttactttgtagacctggttttatggtgatggagtgtgccaccagatctggtgtcactttcgcgaattaggaaccaagcatgcgatgtaaggggcataaggtacaccgaggagtgaatcagtctgcatcttgggactggccggcagcggagcctcggagaccggctccccagcgcggtaaacaggtgcacgttggctgcacctccacgggctcggcccctgtctccgttccggttagtgggatgatgctggcagtgactcactttcctctccctctctggaggctctctcccgaatgaagagccagtgataggctacttcctctagagcctggtccggtggggcgggagaacaaaaggccactgcttgcgc

SEQ ID NO: 23603 - DNA, 2673 bp, Mus musculus
agaaggtttcagcaatacaggatttctgtgctacaagaaacacaggaatggtttgatgactttaagaacagtcaggtgaaattagagtatttgtaagtgttgtgatgtgaactcttggggccttactgatgagtcttctctgcctcctgcaggctctgtgttttctcctgagtggcatagtggtgatgattggaagcatgggcttgattgtgctggattgggtccacgatgcctccgctgcaggtgggcactaacagctcccctcacgctggatggtccatccgcctgcctaccgtgttgagtcgactcagcctgctcagtctcacctgatgcgtcccggtcacttccttttgaagtgcagtctactcgctggttcttctggattcagaataagtgaacttttctttctctttggttttttgtttttgtttttgttttttttttttaagaagctatctgtgtgttagggaatggatagtacgacaaaaccacgagccttgggttaagggaagtgacaagtttattccattccagagaatggacgaacttttaactttttatcaaagccacatgtttggctgtctcattgtttaacttggatattttatgattttacttgaatgtgcctaacggaaccattcgatgtgagaaacacttcttaatttacagcaaagtattgaaataagcattgagaaaatacacttattttttgtaccaaaaaatactttaaaagacctcagaagcactattttactttgaagaaattgcatttttgaactttactcagaaccagttgtcaataaactccatcaaacaatttcattgatatttaaaaatgaatattagtattatgaaattatttgccttttttgtgggcattataagccaaatacttttttacccaaaaatcattttcgggaaaaatgttacaaaaaattgcaccatggattagcatggttttgtttttgttcattcagattcatttgaaggatagttggtcgttgctgcaccaagtcaggtgaactccgttcatcgctttctttgcctccaaataattggttcattacaactaaaatgtttatgtcttcaattagtctgggaaacagtgccgagatttctgtaggaaatgaaataactgattttgaggtaccaaatagtgcaattgggtaagacagggtttattcagttgcatcggtctccagagttacagtgtcagctctgggtcgtgctttttgggcccatcctttaaaaccttgcttccaaaagtgaaaacgggcgtttgatggcaataggccaaaactgtccaatagagagcagaacttccaaaggctcatctactggaagcgtggtttacttgacaacacgcagctcagtggtgctcctgctgtgttggcagtccaggctgcaccatgcaggtacactgcaggccctcctcagaaaggtttctcatgcagcaagcttcctaaaaactcgaactggatcatcatctcattgaatgagatgcagaatcaatttgtttacatcgaacaaatgatcagctaggggaggcgggacaagctgcctgtcctcggtgtctggtccagccgcatgcttacctttccatttcaattccagttaaacgtgaagacattacttggaagcttggctttaagagcacatttactgtctgttaacggtgtatggtgaacatatttttaaataatgaggtactttgctcatcaagcgtattgtctaaggtctaattaatatacataattccattaagtggtggagggaagcaagtagaatcgtcaattggttatctggctcttgaaactacatgttttgagtttgaggcaggggccagaagaaatgtgacacacatggtttttgttacagtcttgtattgtatatgtgactgaattcataggcaaggtatgtctgccattaaagactcttgcagactggaagacgtctggtagtgctacatacattgggtacaaccaatggtcagttctgtcccaagatgaaacccctggggactgtgtagacgcaaaggcagtgagaagacactcccccatgctgcttacttgtcatcaagtccagaacctcacctgctcgtcaaagactctgcacctccgcttgaagtcctggaaagagtcctggctaccatatgccaggggatgctgagaggcaggcatcctgagaggtgccatgacaaccaggatcctgttcacagccgatcagtgtggagagacttcccaaacctcctgtgagggagcaaggttccaaatgaatttcaggccaaattccaaagcttggggctgttttacccgccttgaggttcctgaactgaattctcagccttgagcagtcttcagtattaaaaccactgtcccgtcacctcaattcacatcgctgtcttccatggaacgtttcaataactgtactgttatttatagagcagcattaatccattaaagctaacctatttttcaatatttatgataaactgtacatatattgtccatatgtatttgtaaatagattgtatatactgttggaattgggttcaagtgtatatattcccctaagtttcttaactgcattttgatgaattcacattatatatgtctccaaattacttgtacagagaattcaatcttaagaaattgacattgtgtataatactaa

SEQ ID NO: 23604 - DNA, 1159 bp, Mus musculus
gcacagagcggctttgttccctgtgcctagtatcaagctttaagaagtgttttatgttaggaatcagctggcagccttcccagagcagagagtggcgtagaagctccatgaagcaaatggtcacaaaatcggtggtgtctcaaataagggatgctttttttttttccttcccccatcaaagctgtccttttcgcatgcggtgcgtgtggtggccgagttaggtgtgtgccgtccgttcactcttggcttttttctctctccccattcaggttgtggtatctgaacggtgactatctggtccttctggtgtcccttgtcctcattcttccattgtcactgctgagaaatctaggtaagcagacatggttctgacggctgtgagccctcagcagctgctagcattctcccaggaacgaccgaaggctctcagcacctgctcttgggggtggcagcagggcacacacaccccgtttaaagcccccaactgttaacactccatacatggctctagtgtctcgtgttctctgtccatccctgtttgattaaagcggcccttgttcccttccaggatacttggggtacaccagcggcctctctctgctctgtatgatatttttcctgatcgtggtaggtagtgggtttgtttgtttgtttctttcttttaggaaatacatcttaaagctttgtcaaactgctcagtcttgctcacaaatgtgtgaactatgttttcaggtgatttgcaagaagtttcagatcccttgccccgtggaagctgctttggtggccaacgaaactgtgaacggcacctttacccaggcagcgttggcgttggcattcaatagcaccgcagacgatgcttgcaggccacgctatttcatcttcaactcgcaggtaacttggcggcagtcctgttttctggaaagaaatgttgacaggaggataaaaggataccctgcgtagcagggatgtaaaaatgtctcaagacaaattgaggctggatgataggtgggttttaggggggaaaaaactggagaactagcgaagtttcatgttctagcttagacaaaggcagcaggcaaaataatgtgcctcggggcacatctcgggggtagagggtcagatacagatagatcataggtgctgaactgttacaggatgg

SEQ ID NO: 23605 - DNA, 1099 bp, Mus musculus
gggatagcgcttaaaactgaccggttaaggccagcctttccagaaggtattgttaattgtaaaatagatgggttttataagttgacggtctcgccctagaacctgtgacataaggaaaagaaggttggaggtgtataaggtgtggtggtatttacctagcccagatcatatttgtctaagagcaagtgagtcataattttctggatgctaaagagcaaattcactttttaaaaagtctttccggatacataggattggtgcctgacttctaagtaagagtctactaatttttttttaagttagttggctgaacctccagaagtcatgttttggagggttacccatttgggggtcacttacccgtggttgatatgatggaagagtggtagactagaggtcagcactaggctgcttggcttgcctggcatgcagattgatttctgagttcgattccccgggccatcagagcagtagtaagagggggggaaaaaaggctgtttccaaatacaaaagcatgtatgtgtttgagtgtgtagttctgtgttgagattttcaaactgcctgtagatcatggctgacacagtttgtgtggaggcgcctctgacttcaccataacctctgcaccaatgggaagtgcacacactcgacagctgtccctttttgtgacagttgagaaattttggttagttgatggggatctagcactcaaatgactttctcccggcataataaaaaaaaatgtttgagagaaaagctctgctttgtcagaccccacacagatgttaaagtctggctttgggtaactagaagcatcaagatgaagatttgggggggtccttgcaaaaaaaaacgtgcgtggccttggtacagaacatcctgaaatttcaggttttgttgggaatttgaacggccggaatcaaagttaaatatttggaaccctttcccggctcttgccagaaaaactgggaacaatttttgaaattctaccaatgtggtcattggtaactctgtttcgtaactgaaagtaaaactgaacggtgtcacccttgagctctggggagtccactctaacagcttactctggtgctgtagtaaccat

SEQ ID NO: 23606 - DNA, 2688 bp, Mus musculus
ctgaattgcaggctttggtcttccttgtgactggaattattttcatgatgggaagcatggcgctcattatactcgactggatctacaacccgccgaatcccaatcaccactaatcccggggagacgcgtctccactggaaacagctgaaattgtctgaaggacattttagttgtcttgattgggatgttagtctgaggaattagcaagattccaaagacgtttttctagctctatcatgggatacttgtggaagagaaaattatgggttttgttgggaatggttttgttgggaatggtgaaggatgcattaaaaattctgtggcacacattttaacccaggccgtgcagtgcagtgtgtgatgcccgagttgtgtttgcagcagctgtgcaagctgaagcctgttggctgcgtgtgttggtcagcagacaatagcctgtccccccatggtcactccacttctctccacccccagattaacaggtaattctactctcagaacatcagacaaagacctcctggttggcgaagctatcatcagttacggccatctctcactctacaccaacactaagggtcggttgactagctgaggcagggggatatcttgggagctgtccctgtgaggatcatgaatgacggttgccagtatagagtacttcatttcaatactcaaggaatagtttgcccaacctgcttattacaccgagttagtgaattttcattctttttattttttggtatggcaaatgttcaaacatctcactaaacatagaggggggttatttagtttatcatgaaacaactaccaaaaagtaatggtttttaacatctgccttttcatgttgtttctgatatctttgttccactttgtctttgaacaaggcttcccctctcgtcttccgttctcactcttcgtaattttcagaagaccacagtccgtgtggagacacactacccagtattgtttgatacatctctatttgataaacattcagtgcaggaaactgtgattttgctatatgtttgtgtacataatctcattctgcagttatcagaacgttgacatatgggacattggatttttattttttacatatgtaggtttttttttcttcacagacaaaatgtttatatcatcagggtggggcagggaattaagctggtgggctcaaaaatccatgggtacttatctgtccattggagacatctaaaaattaaagtcaaagttgtgcatagttcagtaatgctcttcactgtttacaagactataatcatctcagcaaagtagcgaaggaagggtttgtaaataattttcagtgctaacaatggtctttgaatttaacatgtctagaatagggtttagttcattttagtttacatcggaacttggtgacattcatttgccattaatagaacatcgtgtggttaggaataaatgcaccaacatgacccaaaaccacattgctcacatccatggacgcttacacgggatggagttcagactccgcccactgcctagaatctctggcattgacttctttttttcaattactggttgtatattttacatttcagtaaaaagccaagtctgaaatgcaagtatcctacaggtagtgatagtactgtcacaccaaagcagtttttcaacagtgtgcctaagaaacatatatttgtttactgtgtcattttctggaccttaagactatacaatggtgtgctttgtgatagaaattgagcattactagaaactaccataacttcggagttattatcatttgggagggaaaaaaatcaccaaataggatctttaagatgtctttctattttcattcatccaagaaataaatcaagatagaaagcagaaagggtgtgctgcaaatattaaatatattttatctgaacatattaaatgtgaatataaaagattaatccaaaaatattggaaacctgtgaaatctgtacgtatttcgaatctttacacttagagcagctaacctggaagtatccacttgtgtagttagatattcaagagcaatatcacagtgccaaagacttcattcacacagcaccgatcatttgtgtggccgttttcaggattagagttcacacagactccagggcagatactcagaataccgttttctggtaaatttaacccatttgtaaacagatacaaattttattttcttacatcatttataagacggttcaatgtactggggggattttttttattacagactgtgtattggtatataataaataaacttttcaaatgatgtggctatgatcttctttcgtgagttatttgtatatgacacaaaatcagaagtgtgcatactgcgtgtcttaaatcaacgcgtgtccaccgtgcacatgcagaaagaataactttcctcatctcctgaggataaagagcacagcaaagcctccatcttacacattctgttgctgctgttacaaattactgcacacttagtggtgcagacacatccagaagatccaaagccagacacgctatcacatgtctgtgatccagccctgggaacctgaagcggcagaattgtcaattgaagtcaccctgggccgcactgtaaaaggcacgatctcaaaaagttttacctcatagttaaggaagccggcagtcctcaaatcaaggttctggtggctctgcctctttccggag

SEQ ID NO: 23607 - DNA, 1175 bp, Mus musculus
aatttgttggttgtaccttagaactacaggctaactgggttatttcagtgactagaagtgaagtaaaccagggcaggcggaggggatagcttgaggggctttttttgaaggctcctattcgaactgtgcctgcgtggccgtctccagagactggtgtgggcttgccgactggaggtctattggctctgagatttttgttgtgggacctccttgaacgatagcagctgccttataaagagggtctcacccttcctaggatctggctcctcacccttggggatcgtgcccactaggtgctacccgagttgctggaagtgtgcctatgaccccccgcccgccggaggtggtgggggaacacgggttcagggtttaaaatagactcgctggtctcttgatagttggtagttgaatttcctgactgtaagcatgctcccgttgttaaattgccttacggcgagcagatcagcatgctcccggagtgcgaactctaaggcttggggactctaaggagtcccaagagcctggagcaaagtgagaatttgatttagagccgagactgcttcccacatggtgggatcggggatccgccacacccaacagctcgtaggcgccgaaaccccgcggtagggtgggggtcgcgggcatgaatggaggacttcagaggagagggaaactgaccgtggagtagttgggaggagacaacttggtcaaccagaaggaactccttttgccttgaggcactgagcagggacagacagctgaaaaggcgtaggtggctcttcagggtatcagttcctggggacggaccctcgtggggatcggtctgaggttcccgtggagggatcggtctggggttcccatggagggaccctcgtggggattggtctggggttcccgtgaagggaccctcttggagatcgggttggggttcccgtggagggaccctcgcggggatcgggctggggttcccgtggagggaccctcgtggggatcgggctggggttcccgtggaaggaccctcacggggatcgggctggggttcccgtggagggaccctcgcggggatcgggttggggttcccgtggagagaccctcgcggggatcgggctggggttcccgtggagggaccctcgcggggatcgggttggggttcctgtgaaccgatcctcgcgggg

SEQ ID NO: 23608 - DNA, 1509 bp, Mus musculus
aacattcccacccagagggaggaaggaggtttatggctaaagataaccacaagctcagaacacaaaaggaatgagagttacaagacacaggaggctcccccgctcataatgcagcaagcaataaatcatgatgggaagagtccttgggagctgcctgcaagttgggcttagacattagcgctcagaccagcaggatgactcaaggaaggaccgaagcctgtcttagatgataagggagactctggtgagtggaaggcggagccacaggctgccaacctcagtgaaggtggcgtatgatgaagagcacattgctctgtgcagccaccaaatgccaggcaggctcctctgcacaccgcagcccctctacgttttgaccatgtcaaaactgtagtctgcttaactatgaattgggggaaaaccgcaatacctgccctaccgagtgtctctgtatcaggtgctaataattaattacctgttccgttcccctccccttctcttcctcctcctcctcctttcttcttttcctccaatagaacaaacttccataaagccaatagctcaaatgccgggttttctcagcctgaggcccactgtagacgccttgcttcatcttatccaaatagctcattcttgattcctgaattagcaaagaccccaaacttgacatgagataaccaagccggataagacgacttctggggcacacgcccgtgctgtgttcaccttattgtccgaagatgggatgccaagggctgctgtagccaccagctgccatgaggaaaatgagtggatcagcagagaatgccaccctcaaaagaacagggaccctcaattgtcgagcaaaagcagagttagagggcacactcgtgctgacgatgagtcacactcatataatctaatcattgttttgtctttttcatcctcataggacttgaatcctgggcattagcaggacagttgggagcctgaaagatatttgaataaggggctggcgaaatggctcagtggttaagagcgccgactgctcttctgaaggtcccgagttcaaatcccagcaaccacatggtggctcacaaccatccgtaacgaaatctgatgccctcttctggagtgtctgaagacagctacagtgtacttacatataataaataaataaatattaaaaaaaaaaaaacagcaagctttagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaattccagggccaaaaagggggagtgggtgggcaggggagtgggggtgggtggatatgggggacttttggtatagcattggaaatgtaaatgagttaaatacctaataaaaaatggaaaaaaaaagatatttgaataa

SEQ ID NO: 23609 - DNA, 1223 bp, Mus musculus
ttacagtacatagcaagagaccaaacctcgacagggaagggaaaggctggcatcctcatggcagtcaggggaggaattcgacacccaggaaatgattttacaaagttctgaccacttgacagactgacttcaggagagacagaagctaaggcagtgatggcagagatgctcctttgactgaacagtgtggccatgcatatctcttgctctccattaaacccagacctcgcttcactttcctgaagaaggacccctttgtttctctcccagtgtggccacactgaataaatctgcctttgctttctattcactgttgcttgcttgcttgcttgtgtgtgtacttgaagtgcaagcatgtctgtgcaacctgtatacgcacacacgcatgcatgcatgcatatatgcatgcatgcagttacactagcatgcacatatatgtgtgcacccactatactgggcttttttcctcagtagatctgtatacatttgtttgtttgtttgtttgtttgttttgagacaggctcactctatactcctgtagcctggaacttctgtgtacacgacataactctcagacatctacctacctctgcctcccaagtgctaggatcaaagccacacacttctccattggcctctacaatttttttctcagtccctcactgaacctggagctcagcagtggctgtcctggctgcccagcagactgcctctttattctttatatgggtcctggcattgaattccgctgctcatgtttgcttagcgtccactatatcaggcaagccgcctctccagtccattacctttttaactgctgtgttgtgagcacgttgccaaatctatcaactttctaggaggccagagcctagattttgagcccagaatctgcagtaacaattctgcctcactccaaactggaagaccgttgatgggatgctgtcgaagagatgtcctagtcgatataaactaaaccaaaaccagcacatctcttttccttagacacatgctgtaagggttctgctaacagccccagcctttcgtggtgattagggcagtctatgtgcttctccctgatcgaagaagcatgattccagttcaagtggtacacgtaactaagacaaactacctgatgcctctaactcgagccatggtggcatgcgtttggaaacaccgagtgctcgttttcatatctaatccccagtctcgggttagagaaagtt

SEQ ID NO: 23610 - DNA, 1192 bp, Mus musculus
agcttgggttattttgtaacaattatcattggcataagcattagtggcaagggtgacatcagtcccagcttgaaaggcagttcctggcaggtagctgcaaagctggcctctctgtaagcacacagttcgttgtgaaagcctactgcagtccttgtacatgttcgtagtatggcagtcttctcttgtggaggttatgtgtgcataagatgtcttcccgaatgcttccctccattttgtttttagtttggtctaagtgactccatttttattttgataacttcagtgttctactctgatttagatatcatggtttatttctcttccttgccttgtttccagttctcagtgactatcttattatctccacaggcagtgaacaagacgtgtggtctgaagatacacaacaccgagacaggactgtgtggtgctcacatgccacgagcagagttcaaacagcatccaagccctaaagaccagagccatggaccaatatggtggatggcatgtgtgcgcttgttccagaagtgctactcatcatggaggcaaatcctgtgaggacgtggaagacttcacctggtttctccgctttcctcccggtgacacgggggatacttcgggcagatactgaactgtctgctgccatttacagccacagttacatgggattgtttgttccttccctgggcttctacctcttccttgactggaacagaagctaggtgcttagataaacctggtcaaatattttaaatcaggattctctttttttctcagcctaagagcttaagtggctatttatgtagttttataaataaaaaaaaaatttttttaacatcctgatcataccatagccattttaaagaggagaagagacattttaaagagctatgtgtgctgcattagactactgaagaaaaaaaatagacccaaggaattaacatttctgaggaatctcagagagaagttttgtaaaaaaaaaaaaaaaaaaaaaaagtatttaattgcaatccaggctttctaccctgcctttgatcatttagtttctggaaaaaagactcacatatcctttttatttgtcataagcctttatcagcactaatgttgggcagagatctaccctctatgctattaagatctatttcctattgataaccccagagctattactctgtttcatttgggctgctcttaa

SEQ ID NO: 23611 - DNA, 1147 bp, Mus musculus
ctcagcaagcagagcctgtcctgcccgcccccctaccccccatggtatcttggttccaaagaagtgtcatctggtatgtttatgtctgaggctggccttgaaccactgatcctcccgtattgtattacaggtttgtttgcaccaccgcacctggcttatattacaattatcagtgaccttcctccccctacctccttttcctttttggtattttaagaaaaggtcttactatgtagaccaggctggtctaagagcttagggttatcctcctgcttccaagagctagcattacatagtcctatgatatactaccaagcccagtttctcagtgattgtgagctaagaggacaaataacgtttaactcaggttttgttttgttttttttccccttttctttctttctctctgttgtttttgtttgtttgggttttttgtttgttgacttgcttgtatgtgtcttttgagacagtgtctcatgttcaccaggctggcttcagactcactctgtagccacagatgaccctgaacttctgatcttcctacctctctacctcccaagccctgagattgcagcttctgcctccacccctggtgatgtggtaacgggatccaactcttggctctgcgtgttctccgtgagcactgtcagccgagcagcatctgcagccctgtgtgtgcgattcctcattaacgcctcatttgctgcctcgtgatgatgagctgatgttgttgatctttctttttgaatttgttgagacagggtctctttgcgtaaccttggctgtccccagagctcactaagtagaccaggctggcctctaactcatagatacctgcctgtctgtcaagtgctgggaataaaggctccctgcaaaactttttttgattacaatgtttacgtgattaatgggtaaagacaggtgagtgttttcacctgttctatgagaactcactgttctccctattttcttaattgatacttgggaccacttaaaaccacaagctgcatagccttaacattttaatttgttagttgggccctgttgtctctttcctttaataccaacacacttgagaggcagaggcagccgatctctttgagttctttaaggccagcctagtctatatagtgaattccaggagggg

SEQ ID NO: 23612 - DNA, 1862 bp, Mus musculus
tgtgcgccaccactgcccagctatttatttactttagaggagatgtaatatttgtctttctgagccagaggcgtgtcttcctcttctgagtctctttcttcacattcatttgttcattgagacaagcttccccatgtagcattggcccatctggaactgactagacatggctagcctctgagggttctgcctgcctcagcctcccaaatgctaggattaaagacgggccatcaccaggcacggctgcctgcatgaaggcgaaggccttactttttgagataggttctcttactgaatctgaagcctgccattttggcaaggcaagcaagctgacaggtaaactgggatctgcttgtccgttctggggatttgagcagcctgcccagttcttccatctccccagtcaagtgcttggatcattaacatattaaaaatggtttgagcttcaagaaatggtaattggtggagatgacagggaactatgaggcccatcagaaactaaacgtaagcaaccgcatctgcatgttaatttgtcttaagtggttacaggtggtgctggcctcttggctggctggagcctgggcagcccagagtgcccaatagttaaatgagatcgcagatgtaggagggcttcctgctcctgccctctcccctccctacctcctccttccagccctcaggctcagccttcgggaagcctgcagtgttcctccctcctcgccatgggggtcggggtgggggagaagggcggcaccctcaggcggcagctccctacagtacttcccctatctttcttaatgcttgctgctctgcctaagggtgagtccctcccagcgctctctcttctgttctagcagttcccagacccagcttgtgcaaaagagggagctaagaggcacaccgcaggcaccatggtccgcctgttggcctccgaagtacagcagctactccacaacaagtttgtggtcgtccttggggactctgtgcatagggcggtgtacaaggacctggtgctcctgctgcagaaggattgcctgctcactaacaagcagctcaggaccaagggggagctgagctttgagaaggaccagctgaagatgggaggcgagctggataccctgcacaaccgcacggactaccgcgaggtgcgcgagttctgctctgaccaccatctggtgcgcttctacttcctcacgcgggtctactctgagtacatggagagcgtcctagaggagctccaatccggcaatcacgccccagatgtgatcattatgaactcttgcctctgggacgtctccaggtatgggcggaattccttgagtagctacaagcagaacctggaaaacttgtttgggcgcatggaccaggtgctgcccaagtcgtgcctgctagtgtggaacactgctatgcctttgggtgacaagatcaaggcggccttcctcccacagaagtgtaagggccagtacccccggatctcggtagccaccctgaaaaggaaagtgacccaagccaatctctatagccatgcggaagcaacaaagcactatttcgatgtgctggacttaaatttccacttccggcaagccagaaagcacctgcagggagatggcgtgcactggaatgagcatgcgcaccgcaagctctcctacctgctgctggcccacatggccgatgcatggggtgtggagttgccccagagagactcatgggagcctgattttgaggcgtgggaaagttcaggccaggtagaggaaaggcagccccaagacaacctaggacctcaggtgtttgccccttctccacattgtccttttagaccacctccccttctcccatcccctggcttgcccataaggccccca

SEQ ID NO: 23613 - DNA, 1176 bp, Mus musculus
agttcttctgacctccacgagaccccctcccaacaagtaaacgtaataagtgattaaagtaatacagacagaagtggacagttagccagggagagggcttggcagtggcaaaagccgtgcaggcttgctgacctgaggttagtccctgcaacccacgtagagcaggattcggtgatgcaggtgtgaaccccagccctctgatagcagctagtctgacagtacggcagctagtctgacagcacggcagctagtctgacagcacggcagctagtctgacagtacggcagcagcaacaagagaggctgccgcctatttggtgcttacttggtaatagggaaggttatttattaaactggaaaaccactctgcatagcccctaccaacttcgtaaacgcgatttggcaaatctggactggattatccagccgttgcacgcctggagagtgcttagagtttcacattggactctcatgcagtgctggcccctctcttcccttgctgtacttttccctcacccacagaacgcattctgtcaggaggatcctgtctgtctgtcaggagggtcctgtcctggctgtctgcacttcccctccctccccccatggactgcctggcagcctgcctgtcctgcccttcctgctcttggcagttgacctttcacctttgtaactaattcccacctttaggtacctgggaaggcaaagagttttattgtttgtgttctcagacatagtatgttcctaagtctgtctgggtgacaaattgaattttaacttttaactgggatgttagctggaagaacatagcagtctttttaaatttgtgaccttaagatgggaaaacttttaatatgttgattaaagaatcaattttaattgttttagaaagcactcaagaaggtttttattgaagaaactggcaatttgatagagactgttgatgcaccagatagttctgccactgtccctgagagtgatcgagcaacggcagctgtgggcactggaaccaagaagaatccaagcgagggcgtctctctgcctgcaggggataggccaagagctaaagtgttgaaaatagaagcagtcagtgacacttcagccccacagtgagtatagtccctgtccctgtccctgtctctataacgacggtcaccgcactggcagtctgcttactgag

SEQ ID NO: 23614 - DNA, 1177 bp, Mus musculus
ggtgaccccaaccataaaattattttgttgctacttcataactataatcctgctactcttatggatcataatataattatctgatatgtgatttcccccaaaggggtatcgatacacagtttgagaaccgctggattaaggcattctgatattgctagaattaagtccaatcaacacctcacctgattttcttttctctgccatatcttggctccccagtaaaacatgactggaccttccaggaccgagatgcccaattctacaggttccctggaccggagcccgagcctacaggaactcaagatgtggaagaggagcttgttgaggctatggccctcctgtcccagcgagggcctgatgccctactcaccgtggcgctccggaagccgtgagtgaagagcctgcttctgctcccattcccacatggccttcagttcagattccatagactctctgattcatcttggggaaaggacctaggcagtagaggctcagcccccacatcccagaccatctctcctattcctgagggtgtagggccagaggatctaaaggccctacccactggcagaggatgtggattttggacagaaagaggtcaggattcaaagtctagtccaaccagctagctactcactgggtgacttgggcctctccagccagcttccttcctcttctgtcaagtgaggatcaccatgctcatgtcctcgtgagagtggaatgaaacagtccacagacagtgcttagcacagtgcccgtccctggggctcacccacaaagcctgctattgataaccattggcttgactgattgctgtggagtggccagttggccccaggccccagcgggcaggtggcgtggcatggcgcctccctggctccggtccacgattctcagggcttcctctgctcctgcagcccaggtcagcgtacggatgaagaactggacctgatctttgaagagctgctgcatatcaaggcggtggcacacctttctaactcggtcagtacacacaactggcttgttcttcagccagaccccttcctactgctagatgggaagtgggggaggggaggaaggagggaggagggaagtttcctccccttgtctatggctatgaggaagacctttgtctaaggtcttcttttttaaattacagtttttaaattgttttatt

SEQ ID NO: 23615 - DNA, 2160 bp, Mus musculus
ggaactccagaaccatggcagagtatatgggcccgttcagtttctcagaaatctgtctggtccccttttggggaagatatagagctgttaaagggatactgccaatctgcccaatctgcccgttagcccagctagagggcagcttagacctttccaaatagatctattttcttagccctctgagggatctctgtaagtagggccacgacaatgaattcaatgggtaggattggaactatggctagtgacaggggctgggacaggcttccttgctaccccagacttcattgaagctgtgtgtgggggaggcatcaaaggtctggtcaagagaggaatctttagtacagatctccatcccctgttccccaccctgttaccctgaagtgtcgggtagccaaactcaccggtccttagggaattgacaattggctccttccctaagcagcacagttggacagaatccagcgtccgtccgtcctaccttcccatccagagtttgtttcccatgagggtgctagcgccagccaaccattcccatgtgtcgcatatgcacacatgaccacacacaccagagcaggactcctcggatgaggctagacttgaggaccacaggaaacacacccctgcacttagaagggctttgggatcgggggcaacctggtgggggcaagtgggagctctccatctgtactgagtctccaaccttgcccctcactgcacaagaccaccctgaccgtgaggacctcctccctgcaccagatcctaactctgacctttcaccttctctctctcctgaaggaactcttctgagtggacatgggcccaaggccttacctaagcggagagggagggcaggggctgctactcttctctgtaaccttctctgatgggttgtcactttgcacgtctactcttccacttgggcactgcccccagctctctgccttacctgtgttatgggcacttaagcagaaatacagcggccattttaaccagcctcagggtgtttctttgggggggtgggcggttttgagaggggacaagagtgggcaagatgggggctctagctgtctgatcatctccctaagtttggggctactagacggtattcctcatctctggtcccctatggggagaccaccagctgagatctcctttgctctcccagttctgtcccagccagggttaggatgcccacagactcaacatccctgcagattccatctccccaccctaagccaaggtagatgggaaagggaatctttctttttctaccccagccagactacttggggctccaagttgaccaggatgtgtggattcagaagcagaaaggcaggagctagcacctctctcacgctgggtacacttgtcctggcctgtgtttgcctcaccctggcctttacagtgtaaaaacaccatgggactttagagcagggaaggataaggaacagtgtcacttctagagccttctgctggtagacgctcctactgatagaggaggtaaagactactgacctcccggctaggcctggcttaagccaggcgtgcctgcgtcacaaccttttgcggtgtcttagcaacctgaacctgagatcttattcccgaatcccacagggcccaatgtgcagggctcagcctggggccatctcccttttcacctgggttggtgagcatgtatttggagtggtttcttcctgcatgtattagccaaggaaggacaagggactagagggtctgagttaggtccagacttgtcccctttccccagcccatcacaggatgctgggtgcacacccactccactgacgatgtcccaccaacatccaggaggcgttctcccaaggactttaaagcaaataaaacatatattgttcagaagtttgtttttttttttcacttttttcttttttacaaaaacatgcatacatagacaaggtacggtggggttgtgggaagacacacacacatataccctcttgcacgcactcatacacacacatacacacaaatactctttcttggtcccagacctaaacctcaaaagcctcgaagacttctggggtggcctcccctcccccatgtctgtctactctcccatcttgttcccctcagccaagctagtcctatgtggggcagcagccagagctgaggggtggg

SEQ ID NO: 23616 - DNA, 1113 bp, Mus musculus
gtcccccacacaggcattccccaaagttctgaagacagtcctctgttcccagcatccctgtgctctggcgggagtcacactgaatgaaggactgtggtggctgttaggtggctgctccctagtttggtaaggctgaagccacaggcctcaggtatgggaaaaccaccttgggttctcctaagccctgtgtcatcaagggagtgacctcaggaagccagtacaccagaactggggatgtctaaggcctctcgtgggccaggaatatgttgccagtggaggctcatactcgactggaatgatttcttgggtagctaccaggcattgtttactgcgggcgacatctggatgcacagttgccctctcagagtgcttagtaactggagggccacagaaggcctcgcagtacacttctctcgtgtgacacccctttgtgacgtcccacaagctctttccttgcccagtgggagccccttccaaaggaggtgatttcctgagtgttggtggggaaatggaaccttgggctagacaggtctgcatactgtcccctctctggccctggctgggtggctccaggccctcaccctgaccctcactgggataacaaatagcaatcattagcatccgaggcaggctggctcggagctgaggggggttttgttacacgaacaaacgcaccacaactcttaaggttgtaacttctatggtcgtgtcaggctgctggctgagtttctaaactttctcattggtggtttgcaggggatcttacccttccctgttggtgccagaccccatggagagctgtggtgctctgtgaggggaaggcctctgggggggggggagttcccccctctcttgtattctcatcctttcccttccatagggccacctcctaccctgaagcagccccacctcccagcatctctgcatccctggctgctcagcctggccagctggctatgctggcacagaccctggtctgctggtgagctataaatagctcctgcacccacggccttggcaaggtgctcctggcgtgggtgcagaggacactggagaagaggcagctgagcctgctgtccttgccagaccaggcccacagctggctggcgtagg

SEQ ID NO: 23617 - DNA, 1214 bp, Mus musculus
ctggcttctgcgggtactgcatgcatgtggtgaacagacatatgaaggcaaaacactcatatatgtaaaaatctttttttaaaaaaattagttctgggaattgcaagagtgagcttctttgtaaatgatgcaagcattgctatattcaacccctgcagtccttcagggtcagggtcaacttcacccatcccatagtgtcttcatggtcttcattgctatgcctcaagctgtggaaacactcccctgcctcactgcagtgctgtcttctgatggaccacttcctggattgggtccatctctgcagggaccaagggaaggtggcagatgctgggaaaagtagtatcctgtgaccacactccacaggccctctgtgtctggatgtctccttgcccctaatcctgcctgtgcaagagtgaacatgaggatgttcccaaacaggagcctctaatttacctgaggaccttcgttcccaccccagaacaggctgaattcctaccctgaaaggcccttgtgggctgggggttgggctatgtgatggtaggaaatgtagactggatggtccaaagctagtctggaaacaccttcacacaccaggtaaacacaggtgctgcatggcagctgggcagtggtggcgcacgcctttaatcccagcacttgggaggcagaggcaggcagatttctaagttcaagaccagcctggtctacagagtgagttccaggacagccagggctatacagagaaaccctgtatagaaaaaaaaaaaaagaaagaaagaaagaaagaaagaaagaaagaaagaaagaaagaaagaaagaaaggaagaaggaaggaaagaaggaaaagtgctacatagctaaaatataaatgtttaacttaaatgtttggtattctttaagtgtcaaaataagtgatcattatggaaaaaattggaaatttagaactcttcaccattacaactgctttttaaaaataccaatctttcaatgattagcacttgtaaatgttttaattcaccactactaagggttctgcatcgtcctcaaataagagaaacaaattttccctctcccatagcccttggggctagaagaacaagcctgtgcagtagaagaccagagaactcagaggctttatttgagcatcagagctatcagttgctaactaaggggaccctggcttgtcttccctgtatcccacttgctcacctcagcct

SEQ ID NO: 23618 - DNA, 3839 bp, Mus musculus
cactacacaagccctggcagaccctaaagtctcgagcagtccgttccttacaagcagggctgcatgtgcgagcacgcacgtgctgtgggagggcccccagaagtactgagcgcagcagccgggccccagcttcagtgctgcctgcttctgaccaagaagaaggaccttggcggttagcatcacacgccagagtaggatgaatacaggtctaggtggtctgtggctagttagtttaaatatgcttctagcctcagagagttttatatacatatatgcctatatgtgtgtatacatacatatatacacacacacacacaatgtgaaatatatatttcacagggatatgtttttaaaagttaaaaaaaaaaaaaagactgaatgtgtttaccatttagtctgtaggtttattttcatctttcaaattccagcacacagtgatcccagcaagccctgtgtatcgggcctttgtagatttcctaagagtgttttgagacctggatgaatctggtttaggagtaaaggttatcaaggtaaatgatgctgtcagctgaagatggggtgaattagacaggtaaacttgaggtttttaaactgctctttgttgttgtttgtagcacctctccccctgcccatctcagagctcctgaggtgagatggtgaggggacacagtgccagtgtcgttttgtacttaagttccacaacagggacgtttttctactttgtgtatggtggccggtagttttctatgcagtcttctccccgattccctgcgcccagccctgccagcactgtgctctctctccttgggcttatttggaaattttactctgttttataccaatcttgtttagtacatttttctatgttttaccacaagtcacaatttgaaaacaacaactattttttttactactccattgttaaatgaatgttaccgtctccactccagcagcctgtgcccctcttgcctccccctgcatgttggggatgagggccactgtccatgtgtgtctccttctctcgctgcctctccttccccctctcctccctttctttttctcttggtttcccataggaaataaatagctttctatatgagttgcgggccctttcacagtctcttttagaaaactggcgtgcagactcagcacaggactcaaggatgttgtctgcttctcagtccttaatgtatttaggtgacagcttacacggtggcagtgtgactacttagtctaaaggcgtccctctcaggcttttctcactgttgtctgaggctcatcacaggatacgtttctgtgtttattgtttgttcctttagacaatatctgctatatcttcctcagagactttttgtatggaccaaagcaacaaatatttattgccatgaatacaagaatatgagacatgcaacagaagcactttgtaaaataggtagaattgttgagccagtctggagttggctcccttctccaatgcagtttaaacgtcccaggtaaaagctagtgatcctaagaccactgtccaccccggagcaagaggataagtcagactgggacggggtggcctcatgggaaccaagtacagacttgtagactgtccttagagtcagccaacaggagcaggacaagtgtcggaaacttcaagagggaactctgatgaccaagactgaagctgtttttgtatttcatggccaagggtatgctacagactatgcctgttgttttccatctgtctctttttcccctgacaacatctccctgatgctgataatcatctccctcccctgtaaaaggaatatgtgaaggatgatagcttagcagttacagacttttcaacaaaacccccagtcctccagcagtcatccctggagtgtacccagagaaaatgacactgcttctgcccttttgagaacatgtgctatgatgtatggaagctggctacatccatttgatcacttgagacccactgtgacccccaggagtcctgtgtagggttcagtgtgagtacttgaacatagatagcctagagactcgctgtcagttcactcttctgtgtgtgaggagtacgtcctcctattctttagactgccctcagcactgctttagcatttagtggttcaaggggacagcagatcaccaccacctggtttatacacccatggtatgaacaatcattactggatggaaagagagagagagagagagagagagagttcgttaaagagctgctttttgtttaaatcttaacctctgatctttctgtgtcatcctccaagctctgaaagaaggtcagagtaaaaacggcggacattgtgtttcgttctgtcttcccttgctctactctcgtgcccaatgccaggtggagtgaggtgctctgcgttactgtcgaaggtcagtgtcagcaccgccttggttgtagcatcaaggctgcacgagccttgctaaatgcagcatgcctagatgtgccctggccttgtgtctgggctggggaatggctgatgatgatgtggtgacgctagagactgccttcccctcgacagagccagctgctaggaagggctaatgtgggagaatggtccccaagagcacaggctccattctgctcaggcattcagtctaatccttgtccaagtacccactcagtgtgtgtgcacccagggctgattaaagctctccctggtcacactaccttaaaatctcttgtctggacttctgtagtcctgatgatagaatggcctaacttctccctgtttgtcttgtctgccttctcatagggggcacagcatggagatgccaaggccaggaggctgggttggtgctgtttttctagccaagagtgcaagcgtctatattctcatctgaaaagaacaaggcagggctcgttctatgaaacatttcttaagaagaatagtgttgtgagggtgtgaggagaattggttatttgtcataacttccaaacactgtaggctcagagcagccattccgacctcaaacagggctctttaacagaagcaccgtcctcatcagtaggtcatgttgccatttggggctctcgggctacaccccaagaggcttatcagaacatctttttaaccccttaggtagttcctcctccgtcctttttattgacagggatatcccttgcacattcagatgatggcttcctttctctttgtcttgtcctgtaaaggcactgccttacctgtaactcacggggaatcctctgtctgaagacttgataagtgtgagaggtcaagccctggacttgggagccctggagggtgagaaaggtgggttaacaaaggaagtaaaagccacctgtcctcagggtcttacagtctgtaagtttatagtttgcctgatttggaaggctaagcaaacacagatacaccttgtcaagaaagaatgcgggctcattagcacacagttcagaatgaagctggagtggaggaaaggactgaggtggagatgtgtcagggatgatctcgcctttatctgtatatgtgactccctaggttttttttttttaattgatttatttaaaataaattctgtggattttgcttctgtgctttgactgggaactccctggactcaatactatatttgtgtgtctctgagactgtcctgtctcctcgtatataggagggtatgaaatatgtatgtatgtatgtatgtatgtatgtatgtatgtgtatatatgtgtgtgtatgtatatgtatgtatatattttcttaacatagatagttactcccccccacaaactgtctgctgatccaaactgtacctgtgattggatcttcattatggtctgggtttctgaatccaccccttaacca

SEQ ID NO: 23619 - DNA, 1275 bp, Mus musculus
gcactcaaggggttattcagcattctaatttacaagtcttatttttgtactccttatcatctgagtgattaaataattgcttctgactttctggtttcctagtcaataccttctcagcactgttagcccaccgtggttttccacagcatgctatctctgaaagctgagtctgcttgtcatctcccacgcacagtcattaatgcatgatatttccctatcttcaggactgctagagctttggcagaaaatctgagatctacatgccgatttgagaagtgtgtttaagatcttttctctctctcccttacagacagttcaagaagaagagaaggagatctacagacagctgctgcagatggtcacagggaagcagttctgtgtagcgaaacccaccacacattttccgttacgcctgtgagtcacgaacgcatctttcgtatgaacgtaactgtacagtttgctacttgatattgaaactgcactcttcttttactaggtctcggtgtcttagttccaataagaactctttgaaagactcgctgttgagaaacggaaactcttgtgcatctcatgtcattggttctgatacgtcatcctctggatctgccagcattttaactgcacaggagcagttgtcccacagtgcacattccctgtcatctggtaccccagatgttgcctttggatccaaagactctgatcctcaccatcacctcgctgcacctcatcagccaaatagcttaccagcatcaaatacacagtccgaaggtaaataatactaacagccaggtaactcttcattggatctgttgtaggcaaaactgtagtacatataactcagtacataatagattttaattgaatacatgtgatccaggtagctaagccgtgctaacaccaagcccaggtcagattcgttcctctcttccctcctttctcttccctctccccctctcttgctctttaaaggatgctcctttctcctacgcacccatgacttgctatactatttgatttatttctaaagggctcttactatgtatgtgccctgcctgcttggcacttgctatgtggtaggctggccttgaactcgtgccagtcctccccagagagctgggattacaggatcctctaccatgctaggctaaatgttttaacttcctgagaagagtcaaagctcactcagcccagctgcttcagggattgctttttgtttctcttactttataatgcacgtgggaggttctctgcagttctgtggactctcaaacatta

SEQ ID NO: 23620 - DNA, 1213 bp, Mus musculus
cttcttacccatcatcctgggttttttttttttttaatattaaatttcttgtacttaagacattaaaagttctctttgggggaaatttcattattttcaaaacaaactatagggctggtgagatggctcactggttaagagcactgactgctcttccgaaggtcctgagttcaaatcccagcaaccacatgatggctcacaaccacccataatgagatttgactgcctcttctggagtgtctgaagacagctacagtgtacttacatataacaataaatctaaaaaagaaaaattaaaacgataaatcaggctggattttattcttgtgtaggttttgagctgcttgttagatgctctcagtcaattctaaatggagcagtgtcttcacatgctaggaaggagtggtattatttgtctgtataattcctctctgagaacagtgttttaggggaaaagattgcctcacaggaaagtgttgttgaagggctgtgtcttgctctaatctgactcttcccctagatgacacagctgatggggtgaagatggacgctggggaggtgaccttagtgaaccacggctccactttcagaacccaccgcccgccacagtcaggctttccagaggagcagcttctgctttctgaccagcaggttagaatccttcttctcctttaagtaactaattgttttcctcactataaatgttcatctgagacagtttgaataccacactaaaaactccaagcatgtgaactttttacaattataattttagtggtggatttcttcttggattaagaaagttaagacaaaacatggtgtgatggtttgtatatgctcggtccagagaatggcactattagaaggtgtggctctgttggagtaggtgtgtcactgtgggtgtgggctttaagaccctcatcctagctgcctggaagtcagttttctactagcagccttcagatgaagatgtagaactctcagctcctcctgcaccatgcctgcctggatgctgccatgttcccaccttgataatagactaaacctctgaacctgcaagccagccccaaatatataatgtcctttataagacttaccttggttatgatgtctgttcacagcagtaaaaccctaactaagacagaaattggtacatggactggggcattgctgtgataggcctgaccatgcttttgtttagaagaatgtggat

SEQ ID NO: 23621 - DNA, 1070 bp, Mus musculus
accatgtggattctggggttcaaactcagttcatctcacttagcgatgcctttgttcactgtaaaacatgtgtgatgctgggcgtggtggcgcacgcctttaatcccagcactcgggaggcagaggcaggcgggtttctgagttccaggccagcctggtctacactgttagttccaggacagcctgggttatacagagaaaccctgtcttgaaaaacaaaaaacaaacaaacaaaaagaacctgtgtgatactttacagttgattggtattgatcttgagtagtgtgttatgcagtcattgttagcatctttttcctccctcggtttaaacagactctgtccctgttaagcctcccccttgactctcggtggtcgctctttcacttcatgactttcctagtggaaatgagctaagagaggctcttactgttgttgatcttgttcactgatctaagcgggggggggggggggggtagagttaccttgagctttggtgaacattgtcagttgtagcttattgatgtcctagatgctgctgacggactcttctcttttccccaggacttggatgttgtgggtgatggcatgccatgcccgccgtcgccattgctctttgatccttcgctaactcttgaagatcattcagtcacagaaagtgccggagacgcagtgggtatctttaacaatgactgtcagctaggctccctcatgtagtgaccaggccaggcgttggctagcatgaattccagggagtatcgtgattcccaagtagagagcaaaagtgcccaagatgccataaaatggaaatacccgctttaataaaacaccacaacccaaagcaacttgagtagaaaaggacttattccaccccttacttcaagccgcagtccgtcaccggggaagtcagctgggaagctggaggcaggagctgatagagaggcataaaacaacttcttttgcttttgaatgcttgtcggtactaattttccagatgaaccgcagaactcctaatggttcttaatcctcaagagggggcatccgtttgtttgagtgaaaggtgatagatacat

SEQ ID NO: 23622 - DNA, 1066 bp, Mus musculus
tggctggctctctcctgattccagtttattttgtctgcgccacagtgcagggcacagttgggtgggtttttcctcctcagtgctccgaccctcacagagcccagaagtgctgggcttggacagctgtaatagctgcagtggtgactgaggtggtaggtcataaccttagggcttcttaagtcatttgcgtagcatgcttgaggttgcagctaccactccagaaagcttcattgctaggagctaagttagttgaactggggatttagcttggtgttggagcatatgtgtgtgactcaggatttattccctagtactaccaaaacacttgatgtttgaatcaggttcccactatgtagccccctggttgtcctggaacatgctgtgtagaccaggcctctcagatttgtctctgccttggctaagattgatacattgaccacagtgcctagttaaagcatgagtgttcattaatgctgccaagggctcctccaattcctgtgccatcaagaagaaagatgaactggagtgtgtggccaagtctaaccactgatttcccagctgctgcctaataaactgtcctttggaacaattccaaaaaaaaaaaaaaaaagcatgagtgtctttcctccttacctctgagggatagactctaaggtacctgaaggagccctgaaactttgtaggtatcatcatgcaggtgttatatgcttatgaataagccagttatggccatataaagttaatgtaagctatttacaatttagagataattcctggttaagggacagactgctctttatatcactgtactgtgtggagaggtagttttaggattaggattaactccattctgtatatataaggtttcatggttacagtattggtggttgggtttgttaaatgttacattttccactttgtacgaattgactttccttgtataactgaataatatcatagttatatgtttttttggggggtttatttgtatttgttttctcaattttaggctcacaccactcgttccagtcagaggtgcttagcctttgtggatgatgtgcgctgc

SEQ ID NO: 23623 - DNA, 1213 bp, Mus musculus
atactcatgctaggaaaagggagaaacaaaaccatcttgagattggaattcctgttttattctcctgagatgggagaacttaagcagtctatgcaacccatcagatggtgagaaatagctttctaccattccactgagctctcagtgaccctcatacgtcctcaaatgtcttggcattgattgaggtttcgatcttgatgtttaggaagcattctcgctgcaccacactgtcatttctttcttactcctcagtggatggaaacttggaagaagagtggtactgtgatggtacctgatggagtggtccaaattcccagttgtttcctaagtgggtgagctctccgttttagtattctaaagatgttaacgtgaacttggcaatggaaaggggaaggaaaataatatttaataaaaatcagtgtctacgctttccctttatgagtgtgtattcctggttgtatgaagagaaactcatgggttttgtgttgccatgtgaatgtcgagagggatgcttgacagcatgttaattgaagccagagcaagtatgtctgccgtcaggtaatctggagatgccagtgtatgctgagggagtgattagctgatggctataatgaagtcacttacaaagcagaaaggctgtctggccggccgaagaacccaaggaaagcagtgcagcagcctcactcacgtaggtgtgatttagggttctgaactggaaactgatctgtattacctgactttccacaactgtccattttcttatcagaccaaagaacaaaaagaaaaaaaaaacatgaaaaagcgaagtaacacacctttaccggtttatgtcactcaggtacaatttcgtggggaggtttaggtttgttttgttttgttttgttttgtctgatttttgtactgctcagcatattattctgctgtcgcctctgtcctccgtggggcacctcagttttgggtgctactcctgggatctctactgctgttaggtgaatgatgataggatggaagtgaccattatcataagggctctttgtaaaaaaaaaaaaacttgaaaaactcaaaaaaattttaaagaaggatattgtatacattttatagtctggctatcagtttgatatcttgctgtcaagtatgtttctcaatctgtatttatccatcccatcaataaacgttaatgataaaatacctgatccttgtttgtatgttccgt

SEQ ID NO: 23624 - DNA, 1165 bp, Mus musculus
agagattcttaaagtccttttaaaaaagtggatcaggaatcctgttatgggccttgattgttccagacattagaagtaaatatatttgatgaaggaaatcttgaaaaaatactgactagataaaaattgtaagccaagctttctgactgaaaaatgctacctagccacagatcattgctgttatttggttcattgcatgagtgtgtatgtgtgtgtatatatgtatacacatatatatgtgtgtgtgtgtgtatgtgtacacacacatatatgtgggttttggggggtatggataagatggtgctatgaaaataatttgtctcttgttttaattaatgaagcttctgtcatgccaagtagtctttagggagaagtcagaatcttttcattaaaagtcatagggaaacagaagttgtacgggtgctgcttgccaaggacagactagaaaagacactgaggcagttactagtgctgacacactggcccaacggagagagaatgtatgggaaggaatatgtcttacttacggtgactttgtggttcttaatctgcatgtttgagttgtctgcagcgcctgccgttgctgtgcacaacaaggagctccttgctgataaaccagtgatatttcttgatgtgtaacttttgaagtaacatttctttcttggtatttcctgtgttgtgcaagatagatgtgtcatcatgattactaactttaggcttggtatttgttgagattttgttttccatcctgaccttcccaaacggaaaagtaccttttagtttgcatctttgtctgtgatgatttgatttggggacgtggactgtttttttaatcactctcattaatgtcacgtgttttctaatcacatgcaatcccttagcacaaaggttgtcatatttggtgtcatagcatttcttcacagtaaacctgttgttaagtttcctagaactctgtagtggactagaaataactgcttactagagtcttctaaagagctacttcatgctgtagtctggtcttctactgtagctcaacactgagtttgattagttgagaccttactatattagttccttctggtactgtctatagatagatgcagtgtctgcttctaagtcagtgcgtaggtcctgaactccctcgtgggctctgcatgaacttctg

SEQ ID NO: 23625 - DNA, 1926 bp, Mus musculus
aggaggccgccacactgacctgaggtctcagtgtgctcgaatgctcacttgctgcctgctggcaggggccatggaacatctctatcccttgtattgccaaatagcaaaagggtcagggttccaaaaaagatgacctgaccccaaacctggcctcctaagtctggcactagggaggtcctgtgtgtttgtgtaattgtgtgggcctgtgtgttgtgtgtgtatgtgtgtctgtctgtctgtctgtctgtctttgaggtctccatgtgtcctcatgctccagttcctcagctcttcaccggggactgcctctctcccgtgggcctctgtcttctggcgttaaggccaagtttcctgtgccaagggatggagagtaatacccaggttgcacaggaggttgggtggtgtttggtagtaaaatgataacggtctggggagaggagtccttttttgtgccaaatccctaagtgccatttgggggccacatatctgcactatgactgtccccctgcctagggcagggacccaagcacctgcttaatctctagtgttccttggaacttgaactgttggaggtttgtgggtagaggtgcaggcatttcctgggttcctgggcttgtctcttgggggcatggtgtgctttctgactggggtagtgtgggatccctctctgaggaccccgatgttggtactaggggatgggaacctaggaacttggaactgggctgccccaagccttcggcctgaatctaccatggctagactctagccccggctcccaatcttcacgaagcctgcaagggttgtactctgtcctcgcctgcccttgcctgcctctgacccttgcagcctccctgactctggtctgagttagctggtgccttggtttctctgtctgcatctagttaagccagaggcattacgcctccatgtcgactgatgatcttagacgtgggcaggaaaggcagaggagagtttcaggaggtgcggaaggggcaggctgtactttggcccttcctcaagcttctgccacccattctctgcagaggcctgggttctggtttggtactgctttcctggaaatctccatgtaccaatcggtggaccactgggcgcttgattagccaaggcagaggagaggaagatcagctggtccaggcagaaaatttcctctgtctccccgagccatatcctagccttggataggaagggactactagacgccattggggcaggtgtgaggtatataagccaaagcagggagaccttggctttgggtctgcttcttgccaggtgggaggggcttgtccacaccctggctccccgtaccacagtgccagccagtcatgtccctctctgagttaccgtagccactctcctcaccatttggggaggaagtcagggcacgggaggcaatgggctctggttttataatgtaaccactgtcggagtgggggagggtgacgtaccatgtatttcagtgaaatatttaatatatttaaatatcaataaaatcaaactctttgtataaaaaaaaaaaaaagaaaagccctgttctctgcagctgtttgggtgcagggttgggggtcagaaagtgacaaaccctggtaaagcaagcaagctcctctcccaggagtctctgggcctctctcatctgtgatctaacagcttcctgtggttttgtgcctgtcaggataaagctgcagcctcctcagacagcatgactgctctaggcctttcagcatcctgagggcaaatgtctcaccccaggtgtttgctctgacccctgccgtgcattaggtctagacctctggtgttgccattatagcccttcacttctctcacaccaagatctagcttcatgaggaatctcacacaggactcatggccttgggataactcccttgcctcctcacacccaggatgcaa

SEQ ID NO: 23626 - DNA, 1855 bp, Mus musculus
ataacgcctgtacactgcatggcggcaaaggccaggagcagcgagaatttgcattgtccaacctcaaggctggagccaaggatattttggtggctacagatgtggctggccgtggtattgatatccaagatgtgtctatggttgtcaactatgatatggccaaaaatattgaaggtgagttgctgagagggttaggagagactgcttatattctctctcagagtcagggtgcactgggagcctctgctttagtctggagtgacatcccagtgtcaaggctgacccttgatggtgtggagagtggtgctggctaggagagccttagtgttgtatgcgacaagtcggcagtggggtggaggatgggcagagtcgcgagcactctggctttaccgggtgtagacagcaggaggtgggtggcttgcctgtggagtggagtggggtggaggtctctgtagaccagacgactggcttggtcccgagtgacatcctctgttccccagattacattcacagaattggccgcacaggaagagcgggcaagagtggcgtagccatcaccttcctcaccaaggaggactcagcggtgttctatgaactgaagcaggccatcctggagagcccagtgtcgtcctgccctccagagctggcaaaccacccagatgcccagcacaaacctggcaccatcctcaccaagaagcgcagggaagagaccatctttgcttgacacagcgcctgactggagtagaagccatctctggagctggtgcctgctctcaggcccttgtgtcccttcccaggctctttcttggacatgggcttaggaagtagtcaggtcccgggtctggaagcctgtgaggggctccatgggcacgggaaggtggtgtaggaggcagaggggcgcagttacatcaggctcggcccagctctgcccctgcagccttgccgtcctcgtcctggctgtggggcggctgcctagcaccaccctgtccccagcctgaacaaacacctggtcacccggaggggacttccttagcacatatgtgtgactgtgtactgctgtagttgccctgagtgacccagggatcgggcatcatgaggattgtgaaccttggactctgtcactctgacagctgctttcccatttggcatttaaagcaggttgggcgcctttggaactgcgcagcccgatgccacgggcgctgtgcactctaggcatccctccctagggattttttttttttttttttttttttttttttttttttttttagatatggggacaggatgagctggctgtgcccatcattaagtcagtggaatttctgttttctattctctgagaagataagtttgtatgttctgagaataaacacaaatattaaagctgtgtcagccccgagctccattctcctctctgggaaacaagtcaggaccgcagcgttagctgaggaagtgaaaggaagacctggcctcctggccagcccgtttatccctgtgcaccacgcggggcacgtgggaggcatggcagcaggatggccgtgtgtgcctctctcctgcttttctgtggagctagggcgaaagggagccgctgaaactgcactggagccgatgcgccgggtcctggattcccttgctcatggggtgggtgcagccgagttgggtctgaaggaccatagatgggtcctccgtctctgccacaggcccaaccttgccccttaaagggaggcaagtgtgtgagtgagttcaagtctcagctgcttgtggagccctctggcctgaggtgggcagtgggaagctttgactctgtcgcttcctcgcgtctcagagcaagtcccttgtgtactgccaactgcct

SEQ ID NO: 23627 - DNA, 1176 bp, Mus musculus
taacctccaatcatgtcttcttcagagcaagactccgcaaacttcgcaaaaaggaggccaagcaacgctgggatgaccgccattggtcccagaagaagttggatgagatgacggacagggactggcggatcttccgtgaagattacagcatcaccaccaaaggtggcaagatccccaatcccatccggtcctggaaagattcgtctctgccccctcatatcctggaagtcattgataagtgtggctacaaggtaaaggggcagactgacccagagcttccgctggctcctcctacgttctaggactgcaaatgtagttgggactggagagctctgttccttcaccatccttcgtcttctctgcccacagcaccaaacttaactatgcctgtcactttgtggtggaaatgtgggcctttagggcttgtgtttttccttgggccccctttcctatgtgtctcgggtatatggtgggagcatgctttgcccgctgggttagctctatcccagatggtgtgattctctacccattacttttattctgggccactgtaggagccaacacctatccagcgtcaggccattcccattgggctgcagaatcgtgacatcattggtgtagctgagactggcagtggcaagacagcagccttcctcatcccattgctagtctggatcaccacacttcccaagattgacaggtaggctcagctcgccatcagttgggtgcattgctgggtacgacataaggcaaactagaatcagtagctgttttgtttgtcgtctgttgagagaaccttatatgccctgggttatcttgtagtctgatttttacatgggatcaccaacctgcccattcccatagttgctctaagagtaactttgtcttgttcctgcttgtggtcaatgagaccaaagcttatggagatgtgggataccccatttaccacaggatcgaagagtcagaccagggcccttatgccatcatcctggctcctacccgtgagttggctcagcagattgaggaagaaaccatcaagttcggaaagccactcggtatccgcactgtggctgtcatcggtggcatctccagagaagaccaaggcttccggctacgcatgggctgtgaggttagtttctcaaatgagctctaattaattacactaatatatactaa

SEQ ID NO: 23628 - DNA, 1199 bp, Mus musculus
ggaatctgctgccattggagacacgctccacatacactacacggtgaggggcttgggggtccggggcgtggcctgggaggggcggcgcccggctgaaacacgtcagctttggcttggacacgtggcaagctatcctagagaacttgagtcctaggatcagcccgcacgtgggggcgtcctctcgcctgcttctctttcttccttgttttctgccgattcctctccagcgctgagaaaagaaggatagagagagctccaagaagcgccagccccgtggggcttcctgttccttcttgcccatggtggtggtgggtggaaggagatggggacaggacacaagtttgttaaaggggttgcttccttccgggtggtcccaaattgtgggaagaatggtgggtttagacccaccatttttttttgtcttcagggcagtttggtagatggacgcattattgacacttctctgaccagagatcctctggtcatagaactcggccaaaagcaggtgattccaggtatgtgccccgtgcctctgacctctccctagcctaagcccttgcttgcttgccggctgtattgctctggaacagccgctagaatgaaaaggatcccaaggctctcccgctacctcagactccacttctaacactcttcttgccccacacatcactgcggcagagagtctgagaagtggagctaagctcatttgatgacggggagcctttgattttcctcttgggtactgtggggaagatatgtagcttctagttcagttttgccttcttcctcaaggtctggagcagagccttttggacatgtgtgtggggtgagtatctgaaggccggggcctgactgctcctttttccgggtagaaggtttctctgtcatcccttctccagtggcaggacgttgtagagtaaagggcccctgacttcatactggagaggtgcaggttaatgggaaccccccccccagggcatctctccagctgtcagttttgttgggggaggctgagtgctgtggggagattggtgactttgctgatccacctgtcaggtggagaatttcatattttggtgtcgctatctgaggaggggggtaaggcacttcagatgggctgaggctgccagctcacccccctcctgcctgcaatccctgttccttccctcagagagaagcgaagagcagtcattccttct

SEQ ID NO: 23629 - DNA, 4725 bp, Mus musculus
gtagtagagcgagccttgctcctgctgctgaatcacacacacttagaaccctgctcttccctatctaattccctggccctgcagttctggaactactgggcctggagcagttccttcagatcttgatctgggtttcctgagataacgagaaggtggccatatatgcgcctctgacagatgggtgcgctttgtagagccttgacagatgctgaggtatctctctgtgtgtgttcctttgtgctgcaggatttgccgaatgctatgaatgctgctgagatcacagacaagctggggctgcactccctgcgtcaccgcaattggtacattcaggccacctgtgctaccagcggggacgggctgtatgaaggcttggactggctggccaatcagctcaaaaacaagaagtgagagccaggcagccctctctgactaccccacccactcctgacacacacctgctgtctccttaccccaattttcccttcttcctcttgaaagtggccaaggtcctgggtatcatgtccacatgcccagcaagcgccttgccttcctcctcctcctcctcctccctcctccctcctccctccctgtacactgacacggtcagcccccaactgctgtcctgatgatgaatcattccaatttactggatttaaaacagaatgaagctgttacggtttcgtggggtggtccccattggtttcaggaggaagagtggggtgttctctgtttgctgtttggcactggttgctgtgctcttggcatctgagtcccttccctgtgtccctggccactctcctccctgtcttcctttccttctgaaccctctcctattctacatggacattgcacgggcctctctgtgtgtgcgtgcatgtgtgcgcctgtatatatgtgtatagagagatatatatgtagggtcaggggagggagcacagcgcagctcagggcttacagccgggacactgcgcactggaacctgtcccctgcccttctgtgttggtgagataaggggatgtgggtgggtcccgttgttttcctctctgcaggtggcattcctggatgttgggatacatgatgggcgccttcggccatctgtcttacctttccttctccactatgatgagcacacgaagtggcattggtctctgggtgactgttcctaaggagctgccgtgctactctgcctcattagtagcccactcacgctatcagtctagagtgttgtattgatcctcccccaccgtcctcagatctgctcctcaggaactcagagggaggtgggttagtgggacctgcatgtagaggtggacagtggtcggggaaggcctagttttccatcttactgtcataaggaggagaaggtaaggcatggagcagtcctgttcctgccttctggtctgtcagagatctttccccttagtagttctgctggcctgatgaggactgaccaagtggagtaacgagaagccatggactgggggtaacatagccgacctcagtatcaactccctgttcttcagttctctgtctagttcaggaccaggaaagatgagtttctgttgtcctcgatgtcctgtccccctccttcctggcagctttccccagtcctcaccctgtcctgaataggtctgtggggttggagtagatgccgtaggaccctgcatggctgagcctggaactgtgatcttcagggccctccctccctccatcctctgcttgttcagctgctgctgcaggtctgtagagggcgcctattccagaagatctgacctgggtcctgacttgtcactgcactgaagctgtggctgttctgtgggctcctgtgtgtgctggctgcgccctgagctccaaaacagctgcccataacctctctgctaaggtcaggaccctgggctctctgcagcttggccaagggactcttcccagaggcctgttctgagttcctccactcagtggccaggtttcttgccacctttgtctatagcaggcagataggttccccagcctaccgtcagctgagctgtgcgaggttccaggatgtctctcagtgcaagtagtgctgtgataccccagacaccatgtgagcgtgtgctctagacctggtgtgtgtgagtgtgtgtgtgtgtgtgtgtgtgtgtgtaagtgtgagtgtgtgtgagtgtgtgtgtgtgtgagtgtgagtgtgagtgtgtgtgtgtgtgtatgtgtgtgtgtgtgtgtgtgtgtgtgtgtgtgagtgtgtgtgtgtgtgtgtgtgtgtgtgagtgtgtgtgtgtgttctctacatgggggtgccagggattctgttccattttaaatgggttccttccattccctgcattcctctctttactgttcctgcgtccccctctgtcgacctcactctctctgccgtttctaagcccctaccccctcctttctgttgctgctgtgagcgcctgtttgccttctccgttcactcaccactttgcctgtttggttttggttttgtcttctgtttgattttctgctctatctttgctttgagattggtgaggactttgccttttgctctgccacactttctgaccttcctgcttagatgctagttccagataggttttgtacattgcagacatgagtccactcctgcaccccttaccagagcttatttttctccacctcctgggaccaacctgaggctgagcaggctaaagcagccttgaatgttgccttggtgcatgctgctccagacacatccagcagggagcagtagcaccttggtaacatccctggctttgtggggaggtgggggtgctttctacattccctaatccatctttagggttgggtgtttcatcccatttctgtgaactccctctcttgcttttctcaagctggttttattttttatcttgttctacctttctttctggggacttccccttccctccacctccagagtttgtggtgttacagtggtatctgcagttctgaagtgggtttttttctttttgctttctctggaatgtagactgtacatgtttaataacttgccttctctatccttgctcaaaaatgtgggataatgcaatgactgtgccctggttggaaattaaacttgttttacgcagctctggcgcagccctttgtccttgagcaacactgcggcagtagggagctgtgtggtcctttccacaccgttccttttctctgcagaggtgggaagacacacctcagcgcgtggagtcatggcggaacgcaggtttattgggactgcggttatggttccttcttccctcacaccctgaaggaagtctaaacgaatcaagtgctagcatgtgggggctctatgactgaccaactcctaaagagctctgtcctcaatttacctgtatttaccacctgttgacagactttcagggcagcggttctcaacttgtgggttgtgacccctttgagggtcacatatcagatatcctgcatatcaaacatttacatcatgattcataacagtagcaaagttacagtaagcacagggtaaacatctgggcagcatagaaaatggtaaatatctgggcagtatagttttgttttttgtttttttgggtttttttctagacagggtttctctgtatagcctcgaactcagaaatccgcctgcctctgcctcccaagtgctggaattaaaacgcgtgcgccaccacgctgactcatctgggcaggacagtaaacatggggtaaacatctgggcaggacagtaaacacggggtaaacatctgggcaggacagtaaacacggggtaaacatctggacaggacagtaaactggatgccttcctcagcataaagcagccaggtgcacgaggctgtgtggatcctgttgccaggcagctaactcgaagggatgtcttgggtgcatctttagtaaagcttacattcccgttcctgttccattgctctggtgtctccggctgtcactgaagacaccgttccacacagaggaaaggcgtggtgccgccctcagtaagcagggaaacctctccttcccttgctgcagagcttgagtcccacatcctgccatggactgtttaatctgcactcactgcccctcctttctcccgggacaggtttccttttcctccagttaccgtcaccctctcaggaaccattgctttttgtccatttctctgacttctgaacctcaacccatcaccaaccccgtgtcttcaacattactttccctgaaagtctggctctttgcctcctcctggctcctccaggcttctcctgctaataagttaggagtatctttctctggtgctttgtttatttgttaataaatagatcactttctgagctgtattttgttgctttgttgttgttttgagataagatctcagtatagcccaagcagacttcagacttgtttgtttctgtgttttaagagagggtttctttgtgcagccctggctgtcctggagcttgattcgtagaccatggcatccttgtactcaggtccaccagtttctgcttcctgagtactgggataacggcctgagccacgtcagctgccaccacctgcttgctgacctcagacttgctactctcctctgctggattacaggtgtgtgccagcaagcgtagccttggctgtaatacagtgataatagaggccaggtgtggcagtgcatacctgtaataccagcactcaggaggcagaggcaggaagatctctgaaggc

SEQ ID NO: 23630 - DNA, 2627 bp, Mus musculus
agttccaggaggggacagacaggagcagccgctgggcatctcaggtttgagggggatatgggccgggactacccagaagtgtcagggagcagggaggggtgtgcggccgggcctcacagccctgctgcctccaccgacctcgctggcccaattcaaggctgcaaagagacttgactaagcttgacaatcccaaaggccgggtcccacacctggccctgcctgccgggtcctgcccctaccctcacccccatccccttcctctatctgtctctgtctccctcttttcctctgtgtttctgtctctctatgggttgtgtttccttgttttccactctgacaaatgcaacatgatgggaaagaggcagccagatgcccaggagggcaagccgggcaagccgggcaaggagaccccgcacccacacctacctcatttaagtgttggattttttgctgttttgaaatgtgagaccctctccgagccccctactgccctgactctctcccccacctcactgccctcgtctgagtgggtggaaggggggtaggagaaggacaacaacaacaataacaacaacaaaaatccatctttgtttttaattatgggcgtgggatggcggctgaggcaaatggtgatgaagattgggggtgactggtccctagttgctctaggacctccttctccatctggacatggaggcaggaggggcgtgctaaacctaggaccaggatctcgctctcctgttttcccagcctcatcccgagcccatctgccctccagcccctggacggggtgtggggggtagggtgagggctatccctgagcggcgtgcccatacccagtgaggccgggtgtggtccagagctctcacttgccctcagtcaccaaactgctgctggtctggtgggaatgggtggtgatgtgggggtggggagcttagtgtcagcgcggggagggtggggggtatttatctatttatacatgggattgtacatagtcttgtggggcatgggggagccggccggaggtgagagccctcccctctccccctacccccggggagagcaaatgtaaaactactaatttttgtgctttatatattctatataaatatatctattttctttttacaaaaccagtttataaatggtaggggggtgtggggcggacacatggagctccccttgtgggggggccccctccattacccaacctaccgccctttcctccccccccctccccaccccctggctgtgactgctgtaaggtgggggtatagagagaagctgggtgattcttacccgggttgtatagttggactatgttataacgcacaaagtgagctggccccagggggagccagagggtgatggtgcccttatcttcctttcccttcctttccccccccaagcttgtgctgcagacgaacctcttcctgcgggtagcggtagggtagagggtgtgtgaggcctcagacccctctctggtggagcgaggggatgaaatgacgcttctatgcagttctctcctaggggctgtgggcagagggcattttgtaattactattttcaagaatcagattatctggattgtagagatgggctggatggtggcaaatgggcaggcctgctggaggggtagggcggttgctgttgtgattttaggtttttgttttgttttaaatttgggggattgtggattgatgggggtagggagatttttgggttttttttttttttttttttttttttctggccttttttttttcttttcttttcttttttttttttttaaagctgcttcctcaactgtttcaagctgcaaatgtttgagaataacaactcccccacactcccacggaaaccattgtaattagactagacagtgggaacctgggcttgctgtccccaaagccacagagctgaacggtctaggcattaggtgggggagatggtctcctgtgagtcaggctctggttggggtttgggccctagaactgggaaaggagaaggggcagactttgtaagcatatgctaggtatccgatagtcctgtagaatttagtgaagaaaccttatacagtttttaatttttatataaactataactcagacccacgctacaaggttggaattttggttgttgttggttttttttttttttttaaagtaccctgcctgtataattgcatcagaatcccacccccaaccccgccccctgtgtttgtattttgggttggtttacacttgcactcaattttcagtttctccctttttaccttctaccttcacctccaggaccctccccctttaaaaaaaaataaatcgctgacaagtgtgaacccgtgaagaactttcttttgtgttgtgtgtatcctgtacagcaaggttggtccttcgtgacaacggatgaaatggttcccttttttaaagcgctctctcttcctccacccccagcgcccctgtccttggcatgttttgtatcagcgatcattctgaactgtacataatttatgttgcgagaggcaaagggcaagttttggattttgcttcttcaaagtttgtttttaaacgataaataaaaaaagaacattttaaatacaagtgcctctgtcccatgaccctcgccgt

SEQ ID NO: 23631 - DNA, 1105 bp, Mus musculus
tggggaagacctccaagagtgtggcattgagcatggtttgacaggagggtgtagacagtctgaggtgggagagcgggctcagtgtaggggaatgggtgcctcttccctctctgtacctaaccctgtcctgggtgctgtctgctccccagggtgtccagaagggtcccagtagggagttgctgcctgttcaagctgagacccagatgcctctactccacttgcacagcacagcagcaggcacttgtagcacttgctgatagcacattcctagggaggaggcgggcaaggtctgctcggtctgtcgtgtcatggactgtatcaccccccccaggccccataccttgaacagcaccagcatgtctaaggcgtatcagagcaccttcacaggcgagaccaacaccccgtacagcaagcagtttgtgcactccaagtcatctcagtaccggcgcctgcgcaccgagtggaagaacaatgtgtatctggctcgttcgcgtatccagggcctcggcctctatgcagccaaggacctggagaagcacacgatggtcatcgagtacatcggcaccatcattcgcaatgaggtggccaatcggcgggagaaaatctatgaggagcaggtactgtggggtggctggggctgctgtggtggaggggccaccctcggcctaggagcctggggacaggtttgaatccaggaggcagttggaaaaccgtgcaggagggagaagacaggagaaattgggccggtcatgtcagctaagcctgctgccgggtttgcttgctaacctaggttcctccttctcaactgtctttctagaaccgcggtatttacatgtttcggataaacaacgagcatgtgattgacgccacgttgaccggaggccctgccaggtgagcgtaaggacttaagtgtctctggtggccatgtgggtgtcacctgttgtctctgacactgactctgtcctgccatccaggtacattaaccactcctgtgcccctaactgtgtagcggaggtcgtgacgtttgacaaggaggacaaaattattatcatctccagccggcgaatccccaaaggagaggaggtaagaggagagccctgaccct

SEQ ID NO: 23632 - DNA, 1124 bp, Mus musculus
gcctctgcctcccaagtgctgagattagtgtgtgtgtccttgtgtctgtactgatgatgaataaggcagcaggaagtaggttttagtgagcatatattgtgtgtcacagttgagctagtcaagtgattcatacaggttgttctgtccactgcgacccagaaggtaagccttgccattacgtgagtgtacacagacacacagtgactgagtctcgggagacttgggtgtttggcttaagttccatagccattgctcaaacttcaacatactctattcaactgaaagtatgtctgtccgttcagtaagaactgtggctcctgctcggtccctgggccctgtgcttatctcagtattacaggctctgtcactcccctccacattgaaactgctctaggaaatgaggtgtgagtcctgaagagccacgggaactgatggccatgtggcgggaagtggagcttaggatggggcttggcaaatgttaccctaaagggtgctgtctgtctcacatctagctgtgtggaaccgcatcattgagcctgtggctgccatgagaaaagaagccgacatgctgagactcttccccgagtacctgaaaggcgaagaactctttgggctgacagtgcatgcagtgcttcgcatagctgaatcggtaagcaagcggcaaggagctggggccaaggtgggaatacttactggtcccgtgccagaggagtaaggcagccatccctgtgtccacagctacctggggtggagagctgtcagaattatttattccgctacgggcgccaccctctgatggagttaccgctcatgatcaaccccaccggctgtgccagatcagaaccgaaaatcctcacacactataaacggtgagcttgtgcggctaggccatgggctggaggtgtggtaggacctggctgccttctgagggtttgagatgcagatcagagttctttccaggaacctggggagtcgcccttagccctgattagaggcacacaaatttcctggggtaccccttacctcttccctaatcagggaaacaggacagagttctcttgggcaccctgggaatggctgctggggaggttcttggtcgacagtggtgaaacgtatatgggagc

SEQ ID NO: 23633 - DNA, 2015 bp, Mus musculus
gttccaggccttccctcacaaaagccttcagccctgccagcccccgagctgaacaacagcctccatcagacgccccatgccaagggccccgccctagcctctggcttggagctggtcagccgcccaccgtcaaacactgaacttagtcgtccccctctggccttggaggctgggaagttgccttgtgaggaccctgagctggatgacgactttgatgcccacaaggccctggaggatgatgaagagcttgctcacttgggtctgggtgtggatgtggccaagggtgatgatgagctgggcaccctggaaaacctggagacgaatgacccccacctggatgacctcctcaatggagatgaatttgacctgctagcgtacactgaccctgagcttgatactggggacaagaaggacatcttcaatgagcacctaaggctggtggagtcagcaaatgagaaggctgagcgagaagccctgctgcggggggtggagccagtgtccttgggccccgaggagcggcctccacctgccccagataactctgagcctcgcttaacatctgtgctccccgaggtgaagcccaaagtggaggagggaggacgccatccttctccttgccagttcaccattaatacccccaaggtggagccagcccctcctgccacttccctcagcctgggtctgaagccaggacagactgtgatgggcacccgggacactcgaggaggagtgggtacaggatcgttccccagcagtgggcacacggctgagaagggcccctttggggccacaggaggaacaccagctcacttgctgaaccccagctcactgagtggcccagctgcatcctctcttctggaaaagtttgagctagaaagtggggccctaaccttacccagtgggcatgcagcagctggggatgaactggacaaaatggagagctcattggtagctagcgagttgccccttctcattgaggacctactagagcacgagaagaaggagctacagaagaagcaacagctttcagcacagactgtgctgcctgcccagcagcagcagcagcagcagcagcagcagcagcagcagcagcagcagcataccctccttcccacaccaggccctgcccaggcactgcctttgccacatgagcctgggccaccacagcagcttgctctaggtattggaagtacccggcagccaggcttgggccagtcgatggtgcccatccagccaccagctcatgcccttcagcagcgcctggccccatccgtggctatggtgtctaaccaagggcatatgctaagtgggcagcaagcagggcagacaggcctggtaccccagcagagttcacagccagtgttggcacagaagcccatgagtgccatgccagcgtccatgtgcatgaagccccagcagctggcgatgcagcagcagcagctggcgaatagtttcttcccagacacaggtaacttcacatcggcgtgtacgcgtgatgctgctcatcaccaggtgggcactgactctaggtaagggaggtgggacaccgaggacgttggctgaacagcaaagcactgtaagcagaaagtcagagcttttgagagggagatggctggatgcctgagtagcagaggttttatatctggttaaatttgggacttggagagaagtacaaggatatgcaatcccggtgcgagaaaggttgcaggaaaagctgtggagagcagggaatggtagggcagagagtgggctctgctcttgtctcagttggtcgtagtgaggaacgtctcaaactgagggcatcagtgaggaggtactgtgtcagatgctgtttgccactacgtgctcgatttcatcttaacagactcatgcaatgggtctggttggttttggttatagaagaggaaactgagacatgaaaaagttaagtaacctgtctgagattgtacaagtaggggttggatctgaacttcatggcattaacatttcatgagagtgagattagtcctttacaa

SEQ ID NO: 23634 - DNA, 1669 bp, Mus musculus
tggtctagccgatgtaaacaaatcatgaagctctggagaaaggttccagccgctgacaaagccccctacctggtaagagcacgggcgagcttcaggcctggcatggaagcgttttagtggcttacctcaggtccttgttctcctgtcatcccctgcgcagcggggtgaggagggactgagctctggggaggcagtttgatagggagacgggagctgggcttgaggtggacttctaagccctgtgtcctgtcctgtgtccctcagcaaaaggccaaagataaccgggctgctcaccgcatcagcaaggtgcagaaggtgagtgggcggccttcctaggactggggacgcaggtcgtgccttcagtcagcagcctgactgctccacttgctctctctgtagcaggctgagagccagatcagcaagcaagccaagatgggcgacatagcccgtaagactgatcgaccggccctccatctccgtattccctcccagccaggggcactgggcagtccgccccctgctgcggcccccaccattttccttggcagccccaccacccctgctggcttgtctacctctgcggacgggttcctgaagccaccagcgggcacagtacccggccctgactcacctggtgagctcttcctcaagctcccgccccaggtgcccgcccaagtgccttcgcaggacccctttggactggcccctgcctacgccccggagccccgcttctctgcggcaccacccacttatcctccttacccaagccccactggagcccctgcccagcccccaatgctgggtaccacaactcgacctgggactggccagccaggggaatttcatactaccccaccgggtacccccagacaccagccttccacgcctgaccccttcctcaaacctcgctgcccctcattggacaacctggctgtgcctgagagcccaggggtagcaggaggcaaggcttctgagcctctgctctcacccccaccttttggggagtcccggaagtccctagaagtgaagaaggaagagcttggggcatcctctcctggctatggtcccccaaacctgggctgtgttgactcaccctctgctggcccccacctgggtggcctggagttaaaggcacctgatgtcttcaaagcccccctaacccctcgggcatctcaggtagagccccagagcccgggcctgggcttgcgggcccaggagccaccccctgcccaggctttggccccttcacctcccagccacccagatgtctttcgttctggcccataccccgacccctatgcccagcccccattgactcctcggccccaaccaccaccccctgagagctgctgtgccccgcctccccgatcactgccctctgaccctttctccagagtgcccgctagtcctcagtcccagtccagttcccagtccccactgaccccacgtcccctgtcggctgaggctttctgcccatcccctgtaacccctcgcttccagtcccctgacccttattctcgtccaccctcacgacctcagtcccgtgatccctttgccccattgcataagccaccccggccccagccccctgaagttgcctttaaggctgggcccctagcccacactccactgggagctgggggcttcccagcagccctgccctctggcc

SEQ ID NO: 23635 - DNA, 1219 bp, Mus musculus
tgcaggaagccttctttggaaaggacctgctggacctgagtcggaaggccctgtttgcagttggggtgggccggccaggctttggactgggagcctcaaagccccgggccgatggaggttcggataggaaggagcttatgacggccatgcacaaaggttagtttataaagatgaagtgctctggggtgtccagcttaccttctgcctcgtagttggcaaagatgtctggaggtgggatgggggggtgggcggagggctccattctgggtgtcgggcgtcaccagtctctgactggagtggggctgttgctcacaggagatgatggcccggatgttgcagatgaggagtcccatgggcctgagggcacggctgatttaccaggtgaggactgctggggggattgggtctcattttggtcttgcttgttatcagtaggctctgcctgcccctgagcactcccagagttggcgcctgggcactgttcttggggtttgtgttggcctgagtggtgtgtgcctccataccactgatggtagccttcttctggtattctagggcttgaggatgggggtgtaaaggcatccccagtgcccagtgaccccgagaagccgggcaccccaggtgaaggagtgcttagctctgacttagacaggattcccacagaaggtgaggctcgcacagtgtgctgggtgtgagggtcctgcatgggaaggaagggcccatctgtggagtagatctgtgctgctctgttgggagagtcctgcttaccctccttggccatggcctgtagacctgtggggtcagctcagcagcgtgtgcaccccgtcattctcccacagaactacccaaaatggagtccaaggacctgcagcagctctttaaggatgtcctgggctcagaacgagagcagcatttgggttgtgggactcctggtctagaaggtggccgaacatcactgcagaggccctttctccaaggtacttaaggcagggggtggttccaagtctgccatagctggccttgctacctgattagatcggcagcttctgtttctctgatcctgttgctcttgtaggcggcctcgctttgggcagtctcccctccagcagcccgatggactcctacccaggcctctgccagtcgcccttcttggattctaggttggtatctgcgcttaactttcttgggtggcccctgtcgtctccctccgtgtgggcac

SEQ ID NO: 23636 - DNA, 1042 bp, Mus musculus
ctcgaacaaaccaaaccaaacagataacagaaccaaaccatggtatgttctggaaccagagcggagaatggacactggagctccacatgtacaaatagatagcgttgtctttaacttaaggtataatcaatccgtcctttgggtttttctaaaaactaccaattcattagttaatgcacgagtaacatttattagcttgttttagtaacaggttctaaaaggtgaaggaacctgagggaaacgaaccttgttctgtcgtcagtttggtccttccttaccaacagctgtgttgttcactcagtggggctgtggttggggatttctgttcagcccagctcctggaagcctctggagaggttttgctgtttggtgttaagagtgctctgtccaaacccggctggccggctgctcagaggtctgccctcagccgtgtaagctcttcgaatccctccccgacacagctgaggcatctcctgttctccaccagatcaccaaggtgatgctgctgaagggctggcgttgtgtggagtgtatcgtgtgtgaggtgtgcggccaggcctccgacccttcgcgcctgctgctctgtgatgactgtgacattagctaccatacatactgcctggatcccccactgctcactgtgcccaagggtggctggaagtgcaagtggtaaggagaagcagcctgggctccgacgggaggtggtgaatggcctcagatacagttagcagtaaaagagaccagcccgctgggctgctgctcagtgggggcgcccgcctctgggatcctaggttgggtgctgaaggtctttctgcttctactaggtgtgtgtcgtgtatgcagtgtggggccgcctcccctggcttccactgtgaatggcagaatagttacacacattgcgggccatgtgccagcctggtgacctgtcctgtctgtcatgctccctatgtggaggaagacctgctaatccagtgtcgccactgtgaacggtgagggcatcccttctccttaggtcgactccgggtgctgctgtgagctggct

SEQ ID NO: 23637 - DNA, 1153 bp, Mus musculus
tagctgactgctatgcatagaggaggtaaacggttcacccaggtcaactgggaccaaaaacgtggtacttggaaggaaggcactgctcggttttgctcttctcccatggtggctgttcttagaggcgaggttggtttggtcattactcacttagtacttgtcgatacttggaaacttgacttcttttctgtccccgagtgggacacctgggtcatttttataaagctgttagacgcttcatttgtcatctttccctccaagcctgtgggcccagcacacgcagtcctccctgtaatgggtcccttccatcacttagggtcggagcagcagtttcccaggacgacgccggcctcgtggaggagcagcgcatggaggccgagggagaggacgggcccgactgaagtcgaccacttcttccgttgagacactggtagtaaggacaggctccgcacccccaagtctcaccccttaagcatgcctcacacactccttaagagttaagcacgcttagaatcctgtcagtccgatgtttgctagcaagggcctgactacttggctctgaggattcttgaaacctctactgttgggtcccagtaggggaatctgagtggtctgcctcttacttaggccttagcttagccaggcatgcacacctctcctctgcataggggaaagagggcggcttagctgaggcagactttccttcctcactctctataactctctgcttattaaggtggctgatattgatagttctcctagcaaggaggaggaggaggaagacgatgacaccatgcaaaataccgtggttctcttctctaacacagacaagtttgttctaatgcaggtactgtatggagttaggatggcccagctttagcagtgagagaggcatactgagtgcactcttgcttccccctacccctgccccgtgtgtgtgcgtgcatgtgtgtgcacgctcatgtgtgcgtgtgtgtgtgtgtgtgtgcgcgcgcgcgcgcgtgcacgtgcacgtgtgtgtacgctcgtgtatatgcgcgtgtgcacgctcatgtatgtgtgtgtgtgcgtgtgtgtgcttgctcatgagcttacttggctgagaaggtggatgggaacaatcagggccccagtttgcttgttgcgatggctg

SEQ ID NO: 23638 - DNA, 1184 bp, Mus musculus
catctcgtcttttcccaccatttgaagagtctcccctatctcctccacctgaggactctcctctgtccccacctccagaggcatcacggctgtccccaccccctgaggactcccccatgtctcccccacctgaagactcacctatgtcccccccacctgaggtgtcccgcttcttgcccctgcctgtcctgtcacatctgtcgcctctgcctgaggtatcacggctgtccccaccacctgaggaatctcccctgtccccaccacccgaggactctcctgcctcacctccacctgaagcctcccgactgtccccaccacccgaggactctcctgcctcacctcctcctgaagcctcccgactgtcccgtccccgggaagactcacctgcttcaccaccaccagaggactcactcgtgtccttgccgatggaggagtcaccgctgtcgccactgcctgaggagctgagactctgccctcagcccgaggaaccatacttgtctcctcagcctgaggagccccgactctgtccccagcctgaggagctgccgctgtccccacagtctgaggagccatgcctgtcccctgtgcttgtagaaccaggcccgtcttctcagcctgaggagccacacctgtcccctgtgcctcaggagccacacctgtcccctcagcctgaggagccacacctgtcccctcagcctcagcagttgcacctgtctcctcattctgaggagccctgcctgtcccccatgcctgaggagccatgcctgtccccacagcctgaggaactaaatggacctcctcagcctgcagagcctcctgaggaaccaagccagagctctgcacctaaggagctgtccttgttttccccaagtggggaaccacctttaccccccatgcttggagagccagccctgtctgagcctggggaaccacctctatccccacttcccgaggagctgcccttgtccctgtcgggggagccagtcttgtcacctcagctgatgccaccaggtaaggcggtattagtgttctgttcctctgggggcagtctgaacacgttatggcacatctaatctcagagcctcttcttctctcctccccagatcctcttcctcctccactctcacccattatcccagctgcagcccctccagccttgtctcctttgggggagttagagtacc

SEQ ID NO: 23639 - DNA, 1265 bp, Mus musculus
tacgtgctggctctgcttcactcagtagctgacctataccttcctcccctttctccggcagaggaggctcgctgtgcagtgtgtgaggggccagggcagctgtgtgacttgctcttctgtaccagctgtgggcatcactatcatggagcctgtctggacactgctctgactgcccgcaagcgtgccagttggcagtgccctgaatgcaaagtgtgccaatcgtgcaggtaagagtgtagccatatgccaagtgtggacagaaaatgaggctaggaaggatcccacaatgtgtcctgtgccctctaggaaacctgggaatgattctaaaatgttggtgtgtgagacatgtgacaaagggtatcatactttctgcttaaaaccgcctatggaggacctgcctgctcactcgtggaaatgtaaggtgagtatctttagatgccactgcctttagcatctctacagtggtcttgagtttaatgggtcacatgcatgcctctgtctccagctgaggtttgactagagtctgtcttgctttctcgctcccctagacatgccggctatgtcgggcctgtggggccggctcagcagaactgaatcccaactctgagtggtttgagaactattcactctgtcaccgctgtcataaagcccagggaagccagcctgtcacgtctgttgccgagcagcacccagctgtctgtagcaggtaagtggtgtcaactgagattggggcggggcattgggagcggtgagcctggaggggccatgttaaacaggcagccagtcagcagtgcagtccacctcgttgatggagttgttagctggagagagccacagtgcctgctcccctgtgccctctgcagattgtcccccccagagcctggtgagatccccattgatgcgccggatgctctgtacgttgcatgccaagggcagccaaagggtgggcatgtgacctctatgcaacccaaggaactggcgcccctgcaatgtgaagccaaaccactaggtgagtaggacatgaaggtccctgaaattaatccttggttctgtggcaagagtcagcttttgctttgcctcagaccctgcacgttctgtagaggtagatctgaactaggtagggagatgatatgttgtgtctgcagggagagcagggacccaacttgaagcccagttggaggctcccctgcatgaggagatgccactgctgcccccgcctgaggagtcacccctgtctccaccacctgaagagtcacccacatctc

SEQ ID NO: 23640 - DNA, 1099 bp, Mus musculus
gtctgctcgggataatcaggtgctgaacttaaagattggacccaggggcaaggctaaccgtgttttcctacatgctgattggtggtggggatagttaggaagcgctgtttgccttggggctggatagtatcggctctgacccaactgattgactgctgatcttattccttatagctaactcaagatgtcttcatcaaagtcatccaggagattgcccgggtggagaattcttatggacgacaagaccgccgatgctatcttatgtgaactcttggcatggaataactgccctgtttctgccgcagacattgtctaacccgcagcagtggggcagaccctcaggatataactgctatggttgccaactatgtcccctgtcctctgggcacacagtatggcactcttatttttgcacactcatcccaggttctggtagcctggatgttaatgtttacaaaggggcaagatgtctcagggaccctggcttctaactccttggttttctaaaccaatttttacagtctgtacagtagggatatgagtcttgtgcattgattacccaggacccaccctcctgggtaggttttgggtgttggttgggtaagggtgtttggttccttggcagttctgaagtagaactgtctgctggggtaacaatgtatatttccaaataaactgagaaatcttttgttgacgtttgtgtctggagagagctgaggactggtggcttcagtatttagtattcactcttgtctttctcctcactaaggaccccaccctaagacttaaccactcgccttttttcatctattttgatgtttcttttttgtttgttatattttttttttttaacttcaccaagatctgttgggctgccccacccatctaagtttgtgggtcctgaagatccccttaactacagatatactgccctctagtggctaaatgccatatgccatccgactagctgttgtcctgagaccatgacatttgctgtgtcccctcatttctaatgatgtcaaggagagtagaggtggagactaaaagtgtgtgataacccatgagaattgagaaaagaatgtgcttggcgtacatgtga

SEQ ID NO: 23641 - DNA, 1146 bp, Mus musculus
acctgctgggtgactttggacgcttcaactggctaggcaatttctacatcgtgttcctctacaacgcagcctttgctggcctcaccacactctgtctggtgaagaccttcacggcagctgtgagggcagagctgatccgagcctttggtaagggcatatggagcccgggttggctgctggggagttcattttgcagcaggggtggccccagcagagaagaggttgtgctccgtgtttataggtcacccattgttcatcctgcccctcctcactgcctacctctcttttccttctcttttccagggctggacagactgccactgcctgtctctgggtttccccgggcttctaggaagaagcagcatcaatgacctccagctgggggctgagaaggagagaactgggcagtgcctaggcctggcggtgagccccagggggctgcacctcaggacctggaacctgagagtaggtgacagaggggacggaccatctgcactgttgcttaatctgagccagagtttgggacccggctggcctcctgccttttcagatgtagctgtggcctgagcatccatctggtggagctgggggactcgctctagttcctggacccaaatacgtttacacatctatctgcctcaatcctgttccaggccatgcctgaagccatgtttacatgatttgatgtgcaatagggtgggtgggacttggggggactgggccaggggtaggttctggagacaggtcttccttgcctctggcccagaagagccgaagcactgtgctatcctgtggagggctttggaccactggagagaccaagggtgctgggaggaggcggctgcacccacgagcaataaaattgatcccagggttttcttggttcttttgtaaagagcttgtccctgtgtctatctgagttccttgttccaaccagtcctgagccattctcagccattcctttctctctggagccatcgatctggtgtccggccagacagttctgcagagggctgccattctgcctacagctttacttaaagtgggttacctctgctgggagtagcaacccacccctctaaccactcaggaagcaggggcaggcaggtgtatgatttttgtgaggccagcctagtctacagtgca

SEQ ID NO: 23642 - DNA, 1135 bp, Mus musculus
tacttgtatgtgtgtgtgtgtgctttccctgtctatgggccacatctgtgaagtgcctacagaaaccagaagaagtcactggatcctctggaactggagttacaggtggtggtaagctggcttatgggtgccaggaactgaacctgggtcctttagaagagcagccagctcttaaattgtcttaaccactgagccactccctccccccttgtacctcctaagacttactctttagagtttgtaatttgagctccagagactaagtcagggtcactgccttgggttcatggatttgtatagtgagtttgaggccaatcagggctatagagaaagatgttgtcttaacaaaagaaaaggggccggagagatggctcagccgagagcatggactgcttcttaggggacctgggttcaatttctagcactcacatgggaccccacaattgtatataatgctagttccaggggatccattggaccaggcatgtgtgtggttcacatatctgtaaaggaaaagaaaaatactggctcttcaattagccgtgtgcatttaatcagctgtagtcctcttaaagtggaaaagactgtcacctcttctgtaggctgaagttccaaactgagagactgtgtacacattcaacatacagaggaccccttgtatacagtgacttagaagataagtaatcagccaggcttggtagcacacagttttaatccagcattcaggaggcagaggcaggtggatctcttgagttccagcccagccagggggttttaatactagtgaggcctgttttaaaatatataaataatagatgataaatagttgtaaagcctggctgttcgtgaagtctttccacgtcaccatcctggttctcctaggatcacaggtataggccaccatccctggcctcccatcttagaattgagaagtttcattgtaatatctgccttgcctaaggagggagaggatctggctacacttcaccactggtcacctgcatcagatggcagctgtcctcttgtataagtgaggatccttagtgcactcactgctccatctgtaactctgggccagctgtcccacctgtgctacttgactgtaggtgtctgagatgtgttcttgtctagaccc

SEQ ID NO: 23643 - DNA, 1609 bp, Mus musculus
cacaggctgaccagtgcacaggtctccagggcttcttggttttccacagctttggtgggggaactggctctggcttcacctccctgctgatggagcggctctctgtggattacggaaagaagtccaagctggagttctccatttacccagccccccaggtttccactgctgtggttgagccctacaattccatcctcaccacccacaccaccctggagcactctgattgtgccttcatggtagacaatgaggccatctatgacatctgtcgtagaaacctcgacattgagcgcccaacctacaccaaccttaaccgccttattagccagattgtgtcttccatcactgcttccctcagatttgatggggccctgaatgttgatctgacagaattccagaccaacctggtaccctaccctcgcatccacttccctctggccacttatgcccctgtcatctctgctgagaaagcctaccatgagcagctttctgtagcagagatcaccaatgcctgctttgagccagccaaccagatggtgaaatgtgaccctcgccatggtaaatacatggcttgctgcctgctataccgtggtgatgtggttcccaaagatgtcaatgctgccattgccaccatcaagaccaagcgcagcatccagtttgtagactggtgccccactggcttcaaggttggcattaattaccagcctcccactgtggtacccggtggtgacctggccaaggtgcagagagctgtgtgcatgctgagcaacaccacagccattgctgaggcctgggctcgcctagatcacaagtttgatctgatgtatgccaagcgtgcctttgtgcactggtatgtgggtgagggcatggaggagggtgagttctctgaggcccgtgaggacatggctgccctagagaaggattatgaggaggttggtgtggattctgtggaaggcgagggggaggaagaaggagaggagtactaagtccattccttgagccccctgtgtcgtcaaactgctccagtattagttgcaggcactgatgcttctgtgctgtttccattctgtgatcatgtcttctccatgttgtacctcttaagttttccatgatgtctcaaagtaaaagctttaagaaaagagttttgtttctggatactttgtttcagatcctgtagctcagatgagcctaggcctgcctcgctaattgcaatcccctgtgatagtcattataggtaaccgctcagctgattcattgcctcttgggtactaggggagcactagactgagaaagtctgtatggcatgggagctttgcttgactccacgctacctaaaatacttgccaagatgtcaagtgatccttaaggctggttgtgcacttacttccattgaggccaggctgacacagggcatggagggtgtgttgtttgaactgcaaatatcttgagagtggtatgaattccaattagccctgattccagtttgaggattggggtctaccaaaaggcatgaagtctaagagtttttgtcccttactgctaaggtaaagtctacaggggtgacagttaactggtcatttcctactaggaaagagccaaaggaagagta

SEQ ID NO: 23644 - DNA, 1195 bp, Mus musculus
gagatcaccaatgcctgctttgagccagccaaccagatggtgaaatgtgaccctcgccatggtaaatacatggcttgctgcctgctgtaccgtggtgatgtggttcccaaagatgtcaatgctgccattgccaccatcaagaccaagcgtaccatccagtttgtggactggtgccccactggcttcaaggttggcattaactaccagcctcccactgtggtacccggtggtgacctggccaaggtgcagagagctgtgtgcatgctgagcaacaccacagccattgctgaggcctgggctcgcctagatcacaagtttgatctgatgtatgccaagcgtgcctttgtgcactggtatgtgggtgagggcatggaggagggtgagttctctgaggcccgtgaggacatggctgccctagagaaggattatgaggaggttggtgtggattctgtggaaggcgagggggaggaagaaggagaggaatactaaattaaatgtcacaaggtgctgcttccacagggatgtttattgtgttccaacacagaaagttgtggtctgatcagttaatttgtatgtggcaatgtgtgctttcatacagttactgacttatgaatgattgatttgacagagacccaagctgcccatttcacttatgggttttaaataaaatactccctgtcttaaaagttgtcttgtgttctatatttgagtgtgtgccagctttcatgctttggctgaaataaataccacgacctcagaggaaagggtttattctaccttactgtctgtccatcaagcggggctggggcaggagctgaaaggggcaaagagggaatggcacctcctggcttgagccacgctgtgctctgtctgcagtttatctgacccaggaccacctgctcaggggtggtgccacccactggggacccaaccttcccacactaatcattaatgaagaaaatgatgctcccaaagacctaattacagactagtgtgatggaggcacatcttcccatgtgactgcacattgtgtgaagttgacaggttaccaccacattatatggaaattatgtactatataaaaaagattttgtggtgtaggcctgtcgtatcaacagttgggaagcagaggcaggaggattaaaaggtcacatactatataacaaactgcagaccagcttgggctacgtgagac

SEQ ID NO: 23645 - DNA, 1132 bp, Mus musculus
gcgtcagatcccctaagccagcctagtttttagtgttacttcaacggcatatttatatttagcccagttaagaaaaaatgtccgtaaaaaatttttttttcaatttaaagctagagtaaactaccaacagcgggtttttttctctcccttcccctctcccccccctctctctctctccttccttccttccttccttccttccttccttccttccttccttccttcgataaagggtttctttgtagctctggctgtaatagaactcaccctgtagaccaggatggtctggaactcagagctctgcctgcctctgctacctgagctgagatgaaaggcaaaccacttggcttgcactttggtttttgagtgtcttatgctcatgccagtcttgaaatcattatgtggccaaacatgaccttcaactaaaaccaagatccttctgtctccactacccaagagctagggttattcacctggttaacaatgtattagttcagttttcaagaaaaaaatgggtgaggctatcaaaccctgggctctggaggcagcggcaggagtatcttctgagttctggtcagccagcacaatgagacccggtctcaaaagcaaacaaagttaccaggaactcagcccggcttggaggagagtggctagttctctagactttggaggctgagacagggagggggattgctcatcatgagtttggggctccttagtccctagtgagtcccaggctagagcgggctacagagtgaataatttcggtaaaaggaacctccctgctaaataagttttaactatttgagagaccatttacctagcctgcacctggtcagctgacaatagaaatttaaaagaaaggctggagagatggctcagctaagagcaccaactgctcttccaaaggttctgaattcaaatcccagcaaccacatggtggctcacaaccatccttaatgagatctgatgccctcttctggtgtgtctgaagatagctacagtgtacttacatataagaaataaatctaaaaaaaaaaaatttttttttttttaaagaaaaccccatcccagtattgtttaaggtctatggaagctttggggaagtgaggtgcacagccctcaggtagcg

SEQ ID NO: 23646 - DNA, 1196 bp, Mus musculus
ttgtgtcttccatcactgcttccctcagatttgatggggccctgaatgttgatctgacagaattccagaccaacctggtaccctaccctcgcatccacttccctctggccacttatgcccctgtcatctctgctgagaaagcctaccatgagcagcttacagtagcagagatcaccaatgcctgctttgagccagccaaccagatggtgaaatgtgaccctcgccatggtaaatacatggcttgctgcctgctgtaccgtggtgatgtggttcccaaagatgtcaatgctgccattgccaccatcaagaccaagcgtaccatccagtttgtggactggtgccccactggcttcaaggttggcattaactaccagcctcccactgtggtacccggtggtgacctggccaaggtgcagagagctgtgtgcatgctgagcaacaccacagccattgctgaggcctgggctcgcctagatcacaagtttgatctgatgtatgccaagcgtgcctttgtgcactggtatgtgggtgagggcatggaggagggtgagttctctgaggcccgtgaggacatggctgccctagagaaggattatgaggaggttggggcagatagtgctgaaggagacgatgagggtgaggaatattaactcatgtgctgccattctatacttctgtggtctcatctttgtctttgtgtgtgctctaactgtcctaaactgtcaataaaggtgtttccgttgtaagttgcaaactggcatctggttcatagcttttccccttcccctttgagattgcatcttgctagtccaagatggcttcctgcccctacacctctatgagtgctgccatgatatgacagccatcactgtccctaactgaatcatggattcatgactcattgagtgtgcccagttgagactagtgattagttgaccattttcaagtacccactaggtgctgtgttctgtgcttactgattaaaaacaaatgtgtattttgggctggagagatggctcagcaattaagagcactgactgcttttccagaggtcctgagttcaattcccagcatccacatggtggtaatgggatccgatgccctcttatgtgtctaaagacagctacagcagtgtactctccccgccccccccccggccccccatcctgagacagggtttctctgtatagccctgg

SEQ ID NO: 23647 - DNA, 1101 bp, Mus musculus
actatactgccttacccagcactttctaactttaaaaatatagaaataaaaattattactatttgtgtgtgtgtgtgtgagagagagagagagacagagacagagagagacacagagaggaagaacacagataagtaccaggtggcttatgtggaggtcagaggacaacttggagagtcagttttctccttcaccatgggctctggagattgacctcagattcccacgctattgcaaatgtttctagtcactgactgtctcttggtcccttttatttctataaatgctctgtgttttaaatttcaaaattaagttttcatgtggtgctactatttttctacttactattcctggcatgacggttggatgcgttcttcctgacattaagcagtgatcatattgtgaactgcactggcactattattcaccctgctgtagtctgctgcccggtgacctgcctgtgccctcttttgcagataaacgcggtacgtgcgatagttcccaataagagcaacaatgagatcatcctggtcttgcagcactttgacaactgtgtggacaaaacagtgcaagcgttcatggaaggtaacgccagttccctcagtgtagactctggaacctgagccgcagcgcagtctccggacggcgctgcatactgtggtcttctgttagctagggtactcctttcattcccaagctatagaaaactggaagagatgctaagaaaactcctttgctgtcagatatgttctccccctccccaaatcaagaaactgtgcagctgacagactgtgggatttgaatggaattggataaagtaattgaagacgctattgcaaaggaggaagtcaagtggcccacgaacacagaccagttcaagacccagcattgatttccaagctccattatgagttagtttggttctggcaggggactcaaatgttatgagttcagtttccttacatttctatatgctagatagaaaaaagtaacagccttgtccaactccttagatttatagagttaataagtgcttcttaaaattctttccatataacttgtttgaaaaaactttactctgaagctgttttgcctttgaac

SEQ ID NO: 23648 - DNA, 1220 bp, Mus musculus
ttgactctcccctgccctacaatgtgtgttctgttccggggaagactgacaaatctgcttgtctttagctttctttctactgtccttttgcactggtcacttcagagtccactcagaagtgttaccgtcccaaagttgtattggtattgcagcaggtgagaggagcagaaaagaaaggacagcacagggggagggagggaagactctaaaaggtccatggtcatttccattcatcccatccctctgtcttccctgggtaactgagtaaaatgggccagggtttgaattctgtccagaagtctccatacagttagctttctatcatgtaacttttcccatatgagtatttgatacctgctgccttccaccaaggtaaaggatctctattttacatgtttctattaccgattatactcaagagaatttacacaaacaaatgagtgcaaacagtattttaggtagtatccaaaaatccaccaaggttagggatgagatggtgtcatcaaagcacttcaggtggagggccaccctgtctagacagttggggagtttgagaaagagaaaacctaggctgtcgagatggcttagtggcttaagtgcttgctgcaatggcagaaggattggagttcagatccccagaacatacaaaatgctcagctccttgtaattctagcctttagtgcagagactggatcaccagagtatgacagctagtgagactggctttatcagtgagctccgagtttggttgggagacctggctctccccaaggaatagggtaaaagattgatgaaggataaaggataattcctaacatcagctttgggcctctgcatgctcatgtgcctcccatgtcctcagacattatgaaatggggaaagaaagaaagctcacttccaaaatgtagcacactggattggaaaggcaggcactctcagaagcccagtaaacattcacagaggtacaagcgactgccaagtggtgtgcttggtcctaagaggacagagtgtgtgggtgtgcgggtgtgggtgctcgggtgtgcggtaatgtgaaagtaaaacagagtgaactttggatcatcttgaataaaatgagagaaatctaacaattcctgtacagaaagttaactaggaagccctggcctcaggatgggccagatgtggaactgcctgtagcgaaaggctttggatggtagatgaagagaaaaaagtatttattt

SEQ ID NO: 23649 - DNA, 1181 bp, Mus musculus
cagcttctgcttagggagaaaaacagccctttagccacatcctcaccttttacagagtgtttgagctgggctcagaggttaagagcactgactgatcttccagaggtcctgagttcaattcccagcaattacatggtggctcacagctatctgtaatgggatccagtgccctcgtgtgtctgaagaagtgtactcataccaaaaataaataatttaagaaaaaaaaatgtgtttgagccaggcgtgggcacacctcgaatcccagcccctggggggcagaggcaggaggatctcttgagttctaagctaatatagtctacagaataagtttcagggtagccagggctacatagtggcaccctgtctcaaaaacaaaatcaaacaatataagactgtctgtctgtttgtgtctacgtctatgcccagaggccagatgaagtcaaccagcattttattcatccctcactgccaaatttactagacatagggcctctcattgaacctggaggtaggctggcagacagcaagccctaatgatcgccttcatagcactagtgttacaaccatgcacagttgtgtgtgtgtgtgtctgactgtctctgtgtatgtgtgtttgtatatattatgctggcatccaaactcaggtactcatgcagcaagtgctcttacccactgaggcatctcttcagccaccaaaagacattatatatatattttttccatgtatttaagtttgtctgcatgtacatctgtgcatcatgcctgtgcctggtactcatggaggcctactggagtgtgtcagatccctggaactgggggtatccacacatgtgagccatcatgtgggtgctgggaaattgaacccagatccttgctcctggaagcagctgtcttgagtgctgagggatgtctcctcctgccccaccccaggtatttttgaacaggtaataaaaccatatagttggcatattcataaggcataaaatgacatactgtggaaagtctcttccttctgtgccaggaaggatctagcctttgctgctgttggaagatgggtggtgttgagcactgggtgggagagccgctctcaaactctagtccataaagtgacaagagagtgtcttttgtatcttatacaataaagcttcgccccaccttgcctccctcagcttagcagcaca

SEQ ID NO: 23650 - DNA, 1205 bp, Mus musculus
aagaatccaaggtgcgttgattccctcattatatctaaagatcctgattcgtctttgcaggtcctttagccaggacctcttctgctggagaagtgaccaggctccacttttaatgttcacagcctagtgagggaacaggcattcctggtccatctccttcctaaaggaaatgaactgtggtggcttggatggggcttggatgttaacttccttcatctcttaggaccaaagccctggtcttggagctgctggcagctgtgtgtttggtgcggggaggtcatgaaatcatcctggctgcctttgacaatttcaaagaggttggtctcttctgcatgctcgtgtgtgtgtgtgtgtgtgtgtgtgtgtgtgtgtgtgtgtgtgtgtgtgtatttaagaggagaaggggggtactaggtatatccaatttactgggatctctagtgactttaactgctgagcagcctgcttcagactgagactacaacaaaagccaaagcaaaactgaagtcttttagatcttgttccaggacacctcccagtttccagttaatgaggctctggatagagtgcagactgtggttggagacatggctcagtagtcagagcccttgctgatcttgcagaggccttgagttcagtttccagtatccaaatggtggctcataactgtctttagttccagttccagaggatttggtgcccccttctggcctccataggaacagcacacacattcatatacattcatagcggcaaaacacaatcttcttttctttttccttttcattccttcttctccttctcctctctcttctctcttctctctcttctctcctctctcttctctcctctctcttctctctctctcctctctcttctctctctcctctctctcctctctctcctctctctcctctctctctctctctctctctctctctatctctctctctctctgtctctcagcacaagctccactcctcacccactggagtgcagcctgggcatcttcactttataagactcctcaggtggctctgctgccatgagcctgtgggtgggatccaaagcaagagcaagtatatcctcagggaagaaggctgttagggaggggagagaactcctgtatggaattttcccatccctagatctacgtctgaaacccagtttgcttgaactcgggattcctcaacatccaggcacag

SEQ ID NO: 23651 - DNA, 2339 bp, Mus musculus
gtttataaacctaattttggaataccaggcagtgaacgcagagctgtagaggtgacaggcttgctggttctgtgtgggctgggcccagggaagctgtgcagttggctctcccagctgctgcccctgatgtcctgtcctgggtgcagccgggagggttggaagggctccctcatgatgagcgctcctcatctctccacacccttggccgatgctcactcatgggtttgtacgtcagaggggaaactacctagctgattttcttcatttgtaggacaagaagaaagaaaagaagtgaccaactggccgtcagcctttcccagctcaccttctcccccccacccccccacccctgtttctttgcacacatcacaggtgtcgtgttctatgataatgaaagcatcaggaaagcttttgtacttagtggttttctctattttgaaattttttgatcaaaaactgattagtgaatatagtttggagtttggcttcgtgtcctgggttcttccccgtcccttttctgtcagcccatcacagccacctgctctgctcagacagccaggcaccagaagtgagagcagaagtctgcatcctgccgagccgccgcagacggagccccgctgctgactggaccctctctggccctgtggttcggttctcacagttccagtgagactgggcagcgtgtttgcctgtcctgaggtgccaggcctgcagagagtggactctggtgggtgcttccttcctctgctgcctaactgagtctggcacaggctttctgccttgccatgaggaggaggtgtagacttgtgagtgctctctccgctctgagtggccctcggggaaccacctgctttccatctgtggggtggggcgctcgctccgagtatgtgtggcaaggtggaggccacaatgccaaggttccctagtgtgtttttctttgttggttcttaaaattatcaacctttgttacggatgggcctccactaggtggctgtgggtaaagtcttggggggaggataggaaaggagaccggctgagcctcagggctaattgtactgagtaaggactgcagctcccggtgaccgcgaggagtcggtgaggtgggactggtgactctcagaagctcctcggtgcacttttgtctcggcagagctgggagggagcaggcgctcgcggaagcacgtcacttactgggtttgttcacctgtttccagcaagttttggtcttttgggcagaagcctgttgaccaactgtgggccaccacagtctgcacagaaaggtggcacccggagtggttgtggccctcactaccaagccacgggcagcccatttccagtaggatggcggtttggatttctttgctcagagccaatgcagttgacacagtggctgctgggttactgtcccatgagactgtactggacgggtgcagccagagtggcgcagtgcactaaggtgccggccgccctgcctgcccggtgcctcccactgacctgagcttactaagggatggcagcagctccccagaaaaaaacgacactgcgagccctcgggacatgactgagttccacctcctgaagccagactccacctcttgtgcttttttgcttgggaaaaaggagtttttctttagaaacagtgccaagaatgatataaactacttttaactaagatgcctaacaggcttttaacacaggtgtccatctccactctgtccccggtctctgtcccagctcaggctgcgttctctaactcatactgtgaagacaaccgtgtttttgattaaaaaaaatatatctacatagtcttaatttgtaaaaaataaagaaaattccttaacctttgctggtgtctcagtgttaaatcaggggcatgctgggttagggttggcacagttgtcgttgctagtgggagctgactgggcccagtgtgctccatggagaaagcaaggcgcccacttaggcctcccgctccagagtcccaccatgccactagtgttgagaccctctctatccagccccggcctcctccagagccctctgctcagcctggcctttgctggggttgtctgtggtggtggctgctaaagttaggatgtgcaccagccacgggacttggggcagagggttactcaccctgcaagtacttgtgttcacttccggtggctgggctcctcctcaggagcaccggtgagtgtgcgcctgagatgacttcagtctgctcaccccgttcagctgacacacaaccatggttagccgtagtgtagattgtagattagaccagggtgccatggaggagggagggtacttacagaaaatgctgagagtctaactcaaag

SEQ ID NO: 23652 - DNA, 1143 bp, Mus musculus
acttgcttttcccctcctcgctgagcctccacgaccgtgtggctgtggtcaaaggcacatatgagccagaggaggactgggaagatcatagagaggagcggaagaagaccatcgagctgacggcacactgaccggcaccgggcaggggccagtccctcagcccctggaccactggagaaaaggaagacgaagagtttggagcacctctccctagcatcctctcagctggagaggcagcattggatccccatgccgcacacggggatgggatgggagcagaagcccatgatgggacacttgggtgtgggccagggacagggcctctttggaattaggcagaacgactgccacagctcagacctcagagattgtgaaggcagtgccaagctcacagcagttcaggaccatcccagaaaggggtgatagccctgtttatctctccaacccagtatctcatgtgccaaagccttcccccaggtagacagaggggacattgcctgagagctcttcaggagagagatagatggttcgtcgagtgccatcttatttatttctggttaagatggggcggaggatgggggggacgctgctggtattcgggttgggcgtttcccaataaaccaccaatcttcatattgtgccttcatctccctccaaaagcctcttgggacagtggccagtcacatctcccacttgcgatgtcacaccctcactcatgctcacttgagactaccaagaaaaccaggagacaagacctcagaaaaggaagaaaagctgaagctcaggaaggctgagaggaccggagagctggcaggaggagagatcaaatgtagagaccgaaggatacagaaacagcacaagagacccggagagggccaagggctaggaatagggtccacgtcagagtcacgcgtccctcccaaccatcccttcagctatgtcaagtccgccacttgaggagcacctgagtgtgccaggcggagtggagaagtgagccagccacagctccttgggattcctaagggatgactggccagagcttcccaagagtcctcacccggagcttccttttctgggtctcctggtgttgccaagaggcagtgtgcagggggcgggggtggggggaggatgttcagacattca

SEQ ID NO: 23653 - DNA, 1685 bp, Mus musculus
tgtcaagtaacagtataattgtctattcagtatttttcatagaatatgttttttaaagaattcatgtgcgtgtataatgtgtgtgtaccagggcacccacttggagaacttgcagttctttccttccacctccatgtgggctctcagggatggctctcaggtcgtcaggtgcatatagtaattgcctttcttctggtgtcactcaccagcctgtagaacacttttctgattcattttctctaatttatttctagatttgggaacaagagcaagtctgccaccaacttaggtcaacagggcaaatttttccctgctccgtacctcaagtaaagctgtgtctgcctgtgtttactgcacgagacacccctgtctgctcttcagcctcctgtgtaatgactacttttagcattttccagactttaaataaagttgaacgcgtatgagagtttgagtgttgcatagctccctcccacctggacacttagcacctttactagttgtcgggagctttaaaataggagatctttaccagggccgaaggggaaatgggtataagttggggctcttagggggaggggagaggagatccctttggcttaaagccaaatactgctcatgaaatgactttgctgtggtgtcacttagacaatgacagaaactgtacctcttaggtaacgtcttagttatctcaggacaggataaagagctgcgcagcggccccttctcagaacacaggcctcttcctccttcggggactgacaagaagcttggagccctcagcgggatgggccgggccactgatctgaggatgcttcacttctgtctgggttaagctgagaaagtgccacaggctctgatctcacacagcgtgctgtttctagccagcctctgcctggattttgcagtcaaagtcaggttgatctgaagccgaattcgttctgatgcctgacccccttgtttgtccagtggagcccatttaaaaagtcagctagcagttcagaagacaattttcatatagcaagaaagttagctgcttctgtctttggtgaagtttttctgtgaaacagatctatatatgtgaacattggcttttttggttagcattttccagtgttcaaaatggcttccttccctgggatgttttctgacccatactaacccttacctgtaacatgtatctggaatattatgtggaaaaaataaatagctttttcaaagtgaaagtgatgttggttttcttgtccttcagcctcttcctgatgatctctttccaatcagtgttttcagtctcttgtttgcacctcccagctgaacctgaagtaaacctggagaactttgtcctcctcctcgttgtctgtttttctaaactgaagccctagatttgttatcttcttgtttgaaggaagcgttttaggaaaaaaaaaaaaagaaaagaaaaagaaagaaagaaagaaaaaaatatatatataaaaaaactttttaaaccagtctttagggatcagaatggtgcagatttaaaggaaaaaattgccgctggctggctgcctggaacacccttcactgctggaagtgactctggcgtgagccaggatgattaactgagggcacctgcacttggagctcagaagctggtgagcagaatgtatctaagattgaacacaaacagttgcaggcttaatatgtag

SEQ ID NO: 23654 - DNA, 1203 bp, Mus musculus
aggtatgaggattcatgcactggagcacgagaaacgtctctgcagcctccagagaacagccactcctacgttctgcagcacgggtcggggaagggctcctaaggatccacccctaactgaggagggattggcagttggccttttgtctttttttcttcatcttcctcctcttcttttttttgagacagggcttcattttgtagcccgggttggttttgagctcacagagatccagttgcctttgtctcctaggtacttgaattaaagcatgtcaccatgttcaccagagcactgctatgattaaaatgaagaaaacaagacctattttacagtttttgttgttgctattgttgttgtggtggtgggaattattatattagcatgtgtgatgggcctaaaatgttgtttcatacacactgtgcgcttgatgcatgtggttgacaataactgttattcatattattctatgcttctgccctgttgtatcttcaggttattaagcctgaatcttgtgttccgtgtggaaagcggatcaagtttggcaagctgtctctgaagtgtcgagactgtcgtttggtctcccatccagaatgtcgggaccgatgtccccttccctgcatcccccccctggtggggacaccggttaagattggagaggtaagtatcatggcagccaaccaccatttgtctgtaaaaggcatagtgtcaggtttttattttaaaattattgatcttaaaaaaaaaaaaaaaaaaaaaaaaaaaaaagccaggcatggtggcacacgcctttaatcccagcatttaggaggcagaggcaggcggatttctgagttcgaggctggcctggtctacagagtgagttccaggacagccagggctatacagagaaaccctgtctcgaaagaaaaccaaaaaaaataaaataataataataataaatatatatataaaattattgatctcaaataaaatttccctccatgaaaaatgaatagaaatagtaaaatgtcagaatgttgtttggacctttctacagcaggtcgtcgtcgtcgtcgtcgtcgtccccccccccccccccccgctcctaggaagatctcacacatgcacagtagccattcttatagcctacccctggctcctaccatttaactttacagtcgtgaactcaaagctgttcttgtcctcgatcttacctggtgaatt

SEQ ID NO: 23655 - DNA, 1119 bp, Mus musculus
gttatacctgaatttgctgtttaactctggctcagcaatatgtgactgtgaaggaggttgtttttattttatgtgactgtcctggtgtgtgacagctaccccaaaggtatccctctttgattgccttctgttcaggagctttcagcattggtgacatctggagccaggtgactaatgcgtcacatactccatagcagatgccctggttaggccaaaagtgcatgacctattgaatcaggcattgctttccactaagctgctgtccgcagtgaacaacagggtttgttcctggtcattttcagatgtgtttgaccatatagtccagcaagactttatatttgggatgaagctaactataggacctatttatttgagcagctatatctttgctatttggattattgaagtttttacctgtcctcagttgaattcatccaggttgtgaaggacttcgaggacttccgaaagaagtatcaaagaaccaaccaggagctggagaaattcaaagacctattgttgaaagcagagactgggcggagcgccctggacgtgaagctgaagcatgcccgtaatcaagtggacgtggagatcaagcggaggcagcgcgctgaggcagagtgtgcaaagctggtgtgcattgctttgcttatcaaactggtgatggggtgggaagacgtggtttggtgaggtttctgctgaacatgcagacccagtttctcttctacatgaagagctcacttgacatctggcatgtgattagagatgaaactgaagcctgtgacttcagtttcatagattgaaactttcagtcttttcgtttgaaaatttattttctcctttaggcttgaaacagtttttcactagacaggtttcaaatgagagtttaaagaattaaaacaaagcagccaaagatgtaaagttggtgaaatgtgtgcctggcatgcacagagccttggactccagaacaagaagagaattctagaatacttatctaatacaatttatttgctattcttggactgcagagatggctcagtggttaagagcgctgactgctcttccgaaggtcctgagctcaattcccagcaaccacatggtggctcacaaccatccataatg

SEQ ID NO: 23656 - DNA, 1106 bp, Mus musculus
tatctggggtcccccatagtctgggaagcttgcagaccattctctcgacccgagctgacccccccctccaagcctctatgttttaatgactgtcatcttggatggtccctcgttcaagccacctttggagcctgcatgtcagggaagtcttcccttggacaagcagtgacctccggttaaggattttgaatggacataattggaggggccctatatgcgccttcatctcaggacaatgacagagtcttgtctcctctttcctccctctaggatccccttggcaagcatggaactgaagaccgaggaggaggaggtgggtggtgtccagccggtgagcatccaggcttttgccagcagctccacgctgcacggtcttgcccacatcttctcctatgagcggctgtctctgaagcgggcactgtgggccctgtgtttcctgggttcgctggccgtcctgctgtgtgtgtgcactgagcgtgtgcagtactacttctgctaccaccacgtcaccaagctcgacgaggtggctgcctcccagctcaccttccctgccgtcactctctgcaacctcaatgagtttcgctttagccaagtctccaagaatgacctgtaccatgctggggaactgctggccctgctcaacaacaggtgggcagctcccatccacccctccgcatgacttgtggagtaacaccgtccttagcccaccaaaagtcaaacagctctgccctctagcattcctttaaacctgccgctcaaggcggaggggctgagatcatgccagtaccagttacctacacacaatctctgattccagcttaggtcaaaacagctctgtccccacccagcctgagctaggagatgttagctctttccccagagagcatcacctacctcctggtactatcctccttgcctcacttagggaatgggacggaccaccttttttttttttttttttttttttcctttttttttttgagacagggtttctctgtatagccctggctgtcctggaactcactttgtagaccaggcttgcctcaaactcagaaatctgctgcctctgcctcccgaatgctgggattaaaggcgtgcgccactac

SEQ ID NO: 23657 - DNA, 1122 bp, Mus musculus
agccttaacataccctctaccttgctccacctatcccagtgccctttgcctggctgactgtggcctccctgagggaagtgactgctggagaggtagctcctacccaggaatggaggacactaagcggagagagttacagacgggaggtggggagggaggctggggattggtgactccctcttgcagctgggcggtgggtacccacagccagaagccggagccctgactcagtggcctttctttcttcggggtgcccagggcccagtcctcaccttgatgcccaggcccaccgcttgcattttctggtgagtcagggcgtggtcacatgaggaaagagattggcctagagcagaagttgaaagacgtgctgttgtgtgtccctaccctaagggggccacaaggtgaggtagagggcctcctcaaccagacacccttcccaggccagctctccaatctcattcctggccttctctgtccccactgtctcttggtctctaatcccaaaacaggacttatgggcagatcacctgtgtacgttggcctggagccagagagcaaggctttggcatctttgagacctcttggttctcaagagttgtttagagatcagaactccccagaaagaaacagggcaaagctgagaaatgtacactggctgggggggcagcaggaggggctctgggtgacgcatgcctctggtctaataaactgggtttcaaccatctcttcagtgttggttttctgtttgttgtttggtttgttttgagacagggtttctctgtgtagccctggctgtcctggaacggctctgtagtccaggctggcctcgaactctcacagagatcctcctgcctcccaaaatgctgggattaaaagcctgagctgccattatcctgcccagtgctgtttttagttgcaaactgtgggtgttacctttagaatggagcttgccttgagagccacacaactagagtaagggaatttgagtggtagcccggtgtggtggttatacctgtaattccagcaggtaggagatggagcagctatcttccattacacagtgagtttaacgctagattgggctacaccagaccctacatacttgatcaggtaaacactgat

SEQ ID NO: 23658 - DNA, 1930 bp, Mus musculus
attccttgggccctgtgctgcctgcctcagtgtacctgtcttggtcttgcttgaggcattccaggggacttggcttcaggacagtgtcacaatgaagagggtgtcacatttctgtctcacagtcacctgttatcccgtcctgtaccccagtcgtcccccgtcccgtcgtgtccccccctcaccccaccccgcctcagctcctccccatcaggctcctgtgtgcctctacctccctatcctacataggacctctagatagtgttagagaaccacagagtgggggcctcctgaggtcaggtggtcttgagggagaccagctacactgatcctgcccttgtcaggagacctaggccttgggagctatccctgtctgagcctcaggcctagggcagtctgtaagctagctgaccttggccctcccggtagcttgacttcttccctcccctccgcaggttggggcagaggctcctttacctctggcagtaaaggagcctgggcttcactgagccccgggttggtcccctgccctctggacttaacctgctgtctcagtgtcctctgaccccttaggggtccatgtcagtattggagtgtgtgttgaattgttgctccctcccacacactcccgtagccgcccagtttaggatttccctacacctgccctaacccacgcttttgggttggggatcttgcctttccttgtcattcccagcagagactgttccttcctgctgttagaggagtggcttgtttattcactccaccctgccccctcctgtaaatggagaaacaggcctgaaatcaaacgggtaaagccctaggccatccctgtcttcctgtcccatgtctgcccagttgaatcccactggtggcttcccgggcactgaggagtaaaagcgcctagggctggagaataggtctgaaatgggtttgtgactccccaccccctgccctgccctcaaagcttcagacccctcagggagcagcaggatgtgggatcgaggccccttgggacagatgctttgaatcttccagggaagcctccgattcttccaggtttgtcacccggagttagcatgtcccaggctcgcagacaacactgcagggtgggagacagctgggcacagggggattctgttgagcatgggctctgaacccacagaactgacaaagcccctgcttccccacccccacctcaggctcctgcgagcagtgctcctgcacccttcccagcctgttctgtactggggacagcagtcttctccctgtcctcccatgtcctatatccacccctccccttggaaggtcctccccacagtgacactggacagccctggggcagctgagccccagcctggcttctggctggaagcgcgatgaggagacttagcactccacagtgtccctggtggtaactgttcttattaactgattgtgttttgttttgttttgttttgttttcatggaccaaaattttttttgtactgtctccttaactgatgtcacccagttttaataaaagacttctaaagagcaggtccctgctgtctggaggggtcactgtgggtgcctgctgtctggagaggccactgtgggtccctgctgtgtggaagggtcactgtgagtccctgctgtatggaggggtcactgtgggtgcctgttgtctagagaggtcactgtgggtccctgcagtctggaggggtcgctgtgggtccccactgtccggggagtcactactgtagtgccatcagggttaggctgcccagggctctcttacttgagagatgtttcttgaacactggtgatctccagttgtactgggctctgggggtctggggaaatgagtcttttccccggggactctaggtcgtatcagaggcttgtgacctcagcaatgcccttgggatagtccctcccacctccatcatga

SEQ ID NO: 23659 - DNA, 1152 bp, Mus musculus
cactgtagctgtcttcagacactccagaagagggcatcagatctcattacgggtggttgtgagccaccatgtggttgctgggatttgaacttcggaccttcggaagagcagtcgggtgctcttacccactgagccatctcaccagccccatgcttaactcttttaagagcagccacacaggagtcaccagcataggatgcatccgtgaagatgaaaataaggaatggctctccgggaaggaggagaggcctatcctgcagaccaactccaatctgtctttgtaggggaagacatgccatctgccaagcagctagccgatatcggctacaagaccttctctgcctcgatgatgctcctcactgtgtatgggggttacctctgcagtgtacgagcctaccgttacctccagctgcgcagtgccaggcgccaggctgcagaagagcagaagacctcaggagtcctgtagagcagcgaggcgtgaggcctgcggcctgaaatggaaaagattttcctgcatgtcaaccctggcaagaactaggcccccatgcctttcaaacctgctgggctaaaatgccttggtttctgtagtgctactagcttgtgccgttctgacagtttatggaggccatcaagtaaatgggaatgtgagggtgaggtttattacagagattaaatattttgctttgtttgtgttttagtggttctgtgtacccagagagtaaatggatcatagaggtgtggctttgagttctctaaaagcttggtctctctctttctttcctgttttgtttgttcaagacagggtctatatagccctcgctgtcctgggactctataaaagactaggctagcctgaactaagagagatcagatcctcttgcctctgcctcccaagtgttgggattaaaggcctgcaccatcatgcctggcagtatctttcctactgccgtaaagaaaccataaaaagttacctcacggaagcatttatttggggcatatagtctcagaggggtccatgaccaccaccgtggtgggaagcgtggcagcaggccagcagccatggccctagagaagtggagaacttacatctgatccacaggcacaaggcaaagagctaactggaaatggcgggtttttaaaacctcaaaacca

SEQ ID NO: 23660 - DNA, 2160 bp, Mus musculus
gcctttctggtatagaatggcataaatgaaagcaaaacaggaagcaggcaaactctgttcacaatcacagccagtgacacagaagcatttaagtcagtgtcaccgaacctagaaacaggtacacgagtgggctttcctaggctctgagactcatctgccccgtgagtcctagaaacaggtacacgagtgggctttcctaggctctgagatccacctgccccgtgagtatgaaacgtagcgtgtgtactgcatttggtcctgtccccctcaggtgtctaaggatgaccgcagtgatgtagagagcagctcagaggaagaagatgagacaacccacaaaaacaacctctctggcagcagctctagcaatggtgccaactgcatgaacggctacatgggaggcagccacttggctgaagagcaggggacttgtaaagccactggcaacctacattttagggcctccccacatctacactcctgtgactagagggactgcaaggcactgaggagaatcaaagaaatatttttgtgttttaaagaaactctgccgttttgtatttaatgccctctggtcctttcagtaaggttattggctctgtgtttgtgtggtttttgtgtgtgattatacatgtgtattgtgcatataaatgagtttcattgactcggttggggcacaattctggattactagtcattgtctggtcacttctgagcccacctcaagtccagccctggctgcatcttgaattaagctgtctccagaccatctgtgacctcgtcccatggctcttgagactctgggttcctgatcacttaaataagtgctgtcaccagactcagctccaggacttgaaaattgttcttttggaggaggaagtaatatttcacctgatggaacactacccaggatcaacatagctcctagctacatgtccccttcctatcacctgctagtggcagggacaactacataccctgctgcttatttaatggtatgcagggagggggagggtaggagaggatgagctgagatttggagagcagcagccactggttgcgctgttaatgattttatactattgcttattcttctgtgattaaattgtttcaaccctctactgtctgtctctttagtaactatccctgctaccactttggctgcctgtgcttacagacatgtactgtaacgaagttttccatgggctgaaactgctcttgcagaggatccagggttggtctctagcaccgataaagagcagctcaaaactgcccgtaactccagttttggggatctgtctgtacgctcctctggctccacaatcacctgtatggatgtgtatatagttacatacactcagacctacacataaaataaaacaaacccttttaaattattattatttctaattcaagaggttcttggacatccaaatttttcttttatgcattctaagaggaatctgacagaacatctatatctttgggctgtatgttttaaagtagacatatttaattggtgtgctggctagttttgtgtcaatttggcacaagttatagtcattttggaagagggaaccttagttgagaaaatttcccaactagattggccagtgggcaagcctatagagcattttcttaactgatggttgatgggctgttggtcctaggttttatgagaaaacggcctgagcaagccatgaggagcaagctaagagcagtacccctccatggcctctgcatcagctccggcatccaggttcctgcccagacttccttctgtgatggacagtgctgtagaaatataagccaaataaacccttaacctaagttgccttagttaatggtgttttgtcctagtaatagtgaccctgagacatggtcacagcagcactgctcagcaaacagtcatggaccagagaaaaggagtttgctgagaagccagggctcgtcagggtgcctgttctcatcttgtaccacagagcctgccacttcatatttgaacatgccataaatgaatgagtccaccatgtcttcttagttctgtctttaaacctgtggacaaacttgtcctaatccagatttttctcatggtaaatatattccagaatacttttctgcttagtgatcatttaaattacagagatatttctagaggctgtg

SEQ ID NO: 23661 - DNA, 1139 bp, Mus musculus
gtatgacttacattttataaaactacatctgacagaaacaatttaaaggtgaaaccttggttttggctcccagtttcagagagtttccttccatcctgcagggaaggtgtggcagttgctcagttcatggcagtaggtgtagtggaagccaactacgtcactgagccaggaggcagggaatgtgcccggagagccgtcagcctggcatagcctttggatggcagtcccctcttacctcctgccagctgggccctgccattcctaacagtttcacagcctcccaagatactgctgccagctgggcaaaggcgtccaaagcatgagcctgtagacatttcacatttataccaaagcatctaataactattgaagagttcctcagggttaacttggcctgcaaacccaagaaagaaagacttaattaaacctgaaagcctaaaatagttgcaataagatgaattcttgctgggtagaggcacatgcctttaatcccagccagcattcaggaggcagagacaggtgaatttctgagttcaagacccacctacagagtgggttccaggatatacagagaaaccctgtcttgaaaaacagaacagcaaccaaacagatgaattgctcagctaataggtagttctctggcagttttaagattaattttagttgtgtgtgtgtgtctgtctgtctgtctgtccgtccgtccgtccatgcgttgagttcaggtgcccacagaggccagaagagggtgccttggagctagagttaacaaatagttgagagccacctggcagaggtgctcttaagcactgggacacaggttaagaccctggggatggcagcacactggtcggcttgcacggcctgccctgtgctgcctgccatctccatctctccatccctaggacttcctgatgatgtttattcatcatatgattggcattatgctcaccactttctcctacgtcaacaacatggtgcgagtgggagcactcatcttctgtctgcatgacttcgcagaccccttactggaagtaagagcccatcctggcattcatgaatcctttctcccttttttgatatgtgactttctccccaactcatttttttatctttcacctaggctgccaagatggccaatt

SEQ ID NO: 23662 - DNA, 2812 bp, Mus musculus
tcgaacctcttccatcaagagccccaaggcctcttcgccatctctcaggaaaggttggagcgagtccgagcagagtgaggagtttggaggagggatagcgacgatggaaaggaaacaaacggaaaatgccagaccctctggggagaaagagaatgtgggaaaatcacgctggcagggcgaggaagtgccgaggagcaaggaccgtagttcttttgagctggagagtgagaattttatggaaaatggagcaaacatagctgaagatgacaaccatgtccacgcacagcagtccccgttagaacccgaggctccgggttggtctggctttgtagacaccacggctgctaaagaattcactacccagaatcaaaaatcccaagatgtcgggttctgggagggagaagtggtccgagagctgtctgtggaggaacagataaagagaaaccggtactatgatgaggacgaggatgaagaatgaccggccgccatggttctggccttagattttggttagcaactcactgccctttatcaagtggtgcgcagaaacaggcagcttggcgccaagggtcattcatgtgggagcaactttggaaatgaattcccgctagcaaaacagggcaaaaacaagcaaaaacaaaacagacaaacaaactcacccaaaaccaattctaagcgcattgtcaaaacaccagtgatcttttaagcctggtgtggtggtaaacacctttaatcccagcactccactcgggaggcagaggcagaggcaggtgggtctctctgagttccaggacagccagggctacaaagagaaaccttgcctcaaaacaaacaaacaaacaaatccctccattttttcagggaagggctaagtagggatttctctcactgatgctgcctgccatccactgcattccccaaatcaagattggtgtggttagatatttagaggcttgttttcacactacagagaccattgtggaattagagacacacacaacacatttaggagcccacctcatgaccagaggcactttagtataaagggcacagtgtagctattttaccaatttcattttttagtactcaattgctgaaaatcaaatatttagtctttcaagcttttgaaatgcattctcttcctctggtagatagggaaagcttactgtctttcatcctacatcctgtatttttaatcactgaggcacaaaacagcaacctttggccaagtgaaaggcgctggttactgaagccggagcagcagtgttcaatccccaaaacctacgtaaaggtgagagagcagactgcacagagctgtccacacgtgcccatcatcaacaataagaaacaagttaaaaaaaaaaatacaaccaacctcacaaacacctgcgagacagagaaccaacctatatactttggtgtttggagagacggacattgtacccagataatcagtggcgaatgccagtgtgtctccctgcactctgggtgtttgccatctcttctggtggtttctcgcactttgcggaaagctgcagtgttgctgtaagaccttttggatcacgcttcaccatgctccaagtaaaacaacctgagatcagagctgggaagcctcaggtcgaggcgaatcttggctctgaaatgtattgatttttaggccagataattcttccagggttgcattaaatcacttttaggtctgtcttcttaggccgtgtcctactttgattcattgtagtgataaaacactgggcaggagcaactcagaggggaagggtttgtctccactcacaggccacgggtcacacacaggccacgcgcgcacgcagcatggtcaagggaagcgaggccagaacccagaggcaagagctgatgcagaccgtgtgggaacactgcttgctgacttcatctctgtggcttactcaactggttttcttacaccacccagggccacctggccaggggtgacactgctcacaacaaaaacagacaaggcccacaggtgcatcggttagaggcggttcatcagctgagtcccacatccaggtgactctgtgtgaggctggtaaacccagaggaggatagatggttttctctggtattaaggctttagaatattataaacgagtgcagttcttgtatgtaactgatattccaaatgatgtgtatggcggggtgggcttaaggtagtggcctctttgcatttgtagagatttagctcagttttagagatgtaaaataatctgtttccttatggccttgtttagcctaaaacatttttattcaataaagcttttaatttacatttccagtgtccacactgctcttattcccgtctcctccacactgctcttattcccgtctctttacacagggtctctcggaacctgcttctattgagcagcttttagggggaaaatgctgtgagttcatttgaccactagatggcaatgtagaaccgaattgtgcacttttcatctaccctaaagacttttttgggagttggggggctgcaagtaatttggcaagaaaattagtgtgtgcattcaaaatgaactgtttgttttaccaattcaaattccagtggcggattttactgtttaccgcattccgcatttactaatttaccttatgattgtgtctgacacaaaacaggattttcagccatctctgctgaagacgcacgctcttcgctctgggtgtgagcgcgtttggttgatttcttctatagaatcaacttctccaagtgtttcctgctgccattgattcgtggtttcaataatagcctgaaaaccaaaggtggtggtggtcc

SEQ ID NO: 23663 - DNA, 1183 bp, Mus musculus
catacagagggataaaaaatatctgaggaaggtgaagctttttttaaaactccagctaacagcacactaggccaaagtagcacctaccctttcttcctgagggtggtgactgcagctccttctattggtgggagctcaactccagagtccgccaggattggctaaccacccttgcccgctaactattaactatgttggatttaaaatgaagaggaggaagaggaagaggaagaggaagaggaagaagaagaagaagaagaagaagaagaagaagaagttgtttctcacatattgaattcagaaggtccagctgcagaacaagccccaaggatatttggggctctgaatttgatctttaagctaaaggaaataggaagcaggaatggggcaaggggcggggatgtgtctcttacctccgacacactggctttcagtaattcccagatatttgaatggcagaatctggctgaaggccatcataacagaaggtgatgttccacgtctgtgtttgaaatactctatgaacctaagtgtcttgagtatatttctagtcctaaaattataatttaaaactttatttatatgttttttttttttttgagactttgagacagggtttctctgtatagccctggctgtcctggaactcactttgtagaccaggctgtcctcgaactcagaaatccgcctgcctctgcctcccaggtgctgggattaaaggtgtgcaccaccaccgcctggcatgttttgttttttgtaaggcaggatctcctataacctgctatatttgtagagtgtacccttgaattcctgatcccctgggctctgtcgggattaattacaggtgtgtgccaccacgctcgggctaatttgtaactataaccaaaggtctatccacattatgagacataaagtgttgagatttcaggaattacaaaacacttgattcaaaaatctgtgcccagtgtctgcagcatagctcagcatgctgcgcttgcctggtgtgtgcaaggacctaggtttgatctccagcacgaaagagacaaatcatgctacagcctacacacacgtcctgggagtgtgtgagggcggaggcctgggctccctccatgggtggcttgccagccagtggaaggacagctacaggggtctaccaggcattgcaataaaacatggctgggta

SEQ ID NO: 23664 - DNA, 1121 bp, Mus musculus
cagtggtcagtgttcctgcgtgtagggagagacagtaggggggaaaggaaagaaggaaggaactaacaaagaagaagagacagagacagaaaccctgtggacctggcagagcctagcttgggcttcactctgagattttgattcaatctctcccaggatgttattccaaagaggggatgatttcactccaaatgtgactttggaaccaacttaagttcagaaaaaggccaactaatgtttgcacagtagggtcagtgatacaacgatggaattggactgggacctcagagatcatctgttctgacctccttttacaggaaaccttaccccaaggatcctgactcctctgacagaggtcacacggacttggggaaagcagcccaggagtgtgatctgctgatctgcgctcttgctttgctcacccagctgcccatccctgagtgctgggggtcctgtcctaaatattctctccctttctctagcccacaggtgtctcagagtctgtagacaagatggaatcgactccatttaatagacgccagtggacttccctgtcattgagagtaacagccaaagagctttctcttgtcaacaagaacaagtcatccgcaattgtggaaatattctccaagtaagtgctatctcggtccaaaaggaccgtctgccttgagcagatttaccacctgtcaggaaaattggtgaagtgatgtcaactggccggactgagcacccccgggctttatgcaccctacaggtcactggagaggaaacaatggtaccagtcagaaggcacctcccccatctttgaatttttatttaactgagggaaaaaaaagttataaacacaaaaaaagatacttgtaagagccgggcatggtggagcacacctagcactcaggaggcagaggcagggggatcgccatgagttccaggccagcctgttctacagaatgagtctaggacaaccaggaggactgttacacagagaagccctgtctagaaaagcaaaaagaaagaaaaggaaggaaggaaggaaggaaggaaggagcaaaaaaaaaaaagaaaagaaaaagaaaagaaaagaaaaaagatacttgtaaagtaaaatgttaccaaattca

SEQ ID NO: 23665 - DNA, 1235 bp, Mus musculus
tctcgggtgatcttttatgacctgcaattttcagatcaaagtgtgtttttaaaagctataaattatatttcatgtttaaagaagatatgtgaaattaccatagttatatgtctaacaagctaatttgggtttcttttttttttttaagttttctttttacattaacttatcttgcatgtacatgtatgtggacacatgtggagtcagagaacagcttttggtgtgaactctctccttccaccgcgtgggctctgtggagaactcacgccaccaggcttagagccatcttgcccagcccctgactggggtttctgaaatgcaagagctccctacactgaggcacattccggcccggcccgaccctttctttcgctggtgatttgacagaaataagttgagcctgcagcgcccccacattccacagccacgcttctcttttgtttgtgctggaagccatcatgtttccagcctcacctcctaaatgaacaggagttgattttctttctgaacctcgggtcctttctatacagatgacccagccactgaaatacaccgtgacagtatttctgcatgtgttactgtgaggatgaaacacatctgtatgtgggattccattaaaacgacacagatccgtactccagcaataggatgaggagcacagagtctctgggctctgcagtgagtacaggttcagccagaatgtcagagtcgaaccctgtaaaccctataaacgagaaaacaaataaggaaacacaaaacaaaacagaacagaacttggccaagcctgtactctcaacactccgcaggcagagggaggctccaggccaggcagggctatgtagcaataacctgccttaaaaaaaaaaaaaaaaaaaaaaaaaaaaaatctgagttctaggccaacctgggctacagagaaagtttctggacagcgagggctacacagagaagcccagtctcaaaaaacagaaagaaaaaaaaatagcttgcaagatgctagggattgggttttttgtttgttttgttttgttgtttggttttttgagataggctctcaactagcccaggctggcctcaaactcgctgtgtagctgaggatagctagatggcctaaacttttgtttatttagtgtgtgttggggtgggggtggggtattcataaatgctacagcttgtgtccggaggtcagtggacagctttgtgaagtcagctctctccttccaggagagactctg

SEQ ID NO: 23666 - DNA, 1193 bp, Mus musculus
cacacctttaatcccagcactcgggaggcagaggcaggcggatttctgagttcgaggtcggcctggtctacaaagtgagttccaggacagccagggctacacagagaaaccctgtcttgaaaaaccaaaaaaaaaaaaaaagagagagacaaacctctagaagattgctggggtctttaactgtgctttctataggaaggtaaaacactccattgcagactgtgcacagtaacctcaaggtgcgctaagtcacttaacacaggctcttgaggcttctagtaacaaattagtggctttatgtagtttctgctttattatcgaggttgaggttttttggtaaatggtacctttagagggatcgtcccaatgttctgttctgtggctgggtgtaaaaggtctgggagtcaaaaacatctttaggatttatttttatctttgactatgtgtacacctggggtggggcagttgcgcatgggaatacgggtgcccaaagaggccaaaagcatcagatttccccagatctagatttataggctgtttcaggctgcctgatgtgggtactgggaatggagcctggggcctctggaaggaagagcttaaaggttcttaaccactgagcatctctccagactcaaattatttggtgactgaatgaaaacttgtttttcattaaaagtagggggggtctcacccaacaagagtgcaactactagcatgtgctatgacgtcctatcactttaaaacattttggggagctgttttgttctccatactggggtactccagccgcacggcatctgactcacgtgcacacacaactttttaaaaggtatgagttgttcatctggtggtatataagtaagatcatgccacttacctgagtggcgcacacctttaatcccagcactcgagaggcagaggcaggcagatctcagtgagttcaaggccagcctggtctacagagtgagttctaggccaggccagggctacacagagaaaccctgtcttgaaaaaacaaaaacaaagacaaaaaaaaaaaaccaaaacaaaacaaaacccaaaacacttattttgcagcctttttgtctcttgtaatatgggacaggtgacacaacttctcccaagttgaaaatcccacaaccttggaagcatcaatgagggctcagctcggtggttcctgatggttacctcag

SEQ ID NO: 23667 - DNA, 1151 bp, Mus musculus
tcaggagacagaggcaggtggatttctgagtctgaggctagcctgacctacatagtaagtttcagaacagccaaaactaagaccctatctcaaaaaataaataagtcaaagaaaaatgtaaaactgtaaaagtgggctcacatagtaaaaacctaactgcttgctgtatatgagacagttaaagaaagaacactgaaagaccaagtcctgaggctggctcacaacttagaggccagcctggggtacacaggaaggccctgtcagaaggagaggttgcggaagaacaaagacataatagccagatgtatattttgagaagcaaaagttctctattcctaatgtcagacaaggccgaatttaatgtaaaaaggcatgagatgagacaggtgatcttgtactgtaggtaaaagctgcacttaagatgcaggtcaagctccctaaacctgaagtggtgtttgttgctcttgttgaatcccaaaccggctcccgacatgggactagcgaatgaacgaatgatgctcactggatccggagaccccaaagaggaagaggaggaggaagaattagtggaccccctaacaacagtgagagagcactgtgaacagctggagaagtgtgtaaaggcccgggaacgactagagttgtgtgataagcgcgtgtcttcccgatcacagtcagaagagggctgtacagaggagcgctttgacttcctgcatgcacgcgaccactgtgtggcccacaagctctttaaagacttgagtaaatatgcagattcgcctgccttggccttgtcactgggaatcagggacagttccttattgtggttttgaacatttgtttctgatgcagtaagctctgagaccctcactgatttgggcaggtagcttctcttctgtgtaattagcagtgatttcatcctaataaactgatttgcaaacttgaaaaaaaaagatacggatcaaacagctacaaatatccaagcaacagtaacactgcagcaacctgcagacagagactaggaacatgggaagacagaataatggctttaaccatatctctctgtctaagttcaaagatacataacaaataacaaataataataacaaaataacaacaaatcaaagaaccacaaaaatcttgaaagcagggaa

SEQ ID NO: 23668 - DNA, 1134 bp, Mus musculus
atttaatgaaatgtatttatgaatgtttagcttatatatgtatatgattatttttttatgccttacaggaaagtcagtaatttcaagtactacatgtgtcttgaatgtagtatatcatttatataatttcctacacgattagtttgggtctgtaataagtgcctgattaactcactggccttggacagttaacctcattgaggttattttctttatccacagaatagaaatcacaaaaagtaataaccagtgacttttcagaaaaggaattaagcaaacatttgggtacatagagtgctaccttatccacaatgatcaaaacgtctcccttcagacattaacttaagccattggacttttccccaactggcaccattctttgacatttttttaggagatataattcgagttatttcctgttcacattctgtgccttttcttgaaaacaggccatacagaactttcagaagatatgtgtaaggaatatgaagtaatgtattctccatcttgtgaaaccacaaggaatactgcagatgttgaagagtcagctgatggaatgatcttaggaccggaagacctgagttaccaactctatgatgtttctggtaacctttgttgttctattgctaaaatgagaacttagtgtctttagctctccgtcatttccgtaaacatgacattggtcagtttgttttcttttttgaaaagaagcttatgtcaaacaagtgttaggtacttattaaaattattgttggctagtacccagataaaatttgtagttgagaaagaatctttgtttaaaaaaaatgtcctgttaaagaaaaatgtgattaatcccagcactggggaggcagaggcagatggatttctgagttcgaggccaacctggtctacagagtgagttccaggacagccagggctacacagagaaaccctgtctcaaaaaaccaaaaaaaacaaaaacaaaaacaaaacaaaacaaaaaaacataaaaaaagaaaagtgtgaaattatcaggagaaataggtttctcagttgattagttaagattattattacaagtttaaccaagttttctgtgtgtgtgtatatgtatgtatgtatgtatgtatgtatgtatgtatgtgtatgtat

SEQ ID NO: 23669 - DNA, 2533 bp, Mus musculus
ttaaagagctttgaaaacactgcataatccgtgtaacccagaattattatttctttgtaacttattattcagcttggcgagcgcttttgatttggcagattgataacatggtatatttacttagttggaaacaattatttctacatacttttaaaaaaatatctgctagatgaaacatacaataaaactacctgtactaaaatttgggagaactttaggtcctttaaaaagtattaatcattattagcaacatctatgataaaagtgtttattctggtttacttagaaatgataaacatttaaagtgttaacatcttatgaatgcagtgaattaatagaataaacattttgcaaaaaatcacttgataaggattagaaactttatttttgcacttaaaatgaaaaataactttgttttctctaaatgtgtcacagatgtagtttccgatttcttgctactttgtgtgactttctgataatccattactacaggttggtttttttgaacagttcttcccttgaaaccagggccgtagacagaccccatgagtgttacaacactgagctatacctccaacttctaaaggtctgactgaaatccaagaaaaatttcctcttaaagcaagtatattcttggttttttttttctccaaatactgagtgtagagtttttttaaagcataggatttttatttcaattttcctcagtatttctaaacagctcccatttgatgggggtgtatgtggggaggggtaatgaatgtgaatgtgtaatatatatttgcagtgtgtatttggccgttattttattgcagcgtgtgtaaatgatgcctgtgagttatgtgaaaccggcttttccccatcatcattactcaagtcaattgggtgggtgttcattgtacttcaactatttattggttctgtagatgggggaattttaaacgtcagagtgtgttcttcaccttatggcttgcttcattgaaggccaagagtagataacgtgatgcttattgtgtcctacagtagtgcatcgtggttcccactgcatgaagagagcagaactcacacaagttcatcatgttgtgcttcatagagaaggtgcttagaggggctggcatggcaaaaccttctcatctctgtcttgatgatatctagtctttaatctgaatactcactctcagttttgccaaagactcagtggcgtttaaaagcgttctatctacgttcttacccacctatgttttggagacagatgaaaccttccagggataggggtttgttgtcttacctgcatatctttacatataatcaaatgatatgcagaattttaatttatttttagttcctaaagttaaggtagcttcaatattatttcacattcctttttctctttaaattgccagatttgcttttcaaagacttaggggcagaattaagttagtatctttcacttagagtaaagagaacaagacaatattatttaagagttaggagcactttgtctagttctgttagttatgtatggccttaataatcagtctcttggcttaagtgttcactggtttcactttgacacagttgaacagcactggggttcagttcctgatgcttgtgttggcaatatatattaaccatattttaagagtatcattctggctttttatggaaaagatgaaaatcaaacagtatattccttttgagggtttttttaatacgtaaatatatataaatataatatatgatggattttttctaattttttatatttccttacaatttggtgactattactctaactttagactctttggcatatactaagtagctagtctgggctttaaaaatatgcatggacatttcagtttgttttagctgaatgaggacattttgaattctcttaaaagtcacctgattattaaataacaatgtttatttttaaaactaacaatgtgttgtgtcttattacacattacacagtcctaaaggtgcggctctgatgtctgtgagctgtgggccaagtattctgttttcagttctatagcacagaacagtgattagaaatgtaaagagatacccacatcaactttctgtttttgtttttccaactgattcaggtgtccattgaatgacgtatctcttaaatgttgggggagtggtgtgtcagaaccagttacctggcttctgttttgtccatagcttagatttgttccgttgtcaaaactgtccccccccccaaattgtgtgacacatattcatgcataaactgttaaaacgagcatctttgtatttgtattgttttcaacattgccaaggtgctatgggaaattaaaattacaaaattagaaaaaaataaaattattgaaaaacaggtctggtttcttttttccaggtggtgtgcatctattgctgtttgtatttttcaggaatttatatgttgccccttctggttctgtcatagaactaaagcagagttctatgggttcttgtgggttttatgtgtgggaggcgggtattttatttgtaagatacccac

SEQ ID NO: 23670 - DNA, 1195 bp, Mus musculus
ctttaggacacatctaattatctccttagaattaactccagtgtggtgtagagacagagctccctgtgggcacaaatgcttgctgggctccgccctctcgtcagcccttcactcctggttgtgcaatcagtcttcatcgttctctgaaattacccttgacttcttctgtttccatctttggtttatcttaattgatctgaatcaaaagataagtaaaaccacctaagcctccacttggcatttttaacaatctgagcaccaagagttcacccctcagaagttacagccctgcctgagtgcaaatgtccatgtgcttaactttccagatatccacacggaagcagtccaagctgctctggcaaaacacaaagaacagaaaatggctttgccaatgcccaccaagaggcggtccacatttgtccagtctcctgcggatgcctgcacacctccgggtaggtgtatcacccttccactttgagagtgactgcatgggcatttggaaatactccttttcctttctgtgacctagaactgcctacacatcaaataaacctaaggagtgcactctgaagggagctggtgagcagccataacaaggccctctaagacctatacagactgcctcctcctgagcctgactcacttagtaagcacgggcacaggcccttttttgaggaattttggatgttttgtgtctccaaatgcaattgatagtcatagatttaacctattagtctcctcaattgatgttttatctcaacagccagcataggagtgggtggacttgggacagaaatctttatgctgttagagattttaggagcatgataatacaaatttgatacagatctaaaaaaatagacatctgttaatatattcttatatttttaaagtgtttttttctatgtgaggttcaaaagtaagtgggaaatagatatccctccctctccacttaccagacttggaatttattcctcccaatgtaaagtttctttcctgttcacaatgttttgccaagctgggcagtggtggtacactcctttaatccccgcacttgggaggcagaggcaggtggatttctgagttcgaggccagcctggtctacagagtgagttccaggacacccaggactatacagagaaaccctgtcttgaaaaaaataaaacagaatgttttgccaaatttattagaagaa

SEQ ID NO: 23671 - DNA, 1313 bp, Mus musculus
atttctgtggtatcaccgagaacatgttagcagtctgtcagacctgagctctggcatgtgcgacagcacgttactaaagcagttacatgcatgttgcgctaccctcatctggtatagagacctgcatttttacctaaccttctagactcctgaaagggagttaaatgaattcacatgaaggggtcgcctgagtcccgcagttccccgctctgtactgtattttgccatttcccgtagtcaggtgttctgcagggtctcttcacatgaagctgccaagcgtgagtcagcccataagcaaagtcaaataacccacgtgaggactgctttgtgtgtctaactctcagttataagcattctgaccagtgtttaaacgtgtaaataagaacacacatagttaactaaagaaccaggcagtcccctgcttaactgcagcctggatagctgagctgctgctgagggcacgccgtgcgcgacggctgacctggcagcgtagagtgggatgatctaaaactaaagctgcctgtgcttgtttgtaaagcttatactcccagaattagcctgagctgctaagaattcctcaacccattcctctaagctgaaaagcactcttgtcagaatttagacctaactaagattcatcagttcctaacctactctgcagaactgcaacagttcgctcaggccagtgttgaaactttcacaccctgagtgactacgggagaactgccagcttccgcttctctgtgctctgtgtctgcggtttacatatagatcgtccccctggaaactgaggcatgagctcttcctcagaagtctgtgagggtgaatgctaaaggctgggaagggagtgggctagccagctcatggaacgtaggccgcatacgcacatcttaccagtaaccagtgtggttgccagagtggtcaggctgctctgagacagggaagtctgatctccgcaggaaactcttgtgaagtaactggtgcctgaggtgcactcaagtgtgggactgagcttggcttctggctcagtttccattttttggtctgaaacttcatgtatttgaatatagttaaattttattatttttttcttacagaaatatttttaaaaattaaagaaaatctcaagtgaaaaagaattaacctgttaaatcagaatggttctctttgacccgttctggtctattgtgtaaatatttatttagactattttgataatacatattatttaccccactgtaacatcctgtaaactaaatgcgtttttaagcaatttttaagacttgtaattaccctaaaaataaggtttatta

SEQ ID NO: 23672 - DNA, 1547 bp, Mus musculus
tcacgccatgagggagatgttggggtatacaggaagggcagagtgacatcccctctcaggactgagtcctttacaaaggaaatggcttgtgtattttgaaagtcttaaaactaattgtttttcttttttttttcttttctttctttcttttttttttttttgaaacagggtcttttgatatattctaagctatcctccttcccctccttggttacaggtgtactctgccatgtgtagctcttaaaacggcccatggtacctactaagcagagcaaggcctgggtatcaaacagttctgtgttaacagttcctaaattctaaggtccttgaatttgaaggaaagacctttaggccaactctgtcttggctgataactcttacaatgcacgttactaacttggtgtcgctacccaggacacattgtctacagtaaatggaatgtgagccacatctgtactctaaactttcctaataactgtgttaaacaagaacaacaaaaaaaggtctcattgtgtagccctagctgcttataactcgctctgtagacctggctggtgtcaaactggagatcctccttcctctgcctcgggagggctggggctaaaggcacacagcaccaaacccagctaagtacagcgtctaaacatttcttaaagcatatgatattggttttaatatatttaccaaaagtactattgcttggatataaaatcactgagctgtttccggttctctctaagtttgggaatcctatgtgtatttagttctgactagtcgtttgaggtctcggtggcagagcctggctagtgactaccatgttggtcagtgcagcctgctatcactccttcaagcacagttctgaacccagtccatccatccagtgggccagctcccagacagccattcccaggtcatcttctttaagacagtgctagagtagaacacggggcctgtgcataacaaacgccctacttctaagctcgtccttagtagcccaggctggtctagaacctctggtcttcctttctctgtcccgagtactgaaattgcagcagacaccttcatgccttgcccaggcttctagtcttttcctccttctggtaatgactacttctttttttttttttattttctgttgcttttctttgagtccatccccccaaagtcagcctttactagtagaggaacaagacctgagcgctgtccctggggaacctcactagtcattcctttcccttgatggggcttgtgatggacccaaggtctacctcagacttgagtctgtttccccttgatagcatcatggttctggccttttccacattcaatggaagcttcatggttgttctgacagtgaaagcagtcctggagatcccattattaataaaacaaaaaggcctgcagagattcctgaccactgatcatgcggccaggaagggggaccaagagtaaaccccatcttaattacaagagaaaatttttttctttttctcgtgtgtgtgtgtgtgtgtgtgtgtgtgtgtgtgtgtgtgtgtgtgtgtgtggag

SEQ ID NO: 23673 - DNA, 1209 bp, Mus musculus
ttctaatctggaaacctgtgaagcctcagcccttgagagggcccgagatggatcagggagttctagctgcacacaccccgagcgcctgagccctcagaatgcccaccatgcacacagagactccattctccccaggaccaagtcctctgctgttggggaccatggcctgtctcctcaccttagtccctgggcgtttgcttattggtctcctggaatctcaaagggcctgaggccttaggctcctttaaggtctctgtctcaggcatggtgctcaatatcttggccaaataagttacttcccttgaatatccaggaattttaaactaaagcaatgagttgtctgtcaccttgccctggaactccagcgtaacctgccttagtgttccttgtgttgtctgctttgatgtaaaaccacaggtgtgtcgaggcagaggctgcagtcctctgtgcgcacagtaggcctttgctttaccattcaacagttctgacttaggcatgtgtagatgggtccttagattcgtcccgaggaagagactgcaaagacacatgaagatttctgatcctaaaatgctgttttgtttacttcctgtcaagatatcaacccctgtccaattcaaactatagtactgtgtaattatgtataaaggtttttttatttatttgaaattaggttagatatacatttttaaatttaacatctggctggacagtgttctattaactcattgaatgtgtttcctttgtcttgtgttaataaatattgatgcttgattatgtttaattcttaaaccttgggtggagctgggtggtgttgggatagaagcacaggccttctgctaagcatttgctctaacctgagccacgccccctttcctggattgattgaacacaacttgagactgtaaggtgagaaggtgactctacagccaactaaggagtgtgctccagaacaggcacaactaaggtcactgggtcaagggacagcaaacccttcatttggattttgcaagccaagaaagtggttgtcagaaattttatttttttaaccttggggtgtcttttcaaatttgggggggggttgtttgttttttttttttttaagatttatttatttattctgcctgcgtgccagaagagagcaccagatttcattacagatggtgtgagccaccatgtggttgctgggaattgaactcaggacctcaggaa

SEQ ID NO: 23674 - DNA, 1392 bp, Mus musculus
aaaccctgtctcgaaaaaacaataacaaaaaaaaggcgtgccccaccacgccgggcttagatagaaagtcttaggctacatgagatactgtatacccagtactcaaaaaaatcctgagcccttagatatttcattattgcccaagatttctgtggcaacatcagcaattatcataaagtgcccatagattccaaaatgtgtaccttttataatttattatatataaatctcgggtagtatgtctaaactataaaattttgtaaagacattgctattttattccagtttttgtttgtttgtttgtttgcttgcttgcttttctagtttacccagtcagtaattcagcctgcattcaaacctatttttttaaatgttcttttgtttgttttatgtccttctttgaattagtgaattatatagccttatgactacttcctctctttggttaaagttgccattgccccaaacggagccttacagttggccagtccaagcacggatggagtgcaggcactgcagacattaaccatgacaaattcaagcagtactcagcaggggacgatcctccagtatgcacagacctctgacggacagcagatactcgtcccgagcaaccaggtggttgtacagagtaagtgtgcttccatatctacaaatgggcccaaggcctttcaaggcacttcatgaataacttcacttttggctctacagctgcatcaggagatatgcagacctaccagatccgtaccacgccgtctgccacgtctctcccgcagaccgtggtgatgacttctcctgtgactcttgcatctcagacaacaaagacagatgaccctcaactaagaagagaaatacgactgatgaaaaacaggtaagtaggagagcatattccacagtaggtaatatttcagccacataccacctcattagataataggaagggccaggcagtggtggcacacacctttaatcccagcactcgggaggcagaggcaggcggatttctgagtttgaggccagcctggtctacagattgagttccaggacagccagggctatacagagaaaccctgtctcaaaaaaaccccaataaataaataataataataggaaggagtaggtttgcatcggctttggtttactgtgtggtgggctatgtccagtggaatgtatgagtattgttgattccagtaggcacatgggtattagtcatcccagtgacgtcattgttcagtctttgcattaaatggcttatgatatagaattcttcagttttactacatcctttgatataattgcattgccaagtgaccgagagatgatatagctcagtgattaagagcattgactgttctcgcagaggacccacattcaattcccagcacccacatg

SEQ ID NO: 23675 - DNA, 1132 bp, Mus musculus
gccattttctatgttgtttcttactgaatcaaaaccaaatcagagcagctttgaactctccctccaaagggaccaaaggtctctcataggccttggaaaaggaagcagtgggggagacttacagcttgcaaaccgaataaataaatcccagaaaatgggaaatccacggctgactaacacaggaacacctccttccctcccccaacccggtaagaaggaatcagaacccacttgctatcctggtgttactagtctgctttggctgccacctgtgctctggccagtggctctctgtcctttggctcagggttttgccaatggctgctgcattgtcctgcacgccacagctcgtataagtgcacctgacacaccagcgtcatcacagaactccacagaacagatgggaattctctgtttaatttcccatcttatctagcacatactttgctgaatataattaccgtaggcagtagaaggccactatagttagggaaatgggtacagtacgtggggaaccctaaaagtaatgcacgagagtagttaccaaggactcggggtgcgggggggagggattcttctgatcaaatatcactggtcctgagtgggtgtggtggttcagccttagtcccagcactcaggaggcagaggcagaggggcagagagagaggcagagagagaggcagagagacagaggcagagacaggtagatatccttgagtacagcctggtctacagatcaagttccaggaccgccagggctacacaaagaaaccctgtattgaagaagaagaaaaaaattccactggtcctgaaacaaaaccatggatatcattgtgttcatacagagagcaagtctgggtgggcccaagggtttcagctgcatttgtatgtatggatctaaacaaatgtatatttttcaagatgattttgcagaagttctattttaaatgttgatcaataaattcatattcatttaataaatgaaaataaatggtttctatatatgcctgcttggctgcatttgtgtcttagtgtctctgagaaggaaactcccacttagaagattaaggtatttgagtgtagagatgtgtttttctacagccaagttgtatatacaatggatgagggatgt

SEQ ID NO: 23676 - DNA, 2828 bp, Mus musculus
ggaaacactgatgtgtgtgtgtgtgtgtgtgtatatgtgtgtgtgtgtgtgtgttaaggtctttgtttccttttgtttttgtgaaatagcatcttgctattaaatactaggttgcctaaaactcactatgtagcttaggctgtgctcaaacctacagcaatccttctgacctaagctcctgagtgctgggattccaggcacgtctaccatgcctggctctcatgtatgcttaagatgagttttgttgggggtcagggtggggggtagggggtcttaccctgtagcattaggcagcaccttgaaaaggtggcccttgagctgttttaaacactaagtttctaaatagctgcccaagggcagtagcttgtttttagtcaaaagaaacgcaaccagactgtcgccatccttgaattatagaatgagactgctgcctttgaagtcagggtttttgtttggtgcattttgtttgtttttcaagagttttttcgtggctgtcctggaacttactctgtagaccaggatggcttcgaactcacagagatcctcctgcctctgcctctgcctctacctcccgagtgctaggattagaggcagacacctccactgccctgctggttcaggatttttttttttttatttctacttcggaatttctcagtggaaagaaaaaaaaggtagggcataagtggtgggtgtggacagatgatggctcacctgcagtgcaggttttccttaaggaatggagcttagcagggagggcttcatctttagccctgaggttagtaacttccctgctaatatcaagccttcctgatatgttgaatcttgagcacacacagtccctgaatctttctcttctgagagagtgctgcctgcagaagactgtagcactcgtggactgacttttatgaggctctggactcggaacgagtcacagagctaactgcactactcccaaaagtacccttcaccaaatcatgtctctggcgctgccattccacgcccaagataactcagaaggcaatctcaggagctctggacccaaaccttgcaaagtcagtaggtgtcactggtgtgaagtcctctcccggcaaggtgggcctgggctgtatcctaacagcccttcctcggagagaaagcctgctgaggccagactgcgaagctctggagtcttcagcaccgaactgctgccctcagttcagctacttctgacctgtcacgggggagacgtgattctgtcacatcaaatgctgtctgtctgctggagaggagtgacacaagagtgtgtgatcattgtcttggtggcagcgggagctagagctgcttcgaaggatgtcctctctgacgctttccctgtggcgagcgggccgacaaatggcctttgctgtctgtgcctctgtagcgctcctgctagcatttctcacagtcagaggctcagcctgcatagatctttatgaggcatacattatcaatcgctgtgtttcactcacccacagctaatccaacaaaaccaggtcacgggtccctcccagcagcattcccaacctgtggttgccacccatctgcaaccctatattcgaagacatttacctcatgatttgtaacagtagcaagattagttacaaagtagcaaaattattattgggtgtgacccccagcatgaggagctgacttaaaagagtggcagcttccggaaggtggggaacccctgcactacagggtcctcctcccccctgcccccctcccccactgttcccgaaggctagaagctgagcttttgaacctgtgcagtgcttgagggccaggctgacggcagcagaattccttgcatagatgctctagtgatgtctgcatttgtacagggatggggtggggcgagcagagtgtatccagattcgccatacttaaagagtccagcctgaagctgcttgggatcgcgcccagggctctgcctcgtgtgttctaggcaaggctccgttgcacatctcacttcctgccccagaattctgttgtgttatacttgtttacaatgatagaaggtttcgttgtgtgatacggtctcttctgactctctgactacaatatttacagtgtcaaaagattaaaaatgttccctattcacttgattgtcactgaaaacggtacttcaacagtacagtaacctgtaaacatttcacgccccccacgcaactctgctaccggcattatatttgtgagccatctttgtgcattctctgaattggtccttgttcttatgtgacctgaaatagttgtcccctcagtgcactgggagctgacaggccggggagtagcggcagcttgtcttgtgagatcctgccaggtcggcagcaagtggcttcaaggaggctttagtgaactttttacagcttgtgaacgtgctgtgattaaaccagagcttcccgctttcctgtttggttttctttcctgtttggtctttaacaccgaaaacactttatgatggagccttaacaactgaaataaagacctgccagtcgccatcaggagggacacactttaagttccaagcgtcggtgcttggctccctaagggacagagaaggaaatggattcattaccccagaaagtctggattagccgtagacaccaagaggggcccagatagcttcaaatgtgccaccgccaccaagcctccctcacgcctggcttcgcgcttaatgcccacgtggtgggaagggagaagctgctctcagtggctgtctctgcccaccacaggtgctccttggcacttgcatactcaccccacacaggtacacaacaaatcacatttttttcagtctaaatgaaaat

SEQ ID NO: 23677 - DNA, 1099 bp, Mus musculus
cagtataagctcattttaagtgagtgggatggagggattggccacattatcaggaactcaccccagttaaaatgggatctgtttatttctgtttagttccgacgagatatcaccaagtgtctcttcgttggcctcatctccattccaccctttgccaactacctggtctttttgctaatgtgagtatatactaccagcagcttgaaactatacatttagaagagtttattgtattattattttcatgtatatggatgtcttgtctgcatatatgtctgcaccacatgtgtacctggtgctctcggtgaccagaagagtgtatcagattctttagaactgcagttacaggtgtgggtgctgggaattgaacccaggtcccctagaagagcagccagtgctcttaacctctgaaccatctctccagctatgaaagtacagatttttttttgtaaagattaaaaatcattttgtctggtgtagtcccagtgcttgggagttggagcataagatcagaagttcaaggccagcctggattatagaatgagttaaaggctaaccagagctacatgaaacctttctcaagcaaataaaaaacaaaagccgagaaaactattcatttttagttacatttttatcttttatttttatgtatatgtggttgtatgaacataattatatgcattacaggatcctgtggagcagaagagggcattgggtcccctggaattggagttatagatggctgtaagccaccgtgtagctgctgggaattgaacctgggtcctatgaaagagcagacagtgttcttaaccccagctcccaagaaaatcatttaaaaattttttcatttctgaagttcagaggtcatcaaacttcctgcttcagtcttttcattattccaagttttttttttaaaaaaacttagatttatttattttattctagtctatggctgtgagtgttttgcctgcaggcgtgtatatgcaccatgtaagggcctacagattgttgtatgccatcatgtggtgctgagaagtgaacctggttctggggtcctctgtctgtaaggacaaaatgtgctgttaactgctgagccgtc

SEQ ID NO: 23678 - DNA, 1099 bp, Mus musculus
cccttaaattttgttgagatgaacaaagataatgttaaagattctgtattaaatttgaatttatgtgtgtttttgaagtatttaataaagcttagatttttttatagagagtttttggttcttgttgctgttgtccattaaaaccaacctgtaatgtggtttctaatttcttttggtctgaaacaagtttaaaaccttgaaacctgaaaattcctcacagtggtgcaaaatcagcttgacatattaggccgagcactccctcacccaacatcccattttgaggtgacatttctagtttcgtcacgttccaaggactggttcccagtcattgcagttgctgcctctatccttggcaagtcactgttggctgccgtccccttcccctgtcccagtggcaaatgggagaggtaaactaggaaggcagcctgtgttgtgagacctcctactctggctggcttagcacttgttacacagctcaggctggttctgaactcacgcctcagcctcacacgtgcagagaggaaagatatcgacaccatgcctagacttggacttgcttccaaatacatgaatctctgaggcacaaatgatgcatataattctattagtatattggctataaattacatgacttagggggccagagagatggctcagtggttaagaggacctgggttcaactcccagcacccacatggtggctcacagtcatctataactccagttctaggggacctgatcctgtctcctatccccaaggggaccaggcacatgtggtatatagatatacacccatacacataaaagagtaaaaagttaaaaaacctagatgtcctaatttttacctgaaattactttttattagagtagccttcaaaatcacagaagtgaatttatataccattatagttttagattttgtttggttttgttgttgttgtttgaaatagggtttcctggctaccctggaacgtgatttgtaggccagactcaccttgaactcatagatccacctgcctctgcctcttgagtgctgggattaaaagcatgtgccaccactgcctggcttttttttttttttttgttttaaaggctaggc

SEQ ID NO: 23679 - DNA, 1580 bp, Mus musculus
gcagcccctccctaaagcattctgaggtaaggaggtatccattcttcaaatgaatgtgagtgaagcagcccaaggctcttccttaattcctctggagtgatgctgtgccatgctggtctttgcttctagtaataaaacatcaaattaggtttggagggaactttgatcttcctaagaattaaagttgccaaattattctgattggtctttaatctccttaagtttttgatttatcttacttggtaaatgaaatgcattagctgtctgccttttccttcccatcctctgcccagcctgtccactgtccctgctcctccaccccctcccatcactatccatagaatcagtggtgcaggaccgaaagccagactcagccccttgtctccctgcacctgtcccacttgacattttttaactcatctttcataaggatcctctgaagccccctgtgtgacctgagcacagactccatttcttcaggttttgtatatctccaggcaaggtgaagggtacccttcggacccgcctcataaaccatctctgcatcaccatgaacccagactagctgtggtgccagaaacctgaacttaaacaacagttctcagtgcaaactgtcctaggaaaatttaaagatgacaggcaggggagaagatgcatatcaaaagcttggctttaaagtctaagggagttttagatcaaaaactagctatcacttcctgagtgtctcatgtagccactcaggctcccaggagtttcctgaggtaggttagtagggtcacgtgaatgcctcactatgacatgacttgagtccagtgagatctcattaggattaatatttcagggatccttaatattttgatttgttttccgagattggattttattttatctgctatttcagttcatctaaatcttgtgttctgtacatgtgatgtttgactgtaccatcgactgttatggaagttcagcgttgtatgtctctctacactgtggtgcacttaacttgtggattttttatactaaaaatgtagaataaagactattttgaagatttgaataaagtgatgaagttgcattacacctcacgccagcattctttacttagcatgtgctcagatggcttcctttatatggcaggtctttaacatcccacccagaaaccagctagtgctcccattgctgtttcttcaatacgtctttgaagtaaatgtaggtgtgtcaggctaggcttgactgctctcctgggttccactagagatgatcctggactcacaactgtaatccagtactcacggggcagaggcaggccgatctgtgagttagaggccagcctagtctacccagagaaaccctgtctcaagggtaaaaaaaagaaaagagctttacagatgggattgaatgccaggtctttcttggctccatctatattatacacagggatctgggagattgtggcccttgccagaattgagaacaaacccacttatttctcatgtgtttccagtgatgcttgtctgggacaaacctgggttgtcctcattgccaactcctgaatagttttgagaactgtagaacttcca

SEQ ID NO: 23680 - DNA, 1190 bp, Mus musculus
gcctgagagttggattttgaagccctgtggccaccaaggcaggatgttcttcttgcaacaacactggtcccattttctttcttccatatcagtggagagaccaggaggtcacatgctacttggcccaaggcttttgtcctctcctagagacgagcctcgaaagcagcctgagagtgtgtcctgcagaggaactggaagggcagagagcctctcttgttagcagatctttgaagcaaaccctcttgatgtgtatacacagagtgccttcatcctatgtcatttgcacagttatctatggaggagacagggagaaaggagccatccattgagaaggttgagagtgaggtggagtatatagttcagggaaaggctctgagtttgaccccttagcaccacagaaaacagaaaaggagtccaggagagaaaggcaggcagagagaggcagagagggacatagggaggcagagggcttttctgcgattgcacagctgataggtggctcaagctggggttgagtccccatctttggtgctgtaccagggttccttccggcacataaaaacactaaacagcgagctgccagccatgccatttcctgaccccctctctgatcattctggctgtctgtcctccagaaagactggtagcgagatgggagaccacattgagatcctggcctgttagtgtggaaagaagttcatgagctgagacagctggtgagcctcaagcccaggtcccctttgttctaagctatagacaaggagagtaataggctgaagcaggagctaggcatgaaggcacaggtctgcagcctcggtgctcagagactaaagcagcaaggtcttaagctccaaggacagcctgggcttcaaaatttgacctttcctcaaaggcaattaaaaaacagcatggagaatatgcaggggactgccttgcagcccctgaactaaggcagcccccctccccttttacacttactcctcagcagaaactagataggtgttttgtccaaggtcacctggcaagatgtttagcagttccaagcttagacccaagataaggctaatcagagtcgtggcaagtctgaggggtcagggacagcgtgcagttgcctggagggctgatctcatctgcttgcctgagtgccctgtgcagagctgacccgaggatgccagcctttctacaatcaa

SEQ ID NO: 23681 - DNA, 1193 bp, Mus musculus
cctgaaagtcagaataggagcaacaagctaagccacagtagcataggcccgctcaggtgtgctggggaggacagagggggagggggagggtcagatggttccctgtcagactggactggaccagagctcctgtgtgtgctaggctgaggctgggcattttacccacgggaatttgctcttccgaggcgctcccctcccccgggcgctctgacctctagtttacaggagaattaactgaccttctagggcaagattttaaaggaggttacatcgaagcacactggaaactgcaatttaggtcagattctgttgggggagtcgtttggtttatataaatacatacatctctcccccccccccccgaagtcacctgtgtcaaatccacaaatctatttggaaatcacaaacattttaatgttgttctggcttttgtgttatcctgttgccaccaaggacaaagaggggctgactggactcattttatttccttttgtcaaaaggaaaaaaggaaaatgcccggtgttccaaacggaaacgtttgccacatagaaccagagccacatggggggcacagtgggccagaactggagcggactgggcggtaagttctgggacattgcgtcctgggtgccacgcaccggcagacacagctaaggaaagaggcgtcctctgtctctaacatcctgggtagaagtttattgaccatggttgacgttcacacgagaccatctactgtacattaacatgaatgtgtccaatatcatattcattctacttttttgaactatttgctaagttctgtctgttcccggtcctttctagatgttccctctgatgtaaactcagcacctctctccttccttgtctcctggcgttcttcttactctttgtctctgctttgatgctgtgtccttcggaaagccttctgatattctctgtggctgacgctgggcacttgtactgtagagatctttagcttcccatcacagtccacatcattcaacgttgttatcgtcgtctctcctgctggaccgttggctccaaagcctcaaagtccccactctgcctctaaaaaattatcctagcccacttaaaattatgtaaaagatgaatgtgagccttggacacagtgaaaatttctggatctctctggactgcacagtcccagaacacaccaccctgggtgtgttttt

SEQ ID NO: 23682 - DNA, 1159 bp, Mus musculus
ttccacaagccacagggaaacaaaatcggtgagtgtctttaaagtatgtgacagagtcgcacagggaaaggacacagaagactctgaaagtcttctccagggcagagtgagtctgtttttctgagtttccgtgctcatgaggcgtaacttacaacagggcttaaagttgaagcttaaaattaagcaaaacctgttagctctctgagagattgcttgtttcatcagtaaagtgcttgcacatggctgtgacagttaaaaaaaaaatgagcccaggtaaaaagtctgggtattatggcgcctacttgtgaatccgttctcaggaggtagagaccgatccaggtggttcctggcaggtgtggagactgtggtgggagtgagcagggctttgagtgaggagagctttggggtttgaacaaggagacctctgggggttagtagaggaagatgtgattcaactcgggcttgtttttaatttattcatgtatttatattccatatgccaccccctccctgtccttccatcacaggggtcctcccctctgcccctctccttcacctgtgacccttactcctgaagactgtttcaggagcactggagggcaaaggtgaagcgggtcacccagtgagagaaggcagtggcttgctgagtgtggggacatgctcaggttctggacacattcggaatatcagctgaggtccgtgtggatgctgggtgtgggaggacttgaacatgctgctgcagaggtttgggctagcacacagtaaaccttggctggtctcagaaatctgaacgtgggcctgggtaccccaaactgcactctttagagactggtctcggctacgttagactgtgtcagaggcttggttttccgtattgtagccttgtaatgtgggcattactttgagtatcctaaaataatcttgtttaaggattttcatgttagttcaggcgctaactttctgtgctgtgtttaactgctgcgattgtttgccatgccaggtccgctccatggtgagtgacttcgccgtgttcctcaccatcttcaccatggtggtccttgactttctgattggcgtcccgtcgccaaagcttcaggttcccaatgtgttcaaggtgagtggacctcggtgatcttcaagcctgagggtacactgatct

SEQ ID NO: 23683 - DNA, 1164 bp, Mus musculus
catacatattcatatagacacatacacatgcacacattctagatttctttgtccttttatgtgatcctttgttgttatttaatgtctctttgtatccctagtaattttccttgctttgaagtttatactatctgattctattaatataaccattccagatctctgatgattcacagtttcgtgatatttattgtacactctttttatttaaaaaaaaaatctttttactttgaagtaatttcagactcgcaagaaagtttcaaaaatagtacagagggttccttcatgccgtcatttatgtaaccatcatacgtttatgaaaaccaaggtgttcacatggatggaatgctgtattattaagttgtgaactaatgagcttttctgtcccagggtccagtcacacaataagcaccctcttcagttttcgcctgcttgtcaccgtgattatgtggggtttctcgtgggcagcatattgttcgttctttttttttttctgtacttcagcctgtctgcccatttctatgtctcacttttcaatatggtgagtgtgcttccgcccatgtgccccaccctcctcatgaagtgtaggtgcgtgatgtggctgttggcctcatgttacacagcacagctctagaatttactcatctttcttacctgaaaatgtgcactctgtgactaatacagccacatgacaatctctattctactctattctaatcatttatatttgaagtaattatgaatatttaattttggtatattagcctgttgtttgtttgtttgtttgtttttgtttattctgtgttcgtttcctttttcttcttttgggatacacacacacagacacacatacacatacacgcatgcacacacatgcacatacaacatacatacatatacacacacattaatttatatgcaatgttttagattttcctatttgcttgttccttagttttttgagacagggtttttctgtgtagccttcactacccttgaactcgtcccatagaccacgccggctttgaactcatagacccgtctgcctctgcctcccaacttttaatgtacccttttttataatttccttagcattgcactaggaattatcatgcatacatttaaatgttcagtcggcctaaaattaccatttactgctttgaa

SEQ ID NO: 23684 - DNA, 1151 bp, Mus musculus
agtagagtcacaaagcagcatgcgtttagggtccacccatgtcatgtaaggtgtcaggctgttctttctattgtaaacagatgccatgttgtctgtccctggacactgggatgctttcagttttacgtgattatgtgaaatgttgctgtagtgctaggctttgtttaatttttttggttttggacagttgggttctgttttctgatggcgatggaaactgaatcccaatgcactgaatttatgcatttgtttcatttgatgtgaagtgggggaaaaaaaaaaaggctcgtttggtttggctcacggtggtgcttccagagcgctgggcaccggcttgtgctgagtcctgctctctttggttgcttttacctcttttacatttctctgccctgatggtgaatcaaaaccaagcaatgactaatagatttttttttttttaatttctgccacttcatgtccatcccaggactgacattttcccagtgttctgtgtgtctccaagggctcaataaaagctctgacttgttctagttctctgcaatgcccttcactgaggctcgctgtcaacactgtaagattgtttcttctaacagtctgctaatggcagcttgctacacatagaccccctgaggtccacagagcaggattttgactcatctgtcattcaaagagactactgatagcctgagggggagattcagacacagttggtgaattttgttactttgttcctgactcctgcttaaacacccaatctccctccctctgtgggaaggcatatttttggctggcccttttctctttgtgcggtgccatctgtcacaggggtcattgcttagaacctggcttcttcccggctggagcaggtggtcacagccagtggctattgacagagttgggcctttggagcttaccagtgtgccccccacccccctatgctgtgagtgtggttgttacccttcagaggaagaagagaaagctgaataatgcaaagctgattttgaattgttgatttattcttgtgttccaactacttgactcttcttgtctgtctgtctgtctgtctgtctgtctgtctgtcagcctgttccgctggaccctcagaccgggttgaaagaatgcacagaacacaaagaaagcagtgtctttgg

SEQ ID NO: 23685 - DNA, 1142 bp, Mus musculus
agatttttcacatgggcgctgggggtcaaactaggtcatctccctagttctggcttcagaacttttctcacaggtaaactccctggatactgttctaacaatccagttttatagatgccccacgtcacatgtagatgtgtacatgtacatgtggagacatgtagaatggctcaccgcacactcctgtttgtggtaggggtaagtgagttgctggatcagctcagctgtctctgtcttctgtccagcagtctcagcaaaggtggcagttcctgctcaggtggggctgctccagtttggtgacaacagatagcacattgccaaatcactgttcagttttgatcatagagcagcagctctcagccttcctaatgctgtgaccctttaatgcagttcctcatgctgtggtcacccctgactgtaaagctagttttgtctctactttataattactttgtaatttgtgtctgctatgaatcataatgtaaatagctgtgcttttgaatggtcttcggtgacccctgtgaaagggtgaaggacccaaagggcgagaaccaccctgataaagactaggctgtgatggtatgggaagggaaaggtcagaaatgtgcgagcccttattgccttggctgtggaagatctcgaaactgttggatgtatctcatttttcttcctcacaagtaatgataggcagagtattgcaggggaaaggagcacacagtgtaggggtgagagagtgcgggggtgagggtgtgcaggggtgagagagtgcaggggtgagggtgtgcaggggtgagagagtgcaggggtgagggtgtgcaggggtgagagagtgcggggggtgagggtgtgcaggggtaagagagttcaggagtgagggtgtgcaggggtgagagtgcaggggtgagggtgtacaggggtgagagagtacaagggtgagggtgtgtaggggtgagagagtgcaggggtgagggtgtgcaggggtgagagtgcaggggtgagggtgtacaggggtgagagagtacaagggtgagggtgtgcaggggtgagagagtgcaggggtgagggtgtgcaggggtgagagtgcaggggtgagggtttgcaggggtgagagtgaagaggtaagagtgcaggggtgagggagt

SEQ ID NO: 23686 - DNA, 1114 bp, Mus musculus
cataacttgtatataagaccctttcttcccccctgttttcaaacccccacccagtgataccattacaagttaactttggtttgattctgcaggtatataacagagtttgtaaacctaggcaatgtttcagctctacgcactttcagggtactgagggctttgaaaactatttcggtaatcccaggtaagacggcccgggcttggtgtcaggtgttgggttagggccctgacgtgacgtattgtacttttttttgttttgttgtggttttgtgtgtgtgtttttttttttcctttggtgtttgtgtctgtacccgtgtttgtcatttgtgtctgtgtgtgacctccctcactacagatatgtgacagagtttgtggacctgggcaatgtctcagcgctgagaacattcagggttctccgagctttgaaaactatctctgtaattccaggtgagcgaattcgtgcacaagaccagtcttgccacgctcctacttcctcccattcgtaatgtctgccacatttgaacctgggatcggcacatctgatatgccttgtctcgctctgcatgcttccccctgagaagaattctctggaatggccctttggtcctgaggcagacgtctcggaccttgcttgccgggcatgcggctctcattccatccatgcgtttgaaataaaaaataaaaaaagcacatgcttataaacccttaggccctcacagcacccgaggagaggtgtaccggggtgggctgtgcctctgtatgtggaccactcgaatcatggcctcatggaattacagtgtctttaatatccacccccattccactgcttgtgatttcagacttcccgtagcatgttctgccaacagcatgttatccaaagacttgtacttttactggtgttatacgaatgtaatcattttagtcaaggagcaacttgcccagttaactagtcaggtcagactagttaaagtggagaaggcttggaagtcagtgagacagattttaagttaccgtctcccatattttgcaagtgtctgcttcggtagagtgagacctggtaggtgtctcctgggagcagactcaggggtctcaggggtcgctctcaagtgcaaac

SEQ ID NO: 23687 - DNA, 1117 bp, Mus musculus
tgttaggatcctgcctgtcatctttgtgctgcagacagtctccaggtagactgcgcactggttcaggtcagcaatgtggggctcatcctagctccagagctactactggcactggccattccctgcctacaaaggaaatggaccctccccgcagaagttcttctagtcattgtgttaaggaaaagaataatggaagactgtcctaccctggcagaggctagggtagctatttggagctatcatggaggaaagagagggtattacaagaagtatggttccaaatgccacaaagggttctaccgtcagggagagtgatggttgggctttcaaggtggaagttatcatctgacagggagagaggggattatggggccagagccatgtcaaggatgctcttgggagagacagtccctggtggtgcttattcactgcgtttcttttgttaatgtagtgactcattaaattctcaaatggtttcttgtcaaccaggataagagagcttgtccctgtcggaaatcccatgttggcagagctgaggaggggcagctgaggggtgtggaatgtgtgtatttatctgtattcttttccataggttccattaagtttgtctggcttaatttaatgggagcttctgggagctgcagactgtaaagggcgagggtaaggctcttgtcacctcttcaggctcctctccttccaacgggacctcttcctcccccatcccctcagcccctcccttctccaacctgcgtgtgtgttctgccgccttcccttcctccttctctcttccctttgtggttttcttccgcctctctcaaccacctttccttccaggtcgtttgagtcaagttgaagtaggctgaagtaggcagccggtggtacccacttccgctgctgggggggtcccccgcctgttaaatcagtgctagggggtttattctaacactctggaacctctgttttctttttcttttcttttctttttttttttttttctcttctgtttttgtgtaggtctctttagtcagccttatagctaatgccctgggctactcggaactaggtgccataaagtcccttaggaccctaagagctttgagacccttaagagccttat

SEQ ID NO: 23688 - DNA, 2554 bp, Mus musculus
actggccatacccgacatgagttggcaccagggcctaaggaactcctgctctctctccccgcaacctttgtctcttgtcctctgagcgacatcctcctttcccattctactttctcagtattggcttagtttttcttctcatggttgtgtcactgacccctccccatgctgtctctgttccttttcagctcttccttctggtccccatccatcaccttctgtgcttgtctctgtctcctggaccctgtgctttaaccctccctctctcattgttctgattcacaccacagcgactcttggcggaagttcttttggcccagaggctgagaaggggggtgggggacagggagccccaaccccctccgtactttacccacctgaaatcttggggccttagggggtgggacaaggattaaaaaaccacccaaagaaggcttccccccccctttttggtttgttcatttttgaggggaagtcccagaaatgtaggttgcttaatattttaggcctcttatttttgtaagatgtgtaggatttgctgtttttcgttttattttgacaactcaggaagaaactgacctcagaaagaatgttagagtttggctgctctcctgttacccccaaccccgtccctggggagcagattctcccagaccagagagatttggggctaatgaggaaagaccagacccgagccccagactgctgtccctgggatagacgcagaatgtatctaggggctttctccccaggcccagcttgcaagcaagaggatggggcagaggctccagggggtgctgcttgctgccttcttaccattcttccccgtgggccccagtcctcagcttccggtggtctgtgaaccttgcagagagttggggtgctcttgtccattcagctgggcagaaggttctcaggccatctgactggaagcaggttctgtcagaggtgctcaataacaggctaagaggattgcctctggcgtgaacgtggtctagccacaagtctggctggacacaacattgactactaggagccaggcaccctgtgacgagacagagcactgccctggaaagggttctgtgtctctgtgtggggtgtctacttgtccccatggagctctgggtctaaactgagggcctggagggaactgggtgctttcctgtgacgttagtccagacttctctgcaaaccacatccctcctgctccttctcttgataaggctctttggtcccctcaggccatttcacactctttggtgcaaagaaggtacaccccctatctttgtcccaccttagcccccctaccccttgcccctacagctcctagatcccttcatgttctagatgctgagaataccatgagagacatggcaggagcaggggcagggtgctgagggcaggtgtgaggagtgtgaacaggagagctactatgtctccttcatccttgttctctccaagcctctctctggagccagccgaccaagtacagggcttgatgcttcagagcaagtggcccagggtgatactgcagatgatcctcggtggggcctagagtaagggagttctctcaggtctggggtgggggtggggataccggtgcaggaaagtggggggggggtgggctgggttaggagtacatggacccaccgctggggtccccacacttcctttgctgggctctttctgttcccggtttggaagctttgcacaagaagacagcccccggctgcagcacctacctcacgagcatggggcaggatggcagggcgggtctagccctagcaatgttggggggcataccaaagaatccagggatggagcgcaggggagggcacaccggccctccactccctctgctaacattgggttgggatcctctctcggttgtaacccatttctacctcattttgctgtgtgttgtacatggacatatttatctcctatctgatgatgttctgcagttgtggcctgtctacctcagaagacactgtattttaaaagaagatattacacagtattaaagttatgatgtgtggcatccagaggatttcttgtgggtagtgggatatggggagtgttggctacttgggtctgtcagtctcctggctgtggttctgagtgtttctgttccttgggactggaagaggaagaggggctcccaagagcagggcagtagccctgggtgagcatgatgagggtcatatttgtcttccacagggtggagggcaaggtttggagacatctgaagccaagtcctgcgggccacatgagatcttttgcccatttccaccctgctgttcagtcctggttatcactcacggtaagaagccgttgcgggaaaaatgttgtgggaaataataaaaagaagaaggaggaggaggaggaggaggaaagaaagaaaagaaaaaaaaagagagaaagaaagaaaagaaaccaccaagttcctgagctccaaccacttactctctgccctccaattctccatcaaggccagagctcccgagttacctttgctgctatgccagccccatgcaacgactgtccaccccac

SEQ ID NO: 23689 - DNA, 1158 bp, Mus musculus
cactgcagggtgtcactggcaggggactacatgagccgcttgccaagcatgccagctgctggcacagctttcaactgggagggatcacagtgccccatcaaggttgggctgctcccctccgtctgatgtgtggcttggaagcgctaagagccccttgggaagtgagcttaggaaggtgttgagcggcccagtgagaaagtgaatgagcagggatcaaggacctggtgttcctgaatgacccagtccatagggctgcacttgctctggaggggacattcccctggcttgccacaccaagaaaacactgcagcagccgtgctgccttcagtttcaaaccgtggacagctttagaattcacctgtgagctggaggtgggcaggagttcacagtgaagagctgagctcacactcactgtttgtttctgttacttattacagtactgtagcttcgagttggggccttgtgcatgctaggtgggcactctagcactgggttttatctccacacccaccaagcctactttatactggctagtcctggactcccaggcagcatcgggataaagaacagggctcaggaatcatgcagcaggagagtggctccctgcaggaattgggagacagaggcctgccttcttctgttctcttcagggcctggcacacctagaccagtgacaagattagtcattgacacaaggaagagaccgtggtttaccgtttgaccccttgatagattcctaccttctgtggtgacgcagcaacataccaccatcctgtttggatctcagtcgtgttcgagagagcatcagccatgctccctgagagcatcagccatgctctctgagatttctcccacatcaacaaggttttcatacttggagccagagttaatctctctcgaaaacatttttcacattgattgattgattggttgtgtgtctgtgtctctgcacacatgcggaagtcgggagacaacttggaggaattggttctcttcctaccatgtggggttccggggtggaactccgggttgtcaggcttagcagcaagcacccttacccactgaactgtctcgccagcccctagaggtctcttaagtctcagcctcacactaggggtgagaggtaggggaggccagctccagtgttgcctgacacag

SEQ ID NO: 23690 - DNA, 1126 bp, Mus musculus
aaataacacaaataatggcaataacacataacactactactactaataataataaagacaccacggcctgagtgacttccagagcggtttgctctgtgctcgtggtccagatggtcacagcctgtgatgctgaaacagggccaggagctgagagctcctatcttgagctacaagcagaaggatggcttgtgacctctgaaaccccaaagagtgccccagtgatatactttgtttagcaagaccctacctcctaggctttccaaagagccacccactgagggtcaggcagtcaaaggcccaagacagttgtggaggagcatctcaagcaaaccaccacacacacctgggtaagggagtaagcctgagagagaggtgctctctgtcctccctggaggctgccagagatgtggaggcaggaagtggcactgtgtgtagcacataccttcttccttattgcatagtgttccttctatgtggcccttgtctgtgttctctgcagataatggcacctggacccagctgtggcttgtctctgactatcacgagcatggctcactgtttgattatctgaaccgctacacagtgaccattgagggaatgattaagctagccttgtctgcagccagtggtttggcacacctgcatatggagattgtgggcactcaaggtgagtatcgaactcagccagggagcaggaagcttgagacaaaaggcctgtccatccccatgtcctcctcactgaggcagttgggaacaaacgctgggaatggtagtttcgtgtgaggaacagagcccctaactgggttggctttcctcattggctgtcattagccctcccctaggaagagccatagatgaaggcttggcagctgttaatgcatggcacaggtgtttgctaaggaacagcatgaaggaatgaaactaagaagcgagaccagcacaccaggagcaggagtgcaacaatctcatgccaaggttgggcactgccttgcacagctcacggtggcaagatgcggtgcccacctgtccgcatcctggatgaggaaacaggctttgcacttggttgtactgttgcctccagatcctgatgtgattgttggtgcttggttgacctgggcagcagctc

SEQ ID NO: 23691 - DNA, 3456 bp, Mus musculus
ttctccccttgcacctctgccccttaaggaagggaaggcctaggaaaaaagcctcaacgcatcacggggtggatctgacctgacgaataggcaggcagcgaagatgagccagtgccagcggccaaggcttctgtgggtctctcactgcgggtctctcactctgggtctctcacaggccttgcgagtgatgggaaagatgatgcgggagtgctggtacgccaatggtgctgcccgtctgacagctctgcgcatcaagaagactctgtcccagctaagcgtgcaggaagatgtgaagatttaagctgttcctctgcctacacaaagaacctgggcagtgaggatgactgcagccaccgtgcaagcgtcgtggaggcctacctcttgtttctgcccggccctctggccagagccctggcctgcaagagggacagagcctgggagacgcgcactcccgttgggtttgagacagacactttttatatttacctcctgatggcatggagactctgagcaaatcatgtagacaactcaatgccacaactcaaactgcttgcagtgggaagtacagagagcccagtgcatctggcgtgttgccaggagcggtgaagggtgctgggctcgcccaggagcggcccccataccttgtggtccactgggctgcaggttttcctccagggaccagtcaactggcatcaagatattgagaggaaccggaagtttcctccctccttcccgtaggcagtcctgagccacaccatcccttctcatggacatccggagggactgcccctagagacacaacctgctgcctgtctgtccagccaagtgcgcatgtgccgaggtgtgtcccacattgtgcctggtctgtgccacgcccgtgtgtgtgtgtgtgtgtgtgagtgagtgtgtgtgtgtacacttaacctgcttgagctttctgtgcatgtgtaggccagggtgtggtggccatactgtctctgagtgctgctgcttctcagtgagcagcatgtagttaacctggtgccctcctaggtgtctcctgtccccagaccccatcagtcagggaggttctgtcttctcagcaggctgcttgcccaccctgtgtcacaggccctcctcttccatttcagaccagaaccaaagctggcccacttgtccatggtaggagaagcttttgggtcaaaatgagggggacttgatgagcagagagagaatgtaggtggaagtcttgggtgctgtgtttcagcatcagccatgggaaatgagccagcccaagggcatcttccttgacagctgtgaggaagggccgaggaatccgaagccagagcttgggactcagattggaatgtaacatctgtttatgtcccaccccagattctgcaaactgcagtgtatatttttggtggtgggtttggggtgggaagggatgggttgcagggcgtggggagggaggctggggtgggagggaggcatctgcatgggcttcttgtactggattctctgatcagggtagagaagaggcaaggcttgcatccacttcagggtccctactgaggagagtgagcggtccgagctgaatatggtgtttaacctaagtttagtatttaatgaattctagaagcctggctgtgggtggtgatttggtcagcatatcttaggtatataataactttgaagccataactttttaactggagtggtttattttaattcagtttattttattttattttggggggagggtcaggattttaactttaatattgttaagttttgtaaaaggagaaccatctctgtgacaattacctcttagtctgtttgtttttaaagaaatccctaaaacaaacaaaacacaaaaattctccagactcaaacgcacatagttcagtcactggaaacgcttgtctttgcacctgagcctgatcccgctgagcagtgagggctgcttttccccatgggggcttgctgtctcgtactccctgcaccctcggccccatcccgtgagcacctcggccctctgcacattgcccggctggttggaccctttccagatacttgctcagcaaatgtgggctgcgagcctgctgagcgctggcccgggaggatctcctcagggtggggcaggcttgggcgctgctctgctcctctaccactggagggaatggaatcatgcgatgggcgagcacctgctgtggagaccagaagtgctcatggctggtcctgagagccttgatgagctaggatcactgttcttaaagaccactgaaactggaagggggacctgtatccccttgggaagagaagcccctggcaagcagtgggtcctggagactgggttcattgtgagcctttcctgccaggggaggcatgagtctttgcagggaaactgtctcctccagcttctcctgccttggtctccccatattcttagcctttctatttatttcctggtgtataactttccttgctttaaagggatcttcctttaattccttgggccaatttactggccattgaacagtgtcccttgagtcccaactgtgtctctggggaacctccttacccacccctgctgacctcccacttcccaccctgcagctgagtatccgtgattacaggcgattgaactgtagagtcctctctgcctctgtacctgccagcagcagcctcacagtgacccccacgccactggacaactcccaggagacctgtgcgctccgtgcagctcagctcagccgcctctcaggaagcctggagcaggtctgggggaccccccccccatcactctttacattaagctgagagttgggagaagctgtgctttggctccctgaggccaccctgatccacggggcacccgcacctctgcgttctggattcacagaccaagtctaaagcccgttcgttcctgagttgccgtcaaggcccctgaacggtactctcggtacttctgtttgttttttgtacaatttattagaaaggactgtaaaatagccacttagacactttacctctccagtatgcaaatgtaaatatattgtaatataggaaatttttgttttaatataagaatgagcctgtccagtttctgctgtacattattaaagttttattcacagaactgctctgatcccgtctgccttccatatgtaatgactgcctggggcttggccgaagtggggcctgggtcccctgcgtgctgcacttgagcagaacatgttctctgctgacctggacaattaggtcttctgggactggctttgtgtggtcttttagcattttggtctgttttttctaaaaaaagatttttgattctgggtagtcatgggccactccctgtccatggcaatgtaagagactccggttttgcttccctctcctcgactgaagtgtgatgcttgagctgtggggtgcttaggagactgaggcgagtctgcatgctttagctggaatttt

SEQ ID NO: 23692 - DNA, 1139 bp, Mus musculus
tgcatttttggtattaaaggatagctcttggagtagggtgagccagggcttgaagtttaggaagcgggcgaagggtctgcaaggtgcttggttttggtaggtagtgggcgcttgtttaggaggtttccccgctaggatctccagtgtgaggcactctgtactctgggtttgggtgttgattgccgggtagggggttgtctgagcatggactgggaaaaggtactcagagcttcggcgttgctgggatccatccaagtacaagtaagattggatttccacgggtctccttcccgggctctcagccccctttcccagtgtttacttaatacttcataggctgtacttagattttctgattcccttaccgaactttctttctgaaccgtgctggaagacctgggggttgctgaaggaaatggctagctaggttggctgggtaatggttgtgttagactaagttgtcagagtatctagaaacctaggagctgtagcctggtgcagctactgaaagccgcacgtggagcctgggtggaagttgctcacgatagagtctcgatgtagtactgactaggggggagaccccttctgtcatcagacagacttgtataccccagtggtcttttgagtctgttaggtagggtgcagcctgcgggcttggtcacctaacaggtgttgccaggacctgccccaagccggattctcccactccctctttcaaccccgcctcttcctcctccttgagacacccccaccccctcaggaggctagatgcagatctgtatcttgtgttgcggactatcggcctgaagctgggtagattggtgggggttgatccggatgtaggatgtccaagtggagaaacaggatttgaatggagctggaacaaacgcccagtcctgactggctgccacccttcttcctccacccccaacccatcccttcccaggcttcttgcaaacagaggcagaagtggccatatttctttctttctcccaggtgctgtatgccctagggacttgacacggggcaggcggggtgggaactggttggggggggggtgctgttttatgggaagtcgtatgcctagccagcggtggagctgtcctggctaggcacccaggggtggtgtggggaatggg

SEQ ID NO: 23693 - DNA, 1273 bp, Mus musculus
ggcctcagagaatcagaaccctctaaggccatggcctgctcatctctcgtgtcttccccaggatgcactgaggaactcaggtggtgatggcctgggccagatgtccttggaattctatcagaagaaaaagtctcgatggcctttttcggatgagtgcatcccctgggaggtgtggactgtcaaggtgcacgtggtagccttggccacagagcaggagcggcagatatgcagggagaaggtgggcgagaagctgtgcgagaagatcattaacatcgtggaggtgatgagccggcatgagtacctgcccaagatgcccacgcagtcagaggtggacaacgtgtttgacacgggcctgcgggacgtgcagccctacctctacaagatctcctttcagatcaccgaggccctgggcacctcagtcaccaccaccatgcgcaggctcatcaaagacacccttgccctgtaggtcttgctggagccttaatggcagctccttaatggttctgggagcgtgttgctgggatctcggggctctggaacctgcactagatccttggtgagacttgaagagaagctcgtggtgtccttgttttgtggttgccagcctctggtgaccctgtcacctttgcagtggtctggtcctggatgcagcctttccacctgctctggtggggttcaagttctacactgtactgtactgtaggggtgctgaataaagttgaggtgtgagtttgtctcagctctcttggcctgtgtcctgccctgaaacatgaatactttgtggcattctcctgaggacacacatgtatgttgagggcattattcaaagatatgaggaggagtgagcttatgcagtagaagacaggttaaagctgatgtagcctgagctctgttagacattcatatgcatagctgttacccagccagatgtgaccctgacttgtcccgtggatgggggcagtgggtggtttgtctgtatagagcacacagagaatggtttagcatgggtatgtaagcgaaggcaggacatgggtttgttgtgtcccgtgacactgctctggttggcccgcccctcgctgttccagggatgcttgggaacaagctcatttctacacaggtcttaactagacaggggtgtctgcacaggcccgtccacacaggcctatcaatctacacaggggtgtccacacaggcctatcaatctacacaggggtgtccacacaggcctatccacacagccccatccacacagccccgtctacacaggcctatc

SEQ ID NO: 23694 - DNA, 1127 bp, Mus musculus
ttgcttcagtggcacagccttgttttgacttggcttggtgttggcatgaatctctggctctaatcttatatgcatgtggatctgtgggagttggtttgaaggattttgctttttcaagacaggattactctgtgtagccctggctatgctaagactcactctctaggctggactagccttgaactcagatgtaaaggtgtgtgccaccaccttccagcatgtgctttttaatacagaatctcttttttatagtagtgactggtctggggttcactgtgaatattgggctggtctcagactttgagccagcctctacactatgactgctggattttgggttgttttgagatggtcttagcctgtaacccgggctggatttgctcacatttatcctactgtctcagttactcaggtgctctgccatgcttggcttcttaatttccttttgtctgctcttctgtcctagtgtcaacaacttggcatagtaacgatgatgacgtgtacagggcgcctccaattgaccgttccatccttcccactgctccacgggctgctcgggaacccaatattgaccggagccgtcttcccaagtcgccaccctacactgctttcctagggaatctgccctatgatgtgacagaagactccattaaggatttctttagaggattaaatgtaagtgtctttttgtgtcaaactgtgggatattgaggataaaagctaaataaaccgattgtgggatgggccacagaggaaggcaacagagtccaagatgcaaagaataccttaattaattttgttttaagggttaaattactatgacttgaacagtgtgggctatagagtaatttgtcttctgcccctctacccatttttctcccaggttcttatatgttctttggagaaattactttttgtttgggttggtttgtttgtttttaaccctgtttttttgtttgtttgtttgtttctttattctctcagatcagcgctgtacgcttaccacgggaacccagcaatccagacaggttgaaaggtttcggctacgcagaatttgaggacctggattctctgctcagtgctctgagtctcaatgaagaggtaaagaaattaagaggtggggtgag

SEQ ID NO: 23695 - DNA, 1105 bp, Mus musculus
cgtgtggatgttgctgatcaagcacaggataaaggtaagaaaactggtagaacttcccagtttggtgtagtggtcctagggaggtagtgaggctagaatcagttctcagcctgctttgttccatggtaactttaggcagtattaaaggagatttgcctcagtcgaagggactactactgatacctaatgagtataatccagattcatcctatctccttccgatttcaaaccacctactatccttgggctgtaaatttataattagatttgctacctaggagcttgagctttagtgtgatatagataaacattaattaaaatacatttgaggaaaagaatagatcggttacctggagagagcaacctcaaggcctggccttgggatgccagtgcaatagaaaccgtaggtgggatgtgagggaccatgtgagaagtaagtggtgtcttgggtgagctaacttgtttggttttctgtctacagacagggatgaccgttcttttggtcgagatagaaatcgggattctgacaaaacagacacagactggagggcccgtcccaccacagacagttttgatgactacccacctagaagaggcgatgatagctttggagacagtaagttcaggttttttaattgtttcttgggtctgtttgataatggaacgttagaagttggggaacaacttataaagtctggtttctatggagttttttggggggagttattttgataataagaattgttgacaaatgcagataagaaatttgataagttcctaattttaaaaaatattaacagaaagtacaggcatttctctttgaacacaattgtttataaagaataactgaggcagaagaggtagtagcttggtctcaaatgttaaagtcctatcaaacaagcagtgggatcctaagttggattcctagtctccctggtaagaagacagatgtggtgcagtgagggtggtagctctagagcctactgacttgtcagtgggtctatctacttcaggtcacagagagaccctgacgccaagcaagaacaacacagacctacatacacacagacatgaaacctacagcaaaaagctgatgcttatttaa

SEQ ID NO: 23696 - DNA, 1205 bp, Mus musculus
tgcccagcatcccaagtggtagtgtggtcctatgaattaaatctagagccgcatgtgtgttaggcaagcattctgccgagtgagctccattcctagcacccatcagggattgtttttttcttttaaagaaataaatactaaaacatttaagttggtacaaatggtttgtggctgtagtcagaatagaactccaattggtctagtgagctgccacacttgttacctgttttcttttctttctagagtatcgagatcgttacgattcagaccggtatcgggatgggtatagggacggatatcgggacggcccacgcagagacatggaccgctatgggggccgggatcgctatgatgaccgaggcagcagagactatgaccgaggtagtcatgataataatactcagttgaaaaacacttctcaagaattttctattttgctcccccccccctttctgtgtgaccacaatttgagatctgttattaggctatgactccaggataggcagtggcagaagggcatttggaagtgggtaccggagagatgatgactacagaggaggtggggaccgctatgaagaccgctatgacagacgggatgatcggtcgtggagctccagggatgactactctcgggatgattataggcgtgatgacagaggtactcatctctttcttcatggagcagaaaactagaaagttgtttctcagttgtaaaggaggtggcagagcacagtagacctgggtgtggatggcagcgtggagacagaatgttttcatcttggatgctgctccatagccatcttcagttaacatttaatgaactgtagaaaaggagaagacacagccttctgttgccctatcagtgaggaaaatgagagtcccagccagtcattatcactgattctatgaatggtgagattagttttcagaggtcaactctgagtattgtgcccctagttaccgaaacaaagcactgttacaatcagctctaacaagggctaagaataaacagcagccacctaggctaagtgtggcgacaccatctgaatgttagtttttttctacctttgatcaggatgaaaattggtcttgttaggtaacactgcttgattaaatttaagtctattttgaaagtactttgataatttgaaaagtgaaagaaattggactactaagaatttcatacaaaagtgtaagaactagat

SEQ ID NO: 23697 - DNA, 1070 bp, Mus musculus
ttgtccccatgtaaaggcctctgctgagctggagttgggcagtggttcctgggctttggtcctgagtcccattcaccacaagagcgtgttattcccagttacggctgtcctaatacatagacaagttgtaacacccccccccccacctccccgaaaaaagtgttcattccttccaaataaagacaagattgctgttctttcagatagctttttccccttttccagaaagcacttttctccaggtggcctggaagccattggtttatgtgtaactgtagctatcaggaaccagttagtgtctgtctgctgctgatggaaaagaatgtgatgcccctattcccctgctgctacagtccaggtgggctctgtacagcgagctcctcttcccccacagatacacgaaggagagagagtgagaagtctctagaaaatgaaaccctcaataaagaagaagactgtcactctccaacctctaagcctcctaaacctgaccagcctctaaaggtaatgccagcccctccaccaaaggagaatgcgtgggtgaagcgaagctctaaccctcctgcccgatctcagagctcagacacagagcagccgtcccctacaaggtgagtaggcctgtaacagcagctgcttagtggaggtgccctgagggagtgtgtgctgcagaggaggttgcctcctgtataattcatatactgttgtctcaacagtatctgttttcttgatttttgttaaccagttgacatgagtttggtggattaagatcagctatgatgggaatatttaccatagaaatatgtagacatgctttgccctgggacatactgtcagtgtaaccttgctcactcaagtgattcttaaatttttccaagagaagactccagctaagcatgttggatttccaaagcatatggcccttaagtgtagaagacaacagtctttcctgtattttaatattgtagtgtggaatgaaaaggcagcctggtacatttggaaaatggtgtaagcttgtgttgtctttcctgtaaaaactgatggctgattgcttgctgctttattccagtggt

SEQ ID NO: 23698 - DNA, 2640 bp, Mus musculus
taaagtagttcttggctttctcaagcattgccaggtttaccactgtgaataaactagagtcacggttagatttgcagaatctaaaaataatgcactatcccagcaacactattgaatacctattgtgtctctgcaggaaggatggcaaaaaagatcaagactccagatctgcgcctgagccaaagaaacctgaggagaacccagcctctgtaagtgccatgtgcctttcctcttagttttgcgtctgactccttttgtctccagtgagcacacttaaggtggggttaccttcctcggctctcggaaagaggatgtgtgcggccgtccactcgtgcccctgaccctccctgctctcgcagaggaacgggtgtggtctgggctcccatccatgatccgtcctctcctgttacagaagttcagctctgcaagcaagtacgctgctctgtctgtggatggcgaggatgaggatgagggcgacgactgcactgagtaggacctccgcaccctgtgctttctcctagtctccaccccggaacattcaagagcaaatcaaacctctatccagacaagacaaaataaactcaccatctcctgaagacctttctaaactttttttttaatgaaatgaaattcttttgcatgctgctgcagccttttaaagtattgaagtaactggagaatcaccattgtagccagagacgtggctaccgcttttgaatggggaagttgtgtctgacaataccaagcagttactgtgtgactagtgcctggggctccattcagcagaattgcagtgacagagaggcagtcacatcagttaggcagtagaaaaaggtgcaaagcagaagtgagatttctactttctaattcttatcctgagatggcacctgtgaatacccaaacattacctgaatttacctgaataaatttcccatccttagaaaggtagctctagtctcaagctgttttagtctccaggaggctgccagcccctctactttagttctgacttcaatggggccagcctaagggggaattgttttatttttttaccccccaagggggtagttgggagtgagtctacggggcactaacaagtagttcccgcttggggaccaagatgaacggaaactcaatcgtggtttggaaagctttggggaggtgactaattatattttatacccggtagtgagggaaacagtgtgacctccagtaaacacatacatagaatggtcatttctggatgaggaagcacttaacaggtagtgagaaggcctggctttgccccttctaaactctcctttctagaggttgaaatatacccatattattttgaaaaccttgtcactctggtcatctcatggtctccatgacacttagcctcccagagctgtctgtgagtcacacacctcccacagacactgtatcttagccacaaaaagccatggcctgaggactcgctgcttttctcaagcaagccagtgagttttctctgtgctatctttgatttctgcctgctcctgcagctttcagcctcaactgatgggcttgggtggtgaataggggtgtgtaaatggggtgagttggaggtcttcagccttgaatgggatgtaaggtttctataaatctccctcactggagccccacgctggtgcttgtttataatgtatgtgaccctgactggttttctgcttaggagggttggcttctttactcccctcaagaataaaggataatgcaaagaacgattgagcaaggtcctggtttctcttgcaacactgtagcttgacctgtctgctttgatgtgcacctttgtaggggtcagctccaaagatggcgagcctccctgttgtgggtagtcaggtacctgcagacagaggataccttggtcctaggcctgctgtgcaggagcactgatgtcccgtgctgcagcagtaggcacagcaaatcgcttctccggtggatttgattggctagtagctaggaagtgggcttttgcagatacccacagttgaatgggtttttttaaaccattgttgtagacaatgagaaggtagtttgccctcttcatgtctatttcccttccagatagttgcatccgaagacagctgttttgtcccactctcctactttgctcctctgttaaaataaaaacaggggttgacttatgtcccgctcctgaatacatgtaaaatttgtacaaaaatatcttctatgaaaatgatttgtaatctgtagacattacttgggagatgtcttgagatgtaaaatcccatcctttgggttgagggtttttttgtttttctccaaataaatccagtctttaaagttgatggttaatgttgcagtttatcgctctttccccccccccccccatgcctctcctttccccaccccttccttccgtttcgcacagcagtatgtgagctgttgcaggacagtgggtaggctcaccaacagtggagatggacctctgtgcatggagcccaggcagggttcgccgtcctggttgacttactccaacccccagtgtttgcctccttgcagtccatgaagccacgtggtgggcttgcctagcaagctgttgggcactgatacagggaaccacctcaagagatatttcagacttaagggagcttt

SEQ ID NO: 23699 - DNA, 1195 bp, Mus musculus
gctgctttccacagcactgcagtgactcctaaagcccatgtttaggaagttgtgggtttggggcttcatgtctgagtcaccccagtatccccagagaaggggccagagcgcaccctcttctccacatcctagggaggtgccaggcccatcctcatccgctctccccacccccactccaggtcttcttcactcggaatggcaagatcatcgggaagaaggatgctgttgtgccgtctggaggtttctttcctaccattggcatgctcagttgtggggagaaagtgaaagtagacctgcaccccttgagtggctagtggggtcaccagtccatctgccctctccgtctgcattttctctcacagcaggccctgggagggcatccccagtttctgtcagctcaggctgcacctctctgtctctgggcctgagagcagtggtgggcccagagggcagtattgatatgaatgggaggagccccttgatcgggttaatcggtcctggatcttctttcacctcgctgggcgttgagcaaactgggaggtataagcccacctgctgacctgattggtatggtgctctgccgagggtgagggtcgagtagaggcagtctgtccctgtctaccacagctccccgaattctcttcatcccctctcctcatgtaagccagttgctgctgtctccccctggctgggctagggggcctgtcttggccatctctcctttcactggctgctgtcctaaaacacatctagggtctccattgttttctgagagatggtcccaccctcaacccacagcagaaagcctgaacttggcttcctgcctgctcacacgcaactgtgtgtgtgtgtgagagagagaggggctgtgtggtagcgtgggacttcagcctttgctgccatctccttgtctgcactcttcttcaaagcacctctagccctggctccccaggatggagccaaggcaccggggcatgtgttgtattgtggctgtttgcccagagcagcagcttggccccttctttctcttcacctacccaccccccaccctgtgccccagcttgctgcttgtgccagttgacgtttctgctccagtgtttgattctagtgtctatatagaccccccaaccagcccccctcttcccgtttcctgagctcctccatcccatcaacagggagagaagcagccggagct

SEQ ID NO: 23700 - DNA, 1142 bp, Mus musculus
ccttccaaactggcatcactctataaattcgtggtccctgagttcatcccctgagacacagtggaataaacacacatttgccatatctccttcatcagaaggccactgacatcacaacagcagaacgtttaatctggaaaaataaggcagaagagaaagagataaggcttcagctgtcaataattacgcatgatgggataggaggcaggagagtagcccagctggacactgggagccatgaactgggccacagaactggttgtgtaacccggacaggtgccgtgtatctttgaaactcagctccctctataaggcttgtagacttaccctgaacaagtgtgagggtgagcagtgcattttaagtgcagaaggtggtgtacggtaagtcatggagtagggcccatgtttttgtttgcttttgctgggtcttccgtgtggtaggcaagctctgatggccaccctagcccagtttgcttgtttaattagtctctcgacctttgtactcttcgccactgttggggcaggggagctagcccggtgcctgtgaaggactgaccctccctcccacatcccggccagtgctcccacctccccagactgagtgtactcataaaacatctaagcatcccttggatccgagtctctagccagtgaggccagtgagtgctgacagtagattgtgtttgagcagttcctctcaggaaggtggttgtattccagatccactcgccctctcctggggctccttcgacctcagcgtctgtcggcctctctcctcaccccttcctctgagtaccacaaaaaatcagctccctgggatcttgaggtggcctccctgcctcccatagcatctctggctggctctagccaggctgtccccatttgtgggtctcaggctgttcccacttgtgggccctccacttggatgaacacctgtaggcggtccttcatcagctctcactcagctctttcctcttgcatccataattgtcctggggcatatcatttttttcagtcaccaaggcctggaactccagggtcaactttgattcttccatttccttcaacagagattttgtaagcatcttgtgtatgaccagagaatgaccaaacctggtttcttctgcctgcccttattcagg

SEQ ID NO: 23701 - DNA, 2080 bp, Mus musculus
ccttttcttatctcctcaagaagagcggtgttgtgtcacgggtgttcccatggtttgtgtggcactggggcctgatgggatcagctcaagtgccttgtggaggacttgggttccgtagcccatttggctcttttttctgggaagttggtcttggttgtggtttgtggctacctcgcttgtccttgactctagaacccaggcacagttgagcagggggttgtgggtatcagagtatgctgtccttttgtgtcctcttagaacaaggatagtccaaagttttgttaactatgagaaaaacagaaattgggacagtccttatgggacttgtgtgatggagccctctccctgtcagaatcctctgcctgttcaagtagaggagatggaggtctggtctggtctggtcttcagtctcagagaaccgaccttggctccctcctgatagcatccctgcagagtgggggggggggggtgcttcagaggaaggattgcaggaagacacctaatgtctgctttattcttgaccttactctgttataacacccttctatcttgtctacccctggaaaggtgattggattagtgtgtgtgtctgatttgtgaatgcttgtgtttctttgcttggaaggggtgaaaattgttgactgaaattcattcggccaccaacttggaggacagaaaaacgtagggcagccttcccacccagacctgaaggacgtctgcctcccttgttcttgctgagaacaggggaacagaggggcttgtttcagaagaatgttgagggttttttctcattgttgttaggttgatttaaccgtgtactgatcagagtgtttctaagccagggcttctgaacatgtactttctaaagtgagataacttctgctaaagaaaggattcttaagggagaccttggggtttcattgagcactccaggacccctgaggcctacttcaggtgtaatctttgggttacacctgagcacacaactccagctgtgggtaggaatctgagctggccgcctccaggaagaagttttgacttgcaaatgagagccaggcagcaacctaccttaagacctcttccagtgtattgggagatggtccaccacaacttaaggggagaagggagaatgtctcagccttcagttttcctctgatagcacctgagaggaggtctgaagaggacagcctgccgtgtgttctggctccctgctgtccctctaacgtgctgtaaagcctgcgcctctgaccttcgtccgccgtgtggcccctgggcatccatgttcgtgatgcacagaccctttgctgttagagggttctgctgggctgggatttttctgtcactgggaaagaggatacgctgagaaagatatcctcccagaaatgcttttgaaagtggaatccctccctgccactcgtagatgatctgttcgtgctgaaagttggcagagtggcctgtgcctctgcaagtatgaatgtgtttcctgggtcagagcaggccctgcagacagtggcgttctgcctaggtgggagctgagagaagtgagagagaactggatgtgtacagacagcccacccagaaccacactgccaaggccaggtgtgagaggctcagaagctggcagtgggtaaggacagacaggctctggggtggagagtaatacaacagccaagagcctgggcagaagccacatctctaccctgggggaatgcacagacagctgcaaaggctcctgagcctgatgcccccctctgctggggtgggttgttagcactggacagatgtctcaggtgtgtgtagaaggggaaatgagaaggtgggtgctcagacatcagaatgtggatgtgggtttggtagggagagtaataccggtccttggatggactcctgcaccaggccgtcccatcccacccttgctggtgcctgcccttcccatccgtccctgacagcctcttgtcatttagctactgattgtacttcatggcttgacatagagggttagagaagtggggtgaccacactttgagccctctccccaggttccttctgcccctgctgtggccctgggcttttatcttca

SEQ ID NO: 23702 - DNA, 2059 bp, Mus musculus
agaggtctgagctagccagggctcctgtctctaaaaacagcaaagaggaagcttgaaaaatggagacaggcagtgcaggttaggtgaagttcaaggcagggctggagcacctagggagcaccacaggagaagggagagggtgaagtcagtacccagaagtgacaggtctgagctaggagcacctgggaggacctgcacccatgcgtttctgatcctctgcgcacttctgctctcccaatcctcttcgtgtctctctgtaggagcagaaagggctataaccctgaagatggagattccaggcccgatgccacccctgatccgagagatgctggagaacccggagatgtttgaggacgactcctcgaagcctggcccccaccccaaggcttccagtgaggacgaagctccagggggccagggcaaaaggggccaaagtccccaacctgaccaggggccctgacctaccccgttgtggggttgggccccaggcagcagactgaccatttcccagataccgccagtgactgggggaggacctgccccgcccactctccacccttttaatgagctcgttattttgccaaagtttctaggggtgcctgtgttcatccctgtcctgttctaactggctccctctacagtcccgcgggactgctgcacacctaccagaagagctggagaaggggcgagcctgggtctagactctaaaatctcagcactgcctttcggattcaggccacaggctcccgacgcaagaggaagccccgccttcccatagccttttcctctgccaggtgcttgggcctctgggagcaaacaggaacactagagaccaaaaggggggccccccccgagggagggctgagcccacccttgtgccccaccctgagcgcctgactctgtgtgatgaatctgccgcgctcagtgcccccggtgccccatcctaatcctcctgccgggtgtaggggcaggctggggcctgcgtttctagggtggggcctgagggggaagggagaatgtgagcccgagcccgtctgtacctctgctgaagtacagcactcatcctgggccctccattatataagcctctcccttacttctgtctcgtgccttggcctcccgccctcatctcagccatcaggcagggccctcctacactacagaggggccaggggtccctctcctagtgccttctacccttgatccccccagagcagcttggccccggggaggggagatgctgcttagctgatcccaccttgacccagaggaagcctctatttatttattagcttttgtttacaccctggaaatgaccccttcctccaggggtcttgggagggggagcccagggcctctgtgaccccttcctttctttccccaagcccccagtttatatttagctgccaaataagattcctgcaggctcccccatttctctggggggttagggtgctgtcccctcccctctgtttacatctcctaccccgctgttcgcatattgctgagttttctatttttgcaaaataaagtgatggaaactcaatccgggtgtggatccctctaaagttggagaggtgacctgcagacctggaggaggaactgggcccagtggtggagctgctaacgaactttgtagttttcttggggaagcagaatactgatgtggcaagggagggctacaagccacccgagccaccctgagtggcctctcccagtcaccaatgagttcttgccattgctgggatcctatgggttcatgctacacctagatgtgtgtttgcctgggatcctgtgggttcatgctattctgaggtgtgtattcgtccgctctgggcagcaatctgagctgccatttgttttgcaagttgtccctgggcctggaagacctgcacacttaagctacagtgtttttagagtttgcttgtttgagaaagggcctcactgtaactcagcctggccaccaagcctcaactcctgagtgctggatcataggcctgaggcaccactcttggctcagtgttgaactgactcttgagggacctctgcccctctacag

SEQ ID NO: 23703 - DNA, 1177 bp, Mus musculus
cgtttgcaaatttgtggtgcctgccaagataaatgcttgcacagatgtatgtctgagcaagcgcgtgcgccgctcagctagtagacgtatgtgtatgtgtatgtgctccactcccagctctgctcatcttggtgcccggcccctttcgctctccaggccccacccccatccctctaggctttgcttttacaaaaggtctccacagagctagctgcctaggcaccctaagtgaggcagactgaggcagaggctacagcttcgccttcgcgccccgcccagttcttttcccttgctggggatccccctcctccccgcccatcccttaccccccatgcatctcagcgccctacgctagccctccccctcccccctccaggagcggggcgctgcggggggaggagggggaatgggctgcgggtccttggtgttctagcacccagtttctctccaagccgggtcgcgatgtacgactgcatggaatcgtttgtcccgggtccgcgacggctgtatggggcggccgggcccggggccggcttactacgcagagccactggcagctcctgcttcgccggacttgagtcttttgcctgggcacagcctgccagtctacaatgtaggtattcgagctcggagatcgggtgttgggtgcacgagaggttggtgcttacaatttccttgtgtaaagtttgggaccagggcacaagagggtattctggtcctttctatatgaggtactggccctttaaacacgagggcctccagagtccgtctcctttgcgtgtgtgctgcagtgtttggagtatatgtggtttttatggtggatgtttagctagggcttcggttgatgcccctccagagtccttgggtgagagaccgatgtatgttgctagtgtgtcctccagtccttagtctcggagggctatggcacccagcactgtgggcagcgtttgtaaagtccatgctggaagttgggagtgttaaaaaaaaaatgcagagcgtgtgaatccctggcttgtacagacctaggagacgtgggtgtggagtagggggtctctccacgcactgtgacattccgcctaggttggcagatgttcgtggcccaatgtggggatgtttgttgcttgaggccgagagggcgtgtgccttgcgtggctgcgggggcgtttttggaaagtgc

SEQ ID NO: 23704 - DNA, 1099 bp, Mus musculus
cagggtctcactatgtagttttgtctggccttcaactgactttgtagacaagtctggccatgaagtctcagaggcctgtctcccttgcctactggaattacagatgcctagctagtgacttgttttatagatgacagtagtatttaccgctggagctataaaggggcggggggggggggctcatatttttaaatgataaggaagtcctgtagaagggaaacttacgaagttcctttaattttgtccctgatgagcttgtgtcaaagggtcagataagagtagggtgtattctttcctgtcagactctgcccaaagctctggaaggaagtttaaggaccctgtcactgtcagcttttttttttttttttttaaggctgaaaggaaagtacatgtgaaaggttgttagttggcttaaaactgtgtagcaaatgaatggtaaacagatgaaacctgcctcttgccaggctgtgaccctcacctgacacacagtgcttatgccttatggtttctcacacacttgtggtttagtctctagtcttgctcctctgtcccaagctctgccccaggagacagaccagggtgagagcatttagactctgcagtctgatccatctgtgggttcctatggttccgatgagatgctaactccccacatgtgcgctgtattgagcctgtacagtgagctaactgatcctttgcatagtagttcatgctagtgttcctaccacttgggaggctgagctgtgcaatcaagattacaaggtcattctaagatgcatagcaacttggaacccagcctgggctatgtagcaagacccttactcaaaaaacaaacaaacaaacaaacaaacaaacaaacaaacaaacaaactgaggtcaagtagcatagacatcccaacactcacggagtatgggtaggagggtcaggagttcaaggccatctttagctatgaagcaaattgaaggccagtctgggctctctcaaaaacaaacaaacaaacaaacaaacaaacaaacaaagcaagctgggcactggtagtgtgtgtctttaataccagcagagacaggaagatctcttaagttcaagtctagcctggtc

SEQ ID NO: 23705 - DNA, 1201 bp, Mus musculus
tagatggttatgagccaacatatggttactggccattgaatctctggaagagcagatgatactcttaaccattgagccatttctccagccctattaataattttatttttaatgtgtattgaatattttgcctgaatatatgtatgtgtaccacatgtgtgtctggagcccatgtaggtcaactgaggttatcaaatctcttggagaaggagttacaggcagttgtaagctgccatgtgggtgataggaactgaatttaggtcttctgcaagagaagcaagtgctcataactgctgagccatctctccagacccgtcgttatttattattttattattatattatttttccctttgccttaatttttattatttttttaagacagggaattactatataccacaggctgacatagaacttactttgtaaaccaggctggcctcaaactctgaaatctgtttgcctctgctccccaagtgctgggattaagtttgtgtgtcaccatatctgtcagttaattaattgataaattaattgagatggaatctcattgtatgggcctgactgtcctagaactggctttgtagtccaggctggccttgaactctgtcagtttctgcctcctgagtgagtgctggacccagcaatgttttaaagaaaaactggattatactggactggagggagaggttggtggtcaaggacatacactgctcttccagaatacctaagttcaatctctagtgtccatgcacagaggttcgaccacctgtctgtcattccactgccagcaatgtggcttatacacctggacacataacttaaaaataaacatatcatattattcatttttttgctgtgtgtgtgtgtctgtgtatgagtgtggtgctggagattgaactcccggtcttttatatgctcagcaagtgcttggccacatcccagccttgacgtgatttttaaaaataacttacttattttatgatcattggttgtattttacctgcatatgcatgtatgtgtgtattgttagagtccaggagtcaccctacaaaccagaggaacattgatgtcagtcagacagggatagtttattgaacacatactccaagactcatcaatcagggccatagctcagactcgagagctaaaagcaacaagggtgaactctatccagggtcagtttatatagggaagaaac

SEQ ID NO: 23706 - DNA, 1165 bp, Mus musculus
caggaacacgtgacagacagcgcggcagataaactacaactcccagagcgccacgcggccggcctgcgttacgctttctcgctgattggtcactagggatatttgaaaggaggtgctggcgcggaaaacgaagcgtgcccacccggtgcttggtggagctcgggctggaggacgctgctaggccggtgaggaacggcagcttcgagggaattaaggcacggagggtctggtgagcgcgcgctcaagccgcggtaagtgacattcccattgctgacctgggaagaaacggggcgtttctgcggaggctcggcggcccccgaaagggtgtgctcggcgcccaggaccctgtggagacccctgcggtggcctggtgggacactgaggacaaggagcgtcctggaggaaggaacagtggacttgtcagtttgtaacgggagcccagtttatatcggcctctccccgcataggatttctggtgggattctttgcctgcttcatcctttgaatcctcctacaactttcaatcccttctttcctccagttatttccattacaacccttcgcaggcttctacaaaccatttcgttgtatctagacttttgccatgaggaacttcaaaggagtcaacttcgccactctgctctgcagcaaggaggagacccagcagctgctgcctgacttgaaggtgggaccctttatggctcaggacacacctagtttctgagattatctgtgtttttttccttttccttttttctttttttccgagacagagtttctctgtatagctctggctgtcctggaacttactttgtagtccaggctggcctcgaactcagaaatccacctgtctctgcctccctagcgctgggattaaaggcttgcgccaccacgcccggcttccttttcctttttatttattgtttttatttttatttaaaaaattatttttccgccgggcaatggtggcacatgtctttaatcccagcacttgagaggcacaggcaggtgaatttctgagttcgaagccagcctggtctatagagtgagttccaggacagccagggctacacagagaaaccctgtctttgaaaaaaaaaatttttttttcccctagggctactaatgtgatcatctcctaaggacactctggtttatgttctcc

SEQ ID NO: 23707 - DNA, 1195 bp, Mus musculus
tctgagtacaccattgctctcttcagacaccagaagagggcatcggatcccattacagatggttatgagccaccgtgtggttgctaggatttgaactcaggacctctggaagagcagtcagtgctcttaactgctgagccatctctctagctcctttcctttcctttcctttcctttcctttttttttttgtttttttgttttttgttttttgtttttgatacagggtcttattcttttttcttttccttcttttacttttggtgttctcctaagccagttccaatcctagcttcacattagaatcatctgagtgaacttcagggacattctagtgtaatgcttgcctcatgttaattacgtcagatccttgccctagatctcaggcatctacgtgttctaaaaatcctttacccacccgttccccgggccattctttacacagccagagtaaaaggcagtgccttcagaatgggttgaaatgatgggttggctgcattggtaagtgacatgggtcgtacaggggccttggactgtatctcaagtaagggtcaaggagctgagggataaagatggagctatggccttgggtgggtgtcactgtggcaaacagtagagggcactagcctgggtagtggggctcctgtggcagcctgggcaggaacagctgtagtagaaagcagtggatggtacagggccctcatcttgagtataactggctaggaaggaggaagaaagaagaagagaggctctgcatttcggtcacaaccagacagtcccatttgccaagaaagaatcacaggagttagaacaggtccttcagcttgtggatgttgaccttagagggactctagaattggagggtactagaagcctagttctcaggaattattgagaggcaggagggccacctgctatctctcctccatgtgttgactgactgcttgctcgctgtgctgtgcacaacagtggcttcatgttccagctttctcctgtctctgatcagctacataggtgcttcaggctgcatgtggagagtttgaagaaactgggtaaacaggcccagggctgcaagatggtgaccttatggctggcagctctgaaaccctacagtctggaacacatggtcgagccagtcactttctgggttcgagtcaaaatggatgcatccagggcaggagacaaggagctacaac

SEQ ID NO: 23708 - DNA, 1142 bp, Mus musculus
ggtcatttggggggttgtggcagtttgttagtggtgctcaaagaagaaatcaggttcaaaaatatcttagtctctctctttctcttcctccttccctcccctctatcctttctctcctatgtagtgacagggtagaaaccaggatcataaaggtggggaacaaagaacccacaaagtagcaaaggccagctacaccccgcttaagtgtatctttctacagctctgccttggatgctgtccaggaagccctgcagcttctggagtccgtgagtcctgaggcccaggagcaggatcgacttctggatgataaagcacaggccttgttatggctttacatctgtaccttagaggccaagatgcaggaagtatgtggaactgagtccagccgggctgctcccaccaagctggtaccagtcctgggttttgtttcaatctctcttctttcccaaccagggtattgagcgggatcggagagcccaggcccctagtaacttggaggaatttgaagtcaatgacctgaactatgaagataaactgcaggaagatcgttttctgtatagtagcattgccttcaatctggctgctgatgcaggtgagggcagtcagccgtgtgtgtggcacaggcatcttggaggcttcctgagcgtatacataacaaatgccaccagtgtgccacaggctgggtttgtgctggatatgtggggcagtgaggaagaaggcaggcacaaaggcacggcatggtatgaagatggccaggtggggaaagtggtcaccttcttccgatttacagctcagtccaaatgcctggaccaggccctgactctgtggaaagaagtgctcaccaaggggcgagccccagctgtgcggtgtctccagcagactgcagcctccctgcaaatcctagcggccgtctatcagttggtggcaaaggtaatgggatggctggatgggatggctctgccacagggttaaactagaacccaagcaccctcacctttgacctgtgtacatgcagagaagccgagtggcttgagtatggactttgctgggtgtggtgctgtacgcttgcaacactagcacttgggaggctgaggaaggggaattatgagttacaggccagcttgcattatatggtgatatcc

SEQ ID NO: 23709 - DNA, 1168 bp, Mus musculus
atatattacatattatacttttatataacatgtattcagtgccatattttatataatatataacgtgttataaaatacatatttatagataaatacaataacaaagtcaaaggttgggcaatgtgccatatggacaatctaatgtgcatttgaagaggtctgaggagcaggctacaaggagagtggagccattaacagtgaactggagcccagagatgactgagtttctgtcagtgacctgggcctcatggcagctaaaaggggttactgctgggtggaaaggggagaacccaggccatggctctgaaacagcacttggtgatggaagtgcgagagggcatcgacctctgggctggacttagagggtgtgagcacccgcagtgagtgctgggatcaaaggcagcaagtgttctcacagtcatcagccccccctcccccaatgcatttgtttgtttactgttttctcaccacatccttttgtttatccctggcagaccctcctctggctgcgcccaggtgttgtctcaccctgggcacacaccagtcactagcttggcttgggcccccaatggggggtggctgctctcagcctcacctgtagatgctgttattctggtgagttggttcccacccctcagacaagagccttccttacctggtggtagaaagtgtgaggcagtgtggttgttgtttgtcttcagagtttcagctgagctctgccagctatcactgtgatcttaaacataggtctttatgtcgagtagtctggtttcttgctgcttccccttctctggggatttgtgtacataaatgggtagcccaccatgagttgcttgataatcttttgagtttctgtactgagttccctctatctcaggtatgggacgtttcaacagagacttgtgtcccccttccttggttccgaggaggaggggttaccaatctgctgtggtccccagatggcagcaaagtcctggctactactccttctgccgtctttaggtgagtaggcgaaaagctaggggagtgagggaagaacccagagaagggcacttcacttcccggccagtccaggggtggagcctgaaggccctgctgtaatctggctttctttggtttagagtctgggaggcccagatgtggacttgtgaggcgtggccaactcttt

SEQ ID NO: 23710 - DNA, 1204 bp, Mus musculus
ttgttgtttggttggttggttggttggtttggttttggttctctgagacagggtttctctgtgtagccctggctgtcctggaactcactctgtagaccaggctggcctcaaactcagaaatttgcctgcctctgcctcccaagtgctgggattcgaggcgtgagccaccactgcctagctagaaacagcttttacaaaacactatgccagtggctttcttctacttctctcttcaaaccaccaaactttgaggtaaaaggcaagaaaaggcatgccttagcacaacccccaaagctcatgagacaaaggaagagagtggctgcaaactggctaaatcctagcacaaggagaggcaggccttaggtagactgggctgtaataaggaggaggagtcagtggacattttaattactactgttccaatccaaaaattctaaccacctcttgccaggtgtggtgcatgtatgtatataattccagcctgaaagtgggagcttggaggtagctcaagcaggaggattaaggaatgcaagccattcctggttgtttagcaagactgagactgccggtagtggtggcgcacgccggtaggatttgctgaaggaggcagaggcaggaggatcacgagttcgaggccagcctgggctacacattttggggctggtgagatggctcagtgggtaagagcacccgattgctcttccgaaggtccggagttcaaatcccagcaaccacatggtggctcacaaccatccgtaacaaaatctgactccctcttctggagtgtctgaagacagcgacagtgtacctatatataataaataaaataaaatcttaaaaaataaaaaaaaaaaaaaaaaaaaaaaaaagactgagactgtccccaggtgtacacttatatatatatatatttatttatttcatgtatgtgagtacactgttgctctcttcagacacaccagaagagggcatcaaatcccattacacatggttgtgagccatcatgtagttgctgggatttgaactcaggacctctggaagagcagtcagtgctcttaaccgctgaaccatctctccagcccgaggttttatctttacacatgagtattttgtctgagtgtatatgcaatatgtgcctgatgcctgcaaatgccagagagagttgaatctcctgaaactagagttatagagggttgtcagccac

SEQ ID NO: 23711 - DNA, 1244 bp, Mus musculus
acagagacacacacacagatcttgaagaaatggtgtgttatgagctagtgagatggctcagcaggtaaaggcacttgctgtcaaggctgacagcctgaggttggttactggaacccatgtggtagaaagaaagccgattgccaaaagttgtcctttgatttagacaagcatcctacacatatcactcatggaagaactgtagttaaaagttagagccgggcagttggtggcacacgctttttttgttttgttttgttttttgtttttttgagacagggtttctctgtatagccctggctgtcctggaactcactgtatagaccaggctggcctcgaactcagaaatccacctgcctcttcctcctgagtgctgggattaaaagtgtgctccacgggaaaaaaaaaaaaaagagccagtcgtggctgactctgttgtgaaatttcggtagctatttagtcctgccttttcacctttctccttgtctttttatttcaggtgatcatggaactcaacttggtcttcatggatctggtggtgatgggatacatgatgagacagcaggtggagaaggagagaatagctctgatctccaaccccaagctggacgcaggactcgtcgggaagcatgtacatgcccctattgcaaagacagtgagggaaggtgagttcattttcttgattatagaatttttcttttactttttttttctttcttataaaaatatgaggaaaaaatgataggagaggactggagagatggttcagtggttaagagcactgacagttcttccagaggtcctgagttcaattcccagcaaccacatgatggctcacaaccatctgtaatggtatcccaagttgtcttctgttgtgtctgaagagaaagagagtgacagttgtagtcacacgtgtctgtaatcccatgttttgtgacagacttttcctgaggaggtataataagtacatgtgtcttttttttttttttttttagttttttgagacatggtttctctgtatagccctggctgtcctggaactcactttgtagaccaggctggcctccaactaagaaatccacctgcttctgcctgtcaagtgctgggattaaaggtgtgccaccacacctggcacatgtgtctatttaaccccacatagggagtatataaataaaatgagggttttgagataaagttaagaacaggactatgacttctccaaggtgtagttgaggggaaggttttta

SEQ ID NO: 23712 - DNA, 1662 bp, Mus musculus
tttgttattttatttgggatcagctccttgcactcctttcctgacttaatccttgtctccctttcctcacacgatcacttcctgtgttgtttttgacagtgattcctggattaggcacttgtgttaatattttaaagactttagttccagcaacagagtggaaaagcctgaagtatagtctgatgcttgaagtagctatggagggagtgttcaaaatactactgacgcaagcaccttagtgctggagagtcaaaaccatctcccttttttagctgttctaaacatcagaaatcagaagtctttctgtggaattgtacaagaggccctttgaaggagatatacttccaaaatggtcaaatagtaggcagcagctttcagtatgaaaaagatgttctcagaaaaggaaataactcttagtcttgggttcagaagttagtggaattattcggatttcagtatcattgtcttccaaatagctataagcctcaatgtatgggcttctgagttcacactctgaaaggaagtacacttcctcttttgaacatttctgtagttccttcctattactgttttaatgttaaggagcatcagccagtgaacctgtttggattttccatcctgtagagtgcaaaacttgtgccagtggcaaaagtggttctttaaaaaaaaaaaaaagtcccccttaactcttccttagatatacttgggtggttcctaagggaaagggaagcacacaatcatgggaacgatagcccagaacaaaaagaaatcttgtcttaccactgtggattataggagaaactgggagaaattatcctgctttctctatggcctgattccagaagagactgatccaaacattttatcggcagggaaactcagtgcgtttggcactgagacttaaatgcaaccagaattgtcctcaaggcccagccattaaagcattgtctctctagaccttgtgctatcttgtcagagagcttttcactgtgaggaagtatgggagtggttgagtgtatgtgtgagatctgttaggttggggataggttttctgttagccaatatttaaagagacctgcaataaaaaattaccctgatctgatagagaaactaaattgtttttgtatgactgcgtgtgaatgtatttgtgcctgtatatatctacatgcagatgagaacttatatttgaaattgttggaaaataaattcagatcaaaacgcctttcaggtccagtatctagaaattggtcataaaacttgggtatgttcctaaggtcagttctctgcttatgctaaatcggttaacagttatggggttggggggatatcctagtgcactttctaaagaagaaactatttttgtgtttgaaaatgaaatcaacatccaaatctatagtggattccttattctaacttctctatcttggctacaaatagattatagtgttattatacattttatgtaaattccatctaaactaggttcttgataagtttatggtattgttagcttgaaatactaacattagtttattccatttggtcctttctatgcagacttaatactgttatcaagactcaggaaatatttcaagggactgtccccaaatcacatgttattaatgttgacgtaaaagttatctgtcctcagccaccatcaca

SEQ ID NO: 23713 - DNA, 3002 bp, Mus musculus
ttttctaaagttaagagactacattcctctagtcagggtctcatgactgaaaaataacctttccccaaacttttggccttcagaatttaacataactggcatgcatattgattctgaaattcttttcattacatttttgttgtttggggttttttgtttgttttgtctcattgagacagggttttactctgtagcccaggctagcctggaattcactgttaactcagactggcctggaattttgaataatttttttgccttctaagtgttgggattacaagtatatgtcactatgtccagccttcatgatttttcacttaatttttaaaaaaaatgacggcaccttgcaaagtggtgggtgaccaccaatataatcttgttttttgttttgaaataggtctttctaggtacccttggctgatctgaatttatatgtagtccaggatgcagcgatctgtccaccttggcctttcaagtgttaggggttacaggtgtgtgccaccacatctagcagaaatagtaatcttaaagcattcatttccttgtcctaggctgcccatttgtactcatttacaaactatttgactgtgtcatctttttcctagaaaggaccaactcaccatcttccttcagggacctcctaacaggcacccttcggggtgctattcaaaacgcaatataatggttctttctcagcttggtctcagaataaatagaccctttaatcacagaaaatatagactgaagtatgggatgaaggtgttataatttggggagggtgggagactaaagctgtaaattactatggctgatttatttctactatatacatatattttttgcttttgtatatcctatatagaaaactaagcattgtatttttttaacaaatctgagaaagcactatgaactgcaggtgtttgactttcagaatatattttgtattgttaatacttcacattatgtgaatactggacgctgcagatctttgtaggccgcaataaaattggacactttttgaggggttctttggaggtgctaatcaggcctctgttacactttgaaggagccctggtgctacatgattaacgtttcattcaattttaagtgccctaatgtctttttggaccttgggatcagttgagaagtgatttagagatcaggtaccgagggagtgaggatagtgtgcctgcctcagctaagggcctctttcatggttttactttccatagacaaagttgggtagcctcttggggttgaaagcagaaatgttggaaatctcagagtttcatcttctcttagaagagccagtaacttacaaggataaaggtagcagcagttactttgggagaggagggcatggcacttttccaacccggaaaacattgctttgaaagctgctgataaagcatgggcaggttattagtttggtttagaagactgtgcgtctcttggctctgctccggggtacagatctcatctaggaggatgagtagaagctttgaggttgagctgtttcttgtctttgtctgccttccttaaataacatcccccaaaaagacattaagcagcctttacgttcctactccctcttcagacttggctcatgtgttgtaggttgaagactgggaagagagaagaggggcagtcttcggctccattccttccctaagtcatctctgttcaaacttccacacactcagaaggatttctccacagcactcatgtgagagagaagctgcttctttttttccaatttgccccttctttatcaaacagcccaaccttccttgtcttgggattcatctgtccttcagctcctctaagtctcagctcgtggaggtagaggagcctggcaaattaggctggggctacagatagagaagacttgaggtacatctgcttggttgtgtgctttcctatatcttgccttcaggaatcacactgtgccttctccactagggaactgattctatctacacagcttttccagtaactgctcttgaaaattgtgggtaatggcagttcttcatacttctgatgactcttttctcccaataacatcctaatatcccttacctagctaaagactaggcacaaagtcagaatatgttgataatggtctgaggaagccaaaggcagctgccctagggcctgcttccctctcccaagtctgtcatctctgggcagaggagtagtgctccaatctggtgcctaaaaccagtttatctttcttaatactggcaataaccagtctctgtaccactgttgcctttaaaccttttaatctcacgatgtttgttgtgggttccaatccagttatcaccagggctgtgagggtaaatacttctaaacagtcacttaccttgttctctgccctcactcttgagtatgtatgatgttaatctcttgtcttcctgttccttttgtatcttcctcgtctctctccccctaattttgtccctgggtgttttggggatctcagtatctctttctctatatctctatctcaatctctctgccttttgtacaaagattagtttcaatgtagtctgtagctcctttgtaaaccaattaaaatttttttaataaatcatgtctctggtgtattgagagtgttgggaatggggtgtgtgtggtaacttcctattttgaatccaacaaatgttgcagctacctacactatattgtgctcccatacattttaatgaatgcattttactctacacttaaccttagacgagggctcaggaagggaacagtgcactctgactgcacagaatgtggaggacttcgggttccgtagttcatgcctatggacccagcactgggaagactgagtaggatgaagtagtgtgaatttgagaggccagattggtgtatataggaagttctaggccagtttagaatctgtctcaaaaataaagcagaaaagagggtggacactgagtgctgagtttcagagctcaactataaagtacttctgagttgtgcatgatgcc

SEQ ID NO: 23714 - DNA, 1163 bp, Mus musculus
gtaaccagaggtcatctgggtctgatgatgtgtcctttccccttgcagcactcctcctcttcctcctcctcttccagcagtgactctgactgaacgcagggcctggagcctcctcccctccagcctcaccagctccactctcccaccaagcttcagctgtcatcctcgtacggagtgaggggcattagccctctgctccctgccccactcctacctgtgccttcccctgctgttctgtcccggctgtcaagggctagctagcaaaagcaaagcggccttcttgatctgatcgtagctgatgaggtcagtggggggaactgtcttttgaagatggcaagacctctgagctaaatggggagcaccattttaagatctgcaccatgtgatttttttttttcttccactttcttttgtaacacttgtgacttgggtttgtgacagtttgtgatgaaaaacctctacttttgtaatggcggcacatgagagtgatttaatggcaactgtgttcccggcagggcttttggatctcagtaactgtcgagctgctggaaagtgcagtctctttacttggtgagctcttttgggacccgacttattccttagttcagtatgttatctttgatggctctaagtccaaataaaagttcttcttccaggttctactcacctgtgccattaccttgactgggctagttttgttactcttggtcatactctttaaagtacgtcacttttttatttttatttttttaattcctctgagagtctcacatcacccaggcttcatatatgtgtgtgaatatatgcatatatatgtatgtgtgtatatgcatatatatgtatatatgtgtgtgcatatatatgtgtatatgtatatatatgtacacacatatatgtgtgtatacatatacataagcatatatacatatgcatatatacatatacacatacacatacacacacacacacacacacacacacacacacacatatatatatatatatatatatatatatatatatatatggtgactttgatatacagatccttatgtctccacatttggagtgctgggatcacaagcttcagccaccacacgttgtttatgggcttgaaccaagacctgtgcctcctagtcacggactttatctggagctacgtc

SEQ ID NO: 23715 - DNA, 1161 bp, Mus musculus
ccggcttgctggcggggcgggtgagcgcggctccccgcgggggtcaggcgctggcgcagacacacgaggaggcgctgcttgtccggcccctccccctgggtcgcagcgcccccccctgaccgaaccgtttattcaccccctttcccagtcaagggaaagggggggggctttttttttttaagtggaaaatgcttggatgacccgggcgggggaggggagtggggagctgcagagttaaagggtaggcggactccctgttaccgagttactctgacgttctctcgggtaacgaattttgaaattacaaaatgcctgccgctataaaccagaccgagctatttatagaggggtaattgactgcaggattaacagctggattcccaggatggggtacacttagattgacctactcaggagaggaattgacaggtttctcagattacttacatgacttggagttaaaaaaaatacatcttcgtgctttacttaagaaatgaatttgtagctaggttttcagtttctttgccttttgaacttgtataactgtatttctaaggtgattaatataacagtggggaagtggaactaacagttttatactgtatgagggggtgttaatcttgcagactcagtgaacaagcattgtttttccataaatgagatgttgatttgtgaggtttttttttttttgacagcaattaactgttttctggaaatagggaactgatgtgctttagggatgcatttatgtaatcacttacatcctgaagtaaccagaagatagtttgcattatatagagtggtgtgacagtcactttaaagtgctttaaacatacttaaagtatggacttgggattcagagtttggaggccagcctggtgttaatagttacattcagtactgggcaacatagtgaggccctgtctcaaaaaaacaaaacaaaaaacccaacagtatgtgtattgtgtgtgtttatggcaaagtgaaaactgactggttttatgaagggacaaaattagttgtaggaggagagaaatcattgatactgatttgaagggatgaatacttgccatgctattggagaaatttcagggcttgagactcttggaactgtcagtgtttggtgttaaagtattaaaaacaaaaatatcaaaaaccaaa

SEQ ID NO: 23716 - DNA, 1338 bp, Mus musculus
tagattttctcttcattatgatgaactctgaatttcttaacactggattttctccattgcaggaagttggcagtatcatcggaaaggtaagacagtttcacttcagcattaattcctgtttagtcagtctgggctgaaatagcaattggaacttatgtttgacttttctttcttacagaaaggagaatctgttaagaagatgcgcgaggaggtaagatgcaaggaacattgggattgataaccttggaaaaacctgaaaaagtttgtgagattacagggggaagagctcagaaaaggaaagcattttctagttagtttgtaataataatagtatgatagaaatgagttttgtgtcaagtcctaaaaacgtaaggcacatgcaataggttgaagacaagtagagcagtattaggaatgcttttgtgtagcatttgttatctaggacagactattctgtacaattttagttctttttatctattaaaactacttgtttttctttctagagtggtgcacgtatcaacatctcagaagggaattgtcctgagagaattatcactttggctggaccgactaatgccatcttcaaagcctttgctatgatcattgacaaactggaagaggtttgttgtacctttatgattgcctcctcctcccataccaggcaataaaaaaaataaagttcatgttaagtaattgggctatataccctcagttgactttttttttaatataattttattctatgttcattagtgttttatctgagtgtatgtttatggaaggtgtgtcagaacctctggaactgtagttgcagactccaggtgtgagccattacatgactggtgggaaatgaacctggttcttttggaagagcagttaccactcttttttttttttaaagaatttttttttttatatgtaagtacattgcagctgtcttcagacacaccaggagagagggagtcagatgtcattacgcatggttgtaagccaccatgtggttgctgggatttgaactcagaacctttggaagagcagtcagtgctcttaaccgctgagccatctctccagccccccagttatcacttttagcaccaagtcatctcttcacacacacacttttagtatggtttttagtatttttattttttgacataagggtctcgttttgtaaatctggcactactgtgagtccttcagcacgtctgggataggctcctgagtgctgagattacatggaaatatgcattaccttttctaattttgccatttacagtgtttttagtaattgtttcacaggtatgctattgctttctttacagttgaatgaactta

SEQ ID NO: 23717 - DNA, 1191 bp, Mus musculus
tctgttttgtgagcaaaattcccagtcctgttttaggccaatagtccccctagttaccttacagctggtgtttcctgctagtcagtgtggctctcttattggaaaaggtggttatagttctgtgtctaatggcctgtgtctgtactggcctgtatctgcagatttttttttttcttggtttttccagacagggtttctctgtatagccctggctgtcctggaactcactttgtagaccagactggcctcgaactcagaaatccgcctgcctctgcctcccaaatgctgggattaaaggcatgtgccaccatgcccggcatagatctttttttttccttctctttgtgagtgctgaactataagcaatgcttatatatgcttatatatgcttatatttgggtgcaaattgtgatcttcatagtttggtatggttatggtacatgcatgtccaagagtaagtgattattttatggaaggctttcaagtatagatatgctatttatccttttggtgttctaagcagttttcttttttaacaggacataagcagctctatgaccaatagtacagctgccagtagacccccggttaccttacggctggtggttcctgctagtcagtgtggctctcttattggaaaaggtggttgcaagatcaaggaaataagagaggttggtgtttatttgttttcaaatatctctttgctttttttgtttttatttttagccttgattggcctgactatgtagacaaggatctctatgagaaccacctaccctctgtttcctgaatgtgtgcaccattgttgtgtctggccagcagatcacaacatgggttctagcctggaaaggcattttggaaacctggaagagaagaggggctaggtggcgagagaaagaaatgcagctaagacaggcattctgatcaaagctcaattttactgttctgcacgcaattataaagcaggggaagggggcccgattcccgccaattaatcttggggtccaatagcagggtgaccacgtgcacagctccgaacagcaaagcggcaggttccagcagtgggcatggcaaaatgattgagcgggaagctccacccctgagcaaacaggtttcaggctgggggaggggagactacataccattacaccccataccaaattgtgttacagctagaaaaggttagcattt

SEQ ID NO: 23718 - DNA, 1101 bp, Mus musculus
ttggggattgatggtagtagtagcaggtttgtaatcttaggacataagagacttgagaagggaaactccaaggccagtttactgtgggcagtttaagagaccatatctgagaaatacaagctggattaataccaggatttggagacagacaaggtcagaatggtctgtgcagtaaattccaggccagccagggatatatggtgaaaatcccctcaattaaaaaacaaacaagaacaacaacaacaaaaaagtgggattaaaaagaatgttcatatactgttgtacagtagtttgcttagcatgtatgtggccctaggtttaacccctagtactgcttccacaggacacctacctccgcaatcatgattaacatcccatgaagactatagtgtggtgatattgaagttaattttaaaaaatcataaattttattttgtggtgtccaggattgatatctaaggcctcacagatgctaggtggatgttcctttactgagctacatcccagtacactattctgtatccccgtcctctgtttccccccacccccttttcattttaaaggtgaggtttgctatgttactagcctatactagaaccttatatacatttactagtaatcttgcctcagtctctcaagtacctagcctggctcagtaatgtaagaatatgagtgttacttagaatttctttttttttttttttttttttttttaagatttacttatttattatatgtaagtacactgtagctgtcttcagacactccagaagagggagtcagatcttgttatggatggttgtgagccaccatgtggttgctgggatttgaactcctgaccttcggaagagcagtcgggtgctcttacccactgagccatctcaccagcccccatacttagaatttcatacgttaatacaatctcccagttttcatgacatatagttgctgttcttttttgagacaaggcctcactgtttagccatggctggcctggaattcagagatgtctggctatgtatttagttctccctccccacatgttttttttttttttaaatttttaaatttttatttatttaatttttcaaggcagggtta

SEQ ID NO: 23719 - DNA, 1162 bp, Mus musculus
gtagtgtgagaacaccagagcattctctcaatgcctcgtttacctttaacagttagagttgtgtgagaagattgataaatgtcatgataatagtagtgtattttcatggttagtgttttcttgataaatgtcatgataatagtgtattttcatggttagtgttttcttgagtaataataggtaaagcagtttttaaagtattgaaattcaggttaaaatagtgatctttgtaactagggcctaccctatttaaaaacatctatgcttaactagttatatttatttgtattttgtctgaaaaccatttgagaggggaaagcatcaacttggagttaattccacattttattgaaatataatgaaagtgaagaagtttatgtcttgctgagagctttcacaagtggtcatattgcagtgttatatattgagatgtgttagatctttgttttagcattagctttgttttaacaggtttgtcagagctgtcataaatattggggcaagagaagcagcagctcaatcagtcattgtagacaggagggttagcctcaggagtcatcctcttcccatggaactctaggttcttcagtgctgtgtcacccatcaacctccgcacgacagtctgtccttccttatcttcattccaaacctcactcctctccctttgtacctctttgcttccctccctccctccctccctttattcagttaactgccctctaaaagcttacagcttcttctatctatcagttgccctcttatgggtcattcccatggacctttttataaatagaccagttcatacagtgtccagagatggacctgtatcttttgttgtaaagtgggctctgtaggggttcaagttaatcctacagtgaccaagacctggcatcagctcacttttactgaaaataacccaattgtgcagtgtcatctgcctctaggtaactttttttttttaattcactgattacagctcgtttcaaatctgtgttgtgagctcctttttaaaggaaacaagaaaaaaaaaataagcaacttttttttttttttttggtgtgaatttcatgctggtgacaaggtgccggattgacagccctggagactgaaatcctctatttatccacaggacaggtacagcacaggcagcgacagtgcgagc

SEQ ID NO: 23720 - DNA, 1155 bp, Mus musculus
attataataaagttagtgtctcagttaagccacagttaacatgttacggaattactgctctttaatactagataatgcaaatgtaatctgaagcacaaaaacaaatttgaaattcttgtcagtatcataaggtaacggtggaaaaatgaattcacacttttttgacaccccaacagcgaaggcattgttgatttatttgtagctatctcacttgatttcaatattgctctggttaatttgtcatggagtggaggctacattgtggggatagaaacaaaagctaattcttgggatgagaaactggcttggagtatgccttgatttgtagttaatcaggcattgaagtgggaccttcaggttttaaaatccaaggttttaatagcagtataccaaaaggattgtagagtgcaaatttaggtacaaattgtagaaattggtaaatagtatttgtgtttgtttcgctgtgcaactcttaatttgtttttgttttgtttctcaagttgattggctgcataatcgggcgtcaaggcgccaaaatcaatgagatccgtcagatgtctggggcgcagatcaaaattgcaaacccagtggaaggatctactgatcggcaggttaccatcactggatctgctgccagcattagcctggctcagtatctaatcaatgtcaggtaagaatctcttcactgtgtcacataacagggagggagagggttgccatataacaagtatgggttttttatttccccataagttctgctttttttctgtctttaatgtagcagagaaaacaagcagattggagtaagttttcatggggttgtttttgggaagtggaaatatatgcctgtggtatatagtatatgcctgtgctgaataggacagagctctagtaataacaggctcactgaaacacacttgggttttgcttgttttcacacatcatgtagacagatcatttcatttttgaatttggagttcaaagcaccttgaatttttaaggataatgagatatctaagtagcttcttagaaatagctgtcatcattctgcagacatttttcaaatgacaagtatgttctgtttgtgagaaaatcaagccgactaggagtagtgctccagatgcattcatagtttttatcccattgctcacccta

SEQ ID NO: 23721 - DNA, 2554 bp, Mus musculus
ccacaggttttggattttgaagagtgagctaaggaactgaattgaagctttgatacttgtttttttgttggtatttgtcctaaaattataagcttgaaaacaataattcaatttttcactatagttcctattcttgctcctccctttaagtattgttaaaattacataatatctttaaatgttaggctcccaacacaaagttccttcacattggtgggctgttctagtgtaaacacgacaggatcaactccttgaagcctaatgttctctagaaatgctttcagtttgcaaagagtaaaacgtgaagagacagtgtcaccaacttaacatcatttgttatgttcttctgagaacacctcaggaaccttggttgtagtggtgttacataaacaaccttgtgcactatggtactagctaatctaagaaaccttgaaataccttggtgtgatgaattgtagctaggtaagctgacttattcttctttgtgttttacaggctttcctcggagacaggtggcatggggagcagctagaacagagcagacccatccataatcctgctgttcaccacccatgatccatctgtgtagtttctgaacagtcagcgactccaggttttaaaatagtttgtaaattttcagtttctacacactttatcatccactcatgattttttaattaaagtgttttaattcctttctctgttcagcagttacgctgagatatccatatttagttttataagcttctcccccttttgttttttggtttttgtttttgtttggctcatgaatttttgtttgtcatggaaatgtaagagtggattattaatacatttcagtttagttctgtaatgtcaggaatttttcaaaaaaaaaaattaaaagatggactggagctttttctttgtgaatagaaactggatgccacagtgacttacgtgggtgttgttcctgtctgatgttatttttataccttttaacttccagagagccctgattcagtttcaatagaattaatggactttcttcccttttttaccactccaatttttttaatttgccctcaatcacctccccctccatgatactgggtagcctctgaaaacttgtttacggagattgacaattacacttaccctaggattgtagagcagctggtgcatttatggagctgggcaggaactcgtggatagtaaggatagtaaacttgggaatggctgccccttgttctaccttgcatactttaaagttctagtaattgttcatttagttttctccataggtgttttgagacctccttgttctgaaatcatttagaaaagtttacctgctatcatttatgttaacttagaaaataacttgtccaaattcctcagataaaatcttaaatccaagttgaaaccatgtattataccactctactcattcaccaagaaaaccctcgacagttgggcctgcatggagtggttatatttcaaggttgttcacaggggttacaatatgacagtccccacccctaccaggcaccaagataacagtggggactaacagcaccccagttcttcagcctgagccatcacatgctgttagtcgtctggcccaaagccagggtttgggcagagaaacaggaacaaagaaatgagttacattgccacctgagaaacctcagagggatgacccagccttagtttctttccctcctcccaagtgcaaaatgtgtaaacagtaaacggaaaataaaagtgcagttttaagtgaatcctctacctgcccctccagtgttcagggatagacagtatagagacaagcctggcttttctattgcctacttgcttgttcaacataaggaatggggtgaagcaagaaggggccagcttcctttctttatagctctagggtagtactcggagtcattcatttccacagctgccagtgtccccagaacttattcggtaattggtcaggggcgtcgttcactctcaagcctggcttaaggctaagaaagccccatctatctgttgattatgtggcgcatatatattatttatataaatatttctctatgtacaaggaataagagtgtctttcatggaggaagggaggctgggggccgcaaggcatcaatgctgttggagttgtccaattcagtgctgtcacagtctgagtcttcaggattggggccctgtgaagagtagaaatgcagtgaggtgggggagccttggggacccttcttttacattaacagtggagttttttttttttttttaaatctgttcataggtccaaggcactatgctagattccttttaggataccttgatgactactgtcatcaaagctgccacacaaattaaacatcaggcactatatgctcggaaccattaattctcaactactacttacatggatatttgttttaatggttatggaataatgatttttagattctcaaatgactgggtttctgatcccagttcacttttcagtgtctggtggttgcaactcaaacttacctggccatcctggtgttgcatgggcaaggagctggcttca

SEQ ID NO: 23722 - DNA, 1189 bp, Mus musculus
tgaatcccagcactctggatgcctatgcagaaggaccaaaattcagggtctgcctggactatataacaaaactgttcaaagtcaaaagaaaaaggggaaaaagtattgtcttagggttttactgctgtgaacagataccatgaccaaggcaagtcttataaagcacaacatttaattgggccgcttacaggttcagaggttcagtccattgtcatcaaggtgggagcagggcagcatcttggcaggcatagtgcaggaggagctgagagttgtacatcttcatctgaaggctgctagtgggagactggcttccaggcagctagatgagggtcttaaagcccacacccacagtgacacacctactccaacagggccacaccttctaaaagtgcctctcccagggaagagcatatacaaaccatcacaagtattcttctttactgggcaacaggtctctccagctcagcccacccctagcactgggggacggcgacggcgtacagtggatgaagatccagatgagcggcggcagcggtttttagagcgaaacagagctgcagcctctcgatgccggcaaaagcggaaactgtgggtgtcctccctggaaaagaaggcagaagaacttacttctcagaacattcagctgagtgtgagtggtactgggtgactgttgtgattgtggagtctggcaagaggctgaacctgaacagtgcagctgcagagcagagaacaggcattctgtacttaggttagatccagaagtatgaccagaagtgtaaagagtcccataatagtcagaattgaaacctttcccttagcaattgagaaggggactgtctccttccagatttgccactagcacaagacccatttggaatttgaggttataaactcagagtgctcaccagttggaagtctacagaaaaggcaagaatatacccatctggatgaaggaaatcaggttaagcaccctggggtatgctctctcaaatcatcgacagaacctgactgaattagagaacacctaatgaaaaatgtgtttactcaggctggagagagagctcagtggttaagagtaccaaatgtgccagacggtggtggcgcacgcctttaatcccagcacttgggaggcagaggctttcggatttctgagttcaaggccagcctggtctacaaagtgagttccagg

SEQ ID NO: 23723 - DNA, 1197 bp, Mus musculus
aatagttaaccacataagcacaaggacctgagtttggatctccagcacctaggtaaaaagctgggtatggcctacaacccctgttcaaagggagtggtgaggagacatgcctaggctgggaaaaggaagagacagagacagctggagcttgctggtaagatcctactacagagagattctgactgaaggcaataaggcagacagctatagagggggacagctgatgtttacacacccatatatcatacacacacaatttctttaaaatgtggcttatgatggtggtggtagttttttggtgctagagactgaacttagggccttcaatatgccaagcaatgggttctactactgagatacattcccagtctttccctattttatttaatctgaaaaactgtgttgtttctacataagttacaaataaaatctgaccagcctagtgcataaagtttacttgttcagctcagaaagaacactgcacccataggacaactagtgagcaattcaactcaaaggcaagttaggtttttcaaggagactatggaagagagtattgccacagaggcccaaaccacaagcccaacaaccaacttttaagttaaatcttggcttatgttaagacttccttagaatagcacttcttgccgggcagtggtggcgtacacttttaatcccagaacttgggaggcagaggcaggagggatctctgagttccaggccagcctggtctacagagtgagttctaggacagccagggctacacagagaaatcctgtctcaagcaaaacaaaacaaaacaaaacaaaacaagaataacacttcttaggaagaatgacaatactgaaaagcaaaaaatttctgcaaagcctgttttcaaatatatgggaacatttaggattaaagttggcaaaggatgagaaaaagcaacatttttataaatttgtaatgagttttgtcctaaacacaacatttgaaaggctagtatactaaccttgggtttagtgagctttcctaaacatccgtctacaaagttacacaaataaaatgtttctcttctcatatagcaattctgttttgtttggacacagggtctcatttagtccaggatggactctccaaggacaaccctgatccctcccatacctcctacattcattgattacaggcatgtgtgggtctacacccagtttatgt

SEQ ID NO: 23724 - DNA, 1346 bp, Mus musculus
ctgctcagcaagcttgctggtcaactacttatttcatagagattttcctaaatgcttagaaccaataagtctctcagtctttgccaagggactcggtgcttgctgaggcatgctttcaacccccagccaggcagtttatgatactccttcacttcctgctgggatggagcctggagttgaatcaatggtaagaaagtaagaagccctctggtctttcctaactacacacagtcctgagtattcacatacctaatgtatgtgtacattctagattcccaggaacaccttaagactctccaaaaccctacacagacaccagactctctaactttttcttgtgtgtatgttagttaccttatcttttgccccagttgttatctactatcacagaatgctgccacattaaacagttacctcttgttgtttagacaaatgtctctgacatgcccagcatggccccagttgaataagggaataaagaaaagacagctttttctcttctccattcctccgccatcgtgcgcgctattcttgattcggcttctcgccatgtcttctcacaagactttccgaatcaagcgattcctggccaagaaacaaaagcaaaatcgccctattcctcagtggatccggatgaaaactggcaacaaaatcaggtacaactctaagagaagacactggaggagaacgaagctgggtctgtaaggattcacacaatggcaagactgaggatttatactgaattgtcatcaatcagtcctaccagatggatttcaacatttaaacctggagacttttcgtgtcttgaattaggatgtttgtccagtaataaaatatagaacctttcaaaaaaaaaaaaagaaaaagaaaagacaaacagaccttcagaaaatatggaatcttgtggattgggttcactgataaggaagcttgggtgcttattatatacagttgaactgagaaatagatttattgtatgtagctgaacaaggaggaagactgtcacacgcagctaaacaaggaagctgggcttatggcatacaactagatcaagggggcaggtttagctaatctcaatagtagcaatttctataggggagctttcttcaggtggtaaatatctgggggtagaaatcaatggaggacatttctgcacacactatcaacacaagcaaatggaccagcagaaggctttgccattcttctgagctgggatggggaaggttttaccattttacaatgggtctgaggctatggggtccttaacctggctgtgtacctctgtttattcagaacttcctctgttccccacagtccccaaacaaaaaatatgttctctgcaagct

SEQ ID NO: 23725 - DNA, 1152 bp, Mus musculus
ggagcgtttccggcacctacagcagcgggcctgctgattctctcttcccgctggcgttcacggtcacggccggccggaggctggaccggcgtaatttacgaggcgggaggagaatctacccttaaaggggctacgggcagcagaggcccagctcaacccgtttcccaggctggtgacaatgaaggagggggcgctgcagtcccccacccaactcctttctctctatcccctacccgccccccaacatcgccctttgtctcaggatccgctgcctccgcctccgggccagctagccaccgagtacggggccagagctgaagagggaggggctcatccccagactcagttggaggccaaagacaaggctttttattcacaaatcctttcagccttcagccccagacccaacgttatgaggctggccggctctggaaagaacagtccagataacccaccagccctcctgcaccctgtttttactctttccaccagcttcctgtctgctgcctcacttctgtgggaacacaggatcgagaagtaggggatgggcagagctaagtgcagcttgagcagtgtgaaaccgcccactgaggtgaagagaggcttcccaactctccaaggacaagccacagaatactgggttctcccaatagcacgtggcttcaagtttgtttacaggattgtgcagagacacaagcaaactgttgggtccaaatctctctccctactaaacttgcaagcaggcagcttcttggtctttccatttggctcaatagagaggaaatacaatcacatgccttgatcctccattgggcacctgacacatctcccctcccactacacatgttcatctatgttcaagttcccacaaagcatctccactccagctgtccacacaatctcctgtgacagggccatgggaatggagtactacccttctccctgtttgtatccccttgtgcagcacttccaatgactggtggtctctagattcaagctccaccactctgatttgattcctgaagcctggtaggaaagagactagaacaccccaaaaggaaggaggcaaagttatgcaatattctctttcctttgctttaaacttgacttctgtgagcttctttgtcaatatttgtcttgttgattgtgtct

SEQ ID NO: 23726 - DNA, 1924 bp, Mus musculus
gatcaggagtccgaggccgccttcagctacatattgagttcaaggccagcttggaacacattagtctctgtctcaaaaataagtaagtaaataagtaataaaaaagtgaacttcttcagggagcccagagctgtctgagaagctgtatctgagggagacttctgtgtgtctagactaggaaggatctagattttcatctctccctttttttgctccctataaggcctttgaacttaaaaaaaaatgtatctatttattttggtttttcgaggcagggtttctctgtgttgcccttactgtcctagaactcactttgtagaccgggttggcctcaaactcagagaacttatatttttaaaaaaaatccctctgttttgtttctgttcacgttgtctatctgtttttaaatttcgaaacaaggtctcattgtgttggcctgtaactcattattatagaccagctccgctttgacctcacaagaaatctgcctacctctgcctcctgagtgctgggattaaaaggatgtgccaccctgcctgacctgcttatgaacaacctctctaagcactaagatcctttaaaaaaaagagggtgtgctgcctcctagcactggtgtgaggtgtgaggatcgactgagataacactgcagagtgctttgcaaaaggctgacatatggtcctcactacacactctttctgctcacctcccttcgaggtggggttatatcaatgcactacaagggaatttcccgtctgctctgaagacctttgcctataaccctgctcgcttgctggagaatgaccaatgttacgagaaacttagcctctgacttttcagactaagcattaaagactcctaagccttgtgttgggtctctcctctcttcctacacttcattggtgggagaatgattttaggttatctcctcccttttcttacctattcactgtctgaaaaaacttttctcaggtagcttgaggaggggggacagagacctctgattgccctagccaagctgcaggggttttggtaggggcctgccctgaagttcatcaggtactagggcaactgttgggaacaatgaggagctggtgtctcatctgtctctttaatggttggttggatgaatctgtggtaagggctgggaagtgagccacagtgagagcagcaggtcttagggccatcttaatgaagatacatggtctctctatctcctgggatacaagtcatctccagcattctaaaaattagtatatttctatctcagctccagagagggagactaaacctttgaggattccccagtgatagaagtgttgtaattattcatgttgggggtctcagagcattccagaatttgttgaactttgactcaggatggaggccaaccctccagaaagaccagccgtatgtattgagggttggggcttagcctgaatgccagaatgggacaaggatagagattaagttcagccacatggcccatgatctcgaccagttatacctccacagtgaccctagccagctctcttggacacttgagtttccactaagcttgctggctggtgcacacatgtatatctgtgtttctttttgggtatttggtgctggtttgtgtattcattcattcattcattcattcatgtgctctgtgtgtcattttggagttctgggcatcaagcccagaattttgtgaatgggaagcatgcactcttctatcactgagctacatcccttgatttgtatttgtgataaattgtaataaataaataaacaaacacagtgttttcccccctgagttttgttttgcaaattactgaagccgaagggtttctgagaactcttggtcagaacatgcagctggtatctgaagtgaaataagtcatattgggagccctccctaagctagacttcaggaagtcac

SEQ ID NO: 23727 - DNA, 1078 bp, Mus musculus
ctgaaagtgagattttctagtgcatacttctgtgctagcctccctacttggtcttaatggctgaccttgggcaagtctttcctttcaatgcctcagttccccatctgtcaaatggggtgataatactgacctacctcatggggtgttgtgaggcattacagatcagagctgatcaactcctttaggattgcctgtggaggataccttcagtcgaagtttttttagccctcactgagctacttccaagtttggaagtacttagtgaccttggtgagtttctgtccccaatcccttaacccctcatcaatgctgctagttcagatgttgacagtgttttgtgaatgttggagtcttgatcatccagtctaacttgggatgctgtgagggaaggcacttgtgggctctgtgtcttgcatcacaaagagacttagaaattcaagagccttgggttagggaatcttgaggcaggagtgctacttcatgtctttctctgcaggcaggagttaaggtcctattctcatggatgacttgtgctgattgtcttggtagtgtggattgatattgttgcttccattttccaggctgacctaggacaggtcgtccactgaactcttcatgctccgatgcctctgccctctcatagaagccagacggctcaagcaacataacactcccttcccctaccaaaaagagctacattgtattttgtttttttctagaaataggtataccatttcagaattgagcattggtcctcaaggcttcttttcagttcactgtgtgtggaatctgtcacctcttttcagtgtataccatctgacccactgaggacatcttggacacttgtttgcccacctgagggttcaagagcctttcttgctctgtctcagtatagggactaaggcatccccagattcttcatgataggtttccttttcccctacttgaccttctattggtacccatgaaaaagcacaaggtcctagctccctgtagatacacactccagttctgttgggtagactctactcctaacaggggtcctagagggttctctggaggatgggaaaggaacagt

SEQ ID NO: 23728 - DNA, 1084 bp, Mus musculus
gccatcagtattaatcggaaaatctaataggaaactattaccaagaaattaggccaaattgaatgcaatgaactttttatcatctttttttggtaatgttcttggtgttggcaactgtgaccctaacagctggtccaagcccagattgctaatttcacttttaaagagcctaggctggccctagtgcttgtagtactcctgcctcagccttaaatactgggattatgaggggatgtgtgcattcctgtttgtgtgggtgggtaggagagaattgaactcagggccttgtacattttagacaagtgctcaaccactgagctgtattcctagttcagagtgttttgtttgttagggaagtttccagagagactgaatctgagctaacattgctgaaacaccaaccttgaattttctcatcatggatttgtccagtctaatcagatcagtgggatatacaggtatatattaaagtcatagagtgtccctggtgaacattgttgctgtatcatccgttgagtgcttgtgtatagagctctgtactggctgctgtgaaggctgtgggaggaagacagtgtcctgctttgaaattctttgagaactaaaaagatagtttccttgtatgacaacaggaagaagatgcaagccagtgttttcctgtttgcagtaacgctaggatttgatcctgaacagcctggcagtgtgcctgatcccagtagttctaagataggaacaaaatgatttcccactggaattctaagggatggggaagatatctttgttttcctttctgtgttacaagttatatctctggtagtaggagaagccatcagtatgtccttaagatgtttgtaaagatgctaccacctttgggtgagatgagtcaggcagtggaaaagttgctgtcctttgggtgtcacaggaggaatgccaggcagtagtagagggaattgtgcctaggagtctacactgtgccctgcagccctgctgcacttcaggtgctcagtgctaatcttacttaggaaggccatgctcctttctggaacttggattacccactacaagactgagaatcagtgtcttttgt

SEQ ID NO: 23729 - DNA, 1184 bp, Mus musculus
agagtgaaaatgagcttgtgtggtgtctgtagtgctgatgagattgagtggattagagggatggagtgcccaggtgattctcttgagactcctggggtgctaaagacttgtgggggtcccttccttttttttttttttttttttttttttggtttttcgagacagggtttctctgtatagccctggctgtcctggaactcactttgtagatcaggctggcctcgaactcagaaatccacctgcctctgccttccgagtactgggagtaaaagcgtgcaccaccatgcccggcgtgggggtcccttcttaatcatttgcaaggaataccagaaaagatgactacatcttattgcaaaagtatctcttaacattgctgtctctgattgacctaggtcggtattatatttcttgagttgtaaggatttttctgaactgaagacaaatgataccaggtgatactaacaaaggcgatgatttgttgttctgaaaaacaggtttggtttggtttggtttttccttgatttctacaagctctaatctctcctgtcctatttatagcaaagcaatgatatcgctcggggctttgagagaggactggaaccagaaaagatcatcggagcaacagattcctgcggtgacttaatgttcttaatgaaatggtgagaggaattgtgcttcactttacagttgtatttttgctacgaagaaagagtgtaaaattgagaattcctaaatttaatccttaaccaactccagtgtcagtattaagtgggaatttatggtttggaatgaatttgtgacattctcaagctttggtattgtgttataataaccatatttgggtaaaaaaatttggggtagaaaaattgtattactactacctaaatatctatttgtatagaactaaatcatttatgtaagatcatgagtctatgactacgggataagagctaagtaaagcttccatcactgagggtcagggtcaccgaatgatagagaaattaatttccacaaaaggcatcaaacttaatgctaaataaagcataaattactttatcagagatagtgacttatagaagaaagtggaatacgctcatccttctgctgtcctttcctgacagggtctcatgtagctcaggctgtccttgaactcaataaggagtccagaatattaaattcctatc

SEQ ID NO: 23730 - DNA, 1177 bp, Mus musculus
ttttgtttttgagacagggtttctctgtatagccctggctgtcctagaactcactttgtagaccaggctgaccttgaactcagaaatctgcctgcatcttcctcccaagtgctgggatgaaaggtgtgtgctaccacgcccatcgaggaaaaagattttggttcctttaattgaaagtttcccacatttctctttgagttcctggctcagaagtagatacagaaatggtcaggaataacgcccatgttattttctctttgggaatataaaattaaagagttaaataattattctacttaaaaattttgatctcttcagctgaagagaagttgttgttagagaaatgtggattgacccattttaaagttaaatttgtaaccttgtcttataattgtagatcaaaaagaagggtaagtgactcactggtgttgtatcctctgttccatcaagaagtgacgttttaaccctcaggtagattgaaccatttcatctttccccctttcaggaacctggtggccatactccttcaggtggatcaacaggcacacgacatgggaaagaagaccaagaggacagccgacagctcttcttcagaggatgaggaggaatatgtggtggaaaaggtgttggacaggcgcatggttaaggggcaagtggaatatctgttgaagtggaaaggcttttctgagtaagtgctttctttttcagtctttagaactctgtagaggtagaaaactttgatttacttgcccatgagccacagtctgtctttttcccagttacatactttcatgagaatcaagagaggcagcagaccacatagtctccctattgtggagctgatattttattgttcttattttgaggggtactttaaggaattggttgggaacacagtcttgggagccagatatcctgggaccagattcttgttccaccccgtaagatacaggtgaagacattgattaatttcttttattattatgacttaacattttttgttgttgttgttgttttgtttgtttattttttatgttttttgagacagggtttttctgtgtagccttggctgtcctggaactccctcagtggaccaggctgactttgaactcaggagatcagcctgccaagtgttgggattaaaggcatgcaccactatacagagctaaattttttt

SEQ ID NO: 23731 - DNA, 1332 bp, Mus musculus
ggactttttttaacagaaccattgatactacgttggcacaaagtattaaaacaaaacattgtcttaattctacaggtggctatggcggttccagcagcagcagtagctatggcagtggcaggaggttctaattacatacagccaggtaagtgcctcctttgtgtgtgtttgctaaatgttataattgaacccagtaacccaaatgtagctgagcagtacaacatagttaacattataatttcagtaaaatggtggatgttaagttaatatgcagttcagcaaaatttgtgggaaacaacttgctctattggattgtagccttgagtcttaatgtgttttagattaacaactttattccatattgttcaacaggaaacaaagcttagcaggagaggagagccagagaagtgacagggaagctacaggttacaacagatttgtgaactcagccaagcacagtggtggcagggcctagctgctacaaagaagacatgttttagacaatactcatgtgtgtgggcaaaaactccaggactgtatttgtgactaattgtataacaggttattttagtttctgttctgtggaaagtgtaaagcattccaacaaaaggttttactgtagacctttttcacccatgctgttgattgctaaatgtaatagtctgatcatgacgctgaataaatgtgtctttttttttttttttttaaatgtgctgtgtaaagttagtctattctgaagccatcttggtaaacttccccaacagtgtgaagttagaattccttcagggtggtgccaagttccatttggaatttatttatggttgcttgggtggagaagccattgtcttcaaaaaccttgatgtcgttaaactgccagttactattgtaacttttaatgagtttcaccattgaaagggtcatccaagcaaggtcacaatttggttataaaatggttgttggcacaccctatgcaatatcaaaattgaataacggtatcagataaaataacagatgggaatgaagcttatgtatccattatcatgtgtactcaataaacgatttaattctcttgaatggaatgacaactgtatggatttgggactggcagagatttggactttccctacccaatgcccctggtaaatgctcattgtttgttaccacagtgcaagttcaaagctctgccagcagagaggccaactgctggttaatgccacctataagtccagagattagcattgttggggcatcttaactgataattagtaagaactcttaattgccctaacccataggctgtagtgaaggaaaactgcagtttaactgggttgt

SEQ ID NO: 23732 - DNA, 1332 bp, Mus musculus; identical to SEQ ID NO: 23731

SEQ ID NO: 23733 - DNA, 1332 bp, Mus musculus; identical to SEQ ID NO: 23731

SEQ ID NO: 23734 - DNA, 1099 bp, Mus musculus
gcacttggtttttctggagatgaatcgtttaaatttaatgccctattaatcttaaaggaagtggatacatttctatttgtgatgatacgttttggcccttaaattttatttaaccttcctttgacccattttcttaaaagtaatggctcaaagtaatattagataacatttccccaaaatggtgggagggtgggtgggttgctaatgggagggggtgggactagtttaatgatgggaattggcctcataaaaggttagttctaaatgttgtttgcttttctaggaaggaatctgctatgaggcttaactgctgtcataaaatttgtttaaaaaattctgcagaagttgctggccaaaaggtgagtttttgtgactacttcggtaagctgtacatagaaaccaggagatgttagggaggaatctagatggagcccaccactgtctatgtgaaactgcatcactctctctcttctcctttacaggaacatccttaagacagcagcctttattctgggccactgtactccactcactgccatgcagttgggttttagctgtactgctaaaaaatcattcaattttgtgaatggcttactttggtttttttttttaaataaactttttaattaactcctgtttcttgtcttcctttgtgacttagcaacattgagttagaatccacattaaaatctataaacagcctggtcatggtggcaaacacctccagtcccaacacttggaaacccaagcatctactttccttggagttaggggtgggatctgtatagttttcacctggagaattttacctctagcttgttctttactgcctccatctttaaaagaaactgatagcccaaactttgagacccaagtgatgaaggacacaaagacctttgcctgtttttttctttcttgaggttagaaagggtttcacagtttaacctggctgtcctgtctggaattgaaggtgttcacccagccttttttttttttcaaatatggtcttgctatgtgatcttgactggcctaaaatctccctgcctgtacatatttcaaagtaaacggaacgataaggcagatttttggtttttttcaa

SEQ ID NO: 23735 - DNA, 1099 bp, Mus musculus; identical to SEQ ID NO: 23734

SEQ ID NO: 23736 - DNA, 1192 bp, Mus musculus
tatgagggtattaggaactgaacttaagtcctcttcgagaggcaggaggattttgagttcgaagctagcttgagcacatggtaagaccctgtgccaaaaaagaaagcagcaagcaaaaattaaagaaatcgctaaatctatgctgagctgaagagcgtactgtacctggatagtactgaaaagctgctcttagagaggacatgctactaagccgcctccaagtttcctcctcttgcatttctgtttgctggtttggtagaacctctgggatcaaacatgttctggcctcacctccacaaagcacacaactgtacaatgttgagaagaggaaagggaagatctagagggccaagaaatgagtcaaaatctaccttggtctgggcatttctaggtgacaatagattccttccttgaggtactttacagtggatcctgcttgaattaaagcaccagccttgggagatggagagatggctcaggggataagaagagcatttgctttcttgcagaggacctgggctggctttaactgcagcatccatatggagtggttcataaccacctgcagcaccgtcttctgaccttgggcctcaggcaagcatgtgatgcacacacatgcaggcaaacagtcataaaaataaatactgagaaaagcagtgcagccttagttcatagttggatttaccaaatcttcttccagtcctttgtctctcagttcccatcctgtttttggtctcagttccctctgctgctcttttagctggctctcccgttctcagttgttagtggagagcaatctgcaggttgccattctccatgaataacctgaaatcttaataccttacactttccttcagcctttactttttatttcccccaccctcaaagctgaattactgtagcagttcagatccttaaaaactttgtacagaggtatttttttttcttcctgttttcaagttttaatttctgagtgtgtttccagtgttttacagattagacctcaattccatacattgtctcactttaatattttttcctaaaactgacaaaatcctgatttccacttctcattcaaatatcaggccatctaaagtgcaccaggatgtatatgcatctagaggaggaagctgcaggacacattggcgactcaaaggttgacattgtttcagtggcctttgcttcctgaatc

SEQ ID NO: 23737 - DNA, 1607 bp, Mus musculus
cctcaaaacccacatctgctgtgacttcttatccaggcccccaacttatgtccttagggtcatcttggagaaccacaatggattcttctgtctctatactttctggggttctttcccctccctctcatgagagtaaagtccccagcagatttgagtgagtcaggggaaacaccctcttcctacttacacttgtctcgcccaccccccattctctccttggtttcttggccctttactgtggctgtacttcagatcatcaaagcaagagaaagaatgtgctgagtgttttcttccctgtgccttaagggccctcatcccagcagcccatatagccagcaaatggaggactcctaacttcagcacaagtgggtttggagtggcagaggccatactttctttgcctcagcttctctccttcctgctgccctatcctctgccttagaagaaatgggaacagcttgtagggaagggacaagctgcagaggaacagtgatttaaaggcccttggagctagtcccctcagcctcaactttgatctggcctttagcctcaaagctgctgtacctgcacatggtcctgagaacatctctctaggcctgtaccacacctctctgcctgtagaacctgtgagatcattgcctgtggcctctgtcaccctggagcaaagccagaccttggaacccaaactactttagtccctagaaaagtttctgctcagaactgaggatggaaagagccgtaatgacgttggccttgccgtgttccttctcctcagcgccacactcacatatttctctgctttggttctacaatctgttgttgagttccccctctctgcatcagtcttccctggaaatggaggacctggtgcagtacctttcctctgaggcttggattcccgttcttgggtgtaatgttgctccctgatcccatatccctgtgaaaatgacttaggaaaaaacgtttctgagcaagcattctggcccatgcactggctgaagtgggcagactggaggcggcctctgcaagaaatggagtcaggcgaagtccaccttgtacgctgctgtgcggcttaggaataaagtgaatctcttccaaactgcctttgtgtgatggctctgttcctcccttttttggcagctattcctgttcctccagccaccacccccacgcccccgcaccccacctcttataatatttcttcctttctacctcagagactccccagcagtcccccctacccctaatttacagggctgtttgcctccttggcatctctagtcccctcgcctggaaattggcgccaggggtggggtggggatggtattttctcagtgggagactcagggaactgagttctcccccacacacccccaaagccagctgcctgctcccgcctcagccattagtaacccggagacgcgcacctgcgtggaggctctcctccagcccctgctcccttcccgcacctcccactcctccgaaacggcgctgagcgggttatttatcggagcctgcgctgctccagaaggtcaggacggtggtgtaaataacctcttctcgccatttccccatccctccagagcctgctcccctcccccttctct

SEQ ID NO: 23738 - DNA, 1128 bp, Mus musculus
aggaccactcagaaggaagtatggcccagtgcttagcaatggccctgcctctggggattactctttgctgaaagctcacagcccactacccactgcaccacagcacatctccagcaggaggcaccgagatggcgtggctgggaagcccaaccctctactgagccggcacaagaagcctaggggcgctgcagagctggcggtgaggcctggatgctggggaaatgggctatgggaggacccaggaaagcttgaaagggatctgggcaagccggcagagcttgggcttgctgaactactggtccgacctctgtccccatctttctgcctgctgcagggcacgctgactttctcaaaggagctgcccaagtccctggccggtggcctgctccccagccccctagcggtggctgcggtgatggccgctgcagcaggatctccgctgtccctgcgtccagctccagctgcacctcttctgcagggaccaccgatcacacaccctctactccaccctgccccaggacccatccgaactgcgcacggacccatcctcttctccccctactgacctcaaccctgaacccctcccattgaatcccccacctccagccgggacccaggtctccgggctcccagcccgcccctcttcccggcgctccctgaatggtctctccttccccccaccccgaggtacggggttccaggaaaggggaggggtagcgggggaggggggcttcagaagggggggaacaccccagatctcagggaaccccgccccctgcccttccctctcccctagaaaagaggggggccgtctcacccccgagccccctcggagacaccccctcccaaaagccatgtccatccaacccttcccctccaaacctagcacaaaacggggttcacaagccatggtcggggcccggggggagaacatggattttcttggcaataagcggactctgggactccggctcccctaccccaaactaaagcgcttccgtgaacaaccccatcctcccgcaggaggaggggaacaggcgggatcctgggtccctcgtaagcactttggttttaccgcctgcaacctcactgtgcccgccccgcaccatgccccagccccgggtccag

SEQ ID NO: 23739 - DNA, 1147 bp, Mus musculus
tgcctctcatttggcagaaagttcctggagctctggctgagttgactttaatgtgatttccttatgacctcgtttccctcttcaacatacttactcaccattttcatctgatagtctgatcctccaagttgggcaggtagggctgctgggtttgtctagaggccctgcccttaccctcttcttacccccttccccacttacttttctctggcccagtgggagaggatatgccccaactcataggacacactcaagatttgtatggtattagagttctccagcccaccctactgggatggatagtgggtgtacctctgctacccaaggatatatggctgcagctgagatgttcaggtagagaagtctgtatgtatacaaaacctctcaaatggggtggaaagaaaaggggtgcttgactaaaaccgaattattcttttgttttgttaggaatagaactctgataagtataagagttaaaaagtattttgtactcatttgtgtgtatatatgtccaaacagtagtgcatgtgtgctctgaggacaacttgcaggagctgattctccttctaccacgcgggtcctagagatcaaactcaggtcttcaggcttagtagcaagtgtctttaccagctgagttagctctctggcccaagtctaaacattctttttcttttttctttttaattaattaattttttattttattttacatgcattggtgttttgcctgcatgtatgtctgtgtgagagtgtcagaccttggagttacagatggttgtgagctgccttgtgggtactgagaattgaacctaggttctctggaagaaaatccagtgctcctaactgtggttccatttttccagccccagtccaagtattcttagctaagtcttagacttcaatgaatatacagaggtatattttaaaactatgacaaaatagatttatttatttagagagaggttctcatgtgtcctgggctggtcttgaacttgatatataatcatggatgactttgatttttctggttctcctgcctctacctctacagtgctattattccaggcatatatcaccatacccagtttattttaaaatttactttaatgtggtacatgggcttagaaatatagacacaggcattcct

SEQ ID NO: 23740 - DNA, 1184 bp, Mus musculus
ggtgactccagcttcagctctgacaggcatgggcctctccgaccttcatcactattctaggataatgttggcgggcagagatgatcaatcatcatattaaaccataatgagcttataatcctcccgctggagctgctattgtctcctgcacattcattaggacgattatctcctctccttcttttccaaatgtgttcagcaaatgtccagcctgctccttctgcaacagagcagcacaggcacccacttctctttcaagggctcttggtccatcttgccttaactccattccccactgtggcaaggggaaagtgtcctcccgaggtatcatggccagcgtactctcctatctactgtgggtaaaaagtgtatcttccctgttcttaccgtgcctgcttttccttgtgtgtctccacagcccagatcagaggggcaatccagatcacctgacagccaagtaaaacagactcacatgggttttccctcctacaccattaaggggggcggttttctacctcctaatgggtgggactaacttaacccctaatccccttgtcagtctgagtacagctgttgctccaggcagggacttctcttgtagatcttaaatttcacatacctcattaggtcagagggccaagagtagggatccttgagggaatacaggctgtttcaacttagcccttttctgcactaattagaatttcaagtgtcacagagcctttagatagcactaactgggtttagtaactttgtggcagaaagcagttaaccccgtccttcattcacacagtcattgccagggaggctggagtaacagatcagatgtgtcacaggtcctgagtagttggaatgggaaaatataattagccagttgattaattagggtcgtgcccatgcttccattatgaaaaggaagcaattgttgttggctttcagcaaaaccatccagctttcattaaaccaacttgatagctgttttgggattgtgcgtggatgtttgctttttatttcttcagacctggggttagccgatacttccttcacttgacacacataatcaacaaacatttttgttagtaacaactgtctgctctttaggatagatgcaacagagactctagcttcatgcttcagctaattgtccttccttcctatgaagaggacattatatgcaaaggggt

SEQ ID NO: 23741 - DNA, 1156 bp, Mus musculus
acgctgggtctagcaggctccaggaaggaaaacgactgcaaggagacaggcctggagcctactgggaaactgacttcactgaggtgaaaccggctaggtatggaaataaatatctcctagtttttatagacaccttctcgggatgggtcaaagcattccccaccaagaaagaaacggctaatgtggtagtcaagaagatacttgaagaaatccttccccgctttgggatacctaaggtaatagggtcagacaacagacctgccttcgtctcccaggtaagtcagggattggccagacaactggggacaaattggaaattacattgtgcatacagaccccagagtttaggacaggtagaaaggatgaacagaacgctaaaggagactctgactaaaatagccttagaatccggcggaagcgaatggacagccgttctcccttatgccttgttcagggttcggaatacacctggaccccttggcctaactccatttgaattaatgtatggggcgccccccacccatttttatgaccataggagataagaatcgcccggatgtgtctttctctccttcttctagtctttggctcaattaaaagctctcgaaatagtaagaaaagaggtctgggaacagctaaaagaaacctatgttgctggtgacacacaggtactgcaccagtttgaaataggagatgcagtcctggtgaaaagacaccgagcaggaaacctagaacagaggtggaagggaccctacttggtgctactgacaacgcccactgcggtcaaagtggaaggaatccccacttgggtccacgcatcccacgtcaagagagcaccccctggagtcagccatgatgagtggactttggagaaaactactaacccttttaagttgtgcctacttcgtatgagccatcccaaaggacttcaacccccacagtcctgttcaacaaatgtgggaggtactcaatgagggggggtagggctgtatggacaatcgccaaggtacaccctctgtggacttggtggcctgatcttttccctgatatctgtaagttggctataggagcccctcctggatgggacttggaagggtactctgacattcagagggcacctttaacaccccttccatatgtagaaaaacattcgaga

SEQ ID NO: 23742 - DNA, 1251 bp, Mus musculus
aagagaagagattgagcagattgaaaataagagacggttgaaagtgaattgaactggctgactgagaagactgtgggtggcagctgagccagaagaagctgagctgagccagaaaagatgatggttaggagacagaaaaaagaggaggatcacaaacagtttataggaagaagaggccccatcccctgctggtctacacggatttcttggctgttaacttcccacagactctccaggacgggcgcctctctcatttgggatatctttctttttaatctactgttttcattttgtgaaattagcctttgggtgtttcgagaatggctttatgaactaaagccatctgctaatattgtgtttcttgtcttttcctccaacgtttttacgagccgtcgaagatggggtacttctcatccagtgtggttttgcttgtggccatttccagtgtgtttgaatttggacccgttgctgggagagaccttgccatcagagataacagcatttgggaccagaaagaacctgccgtacgcgatcggtctttccagttcgtgccttccgtggggatacagaacagtaagtcgcttaataaaacttgctgtctgaatggagggacttgcatcctggggtccttctgtgcctgccctccttccttctatggacgcaactgtgaacatgatgctcgcaaagagcactgtgggtctatcctccatggcacctggctgcccaagaagtgttccctgtgcagatgctggcacggccagctccactgtcttcctcagacctttctacctggctgtgatggtcacgtgatggaccaggacctcaaagcatccaggactctgtgtcaaacgccgtctgtgatgaccacttttatgctagctggcgcctgcctttttctagatatgaaagtttaggtgtcatgtgaattccatgccagtgccatagcaaagatgtcatttatcttgatgctcacagtgaatccctaatgttacccctcaaaacactaactaggccttagctctgcatggcccctcctctttctggatgttctggctgtaaaaactatggcgtgtgtgccaagcactgtaacaccgagttacattcctagcctaaaagctactctaagaatgtgctgtctgccatagcctgagtttctttttttggtttttcgagacagggtttctctgtgtagccctggctgtcctggaactcactttgtagaccaggctggcctcgaactcagaaatccgc

SEQ ID NO: 23743 - DNA, 1515 bp, Mus musculus
gcgttaccctgtactggggcatataaagtttgcaagtccaatgggcctctctttccagtgatggccgactaggccatcttttgatacatatgcagctagagtcaagagctccgggatactggttagttcattatgttgttccgcctatagggttacagatccctttagctccttgggtactttctctagctcctccattgggagccctgtgatccatccattagctgactgtgagcatccacttctgtgtttgctaggccccggcatagtctcaggcctgtgtttcttgatagaagtaactctcttacttttcttcctaagacttttaaaccgttctgaaggttattaagtcccaatgtgcaactggaagaaaattcagagtggatgaaaacagctaaattatctttaagcagggaggtggtggtgtctaccttaaatcaggcaaaggcaggcatatttctgagttccaggacagacagacctatacagagaaaccctgtctcagggagaaaaaagagagagagagaagaaaaactattatcttaaaagaaaattaatggaccaggcattgtggcagatggctttaatcccagccctcaggaggtagggataggaggatctcagagttcaaggccagcctagtctatgtagtgaacccctgtctcaaaaaggaaaaagcatcctgcgagggagttgaggaagtaatgagggtctgtgcagagggagcagcagaaaagtgactaagactggggaaacagaatggattatttgattgatgtttacaaaggtgctgggaatttaaaagctaagttctttagccaagcacagtggtgcacactattaaggtcagctctcaggaggctacaacaggatgactactgagagctcgtgtccaacctgggctatgtactgagtaccaggtcaacaaagactgaatggcaagaccctcacagaaaactcaaacacctgagtctcttctgcaaaagtatgaaggctttcttcaagctatacagttgtggaagaaagaaagtgtttattattgtagtagtaaaccagattataaaaaccacgtattgtcaagtcagtttttataatatattgttcatgaatatgcacagtaaaaatgggaactatggtgaaaaaaaaaaaaagaagagtccacaagtagccaaaagaaagaaaggaagaaagagaaaccatgagactgcacacacaaccctacacttcctacatttaacaatcatgtgcacactgtactttccacctttcttccttaatctccacggcttcccgctaacccacaaactgtatcaagaaagaggaagcatagcttcagcaagcagttaacatctaacccagcacagcataaccaagtgacctaggtccacagcaactgtacttacaatatagacaggtgataggctacatatccaggagactttccttatcgacacctagcacctccccacatcctagtcaggagatctaattcctctaattcccagtgctaattgt

SEQ ID NO: 23744 - DNA, 1115 bp, Mus musculus
ttgccccctcctagaggccactgtttcagctgatccacagttgagactgtatgccctgtatgtcaaggtcagatttggctggtttctccacatttaggatgtaaagcatcattctgtcagggagttgggcgtcttaatggctttcagggctcttcagccctctgtcagagatgctttgaattgtatagaaaggtagtctcgagttttcacctaaccctgggatatagtggttgatagacagcagtaagagcattagcttcctactcttgcttctcaagggaggaactgctatggtgcctcatgggctctaatgtttgggtgaaggctgaagagttgaaggacagggagtaaaactggaaaagagcccccttactcatgagagttggcaccaaaagaaatgagaaaatggctgatagaaaggttggaagttgttaccttttttatttgtttttgcctctaaagaaataccaaagaagttgagtttatgcttcgggtcctgctgtacatctttttgttttgtttttcaggacagggtttttctgtggagctctagctgtcctgggcctggctctgtagaccaggctagcctcaactcaagacatctgcctgcctctgccttgagttgctgggattaaaagtgtgcgccaccactgcccagccttgctgtacatcttaacatggaattcacaatttacctctcagtgtttgtggttttctgcattctccagactttgaaagaccactcacaaaagattagggaaaaagaggacttttacaaaaactattactacatgtgcgagtagttaaatagcctttgatattggtattggtgattggtatgcagaaaaaatgaaaaactgttatgtcagttactgtgaaatatttttagttatttccttatcgtgtgcttgttcctaaaaacattggttgtatgttattttcaagctgttctgcctctaagacgttgaagaaaaagctgtggtgtttgggctacctttattgtgatggccttcttatcctcctaataatattgccaagtagggtagattccacacgattgctcttaacccttggtattagcaaatcatataggtgctaataacgaatattggata

SEQ ID NO: 23745 - DNA, 1176 bp, Mus musculus
gctaacctgacctgaatttgtgattgcacaaagataacctcttacacaccgtagccccacaatccatctgagactgggcttgggcccaagctaagcctggatctcggggcctctcattcacctcaccccctcctaccgaaagctccggcccccccagcgtctgtgtgttcccgccatccgtgatcgactccagagtggtccggtctctgctttcggaatcaccgtgtccctcagggaccattctactgctccgactgaacatatcaacaggcggggcactcaccaccgagacccagccagaggaaccggaaacggctgcttgtagaagctcaggaatagcctctcagttgccaggtgcgattcaggtcctcgggaagctgctcaattggtccattaaggagggaccgccgcctcgggagtacgctggccaatcaggatgcaggatggatggggggggtcgcttccggcggtttccctgcagctactgcgtggggagcatgggagcgtgggagtgttgtggtggcctccgcctcctttgtcgcgtctcggctgggcgtggcttcacgctgcttctgccgggttgggcgaggttgtcggtactccggggctggtgagtgtggctgtttcagagctgttttggagaaagaagccgtcagctcagattctcaaaggagcttgagggcgaagtggaaaggcctggcagcggagttggagactctccactcgaagtgttgtccaaacgtggggacttaaggagcccttcctttccccagatggcgtccacgctccccacatcggatgagcaggtgaattgtgtcgctattttcctacaggtgtcctgacctggcggcagttagacgcgcaggtcctgaggcgcctcctcagatagccctttgaccaagctgtcttacgtttcttggcttaccgacttcctcatttcagaatcatcaggtggaggagagccctagcaggggtctataacaatttctcaaagttatcttgctgaaatgcgtctccaaatggcagattcctgggcttcacacctgttgaataatgataattaaaacccaggtgaattttacaccaaaagctctatgggtttacaggaacagtaaacttaggagagaactagagctttaggtggtggtggtcgtgatgtgtgtgtgtgtgtgtgta

SEQ ID NO: 23746 - DNA, 2015 bp, Mus musculus
ccagactggcctcgaacttagaaatccacctgcctctgcctccttgagtgctgggattaaaggcgtgtgccaccacacccggcatgagacagagtttcttgtggaacttgcagctcattgatttaactggaccaactagtgagcctcagagatcctcttgtctctgtctccccaactgcaaaccaggttttttgtacgggttcatgtttgtatagcaatcatttttccaaccaagcaatctctccagcccctgagtggctttttttctttttaatgtttttaagtatcttgagaatttgagggcattggatcctctagtactagaggagcaggcagttgtgccatgtatatgcagagaatttgacccatgtcctttggaaagagcaacaaatggtcgtaaccagtgagctacctcccaaggccctgaacaaagttttttctttttcctttcttgttttttgttaaaatgatggatttacatgatttgaatattggaaagttacaggaagatcaagtaactcctactcggggctccagttactcagcttcactttacaagaggcaccaagtgatctgtggtccatgcctgccactctgacaccagtactgtcaccagtgcatctctatgtggcattctccaaagtcctacatggactttccatgctgacaacttttacaggaagataagattctgctttgatgcaacaattttgattgctgagagctgggatcccaggccgagagaacagagaattgcagatctggaagagacttggatgctgcagcatccacatagaggcttgatacacatccagatgtgaatcttgacagtgtttatatttgtataaagtcccaggagagcttggtagccactgataaaactgggctggagaagacctcatgttttggtataccctggctcagctaaatcccataggccagatagtgaggtaggtaagcatcctaaagtgccttcacatgccatactctcttcccctcaggctctcctttttacctggagtccttgccctgcctccatgccctggcaccacccaatggcctggcaggtgtgtctacattcactgggaaagggcttgccaggcttctctgctcctgctccttcagctccttcctacaagatggactgaattttgctgaaaacgtggacattttgaccctgaagacacaggaaccttagaataaagaggcacagcaaggagaatgtcagtttttgtttaggaatgccctaaagaagtatagatggaagcgttcttactcctccatgaaaggctggaaacggggaagagaaagaggggctggcccttcacaagaatttaaagcttcaggaatcagtcctctgcatagacagttagatggacagttccctgttcccagtgttctgcccacttcttccgtccagaaggaccatcctgcctgttgaatcctggcatgctccacatagcgaccacactgggagctgggccaaggacaggtagctgttggcttctggattccttccatgcttatcctctagaagctgaaacttcaaggcctgggctaatgcagacaggaggtggctgagctctgtgttgacatctttgctactgtggacccatgggacctggccttgggagtagcagctggtgcctgtggtccttcagcctctgcggcagaggcttctgtcagtaccatgaattgtgcttgcagcagacatctcaagtttccagcatcccttcccttgtgccctcaagtgtttgctgtcacagtcctgcccagaattgctgcagtatgacaggagcccttcagggtgtccacagcccctcactgtgccaggctgatgaaaaacagctttattgacaggcctcattactgagtgcttcctccctcagcgtcctccctcagcatctcctggctcagggctctcaggctgtagagccagccaaaggctgcctggcctcagagggggaagggtccccacaaaggaatagcaaggcagtaaagtatccccctccctc

SEQ ID NO: 23747 - DNA, 1188 bp, Mus musculus
tttttgttgttgttttgcggcagggtctccctctgggttccagggtagtatgaatattttggaagtcccaagtctcagcttccaaagtcccggagttacaaatgtgagcttcaacccccagcttgtggttataagcaggtggagttttgttgtgtgtttggctcaggctttcctagacattgaggaaattcttttgcctaaactcagttttgaactagacctggcatctccattaatcttttgtttttccagacagccctaactgtcctggaacagtttctgtaggccaggctggccttggatttaggtatcccctgcctctggcccctgagtgctgggattaaaggcgtgcgccaccctgccctgcatgccctacccccaccccaagcatttttaagaggatatacatacaatgtatgatcttttgcaactgacttcttagtacaagatttcaagattcacctctttccttctttattatatctaaatactgtatccattcatccattagtaggcaattgggttgggttgtggtaattaatcctgttttgtgtggacataaatttcacttctgatacaattaggtccaggattgagggtcatgctgtaactgtggttaacattttgaggaactaccacactttccccacaagatactgcttcatattaggtccctaccaagacgtgtgtgaggtgaaagttccagtccccccaccacctcctgccaacacatttcatgtttccggtctcgtggctatgaagtgttactgtagtgtgtttgatacctgacggctcctgctgagtgccttttatatatcttttatgtagtttagtggccatttggagaaatgcttgccctgtcctttgtttatttataattatattgtttttttctttcatttacttattgtgtgtgcgcatgtgcatatgccacagtgtacatgcagaggtcaggagacagcagtgggcgttggttctttcctttccctgtgtggttcccaggaactgaactgaagttatcagccttgggggttggcaccactgctcactcacctacatctccctagcttacactgtctctattgttgaggtaggaaattgagatgagtatgctagcttgagcatactctgggctgccagttgtctccgctgtcactacatgccaggataggagcctgctcactggca

SEQ ID NO: 23748 - DNA, 1202 bp, Mus musculus
gtcctcatttaaaatgcaaagtccaggcttagccgaccctgcatagatcctaaattctgtctgagatagagccttggaacctgcatcctgcatacaaactacatacaactgctagatgtaagttgatattcacctaaatgggcgactgattccaggggacccttctgataactggccctcctgtacacttgagggcatcaggtagacctgagctataacagaagctgccaacacagtttcccaggctgctcctggttgtgagcttagccctgtcctagctgtgcatgtgtaggatggtttgggagattatgtgtcggtgacaataaccacccagtcactagctattcaacttctttcaggaaccccagctaccattggagctgcccaagcaaggagagccgagtccacggcggccacctgcttcccagagcagccttcctgtgagccacagccccaagatccggctgctgtcctccagccagagggagcgtcaagcccttcaggaccttgtggacttggcagtggaagggctgagctctagcccacagcccgggagtcggggcgtacccacaggtgggacactgggcaggttgttgggcctgccccgtggaatctgaggccagtgacactagagcatggtccgctgggaggctctgctctccgttcagtggagagtgtgctaaggcacttttatactttgcctcagggatgaagatgatgcagaacatttgagtcttaacgatttcacattcctaaagttagcccaggacagagcttcctaggctaatctggctgttttataatcctcctacttccctgtgatggagatgggtaaaaacaattgggggagagttgctttaagtaaagatgtccttaaataacatgtgtacagccaaacctaggttcatcctgcctgcttgggagatgatatccttttgatctacaaatccttctcttagggttggacctggtacctagcagccttccgctgacggggtttgtccttccatgtaagaagaccctgaagaaggatgacagtgcctcagtaagtacaaaggctgctgggccacagtgacttggtggctctgccctggctctgtggtgtttgtcagatgtatactttgacacacgtgatggagctgagagccccaggacgtctgtctcttttcttgggtcattgccacaacgtcttctgccattgc

SEQ ID NO: 23749 - DNA, 1141 bp, Mus musculus
tctaataaattgtaattctgttttgggggcatataagactagtttgaggtcccctgttgggtatgggttggggaggctgccctatcctctccagagcacttatggattccagcagagccaacacgggaggagttgtgtccattcttctcacccctggggctcatcatccatgcggccagggaggtgctaccctcggtccttccttccttcccttatctggtgggctcagctggtgccacccggtcatatgctttcatttctcccagaaaccatccatgtttgatgtgagcagggagctgggctccagcgtggcactgtatagccgcaaggtcctcatccagaccaaggctgcagacatcctgcccaagtggctgcgcttcattcgaggtactgctgctgacacccaggctctgcactgtggacggtgacccaggattccaagtggcatggccatgtgtcctcatgctgcccactgcatttgcttccgctgtgtcctagaccctcctcacccagcaggacaggcaaggagttctttcagggttggaagtttggcctgagctgtgctgggcctgagttatagttgagtaaggagtgtaagcagcatttactttcatagcacaaggaccagccctctccaagacaagcttatgactttctccttttcttttgagacaaggtcttctacacagcccaggcctcggtctccgagatctgggattacatagtagcttagttagtactttggagttgaatgctgggatgtgtttggtgtgtgccagtcttgccctgagagggttttaccctgggactgctgtactgcccactgcccctgagcaggactgaggagcagcgccccctgctcttcctgctcctcctttaccacccatggaggtttccgttggtgcaggggttctaatgttcctgtcttctcaggtgtggtggatagtgaggacattcccctgaacctcagcagagagctcctgcaggagagtgcgctcatccggtaagcccagactgcaaatagcagggcactcctgtggtggctggccttgacttgattctgccccgggtgtgcttttcagaagccaagaccaaagggtgaagagagacctgagggcaggatccctccctgaccttctag

SEQ ID NO: 23750 - DNA, 1097 bp, Mus musculus
gatgagctactctccccttcgaaggtctctgtcctatcaccatcccctgggagagtaggagctagcagaagagcagtggtgcagaactcagagcagaggcttgctgcaggagagaggactgatggccccatggaagagttgcagctgctccagcgggctgctggacccaacagttgtgaccactgcctccattgttttgaatagaagaacccccagaggatggatcagagccaggcaggcgtgtggccagggtgtactgctcatgagagttgcatgatcagctgccaacttgttgactcagcacctttccgaaattggttggttttatggtttggggctgaggatggaacccacaaatgagttaaactgcactctagccctgaggtgttttcagtggtaagtcctccaaccaacccttcaggtcttctctggtgttgtggactgacaggactggactctccaatgagcttgtggtgtactttgaaccctagccatgagcacagagggaagacattgggattcctggtcctgtccatgtgctttggcctagctacacagggtctgtgtgtgacaatatctctttcttcaggacactggcattgggatgacacaggaggagctggtgtccaaccttggcacaattgccagatcggggtcaaaggtaggtacagcccagaacccctcctcccttctaggataggcactgtgggaccatagagaggtgtctgctagcagtcttgtgctgtacagaggtggaagtcactttgctcagagctgtagtgtagtgaacagacgagttgaagcctgcctgtccaaatccaggaggattcatccattcacccttcaagttaggcctcacccacccacccactcagcagaggcggccacttttcccaagcagcatttgatcttgagccactctgcctacaggtgcagtgggtttgaggacagccagctattaggggccattttattgtcagaatatatgctgggaagacaagatgtctgtcttgggatcctaagcagggtccattctggcctaaggcagaggccagaggtgtgcactgcctcctggttcctgtgtgctttttctgttt

SEQ ID NO: 23751 - DNA, 1227 bp, Mus musculus
tgtagaccaggttggccttgaattcagaaatccacctgcctctgcctcccaagtgctgggattaaagatgtgcgccaccactgcccagctctttcacaggtttcttaaagtctcagttcacatgtaagtccaggcttcactgaccatcctgaaaggaaaggttagctccagagtatttgttgaagagataccaccgaccatgggagacagggtattgtgtcattaggtcatcagctgccgccattacagactcggcagtcaggtctcagtcagtgccattcgttcatctccctacctcttgctcctattccctaggtgttcatacgagagctcatctccaatgccagtgatgccttggagaaactgcggcacaagctggtgtgtgaaggccaggtgctgccagaaatggagattcaccttcagacggatgccaagaagggcactattaccattcaggtacttctgtcctgacagtacccagctctttgtcaagaaacagccggggtgaccagacatggggaggactgcattctagttctggctggactccagtgatagctgactgtttccttcctgttctgagcactcttgcggtcactcactaacccaccttaggatcttagagtcccaggcagaagggaagggaatttagagttactcaaaaggctatggctttggtctctcaagagtgagaactgtggcagtcctggggatttaacccagggcctgtgatgtgctaaacaggccctctgtcactgagttggatctacccttgccttaagaaagtcaagtttaccacttctttctctgtttttaaaagatttatttatgtgtgtgtgtgtgtgtgtgtgtgtgtgtgtgtacacgcatgcatacatgctcatggcaacatgcaatcaagtgctcctttagctcttccattaatgcctgtgatactttcaagtgaattgtgtgtgtggtgtgaagtcttaaggatcccatcccatcgcatcatcttggaaccgtggtcagaaatgtactagctgttgtgtgcatggaccctttgtgttctgtcagctgtatccctgcccttaggtgcctagaacatgctgcctttgctagtgcagctttataaataatctcaaatagccagtgtacgttctccaactagttcttttgaaaagcatcccaggttctctccctttctgtcagtttgtcatgtcatatgaaacttgggacatttccatt

SEQ ID NO: 23752 - DNA, 3060 bp, Mus musculus
tttttgtttttgtttttcttttttttgttgttgttttgggtttttgttttgtttgtttttttgttttgttttgtttttctcctccccctcccctttcatgtttttggactttttgtactgaaaattcaggcatttgggctctttttattaagcctagatgggactgtgactcccaagtgtggaagggcagactgatgtttaaagaaacaatacaaagaatatatttttttgttaaaaaccagttggtttaaatatctggtgtctctctctctcagctttttttttctctctctctctctctctcttttttatttttatttttttctgttttgttttgggggtggggggttgtttggactttttgtcgtcattgctggtgactcatgcctttttttaacgggaaaaacaagttcattatattcatattttttatttgtattttcaagacttaaacatttatgtttaaaagtgagaagaaaaataatactcagaaactggttccagaaataatgcatcttataatgtgtcccgataacgagctgatgttgcgggaagatttttttctatagtgaactctgtgggcatctccaagtattacccctggatgataggaattgactccggcgtgcacacatgtacacacccacacacatctatctatacatgctggcttaagccaacctcttgtcttgcagatgtagaaattgttgctttgtttctctgataaaactggttttagacaaaaatagggatgatcactctcttagaccatgctaatgttaatagagaagaagcattcttttctttcttctatgtgaaacttgaaatgaggaaaagcaattctagtgtaaatcatgcaagcgctataattactataaataagaaaattcaagaagattcaatcactgtatagaatggtaacgtaccaactcatttcttatatcatattgttaaataaactgtgtgcaacagacaaaaagggtggtccttcttgaattcatgtacatggtattaacacttagtgttcggggtttttttttttttgttatgaaaatgctgttttcaacattgtatttggactatgcatgtgtttttttccccattgtatataaagtatcgcttaaaattgatataaattactgaagtttttaacatgtattctgttctttaagatccctgtaagaatgtttaaggtttttatttatttatatatatttttggagtctgttctttgtaagacatggttctgattgtttgctcagagtggagagattggggctacagtcatagctgcagtgcaagtggcagctgagcactgtcccagactgtggccactgagggaggaaaggggagctccttgcacagacagtgaggggcagctcaggaccaccttgcatatttagtactcacaggtgaatgtcacccatgccaggaaggactatcaccactgggtcagaaacagctctttgcctccagcccactcttcctgtcctcctctttgttggtcagctgcccctgtggggagggctcctgcctttttttttcagaccccccttctctacccagatcccacaatcaatgcaaagggtgctccagggacttgaggtggttcctgacctcccctccccaaaagttcagcctgccccatgtggcctcattagggccttgcaggcctggtgccaccctgggggctgctacttgatggtcttacccactcatggagtcatggagttacaggtaccttcctgagcaggggatggtagctcctgaatactgtaaatgtcactctcagaggaggaccactgacgggggactgttacccctagtctgctgctcccagggaatttttttttttaaatacctgtcttccaacaaaagagtggtctagatgggggtggggggctgctaaatttagaaatcatgacccaaatagccttccttttggccttttaagttcacaaaagtattttcaaaattcccagtgcttggaagtctaaacttgaagctattcgagattagagttttcaatgtagaattttgaatcttgaaatttaatgctgtggataagaccaggtaaggaatagaccatcctctaacatccccaactaagccctgtcccaagtcctccagaggtgatgctcgtctttgctcaacttgatgggtccttgcacattttggctctcttcagaattccctttgctgccaattgggaagtcccaagccatgtgttcaaacaagaagaggaactggagcctcagaggagctgctctcagccccactcaggaggtggcacttgacaatgtgtagccttttaatgtgggcactggggacatccttttcaggctatcctgaaattcaaagctttgtaccaacctccttggactctgcatcctatgcaattgtccatttggatgtcaaaggatgtggctgagagtgggctgtggatattatccctattttgtcctaaggaaatttctgtaagagctggagtgcccagacactgtgtctcatgctgtatacttaagaggaaaagaaaaaagtcctatatttgtgatcaaaaagagggaacttgaaatgtgctggtgtttataataaaagctggtaaaactgcttggattcaaagatggttccgattggctaatggtccccttagccttagctcaactaccagtcagtgactgaagatcctagtatacttaaattcatttgaggctctaagaaacactagcatttaggaactgaatattacattcacagataacatgctgttttcctacattgttggagtgcaaagatgttttggtttctattaaatggggctagcatggtgtggtagcccacacctttcatcagagaagagccagaggcaggtgggtttaaggccttcctgatgtacataggaaatgtcagagttacatagggagagaattatcttatggggaagtggtaaggatgggttttgaatcaactagattgttgatgcatgacaaaataagctggtatttaaaaacgaaaggggatatacacttctaattaagctgattgtgtgttggtggccac

SEQ ID NO: 23753 - DNA, 1153 bp, Mus musculus
ctgcctcccgagtgctgggattaaaggcgtgcgccaccacgctcaactgattttttttttttttttaaaacaaagagttggtccttttctcattattgtttaatgtttcctctttctgaatttgaaaaaaaaatttttttcttgttttacctccctaaatagtgtttcattactggtttaatactactcttaagacatgctagtagtctgtgtgaaatgtttccttaggttaagattataacaacatgacagttggagagctgttacgttttcttagattctcatttccatttctgcttaatttctagattttggatcattgtttgacttggaaaatgaccttcctgatgagctgatccccaatggagaattaagccttttaaacagtgggaaccttgttccagatgctgcgtccaaacataaacaactgtcagagcttcttagaggaggcagcggctctagcatcaacccagggataggcaatgtgagtgccagcagccctgtgcaacagggccttggtggccaggctcaggggcagccgaacagtacaaacatggccagcttaggtgccatgggcaagagccctctgaaccaaggagactcatcaacacccaacctgcccaaacaggcagccagcacctctgggcccactccccctgcctcccaagcactgaatccacaagcacaaaagcaagtagggctggtgaccagtagtcctgccacatcacagactggacctgggatctgcatgaatgctaacttcaaccagacccacccaggccttctcaatagtaactctggccatagcttaatgaatcaggctcaacaagggcaagctcaagtcatgaatggatctcttggggctgctggaagaggaaggggagctggaatgccctaccctgctccagccatgcagggggccacaagcagtgtgctggcggagaccttgacacaggtttccccacaaatggctggccatgctggactaaatacagcacaggcaggaggcatgaccaaggtaagtgagctgaagtgcttgaatgtttcttgaatgatgatgggcatttactttcaagacacagggcagcatgggtctatgtggcttcttattttcccttctcttgaaagtttcacatgtccatgaaagaaacag

SEQ ID NO: 23754 - DNA, 1150 bp, Mus musculus
tgtatgtgatattaggcctctattggatgtgtaattgtagaaatctttcccattctgtaggctgccagtttgtctggatgacaatgtcttttgccatacaggagcttttcaattttatgaggtcttatttattaattgttgaacttgatgtctattctaatggtgttctgttcagaaagtctttcctgcaccattgagttcaaggctattccccactttctcttctatcaggttcagtgtatctggttttatgttgaggtctctgatccatttggagttgagttttgtgcaggatgatagagatggagttatgtgggtttttgtacatgtagccatccagtttgactagcaccttttattatagatgctgtctttttcccccagtgcttatttctgatgactttataaaaaagcaggtgtctattggtatgtggattaatgtttggaccttcaatttgactccattgatcacatttctgtatttctgtcagtaccatgctgtttttattactgtattgtgctgtagtacaatttgaagttgggggtagccctcacccaattgcttcttggaggatatctgtcagacctgctctgtcctgtgctttaacatcatttaaaaagatcatgccttcctattagtctcaagcttagccttaagagaacagctcgtacttttatgctgaaatgtgtaccactgctttgatagtcgcggagcttttgcatagtctactttccctgagtagtcctctgagacagagtcctgcgtgggttttccttagcttgctgatgagcttcgaccttcttgaatgggtctgacccaggatacttcatacacagtcagaatgggatgtggaaggcttggaagtaagcaaagtgccctcgctcttttaatttctaggcagtttaatgaaggactgtagttgtcctagaagaactattgggatcttttctggttcccttagatagcaagactatttttgagttctgtgtctaaaagttgaattcctattaaacttactgttaggaaatacattatctctagtgacatttccccactattaagaatacttgaatattatctatagtgacccccccccatgttttgtttctattaatcaaagagaatgtttagttgaagcattgctaagag

SEQ ID NO: 23755 - DNA, 1199 bp, Mus musculus
ggctatagaagggagcagggctggaagcaagccccctcctggcatctctagggtacctgggcccacattcctgtggcccacaaatgggcttctccgcctccaacactgggcagtttcaggggctcatctgcacgcaggccaagatttcatatgctcaccagacacaaagcttacaaaccaggcctcaggaatctcaaagccgtgttttcatcccgaccccacacagaagggtcttccagccaagagtgaagatgtttgtctcagaagctgacccatttgagggagatgtttaaccatctgaggatgcatttatttatttatttatttatttatcaaaacatgtgtattatggggagggggcactgggtagttttggtggagggaagcagtcagggagtgggcagggcagtttgcaaaggacacagccgaccaatgacaagatgtccctctatgtttcatgtctcatccactgtggcccatggtgccacccagggtgctgttccctcttgtggggatccagagtaaaactggctcggcgccaggtgggattctgcaaaccttttgtccgttccacccactgttggactgcacgggctggcttgtggtgggatttaattctgttggtcaattcaaactcttgaagggggtttcttacggggcaccgagggacagagccatctgttttgccaaaggaaatgcagacagcctgtcacagatgaaatttgagttcctggctgctaaccttgcttgtaattaaattgtgttcttccatgatgaatctcaagttgatgctggaaggagctcaagctacagctgccccgccaccatcatttttccaggtcatgctgatgtgtagctcatgagacaactgaagaccatctctgtgcctattggaggtcttcatgccatgccctgtgtgtggtgtgttctttcactggtaaacttcactgtatagctttcacatctgagttaagcccggttttcactcctccctgaagatggacagaacctgcttatgctagcaaggtgacatcttagctttagtcagctacttccccagagacacctgggatggccacccatgcagcaaagccatgccaggacccagagtattcttagtgactggaagatttcctgtcccagttggctccctgttggtcttccaactagaagaacagataagttgtgacaatacctct

SEQ ID NO: 23756 - DNA, 1178 bp, Mus musculus
agtgagtagtgactgctttctgaacagtctgtaagaatagtgagctatggagagctcagagtgctggattctagtgctcacaggttccagatgtccagaaattctcagaatacaccccaaatttccaaatatatcttcaccactcactatgatgtagacacatatacatgcacatgccataaacacacacatcttctccccccccgccccccatcatttgggaaccaggtttcagccagcaccccttaatattcctaagtatttcttaaaaacaagcattctttccatacgtccaacaagcatccaccttccctagtcaggaaggcaacattgccatcgtgcagtacctaagcctcaggcccctgcatactgtgccagttgctgttttgagaaatgtccatcagagccgatccatgctcccagttgtcacagctctttagcttcttccttcatctttgtcctttcatgacttggacattttggaagacaactggctagttattttgtgcgacagccattagtttaggtttgctcatgactagatttaggatgtgcagagaagaatgctgcagagaggcgatgtgaatccagccctgctgatgtagtgtttgttatttctagatctgtcatgtttcattacttggggcagaattgatgagtttttttccatcataaaattaattggttatcatttacaatttggttaaaaagtagtactctataagggaaacaaacatttgtaactgttagaattgtgtttctcattaggcctttagctatctttgtttccttggatgcatcagttagtatggtagttaccaaacagtgatgttctaattgcactatctcatctatatttgttagctgtcgttctgctctaagagagtgagtatgcctgcctccctacctccctgtcttcccctccctccctccctctatctgcccccccccccccagtttgtagtcattgggtttatgtaatcctttactatcaacatttgctttcaagctccgactgtcctggtgggagctcgttcatgctgtgtccttttagtgtgtccctgccatccttgaagactcctttactttttgacaaaatactttctgggctcttcatgaatgtttcttcactccagctctggaattggcctttgctgcagtaagccttggtttcctat

SEQ ID NO: 23757 - DNA, 1227 bp, Mus musculus
agggagagagagaatgtgtgttctgagtgtgtgtgtgtgtgtgtgtgtgtgtgtgtgtgtgtgtgtgtattgcagggcagccttaggtactagtccttgctcctatctagtggagaaaatactactacagctttgtacactctacattgtggacactgtagagtgcttagcaagacttagaggacctgcattcaggcctcactacaaaagaaccaaaaccaaaccaaagcaaacagtagcccacctgcagcctctgctcagtgaactccctagccattcctagcaaagccctgtggccttctctgcccttccagtttgttttgtgtaggtgtttgggatatagtctggcatggaacagtatccattactgagctaagtctttaacacagagggggctttggcaggaactagaatgggcaatggaggagagccagtcaggacactgggcctgaggatgtgaacttgagctgacagcctctggcctgctgtgttcctgtggctggaaggcaaggagagcagcttgggctgtggtaggaaagcacaggactaggggtatggaaaaggtgaactgacttcatttattcaggcgagctgcaagctttacatagacgtctcaagaagtatatttatcttgagtaattttgtacttgtggtaactctttgtcatttatgtacataaacccatcattatacactcacttatccccccccccccttgggggaacaaagcttcaggttatttgttttacataatttccaggattttaatgtaatgttgttaaattctgttcagttgctttttccttccaaagcaggaaaaaatgctatacagaaatcagcttttcagtcatttgttttcatatttgatttatttgagaaatagtagcttacttttttttaaaatgtgatctagagaggaagaaaacctatagtcatctgatatatttttttgtatacagattttaaaataacattgtatcacaaaagctctgatttaagtaaatgttgtttatgagtgatccagttaactttacattattaagtgtgactacttgaaagtgcaggtggcactgtattttgtgactctttgtgactgagttcttatctccagaagtgtctaaggtcatctgtgttcctttttgtcatgtcagggcactgcttgatagttggggtgggggctgtgtctgacaggggagcgctgttacagaattatcacagttgtgagat

SEQ ID NO: 23758 - DNA, 1202 bp, Mus musculus
gtgtgtgtgtatgtatatgtgactgtgtatgtgactgtgtgtatatgtgtttataactccatgtatgtatgtgtgtatgtgactgtgtgtatatgtgtttataactgtgtatatatgtgtgtgtgattgtgtgactgcatgtgtgtacctggatggcccacctaggattgagatcgaggaagaggcattcaaagagcaatgccctgtcagctcctggctttgcaggtatgtcttagccttaatctcacaggtattggcaatatttaatgccagttccccctcagtgacgtgacacaaagcttgggctttttctaataaaaagaaattgttctctagaagatcataaaggtgacaaggaggagacaacagaaaggaaagagactagtggcctagaactgtatgcagagaaggtgtgatcagtaggtcttgtcctaagggaaaattctcaggcataaaaagggactttccctgtacctgcttgcaatctggtatgtagtctgtttgtctacactgtgtataggatccacagtgtagaaaagagtgtttatagagtatttcctttgtgccagaaactgggcttcagccctgtaaacaaaacacacatctaacaaagatgggctgatcctcttacctgtgtgtcctgaggctttatatgcgcagggaggtcgctggctggcagagttcagaaagcaaacgtcgtcacactgcttggaatcgattctgggcttgctacaggatggccttgggcaaatgattaaactgcatttcagtctccttactcataaaatggagacactgtcagtctctcccttacaaaattgtggtagggaatcaatgactcggacatggaatgtgcttgacttgacataggacaaaaccaactgacactactcagtaaactttagtcatcatttctatcgttagtcatatctcaccgatgagagtgactgtcagagtggccagaatgaaggcatgtgtaaatgagagagctaaacttctacccagtgcccagctccctgtttggctcaggctgggttatctgttcaggattacattaggttacgctgactctgactccaagcctttttcaaactggagaagatttgattgagtttctaagtggtcattcagtacttcgaatcatttttttttaagtttgtttatgtatttacttggtgtgtgtgtgtgtgtgtttagaggac

SEQ ID NO: 23759 - DNA, 2898 bp, Mus musculus
gacctgaaccaggtgattgagaacaggctagagaacaagatcgcttttattcgacagcatgccatccgagtccgaattcatgcccttttagttgaccgctatctgcagacttacaaggacaaaatgaccttcttcagtgatggggaactggtctttaaggacattgtggaagatcctgataaattctatattttcaagaccatcctggcaaagaccaatgtcagcaagtttgaccttcccaaccgtgaggcttataaggacttctttggcatcaaccccatttccaatttcaaactcctctctcagcagtgctcctacatggggggttgcttcctggagaagattgaacgagccatcacccaggagctccccagccttctgggtagcattgggcttgggaagaatccaggtgctcctaactgtgataaaacaggctgtggtgagaccccaaagaatcgctacaagaagcactagtttctgtgtagctattcttgggtccccactggtgaataagcttgtgtcctaactgtctcagaagtcctggcttgttaaccctttgagccatactggtgacaatcagtctgcattggagatttgggagttcattgaggctggtgaatcagggaaggttctagggaggagagtggtaactgtgaattatagtgtgcttgtcatattgcttcagttagaaggccttgacacaggccaagccagtctacaaggcttcctttgctttttctgggtcctgtcttagagagacagagagcagctaaattctaatgaataataagataacgagggtcaaataagctaaactcagtggaaaattcctgagtaatagagggttctcaggtctgtgtcaactcctcacacatacatcttctgtttgatccctgtccctccttggctccctcctaagcttgggttgattttcagaagtggacagactcttgagtctaatcttcataaattttgagcccaaccttggaatcttctccatgttttcccaaggggtggggcatccagaaaactaaaacatgagttttcaaattaggatgttgatctgccaccccaagtataatttcattgatgtcccagttggagagcttagatacttagttgtccctaaaaggagagtgagcgggtgatgtactcaggtactttccctccttatgtgacttacatgaaggtcctggaagcactcccggggttaattggtttgcggtgtatctttgtatgttgcatgtctttgaaagctcagatcacagaggtgttgggtttcagagaggacaatggagaccttgctcctagtccttggaggcttctctggacagacattctcccaagtttcaggggaagctgtgtccacagcttctttgtgggagcacttgatagaggacatgtctcttctggttcccagaaccatggtttctcttttcctttcttctccattccctgatgcattaatacttccaactgagaaaaagtccctgaatcagaaccagtaccagccttggcattggcactggtgccagataagacctgaggttcaggttcaacctgaacttctgcagatgcccactgaatgcagtcaggacagccaggaccttcaaacaccagtgaatgtgcacttgagggcgtcagacttgagggcacagagagaggactccagagagtcttgcatggcacacatacattgccaccttgaagtgcaggggagtgagaggctctgggaggatgaagagatttttgatggagcgggcaaggtgaagttcagcctgccttgagggctttctctgagcacagccagctgcttttttgggagcaagctctcccgggggccttagttgtgaggcatgggttgggatccgccagcaccagggtgtcatctagaacagaaggaaagtaggttggagagctgagccagtcattcctcctaaggatcaagtaggtagcataagcagtaatcaatggagactacatagagaacttcaatttaggagtttgtgtttctctgaattcctggcagtctggtgccccctcctaagggaggctactgctctggctcaatgtagggcccaggatctgccacaaatcaaaagccccagagctgccaggacaccgtttccaaggagtgagtttctcccgtcacagttattcatggctagggcagatgagctgcaatctgtcttggatttttcttcccaaactcctcccctcttctctctatcatgtgctctctggagagactgtctttcccacccttctccttcatgcccctcatgcctgtgggttttgtgtggcaaatgtttttgcagaaaccagggaaaaggttgaactgtacggaccttgtcctggctgtcagtgcctgcatgcttggaggaaagcagatgacgtaaggccaattaattcttacaggatttgcatttgggggaagacaccttaccagtagtatcctccttttggatttttctccatctatttcttctctgtctccattttgctcctctcctgcccacaggccactgactgtcagtacaggtttttagcacgtatcctttgcccagctctgcagagatggattctgagcaagttctgactatgggcgtttcatcccaggagaagcatgggattcagagatgtctgtgcctgaacagtggctgacctttccagtgttctttccattctggtttcatcagggagaacgtctcaataaagttccaatctctcttcaacgccttggccttcttgattgtctccagccaagtgaatttcttagtttcctttcatcaagtagagtattctctctctctctctctctctctctctctctctctctctctctctctctctctctctctctctctccctccctccctccctccctctctttctctc

SEQ ID NO: 23760 - DNA, 1169 bp, Mus musculus
aagctcgtagtcgtcgacctcaaaggtcagatgtcgtgggttttcctatttgctagattgcagatcagggactatcaactaggattggtttccatttggcctatagtccttcatttgtaggcatttccaggtccttgacctatctgagactttaggtcaaggtagcaaatattctaggaagactcaagttcctaactcctggaccttagcccaagggccatctttagccccttctcccctaccctgaactaaataaccctgggcatgttgggagaggccactactgggctctgcttctctgcttggagcctaggacaacacccacagtagcccttgggggtctgggcttctttcccatcgtgtttgcccagttgccctagtgactgtgtgacccttctcccccgccctccacctcctgccgtgcctgcttgcacccaccatataaatagaggcgaggagcagctgggctctcttggcagtcaccatgaaggcgctgctcctgctctgctgtttcctggcctccctgctgctttcaggacaagcaggtacgccccctgcacaaatggcttccattgggcccctaatgtgcccaagtttttatccgagtggggggctgggctgatggcagaactttgcatctagctcgtataactgcccttctctcaggggcccgggacacagaggatgaggtgctagagagaagtgggagccagtgaggggttctaagaagaaatcagagcaaatggttctgaggtctagaccaggttcagagagaaacatgctggagagaggaccctccggagtcaggcatagaggaatctctgagatggataaaaatacatactcttggagctggaggttgtctgagttaccatcttggtgggagataggacagagactttgttttagctagtgacttaggtctgcatgtccatggacagagtgggacactgcagacaaagctgagaatcattttatgaacagtgggacagagttggaactgggatagggtagaactgaatggaaagctgagaactggtgactgtgttggaagcaactggacagaatgtggaggggaatggaggagagccttccgaggggcagggtctttcctccagaagggggctcagctctgcacaccatggctctcctttggcatctcaacattt

SEQ ID NO: 23761 - DNA, 1099 bp, Mus musculus
tgggattagatgctaattgatctggcatctacagttagagatcaggttggtaatattgaacaatgttttctaataatacccaacaattgttataaatagaagtatttcaactaagaggctcgatttgggtggaaccttggaaggcagcgaatgggtctgggaaaggcgctgagctggagcgaggacattccgaggcaggcgtgggcttcctgagcctggggccaagccctccaggagtctggggagggccgggaccggaaggtgggggcgtgtcagaggacggaagctcacccctaaaacgtcccctcccttgccccagaccaccactccccccccattgtagagcgcgccctctggcggtggagcaagttttatcccgccttccccatgaatgagaagctgcagcccgctgcgcgcgaagtcggaaagtaaggtagtgaaagaggcaagacaggacctggcagccaccaccagacctctaatggatattcggaccgcgctggcagcctgcctcagggccgctgctgttctggcttgcctccgcccttcccttccttcccacttgctctctcttcctatggcagccccaaacatccgaggtaccttgcgcacctgcctgtacccttcgcaatctaatttcctagcaccagtcagagtttgggccaggcagccacctgggtaaagacggagggaggaggctggcgggtggtcagagtcagccccaagttacttgtgggaaacagtggctatgacgcaagtttccagggggcccgggtcggctcgaaagggagcgcgccagagtggctctgctccgctccgtgcagtggcaattatgaaaatgcaaaagcctgaagcacacacccaaaagagccttccctttgctgctgcagccccgcccagcgcgtcctccaggatagcggtgcgcaaagaccccgcactgggcagtcctcaccggaccctggactgcacagactgggatcccgtgcggtggggctggcctttttttttttttttttttttttttttttctttttagctacgcttgccaacctgtcagctgatggacctcatcacccatagtggcgcatgtagctgggcc

SEQ ID NO: 23762 - DNA, 1254 bp, Mus musculus
cactcagtgcaacccatccttataggtgagaagccctacgtctgcccctatgagggctgcaacaagcgttactccaactccagtgaccgcttcaagcacacccgtacccactacgtagacaagccctactactgcaagatgcccggctgtcacaagcgttacacggaccccagttcactgcgcaaacacatcaaggcccatggccactttgtgtcacatgagcagcaggagctcctgcagctgcgcccaccccctaaaccaccactgcccactcctgacagtggctcctatgtcagcggggctcagatcatcatcccgaaccctgctgccctttttggaggccccagtctgcctggcctgccattacctctacctcctggcccccttgacctcagtgctctggcctgtggcaatggtggaggtgggggtgggggtattggccctgggctgccaggctctgttctgcccctcaatctggccaagaacccgctgttgccctcaccctttggggctggtggactaggcctgcctgtggtttctctcctgggtggctctgccggtagcaaggccgagggggagaagggtcgtgggtcagtacctgccagggtcctgggcctggaagatcacaagacgcccctggaaaggacggagcgcagccgctcccggccaagccctgatggactccctttgctcccaggcactgtactggacctgtccacaggcaactcagcagccagcagtccagaggtgttaactcctggctgggtggtcattccaccagggtctgtgctgctcaaaccagctgtggtaaactgaaactgggcaacccatctaccagctgtgacagcccagccacctaccgtgggctcatcccccgacgaacagaaactcttctgcgaaatagcaataatatcctactgccccagggccaagctgcagccccagacaagctgggtggcaaggtggcaaggatggtgctagaaggtctgtgctggcctcctggctccaaagtgaggacttggcttggacctgctgtccaagaagagccattctcttgggtgctaaggcctcaatcacttccatttccctagtctgtagtctgggtgaggcctttgcctgtcctcccaggacgctcagtcctgcctcttgctctggtgcgttcctctctatggccaccctggctgggcagggttccagtcctccctgccttacctacttgtcagctaggagcccccagtgatcatagataggccc

SEQ ID NO: 23763 - DNA, 1436 bp, Mus musculus
tctggtccacctctagagggagagcaagacagacactgctgccttctcctgcctgctgctatgacaaggtgcttctctgcttgcttagcagagaagcctgctctgccagcacttctctttcctgccagagggttggcaatactttccaaagaggaggggtagctgaccactcaaccttctccttggggatgtgcaggcaggtacaagggtcactgtgctgacctggcccggcttggcctggcctgagcagtgttactctgcagaagcttataaggcactagtctacaccacgtgggctctcaagcttgggacacagctacaggtttgggggcaccaagtaatgggatgcagggaagaagactcattggaaaggcgctttctagaaagcactgactgaagcccctgagtgttaagggaggctaggcagccaagcacagcattagcttgggaaaaagctagctagagaaaggcctggccatctggcagggttctttcctgactctagttgaacccttttcttggtgctgcctctcttgcccatgagctctgcccaagccagcgaccccagggcttgtgcaacaaaccaaggacattggaggactgtgtgctccatagctccaaaaggctagctgccccagcttgggcttcttgctgtcccctgtactatgctgcagtggctaagcccctcatgtccccatctgtagaacaagagagctgctgaggtgctagtgggtccttggctctgtggttcctctgagcagttctgtctagtctttttctcagactgcctttctgtttcagaagggtcacccttccctaacctacctgactgctggccttagaaccccagccctgatggggctcggctgtgctggctctccttgatggggctgtgagcaagttaaggagctggtctcctacctttgggtctgcctaggatccaagcaactcctggctctattagggtcctaggccttaagtccctggctgggggatttggtttgagactcaagccaaggagaagaacagagcactggacattagctcagcatgtgactcaagtgatagaccaggctcagaagggctggttacttcctgtcagtttgttgcacattccaggattcagtattttaacaggttctaagtgcctttctcttgtagtgtatggttttcctccttctggctccatggctgttagcatagagtttaaaaaaagagagataagctaatgactataacaatatattcctccatgggagaggaagtttatacagaaacaataaagtgagttgcaaagatggtttctgcacgtgccagggctgggacacctgcttttgttcgtgcctggttgttgacctcccaactagagctcccgaaagccgtctggagctttcacctcagcctaccacaggccaccttcattgtgaaagtgatcc

SEQ ID NO: 23764 - DNA, 1165 bp, Mus musculus
gcctccaggaatgtcagagtcttattgcattccccaggaggagctgggggggggggggagtgggagggggtgttcccaaccttaaagaagaactggccttctgcctttccccagccgcccccaaactgaggtggcctgaagaagcctcctcacacccagggagactggaatgaggaaaagcgggggaggcctgctgcctggacagcaggctgaggggttggggaaagcagccgggctgactctggaatgtggaaactgataaaaggaaggagggctagtcctcccaacgatgccagagcacccctactggcctgctgccgtcacgtgtacacacacaccctctgggccacactcctgcatatgtgtgtgtgtgtgcgcgcgcgtgcgcacgagcgcacacacacacctctcccttttccaaaagcacacacaaattccatagcagtgaggggagctggttttcttggcaacacaagggccttgggttccacagctctgggagaagggggcggggggctctaagggatctaaggtgactggttccttcacataagattaggacctgccagtggtcaagaatgactttaggcacttacccaagagaactgtgctgggggtggttaggtaggaaccacttcctgctgccaaatggagccccactttcctgggactccagttgaacctagccacaaaaatcctggctcttccttagtacttatcctaactaacccaggctggggatatctggaatggcagtgactctgtgtgtgtgtgtgtgtgtgtgtgtgtgtgtggtgtgtgttgtgttgtgtgtgtgtgtgtgttgtgtgtgtgttgtgtgtgtgtgtgtgtgtgtgtgtgtgtgtgtgcatgtacctaagcatgtgcctgactgtctgtctgcctgcctgcctgcatgcatgtctggctatctctcttggccccagggctatctgccagagaggacttgctcaggaaagtataagtcttacagtgtctgagaagcctcttgtactctctcttctcccaccacttccagagagtggtctccaaacactctgccacagtaaccttctgcgtagtgccctctttacccacagatctcaggtggctgttctggtgtgcaactctgaggcttggcaagttggggacaagcagcgtctgt

SEQ ID NO: 23765 - DNA, 1145 bp, Mus musculus
tctgcccagtgtggtggcgcacacctttgatcccagtacttgggaggcagaggcaggcggatttgtgagttcgaggccagcctcgaacagagtaagttacaggacaggcagggctatacagagaaaccctgtcttggaaaaaaaaaaaacaaaaaaacccctcaaaaacaaaagaaaagaactgaacccaaggatgtgcagaggcttaacgaatgccccagcactgatctctaacgtgattgtggtgtttgttgaaacagggtgtcactgtgcagcgccagctctcttcatactcatcctcttgccttagccttctcactggtgggatttcaccaccatgcccgacttctgtagagtgttttgcacttagtaaatcgacagacttgtttgacataagctgtgttgcctgtgtccctgagccttagaagactcagagctctctgactgctgtgttatctttcatcacaggtgttgagcgatgaagtgaagaggaagcagtatgacgcttacggctctgctggctttgaccctggcaccagcagctctgggcagggctactggagaggaggtccctctgttgaccccgaggagttgttcaggaagatctttggggagttctcatcttctccttttggtgatttccagaatgtgtttgatcagcctcaggaagtacgtttcttattctttatttttgtattttttgagagagggtcttacattctagccttggctgtcttagaactcactctgcagaccaggttggccttaaactcacagagatctgcctacctctgcctcccaagtgccaggattaaagacacgtgccatcatacccaatgttctttattttaaaggatcaacttttaggtttaagtgcagcacaagggtcttttttagtttttgtttctcagaaaggcagtggaatgatttaacgtcatccatttgacaggaaggaatacttggaaaatcctttaggtagtgatgaacatgtacattgtgatgtcattatcaatagctgcttactcagtagattgattcatctagagcaggggttctgaaactggattgtgacttcttcgggtggggcttgaatatgagatatcctatgaaccagctatttttattatgatttatagcagtagcga

SEQ ID NO: 23766 - DNA, 1468 bp, Mus musculus
tgaaccgccgagcaacagcaaaactatgtgacaacacttctccgcataaaggttatggtgccctaggcagtgacatatggcctcaggctggacaccgagacaggtggaaataccctgtccattggtagatgtcttgcttcttctggttcaggcagggaaaacacttggactcttcttgcagcactaaaactaacctggaatcgcatgtagtagagctgaaagaattaaagacccggcttacagcttcagatgaagctttaagctgcagtgttgtgaagtgattaattccctttctaccaaccccgtgggagttctacagtacggctgtcctgacacggctcttgtctaggaccagggcggcacatcccaccagcgccatcttcctggacagagtgagctgtcagtcactccccaggttttttttgtttttggggtttttttttttttgtaccaagtagctagaaagtgggacctagggccctgggaggacacctagcaacagcaggttccatttcacctcagatggcagcttgcctggcagtggacttagagtgttctagtctgatgtatgtggggtttcctgccctgttggaccaaagtttccatggtcctatgggatagccttcagcctctggagacccagagcttgcctgccagggcttggttctccatttccactgctgacatttgatttccagtgtatttaaattactccgtggtaaatttcattgtcttttcctgtgtaaatgttaaatgacaataccatcggtgaaggccctccacagtggacagagcaacttcctttccagcctctgctggtagcatgctgcagcttctgtgttaaaggtcctctggagctcgtgtaagacaggaagaacactttctctgtagtttctttcttttcatttataatttacaaaagtaaagcatttattagtgtctgatttaagaatgtaaagtgattctgtatcaatgtaaataagatgatctactacaaaagatatttaaaatcaaaattgtggtcatttcttctttgagagttcaaagtagcttctgtaggctgcccagcagagggcaacaggagagtcagctggcagcatctgccagtgcagacccctactctcatttccagagcaggccctttccctgagacagtgcttctatgtgagcttgagcccagctgagacatgtacacgtgctccctgtgccctttggtgactgttctgtttcccctaataatttttcagtctttgttttgctatgtagcccaggctggaactcctgatcccttgccttcacacacacacacacacacacacacacacacacacacacacacacacacacacacaccctgcacaagtactaggaccacagatgtaagccaccatgtctctaaaaacattctttgtaagtttttgtaaaggtagtagctggaaatgaacccaagacctcaggcatggtaggc

SEQ ID NO: 23767 - DNA, 1114 bp, Mus musculus
caaaccttaaatagctccttcttaatgtttcctttcaagaagtctttgacaaactgggtattttctgctcggtcatgtgcttccttggtcccttccttcaggagctcagaaaggtctgccattctgtgggggatgaactttgagtgagacagtagccctttccagttctccagaaaggactaaagggcaaaagacagtttaggtccaagatagagactggaagtaggagctgctcagacactatttcagtccagcatgagtaactgagctgagaacagggcgagatatgacaatctggcacaaaaactcagtggacatgaagtttactatggtctccacaaaagtgcctggattggtatctgttagtcagcacccaaatgaacgatgctttgcttctgtagccacctagtggctgaagaaccaaaacttacaatctatccaggaaagagctgcctttcctgtggctgggcctaggtgtgggaagatagctgagaggcagagatcttagttggcttctctatatctctctctctctctctctctctctctctctctctctctctctctctctgtctctctctgtctctctctgtctctgtctgtctgtctctcctttcctcctccctctctcccttcctcccttttcttttatctttgagacagggtttctgtgtaactctgactgtcctggaactcattctgtagaccaggaaggccttgaactcagagatccactgcgtccaccagttttatatttaacagaattactcaggataaagttacatcaacaaatggatatggaagaaaagtatcatcataagtacaatggaacctaggaaggacgactgtgaatctataaactccatctgttagcatgagaaaattttggttttcttgtggtctagtctctgcacactaatttttttagatcattttgtatcaccccatgtcctaataactggtttattagcaaatatagtaagatataagaaataacttagccagtgacaggactctactgagaagctaagaacaatgcgcagcaggggctagtatccaaacatctatacagctcagtgctgatgagcatttcctagtacatactgaatcaggc

SEQ ID NO: 23768 - DNA, 1283 bp, Mus musculus
tctctggaataagtgccagcctttttgccatagttgacttgcttccatattggagctcctcagtaggaacagctgtggcactgggctggggaccaggaagaagtcacaagtggtgggagtatcctagggacatgagtcgtgcccagggtataaacccaaacctggtcatttcttgaacagtctgtgaatatgcctgtgtggacgctgtatcctgctgctgtccctctcctggtctctcacactgcatggcctcctatcactgtgaattgtggcctggtcgcagtttgtagtttcattaaatggccctttcactcccctgccctgggcctctgctgtcttgcctggcttccttcttttctgagagacagggtgggactataggtagtctagtggcaggcaggagcccgggcctgggaaacaacacatttaagaacccaattacaccaaaccagaatttatatatatagacctgccctggggaaacccagctgttctgggccagggcattggtttctgccatttgcataattagatgtccaggctgcagaacctgagaactggagccccgtcttagcttagtaacttcttaacctatagctattgctctttcgtccttaaacaagacagcactactggactaagacctgatagtctgaagatgacacactgaagtctcggcactcagttcttggtaaatcaatcttctgaactgtgaaggtggtgggctcagtctctttgagtttccctgctgttctaccattttttcacacaaagacttttataggaatagattcctactaataaaaatgtttaacttcatatttctattttagaccatgcattgtttaaatctaagtatgtgcttttgaaataagaaacctcaaagattttgagttaggaaaaatcacaggtccaagcagatattaaggatctttatggtatttagcatgaatacatggaaatagaaggtgctaggaagttggcaaggagtgccatgaaagaggatgtccatttgtatgctgtttctgagggactctatcctatcccaggaaggagggaagtgtgtggcgtttgtttttagagtgttatggcaggcacaccagtcagctgagacacatcaggctaatagacttattagggagatcccggttatgcagaataagctctttagactatcaaaaggcctagaaaactgagccatcatcagctggcatgaccctttcccacaaaccctgtgtgtatgggcatctcactcccagcatggcaatgaccattccaagcac

SEQ ID NO: 23769 - DNA, 1208 bp, Mus musculus
ggggccagatgcagcccaagtgactcccagtaacttctgggcacgtctcctttgtagaggcagcaaaggccccaccagaagggtgctcaaccttccatctgtgctttctcccccacagatgtgcactcccgccaacacccctgccacgccccccaacttccctgatgccctcaccatgttctcccgtctcaaggcctctgaaagcttccacgggggtggcggcagcagcagcccaatggccacgtcggccacatcacccccaccgcacttcccccatgccactggcagctttgcaacacccagctggccaactgcagcctcacccccaggaggcccacagcaacaccagccgcagccgcccctgtggactccggcacccccttccccgacttcagactggcctcccctggctcctcaacaggccacctcagaaccaagggcccaccctgccatggaggcagagagataagggaggcccctcccccctcccggaggccagaaccccgtggggtgggggagaggatgtttctgtgggccccttcacccctcctctgtctgcacctctaaaccccagagccctggaggggagagactggactctagccaggcagtcttgtgccggcacgcacagctgcacgcacgcatgcaagttcacagcgcaggcacccccagctcgcctggatctgactccaagtggcttgggtgcctggtgggcagcaccttggagaccaagcagccatcccagcgaagacttacctgcctggccccaccacctggagtgtttcagagaatcacttggtggcagtcacgtggctgactcctgtcttgggccataggcctagatccctacccatgggaatgcagagccttctccgcatgtgtgcgtgcagctgtgtcttatgtatttatatgtatgtcgctcttcaaaagcaacctagtttatggggcagctggactttgcatgttagagtgagccccaagccccttggcccaccaccctgttgtctgaagggctctgtctcactccacctccttatctgccagcattgctgtttcctgcaaaggattatgggaaactccaggactcttctacccagctcctgcctgcaaaggttccctgcatgcctcttcccctgagcccaggggtacctggtccccatttcctactcctcttttaacaaaagagaaaagaattccaaaccaccacc

SEQ ID NO: 23770 - DNA, 1195 bp, Mus musculus
tcacatgtggcagtgctccaataaataggctcagctacccagttcatgtttaagatagctccttcctctccttccaggtcctggtgtgctttctggaagctgatataaatgaaagtatttccaagttagatctgcttagtgatttggctgaatagacagttccagctgttgtaaagacacggggttaagggcagtccttcctttctctgccggactggagctgggggaggccagggttcgcccctgcacgtgagcctgctactccccatgtggtgctcccccatggtgctcgaggggctccacgtgatcctgatgcctcctactccctttgccacagcttctaggggtgatggcacacttagacacaggacttgctctaggcagcatcaggcccacctcaggctcttacaaagccactgacacccatacgtttgtctccacagccttctgatgatgagaacagtgacaacagcagtgagtgtgtggtgtgcctgtcagacctgcgggacacactgatcctgccctgccgacacctgtgcctctgcacttcctgtgctgacacactgcggtaccaggccaacaactgccccatctgccggctgcgtgagcatactcagggttctgattgtggaatatgcagatttggggactgttattccctactgcatgaaacatggaaacaccatgagttttcatgcaaggcatggttgatcctttagggaaagattagaaagaagatagagaagtgtggtgacacttgaaccaagcaggttaagctttgaacagaatctgttgtcaaggttacctaggaactattcttaaaaaccttaaagtgaggtaaaagcagaacactgtggtgggtaggaagttggcaagtgatgctgggttgttgcccacattgtaggctctaaggaaactcacccaggctcatggctagtaaaccatcagaaatggcttctgcacttggcctcactgtctgcaagcagtgtgtggcagtggctgtccctgagagtcaagtgtgcaagtgtgtgtccatataatgtgtgagttagcactgtggtcatgagacaggctgtgcacacagaaagggaaagtacactgtctgtcccgggctcccagtgactcggctgaggtgggctggctgctccagccgaggtttctgaaggccttggtacccacctgtgataaaggagag

SEQ ID NO: 23771 - DNA, 1588 bp, Mus musculus
gccagagccagttgagagttagtgtgcctgaaggaagaagcttgggaaacagtgcgtttgtccttgatggaggggtgggcaggaggcaagtcttcaccttgaagttgaaggcaggtgggaacagatgagtgttagccagagggccagcatcagcctggtgcatatcacattttgcaggggtgctgccctgtcctgtaattcacagggtagtacttcctgtgtgagcattagtgagctctgcccttctctgccttgtgtgtgagagcctgaggagagagccctctccagagtgccacggcctgctcgctgttccctgacccctgccgacctatatccttctaagagaggctgcagtagaacacctacccacacccccactgccaccctgcttgggatccctggaggccatacttcccctagtctagggcagcattggttttcctgcctctggcatggctctgctctgcctggccctgagttctcctgttttcactaacccctcacactttccacttctgcaaggtgggagcagcaagctacgtaggaccttggtaacgatggggacagtggcttttgcagaccttaatgatcgctctggacatctgggtactgggatgtgtgctggagctggtggccgagggaatcctgagcaggctggcttccatcctgcaagggagcttttgataagagatggggcttgagtccttagaaggcggcatgatcgagacacagccgagcaggtctagggaggagaatgtcccatttctggggtttcatggcatgggcaaggagcctgtctggtccctcctcacttggctttgttcccacagagttctgacagtatcccacctggctatgagcccatctccttgcttgaggcactcaatggtctacgagctgtctccccggctatcccatcagctcccctctatgaggaaatcacctactcaggcatctcggacggtctttcccaggccagttgtccccttgctggacttgatcgaatcatggaaagtggcctacagaagggcaagacacagagcaagtctccagacaggtgaggccaatgtccaacctccctggtgagagccgggagagcaaggatggggaggagggcctgctgtgtgcgcgaggattgcgaggcttcgctgtggcttcacagaatgttacggtgcattttgttccttgataattgggacaccaaaggcccagcagcaggttagaatctgctataattggtcatagccagctctgcgcagagaaagtgctgggctgaggctcccagtgcacacgggccacaagtcacaccaattgtttgctgtcagtaaataattgtacaggcctgggccatgcatgtccttgcccagggagctgatctgaattttgggcagctggtcacttaagcatagctcaccaaagaaacagcagtgacagctgaggtgtgggcaggtagacctgtggttttttattagggtttctcttgctgtgattaaacaccatgaccaaaagcaagttggggaggaaagggttatttgacttacacttctgtgtctatggcatgaactcaaaacagggcaggaagctggag

SEQ ID NO: 23772 - DNA, 1150 bp, Mus musculus
ccccatccatgaggaggacgaggagaagctctcagaggactcggatgctcctctcccaccgagcggtgtggagctggtactgcgggagagcagctcccctgaggtgaggccctggccacctcacccaggcctccctccctgatcctgacctctccccagctctcgaggcagtgccgcacggatacacagccagacaagcagtgtccctgacccggctgcggtgccttgtggtggagtcactttgaagcttataggctcgccaacatgtgaagcgtagcttccagtgacatctttgcatccctgtggcatctgctgcccactgcccttagcttagtctcagtgatttggccgttttgacccgaggacatctgcatcaaaggcctttcctctttgtcttctagagtttcggaacagaggagggagatgagccgtccctaaagcaaggtgagccacttctcccaggtccaaccctgagcccttggcaagctttgggtcctggctagggatacacacctcccaccccaactcatgccgtcaggaacctggacaatcgatgtgcagagatggtaagggcgctgtgatacaggacagcacaggatgtgctggaagctccgcctgtgtgtgggagccatttgttgtgatggtttttggaatttctggctgtgtcttcctgatgagttgagggcagctgatacctccttacctccctatactggagggcttaatgggtagcctaggaggcttggggtcccccattctccttgccggccatgttgggtggtaaggagccccctcaagtctgcctctgcttagtccttgccatgttactgctgaacagaaaagtaaagcaagagtcagggctggcatctaggagaggcccaaggccacttgactcagacatggctctaacatgtttgttagaggcagtgaggcccacagaatgatattgtgcctcccaccccccatgtaactgctgctctattgtaccctacatcctgctgagaggtcctctcataagaggcccatctgcgggaggctgaccctcggtgtagtggggtggtaccctctaagagccacatggtcacttcagccttcctagcctggccttgtagttctattctctgcctcaggcagggcctcagcttcccac

SEQ ID NO: 23773 - DNA, 1181 bp, Mus musculus
agaaagctgagcagtccacaagagagctgcataccaggacaggggacagaggacacagtgacaagtgaaggaggcgtggcgaatgtcctctgcacagcaattgaaaggcttttgttttgttgtttcgtttcgttttttaaaccagagacagggtttctctgtgtagccctggctatctatcctgtaacaactccctctctagaccatgatgtcctggaactcaggagatctgcttgcttccgcctcctgagtgctgggattgaaggcatgtaccaccatgtctggcattttatttttttaatgttttattctcattttaagtatgagtcttgcctgcatgtatctctgtgcagaagttgcatgtttggtgcccacaaaggccagaacagagtgtccaatcctttggaactgggttgttggctgccatgtgggtactaggaatcaaatcagggtcttctggggaggagccagtgctcttaaccactgaaccttcactccagccctccaggacacaacagactgaaacattgatgggagcaggtgatctagggcctcccgtgactggtgcagatctgaactactgcttaaagccacaaccacagctgaggcaggaagaatgtatattataagtatgtttgggcttcagaccaagttcaaggccagcctgggggactttgtaaaataagaccctgactcaaaaagtaaagaggcctgggaatatagttcaatggtagagtgcctacctaggttcaatccccagtactgaattttgttttttaaaactatagttagactactgtgtgcaggtcccaggacattgctgcacatgttcctagggctccctgactctccaactccttcctcctactagggatagtaactccacagcctgagttgagttactgctcaagggaccctatgttatcactttagaagagcctggatggacaactgtccaggtagtagaccctctggctccaaagtcaggaatggcaggaatggcagacacaaaagtgcagcaaccatcagtggctctggactctgaatccagaaagcacccctcgggggattgggctcttctctgcagatctacccagccaagccaccaaaagtgtggaggaaaggtcacgtaccagcttactcctctataccaacagagcacgactcaggacccagggctg

SEQ ID NO: 23774 - DNA, 1849 bp, Mus musculus
tcaagggtccctaggtttctatgagatcacatctgctattcctgccagatggtatgtacctgggttatggggtggagggtgctaggtggtcctgcccctatgaggttctggtttgatgaacagatgcaagaccaccagtcaatcatgacccctccttcctctgctcccacctacaggatggtccacctccatggagacgccacacagccttggcaccaccagctccccctggcctctgctgagtggctctagtcctgagcctggagttgctgagctgaccccattctgaaagtctggcttagcgggcaacacagagccctcagcatcccaaacattgccaggaggcttccctggaccccagcgagaccctggcctctcttgtctgcacgcctcatgtggccactgggatttgagggtccacagtgaaccttgatcaaattgcacagtgggttgttcctccacacaccctcctttttttacggtcaatatatttgtaaatggtacaagatgaaggacaacaactgtctccatgggccacgtgccctagaaggactctccccaactgtcaaagctaatgctttgagcacttagcaaaccagcataagagaatctacccatggaatgttctggaaggtgggcagtccaggttacagttgatgaaggaaacagtgcctgtctgcctctcatgtgtgaccccaaggcagccaggctgtcactgctgctgtcacaggctgacaccttacagatgtcctgaccatgggtgaccctcctcggagcgtccagatcccctcctgctctgctctattacctactagtggtccctggcagctgtgggcaaggcctgggtagtcagactgttaacaccacagtccttagcagtggtcaatgtccagttcccccgcacaggtcctgcttcactcacatcctcacccgctgccaaggtggcggtttgtgcttgcagggcagcactgcccaccacctgccagggaggagcctgagcagcttccatagcagatccgttgccagttacctggcctgtaagcttcttactgattgattgtctaaggctcctgtcagagcccacctagaagcaggctcctagtgatactttgtttccaaggcagaagtggcccatgagtggccccagagcagaggtgccccaggcagtgcagctccctggtgggttggtagagggacctcagcttaaggaactgccctgccactcacccaggtgacagcctgtagcagtgcatggagacccctttaggctcagggctgctcgagctctgactctaaccctgctccttcctagcacagctctgcacatccatctctctctcttgctgaatgcacatatgtgcacacatgtcagcatgtgcatgctcactcccccacttctcacctgccaacatcctggcctctggccgtggcactggtgccagtactttgaaagatggggtgcagcctacacacttacctgtctcagactcacatgtactatcatctgatgtactctgattggctagtttgggttcatttttactgtatatttatagtaataaaatcatgcagcaatattctatgtgtgcctttgttctggcacagcactatgtaggcagcagcattgttggcttttggtgtagtgacaggacactagagtggtttctggcagaactcctgacaggttttgttgctgccttcatttgcttgtgtgagaggggcagtgagtgccccctccaaacatagacaatggtttattgctattttgttgcttgctgtgtctgaaactggacttggaatttggctcacctccactgggcaattgatgaatcttagcctctaggtgggc

SEQ ID NO: 23775 - DNA, 1153 bp, Mus musculus
ctggtgagacctgtcatcaggtgttttccattaccagaggaacccactttctgtgccagtcttgggcctgtgtggaggagcagcagcagtgatggcctagcaagagcccagggtctcagcagtgaagcctccatagaaagcaatgaggtaaaggtccctcttcctcctccggtgttgtagaaaatgggtgaatgtttaatgtgtgtctacacaatgcctggaggactctgaaccttgagtgtgggggccaaagctgcaggtaaatcatgatagatttcacaactcacccttgccatgggtgaagaaggccagaagtttagggccagacaagggctggttcccaacatacccctttcactgcaggattctgatcatgcccggaaaagctcggttcgaaaacaaaccaggagttatttgaagaataagagtcgtcacggcaacagtgatggtcattggccttccagcacagggcctgcttccattccagggtctgaaccccaaactgagaagtctccttactcaggaccccaggtgagaacatttgagaacctgtttaaagagatggcacttctgtaactatgggatgtggattttgggctcatttatgtgtatacatgacagccaggcatttttgagaggagagggtactggtttctccacaaggcatgggaactgattgggctcagaaaggatttttgatgagcggcaggccagctgtggggttggtctccttttcttttcatgggcaggggctgtccccttgctgtcctgctctctgggtctccttaggcttagggatgctcatgagctggggacacagtaatggcatatagcatatacttaacaaaaatgcagccacaccctcactgtagaccaccccagtgaagcagcatctctatgctcagagcagcagctcagggtgtgatgcacagcggggctgctccctaacagcctataaactgggctgtctctgcctgcagcctctcccaggcctagacctggaacatagtgcacctcttgctctacagcatgttactagatgtgctgggatctcaaggctggttctttgaggaaagtggtagagaagtaaccctggaacattttctctccatcctaagcaaccaagcatgggcagaaatggaaactggaaatt

SEQ ID NO: 23776 - DNA, 2383 bp, Mus musculus
caacatcctcggaagactgcattgagggctgtcaccttgactcctaacagcactgagcacttcacatgtctgcgtataaatagagccatgagggttgtgactgttccttcttcaggtggggctgtggcagaagcccacaggctaggccatctgctccacatcaagccagtattcatacccacatatctcaagctctaggtcctgcctgctaagcaacaggctagaaccatctggaaatggctccaggaatcagggctctaccacatagtagctctgtagctagagaccaacctctacctcttttatttttttttttcaggtatacaaaagagccaaggcactggaccagtctgacaatgatatgtctgccgtgtaccgagcctacatacactaagccttgcctgcccatctaccctcccatcttccctctgacctcccctcccagtgtggggtcagggttctgggactagctctggaccagtcacctgtctccatttccttttatacagactttgaaacttgcatcagcacagtacacagcagcaccctgtctccctgaggccctggccagggataagaggatctatctctcctggtggctgtgaagaagctcttgagctgggccttgattgaccctggagcaggaggttgtggattctctctgttcctctgtgttctctgtctctgtcacacacacacccaggatagaagctacccagaaactgctgcctggctgttcttgcaagcttagcccccttctggtcaagagactggagggactagaattgacagggagcactggaagctttcaacttccccaggacagagactggcccccactgggcccctgaaaggagaggcccctcagccatcatgaaccaacagattccctgaggaggctctgtggatcaccagctgaggaggattttcctgtagacactaccattacaccgcagctcccagagtgtctctgtgaactgaagagagaccagcatagccacatagacccctcttcagggggagcagagtctacagtcttctgtcctgagcctgttcctcccaggaggtttcatttggatttgcattccagcccaagggaaggggccgtaagggccttgggagcagtgaagtgtatgggcggctccttcctgtttccattacgccaggctcttgagctgggctacctgttcagcctgctctacacaggtcccctgcatgtccctcttccccttttccttccatggagatatttctgtcccatcctcttttgacccagccccagcctgatcaacaccaataataagcatttcctagatgagcatttcctaggctgggcttttgatgaggaaccttacttctgccagtggttccaagttctgggttttttgggacttgaagcatttctccttgaagaggggaccagagaggcttagaatgtcacacgagaggaatcacccgaggaagccttcctcctcatgagtttggattttcaaagccacgatttaacttttccatctgggataaggatctcaggacatgggcacggggcaggggatgcttgtggagttcagtgcaattgtccattcactgggatgctgaacagtttctgtctggacacagcctgtcttggtcctgggggctgggggtggggaagatgctgtaagaaaaccggttagtcaatgttgtcttaatattgttgacaattctgtaaagttcctttttatgactatttctgtttaagctatttcacctttcattttgaaaccctttccttttatggagaaaatgtgacactgtggaaatgcttgtaagaaagcccctactcccgcttttccttgaaatgacagatctaggtgattacggttgtgaatttttattttcactttgtttttaatgaacatttgtctttcagaataggattgtgtgataatgtttaaatggcaaaaaaacaaaacatgattttgtgcaattaacaaagctactgcaagaaaaaaaaataaaacatttcttggtaccataactgtatcattgtacccaaatgctagggggacctaggtaggagccaactcacctgattctttcccggtggaaccctgggcgggctccatctagccggacaatactggaataacttgatggacggccccgccgaccaatcagtggtggccaaagcccgggtccctgctgaaaaacagggattgaggcgggcggatagaaggcgaggcgtggcctatccgtctagccactcaccagccaggactagaagctacagccagtcgcttgaggcgtagccggcttgagggcggagcttgtgccctatttgccaatcggtcacgggaggaggcgaaaaaggggcgggcgttgcgcgccaagctcctgacta

SEQ ID NO: 23777 - DNA, 2383 bp, Mus musculus; identical to SEQ ID NO: 23776

SEQ ID NO: 23778 - DNA, 1196 bp, Mus musculus
tgttccttcctccatccttggagaagcaagaccaatcagaagctgtctttccttacaggtgattgtatccagagggggacgctttctggaagcaccagtctcagggaatcagcaactgtccaatgatgggatgttggtgatcttagcagccggagacaggggcttgtatgaggactgcagcagctgcttccaggcaatgggaaagacctccttctttttaggtaatatacctacctatacctatctggccatgttgggactaaaggcttgcaggtggggccgctacattggtgacagtgtcagtcccacatggcctcaccaggcttcctaaaagaaggcttcttttgccagacacaattagtacctggaaggaaaaagagccagtcctgtctaggacagatgaaagaggttttccaggtgcatgggtaaaggcaggtagagatgacctgtctgtagaatccttgggacatgacctttgccctgagcaggtgaagttggcaatgcagccaagatgatgctgattgtgaacatggtccaagggagcttcatggccaccattgctgaggggctcacgctggcccaagtgacaggccaatcacagcagacactcttggacatccttaatcagggacaattggccagcatctttctggaccagaagtgccaaagtaagtcacctttgactattcttgcaattttattttcattagagctgagcagctgggtcagaccatccaggaaagagtcctttcatgattcattgtttaaagagccccctttccagtcattccttgccccgttccaaagaggcccagagacacggtgaaaatggtatttgaggccccagagtaggccctgagtcttttggacatgggggaggacagggccgtgcccttaggaaatggtggaggtgagcctgatactcggcgggcaattttcatgtagatcttttaaacttctaatgaatggctttcccttctcagatatcctacaaggaaactttaaacctgacttctacctgaaatacattcagaaggatctccgcctggccattgcattgggtgatgcagtcaaccaccccactcccatggcagctgcagccaatgaggtaacttcacagcaagtggtccaggccctcgatccttgaatttcattgttatttctgtcttgctttcttagctttcttttcttcccac

SEQ ID NO: 23779 - DNA, 2558 bp, Mus musculus
tcaatggcctcctgcctgagaagtgctggtgctcatgcatgacacaggatgctgcaagtagcaatgcacacagctgctgtcgggggacattgctgcttctgtttcctgtgaagtttgtttatgctgtctaaaaggaattggagcacttaaagaatgatctgatttcacttattcttttccagatgcttcacagcttcatggtaaagggcctgttgtaccgaggaaattgtgaccactttggaggatggaactgaatgacataggtctaggaggaagcccaacatgtatgtctctgataacagacatttgctgtgctcttcatgcccactgcttttcttctggagcaggcgtgagtttgaaatggagcacttcttagcacttcagatgggcctccaaccaaggcagcttctgctgctcacaaagcgcttactgacctggtgctctaggcctcatggctttgtcgctggacgacatcaaggggcagctctgtgctgggaagtgtacctagactgtgttgggaagtatagtgtacatgtgtacctgtggcagatctgttggccactgggttctagatctgcctaactcctggcatttggtgtgtctcggagttccctactggtcagggtctcctggccacagtagaatccctggatggttgtgattccgtcccatcctcaggctgtgtactcaagaggacaatacccaggccagagccgcatgtgggggaccttgcaaaatactaagaacacataatgtgtgctccttgtaggggccagtttctcctcagaacatgacaatgaagctcttatagagaaaaagatctttatagattcaacaatcgtggtaggatttttaaagacacctatcttgggctgttttcgtcattaccattgaatgcgttggatagaatgggactgctcttcacacatcacattataggaagacttaattccagtgccttttggtggagcagactttgacaactcacacctatccattcagcccactgaatggatctgagatgaagatctttttttaaagctagtctgtatttaagacagttttatttaattgggttttttaatgactgcacaccataacctgtgccgtcttgacttgaaagtcatctgagcccccaagcccccccaaatcccaggttcccagctctgatttgtttttgtagagttgatgcaggtggactacagtggagcccctcagccctctgtgtctgagagcccaggggttctaagctacaggtagacattccactttgtcttactcttagaaatctctctctggcagagctgtaggacagttctctctgaagcatctgccacagagaacaggtctggggtgctggtgtcctctgcacagcgagcttctgtgtagacttaggagggatgtccagagggtctggagagtagacagaggacagagatagttgactacagagcttccatcatcaggctgtcacacttacccagtggctatttcatatggactcggagggctgtttcctatcctataaatctgcctcgcagtgggtttggctgactgcctagccagaccacatttggggaggtgatcagcactctcggtatgcaccctagggtgggtcaagtgtgcttttggttcctgcctcaagggtatggagctcagtagccctctattcctgtggaggtggccacctttccaccttactgggagcaggacctttgtcagctctttggtctggcctttgctctgactccttttgtatggaagaaccaattgttttcacattggccatgtggactccttatccttttattacatatatttttttgcaacttggatttccagtttgtttacagaatagtcttaggtagtagcaaaaagagccaaagaagagatttgtatagctgagctctaagccaagctgaggccgccagcaaagctgagcagtgggaactctccaggctcctctgcccgtcagacagcgggccctagcaccccacccctttggtgctccctcctccccatgtgccactgcttgtgcagctagagcaggatgccctcatctttaggaatctagtgatgcctcttgcctcagggaaatgtttctttgatggggagtttatgagatttcttttccttgtttatgctttatttgtggtaatgaacgagtgaatgactttaacagccatggccagggagacctatggcccggcttcagcagagggtggaggtagagcaagctcagtgggatgcaagggtttctttggtgggtgcaaggttctgagacttaaccaggcgtggccgtttcttaggtgtgagaggggcttttgtgccgcaactatgttggtgttagggggtggtgtggaaattgttaatcttgtataaagcaactcaataaattgttttgaggtttccaagatgtctttcctcattttttcattactattttatttgcaatattttatttattttattattcttcagtacataggagccctggtgttcatggaatgcccgcccattgtggctgagagccaaggttcaggctcatatgtaaagga

SEQ ID NO: 23780 - DNA, 1209 bp, Mus musculus
ctacagaggcgcctgggctctgtggctgtcaagagagagcagagggagaaccacctgaggcgctccatagtggtcatagaccctgacacaggtcgtgagctgtccccagaggaggctcaccgggctgggcttatcgactggaaaatgtttgtgaagctcagaagccaggagtgcgactgggaggagatatcagtgaaaggtcctaatggggagtcatcagtaattcatgacaggaagtcaggcaagaagttctccattgaggacgctcttcagagtggcaggctaaccgctgctcaatatgaccgctatgtcaacaaggatatgtccattcaggagctggcagtcttggtgtctgggcagaagtaggcccagcccttcttcctggcttttcttggagctggattatcttaaagatggagatggttaactcattctcagcaacttcctgggtgtcttctgctcccgagccttcatatagacttctgagctaagtgttttatccacattgtatcaggctgcttacagtgcagctactgtaataccagcagacactagctgggtagcatctctcagctcagcctcatccagtctgagtgagtgacctgctcccacctctgatgacttaataacctttctgcctctttcaactcaacaagactggtccactggggctgctgaccttccttcttgccattccatttttctgactgggatcaaactatcaacagtgcctgctcagtagtgacttttctcattgaacagggctctacactagaacatgtgtccagaatccacaatgcctggctcttggtgctagaataactagccaggatgtgccagaaagacaggcaccaacaacagtttgctagttctgaaaagatcttagtaatggatggtgtgctagccttactttcagtgccttagaagtcttcatcattatcgcattggcatttagatatacaaaagttgattgttcaccaaacaaatttctgcttctctgtatttcatgtattatgtaagaaaatgggaagtgatagggaactttatggcatgaaaataaaaatctggtggcttgactctaactcacagcaagtatgactcctttacatatgagcctgaaccttggctctcagccacaatgggcgggcattccatgaacaccagggctcctatgtactgaagaataataaaataaataaaatattgcaa

SEQ ID NO: 23781 - DNA, 1205 bp, Mus musculus
gtgcttgctttacatagcgcacaggcaaggaggacctcagctcagtccccagcactcacatcaaaagctgcgcatggcgggacacccccataattacttccactgctgaggagacaggatcacaaggagatcggtgaggcttgccagctggccagcctaattgacaagccccagttcctactaagagatgctgtctgcaaatcaaacagacaaggcagggctcaagagaggctcagtttataaagtgctcacacacaaccataaggactgagttcagatccctagcatccaggcttaaaaaaaaaaactaaaacccagcatggttgcactggtctataaatctgactttggataaagcctacttgctaattggtaagcactgttctcagtgagagacctgtcttagaagacaagaccgtgatctagagagaactgacactgacctctgacctccacatttacactcccaccaactccacctctcccttccactcaaaataaaatagatggctcccaaggaatactgagggtgacctctggtttctcatacatatacccacccatgtttgtgcacatacacacacacacaacccacagactgccagactggtgattgggctccagatggacaccccagggaggtgagccttctcagccgttcgcactgtcccagggcacatccttgacggaagagagctgtagggctgtggttgacccgggcaatcttgatctctgtagaacattaccaatgagctgctacagattgagccagagaagacgcagtgcacagccgagtgtgaagcctttgtgcaggccctcccggccagcggcaccgcacccttgctgaagacccgggtagaagacaccaaccagaaatatgagcgactagtatggttgctagaggcagcccaggagaagtaagtggcagatagacagtcggagggtggtcatggtagggtcaaggggccacctgacccctacacatacaatgttgccctgtgtccttagggtggacgtggccaaccgcctggagaacagtctgcagcggggcagggagctgctggcctcatacgagaacaggctgattcaggacgacacaatgcctgaaagtggtcatgtgttggacagcaagaggcaggagctggaggtaaacttaggatctgagggccatggggtcctttctttgggttcaggacatctgcctc

SEQ ID NO: 23782 - DNA, 1466 bp, Mus musculus
gccagtcattcaccttgccaggggaaaacatacatacccctgcctgccacgtgtccaaagatggaagctgtgctgccctttaaggagggtgggggccaagggagcacccgctgaggggtctatccttataaaactaacgtcctctcatttctgtccttaagtctgggtaagaactgcagtagcatctggcatggatgggaacactagctgtgcacatgcgcacataatctgagttccaataaaactttatttacaaaggcaggtgggcaggacccaacccgtccctgatagacacactaaaggcttccatcttaactgcatctgcaggggtgtgttgaggatgggaggggaaactgagagaatagcaggtggaggctagccattctctagggcagggctgtgggtgagtagatgaatccatcaagtgtcgagtgagcggaggggcaccactggacacgagcaaggaggccggggcctggtgcagggagctgagttccagttttcctgtttccctagatgcttttctcaaagttcccagaccctgctggaaagctaagccagttccggaagaaactgcaggagtcggggcagcaacgctgggatgagagctggcagcacactgtgctccctctgctcgctcactcacagatgacccccaggccccatccaccctgtggccacccttcctgccggggcttttgagtgccccctagtggtcataagcctgaggacagcagtgggcgacagctaggatctggctactgatctggcagctctcttctgttctgagcacttctgttacttccagtgtccctgccaacttctcagtccctgggtttttgtttctggacttgtcacatcccttgcgttctggttctgctgtgagctctgggatagcctgtgttcactgggtttggctgagcaaggctgaactgtctgacaggacagtcatacttaataaatgtatatatttatttgtacaatggaagtgtttgctctgagcctgtgtccactcgagatgagctgctgaggacaggcaccagcactcagcctgtgcttactgtacacttgtgctgttatttaacattcctgctcaacagaagcctttccgctttccgctttcccatgacagtcatttttcttttctcttctttccttttctttcctttttttttttggttttttgagacaggttttctctgtgtagccctggctgtcctggaactcactttgtagaccaggctggccttgaactcagaaatccacctgcctctgcgcgagtgctgggactaaaggcgtgcgccaccatacccggctagtcatctcatttttcaaatcaccttcaaacaccatggcgactggtcagcaccagcttcaggattacgatggctgaatgctcttcgtaagggaacagtttgccagtgtgagggggcacctcttcccagtagattccagcacggtctaga

SEQ ID NO: 23783 - DNA, 1183 bp, Mus musculus
accccataaagccaggcagctgagttagatcatagctgatctctgcttgtgccaactgacagggtaggcaggtgcagagaggcaaggaacccaacaggagaggtggccacagagagatcagtaagcaaaagtgcttacttaccatacgaacaagaagacccaagtttgaaccaccatttaaaacgctgggttgtggctgtaagtacctgtaattctagtgtcgtcaggggcagagacaggattgctggggcttagggaataaaggggaacatgggagcagaacctctgcctctacctttagaccaagcgtgcccacagatacacactcccatagagcatctacccgggcctggaaacctgtggccaagcaaatcagcttgaacacacagcacacctgtgtcaactgccctcctgagatctctgtactcttatctagaccgtgctggaatctactgggaagaggtgccccctcacactggcaaactgttcccttacgaagagcattcagccatcgtaatcctgaagctggtgctgaccagtcgccatggtgtttgaaggtgatttgaaaaatgagatgactagccgggtatggtggcgcacgcctttagtcccagcactcgcgcagaggcaggtggatttctgagttcaaggccagcctggtctacaaagtgagttccaggacagccagggctacacagagaaaacctgtctcaaaaaaccaaaaaaaaaaaggaaagaaaaggaaagaagagaaaagaaaaatgactgtcatgggaaagcggaaagcggaaaggcttctgttgagcaggaatgttaaataacagcacaagtgtacagtaagcacaggctgagtgctggtgcctgtcctcagcagctcatctcgagtggacacaggctcagagcaaacacttccattgtacaaataaatatatacatttattaagtatgactgtcctgtcagacagttcagccttgctcagccaaacccagtgaacacaggctatcccagagctcacagcagaaccagaacgcaagggatgtgacaagtccagaaacaaaaacccagggactgagaagttggcagggacactggaagtaacagaagtgctcagaacagaagagagctgccagatcagtagccagatcctagctgtcgcccactgctgtcctcaggcttatgacc

SEQ ID NO: 23784 - DNA, 1124 bp, Mus musculus
atttccttttccttaagaataatgtgggccttttctcagccacatgcacactgctcgagactctgatgactcttgcctgtctcagtcctgacactggactgtgaagttagcatcatatttcactttcctcacagtgccacacaattattttttgtacactgtgctctgagcacacagttgtagaaccaagcaaattctttcttgggagtatttattacatttatactgagcatgctcagacccttggtttaaaacaattccctcacatttgactggcctttcttcaaagccatctctgctgctgcagctcttaccatattctagtgaatttatttttctgttatttagtttggaccttaaaaaatactgatttcttttctaggaggtgaactgttcttaaataaatcaagttaaatgtgctttaaacaggagctgaggagttggctcagttggtaatacgcatgacctaagttcagttacctagaacccacataaaacaaccagggtatagcaatgcatctctatattcccttccttgggaagaggtgacagtaggatcctggcactttctggccagtcagtctagctgaactgttgaaccccaggttcactgaaatgcttaaatcaaaaagtaaggtgaagagggattgagagacacttgacgttggcctctagtttccacaggcatgtgcactgcacacacaaacacactgatacacacacctgttgtaaggaatactagaatgtatactggactgttagaaatgcacactggccacctgctgcagtcagacatgctttgcttcattttctagacacaagataaaacctagagaagcttgtgtgcttgtcatccagtgggactcagatcatttgattttgaaacgttggcagtcttcaacatggaggaattggtgtttctctgtaagaagagattgtttttacactcttctgaaatattgtttgattcatctagatcaaaagtgaagcttgacatgctaagcggagaaggtgacaggatgtgatccaggaggagctgtcctttgcagaagtgacccttaaattgtgcctttgtccctttctagtgatgtgacctttgtcaagcctcaggaggaccaagagtc

SEQ ID NO: 23785 - DNA, 1206 bp, Mus musculus
tgtggtttgctgtgtagaacagctaacagtaactttctgcgtgagacctgagccaggacaagcctcacttcactcttagacacatcccggaagcaccgtccagagcattcctcctcagtggctactgttcatgatgatagggagccactccgtagtgattccgtgggtccctttgaatagatctctgccaaaggtgcactttctccctaacccccttctttccctagtgttctacgatgatgacttaaccaacgctctgtttaacacactttcccgactggtccacagactgaaaaatgcctgcaccgccatcttctcagtggaaaaaaggtgagctgtgctgccctgcagctgcatccctccctcgatacagtcgtcactgtgcctgtcatacacctactgtgtgctggtgtcatacacctactgtgtgctggtgtcatatatctactgtgtgctgggctgggctctccactcatctccctccctgcagctgcattcctccctcgatgcagtcgtcactgtgcctgtcatacacctactgtgtgctggtgtcatacacctactgtgtgctgggctgggctctccactcatctccctccctgcagctacatcccccaatggatgcaggagtcactgtgcctgtcatacacctactgtgtgctagtgtcatacatctactgtgtgctgggcggggctctccgctcatctccctccctgtagctacatcccccgatggatgcaggagtcactgtgcctgtcatacacctactgtgtgctggtgtcacacatctactgtgtgctgggctgggctctccactcatctccctcccctcacttagtctctttaggcactattgtcaggcttccacacttacacacacacacataccctatcaacacactaacacacacaaatacagaaacacacatgtatgtaacacatgtgaagaaaaaaaaaaggatagacaagtgaagaggttcaattcaaggtaaaaaataattttacagattctggtgtccaaaggtacaaatggcggtgccggagaactctgtgtgtgctccttcccctctcccctccccctccccatacccctttacccctccccttctttcttctgttctctctctctctctctctcatctctcatctctcatctctgcctttgctcccagcatgttctgtgcccccctttgccacaacatctt

SEQ ID NO: 23786 - DNA, 1211 bp, Mus musculus
ttttagtaatttctttcctttaagaatttttcttttaattatttgtgtgtttatcactgtgcatataaggagattggaggacaacttttccaagttgcgttccttttagcatttgggtcttgtgggttaaattcaggttgtcaggcttgacagcaagcccctgcacgcactgagccatcctgctggtcctctctaaagtaagcagagcatgaacacaggtaacagtagactagacgtgccaaagtgtgtgtgtgtggaggggtcccaccacaggcctacacaaagagctacaggcaacatgggaactctgagagcaggagtcttcctcaggggagggcacacccagtgtgaagtgggcgaccctgaaaactggcacatgcaagcacagagtgagccggccgtgtttagaagcatatgcacggacacaacaatattaaggagaaacaggccacgaacttgaaagggcaagggaaggtttggagggaggaaagggaagggggaaggaagtacatgtaattctattgtaatctcaaaaaacccttaaaatgtgcatatcagattataaccattttcaatgtcctggacatgtagcatatccttgcgtttcgtagctgtcgatcgccgctggctagttccagcacttcactctcccagataggatgtaggcacttaggccatagctgtccctgccttcgtcctctccacctctgcctgtttgtaggcatcagttaatctgtctgaatttgttattctgacatccatgaagggaatcatgatatgtttcctcctgtgcttcccagtgctaacttggtggtgttcagagattaatacacttgagtcaatgaaagtgtttgtgggttagttctttgtgacttgactctggggtgcacttgaatgtgaatgtatatgtatgcttaccaactcagcaggtcagtggacatgatgggctatctcctccactcctcgatatgtgaataacactgaagtaaacagtaaacaagtgcttgtttttgtccctgctgaggatagagaaggacataaagaaactaagcttcttaagagcctgtaggtcctagtatcctccgaagccatgcttcagtgacctaacttcagtaggtcccacctaggattctttttagctttgtttttttcctaaggtacttaaaaaatgcatgtatttttatgtatatgggttttttttttctacttgt

SEQ ID NO: 23787 - DNA, 2983 bp, Mus musculus
atgttccggtggaaggcgacgaagtcacctataagatgtgctctatcccacccaagaacgagaagctgcaggctgtagaggtggtcatcacccacctggcaccagggaccaagcatgagacctggtctgggcacgtcatcagcaactagggacctgcaagaaccccttctcctgggcttgagggagactttgggggaaggaggagcagggccatcctggatagaacattctaccatacaagatggggcctcaaggcgggcgtggcccctctcaagcatttcctggagggaaggagttgcgggcaggcaaggggtgctctcagccaccagtgcagcctccagccattgcaacaagctctcactgtctgaaaagcattaaaagcatttgaaaaggagaggcacctgcggaggctgagtggcgagggtgcagtcccagcccaaggcacccgagtaggtcaaacgtgctattttcccaaatgccccctcagatcaagcctgtaaggactattcctcagatctactcggccccctgagggatgtcaccagccctatgaagacttcccatgacccaatgccctggtcggggaagcttcccaggggactttgcctcttggtgcctttgcagcaggtctgtctccaccttcaccttctgggaaagactctaatgcttaggatctctgctgtagcacagtaacctgggactgggcactggcaccactccggagaaggctgggcttttccacttggcctctagggatcaggcggcctccatgtggcattaaaagcctatcattaaagtagtgctgggggtggctgtgggggtggggaagagacctcagcaggaaggcccaagaggggagggtggtgctttatttaaaaacagaatccaggctagtggtgcatgcctgtaatctctgcacttggcaggttgaaacagcattctaggccagcctaggctacaatctgttaaaacaagggctggggatatagctcagtggtgatgagtgctttacttagcccagcgtgtgaaggagtctccgttccactgctagcataaaccctaggatgttgacactgacccactgaagaaaggcagcttcctttctgatggccttgtaaggataggtgttgaaggagaaatcaaaggtatattctctaagacatgcctaaggatcttttcccttcttccccagtgcttggggagcccagagccctggaaatgccaacagcacagagctatgacgaagcctcggcctgctttcttttttggtgtgtgtagagttggggtttggggaagacaggctcctgctgtatagcccaggctggccccaagctcttagcacctttcatgccttggcttcctatttgctggggtcacaggtgtgccttcactccctgatgctttcttttttaatagctcagacttccacagagccctgttttgcccctgcctgcaacactggagagctgtgtttcaaatgaattgatccctagactttttggtggttggctttagttatgattcaaaaatagaagtagttgggaaatgggttttgaaatgtagctgagagctcacgtgtcagaacagggacgcccattctacagtggtgactgccttgagggctgtcccccatcctaaaggtacaaaggttgtggctttcagacatagggtaaagtgtttaaaaatgagttgggtccccagaaaaagctaagatgcagtggtgcacacttaggtagtcccagaactgggcaggctgagccacaatgcctagggttggccatctagccagcctagcttatttggcgagtttgaggtcagagaacctatttttgtctttttaaaaaagtgcctagcacctaagaaacaaacaaaaacgtgttgtcttctggtttctacatgcatgagaacacaaaaaaatatgtggatacacttgttagggtcttgtgcagcggactccagtaccacccagctgaccatctttgttgttgagctgccgatggtcatttttctacttggtcaaacatggccttttccccacaccaggcttggtttactgcccagaggctctcttgaggccaaggaacagaagtctagacccatgcttgccatgacctaggaaggcggctccctgagaccgacaaccttctgataccccattgttcctagtggccaatacagctttgctttcactctggtatggttagactttgggcagcacatggttgacctgctagtgagccctgtcccccactgagctggcagactggcctctgaattcttctgccccacagaaccctttgtaaagggcttttcttgtatggtcacttcagcctgtagacttatcccggaactgcaaggtgttgggaaagacccctgtgatcagagagtgtcaacttatagataaggagggaccccagcatccagtgctggagactgatagactcccaaagctagatgtttgagcccataagccaactctttctcaataaagtttgttttgtgcaagatgaggtgactgtaaaaggttgtgtgtgtagttctgggaggtcagggtgcctgccgctcacatggcagacactcttacagtgtgcttctaactgacaaggtccctttattattccaacaccggaagctgagttctggaacaggcttgttaatgtggtggattatgggcaaatgccctgtggtggtacacgggatataggtaaatgtgagaagggccttgggtttcctgttgcagatgtttgaagggggccttgaggctctccagggaccatgtgggggagatgggagaggaggctacccctcatataggtcctgtggcccagctgccttggagcagaggaacagcaggttgctgatagggtaatgacaacccagggtgggtgactttaccaagggatggggcttttgatgtttctgtgattctcccagtggttggggaaatagccagcccatcaggcctgttccggtaaaggccagg

SEQ ID NO: 23788 - DNA, 1681 bp, Mus musculus
tgagtcttaatggtttgttctttgtccctgccaggtaacatgtctcatcctcggccttggctagggcttgaccacttcaacaaagccccaaagaggagtcgctacacttacctagaaaaggcaattaaaatccacaactgacttccttcccgtgtccaaggcgagggacagtgcgtgggtgtgtgccctttttaacagccgtagacctctggtgcacgtgcactctccccgaagtctccagcaagaggatttgctgctgatgttttattttgttgaggctgttcagtttggcttctctgtatctattgactgccctttttgagcaaaatgaaggtgtttttataaagcttggatgccaatgagagttcttttatggtaaccacaatgcaaggcagccatccgcagcatgggagaagaggttcctagggggtgagtccctggcagaagtccctggttggcgcaggcagcctggccacctgcccaggtcctgccaccagccctgcagctagtcaggctgatgagtaggctcgtccaatttcttccttcagttagactttcagtgatctgtgtgcatctgtaaaggcaaaccagagaaaacagccctagtcaatagtgttctcctcaccatgtccgatgctggcccttcctggggctcctctcctcagctgcctggaggctttttaataaccgtctctctttgtcagctagtactgtagcagcctgttcacgaagtggaagtggatgcactgagtgcggtcctggcagttaggggtcttttatacactgagaacattgtcagatacaattaaggtttactctgttgcccattggcaaatgtaatgatctgagcaggtgaaaagtcactctaggcttctgtgaggacagagtggacgagcgacaaaggagagagccttttagcaagggcgcatgctcgctaatggttagtacgctgttgactttgtaaaaaagataaaataaaaaaggaaaaatggaaaatgaaattgtatatttaatgaatgaaacctgtacaatttgccctgggaggaggccgttttctattgggtgagtgcgagtgaccctggccgacttggacactctgcgtagctttatttgagtcttctccttgtttccctttttgttggagctaatgccagctgcgtgtctagtttggagtgcagatagaaggagcaagccacacttctttcccacccccagtacttctgtttgtttctgtagcagcagtgtacaccaattctcctgtatattgcctttttgctggaaaatgttgtatgttgaataaaattttctataaaaattataatccgatgactgctgtggaagccgagggtgactgctcccctgggagctttgcgttgagccaggctttcagccgccacatgctttctcacctggccttttcctttgggtggcagtttttattttctttttgagacatggttttgccctacaggcctgaagcttgctgtgtagaccaggctgatcttgaacgcacagaggtccacctgcctccgcttcccaagtgttgggtttaaaggtgtgagctcggctcctggcttcccatttggagcttgaggggtaagggtttgtaaggtgtggtggcagttaggaggctgggggaggagcggcaagtcagcctgtgctacgcagacagaccctgaca

SEQ ID NO: 23789 - DNA, 1166 bp, Mus musculus
tgtcccacaccacacgtggttgccctcagtgtaactgctgacctgactgttgtctggtgtgttactccccaccccccaggagtcctttgtgttactgcctgacctcagtcctcatgctgctgtttgttgaatgacacatgctgattttagtgatgtcattgtattagttgttgctctgttgtcactgttccagggctgatgttaccgtgccccccatgcaggtgcattttctgcctggttccttgagtttcacacccactgattgtctatgcccagtcccatgctgccttaattgactaagcttataaatgtttcagggaagtacttgagtccctctcccttttctgccatctttcagcagggaaggtgcactggcctgtgtcactgtagtcagtggatggggaagttgctgttcatactctgctggatgtccttgtcacattgatatgtaatgtcacccaggctgcctgtgcttgtacttgagctttgttgatcatatcgactgacctattctttttgtttctttttaaagtatttgaatcatttgtggattatgtggcagtagaacaactagacggtgacaataaatacgatgctggggagcatggcctgcaggtaacttccttcccgagctgtctccggttctttacccaggcacggatcacactgggctgtgcgcttgcttgtgcttttgagattttgagcccataggcattttctctctttgaatggtctggaggatatttgtttggtgaagaggtgaaatgaaatatagtgaccctcctacctttgtctcctacattaccacttcaggttttttaggggttttttgagacagagttttaccatgtcaccctggctggcctgcaactcctgtctctgcccatcaaacactgggattaaacacggaccccatcacatccagcttcacctgtttgaatggtctgatgaggtgggaggatatttgtttggtgaagaggtgaaatgtttcattgacagaactagcagagtaggtgaaatgtgctgtgagggttgacagtttctgttttgtgcctcaccagaacatttcctgacctttgtatcagaaagtttcttggttattgttttgtttcattttttgatacaaggtttactctgtgtagccttgggtaaactggctttgtaga

SEQ ID NO: 23790 - DNA, 1081 bp, Mus musculus
tgaagtagtactttactgagtgcagagtacaaagacagttgcttcttttgagtaaggttgatcttgtgtattcttatgcgagttgatatttttattttacaggaagtgactgatcctgagaaaggattcatcgatgatgacaaagtcacctttgaagtttttgtacaggcagatgctccccatggagttgcgtaagtttttgtccagttaggttctcctgtactgttctgtgacacacgagaatatgcctaagagatgctaaccgtcttgagtttgcccctatactcaacatcatagttacctactttatacccttaccagtgggttttctaccagccagcactggttttccagtcacagtgttatctataaagaaaccagggccttcatgtgtgtggctgtttgcttttattttgaagactgcacaggtatgaaaacctgtcacaggaaatgtactggggactactgacaggtaggtccctttgtaggtgtgaggctcaactctgggctcttggccaggccctgggactgcagtcactcgtcctctctggtgttgtcagtgttcctttgtcagcatgctagatatgtagccggatcagaagtttgctgggaagaagtagtagttttctgtttagcagtagatttctctctgctgggtggtcacatgggttgaaaatatctgggacacagcttagactaccattttaagtagccattcagcataacaaagagttgctgcccttgaggtttaaaaatgcattctaaaacctgaaaatctacattcctgtcttctgcataaatgtatttctatagatttggtgatggggttgtctgccacgtcttatacacattaggcattcatatttttggggtgtgtgtgtgtgagagagagagagacagacagacagacagagagagagagagagagagagagagagagattgagatcgatcatcgatctgtagtcacatttgatgtaaaaggtagcccccggtgtcttgagtgctgacctttataaatgacagtggtgctgagaactgttaggagactgttaggtgaacgctgaaattgagtgtgagtg

SEQ ID NO: 23791 - DNA, 1109 bp, Mus musculus
aaagcttgctagaaaagcactcttacctagcacagcttatttcaacaacctttaattcctgcaaaactgaaacccctttgtagctgcaatctggattattttaccatatttgaattttagtggaataaaagcagcctaatgtttcacttactaatgtttcaggatgcttgtaatttagaaggatgtttgagagtggtttgttgggttggtattttgacataaattgtgtttaaaggcatttgtgataggatcagactactgccaggtgccattgaagagaattcttttaggatctgacacccccaaacttgtgtatgcatcagactggtcacgttccagatgaccaggatcaactaggaataggtccttgaggattcgtcaaggaagtgaatgatatgctctgcctatttcaacccatagctctcctaggtttatatgtgtgctgtttgttttgagacactgaatccctggctatcctcaaacatatccactgcctcttgggataaaggcatgtgcgaccatgcccagtttatggggtgtgtgtgtgtgtgtgcgcgtgtgcgcgtgtgtgtggtgtgagggagagcttggggggaaagagacagtgagaaacacatgttcatatgctatggtgaatgcatggagctcagaggacaactttgagagttggtccctccttccactgcatttcagaaggagtatgagagttcttgggcaagcactttaaatagggctgagctattgcactgtccacagcccttctgctcagtaacagagagaggtttgcatataaagcagtttttaaagaaatcaacagtatatgtcgagaagttgtattgtgacccttttaaacacaggcagcactgacagaatgcttgagaacttatgacatttgaagggtgatttgatgtcattgaggggaatagatataggtcaaagagattctgaagtacccatttctttttgccttgcagctcttatatgctcattgtttagaaaatttagactaggtaaatcaccaaaacgattctcgctggctcttacaaagcctttgtcatttgaaacctcattgctttgtcacctggctggcacttggggcacaaggcagt

SEQ ID NO: 23792 - DNA, 1189 bp, Mus musculus
gttttttagaagagtaataatactgagccagggaattgctgctcattcctcaagtggaatcctgggcagcaggtgtgtgtgttttcacagtggccggtggtgaatttcacctgcttcatacttgctcggaaccaatttggacttgagaaagttggaagaaggaaggttttcaggcatcgtgtgttggctgtatatgcatggccagcagggagttagatagatgacattgttagccagaagcagacctatggcagaggttgggaattgaagcttctttttttttttttttttttaaagatttatttatttattatatgtaagtacactgtagttgtcttcagatacaccagaagagggcaccagatctcattacgggtggttgtgagccaccatgtggttgctgggatttgaacttcagaccttcggaagagcagtcgggtgcccttacccactgagccatctcaccagcccccgaattgaagcttcttactgcaaagtcgtttacagagtttcttagggcagtatactgcaaggtatagtacacaaggtgatggatactcagaatagactagcaattacccaaacaggacgagaagagggatgaccaggagaagccctatcctgggaacaagagtgcttgcactagaaggaaaggtaggcagcaaggtgtctgttatcagagatgggactgtgtacccagcccacccacttttcctgtgttttctgaatggaattcttatttcttgctcaacccctgaggtgagggtggaggtcactgctgagacagagttgttggtagaggcccagatgtcctgtcaaactcatgctatcaactcacaggtgcttcagatctattggtgtttggaacctgggagccagcgggtgtggtgtcctagtttcaagctgatgggtgggccttcattcttttgggtgactgagaatggaaatttacggaggagagttgtgtgtggtttttaggcttgctgctgactagtaaaacctggtccttcgttctgatcccataccagtgctaagtaaggatccttgacattctcggctgggcaagcagaactgtaggctaggcatcagccccagaatatgctccctgggagggtctgttcctgatgaactgactgttgcttccacggtgctgaatcacatgtgcagggtggtttctcctgtggcgtag

SEQ ID NO: 23793 - DNA, 1134 bp, Mus musculus
ccaggttttctgcagctgagactggtctcgagtaagcttctgctctttctgcctctacctcccaagtgcttggactctcgattaatgaccaactaatcccggtattgatgtcctgtaatagggatatgcaatagaaaactaaatgtatggcaggactgtgtcttcctggtgcctggaaacccttgttcaggaggtcattggtactgccttgaggcaggctccaattggagtgcagtctgggcttgaggatcctgcacgcctgggtgctgggatcacccgctttgcaccaacacacagctgctttattgtagtgttactcctagtgactgaatactactgggtggcggtggcggtggcggggaagacaggtctcaccagacctctagacttaggagggagactatgttcttgctgggttcccacccacattctcctatcaggttttccaggcactatcttaagtgggacccttgttgggactttggctgtagtgtgtgtttgttctctttctttctttgtctctgtctctgtctctgtctgtctctctctctctctctctctctctctctctctcctctctggtttttcaagacagggtttctctatatagccctggctatcctggaactcactctgtagaccaggctggcctcgaactcagcacctggaaggcgctaggattgaaggtgtgtgccaccactgcccgcctggaatagctctccttatggtctgttactgccaagctgtctacctatgggactgttagacctgccctatgaaaaggaagggaagtgactcataataacaccaatcatagctgggcaggtggcacctgttgtcctgtctagcacttgggaggcagaggcagaagaatcacaagttctgagtagttatgggccaagtattgaaatttccatttggtctcccataaaacaccaagcaagacctcaagccatttgcatgtcgtgttcctaaagagcttggcaggtcatctgaggtaaggccctggaaaggaaccagtggatcctttgctgtacctgccttcatccagccctttgcagacctggcttggaaaatgaccatttcaggtgcctctggattttgcgagataagttttttgttttttgttttttt

SEQ ID NO: 23794 - DNA, 1147 bp, Mus musculus
ctggctctgtttgttttgaccttgagtgtcccacactctagaagggccccaaattgacctgtagcctgtgttgatgctgaccctgccgggcagggttgccatttcttttgatgttgtttgttttttgtttgttttgtttgtttgtttgtttgtttgtttttcctagacaaggtttctctgaagccctggctgccctggtactcactctgtagaccaggctggcctcgaactcagaaatccacctgcctctgcaccactacgcccggccagggctgccatttcttagttcccgggacacatgtagctttaggtttgcactcagaattgagtggaatgctaacgaaccttgcttgggctaaggaacaggctgccttgcagctcatttctcgtgttcatggtatagcagtaagcatggtgacatctgaacacgagtgtttcaacctttatcatgtgagtgacaaaactaggccgtttccctgaccagaaccttcagtttgggtccttcatgggctcatctcactctgatcccaccaggctggcagacgccagtttgggctacaaagtgatctttaggcgagccagggcttggcaagacccactcccaagaaaaagaaaaaatacctcccaaattcaccatgcaaggtggcacacacctttgatccccacagggaagcagaggcagttctaggatggcctaggctgctaagagaaaccctgtctcaacaaacaaacaaaaagcaaaacaaaatctcccaaattgacttcatcgaaaggcttgaccctgaccgttggcccaagtcctcattcctttcttgggcatgattaggtctgcttcctctgtggatactggagagaatttttcagagtaggtacaagaacaaggcctgtcaattctatatccactctgatgccttatctgccaggtatcaacatggcttccaggtaggtaaatatttcggttctgtagaaaaaaccccaatccaatgtttatgctgagtcatggcacctgccctctttgcaaaatgtgttttgcccgcagtatgatgatagggcagcccttccctcccctgcacttagcagctctaatgacaaatggacctctcccagtggttcccatctctgagtgttctgcctcttcaggcctcag

SEQ ID NO: 23795 - DNA, 1148 bp, Mus musculus
tgtctgggtgtgaagccactggccccagctcggcgggtggtggacaaggggtagtcctaggcaccaggttctcagccatcggacctggtgctgaaggaaggagagggccgggggagagggaggcgctgggtggttcccacgtgggtaagagaccttggtctggtcagtggctggagcgcaggaaggccttctaacgggaggttagatgcggctggttatgggaaagcctatcccattgttgaagcatagtgggccttgatgagcagagacagtctccgagctttgttgtaggaaggtagggagaaagaaggtagaaagagggaggctgtccatggccgcgtggaggggggtgggggggagggagagagaggagggctagagatgagagtaaggatggtgagagcttaaagagtgaggaggggccaagcagctccttttatagtgggctaggctatcttgctgttgccaggtaactgggggtggagtctagccagaatgccaggagcttgggactttgcctgacttatagacacagaatcatggagttggggactctgtggtgtcaggcacctgactctgggaacgtggctcgcttttccgtctcttgtagagttttctactgggttgccggagcaagcctcattcaaccaaaatagactgcctatcgtggcctccccctcccctcccctcccctcccctctctctctctctctctctctctctctctctctcttctctctgttatttgagactagagagatggctcagtaggaacgcctgcttctttcccagaggacctggatttggtttccagcacccacagcaggtggcttgcatccccaattctaaagaattagaattagagtcttctttgggactttcacacatgtgctgtacataaactcatgtagacacatacttatgtaaaaatgaacacataaatgcctaagaaagatgggtttactttcttctctgtgactgcctgtttgcctgtacacgtgctttttcggtttttgtttgtttgtttttggtttttcgagacagggtttctctgtatagccctggctgtcttggaactcactttgaagaccagagcatgttggatcccttggaactggagttgtagagggctctgagccagaactgaa

SEQ ID NO: 23796 - DNA, 1193 bp, Mus musculus
agacaccagaagaggaaatcaggttttgttacagatagtggtgagccaccatgtcgttgctgggatttgaattcaggacctctggaagagcagtccgtgctctttactgctgagccatctttgcagcccaagtcattgcctcctatcgttcatttattatcaatgagaaggctggggtgcgggctttggtggctcgcgcctttaatcccagcagagggattgggaggcagaggcaggcggatttctgagtttgaggacagcctggtctacacacaaaaatcctgtcgaggtttcaaatccccagtctagaggtcgaggtgcctatttaacatatcaaagccgacctggctaccggttctcccagcatccctcaggccctactgttacagggtatgactagcatcccctgctcgctattctaaacttttacagaccagaggctgggctgctcttccctatatgatccagccattttggttacctggtctcttcatctaccttttacgatactggcctattggtcggattcttctctgtcccctccccctgtcttcacatggcctggttcagtctagtcgcgttccctctggactctcccagatgcctctatctgtgttctccttctgtctacaataagctacctcctccccttcctcctcctccaccatacccgagaacaatatgtgccctatttatttttttcattcagtagctaaaagatggctcagttcggggctggagaaatggctcagggattatgaatgctggtgacgactcttccagagaaccatggttcaattcacagcacctactcagcaactcataactgtaacagttgttccaagggatctgatacccttacatagacatatatgcaggcagaccaccaatgaacataaaataaaaacaaaaaagatgggtcggtggttaagagcacttgctatcttacagtggatcctggttcaattcccaggacccacatgtggctcacaactgatggtgactccagttccagttccaggggatctgttgccctcttatgccctcctcaggcccaagacatgcagcaggtgctgcagggacacacacatataaaaacaaaatcaatcatcctttaatcccaacacatggaggcagagactggtttggggccagcctgggctacaaagtgagttccaggactgccagaggta

SEQ ID NO: 23797 - DNA, 1099 bp, Mus musculus
tgttgtttttgtttttcgagacagggtttctctgtgtagccctggctgtcctggaactcactttgtagaccaggttggccttgaacacagaaatcttcctgcctctgcctcccgagtgctgggattaaaggtgtgtgtcacctatagatgcacaattcactagcaaccaaaaagggacagttgtgatgccctagtagatgcttagagaggccggacttctggaagcggggagccacaggcccacaggaagttttttttatagtagcatcttttgttctgcatttcccgtgctctggggagtctactcatttttagatttctttttctttttctttttttttttcttgaaggtgctgagaaatgaacctaggatcccgttcatgctaagtaagtgcttgtaaaggtttgaatatgcttggccttcaggaagtggtactatgaggaggtgtggccttgttggaggaagtgcgtcactatgtaggcggactttgaggctccgcccagtagggatagaaggtattcctggctgtcctcagaccaggatttcgaactcttcctgcaccgtgtcttcctggacgctgtgatgcatcacgtcgtgacgatagtggacctctgaaactgtaagtcagccccatttaaatgttttttataagagttgccttgttcctggcgtctcgtcacggcaatgcaaccctaacccagaccgtgctctaccactgagtaacatcccagccccttaaaaaaaaaaaaaaaagtctcgccggtcggatgtggtggcgcacgcccttaatcccagcactcaggaggcagaggcagaggcagaggcagaggcaggcagatttctgagttcgaggccagcttggtctacagagttccaggacaaccaggggaacacagagaaaccctgtctcgaaaatcaaaaaacaaacaaaaaaagaaaaacgtctcattttgtttttgtccttttgtttttgtttttgttttgttttgttttggtacagggtctagtgtccattcctaacctcaaacttgatatgtagctaacaaaggccttggatttctgatcctcctgcctctacctcctgagtgttgggactat

SEQ ID NO: 23798 - DNA, 1212 bp, Mus musculus
taagtgataaagtagattatttggggtctttctggctctaaaaattgttctcctgcccacagggagtctatttctattgattgtatttttttcccctcctgggcttggatgggtgggaaattgctaaagcaatttcagaaaaattttcagaaaatatttaaattttatgtttgggtttcttttatcagtgaatctgggttaagtgtattcgaaggtatatgcttcgtggccagttttatgtacccttagcttactgtggtaggaagagcatagctatgtgtaggccacaatatcctgtgtaaccttgggcaatctgcttaagatctctaataccatctttgtaaaagtgatctcctttatatgagaaccaactagattgcttacctatccctctaatgatcctgtgtaaatgttcttgcttctgacagccacagctttttttccctttactgtagtaaattatagctatcactccatagggttaatcttgcctacatgtatggttatatatcatttgtgtgcattgcctgtggaggctagaaggcggctttggatttcatggaacttgagtaacagatggttgttagctactgtgtgggtgctggaaatcaatagaagccagtggttttaacctttgagctatctctctagcctctgctgtgtgtgtctcccccgtttattactaaatcttgagcttagttcctgtgaacaagctggagaagttggttctgagttgccctgttgaaactagtgctatttggagagccttagtctgaagccttcagggagtcatcatggagataggtgcaagggtgcatagtaggaaggcaggcacattccagagagagggaaggtttgttaactaaaactttactcatctgaaaactatttaagcttcattctcctaaaacagttggttgctaactctggtccacactgactcttaaaacgtaaagatgcttttattccagaaattatcttgatgacattcttgacttttatgctagacttaaacccattgggcttaaatcgttttaaaagtattgccattttagttagatttattgtcactgatgagaattattgctcttggcatttcaatttaagataccgtgttctcaatcttattttttgtgtgtgttgaaagtcagtgagctttgggagaaggatttgggcaaagtcaagacagtggaggctttttgtcacacttga

SEQ ID NO: 23799 - DNA, 2235 bp, Mus musculus
ttatttttattttttggtccatttcctgctgtattgagtatttttacttaaacagtattgccaggttcctacaattgtctaaaaccttgatctggcttgcaagccagatcttcaggcttccatttttgcagccacactgaaccacacatctggtttccatagtgatagtgtgtaatttctgattatcagattatgcccagttttcagttttcaaaacagttttcaaaactctggtgattgtgagatgtaaagaggtgctatggtggtcatgcaagtaatacgtaatatgaatcaatacacagaactctatcggattcactttgtgtgtgttagtgctctgaaaatagcaatattaaactgtccccagaataaccctgtaggcttcaactcagttttaagacaagtactacttcctatgccaggtacttaacttatggttaaacacagactgcattcaaagtgacctgaaaaacaggtcatgatctttgagagtgggcttcctttttggtttggtagtagtgagaggaaatggacggtgggagtagatatttattgtttaggttttttttgttgttgttgttggttttttttttttttgtttttttgtttttgcatttttatggatgccctactgtgtgtagttgtcatagtaggtggaagatgataaatatgttttatctgctactaatgtgaaagtaacttaaatagcaaaacccagcttttcctgtccctccatttctctcagaaatgcagtttggactttccttctggaaatgatgagatcgcatggaggttttctagatgttaggtagacccaaataaaagctctcagagtcctctttgggtaaatataagacctcttgtagctacaaccttttagagcatgtttcatctgcatttttactactttgaactgaatggtagtcttttttagaagactgatgtcagcctgccaggtactgtaattcattctatcctattatattatatatcaagtaggacagtgaaaaatgtttccttgcagacttgtagtccagtttcagtttcttctatttttatccttaataaccactgcaaatcagtgtaagggtttttctggtaattacagcactttgttaaaagtttgcaattttgtcagccattaataatacctttctgtgaagaaaccttactaagttaaccattactggctgagtgggatgtgaatggaatgttagaaatgttgtgtgaattgaagttctgtattcattatagatatagcccttatttaaaacagtgaagtccatattcagactaggaatgaaagtaaggtatttctcagtttgtgcaaaagtggagctttactttgtttatttgaaaagcaggaaaaattatagcaatctgtcattttaccttaaatggacaagcctgggcatcacaagtacttccaggcttccctgggatataccaagacatggagttcaattttgcttttctgtggttgtgagtatagatgctggaattggggtttgacggtgtgatggctgctgacaagaagccagaactcccattcctgagggacttgagactgaggaccacgtttcatctcccttcatgccgtgttctgtctcctctgtccaagttgactaaggatgttcttggttgtttggtttcagttggtgctctgaagctgaatctcagtgccctttactcgcagttgtcaaattttgataaaacgtgccattttctttggtaagagaaagcaggtctaatgtctgccagaacacaatttatatgccgaattattggctccattaaactttttaaaaactttagcactggttacttttttccattgcattcaatatgtagcacctcctcacctcatgagtagcgcttccttccctactgccgctcctgtcccttcctccctggcctgccagagtagaagaactgagaccggcccatcagtacaaagggaggtggtttttaatcttagcgtgagttagtctgatgaagttcagaatcttttggaagtttttattagttaagatgcagaacatcaaagatgaccacatactagtgtagtattaggcactgactttgacttttttactttctttttttttttttggacaggtctttttgtgtagttcatgctgacttctagcattcgatcctcctgtttcagttgcctaagtgctatggtttactggcatggtgcttgcttggccttttcagccgatcaagaacaga

SEQ ID NO: 23800 - DNA, 1112 bp, Mus musculus
cctttatccctgtagacagtttggggcctgcttccatggtcatgtgcatgtgcgtgagtgagtgtatgcgtgcgtgagtgtgtgcgtgcgtgagtgtgtgcgtgcgtatatgtgtatgtatgatttcctgtatccacatagaattcagaaactacaaatgaggaaaccatatttatttgttttttttttttaaggctgggttaactaatttaacatgaatgagtctgagttgtatccattttcctaaaaataatacaactttcttctttatggcagctaagaagttccatgcaatgggagattgcaagcttattagtttctggagacataatgtcctctgcaggctgatggttttaatgcctgctccccaggagatgaggctgttctgggatactctggaaactttaggtgggaggacctctctggagtatgcaggtcactctggcctctctgcttcctggtcagctgcaatgtctagaattctccaccatactcttcccactatgttctcctccatgtctgcctggctgtgatgggttgaaactctctgaagccatgagccaaagtgattctctcagcctgaaatttgtttccattgggtgtttgggtcagagtcagacaatgtgaatggagctaaggcaactgcactctgatgagtccaggaggaggtgagcaaggcatgtgctgcaggggtcggagggagcgcagatgagcatgggacatcactgtcgacagctgagtgtaacagaaggacaaacgtagctcttgtacttagttccctgtatctcagagtatgcattttatcagtgtcttcttggcatgataacaattactataaacctagtgttctgaaggtcagaaaggtctcactggataacatcaaaggggcctgagggatgagttctttctgagactctactggcagaagggtgactttggtttttctaggttctaaggcacctgatatcccactccctccagcagccctttgtcttctcccttctgtgtcccctttccaccctaaggacggcattgcaatggacctagccaatattcaaggttgtctccccacttcagattttacccaaattccacctgaaaagccctctttc

SEQ ID NO: 23801 - DNA, 1183 bp, Mus musculus
attctgtgttctttgctcatcaaattggatggatcttgcgatctctccaatgtcgaatgtggctgttgtgtgctgttctcacttgcttgggctaagatgtctcaaggaccagtttcatcctgcactagaaatgcttattagctaggatgagtgggacacagaagagatacccacttaaagcagtttagtcaatagcaatttatttctaaactaacataattcaataggaagtgcgtctgaaattgcttctagtggtcagctgtctgtcatttctttagggaggcttcctctcatggagccaagatggccccttccacaccgtcatccggttcctcatgccagtgtctaaagtaggtaatggtgtgtgaatcgctgatggctagatagccagtaaggtctggggccttcactgctggtcatcagcatagggcctgatgtttgaccccttctaatctggagctgcacactctgggacatcattgtctcagaaactctgagtggtttgtccacagactacttggggctcagtgagtgttccctgaaccccatcagctgtgcttctcctactgctctctagagtgtagttttcagttaaggagcctgccattttggacagtgttttctgtagggggttataccaagtgctgcaaagcattcaccagcttgctaggctctgtgcggtggataacagttgtgtctcctcaattgtgtcaatataacatgcccacagacatagcccagggttcagacacaactcaaatccctgtgattagagccatcgctctgtgactctccaggttctctctgggttcagtatgaagccagtaagccctgagctttcagcattctgtgctctgagctctccccttcttcactggttcaggtgagcaatatgaaggtgggcaagtctctggtatttacttgcctctcattctcagatgttgttgatttaagcagaaccagtctcatgtgagggacaccaacctggaacgttgttggggttaactctcttccccagtctatactggccttgcgccaacacagaaaactcattatgcacttctacagggacctgctggaggtgccagccaccttgttaattggctctcaacacaagtggaattggaaagaaccttatgtatgttaaaaggtaaaactagctttggtatgaagtagtgaaatt

SEQ ID NO: 23802 - DNA, 1145 bp, Mus musculus
ctggagaggatgtagagaaaaaggaacactcctccattgctggtgggattgcagagtggtacaaccactctggaaataaatctggaggttcctcagaaaattggaaatagatctacctgaagacccagctctaccactctgggcatatacccaacttgtaataaggacacatgcttcactatgctcatatcagccttatttataatagccagaagctggaaagaacccagatgtccctcaacagaggaatggatacataaaatatggtacatttatacaatggaatactactcagctattaagaacaatgaattcatgaaatcttaggcaaatggatggaactagaaaatatcatcctgtgtgaggtaatgcaatcacaaaagaacacacatggtatacactcactgacaagtggatattatcccagaaacttggaatacccaagatacaattacagatcaaataaaactcaaggagaaggaagaccagagtatggatacttcagtccttcttagaaaggagaacaaaatacccaagggaggagatacagagacaaagtgtggagcagagactgaaggaaggaccatccagagattgtcccacctggggatccatccaatatacagtcaccaaacccagacactatagtagatgtcaataagtgcttgctgacaggattctatattgctgtctcctgagaggctctgccagtgcctaacaaatgcagaggtggatgctatcagccaaccattggactgagcacaaggttcacaatggaggatctaaagaaaggactgaaggagctgaaggagtttgcagccccattggaggaacaatatgaaccaaccagtaaccccagagctcccagggactaaaccaccaatcaaagagtacacatggagggacccatggctccagctgcatatggagcagaggatgacatctttggacatcagtgggaggagagatccttggtcctgaaaaggctcgatttcccagtgtaagggaatgccaagatagggaagtgggagtgggtggattggtgagcagggaaatgggtgatgagataggggggttttggaggggaaaccaggaaaagcgataacatttgaaatgtaaataaagaaaatatataatttttaaaa

SEQ ID NO: 23803 - DNA, 1145 bp, Mus musculus
agtgttattaaaggttaatgtggaagtagtggagttttctctcttgcataagcctgcaaagagaactttgaaatcatgttgtgctcagcctgggtcagccatagctatataaatgatccaccatgcttttgggtatgtaatattatgctttccagtccatacctaagaatttttatgcataagataaaaaggataggagcatgaagtaagaaggagcagatttggggatcagctagactctggctcagagctgtttagattactgacaagtcagtgtctttagctaattacaaagttctctagatttaaggcatagacactcaacattccagggaggcagtgggatttacagaggacacccttgaaactcaaagcctcccgccacaagtgaactagataactcatcgtgaacatttccttcctccagaccttggagaagcatcggcaccagaggagtgaggagaaacacgcaggctgtgaagattttcttctgtcgttgtccctgctattctttacaaaatgctgcagaactcctgaagctcttgagtgcatgcccgtccccacgtgcatcccacagtggtgatttctccatcatttaagactgagctctaccatgtcctcccaaaagtctgaatgctgcaccctgtctatcaaggtgactttactttttttgtgtgtgtgtgtatgtgtgtgtgtgtgtgtgtgctagaggtcaggctcagatgtgtttccataggtaccattcaccttggttgacttcaaaacaggacctctttgttgaccagcggatggccatcccgacccagggatccagccaccctgcttccccaacagtgggattgcaagagcatgccaccacgcctgccttttagagcgagaattctggggactaaactcaggtccctgtacttgggagacaagttctttgtggacagagccacctctgcaggcccacattcttttggtttccactaaatcgacacacctattttcttgtttattgtcatttagtattgtatttgtttgtatattttttccactccaacattagaaagtgttcatccagagtagagatttcggtctgttaacctgaatccatagcctgttgtgagtaattagtgttgtaagacatagtttgagtcaat

SEQ ID NO: 23804 - DNA, 1193 bp, Mus musculus
tactcttcctgctactcttcctgccactcttcctgctactcttcctgccactcttcctgctactcttcctgccactcttcctgctactcttcctgctactcttcctgcctcttcattgtggcagctactgtagaatctattctctttatcttatagtctgccaagccaagaaacagaagaaaagacgagtcagaatgtacttcaaccctctatgccacatggctcctgctgaatttcacccttttaaatgacttgatgtgagaacagaaagggcagactgctggtgggactccttataggatttggtggtaacctgatcccatcaagcaaagggtaatagcaaaagttattctgagctgtgctctctagcttcctgcttgctatgccttatgttatttctaagcttttgattgtgttatgctacctgcgtgcattatactgactgaccttctctgtgcatgtttgtgggattatctcaggcatgactgtcttgaaacacattatctctgaactcccctccccgccacacactgcaggatcatgtatcgaccctctgtgatgaccacatcagcaatcttgtaatttcctattttctctttcaccagccattagaacacttactagaacaatttgtgaggcacagaggcctacagatatatttgttgtagacactaaccttctgatttccttgtgttcggcttatatttattttccttttccttaatttcctcatcccaattaatctgttactgttttaattcccttttttttgttggaaaagagaaacattagacagctgagcattttaacaatcacaatgtatataattgacagtctgtggtggtttatcttcgttatcaatttgattagattgaggaatgatcaggcaattagtgaaagcacatctctgtgtgtgcctgtgtgtgtgtgtgtgtgtgtgtgtgtgtgtgtgtgtgaatgttccagagacaattgaatcatgagtgctctaacctaataaatagttttatccatcaatgaactgaaagtttcaatagactcttgggaggtggtgaaattgtggaaacaggacctggttgaagcaagtgggcaagtgttttgtgttgtgagctgtatcttgtctaatagaagaaattaagccactaggggtctatccttagaacactcttttaccctggcctctttctgtatgc

SEQ ID NO: 23805 - DNA, 1164 bp, Mus musculus
agaatatatttctgccaatttcttgatacctgaagaaaattacttagtacaaccctttttctgattatcaaaatctttgcctgactgaattgactgattggaaagcttctttccctccctactccctgtgttttgtttttgttaggctgggtctcatagcacaggatgaccttgaggactatatgttcatttattggatggattcttagtggagttttgtgtgtgtgtatgatcaccatttctggatcaactgttgtgggtgcttcacttgcttgttctttgattgcctcttttgttttcttgtttttaatgactagaagtttttgcccatctctttcactcagtgtgtgcctgtctgacttggttcttcaccatggcttctcacaagaccttcaggatcaagcgattcctggccaagaaacaaaagcaaaatcgtcccattccacaatggattcagatgaaaactggcaataaaatcatgtacaactccaagcggagacattggagacgaaccaaattgggtctataaggaaccacacgtacttatgctgtaacttactgtagcgtttacagcgttaccgctgtctggacagctgagtgtgtttcttaggaatataagttttctttctgtgctttagtgagttcattcagcagttcagtaataaatatgtgaaaccttttgtttcgaaaaaaattgcttctgtgttacaacttactttgttttatggttcaggatcatctgcataatagacaagtattctatcagtgagcgatatcctggatcttgtttgtgtagtttggggttgagacaagtccagactgccctaaaactcacgatcttccttcctcggccttctaaatgattggaggactccaaacctaagtgatggaagtaaaaagaaacttatatgtcaagactcattttctctatcatttcatgtgacaattgaaattagattatttcttttttcaatcaataattgctctctggtcctttatctgtgtcttatttaacaaatgttaaaaagcagcttttgcctcaggaagcagtggcaggtggatctccgtgactttgtggatagcctggcctacaaagctagttcctagactgtttgtctccaaaataagtgacaccaactctcttggcacattgctgacttctct

SEQ ID NO: 23806 - DNA, 1108 bp, Mus musculus
gaaagaatagagacagagaaggagtttctgcattcttgggatcacaaaccagaccatgaaagctggcattcagaatgcctgcctaccaaaagtctcagcaaggcccagcaagctccacaggatgcttttcaagggtggctctgtggtgtgggtacggccaaaggtggggaaagccagtctttgggagcagactctttgtaggagtctgcccttccctcttcccctgcccactccactctgacagccacaggtggaatgatgagggcccaaatgtgggacatctatgctcagatattaaacctaagctcacgtaagaagtgggcaaagactggccctggtttgtctgtaagagacccagagtttcccaacccccctgccatgagctaggtcatcacactaatttgttgatgtttgctcctgtttgccttaaggatagtgacccttgcctgacgcagatgtcatgtttaggcattaagtgtccataggtcattccgtagggcatctagtacacgtcggttcacaaatctacttccaagaccctcagaatccttcattaaagggctgggcctgggtgtctgaatttctgatgagctccctgcaatatggttaaatgcactataactggaggtcagagccttagaaccggggggagcagagccaccttgtaaatgttatcaggctaatcacaatgagatggccccactgctagctacgtctcagcctccatcagctcttgctgcctcttccacagctgcttacatctgggacacttgtgccccattcccaggccatacaagcctggaaggtgggctggacagcctcctccctgacctacatgggaaggtctctccttttcttcccgcccttttttctaatgtggatgcttccattaatcctctgtttctggagccttggaagatctgtcttccattcattcatccacccatccatcattcaacatgaatgggtcatgtcacgtgttgggtgcaagggatactctttcaaaacaatccctcacgagactcacagtctagtgaagagcacacgccagaaaccaattagagaagctaccaaccacgatggaacatcagggattcaaaacctcggg

SEQ ID NO: 23807 - DNA, 2239 bp, Mus musculus
tcagtcacatgctgagaccctcatcagtccctgaagtggaacaggaccgagtgccacctgctaaccccagagttggcaggccacgtgtccagacacctgggcaatgggggacaggtggtaccatagccaccagatgctgacaggatttgaagtcactcattaagacactgtaatcacctatctgcctatttcctcgagatcaaaggtacgggcgctctgcatccaggtgccattcatcagaaaataaaaatgtctccttgaacctatcccttagggcctgcttcctggaatccaagggactaggaactctctgagtcacaggactcccaggaactgtttctgcctcatgtgataagcctagggagacacagaggggggatgacactgcctgtgcccacactggggtctccagctctgggaggtctccagtcatgctgggatcggtgtgggtgctttggctgggggccatcagagcccctggcaaagcctgtaagtcacccatgaggtgacggtgccttcaagacatccggtattgcccagggtcccaggcaaaccatcacctggcacgtctgaggcacagatgtaattgtcctcgtgatccgggactaagacgtagaactgagagctgctgagggaattcattccagatttccactgtactgtggtgtgacactggaatatgggcagccccctcccctatcctctccttcccctgtacacgtaaactcttggagtgtactggggtccctgtagggcagatgtgacctttccaaagctcgatgggtcccgagcaggccctaaatatcggggttctagcttggacttgttctgggtcaacttggaggactgggaaaggccacctaggcctggagcacaggtcaggagctgctttcccacaggtgctcaggcctctggcctgcacgtgctgctcacctagtgccggtggatgtccagcccttccagcctgggcttctcgaagtcacctgggaagtcctgcaaggcaagagaagccatgactgtcccaacaaagagcagactcactggggagacccacagccacaagtagccaaaaagaatcctccatccctcatttctgacaacttgacaattggcaattattaagacaattatccaagaaatatttcctagcttcaaaacaaaaacaaggctttgtcattctttcctcaattctgtggtgtgtgtgttcgtccatgtgcatgtatgtgcaggcatgtgcatcccatgatgtacctgtgggggacagaggacaactttgggggccttatttctctctttccaccttgtttttgaggcaggatctctcatctgtctctgtactgtatactccaagcttgttggcccaagaacttctctatctgccttcccatccagaatgctgggattagagatgcttgccccacacctggcttgtgtgcattcttgggatagaattcaggttgtcaggtttacacatccagtgcttttacacactgagccctctccctggccagttgtaggttttgctttaattacttgattttatgtgtatgttgcctgcatgaatgtatatgtgtagtgtgtgatgactgtggaagtcagaagagggtgtcggaatcctctggaactggagttacagataggtggctgagctgctgtatgggtgctgggaaaccgatctgggtcctctgcgggagcagcaaggtttcataattttagccccagtcttaaatatcacttaaaactaaacagtagtcacaaaatgtcagacactttgttgataggagctgtcaatttgttacagacagaatggtgggtgccatggggctagggacaaatagggagctagtgtctaaaggactgtgctcgggctggagagatggctcagtggttaagagcactgactgctcttccagaggtcctgagttcaattcctaggaaccacatggtggctcataaccatctataatggaatctgatgacctcttctggtgtgtctaaaaacagctgtggtgtactcatatacttaaaataaataaatacatctaaaaagaaaaaaaaaaaaaaggactgtgctcttgttgggaatgagaaggttctggggcatctgtgaaaggctgtccctagaactaattgacctggtgtgtgtgtgtgtgtgtgtgtgtgtgtgtgtgtgtgtgtgtgtgttttaacttgtttgtttaactaaaacagggtctcactaagtagccctccctgggct

SEQ ID NO: 23808 - DNA, 1202 bp, Mus musculus
agaggcgagagatgagagttggactctcattgagtctagccagacctaaagcctacatgcatgctactgtcctgtcttgtgctcacatttactggataggactggcacacaaactggggattactgtctcccagccccactcagttggagtggcaaggaagttgtagcccctcctgaagtgctgactcaggcagcactcctcaccttcctggctatttgctggctgtggactgggcaagctagcagtcaggagatcaaaggtcaaagtcaaaggtcatgagtcaaaggtcatatgagccttgaggacaggtcctggcaaatggcaggtgcccagtgaagtgacccaggcttcaacctgttggggacagaagcaggctctcccctgaaatatcatcttcctatgacatctccaggccatggtgcttcaaggcctgttctgtctctcttcctttccatttaacctagagtcaccatgcaatgccttcatgcagggcacctaaaaaacacctttaaaactccactctcctctgctttctgctctatccaggccatccgggtattcttcatgctgcgttccctgtcactgcagctgcgaggggaacctgagacccagttgccactgactcgggaggaggacctgatcaaaacagatgatgtcttggatctgagtgagttggccatcctgtctcgcactagtgggccaggggatacaggctttgctctgtcatttgacctgctgtgctgtgggagtgtgtgcagcatgcattctgcactgccgctgacccaggaccgagcagaagggcagtgctgggcagcagaaggtccagtgagagtgggccgcactgacatgagaacagcactggcctttctggtgttgtggattaaagagtttctaagtccagtggaaaaaagattctcttgatgccaaaaggaagcctataaaaaatacattatcaaaatgaaaaggcacaacaaacccagaagcacatcaccagtatttaggtaagaatgagggctttgcaaatcagaaaagcctgtgcccagcctataaccttgaactatgtattgaccattgtcttagagagtgtttctattgctgtgataaaaaaatcataaccaaaaccagcttaggtttatttagcttacacttccacatcacagtctgtcatcaaaagaagtcaggaaggcaggaactgaaactg

SEQ ID NO: 23809 - DNA, 1103 bp, Mus musculus
ctttcttctggggaggtgtgaggaagcacaaagtcacattttccatgacttgtttcttctttgaacccttgctaatctttttttttttttaagtgggtaaatctttgaaatgacactgtttcaagtttgggatctttgctgtaagtggcaggaaaggtgggcggtaatgttatggaaggtggaaagcctgccttttctaggtcatgtttcaagtacggagaagtcagacaggaaaggtcacacaagaaacaagacaggggctagagctgagctagcatgcttagagccccgagctccatcccctgctccacttaagccaagcatgtcagcaatccctgtaagcccagtacactgagaggcgaaggcaggaacgtcagttcaaggtcatcctctgggatgccggaagttcaaggccagccttggctccaggagatcctgtctcagaaatggtgttagggatcaagcttttaaggctttaaccccagactagccacatggtgcatgtcctgtctctaactccaggccctagactctctgatgagtccagcttggcacttctgtccaggccaacttgttccactcagatagcccagctgtgtgcagggcataggctgtccaagggaggcaagctgagcaattggctcagctcacagctctgccacagctttctgggccactgaaaaaaagagaagagctacaaacaggttagtggtgtggccatcaccagagctttgctatgggagtcactcacacagataccctggacatactttatcctcccaggaaaaccaagctaggtagttcctcccctcctccctcctcccccccccccctcaccatgtcacagctggccacacgccctcaccatgtcacagctggcttgtcttctctcagaccctagaccaagaaggacactgtcctatgggagaaatcagggccactggcacttttccaaatgaaagtagtcatcaattcactgtagaaaacaagaagaaagagagcagtactttttaaagagatatgtgtaaccatgccacaacctaaaagctcccagcagcttgcctccccttggtgcttgctgttctctaacctccattgttccc

SEQ ID NO: 23810 - DNA, 1967 bp, Mus musculus
gtccgctcaggtcacatgggtgagaaggccaagcctctgctctcgcgtgacctggatgacgtctgttccctgctcaggacaccacacagacgctgctccgagcaggcacgctcccttctctcttcatccaagaaagacccattagccagtgtccgtgacagaaatcaaaggatttaaggcacagaaagtcatcctcagatataatctgcttcccaagatgcaagtggatgcccaactggggcccagctgcaaaacaggtgaccaaaagcagaatcccaccctccccctccctcctccccctccctcctccccctccctcctgccccaccctttgctgcttccacgcagtatgaaaaccccatagttgtaggcatgtgccagcaaggaacagatctgtgccatcagcccctccctcctctgaactggccagccaggtcactactccaggctccgtggcgaggccctctatggcttcctacagatctggcctcacccagtttcagtacccaccaaaggcgagccacaagggtaccccatacattaccatctgctcatcattagaccctgacactctgctaagctaacttccctgcaggccccaatgctcagttttccaagagaaagcagtgctccctaggaaggtagtggaacccatgtggactggcttctctggtctttaaaagtgctccagtgggcatgctgtcaaagacaagatgttttctaaaacagaaggctgggtcaggaagtcaaccaatcttccttagaggcagccactccaaaggccctggcaaagtaggatgttctaggatgcttagcccctgggaagagaggaaagtgatggccactgggaacaagagctctgtggaccccacagccaaccttgggtgttttttgctcatttgcagggaggggtagacaaagaagcaggctagccctgtcttcagcacaactgtacactttgggttttgaaatgacaattgctagggtcagcataaatgttacacaattcaagtgactctctaccatgcagtgtggtctccagagaaaagcctacagccaccctaacccacataaacaggtcagccctatccttctgtgactagcctcctctttgcaatccggaaattttaaggaagggaaaagattgtgcccatggtgttcagcaaaccctgaaagggcaactgctgtgtaaaattcaccaacaataagcctgttcccacagctggctttaaggttgctcccagagggttcctgcaaccaggagcctagggcatacctccaagtgagcaaatgtggacttcctgtgagcagaactgtggcccattgctgatggagggatggggtcctggaggaagcaacaggacctcaggactctgaagaaggacactgtctcacctaggtgttggtggcattgggtacaacccagtcttcaggagtactctgctaacttggcaactgtgctctccagacagacctaaccagcaagaacctactgggtctctgtagaactgagggatctaaggtccagtaggtcccacagctcctgacctggaggtcccagagtcagcctccaaaatcattgctcccatctcccaggccatgcatgccacgtctgccctggtctccctcccttcttcaactgccccagggcagactagcagagctggcctctaacccatcacctcagctttgaccgtcaccatggcaacatgcagtgctgcctcctccctgttgaagtcttaggcaggtgggacacttcccacaggtcagactcagtgtggtggtgagcgccctctatggtggaagtggtgaagaggcttcacctgctactctacccaccaaacacttgcattggcaggagtaggctggctgcatcctaaggatggcattggctttctctgtggcctctgacgtgcagttgtaaataaggcatgggtaaaccaagtctgatcttttgtagatgcaat

SEQ ID NO: 23811 - DNA, 1184 bp, Mus musculus
tcaggtgatctagacctgcctccttcctgccctccaccccctagaaaaagcatcgaggccttgagcccagtttgtagctcaggccaacctcagatttcccatcttcctgcctctggttaactgggattgcaggcctgctcctccagcctgcttacatggacgccttaaaaaaaagattttatctttagttatgtgttcgtggggtgctttggagcccaagagagagtgttgataaataaactttaccagccccatgccaggtagctcacagcttcagtaactccctgtagttcctaggcatctgacgccgccttctggcccctggaaaaccctcacaacctagcatatagacttcaaataaatacttaaaaaaaaataagtcctaaaaaataaagagagccaggtggtggtagcgcacgcctttaatcccagggaggcagaagcaggcggatttctgagttcgaggccagcctggtctacaaagtgagttccaggacagccagggctacacagagaaaccctgtctcgaaaaacaaataaataaataaataaataaatagggtttaagaatagtagtaatgagggctggtgagatggctcagtgggtaagagtacccgactgctcttccaaaggtccggagttcaaatcccagcaaccacatggtggctcacaaaccatctgtaacaagatctgacgccctcttctggtgtgtctgaagacagctacagtgtacttacatataataaataaatcttaaaaaaaaaaaaaaaaaaacagtagtaatgaatggcactggggttggaccacggggtccccagggtctcacacacgccagagtagcactcgaccagctagcctcctctgacctttaaactgatggatgtctgttgtgctgggaggatggtgccctacaatcccacgtaaagactaccagctgattcatctttctgcatgactgccttcctgccagccagccagccagccagccagccagccagcagtagtcagtctctctggccttcccttcttccttccctcccctcctcaccctgccttccccaccctacctttttaggcagtgtctctagttcagactggccttgaacttgggctttcctggaactcattatgtagagcagatgagtttctgcctcctgagtgctgtgttaaaggtgctaacatt

SEQ ID NO: 23812 - DNA, 1207 bp, Mus musculus
taccccactaactgtgattgttaccccatttgcatctcctctgctgatttgccattggtgccagtctcaaaccccgaagccacgatttgccttatttttcactgtttggcttgatctattcccatccctgagacagagcctgccttaaagactggttttgtaatgacagacgtctctggcactcagaatcactttaatttcatagagttgggttttttatttttgtttttttttttcccaagtgcacagaagggctgctcacacccaccagacacatacagataaggtcacaagtactaaataaaaggctcacattccttcctgtctcagctcctggcctgtgaagggtctcctttctcatacagtttctgggaactccctttgttcataaacacagatgaaagttacttggcagggagacatttctagaataacttttgtaatcacgatacaccatttctccatttgctggtgtgtttttagttggttctgttttagtttttcacattcagtccagcttgttggccaggccagcctcgaactcctaggggatcctcagtcttcggctctcagacatgcagggccctagctgtgtgcctctacacccactgggccttttgttctgtttttctttgacagagaaacaaacaggtaatttcattgcctgcctatgtaggtttggtgtagttttgaaagccttgtctctgtggggtctctttgagggagttgggggacctctatttgagccctgcttcagtgccgagagattgggagtggaactccctgaaacatgatttcagtttttagagatgaccttctgtggtacggtcatcatggtctccaacatcaccagaccaagtagaaggatgtcaaagacaaattcagggctctttctagggtgaccactctgccgtgtataatattgtcccagtctggccagctttctaggaggccctggctccatcctaagtctacacaggatctgctgcaaataacagtgtacggagtcaacctgacccggaacagaagtctgcatgctggttaagatgcagcctagccattgcctgagctgttcatacaatgatccggaagtgctagccattatttttgcagtgaattatggataccatacatgactttgatatctgcttttaaacaaataaaatctttgatcactcagtgaacaatccagttcaccttttatgaa

SEQ ID NO: 23813 - DNA, 1159 bp, Mus musculus
tcaggaagccaccagtagctgccccttaaatataaagcccatacagccactgtggcctcactttctcaggcaccaactttcgatcacgtggggtctacctagctaatcttgtgtcttgcttgctgtggagtgccacagacacacacacacatgtacacacacacacacacacgacagtacccttgtttttaccctctgcccaccttccatacatctatctgttcatgctttttccatgcagtttcaagtcccaaggacctctcagacacagacagatcttgggtttgtttattgttatttattttgtttttgagatgtggtcttactatttaaccctgactggcctggaactttctatgtagaccaggcaggctttcaactcatagatctatctgcctgtggctccaggtgctggaattacagagatgtgtccccacagccagctgttttttcaatttctcttgatttactatcatcattagtgtgtgtgcatgtgtgtgtgagcatgtgtaagcgtgtgtatgggtgtgactgtgtgtgagtgatgtgtgtgagagtgtgtgtatatatgtgtgtgtgagtgtatgtgagtgtatgtgtgagtgactgtatttgagtatgtgtgtgtgtgtgtgagtgactgtatgtcagtgtatatgtataagtgagtgtatgtgtgtgtgagtgagtgtatatgagtgagtgtgtgtgtgagtgagtgtatatgagtgagtgtgtatgtgtgtgactgtatgagagtgtattgtatgtgtgagtgagtgtgtataagtgactgtgtgtgtgtgcatgtgtgtgcacatgctttgcatgtagtcacaggagtcagctctctggctctcatgacatccaaggactgaacttgggatgtcagatgccgtggcaagcagagcgtctcatttgagatcaggtctcatccccagcctctacctctctagtgctggggtgacatctgtgacacttgggactgacccagcactttgttcatgcttccttcaccaactgcagcacccagactctcttttaatctttatatacacaatgggtgggcactgttatcagctccattatatggatgaagaaactaagctcagagaagtttctggaacagtcccaatcacacagctacaggggagttaac

SEQ ID NO: 23814 - DNA, 1942 bp, Mus musculus
actggaatgggggttgggggtaggagtggctccctcccccccccccccccccgcacatccccacaccccaccttttcacaagtgagcttcctttcttctccagtgggtattgggttttactttgatccttggggctttgtagtcagagcttcctgacacagctctcaaggcactctgtgctatagaaggtcatttctattgtgcacatagcatttacaagagtcaccaagagttcaggttcagggcctggttctcacaggtaagggaaccagcaacatgtctccaggatatttcttatgtctataagcttgctcagatgttaatcccatcaccgtaagcattctgaaccattatgattaaacctgactatgctggtacccttggtgatgcagagagcagagagctccaggctagtctggagacagctttgaaaagcatgtgaaactaatccatttcctagaacccgagggaggagctgtagggaaggaacacttcttagcagtgtataccaatatggggttgggaggcagatgttaaacaccttagttacacagaggtagtcaaagatggactggccatggacagaggctgctaaggagttcttggatgtgtgttagtcctgggagcagtgactctgtaggtctaggaggggaacagaaggtatcaaaggatctacctggagttggctgaggcggaggggttttaccgattcccaccccacatccacctttctacctcctacgtcttgcagccagcagcctaaacactgctgattcttttctccatcatccatggatccaaggccagcttggatctacaccgaaatttgagctggttcatcgctgcagggtcagatgcaggccgcagcttgtactatgctgatgaagttggcttttcaaacagacatcaccacattcttatcagttacactttgggggagcttcctatcaccccctgttgccagggggtctttcaagtttgagtcagtccatccagagagggacgagtaagttcaggcactgtggggcattggtgaggtcatatggagaacgaacacctatagaactgttgaacaaccatgcaagtcttccctgtccttggctatcactggctacctttttaagtgtataccagagccgtacactccaatggttagtaagtcataacttctcttcagatttttttcccaatagtgtaactattgagggtcagggtcaggtcttctgatggttacgaagctagcctttcatcctggggagcttgcaggaactccgaggctaagccactgaagcaagaactgactttcctagatatatgttcaaatggactgtgctactgctgtgtctcaaagctaccagtgtgtgcaataagtggaagggatgccattcctgatcaataaatgctaaatgacattcgagttcattttgtagaccactgagaaagatctttatttacaataaatttcaataaaatttgcataactatattcccaatgtacagtcttcacctctggctccttcaaaagttagtctgtcctattctcatgcttcgtctctgaagccaaagtggagctggtggtggagggcggaggggtgtcaccaggtaactgagttgtacccatggacttggagtggttcggtcgagcctttcccagaggggctggttccttagccccaccttggccttccagctccctctccatagtggccacaaggatcttgagccatgtgtgctcggggaggggggttcctgaggctctagccagctcttggagctctcgcgccttctttaaatacagagcctgcagtttctggctgtggcgccggagtagcctgtgctgctgctccagggtccgctgccggcgcagcaggcggtgcccatccctgcgggcactaaggagcctgccctccacctgctcctgtgtacggcgtaggctgctcat

SEQ ID NO: 23815 - DNA, 1175 bp, Mus musculus
gtgggtgctaagtatcaaacctgggccctctggaaaagcagtcagtgctcttaagccatttctctgtcccccaagcatgtggtttatgttttatttttattattctgttttatgtatatggtattttgcctgcatgtatgtatggtatccagagaggccagaagaggcattgaatctcctggaacaggcgattgtgagctaccatgtagatgctgaaaactgaacccaggccctctgaaagagcagccagctatctctccacagcccccagctatgtttttttgttattgtgatttggtgtttttcctcctttgaaacagggtctatcttaactttggcttaatagaactcactgtgtagagcaagctggcctctgcctcccaagctctagaattaaaggtgtgtgccaccacacccaaatgaacatgtaagttttaaagcaagtggtgattggtttctctggattctgtgagtaatactcagctcagagaagctcattacacattgctttgaatttacaggttttctgagagactccctcttgaggttttaactctgcccagcagttttctctgttctagactttgtagcagatttgggagtggcttcagaatttaggcttcattcagattaggaagccatggtttcacagttcaaaactatggccagttaagttttgctgagctatgataaagacatgtttttagtgttcacgcactctccctatctcccgcttctacattatgagtcactgctaagacctccattggagggagttggaagaagggaagtttatagactagtgctgcttcactgaggcagagggctctgagatgtggcattggtggcaagggtgagattgttggtgtaagttaagacttttttacttacaggtttatttatacatttttcactatgtataattgtttgtttttgttagctttttaaaaaaggaaacttaaagaactttaataaaggaaacaaaaagcttctggtctgagattaatgagctctaaacaccttcatattgtcctggcactgcatttgcagtgatgcttaaagtcttagcgttcaaggctgccactttcagaggggttggtgtatgccattgtgtgtgttttcatggtgtgtgtctgtggcagtttctgtggaaaagagcagggatggatccccac

SEQ ID NO: 23816 - DNA, 1228 bp, Mus musculus
cctcgaacaaagcctttagagcttctgcctagtggatgcttcactctggcctctgggacagaatctgacaagctaagattaagatataacatcctgtaacaatagacaatggacctagattattataaacaccacgtggtgctctgtaactctccttagggtgtttagaggtcattacagccacctgaagacagggagagtgtctggatagttgagtctctcaggggacaaaaggtgaacccagtgatatgaaagtcacctcttgctcccatggtggctttcagcccacttgttgagactgtgtggagaggtgggctaagtgttggctttatggcccgtagtcatggcctctgggtgccttttcctcccttacagtgcagcttgacccggcctctggagtgcggtactagtctttcgctctgccttgtctaacacacctctacattattctgttatatttgtccttggcaggtcttccccagggaagtcatgaacttcacagctgagaacatctataagtgggcctcagaaaaccaggagaccctcttccgatggctacagcctcatggaggcaagagtctgctgttgaacaatgagctgaagaaaggaccagcactcttcctgttcataccgtttgatcccctagccgagagacatcctcttctagatgaggtaagaggcctagtgattctgacacctgtcaatagatctccttccacgttaaagggcactaactaatccatcatcacaaggagtcatcaggaatagttgctggggctcagtggcttttgcctgggaccgggattccccagcttctcttgtctattcgttgctccagtctggggtgaatagcagagaagggaaatgaacttgtttccccagagacctagtaaacagcacttcttcagatggctgcactgaccttcctgttgaggggcgatgggagctcaggcaagctggtaaagcctagggcctgccacttttggggacctcgccaggcacagctgcactgatgatgtgtgtctttctctaaaccttataggcaggtttccagagacagctgccctgcctggagtcttccctccctcctgccttgctttctgggatatccgttctctctagacatgagttcattttacacgtgaatcatttggaggcacttagagggagcaatagcaatcagcagagagcctgggattgctaaattggatttactaggctttttttt

SEQ ID NO: 23817 - DNA, 1227 bp, Mus musculus
cagagtttctttgtagctaacctgaccagagaaggccttgccattcagtggtattggatgtggagaaaaagaagggaccaggttacaggtgaggccaaatataacctgatttctaccaaagggagaaagtgattttagagaggaagtgactgatagtgaaacccaagaaagatacaaatacaatgatgttactggtctaatataaccagagtactggttaatactgatacaatatacccagaactacaaagaatgagaatctgaacctgtggggtttgctgccagggctctgtgctgccaattgtggtgggaaggtccgcttagggttgggggaacccagtgggaaggctgctgcactccttccctcaccccaggatctggctgaatggagaggaagttcaccacagcccacacacagccctcctcaggtggtcagatttagaaatgaaatgtggcagtatattcaccatccattcctggcatcacaagattttctatacttaagataacagctattcatcattcagctgacagtgcctatgtcaccaactgtactcttgcccctgcagcctggagtactcggatactttgaattcagcggttcaccccagcctcctggttacttgaccttcttcacctcagcactgcattcgttaaagaaaggtaaaacgaatgtgtattaagacattggcacattaagcagagatgtactgatttttatatgttttggcatatagtatctttatgattatattttctaatttgctagattccttttctcaatgtatttttaatgaatattaactctcgtttaacttcgattaataaagcattgtactgtaccaggtattttcttgctgggcatggtggtgcatgcctttaatcctagcacttaggagacagaggcaggtggatctctgtgggctccaggccagtttgctgtacatagggagaccatgcctaaaaataaataaattaataaaataatcaggtctattgtttattagatgtagcatattattatatagagtttgaccctctggcgccaaaccatgttctaagttttgtttggactgttgttatgttttatgtgaagtgacaggttttgatctgactcagtgcttacctggtcaatagttgagtatgctgtgccatataactcagggcctttccttcacagggtggtttccaaaggtcacaggtatgccacagaacatcatgagcctg

SEQ ID NO: 23818 - DNA, 1194 bp, Mus musculus
ttgcttttccctgaatgctctggatagatataggtcaactccccttaataaattatgttttctaaaagttgagtcacctgtaaatgtctcctataggaactgtactcatggtgctgtatacggtttcctcagacttgtgagcaatagagcagtagcagcagtgcctggagatcagtggcttttgttgactgtcgggctacaatgttgaaattttgggttgtgagcggtgagaccgtggagcgtgtcattatttactgcttccctaacccacacctgcagggacaatgcccagcatctgtactgtcccagccaggtgttgccttagcatggtgtattggtttctgttcagggcggtgacttgcaagctcttaatttcttactcaaaagaggcctttaaaaaaagtcttctctcttcttccgtacaaaagtgtaatggaagaaaataagtaagtggagaaattgtttgtgtttactcttttttagtcgagcaaaagacgtgataataccagcaaagccgcctgtcagctttttctcctcgagatctccggtccttgacctcttccaggggcagctggactatgctgaccatgtccgccaggattctgaggtggtggtgctgttcttctatgccccgtggtgtggccagtccatcgctgccagggcagaaattgagcaggcagccagccggctttctgatcaggtaatgtgtgctttcacccaagcggtgactgtcaagtctatattagagaagatggcctctcagagaaatgatgccagactggccgtgatatccaggcaaactccggggccttgtcaggtgcaaagcttgtgaagaaacaggaacaagaatcctggcatgaggtcaagtggcaagagtaagcttcagttctgtagcttcaggagatgtgtgcttgcccaggataccaggttgtgggatacagtgctgaagatagtagagaccaagaaccccagctctctcatgtccagcttatgtggcttgtaagccttttatgttgtaagtggcacacaggccatggtgaatgtgtggagttagcagacagcttgaaggagtcggtactcctctactatgtagccaactacttaaatgtttatacaggaaaaattcatgaataaaaagactaaatgttgccaggtgtggtgacacacacttttaatcccagcacttaggaggct

SEQ ID NO: 23819 - DNA, 1163 bp, Mus musculus
caaagtgagttccaggacagccagagctatacagagaaaccctgtctggaaaaacaaacaaacaaacaaacaaaaaaacacacaaaaaaaacaacaacaaaaaaattgcatgtataatttttttctagtactaattttaataaaatggcttttcagactagaacttgacattgtacgtatatatgtatagttttcaaagttggcagagcagtcagtattaaaatgttactttgtttttgtcttaggtgccttgtccacattttgagagagaccacagtaaaatattccaaaatacgttcttttcataaacaatgtcaatttgatatttgtcgacatgaagttcgttatggctgcgtgagggaagatgagtgcttctatgcccatagtcttattgaactgaaagtctggataatgcaaagtgaaagaggtatgtgtgtgtgtgggggggcggggggcttgttactgtccctgtgcaagggaggagtcggggtgtggtgaggacagaatagtagtaaggagaattacacttctcagccagctcattcgataacagtttggggctggtgagatggcttggtggggaaagacactcctgccaagcatgctgacctgagttggatcctttgagtccatgtgaaaggagaaagctgacctgtatcctgtcctctgagctccacttgcatgctcagacacaaagtaaataaagaatgtaagtatgcagttccatccctctggtggaattggtcttagggccgtgtgtactctaggcaaactcacaaccagtaagctttatctcctaccctctttgctgtttatgtcagttaggtcactactacattgtctggctgcccttgagctcactctgtaggcccagcagacctgatttggaatcctacctcagcttccttagtagctgatactataggatggggccaccttgcttggctactgtaatgtttgtttgtttgtatttttaaagaattgtctattttggatgtgttttcatgcagtttatgattaacacaaatttgtacatgcagcatggatttcatgagtaggggaaggattcctcagaagacaaagagctatgcctgttaaatactccatttaaaaaatgtgatgcaatgtatattcatccctgatgggtcaggcggcctgagacc

SEQ ID NO: 23820 - DNA, 1278 bp, Mus musculus
tgttctttattgttctagacttaatttcctctctttcttttttaagatgcaagaaaatatcacagggaaaactccaaaatcgaaatctgatccaagtacacctaagggtaagaaaaggaaggccttgctggctacagagactccagaagcctccgcccctgggacctcagggaagaagcaaaaaaaggatgttcaggaattcagaaagccagaggccagttccttctctactcccaggaaatctggaaagaaggcttccaacacacccagagacaaaaaaaccaaggcggcccactcaaactagaattagtgcattggcatgaaggacatcagagttaacctagagcttttcagaatagttagacagggtgtggtggcacactcacacactgtggaatgcagagataggcagatgtatgtgagtttgaggccagcctattttctacaaaagcatttggtcacctgggataaagcaggattcagtatttaaaggccagatttaagtcctgggctgatggtataacactttgccagcatatgcaatatcctggcttcagtacccaggactgtcaaacaaagcccacccaacaaaaggtactctgctgctggttccatcactgcctttttaacaaggagtctgggacttaaatggtttttgagaagtttctgtgggtgcctctgaatttaatatttctattgtacaaactaggggtttgagacaataaaatatttttaaattgttcagtgtatttgctgatggttctgtatgtttgcttttttaaaaattaaactattacatccccttctgtgtaaagtcgctgtactgttggtatttcacatctcacctgactacttttgtttttgttttttggggtttttttgttttgttttgttttgtttttttgagacagggtttctctgtatagctctggctgtcctggaactcactttgtagaccaggctggccttgaactcagaaatctgactgcctcccgagcgctgggattaaaggcgtgcaccaccacgcccagcacctgactagttttgaagacatgttggagcagctttccagttgggcaggtcagctaatttctgcaaacattccctgagtggttggtgagggattgaaacataaaaatcaactccagggggactggagaaatggctcagtggttaagagcactggctgctcttccaagggtcctgagttcaattcccagcaaccacatagacaaccatctgtaattgggtctgatgcccatttctggtatgcaggtg

SEQ ID NO: 23821 - DNA, 1151 bp, Mus musculus
aaacagggcagggaccaggaggcaggagctgacggctaaggccatggaggagtgagtacaagcattagtaaagtgctggactctgtcctagcacctgtggaggaggaggatattccacactttcagctagtcacaacctgactctgtctgagcggactctacacctgcagccccaagaaattatcctgatttgtccttacctccacctgactggttctcacctgtgtatactcaatggacgggatcgtgctccactctaacaaagccagaccctagctattcttgctttgacagaggcacctcctgctggaggaaggggcagaggcccagacttttattactgtatgtctgtgtctgtctctgtctctgtctctgtctctttcctttcctttcctttcctttcctttcctttcctttcctttcctttcctttcctttcctttcctttctctttctctttctctttctttctctttctctctctctctctctctctctctctctctttctttctttctttctttctaagacttattcatttactttatgcatgtgagtgcactgtagctgtacagatggctgtgagccttcatgaggttgttgggaattgacttttaggacctctgctcactccagtaagccctgctcacttcggtcaggcctgctcgctcaggcccaagagcccaagaatcactggcataggtgccttgggaatgacagctctagttattcaagaccagaattttaacctgctcagtaatgaagtagaccaagacatagcacctaaaggactccatcaggtgacttgtaaaaacaagtagtttccctagcagaaatggttttacagaaccattgaggactagattttaattaagaaggaaggacatttgttgtgctacctcaggtgaaaaatatttctatgccaataacgcagggatttatgggaaacattagatatggctcagaaaaacttaagctgtaagggcaaaggagcgagctgaggcttcttctgcttggaaccagtctcccttttcttggtccccattgcataccaccttttttttttttttttttaagatttatttatcatctaagtacactttagctgtcttcagatgcaccagaagagagcatcagatctcattaaggatg

SEQ ID NO: 23822 - DNA, 2394 bp, Mus musculus
tacaggaatttttttatttttcattttcttcttaggcatagttagtctttttcccccaggcagatgattctgagtgtgggagtgtgtctgcacatgttaaaaagacaactaccatattaataaaatattcaatttgaaccctttcggtatttgaattgcttttgaatactgttttttatcttaatgtaacattgttgcattagctttttaactgccaagtaattgaatacattttattacttggatttttctaaactctccctacccactcactttgaatggagcatttacaaacactgctcaagtttgtattaaaggaaggattttggttgagcccttatattgatggttaatgcatacataaacacctttatgcaactttaacactgctttactaactatgtctattggttatttcctgccaattagtatgatttcttaaagacagtaagttgtttgcaaattaataaaacagcattcctgtcacctttgtaagtaaagcttaatgaaactatatccctgtggacagctccattagcttgttacattagtggaattctgagtaaagcatgggagactggcaaaccctttgatttctctcagagctgcatgcatctagtatgaaaccctgtcagttccacaggttacccacattgtcaataacgttaaaggatgaagagccttgctgcttcgggccatttctcaatccaaagactaaatattttagtcatcacaaactgcgtacactaacataaacaggaatagaatcaagtacagaataggttttatctcaattatttcttaactgtaagctggaatttgctaaccatgatttggatgaaccacgtgcagcattgtggtgtggtggtttcagctcgaaggatgactttctactacagctatcatgcctgaaagtttttgtgagaatgaatgggaagtagaagaggtttgtcagaggcctcctttgtatggaatgtgcttccatttgtgagaatggcctcattgtgattgtccattatgattcctaagatatgttctgacgatatgtttaatggtctggtccgtccctgtaatcttgttctccagaaagaaaagccaactgtatttccagtcataaaccaaaatacaatgcaatgccaactgcaaagatgaatgagttggtgtctcaaggacagggctaaggttgtgcctacagcttctttgaactacacatatggctattaaattacataaaatttaaattttatgatgtctgcaaatatctgggcttttattttctgtgatatatggaagctctaatgagaacaaatccttcttatattgccatgctaataaggaaaaatattagcaaatgcttgagtcttaatttcgaaagatttcccttttgaaacaagttctgtctgctattagaacacttagactcttaggaatgttgtgtgcgtgctgccgaggttcttaagtcccagggcttggccagcacctatgaaaggcctacctctacaaggcaatagaaggacgaaggtaattcttaaaagttttcattggaattatatcacatcaacagaattaatcaacaccatacattttagggacttggaagtttgaaagagtatgtattatcatttcaacccatccattttaaagcgatggtcatatatcagcttgtcatttcagtaaggaggtaagatgtctgaagtgaacatgaaatgtgtgcagatgttggattgtgaaagagcagtacatttttgtgctatcattctgccttctccaagtttaaactttacgtggtttacaatgcaaaaggataatatattctggattctaaagagcttatgcttttcagctatacttaacataggcatgttagcatcatgatttggtttgccccattttacattaatgatcatcatatgacttttatgctaagttatttaatctttcaagtaaatacattgaattttaagagatggtatttaaaaacaatgtaattgtcatccttttcttactgtggaagaggaagtacagcattttgttgttgttaataaataatttgctatccagtagggggtcaggagggtatataaaaccaaaccatcagaagttgaactgagtgtatattgcctgaaatttaatgacaaagcaacatgtttataaatgattaaacacattttctccttgttttttattattaaaaatcttgaaatacacagtaattgcatgtaagaaactataaactgatgtcaagctatttcctgtaacaagataattcatttctgaaaccactagatctacttttacaatgtgggactttgaaagtttgattggacagttcctgtcatcagttgaagtactgcaaatattttggcttatacttgtaaccagatacagttttac

SEQ ID NO: 23823 - DNA, 1142 bp, Mus musculus
attttaattcagaaaaataattatcttgtgattcagtttgttcacttgctccattcagtctgctgactgctcatgtgctgctgcttctggtttatttactgcaccgtgtgtgggtgtttatgaatgtgtgcacctcctacatatgaacatgtgcgcctcctacatgcctggcaccttcagaggtcacaagaggacactggatctcctgggattggttgtgagctgtcatatagtgctgggaattgattccaggccctctgcaagagcaagtgcccttaatagctgagccatccctccagctccccacgtgcttctttgtgtggatgacaagatgagggccaccctgggttggacctgtgtgataggaatggagtgggtcaagttgctactctgaaccgttgccagggtgacaggaacctaagcaacacaggtcctcagtcctggaagccatgtttacgtaggagtgaccctgcagtcccctcttctgaatgtattttgaggtttgaggaagaacggtggtgtggagcacacactgcagcccagtgcaggagggactcagtgagactgcagttgccatgagaaggaaaggctttctttacctcattcctggtcttacccaagcatggttagggcaggtgttctggagcagctcacttcctggtggtcaggaagcagagagatggcacctggcttgtggtcctctctctttcctcattccccagcctcttggatggtgcctcctgaacttgagtggaacatactgagaggagtgtaccttgccagtctcctaggtgcctcctaatctgatacattgacattgaagatccacactcagtcacattttctgtatttgaaagttttttggcattctttcttactttctcaaggcgctatatgaaatgttactgtttttactgtcagtcaccctctttgtggttatagccgtttgcttgacttgcttttgacatgggactcatgtgctctctgagaaagaaccattgctatgctgggacagggatggccttttcattattttccctgggtttcaaacaggaaagggcaacatccccacttaacctgggtgaagtcacttgtctctttagtctgtcacagcagagtattggcagctgtaacctgttcaa

SEQ ID NO: 23824 - DNA, 1202 bp, Mus musculus
cagatactcctccctctgtgtgatttctgctggtctcacatgtgactctattccctgtctgtgtcatttgcatttaagctctgacttcatccagatctcctcctgtcttgcagggacatcaccccacctggagaaccgctgaacaagagcagcaggcccaaagcagtttcccgcttccctaagctgtcccgaggccaccccagggaggtgcgcaacgtggaacctcaaagtggtgacctctgacctcggtggactctcagcccccagccactttgtgctcaaccttgccatggcagctggccctggacaccttggcaggatgaccatgtccccacagagaacacacccttcctgctgccacatgccacccaattaaactggtcagttttagctgctgggtctctgtccttagagcaaagcattgctcactggacagacacagatggggactctgtcactaaccccagggtggccaaggatggttgtcacctcctccagttctgccaacagacagtgggtgccaggctgggcccagacccctggctgagatgcacaacacatggcagaaggatccttcggatgccacctgtgacgctttcccacgtgggaaccagaatgactgttatactcttgaatttcctgatgcaaatgcctgctgcagctggtggatggggtctgcttccctgtcctcttccccctagggtggttagacacccaacggtactgccacgtgcctggtatggatgtgatttctccatctagtggcccagcaaagcaattggcagtgacttggttcttgaggaacttatccttccctcttcttgctggcacaggaagcaccctacacacatacacatacatacatacatacacacaggaaacctgaggctgccccagcaaggacctccacccgccagcacagccctcagcagcagcctgaaaactctggcccaagaattggtggctgtgacctcatgtcactagtgatttggctctggacattgctgtggaaggctggccctataggctctcagacccagtgcagaactgaaaagagaatgattgtcctctgaacgtgtttagcaccaactgtcccctaacatctcagtgggagcaggatgctgtgtcctcacaagatgtagttctattgctctcgtctcagggtcccatcctagagttcagggctcacaggtatggagtgg

SEQ ID NO: 23825 - DNA, 1992 bp, Mus musculus
cgaagggctgaagctcaaagctagacctgggtgagtggtctggggaagcagagttttcctggcaccttggaaacttgggggaagtagtctagaaaccagagaggacttcagagtgcagggggggcctgaacagctccagttctggaggttaccttgggacagacaggtgggctgtgcacaggtgaggcagagcattcttgtcctccctcatggctaggggcaggagctgaggggagcagagaaaccctcttcagcttgctgggaaggagctacccaagaggcttctcagacctagaaagccaacatggttcctctcttgtctcctgagatgcttcaggcttcacacaaaggccacaccagagtgtgggctgggcatgcactttgcagttgggcaaactgaggcatgcagaaaggccctatggggctttggtagccccaagttcacctcctgagctgggggacccagcatggggctgcttcatattctatcatgttctgtacagacaggatcctgctacacctcccacagcagagtcctgagcaccagggctttgggacacctagcctaaacacgtgtcactaagagtctgagctctctcactgcaaacagcatatatagaaccatctttcacattcagcactggagcactggcagttaaagcaggaaggacagaagggagggagggagggagggagggagggaggaaggaaggaaggaaggaaggaaggaaggaaggaaggaaggaaggaaggaaggaaggaaggaaggaaggaaaaggaaggaaggcaggcaggcacccggacttgggaccttggttttctaggattaattatggggaacttgcccaattttgccataatgtgctataaaggctgggttccagggactttgtaagccctttggttgcttgacatctgcctcctacccagtctttttccccgtcttggggattgacactagggccttgcaagtgctggacaaaaactctccagtgagccacactctagccctgcccacactctgcttccacagaaacccagcaaactcttggttccaggttgcccatcttatacctcacaagagcatgttgggactcaggcggagcggtgcagggcagggtcaggtgatggaaggctgttcccacaatgctccccagatctgaggcctagagtgcagaggggagttcagagctgtgctcgcccggtctgatacaacctcaggtttacaggagactgcttcctaatcgtcccctgactgcggccttgccattcttgtggctgctaaaactctgtttctataagcgttcacatgtcctgagggcaagtcagtgtcctaggccttgattactgtgtcatctattcctgttccatctgtctgtgtaacctgtagacacaactggcccctgaggagtggctgggctctgtcctcccaggcccaccatcagactccctcacgttggccgcctacacctgcacctgcattcacccactcaatgtgctcagctgagggactcctgagagtgttctgccagcaggacgacgcaggagcaggcagtctcaccatggtgcccagccgctgcctgctctgttatctgggaagtatacaagaaggagcggtctcgtgcccatggcaataacagtcctgattgctcaacattcctgttagagacattgctacccactccagaggcacagcctggcctgggagctgtgacctccttatgaacaaggtctattgtaacaaacattctttaaactattgtgcattatttcactaaagatagtgttaagtgtttgctgtttaggttggttttgctacctttgcacaactgtagcactgtatatcttatctaatatttctgtgccaaaaagttcaggctctgttgctgtgatatgtggtctccattctacgtctaaagtcaagtctaggcagtgggtggggaggggagagagggcagcgtcagggctggagtggctgctgtgtggaggcct

SEQ ID NO: 23826 - DNA, 2829 bp, Mus musculus
gtctcttctttctaggaaactctcggcaatgttctcaggcttttctgcattattttctccttcctctttttccggtctcccagattccactttcctcttggggctctgtggaaagtgggctcacacctttgtagctggtgtggattctgactcattgccctggttctttttttcccccgttttccacttatcccattcactgtattgggggttagtgtgacttttggtgggcatcttaataaaaccattctgagcagttgtcgcttcgtgctactcaattttcgcctgttttctatcaaaggcccttagtcttacttaaggtctcagatgtacaaaaggcatttgctttaaatacttgtctgacccttcctgttaattaatcacacctgaatgagctcactctgcccgaggagtctggactgccgtacttaccataagatttcttcataagctgtaagatgtttcttctttctggtttagtgtgagtcttcaggaccttctgtttttgttcttgcttcatgcccctgtcgtctggttttggtacacacacacacacacacacacacacacacacacacacacctgagttcctaatggctgttagagacccactgtaaaatctgagcacaattgtaactgtatggttcctggatatgagcttggattgctattctttctagaatctcagatgtgtgctactcaggctcagaggtgtgctggagaactcctgggtccacaagttcgtgtgcatatgtgcactgagaattacactcaggccctcacatgctagtgacctacaccctccactactgagctcaagcctagctccatgactgttatacttggaaaaactttatgaacctgttgttactgagatgctgtgagaagagcagttgaggcgttccctgtcagtcagcactaatgctagcatcatccacagaattgtgaccatggaaatccttggcccctttaatgtctttttcctttccctgcaggtatcagagctgtgttctccgggcactaccacaggaatgccgggggaacctaccagaatcttgacatggtagtttcatctgctatcgggtgccagctgggcaaagacacccacgggctccgtgtggtggccatcactgcggagaagattgttcatcgttactacagtttagatgagctgagccagggtggggtcgaggaggacctgaaggagctgctgaaggagtgactggctcccacagagtccacccagccttcacaccatcaccttccattttgccagaataatctcagccccttatagaaatgtctgagcagaaaggcgggcttgtaaacagatgtgctttcacatcagtcaaactgctgggtcctacccttatttcaaaagagaactgcctttccttgataagacagctacgggtgttttctaattgtggtgtgagacttcccacgtgatgtttgggtgaattcttctcattgtgcagcttttaactctgcccttgaatctactgtttctgacttcaataaccacctactgccctcaatcccaactcagtacccaagagtgatcttaataattcctccaacatccccccaccccacccccagtcccagggccacataggtttgtcgtcattgtaacagatagcgtcatagccatcattgactgcaactttcaggactctcattactgctgatgctatgaacaccgtgcagggagtccacgccaggctgtttgcctttctgatgacaaacgtcacctcagacatgtgcagactctgttccagaagaccagaatggaagcagcaacttgaagaccctgtacagcccacatgtttccctgtgtgtattctcccgatgcaggcggcccaccccgttgtcagctatgacgtggcgggaaagctggtcttgacacagacctctcccaagaagaacacagaactgtgtcattgggtataatttacattataccatgttatttgccacttacataacactattcctggacagaaaagagtgtgagtttcttaaaatccttttcatcatggaattcgctcttctgcctcccctgggagctctgacctctgtggaatttgctctgtgtgccagccatcctggtgcctaagtaaccagggccactacatcctgccaaggaagttttacagtatcctgcagcgacactatagaatctgaaaccaactttaaaaacccactggttataaatgaaccgcaaagcccactaaattagaaaactttcttgttaaaaggttttagtcaatgtagcaaaaccatgagaaattaaataaaaagataattggatatgtaaattcataaggaacaaaagatacaagaagttaattattttatatattagtgacacaccagagcccattattaggaagcacaagaaaagtaatttttcaaaccagagtgatcttgcagtgcttggctgtgttcctatttgtttttgtttcttacagcagagtataagagatcaggagaggtccctggtcctaaaatgtataggcttgattcaatgacaagagaaagattagtcatagtgggctgaaggcatgccccttgtccaagctgcataaggaaaacgcagccttagaatggggacaaggatatgggatagagcaaaggaaacgaagtaagtgcttgtcctcaaaacacatacgtttccgagctgactcagaaacctagcatgtgctaaggatggcctggcgttgccagttttcaacagaacagcggtatccctgtggggcctgctgatgtggggagcaaaagtgtgtaatctatgtaactcagatagcaagacactattctgttctc

SEQ ID NO: 23827 - DNA, 1159 bp, Mus musculus
tggggagccgccctcacattcgccgttacaagatggcgctgacatcctgtgttctaagtggtaaacaaataatctgcgcatgtgccaagggtatttctccaccccatgtgctctgccttccccgtgacgacaactcggccgatgggctgcagccaatcagggagtaatacgtcctaggcggagaataattctccttaaaagggacggggtttcgccattctctctcttgcactctggctcctgaagatgtaagcgataaagctcttgcgctcttgcgctcttgctctggctcttgctctcttgcgctctggctcctaaagatgtaagcaatagagctcttgctctcttgctctctggctcctgaagatgtaagcaataaagttttgccgcagaagatccggtttgctgcgtctttcctggccggtcgcgagaacgcgtataagagagtataactttttttttccttcgaggcagggtttctctgtgtagccctggctgtcctggaactcactttgtagaccaggctaaatctgcctgcctctgcctcccgagtactgggactaaaggcgtgtgccaccacgcccggctggggtataacattttaattgtttgattttcttctttcactgctggaagctagagaatgctttctttgctgtacctccagaaaggctgtatcctgtgcttgccacatgctagtgtttggagcagttctttgggtggatccttttttggatgagaacatacagagatttgggagtttttgcatcaggccaggtgaatgaaaggccttggatcttattggctgaaggccatttctggtacagatactctggtctgtggtttccctgtccacgtgatatcattgcgcctaattcattcattcttcatctctttctcttcccctttgttttacctgacttgtttttcttttctttttttttttttaatcagatattttctttctttacatttcaaatgttattccctttcctggtttcccctccaaaaacaccctatcccatccttcctccctctgctcacccactccctcttccctgtgctgccattcccctacactggaccatctggccctctcaggaccaagggcctctcctcccattgatgtccaacaaggccatcctctgctacatatgca

SEQ ID NO: 23828 - DNA, 1125 bp, Mus musculus
gttcgaggccagcctggtctacagagtgagttccaggacagctagggctatacagagaatccctgtcttgaaaaaacaaaaagaacataatttgtggaaagctataataggatgaacttaaagtaatttctcagttattcttcactgtccatgcaccactgccctgcaaattatgttcttataagcactgataaatcagaactgtcataatttaagccaatttaagcatgataaagagtaacagtactgcacataaagccattctgtagatgtaaaatagtattttgtgggtggaagccagaggatgatatcaggtgtcttcttgtgttgcttctatcttatgttttgagacagggtctttcactgaaccctagggcctgctgatgtggctacattggctagccatcgaatgctaaaaaatttaaaagctgctatgtccagcttttagaaaaatattttatgcatatctgtatatgcctgatgatgtgtttgtgcaccatctgagtgtaggaacctatggagaccagaagagagtatcagatcccctacaacaggagctgcagttgcttgtgacccagatctctgccaaaagcagtgagtgttctttaccattgagccacctctccagctccatgctcagctgagtttttgtaggggaaggggcatgttcagggaggtggtggaggtgctgggcatcaaagtcagggcctcatgcttttatagcaaacattgtatccattgagccaacctaccagaaagacctggcttcattgcatatagtagtataggctgtgtgcttccagatacttagaacttggagtgaggtgtgcagccagccttgttgtcattacctgtcttctaagattaagggaaatttcagaatattggccccactgataacaattaaactgtagatgtacatggtgaggtgagcccacattctcagcaggtgtggctacacctagcctgggagcctctctgtcacacagtccaaggtgtcctctgagctgttagtaatgagaagtagctctgtgcttgtgacatggttaccaccatcggaatgttccctagcatagtgaggatgatggaactatagcgtttgaagggccaaatgatcagtagctg

SEQ ID NO: 23829 - DNA, 1142 bp, Mus musculus
tagttaaagtgtcttagaggtttgcttgcctatagccctatcttatggtaacattttctcaattggggttcttcctctcagatgactctagcttatatcaaattgacataaagctatctagaacatctataatgatttagtctgtgtagtcatgtgtaattatatttcttctttgtagaacaaattagccaagactcaagcagaagacttgatgttgtacaatctgctgccatagtttcagtaatggaaggagacttctagttgaaaaaattagacatttttacatgggtatccttagtttggctgtccaaaggggaggctggttctgattctaaaatgatttggatctttacagtccaactgtagagagccagttcaggaagcagtagtttaatgagttcacacatggaaagggggtctttacagtgtctgaatcccacatatgaaaaaacacagatactgatgactagcaaggaggaagagttgagctttgtgagccgtttagaactttaaatcagtctcagccagcaatctcaattttataatccaccttcgcatcttaattcatcttagtacaatagaaaactggaaaaagtggacagaaggaaatgagattagtgcagaaataattcaagaaatggaaaatagtaaaagtttgtactttgtcaccaactattagctgttctgacaaagaaaaagaaaattcaagttaccaaaatcaggaatgagtgtggagatagaggttctggcctgctaagcattgtatggtgacttaaagacgaaatcatcagaaagataaaataaccagaagaaattaaaccaaaaataacaaaaaccataaaacactgttacaagaaagacactcttaaaggaaagtggaaaggcatcccatggttggaaaaattaatataatgattactatataggcaatttttctgtagattcaacagaatactcttgggcttccttaaagatctgtgtttgaaaaaaatgggcaagccaaagttcccatgttaattcaagagacccataataaccaaaacaccttgaaaaagagttggaagatgcccattgttcagttttaaaacttaagggacaggcatggtgatgcacacctttattccccagtacttggtggcaga

SEQ ID NO: 23830 - DNA, 1179 bp, Mus musculus
ggacacaaaatcagaatacttggggtctttcaaaagttctgtatatggtacctttgttaaaatcaaaacaaaagaacaacaaaaaccatacttgcaattctattcttaactgaaatgcaaagagctcaggtatgcagacacaatgtgtgcacacatgttcacagcaactatacccacgacagcttaagtgttacaggaatctgcagtctatactgaacatggagtacttactattcagctacagaaaggaattatgtattgatatagaccaagtgtgggtgagggagagagaactcagccgttatgagcagctgctgctcttgcagaagaccccagtttagctcctcgcatccatgctcatggtagcctggggctctgacactctcttctggactctgcggggacctgtgctctcttcctctccctgcttcccttctcccatctctaactgcggacgagcctggaaaacacattatatgaaagaagccagacagaaagtgtgacatattattttacttataagaaatatccaccggtagtggtggcgcacgctggtaggatttgctgaaggaggcagaggcaggaggatcacgagttcgaggtcagcctgggctacacatttttgccaggcagtgatgacacctgcctttaatcccagcacttaggagcagaggcaggcagatttttgagtttgaggccagcctggtctacagagtgagttccaggacagccagggctacacagagaaaccctgtctttaaaacaaaacaaaacaaaaaaacaaaacaaaacaacaacaacaacaaaaaacaaaacaaaacaaacaaaaaaaagaaatatccagaacaggtgtactgctggctgccaggaaccacggggaagacatgggagcagctgctgctgctgctctttggttaagacattcctttgagcctacactgtggtaatcaatgtgtaacattgtaagtgtatacaatactactgaattgcttcctttaaaatggtcaacttaatgttaagtgaatttcactctaacacatttttttttttatatataatagagagtaacacaaaatatgctaagaaactaatttctctggattcaaatctccaatttcccacccactcctggtttgtctcctccccaccaacacaatttcattaaccattaatggggcg

SEQ ID NO: 23831 - DNA, 1145 bp, Mus musculus
atttctagcaaatatttctgatattgatactgatatccaagatagtccctacgccagacagaagcagtctaagagctagttgggtcttatttagcaaaatcgacacaccaattcacaacactgagccaggcagtcgaggtcgcactaatgaactagccaccatatctctgtttcctttggggagggagaaaaagcactcctccaaaggggaaactgaggctaagagaacgactgcgcaagtgaacgagcccactgacggagctgggattcgaactacggaaacagagacgccaggcaagctccgctcgggatctgcggacccgcctccgcgcctgcccacgggaactccaagcggcgccggcaactggcgctcgagctacgaggagccgggcggttgcactcggctcaggcgcgcactcgcgcccgtcaggcgagctcatgggagtggcgccagcatagaagctcgcgcggccgccacctcaacgcaggcgcggtggccaagtggtaaggcgtcggtctcgtaaaccgaagatcacgggttcgaaccccgtccgtgcctgccctctttccgtgtggatttaagaattttttaggtgagacccttttcaagagtgaccatgaaaggtccctcgtcttgagctttgagttgcaattttttcccagcacagctgtctggatagattgttttctttcagcttgattcaaacgaactccttttccgctcctctctcgctcaaggtgacggtgggtggtgtagccactgcaccccgtcggtcatgggagcttccacttcagggagaagtttgtggaatgcacgggttggacagaggtcgcaatctggaaggatcacctgcacatttgcggtaagagcttcgcagctaaatggaacctggctggcttcagggcacttcacgtttttctgattgttaaaatccaaggttacccgccgtaaagaaagaaccgctgttgccccacaccgactccacacccggagtcagctggagtccttctagtttgcgatttttaaaaggaaatccgtagaagtgggcatcgccttcgagaagagaggaaaccctgcccggacctggaacgattctggtttgaaaatgtaagcctctggcgcggagcctcctttcgcccctagc

SEQ ID NO: 23832 - DNA, 1789 bp, Mus musculus
atccagtctagacttggtgcttcagtacctatccagctgtgttgcgcaccccaccccatcaccccaccactgctgtacaaatggcagaagtacctctcatggaaactcaggctgttgctgctgtagcaaagagcttggcacttgctctaaactctcctcagccccttggtagctttaggtccctcacctctcagtgtgtgttcttgcatcgctatcctgggggacaatggtggctgcctagtgggcttttgtgaggtatgtgaatgaaatgcccagcttggttgccaacagaaaatgttgtatacacagcaggagaggtgcacgagcggttaccctgtctgtgagcagccagaggcagccagagcgggtcaggtggtgtgctgccctcccaaagcttccgagggtttccccttcgtgtgctgggtctgtccccaggtccagacctacctgtgtacagaagttatacacagcgtgttggtggttcgagtcaacagtgttcctctagtgactgtccatgtccttaatcggcttctcctttacccacaggaagtgtctcggatagccctgccgtgctctttgaagtccctgacacatggtagtggagtactgctgcgacagcccagcctacctgcttggaagccatactgtagacacttaaccagatatggcctgggggagttttggaaccagattgtttcctgcaaagctactttttactgttttggctgcatctattgtcccttttagtctaaactgacctttggcacacgtcgtggttgagggcttctgcaagcgtgtgtgttattaactaattacttcctgctccttgaaaacctgcctgccctggtgaatgttggcaagtccacccagggagtaagtcagctgtgaaccacgccaggagagccaacctccggggtgttctaggcagatttctgcagagcttctcctgcccgagatgtgccctgccatcctcccactgctgcccagaaacagcacacaggcttgtcttttcagtgggagattcctgtgctagctcaggctcatctcaacagatgcccaggctttgagagcttgttatttcaagtttctttccctcagataggagtgtgtcccgggtgtggtgacatgtgtgtgagaagctggctcttctgttcctacgcacagggttcacggtgcagcagcttctcctggtttttactgtatgtctttgtgtgtctgtatctgggtacatggtgtgtgtgtgtgtctgtctgtgtgtgtgtctgtgtgtgtgtgtatgtgtctgtctgtctgtctgtctgtctgtgacagcggcaggcctacagcatgcatcaagtcctcattcagacaggtttcagtggcagagcctcacttgctcctgcaggataccccacagcagacacttctggacatgtaatgcttttgtatcatgaaaataaaagtgaaaaagtaatttcaaaaagctgaaattaaagaaaatttcctagaactctgcctttaactgttctttggtgtgactgatgcacatcccctccatctggtcctcaccccaactccatcacggagttgcacacctccacatgcgaagcacttcctcactcacaaaactcctaactccttttccccagggtctgtgacaacagacctggtagaaataggagcctagcctctttaaggcttcagttaccccagctcagtttgtacactcagcagaagtggaaactggaaatatggagggagcaagccagggccattggctccaccaagtcttcagacttagaggttaggg

SEQ ID NO: 23833 - DNA, 1188 bp, Mus musculus
aattaaaaatcaagcactaatgaactggaggcagccttcattctgagcatacagcctgtatgttctgtgctgtgcgtgctctcctgtgatatagcatcctcatcaactgcctgaaacacttcaggttccaggttagcctgtgttctaactacactgttctcatgtacttacagttctctgttgacagagcatagtggattaattatgggaatgaagaggtcccattttcctattgttgtttatcagcacctggcacattaatacagctttgggttgtattgtgctagacaggcacatctatctcattagtatgtaaattgcttttgtcttaacaaataacaaaattatatgtatatcaaaatgtttgttttctttaaagaaagactctgtcttatatggatcaggctggccttgaattcacagaaattgcctgcctttacttctcaagagctgggattaaagacaagtgtcactctgtgtggctactaaagaattaatttagtttttttaatgtttcattagtaaacctatttaaaacttggatcccatgaagttggctcccctaaatcagtaggtttgtgtgtgtgtgtgtctgttttcaaatcaaatatatttgaaagttttaatttatattttggttctataagtggacattttgcgggggggttcgagacagggtttctctgtgtagccctggctgccctggaactcactttgtagaccaggctggtctcaaactcagaaatctgcctgcctctgcctcccgagtgctgggattaaaggcgtgtgccaccacacccggctaagtgaacatttttttttttttttttaaattaaagggtttttttattattattatttttttaagacttatttatctttattttttatgaatacactgtagccagaagaaggcattggatcctattacagatggttgtgagccaccatatggttgctgggaattgaactcgggacctctggaagagcagtcaatgctcttaaccactgagccatctctccagcccctaagtgaacattcttaaatggaactcttctgtaagaatatttttaaaataaaaatttgccaattatcagatctatacaaatccttacacaaaggttttctgtgtaatcctcagtaatgcaaacctttataagtattccattcttactgtcgatcttcaa

SEQ ID NO: 23834 - DNA, 1197 bp, Mus musculus
cccttgtttcttggaggcagagtctctctgaacatggagttcaaggttttctgtaagctggcagccagtaagcaagccccaaatgtcctcacatccccgcccctcagtgctggggctacaggggtgtcaagaaccatacctggcttttatgaagtacagaggatccaaactccagtcctcatgcgtggacagcgtgcatccttaaccactaagccatttttctagccccaactttattttaagatgaactattacagggggattgataaatttttatttaatttagccatgcacatgcttttaatacgggactgatgcaggaaaaaaatgtgagtttgaaggcagctagctataaccaggtgttgattgttagaggtaggggtgtgtccaaacgtaaagctcattcatcgacattacttgtattagtcaatcctatgatgactgggactctgttgtgtgttcttcttcaaggacctgagggagcccacgtggaagcagtggagagaattcctcgtcaagtactcctttcttccgtaccagctgatcgcggagtttgcctgggactggctggaggtccactactggacatctcgcttcctgatcgtcaatgccgtgctgctctctgttctggagttgttctctttttggaggatctggtcgagaagtgagctgaagtaagtgcctttcagtggtagatggttggtaaggaaataccaatgacgatggtccctttaaagtattttcagacctggcatgggggatgaggttgcctagcgcccccatcaggcagtctacagtgactccaacctcagagcatctagcatcctcttctggcctctgagggcactgcattcatatgcaaaaacctatacgcatatacatataactaaaataagtgaataaaaataaagtcttttaaaaaaattctaccttggctcctcaggctctgatttgagaaatactctttaaacagcaaataagaccgtgatttgtgtccaggaggtagtcttcatttcatatagtggtttggtttgttgattttctttggtttctttgttttattttgctagagatggggtctgtcttaggtttctaatgccgtgctaaaacactgtgatcaatgtcaataggaaagctagtgtggtggtgcactttttaaatctcagcccagggacctcagcactgagaggcagagac

SEQ ID NO: 23835 - DNA, 1965 bp, Mus musculus
agtgtttcctcggttgtgagaacaggtgacagggcagacccctcggcacccagcttacccaagcccaccgtccaccactcttctttcttttcaggacagtgccccagaggatgtggagccacttctggaaagtatcgacacaggggcttttcatggccatgttctggccgcttattcctcagtttgtctgcaactgtttattttactgggctctgtacttcaacccaattattaacattgatctggtggtcaaggaagtccgacggctggaaacccaagtgttatgatgggcagcaaggcccgagcgagcccgtgaatctacctgacaaccaagctgtgacattcaaagagacaagggactcgtttctacccctggtaatgcgaggtgctgcttctgtgtgtcaaggcttcaaccaggtccctcttcctctgactctggcaccatgccagctgactgctacccaggtcagattggactcatggtcaatacccagccagtcttcttacagggacttgagaggctcaggctactatgaccaatagaagtgaaagtcttggtcataatttggggtgacatgctgtcaaaaggctaatatagactgggtgtggtagtgcacaccttgaatctgagcactaggaaaacaggcaggtggatttttgagttcaagaccagagtggtctacagagtgagttctacaacagccagggctacatagaggaaccatgtctctaaaaaaaaaaaaaaagaaagaaagaaaaagaaaagaaaaaagaaagaaatcaaaacaaaacaaaaagaagaaaagataaaaaggaaggccattatggtcagtagccctaacctcactaactgacatactcccaaaccaggcttcttgggccaggtctgtcccatgagtcaaatttaggaaagcaaggataggttttgtcatagatatggatagttggacatacaaaataaagacctagaatccagtcatagtttctcactgaatagttggtaggtttcagaataaactcagagaaaacttcaggctaagagacagtgctgcgtagctgtgttgtttcctgttatgagcattggaaattgggttctccttctgtgagcatggagttgaatggaatgcccaccaggccgagtcttcttagatgactgagcactgcttgatgttgtgttttgaataatttaatctgtacaataaatacagtataggctgatcaaggagcattttgtaagctgccctcacactatataatggacaatctttattctgttctttagtataacagcaagtataattatgccgagtcctgccatcataagtatggagtaagctaaaggatgaccgttatgcccgtgtagacatagtgtactcagcagatgtagaatgtgagctcatcagccttggcctggctgaaacaggcttgcatccaacgtgagaccgacagacggacagacggacagacagaatgtatgggtgagagagagacagagacaatgggagagagacagaaggagagagtcagagagacttggtaattcattaactctttgtatctcagagtgaagatttgacttaaactttgcattgaaagtttggaaaattacttgaaataaaaaaagatttttatacaaatacaacctttatagagaaatctgattgctaaggaaatagaaggggaaacctacattgcttgatgtgttataacctagtcatgttgagtttccagctctgtgggatgttgaaccagggtggttgcttagagatttctacaggaagggacgagtctttcctagttttctcacagaaccccagggccacctgactttgtaagacagcagctttgtggctcaggcacactgtagtgacccctgctcttccttcccatgagtaggtaggggctggctgacaaaggtcattgtactggtactggcagtcataggtttgggagtgcccaggctag

SEQ ID NO: 23836 - DNA, 1213 bp, Mus musculus
ccagtctgtcaactccctttcttgtagaagctggctgtcattgctacctcttcaagtggtcttcaaatgggaaattatcacatgtcacataaatgcaaactataacccgtcctgcctccagcttacactcccctggcacttattctcatgtgcctctgagtctctgctctaacctcagtttccatacttcttccaggaccagcagagaacaaatgccaagaacttttgtgcaggtgtgacgaggagctggcttactgcctggcagggaccgagtaccacctgaaatacctcttcttcccctccattttatgtgagaaggactctcccaagtgcaattgacaggctcacatgtccctttgcacatggaaacgcacttcactttcagtgatcaccaacagcatgcaatttgtgcaggagagtcaccggaggccaagtgctaaagccacctgcgtttgctttctccttccattcaggaactcacaactatgagcctgtggagttgccagtctgatgaaggttcaaagtcctgggcctgttttatacaaatagcgctgtgttgggcgtggtatactttttgaaattcagcctttatgagaagctgtactatcttgtacctgctgcagggctgctggtcagatgtgggtgaacacctgcttaggcttggctgtggtaataacattgccacatgatacatctaagaattgtaactgtaataaaaaaatgttccctaactggctccttgtgtaagaggtaaattttatttcccggaagctgggtgtggtggcacactcctgggatgtctgctggggtgttctgctgaggttgaaaggtcagctgagcccaggaggctggtaccagtgtaggcaagagagactttctcaaagaaaaagaaaattctttcctgggctggtggtactgctgtgtgtcaaaacatttgtgaagcgtgtttaaggtcctgagtttgagtcccaacatttcaaggaaaaaattaaaaaaaaaatgtagaacaacagatcaaaccctaaaaactgaaatcgcaggccaggaaagatgctcagtggttagcagagcttcctgccctcccagggaacctgagtgcagtttctggcctgcatattgttcggctcaactgcttttgctctggttccaaagaatgtgacatatctggcttctgcaagtacgtgtctgcacatgcttacttgcacaagtgtgt

SEQ ID NO: 23837 - DNA, 1234 bp, Mus musculus
gtcacacttctcctgtggggactttggggggcggtaacttcgacaggagccagggttccaggagacatgagggaatgtctaccgtcccatgtaggtgaattatcatcactaggtattgggggttccacacctcagctcgactggagaccagactgtctgtgcatagcccattgccccacactattgttattatttcaattatcagtgcacttgacttcagtatctgcattggattcccttgcatgcctttagtataacctagatggctcctcacacctaatggccaagaaggtcattgggttgtccaggcagaaggcacaacccagacccaggaaggaagggaagatttccagggtagttggggctcagagttacaaggaggcaggcaggggtagataggcaaagtcagggagagtctgggcagttatgttcagctggtacaatttttctccgggactggtactgtgagggacagtgtgtccatcagaggacactagctccttgagaatctttgtcagatggcaaggctagcagaattcccgcttttacacagctatgatctgcccactctcaccttcaggtgctgctaccaccacgactgctgctactctcgggctcaggacgctggctgcagccctaagttagaccgctacccatggaagtgcatggaccatcacatcctgtgtggtgagtgccctatgccgtgtgacttccccaagtgcccactggacatcctgcagatcccaatggctcctgtacccttgtggtaaggtaccactgcttgtagctatccacagaccacataataacgtcatcgaacccttgtaacacacgtactcatgtaggtattcagtgtgtggaccaaaaggagagaaagatactaggtgtgaacaacctaaaagtccataggaggggattggcgatgtgttcatggtgcagccaaactgtagaatatactctaagctggacaaaggatgaggcagaaccatttgagagcctgactcaaacaaaatatcaacaataaaaccagccaactaaacaaacaaaagaaaattaaaaaaaaatctaaatatagagctggtgatactatgtaattttgtcccttacctccctggatctgagggtggagaccgaggccttcttccttccctaggtctactactgatccagcatgccaagtgctaggattacaagtatgctccacctagcctggaagtaagacacttacctttaa

SEQ ID NO: 23838 - DNA, 1187 bp, Mus musculus
aagctgcccgggctagcactgggcgcaaacgcagaaggttcagcaggtcgtcgtgcgcacgcgcagctcccttggcccgctccagtttcctggtgtggagcagaatgccgcttcccgccccgccccttgcgttgccatggagagtgtctaaagcccgcctgtggcagcgccctgggcctggtgtcctctggcggggtttgcgtggaagatgttgagcctctcggagcttccgcaaaagaacacagacttggcggagatgcagtccgggcccttgggtcgctgcagtcactttttttggctgggcgtcgccttcgacgcggtgggtgtggcagtgctgttcactggcgtcttcgccaacttgctgttctacgacatgctgctctatttgggttccatcatcatcttcgtcagtctcctgtggtggatctcctggtacaccggcaacatagaggcgctcccggaagaccccttgagggggacttcgccccgcgagagcggggtgcaccgtagcggcagccgtcgcttctcgctgacccttaggagcgtctccgacacctttcagcggattcgccggcgacggcggcggcgactccacccgcgggtcgtccagcggatcagtagcatcagctctacggacccggggcagctagaaaggaactgcgacgccagaacctcgggtggcagagcgttgttccgttcagcgaagcctgaggctgttctgaatcagtttagcagagtccagacctctaagagcctgcctctgggcattgtccacaccggtctttccatttgtacttctaggagtcaacctgtcttttcagtgacttcgcagacctaccctttggcgtctgacagcaattctcagatggcaatgtcctctgacagccatgtgtatttggactctcactctcaggagcactctaaaatcagtgtggcctctcagatctaccctctggaacgagaagaaagtcagagccacctcttggtgatccctgacagtttatctatggtacccgtgacctctcaaagccaaatcctgccctctgtatcttctgaaagctgtgtgcctttgggccctcactctcaggggcgctctaagatcagtgtggccactcagatctaccctctggaacgagaagaaagccagagccacttcttggtgatccctgacagtttatctatggtac

SEQ ID NO: 23839 - DNA, 1531 bp, Mus musculus
ttgctgtttaaatatatcatctaaataaaacgttttgtacaatgtaaaggtaagctttgaatgcataagaaaagttgggtgactctaaagtgaaaatgtgggacctgagctagctaatttactttctcttctcctctttctctttcctctcccctctcctcttctctttcttggtgctgtttttgtttgtttgtttgtttttgttctttgtttttgtgacaaagtcttcctatatagccttggctggcctggaattcactatgtagaccaggttggtctatgtagatcaggttggccttgaactcatagagatctgcctgtcttcctgtctttgcctcccaaatcctaggattaaaggtatgccctttctattaacagagacctcatgtagaccaagctggtctcagccctgatcctctcccttctacttccagagtggcaggattacaagtatgcactgccacccctagctgagcttattttttctttgccttttttttttttttctggggtggggtgtgtgtagggtctgatgcccttggacagaagagggcatatgatcctctggaaatgaagttagatagctgtaagcccccacgtaagtgctgggaatcaaacctggatcctttggaagcgcagcctgtgctcttaactgggcatccatctctccagttcctttttttttttttttttttttgcatttagttcaataatggaaagaactgaatattaggcagcagttattatcttcttacaacttcctccaacactcctttaagaaatgtatgtttttcttctctagaaatagacacatatattctgtgaatcttttgttattttgagataagagtctctacttagccttgggtatcctggaactcactgtttaggccaagttggcctggaaccaacttgcagaccagactgggcttgaactcacagagttctataaatctttacaggcattttggctacttgaattttatacagtttgaacaactgaattctataaataaatataatatttgatttataaataaatatatttataaatatataaaatatacccaatgacttatgtttctattaaaagagagagaagctgggcatggtaacacatgcctataatcctagcatttgggatgcagatgcaggatgattgttgaaagttcaatgtcaatcaaggcaacctgtctcaaaaaaaaaaaaaacaaaaaaacaaaaattaaaagtagggggcttgggccctagtggagtggctcagtgacagtgtttgcttgcctgatacaatagtgtgtatgtgtgtgtgtgtgcccatgtgcccacgtgtaaactatatatgagcaaaactaattttaaaagggaaaggctgggttggatgtggtggtgtacacctatagtctcagaattcatgaggtagaggaaggcagtatctctataatttggaggccagcctggtctacaaaagcaggttctaggccagccagggctacatagtgagaccctgtctcaaaagcagaagaaaaacaga

SEQ ID NO: 23840 - DNA, 1281 bp, Mus musculus
gtagcccagtctggccccagggtatcctaagtgctggggttataggtgtgggctgctacacctaatgtctaattcattgtagttcttgtgtcatggacagaatccatttcagaaaaccttttgcgttgaatgcttatacacacacaagaattcccagggaggctgcagatggagcttggtggcagtgcttgcttagcacccctaggtcctgtgtttgatcctcagcaccatagctgagtaaaagaaagttatcagaagttagtggtgtgttactaaggagaaatgctggtggggatggcgactagattgactaacttagcagatagagatttgacgactgcagtttagaaacttttctatttatgtttttacaataaaagttttgtaattgctgttttgcttatattctgaaactctgtgctgaattcacctttttatgtctcatgcttaggaatgttatgttcataacttattaaggataagtttatatttcccaactttgaggcgtgaaattctggagcttgttattgaaaagctactcaagttagatgtaagtatcaatcagatcacctatattttttcctctatttttatgggattttatgactacgtatttgtatgtggagaacagtccagatctttgcttccctctcgtcatacttttagaacttggcctgttttctgggaactgtagacagctcagtctggggttagggacaaggtgtgaacagtcatcaaaggcagaggtgcactgtgggaagtgctgtgagctggactgcctgacggggctctgtgtaggatgtgctgtgaggacggcccagaatgaaatgaaatgagattctgcatcgatttatgtttgaaaattcttatgtataatatatggaggaacaggtcaggctttgttttgtttataaagaaacaaaaagggaaaaggctgtaaaagatacatattccagtttggacaggtttagttgcaggtaggggctagttggagagtacttactgtggtagtttgaataggtatgaccctcatagactcatgtgtttaaattcttggcccatagggagtggcactattaggaactgtggcctgttggagtaggtgtggccttgttggaggaagtgtgtcggtatggggggcgggctttgaggtttcctttgctcaagctcagcccagggtgggatacagtttctttctgctgcctgcagatcaagatgtacaacttagggctggagagatggctcagtggttaagagcactaactgctcttccaaaagtcc

SEQ ID NO: 23841 - DNA, 1111 bp, Mus musculus
cagatgtgtaattggtgtaagttcttttgccattctgtggtcttccattttgtcctttgctgcacagaaggtttttaattccatgaagtctcatttattgttcttagtgcctgttctatcagtcttctcctgtgccaatgagttcaagattattctccactttctcttctattgcattcagtatatctggccttatattgaagccttgattcatttgtggttgagttttgtgcagggggattaatagggatttatttacattcttccccattcagccatgcagccatccagtttgacttggccagcataattgtagaaggtgctctttttcccagtgtatagtttttctttttggtcaaaaatcagctgaccagaggtatgtggccttcaatttgattccattgataaacatttctatttgtttgccaataccatgcagtttttattactagctctgtagaaccctttgagattggggatagtgatacctgcagttcttattattcaggattgttttagcgctctctctctctgtctctctctctctctctgtctctgtgtgtgtgtgtgtgtgtgtttccatatgaagctggaagttgcccttttaagttctgtggagaattgtgttggatctctaggattgctgttgtcactatatttgttctactgatccatgagcatgggagagctttccatcttgtagtattttcttcagcagtgtcttaaaagtttttattatgtgagtttttcatgtgcttggttagatttaccccaaggatttcttttttttttttttttttttaattttaattaaaggcatgtgctgccgccacccagcttcttttctaactttgtttctttgtttctttctttttctttttctctctctctcttttttttttttttttggtttttcgagacagggtttctctgtatagtcctggctgtcctggaactcactttgtatcccagtctggcctcaaactcagaaattcgcctgcctctgcctcccgagtgctgggactaaaggggtgcgccaccacgcccggcttttttttttttttttaaagatttatttattatgtatgtgagtacactgttgctgtcttca

SEQ ID NO: 23842 - DNA, 2569 bp, Mus musculus
tggctgtcctggaactcactttgtagaccaggctggcctccacctcctgagtgctgggattaaaggcgtgtgccaccacggctgagatctgagttcttgttgggtaggactttgcttgctccacaaacagaaagtgatcctagcagagtttcactacccagccatctgctcgttagccaccaagtacagatccctcaaatgttcactgtagagtctgctcttgttttgggatcctcaggcacacacagacttatatctagggggtttggttcattcctttcacatattggtccaagctcaggttgccaggcttggtggcaagcacgctctctccatcccatgaaaactttccagaccaacactatgatattctcactttgttctctccacaggaggtagtggaggatgaagatgatgactttttgaaaggcgaggtgccccagagtgacacagtgactggccttactccgagctcctttgatacccacttccaaagtccttccagtagtgtgggctcccctcctgtgctgtatataccaggccagtctccactcctcacaaggatctatgattgagctgcgcaattcttcccagggccctgtgaccctgtgttccaccccgaccccacactggactagtctatgcctcatgtgtccagcttccatgttggacttcgaccagcatctgaagggaaccaggttgtgtgtgcttgcagtttgctccctgttgacatagggaaaaactgagtgtcataggcagtatttcacagtggacatttcacagtatttcacagtcttgcctgtggcctgctggctgcatgctgtatcagccacaacctggcaagtggccttctgacaggtttctttttattagaaccacagttttgactttgttttggtaagctgtcctccaggatcagcactgcctgtgaatactttgaactgtctcctgcttacaggggtgtaatggtttcctttgactagaagtctatttgtgttgtggggtgcgtggggagagccaagcaggcaaagctgaacatttgggcttcactgagggacaccaagggctgcagaggagtcaggcgggaagagaggagtcggagaagcacacaaggtccttgtgcaggagtccccagagacctagctgcagctcaggccgactgaagcaggcctgggggtctgtcgagcattccacagcctgcacaacacggactcagccaggagagctgttttttttttttttttttttggtttcttgagacagggtttctctgtttagctctggctgtagaccagctggcctcaaactcagaaatccgcctgtctctgcctcccgagcactgggattaaaggtgtgcaccaccactgtctggctcaggaaagctgtttttacactgaacagccagccttgctctgtagcaggtgtgctcgaggactgtggacgttgacttcccttggatccttacatgtaaacttgcgtgtttgtgaaaatggccctttaagtatatttaattttttgccacatatttatttaaaggcgagcaatattttcttggtcacaatattttttagtggaattcctctcaaggtttttatactcctgtgtaataagactgatgcagagccctgaatttcattctgtctatgaatacctttttgaacaaagaaaattttattgatttaaaaagcttttatatgagacagacaagtccctgagttccaggccagccttggtggcaagtcactaggaaacttcaaggtctgtctcatctttattttactgtgtgcccctggctgtcctggaaatcactatattgctcaggctggcttcggactcagagatctatctgcttgcctccaacatttgagagcagagagtttgcaccaccacttcccggttcaaggttcttttaactgctaactgaaaatggaatgaaattgcatccatagatactgatgggatgccaggcttggaaagtagctagaatgtagaaggtatgttgacaaataagcctcttaggttacaaaggagtttggggggaaaaaaatatccattgtgaaaatgaaagtacagcctagctcacctggggcctccctgctcacaccaatgcaggtttcaataaagactcagccatgcttccgtgactactgtgttgaattttagccgcctgctcctaaagggagtgggatggttagaaacaggcattggttaagatgtttctcatgctttgaacaagcctatacacttcagagaaattgcgtgctatctgggcatggtgatacactttctgtaatttcagcatttggaggttgaagtaggaacatttttaagttagaaccagacatagtaagatgattttaacagctaaacattttgggaagaaattagtgaagtctccttggaaaacagagaattttctttttcgtattgaggatgaaaaccagggtcttacacatacatgcacccagaccagttgtcttagggtttttctgctgtgaacagacaccctgaccaaggggactcttataaaggacaacatttaattgggactggcttacaggttcagaag

SEQ ID NO: 23843 - DNA, 1195 bp, Mus musculus
gaaaggctctgaaaagacaagatggtggatgtgagaggaccaggctgacctctcattcaacatcagagtagccttgggctgcgtacacatttactgggctagtttcagtgtggtgtctgtacatctggggaaacacacactacattgcttactgcttcacctgtataaacagctgccaggatgtcactaatcccccactgccgtaaaggaaagagacactgccagtggcaacagatagtcactctcacccattgaggagaagcagccttagctggtctaacctttttttcttacagatgggaaccagggtgcagagacttaaggtttagccgacctgtaaactctcacctctaggatttgcttgtcatcttgctgcaaccagaaatccacttgtgggaatggcgtccaggaacacgggcctattcggagttgttctgtctttgcatcataaatgctaatcatctaaaagaaccatttccatgacaagctgtaaggacactgccctaccactgctataggctagttccaaggttgtctgtccccttagctgataagctgcgcacattgacctcccgtaacaacaaggctgccaccaccaaatgcttccctgtgcactgctgtgtttacttttgatggcaagcctacaagaagacaacatgctgtcctctcaaggggaagctgatggtgagaggtctcaggtcacatgtccagtgagcagcagcagggcctcagagccaggtaggtctgactaaagcctgaattcctcatggttacacagaataccacagctccttattaccaccccaagcaagtagtcatcatgtcacataaaagagttcacagtgcccaagacagacagctcatacctgccatcaaacactcaggaggctgaggctgacccagagaagagcactgtgggttccaggacagcctggatgacagtgaggccttgtctcacaaaaggaataaaagaaaggtctgggtcttttgcttttgttgctgtttgtctgtcttgtttttgagacagggactgactgtggtagaccaggctggcctttaaactttgggatcttcctgctttaaaagtgtgcaccgccaagccgggcgtggtggcacacacctttaatcccagcacttgggaggcagaggcaggcggatttctgagttcgaggacagccagggctacacagagaaa

SEQ ID NO: 23844 - DNA, 1099 bp, Mus musculus
taactatacatctgtgttcatcataccccacccacagtctcgtctgaagaaatacacactcttagatttgttactgctgtctgatgtttttaggtatgagcatgcgaatgatgatgacaccagtttgaaatctgatccagagggggaaaaaatacacactggacttctgaaaaagttaaatgaactggaatctgacctcacatttaaaataggtaagaactgcttttccaagtcactgtgaacttaagaagaccgtgtctgactggcttaaggaagctgctttgcatcaccatagaggtgggcgattctggttttaggaccagccagaggtgaagcgtctctcagagtaacgtcgccctccctctccagctctccagacttcccttcctctatcagagtgatcttcctcttcctagggacgaagcccctgtgacagtctgggcctccatctgctctgaggacttaggagctagccttgcatgtttcttccctcaggccctgagtacaaaagcatgaagagctgcatttacattggcatggcaagtgatgatgtggacgtttctgagctagtggagaccattgcagtcacagcccgggaaattgaggagaactcaagggtctgtaagactaatcagagtttcatgtctttcctgagttttgcaatgggacacgtgggactgtatgttcatttctttctttcccaaatgttggtcctatgctaagacctgtgatctaggggttatgccaggcattgggaatgctaggaggccttttcacagttgctgcctgcccccagtgacctcaccagacaatgtggggaaagagccagcagtgtgagcaagtactgtggctcaggatagctgagcttttgggaacttgctcaccgctgcagtatcctgaggcgagtcttcctaactaaaaggagctggtcctaaggacaaacagcacaagtgtgtcgggtggcaaggaagactagcctacagggctagaggacaggctccaaccaagccctgtctgagagcagacacacgaatgagcatgctgcagttcactttggggtaaggaagggatgaggagttttgagaaggccaaggagctg

SEQ ID NO: 23845 - DNA, 1192 bp, Mus musculus
cccctcagcatatatctaaaaaacttatttatcaaactacagagatacctgcttggccatattcattgctactctgttcaaaacaactaagagatgaaatcagtctaagtatcagctaatgattggataatgaaattatgatacacttacacaatggaattctattcagctgtaaagaagaattgctggctttctgccggcaggtctaggctgagaggagagaaccttgtccagccaaatccttcccgagctgaagaaggatgatgattgtctcagcccaaaacaaacacacccagggctgggagtctgtcaaagtagggactcgttttattctatcactcttttgttcatataggcttgaggaaggaagtgggcatttttggtgaggtgagatgacatagggggtggggaagagtgacaaagggtatggggtgagatgatgtatgggatggtatgagatgatgaggagtgtggggtgaccccacggggcctataagaaattgacatatcagcggtagctaggcagaggtaggctaaagcaggtcgtgtacggaagtgaacaagacaggtctctaaactccagcaaaggctcaggcttcctcaacaggcctcagtatctggccaaataaggcccaacatctcccccttttttttctttttatgagcagatcacatggctcctgtcttaagttgtcctccgcctgggaatcttatctgtctctggataccatgtagcactctggctcatggagagtgatccatgtcttaggtctgaggtcttacctgtcattggtcaagtggagagcctgagagggtcactcatattctgagggctaattatatgttggcttccttggctcttgggacttgagcctttgatactgaaccttgacctgatgaagcctaattacctctagacgctgttggaaggattgtgtgatcttgccccaccatgagagggaggagaaagaggaagggatcaaggaggggaagtaggtaaggcagaaagccatggaggccagtccacagtgggttgtcttgaaactcctcctctaagtcttcttggatcattgactctccaatcaatcttttggaggatcttcattgacactgacagggatatctccgttcttttttcttgataaatctgtggaggaagcagaaggagggctctcagggtttggaatttcct

SEQ ID NO: 23846 - DNA, 1336 bp, Mus musculus
cactggaggacagcatatacgggactctgtgcctttctctgggccaccttcctatgcttttcacagcagagcggcgatggtacactgcagtccatattcatcttccttcgcaggaaggaggcgagtgataagtccccagagaagtgacgagtctggacttccttcctaggactcagttctgtttcttcatcggtctcaatcactggcagcaggcctgcttcactgaccagttacgggctccatcatgaggacattccataggcccacttgatttgaaattatcaatgattattttaacttttatccaaacctttcccagtcattccagtctgaaaggcttattctctggtattttcacatctttaatgctttggttaaaaactataacagtgacatgtgacattttagaattattaatatttccattctaatatatggccaattgaatttaaaaaaaaaactccagtttagattgtatttctagcctaaactctcaggctgtttcctacacactgtgaaatctgattatcttttgttcttatagtaaatttctatgcatataaaattcagtcatgaaggttgaataatcagataatttataataacccagataatttataataattattgtgccaacattaaaattctgtaagtagatgtttttaatcttcaaaggaggagtagtgttggatatattctgtatagaataccttattgatactgtctactttttttaaagaaggatctcaggctgccgtggaactcactagataccccagcggggcctcagctctacaagtgctgagattacaggcatgaatcatcatgtcttactcttctgcttttatattatatatatccacatacaggtttttaaaattgatgtcttctagctttgagaagatacagttgaccaaatgcccttattcctggatatatgaaataaaataattggtttctgaatgaattacagcaaatgaaaattctagaaaacgaatcatttctttcctctctaaggaagaactctaattcacactagaccagtctacacagtttgtagcaaccctcctgcctctgcattctaaatatttggattacagacatgagccaccatgcctggctttgtgtgtatatgtggtatttaagtggaaccaggaccttacacaaacaagtgctctgccactggctgcatcccaggatcctaatagtagtcttttataattcagtgctttaaaattctttatctttacactttaaaatggacacaaaaattctcaactagtctttcacatttatttagtttgcctaatctcagccagagccttcaggtttcaga

SEQ ID NO: 23847 - DNA, 1158 bp, Mus musculus
tgattcggtccaggactccagctcagggaatggacctgctcataagtagatgtaagagccaaagttaaccaggaagttccacttgcccagggacaggataatttccgggaacactacagcaggtgtgcttgatcccgtgtaggtgggagggacataggcaggaaatacatcaggatgtgtgcttgtccctgattgagcctgatgggaaatgcactgacttatggattctgctgttttaagcccctacaaaacataaccgtatccactccctgggaccccagggtggacctgaccagggtctatcctagtcggtatttaattaattaaagccttgcttcagatttggctcaaaattgtggaactagtttttctcttgagaatctcagtattaaccacaattgaggcagattttccttcccatatctgtttatctaatccacatagtgcctcacaggcttgctccgaggctagtttcctacatgattttagtccaggtcaagttaaaagtagtaactggcacaattcttttcaaatttgcttttttttcccccttttttcttttgagacagggtctcaggctgcctgggaacttgataggtgactgaagtcagccttgcatatatgatcctgtttctactttctggcattgagattaaagcacactctcacatgtggtttataaggtgctggaaatgggctccaggctttggcccagctacgaaccaccccaactgagctagagccccagaccttttcctaatgtatcaccacttagtgcattcatagagtggggcaaacattagctgcctcattctgacacatttgttcaaccctaaagaaaactgctgggattacaggaaagagatcttctctatcctattgctaggttcatgactgacagcccaacaacaagtgatgataacaagagaaaaggttaagaatttatccatatgggttgaatatcccttatctggaacatctggaaccagaagtattttgaatgctgattttgaaatatttgcatatatttgcatatgcacaatgagatgtcctggtgatggggcccaagcctaaacactaaattcaatgtttcagatcttccatatacatacagacaaatcatttactaccatatttttagtgtatttctgtatcgat

SEQ ID NO: 23848 - DNA, 1103 bp, Mus musculus
agacagagacagggtagggtagggagaaggtgtgggatgtggagcatacagagggtggatggagcaaggggtggggaatggaatatggagtgtaggaaaataaattaaaaataaaattaaggcggggaatggtggcacatgcctttaatcccagcacttggtagtcagaggcaggtgaatttctgagttcgaggccagcctggtctacagagtgagttccaggacagccaaggtacacagagaaaccctgtctcaaaaaaacaaacaaacaacaacaacaaaaaaaaaaaaaaaaccaaaaaagcaaaaacaaaaaaccaaaaaaaaaaaattaaatttaaaaaaagaaattaacaagattgaagctgaagaccttgagtgcttgctttttgcccattgatcagataacattagaactatctgcactatctatgcagcatggggttattattatttttacctaacgatgtctctttttggtaatgagaagcatgtttttgaagaaaaaaaaaaggcctggtttttctcaatacacctttaatggtttttaaattgtttcatatctggtcaagttgagatttttaagaacttcatttttaatttgtaataaagtttacaacttgattttttcaacaaagtcaacaaactgcaagcatctgttaataaaggtcttaaatattaataataatagtaataataataatagtaatgaaagtgccccccatgggccagtcttagaggtgggccattcaagctggcagaaggtcttgagtttgccagagtagattttgtgaagactgagaaatgctcttctaaaattccttaaaatgatgaacagttcaagggggtggacggtggattactccaattctatcacgaagtccaggacaaagaagacagtgatcagaaaaagcaaaagtaagactggacattgaaaaatgtagacagaacatgtcaaagagactgacagaaaaaacaaacaaacaagatccccagccaaaaagaggccagaaagagctgaagcagccttcatcctccctagactgggagagcaggtctgcatccagtctctttcaagggtcacaagaagcacacaaaaccag

SEQ ID NO: 23849 - DNA, 2395 bp, Mus musculus
ttttaaacttttagataaacatgttcttcctttatttctcccacttatttgaaagaactcttccattaaggaatctgtaatatttcaccaaatttttctagactgttgtgaattgtggtggttgggaagaaattcgcagagatcactcagcaggaagtggcttgagtcccattgagcaatctccatcatttgtttaagcaaatggatttgtggttgttcgagaagccaagcatgcccatgagcctgtgggtcacacactggggaatgagtgagtggcaggagagccatttttaggctgacaggaaagttcctggcttctaggtgacttgttggtgtgccttgttttttatgtaactatgtctggttaaccagtgtagcttcatcccatttttttaaacatttgcatttggggattccatttaagagctttctagaaagttatttcatgcttcccttctctgtctgtcccagtttgataaggataaggttaaggagaggagatggcctcgatgtcatgtatttaaagtcagggtttaaatgacacattgtgtgttgagaggtggcaatggtaagagtctgatttttttaaactatgcattaaatgtataaattgtaaatcagctgaagtgcttcaagaggcgtgggttagatactattgccactaagaagagaccagagttctatctgtaatgtgaaggccaagtttgatcagcctatccttgttcttgcgatttaaaagttggctgtaaatctgggaagctctccatgtgaagatgtgtgtccatgttagttcatctggacgtctctcaatagtgtgtggtcttttctgtcacttctcactattggaagcgcgtttgggtttttgttttgtttttttgtggtgtctgatgttggcatttgagaaaagccagcctttgtgggcactgccttgtggaatggccttctctctgggtgcctgaggtatccacttatgagtggcctctcacccgtgttagagagacctgacatttacaatggattgtatctgttgggcgaaaaaggcaaatccattcatgagcagaaagaaactgttggcacacagtcttccactagttagatgacttctttggtgggaaatgtttataatttttttctagaaagccagaaaatggattctgatttcatagccagcattttgataaaaatgtcacaaaattaaaggctgtagagagattttttttttacaagttgatttttttttttttttttttttttttttttttttttttttgccaaaatcttttaaatgaagccattgattcccagttcttagtaatatgacctgccccggatgagctgcactggaaatgttgtgcaggcttgccactctttctgtgcaagcctgaaggtactttctgtgcaggcctggaagcacttctttctgaggcctgatagcacttcctctttaaggcctcatggcacttcctctgcgattttagtgcataggaagcaaaatggcacatgtgcaatttctttaaggcttttaagccgtataatagagttggtgttgagagtgtgagttgccttatttgcagatatcctatggctaagcctgcctgctcagacttcaggtttgcaagcatagagggattatggatttgaaaacactagatgccactaaagttacttggagtcatctcaaaggtcaggttctatgggcagcaaagaatagttgtgtacagtgaacgggtatgtgtttgccatttgctggagttgcccatatgtttggagtgtgtgtgactaacccttactatttaaagatgtgaagacttgattggaagcacgctgagtgtggtgtgcccacagtggccagtccaatcactatttcatcatccagaggcttagataatgatgctatgatgtatgcacgtggagatgatgagacactttttctgcgtggaaggatgtaccagattaaatttatctgttgaaaagacaaaagttatcaccagaatcccctttccatcttcccatcttatactgtttgcttttgatgaggcttgggggacaagtttttcttaactgtctactttgtttgaacatttttggggggtggagggggcggggaggttcaagtgctgtttgtgtgttgggaccaaacagttgtcaataaactttatgagcaatcatctgtaatgagtgcttttgtttgtgggtgggattataaaccagtctagtcagctcattttgggtgaccttggcttttcatctctccagaaatattatgcatttaagctggagttgtgggtagctcagttggaagagtgcttgcatggcactcacaaagccctgggttcagttcctggcaccatataaatcatctgtcatttcagcactctggaggtggaggcaagag

SEQ ID NO: 23850 - DNA, 1208 bp, Mus musculus
gggccgaggcggtaagggagatcattcatcagagggcattgcatcactctgggctgcagacaaaggccaactcgagacttggtggccttgacaacccacagtgctctatctaactccctactgaaccctgcccaggcattttacagctattagagtgtgtcacagagggctggtgagctggctcagtggggaggagcattgactgctcttccaaaggtcctgagttcaaatcccagcaaccacatggtggctcacaaccatccgtaacgagacctgatgccctcttctggtgtgtctgaagacagctacagtgtacttacatataagaaataaatcttaaaaaaaaaaaaaaagaatgtgtcacagagacagtgctccagcagctgcttctcaccagatacactggttaaagcctgctattctgccagcactgcccttttccttactctcacttacctttcatcccttcagctttccagattgctatgctgcggagtttggtgacctagaaattacgcaagacagccacaagggtgtccccttagagcacttcatcacctgcattccaggagtgaacattgccactgctcagaatggcgtcaaagtagtgaagtggattcacaacaagcccccacctcccaacactggtaggtgggccagggtcagagattgagccctaaactcccacctgtcttctgggaggacaggaggaagctgtgggtttgatttcaaacagcagcaccattttcaccagaatgtctcctccaatcttaaaactccccagatgttaaggacttggtagaacctgacttctgaagataccaaaattgggccagcatgctggctcagagaataaagacacccaccatgaagcctaaaaatcttaagtttgaacaccaggatacacatggtgggaggagagagccagctcccatgttcatgagtgtacacacgcacacaaacacacacgcacacaaacacagacactcgtccttttctttgactctaatgtgtcttccttcttcggcttgcacttctgtttaaaggtagaagagtaactggaagcctggcctgagtcagcagctctgggggaggcctggacagaagctccttcctaaaccttgtcctcctctctcagtcttaggctgctcggggcagactccacgggagactcagcctctctctgtgctgagtccacaaatcccctc

SEQ ID NO: 23851 - DNA, 1100 bp, Mus musculus
attttggtacataaaaaccaggcctctgaagccttgttacatcatgctaaccagctgatcagatttgaagagttcatttctgatctcccccctcggttaccactgaagattcctgtgagtgggtttctgttgcctttgctgttttctaggtagattttggagacagagagactgcctagtccaatggaaagcatcacagcctactgcagccttttgagcctctctcttatctcatttgttttgaggacttccaagcttgtggctttacttcagagataggcacttgccattgtccccagtgctagagatgctttttcatataaaatggatggaaaagtggaagaagcatcgttttgctcccaggtattatgggtaaagagcatggcaagagctcacattcttgtgtgtctgccttcagatacgcagaacaatcgtgcatctcgggcgattttttttttccctaagctaccagaagctgtgcttgtttcagtatgtatcttgtcgtgcatggggccactgggtgttgtaggatatgtatattaggagagtgtgaacacattcccaggctcaacattttctagaattgatttgggataaggatgattgccacagagctgagccatgtgtatactgcttgggggaatgcatgtgtaactctgaaagaaattctagcagtgataggaaagacttccattcttccattccaggagaatgacagtaatacattaaatgcacttttaatatataatttcataaaatcactttatggttgcaggtgtatcttataaacgattatgtccaacccagtacttgggacatatacctgtaatctcaacatttaaaagttagaagcagtgtctcacaagttccaggctaacctgggttgcatagctcctgttcagccagggctgcatcgtgagaccctgtctcaaaaacaagaagaaaggatggcatccagtgccatcacaggaggaggtgggcgttagtgttagtaccagatgccagcaagcccagggtctgtcctaatcaaaaccatgtgaaggaggttggaggacctagtccaggggataacattccagcctcctgcagcctttgagcct

SEQ ID NO: 23852 - DNA, 1166 bp, Mus musculus
ccactgagccatggcactggctcctttccacttgatttttcgtgtgagtctgtcactgtacctggagttgattggttttgctgggcagggtagccattaaactctaggaatctggccgtttcttcctcagcgctggagttacagttgcgtgcctgtcttttgtaaaagtgctgagatctgaattcaggtcctcatttttgtgtagcagatactttctcaaccttttcccaaactcagatcataggttctttttttttttttttttttctaaatcaaatttatgtggttacaatcgagcaagtttatcagattttcgaagactgcagttgtagtgagctgggatatccatgctgtcttttactctttgggagctgttgcaccatgaactatggtctcgtacttttaacattttaaaatgggtacttgtgcaaagaagtaacatagacattgactcatttttaacagggtggaagaaagagaaaagaaagatgaaagaatgttgaaccatattgtctggctatgtgatggaagggaaaggaactgagaacccttgcagcagaacacttggatggtttcaccaagataatgatgctaagccgtggctttggaaattctctggttgcttttctcgtcccgagcagacattgcctcttagttcccaaacggtaactatatgcaggacatggcacactgaatagatgatgagtacaggtggtctggacagtctctccagccagtttacgctctcgcactcaataagaacacgcttgctcaactcagtataccactctgagtggcagaggttttaagtgtttaaaattgggggaatttggctccttattaaagcctcaagtcccaaagcttgcatagtaaaatcaatgaaaagtataaaataaattgtatttaactatactttcttaagtggctttgaagataagttttctttatatagtccaggttggctttgaatttgtgatccttctgccttggcctcccaagtgcaggattacagataggtgtgactactgccccagtttagttttaagtcttataaattgaaaaggattgacaataaccttttgtccaagatttcttgggaatattttaaatatgttacttctttcttttcctttttggtggtgctgagtttgaactgagaatgaata

SEQ ID NO: 23853 - DNA, 1591 bp, Mus musculus
tcatccattaaatatggtttgctctgtctgaaggtcaggaaaacgcttggagtttgggaagccagcctcagagccagcatcaccagcgctaccatccgcccagggtgtggtcaagcttttgctttaggaccaatgagaactgcgccctcccctgtcttccttactttatagtcggcttttagtcgctttattttcaaggtagtttgagaaataagagccagtatcaccagcgttcactttgtgccgtgtagcctaaactgactacggctggtggtggtggccttggcatcatccctgtgatgtggctcagtccctagcagtgtgtgtcatggaaatgagctcacacacacacagacaccccgcacaaggcagctctaacgtatgatgccactggcttcctagagttttaatggcctccagaggtgttttgctcaggagctctctgcagcctgcttccagctgaagctgtcttctggaacattctcctggtgcttttacagcatgatcaaattgtatctaggactgggagattacagaggcaaaaaaaggctttattaaactatggtcatgtacctttgacactttaacgctgtctgcctcttaagtcagtgggagactatcctctatcgataaaccctgactcctgtttttcttgagatcccttccctgatgttggggtggcatgtgcatcaagacactggacaacttgcgttgcactggcctttgttacatcatccctaagaacagaacttcatccagccagctgggcttcattcagacaccatagagcaaccagggtggtaaagccggagatggagctcaccgccagacgcgccctcgggatgtggaaagaccagcacaggctctgcaaatgccagctcgtctctcatctctggggtgtagcgctgccccacacttcagtgcacaatgagaaaagcacactaataccagagcttggcacccttcactggctactaacttattttctagttgatgggtaaaactggcctagagttggacctagaacttttcgtgtgctactgacattacaaggtgattttaagctgctggctatttgttctccttagacataataacctggggaaagatggactttattttttataagaaataaaataaaaccaaaagaaatccctgctcaatagatgtgcgtcctttcatgtctgtgcacagggccatgaagtttgtttttaaccaagtaataaaataattgaacaaaaaaagtgttttgtgcattgtatatgtagttgtttgtgtggatttgtagaaacgagtacacatgtatgggaatcaagccaacatctggtgtctccctcaattgtatgtgtggtgtatgtaagtaaacaattgtatgtgtggtgtatgtaagtaaacaactgtatgtgtggtgtatgtaagtaaacaactgtgtggtgtatgtaagtaaacaactgtatgtgtggtatatgtaagtaaacaactgtatgtgtggtatatgtaagtaaacaactgtatgcgtggtgtatgtaagtaaacagttgtatgtgtggcgtatgtaaataaacaggtttgcacacatatgcacagagat

SEQ ID NO: 23854 - DNA, 1197 bp, Mus musculus
ggagcgctttggcccaagagctctctggattcacaaatggaagaacgcacgcgcacgagcgcttcagttacttttgatatgccttgactagttcagtggctgggcacttctaaacttcccccgtgactagcacacatgcccctctggtattcctgagttaacagctttctatttatttatttatttatttatttatttaggttttttgagacagggtttctctgtgtagctctggctgtcttggaactcactctgtagaccaggctggccttgaactcagaaatcttcctgcctctgtctcccaagtgctgggattaaaggcatgcaccaccactgcccggtgagttaacatcttttaaaatctatatttcatctctgctaccctgttaccttctggggaactcaccctatagggtcctcattcctttccgcctgcatggctggaaggtttttctcttgcagctcttgaatctgatcctcctccttcctagtcatggtgattctcgcctccctctcgcccgtctcagtctcctgccggagcagtctaaaagtcctgccctgtctccccattcagccaatggctgtacagcaattctttattattactcgaagccagctgaggacagggacccctcagtctagaggctttttgggagctcaaataagacagagctctgcatgtgatattaagcatacattctcataaaggatagtgattctgccatgctgaaggatctctaaagatagtatcactgtctgtttccctcagttttttatagctggctgtataatacctttaacactccagaggagagcaagaaaaaggaaaaaaaaaatgaaaaccgtgtcagttaggtgtgttggaattgagtgcccctaggatgaaatcatgacagtgctgtttcatatgaaatgttttagtgttttagattggtatgcttgctcatgcctatagtctgagaaactcaaggggctaaagcagaaaggcactgcttcaaaatataaaatagctggagctcagtggtggaacatttatttgccagagcttaattccccgtcactggtaggaggctcggggaggggcgaatgggaggttgatgatgggacatggctgagtttctgttcatcaggtttgcttttttcaaaatgtcatatatatggaagtctaaaggcgtttgatacttgcctcacttcacc

SEQ ID NO: 23855 - DNA, 1163 bp, Mus musculus
ttttaaaaaagcagaaagtataaaattgatatattaaaaatttacttgaatggtcagggagatggatcaagctgcaaaatacttgccagacaagtacaaaggcccaagtttgatcctctagactttctccctcaaaccaaaccaaaccaaaccaaaccaaaccaaaccaaaccaaaccaaaccaaaccaaaccaaaccaaaagttagaaattctctattgtattagatgtggcaaatgaggcagaaaaaggcaaatctctagggcttactgacttatctaacaagccaagttcgaagccagagagagaaagataccctatttcataatacaaggcagatgatatcccaaggagttacacctgagtttgagctctgaacactcactctctctctctctctctctctctctctctctctctctctcacacacacacacacacacctgtatattgcacccctgtgaacattcaacctgtgtattgcaaccctcatgcatacacacttatgtatcattccttgcccaacaagcacaagtccacatgcaaatgattgtaataaacattaaaaaaaaaagagagaatgcatttggtcataggatgttctgccagcctatgctgggagtgtcataaagtatgtgacctgtactatgtcaggttcccagagttatgccaggctttatgattctgtggtagagcagtagagtcaaaattgattatagaaaaccatcagagatgctagggagatggcttaatctataaaaggcccactgtgcaagcaggatggcctgagtttggatcctcattacccatgcaaaaagctgggcccagcagcacatgtctgtaacccccgtattggaagttagggcagagagctcactggctgactggttttaacgaaatcggtgagctccaggttcatgaaactatctgtcctgtctcaagaaatgagatgaaaagttattgaagaatacatcaaagtcaacctctggcctccgtgtgtgtgtgtgtgtgcatgtgcatccacaaattctcatacatgtacacacacacacacacacaaatcagaaaggataaggcacagatgcaaagacagacagcaacaagcttgagtctctagcaagtcaaggtcacagttgtgaagctaggggagatgggtgttgcagt

SEQ ID NO: 23856 - DNA, 1177 bp, Mus musculus
cacactgaagaacccatggctcttacctgttttcctcacagcccactgtacaaaatagctttagtgttgctacagtacagaagaaataaaagctaagacagtacaatgacttggcctggtttctggttataaagcctgtctctaaacctgtcctagtgggagagcaaagccccaagcatttagaggacttctgagagtccagccagtctggagattagtttaggtccatcctgatgcttctcagccatggacccaaagaggccacttggccttgttgtctccacctaaacacaagaaagagcattgcttgggtttatagatggcacacaggacacactagtgtcactgacattactgtatcttcagagttttggcccctggaggttatgagccatgtttagcttctctcagtataccccaggaggatgagatgagggatcagcactgatcatgtttctctcccacagaggttctatgtggcttcctcaagacaactgaagcgcctggagtctgtcagccgttcccctgtgtactcacacttcaatgagaccttgctgggagtcagtgtcatccgtgcttttgaggagcaggagcgcttcattcaccagagtgacctgaaagtagatgagaaccagaaggcctactaccccagcattgtggccaacaggtgggtgtagcgctcagtagagtagaggaaactagctgagtgcctagtccctcggcttccatggtgacacatgcctgcagaaggattaccatgagtttgaagtggccttgattacttagcaaattgcaggccagctaggctatagaatgagaccttgtctccaaaataaagcaatctaggatctggaaagatagcttggtggctaaaattgcttactgtgcaagtatgagaacccatatttgaggtgcagatgggggtggtctcaagagctcagtgcccaaccttggaataagcaccttgtttcttcttcatgttgaagttcatctcttgccaaaggactaattttatttatcattatttatttatcattattattgttattattttgtggttactctcaaaaccagggctttctgcatgtcaggccagtgatccaccactgagctcggcccctgtcccaagatacttatttgcaaatagcagtgccttctatagtttatggcatcttag

SEQ ID NO: 23857 - DNA, 1196 bp, Mus musculus
aatgaacaaaaaggagagaaagaaaacccctaaaaagttcctgtccttgttatgtcagtgatgtccccttcctgccatctggtcttcatgcacgctgacactgtcccctgcgttcagcacagctttcacaggacctgcttaagacacagccttgtgaagggacctaggcagacaggcttggaacccggccaggcaacactcccttcacaaggacttacaccttgcccctgctttctgtttcttcctgttcaaagctggggagggctcactcctcacataaggtctatgaatagttataagcagcaaaagtcaagagcagaagggatggtgcccacgggcaagaatctggtatcaaagacagccagagttccttatagggccagaagagaaccattcacaaatatcagtgatttctcccccctacttatgagcatcgtttcgtggagaaggatagtcccaagaatttgatgtctgggagaaggtactagattcagggagcagccatgcccagctctgcacttgatcctcagtctgaatacttcaaagtggtcctctaggttgtgtgagttacagaccaaagagagacccccatggttagcaagaacttgatgccagccacagttcatacttgctttgaattttggctctaatgtcagtcccagagaagcatcctttttctttaggtggcaatatatgtatttattttttgtaagttaataccattctttcactttaaagggcccagatttctcctgagagtctttttgtaatgacactggaaacatgactatttgaaaataatttgcagtaaagaaaaatatttcatttctttctaaacgaccattttatttttattttttattttttgggcacaaaggtctcaacctctactgtggaagaaccaggctaagacagctatgataccactgtcatcaatagtggcagggcaggactggagaggtggctcagcagttagtgcttgttcctcttacagagggataagtctcagttcccagcacctgtgttcagtgtcttacagttgcctatatctctagctccaaagggccagtgcctcttttgggcaaattaaaaataagaaagagatgggggagggcaaaggtaagagctgcctggagtctggcagtgaggcagaatggcaaagtccataaatacctgggcttgcgtcctactgtcgg

SEQ ID NO: 23858 - DNA, 1180 bp, Mus musculus
cagtgatccagcaggtgctctgaatgaaaaccaacaggactggacaataaactgggtggcggacctctgctgcagaggctgtggttcttcagggaggacttagaaatgtatctcaagatgagaggctggatggaaaagaaaggatggagatgaaagcaaaagaaaaaaattctctgaattccaaagttaaacaaaacttacataattaccattttatgacatgttgtaccctataatttattgatgaatataacttaagatattcttaatactatgaaagtccagaatcgctttccgagctgcctggggatggatccattcggcattgttcttcattcccatcgtaacttaaagggaaacttacacaatatccggagcccttgacgtcctgcagatgaagaaggaggatgtcctcaaattccttgctgcaggaacccagttaggtggcaccaccttgacttgcagatggagcagtacatctacaaaaggaaaagtgacagtatctacatcataaacctgaagaggacctgggagaagctgctgctcgcagcctgagctattgttgccattgagagccctgctgacgtcagcgtcatctcctccaggaacactggccagcgagctgtgctgaagtttgctgccgccacgggagccactccaattgaaggcagcttcacacctagggccttcactaaccagattcaagcagccttcagggagccacggcttctagtggtgaccgatcccagggctgaccaccagccactcacagaggctgtatgtcaacctgcccaccattgctctgtgtaacacaaattctcccctgtgctatgtggacattgccattccatgcaacaacaagagagctcactcagtgggtctgatgtggtggatgctggccagggaagtactctgcatactaggtattatctcccatgagcccccatgggaggttatgcctgatctttacttctacagagacccagaggagattgagaaggaggtgcaggctgctgctgagaaggctgtgaccaaagaggaattccagggtaaatggactccaccagctcctgagttcactgctgctcagcctgaggtggccgactggtctgaggctgtgcaggtaccctctgtgcccatccagcagttccccacagaagagaggagtgcacaggcagcc

SEQ ID NO: 23859 - DNA, 1257 bp, Mus musculus
ctcagcctcccaagtactagttcaggtgtacaccatgtccagcataagtggactcattttaaatgagctagtctaattatcaacaaacttcctttattcgtgttttgtgtgtgtgtgtgtgtgtgtgtgtgtgtgtgtgtgtgttgggtgcatgcagaggccttaggtggtatctggagtctctcttaattgttctttcactttatagtgtcagacagtgtttttaaatgaagcccagagctcactgatgcagctagacttgctaatcagcttgctatagaaatagatccccctgcctctgctttccaaggctggaattatagccttacctgttattttatgtgggttctgggaatcggatctccaacaagcattttcaaccattgagccatctcagcccctcaaagatgttctaaatatttaaccacatagaacatacacataacattttccatgtgtaattgattaaagtagacttaaatgaaatatactaatatttaatgattaaagattacattcaattgcattgacagtatagagtcattaccagttcttttctgccttgaaaatgtgtcttgtgatacttggagctagtaagtgttgggatgcttttgatagcctttggtagaatctggtactttggtctcatgttgtctttgtatatgccactgtgagagttctctcctccacccaaggctgtttgtcagagcccagcctatttaaaaaaaacccctttcttgtttaagggattgtggatcttagcataaatctatgagtcagttaacagatttccaaagcaaaatccattttgcatgtaacagttatatatgattatctaagattgatgaaattttagagttaatagagcctcttttaaataaaagcaaatcttcttttgtaaagtgactaggattgcaggaatgtggtataaatagactagaaatttgccttagaaacttgtttcaagagattttaaagtatgacccttgatgactatatgttaataaaagttaaaaagtaaaattcttgttccagtaggtccctgttatactttaatggctttaactatttgttattttcagaattggtaattttttattatttgttaatttaaaataaagttattgcacttgtttagggatctgtatatacttttctagaatttttgtaacaaacattgggtctgtcacaggcagtcttttgggtgtgaaaacaaaacctgtaattttacattgacctttataaaaactattttac

SEQ ID NO: 23860 - DNA, 1153 bp, Mus musculus
agaagcttgctaaggagagagctgggctttccaagttacctgatttaaaagatgctgaagcagttcagaaattcttccttgaaaagatacagcgtggtgaagagttattagcacaaggtgactacgagaagggtgtggaccacctgacaaatgcattgctgtgtgtggacagcctccgcagctgctgcaagtgttacagcagactcttcctccacagggttccggatgctcctgaccaagcttcagaccattagtcagagaactgtaagtgctcagagcttggctgacgatgatgtggaatgagccagataccaacataataaaatctcagtaaaataatttaacagttagcttggaagctggtcagctctgggggaataagggcaaattatgctgtcatgaactgtcccacacggacatctgccaaagcaaatgtgaactttggtagatccgttgtctgttctctttatttttccagtgaaaagtattttgatagagcttttcattttataaatacactgagttaacctaatatcatggatttccatttgttcttaagacatgcaattcaaatgtaaatatagtagagtattacttaggtagaaactcgtggtgattttaagattggaaaagaatctgaggaagagttgaataacacacattctaaagactagaacattttattgtatgttgtaaaattgggtagaaatttgtgtttgtgaaagctgcgcattaaaaccttacagagaccgtttctcgtttacttaaaaaaaaaagaaacagaagtgataaaacaaacacatacatatatatttgtacatgcatacatgtattatgtgtgtctgtgtgtgtgagagagagaaagagagagacagagagagaaaggaagggaggaaggaaaagagaggtagggagagaaagagagagatagataaagagaaagacacagaaagagagacagagagttagagatacagagagagaaataggattcattagtatggtttacaggctgtgatccagctagtccaacaatgaatttctcccaacaggaagtcctaaaattcataattggtccacaagttagacaatctcagctagtctttagtatacatttgaatcctgaagaagtaggctctacgatgagtgaatg

SEQ ID NO: 23861 - DNA, 1486 bp, Mus musculus
aaggcagagcttagaaaagactagacacctagtactttaaagaaatgtttgccggtttgccgtcctgatttacaggataagaaatgctctttagcagggttgataagatgggtcagtgggtaaagaagatacctaccactaagcctgatgagctaagttctatctctggaacctgtgtggtagaaggggagaactaacttgactttggaaagctgtcctttgacttccatttataaccagcccacaggcacacaaaaatgaataagataattgtatctcatatatatatatgcaaaatgaattgtctacagccaccaaaaagacaaagactttaagcggtggtttaacattaaagcatgtgtgcctgacagtaaagacaatctgtgacatttgtgttttctaggcaattaccaaggacatgtttgaagaagccctgcgagctttggctgatgatgatttcctaacagtgactgggaagactgtccgcctgctctgagctgcatggccctcggactagagtcactcactgttgttattgctgcaaaaggagtctgaaaggcagtattccactatataaacctcttctattcctggaatgtattttgttagtaaatgtatgttttcacctttttttaacattttaaattatcaacatatagtagagtttatattctcaatatgccatattttttaagcagcttgcttcttacctgtttgtacacagagagcctaagcccagttttggaggttttttttaatgtaggggctgtgcctttgttgtgttgcaatgctggggaggaaggtaagagtaccatgcatgctgtatgtagaggctatgtccttactgtgtggagcattgtgtgcttggtataactggcagccgtacatcctttactgtgatatgatgggctaatgatttttatagcacctggacttaactttctttacagagactttttcccataactattattagaacaaagatatgcttgaaaaattattaaatcaagttgccttctgttttttcctaatatgtaaaacattttcctaaataaatgatagaaaagtaatacttggtttaaaattatttctcattaagagcagaactttgctaaagactatattttttgaaatcataatagtgctggataggttataaaaaaatcaaggtatgaatttcattaatttttatagatccttagattattagtttcaaagccattgtagcattaaatcttgtgtaaatattacaataaatctctaaaccatttgaattatatgaagtaggcattaatgtaacttggaattctcacaggttgtgtttatagatctaaaaatgaacatttacatagcactcagatgttggtttggaaatatattccaaaggaaggagtggatgagttaggacatcaccaaaggccatggccagttacctaatctagttgtttcccttatgtgagttggtatatgaatccctgtgtagaag

SEQ ID NO: 23862 - DNA, 1219 bp, Mus musculus
aattatttgactaataaatttgctttgtttcttgtggtactagagatttaatgaaaggcctcccatgtgttaggcaagggctctatcactgaagtaccttcctatgtcctcaaaacagtagaaggagtttttatccaaatacaatatccaattgtatattgtatccatttctcagaagagagttataacttttttactttgctcttacctaggcaggactagggactggtcagctggagaaatggcagctttctgtgggaatatgtacagtacagttggctttaacaccttttttttttttttttttttttttttaaagatttatttatttattatatgtaagtacactgtagctgtcttcagacactccagaagagggagtcagatcttgttacggatggttgtgagccaccatgtggttgctgggatttgaactcctgacctttggaagagcagtcgggtgctcttacccactgagccatctcaccagccccgctttaacaccttttaagtcctatatgtaggtacgttttagtgtctcaactaagaagatggtatttttctcttgtcaggtttgatctcattttcctcatgctagaccctcaggatgaggcatatgaccggcgtctagctcatcacctggtttcattgtactaccaaagtgaggagcaagtggaggaggagttcctggacatggccgtgctgaaagactacattgcatatgcccatagtaccatcatgccccgactgagtgaggaggccagccaggctctcattgaggtaaccaggcttatgaaacataagtttgtaactctggatgagttatctgtttctcttaacttcacttggcttatttttaacaagtaagaagttatagaaatgttttgtcccattccggggtttctaccctgcctgtgatcatttggttcccagataaaagacactcaacctttatatttacgttaagccttaaacagcacaagagctgggaagatagctatcctctatgctattttgtctatttcccagccaataatcctactatataatttgccatgtttcatctgggctgctcttaactccaattagccaaccaacgtggccattatttcctgatttactaacccacggcaccttcttcctctcttcaccttctcccccttgtggttctctccccatcagaagcctagaaccctaagccccacctatgtctcttctg

SEQ ID NO: 23863 - DNA, 1145 bp, Mus musculus
tgagcaaagaaactggatatggtgtgtgaagaatctgtgggttataaatggcacggtccaggctgtttggtctaaggaaggggactagctgtggtcctaggctagatcttgggctttaaagaggatgcatagataggaggatcaggtagacttacccagatagtccctgacacaaattatactcacagtatcttaaattgctcttataaatagaccataatgtatgtgtgtgtgtatgtatgtgtatatatatgtatatatgtatatttttttcctttcctggactcttaaggctgtgttcatcatggaactgaactagaaaaagaaactaatgataacaatagctttgttgaaagagccatctaaaagtttaattttcagtgtatatttactttcatatgatggctgtaaactgcattagagattgtctctttaggtgacaaggcagctctatgaaccgcttgttatgcagctgatccactggttgactaacaataaaaaatttgaaagtcaagatactgttgccttattagaagccatactggtaagtagtatttggaattctgttctttcattccaattgactgcagaaatttagtgtacatttagttctttaggcaaagtaccttgttaacataccaaaatatagcctttagctatagaaactgttattgttggttttggagatagtaccgtatttattttgataagtgatgttcttaatatttatatttttagtccacattctgctttttaaatggctttaagttaaaaaattatatgcatgcatgctgggtggtggtggtacatgtctttaatcccagacttaaaaggcagaggcaggcagatctatatatatatggcataagaaagtatgaatgtgccaggcagtggtggctcacgcctttaattccagcacttgggaggcagaggcaggtggatttctgagttcgaggccagcctggtctacaaagtgaattccaggacagccaaggctatacagagaaatcctgtctcaaaaaaacaaacaaacaaacaaacaaacaaagcaaaaaacaaaaaagaaaaaagtatgaatgtgttttgtgtaaatattcttcatcaataacagtagtttgttttttaaatccatgatacagtataaa

SEQ ID NO: 23864 - DNA, 1198 bp, Mus musculus
aaggaaggaaggaaatagggcctaagcatttgcctagcagtataaggtccttagttctttccccagcggtgcatgaaaaaaaaaaaaatatatatatatatatatatgtgtgtgtgtgtgtgtgtgtgtgtgtctgtgtatgtgtatgtgtgtgtgtgtgtatgtgtatatatatatatatatatatatatacacacacacatatatattatacatatatatacatatatatgcatatatacacacataatacatatatgtacatatatatacagagagacatatatattattcaacattatataattatatatatataaaatgttagaactatattgaacctgggcatagtggcaaacacctataatcctagcaccagagaagcagaggcaggcagatctctatgatttaacctgtgataccttgattgtatccaaatattaatacattaaaaatgattgcgccttttacatttgtcagtttggtagaattacattcttggctacgtacgcattgaatgttggatagtatgttaatgacatgatcttttgtgtaggggatttccacctttgacatcattatgtttattggatctggtcgagtggcttttggctcactgtggaaggccccagacagaatgtcgacacaagtccatggaactcttttataaatttgttcctttactgccaggtatgtcctctctttttcttttttaattaaaagatcactaaagtggggaagggattagtacttttatggcagtggatgtgtggaatcaaagaacgactttgaagcctttcatctttggatgaatttcacaggttaggtttaggttggcaggccttgcagtgtgttccctcacttgctatgttgccttctttgcccagtaacttgattcttaacattctgccagcattaattggctatgggtttgccagtttgtagatggagacagttaaggacattctgattttgtataaatgaatattaccaataacatttccttcctcttctcttccccttcttcctccttcttgcttcctctccttcatcacccctctctcattggctttatagctcagattcctcctaccttgaactcacagtcctcctgcctcatctttcagagtgctggtatgacacatatgcaccaccctcgtatatagagacattttctcagttgatttactttcctttt

SEQ ID NO: 23865 - DNA, 1205 bp, Mus musculus
aggagcagagacttctgcatcttgatctgcatgcagcaggagactgtcatatttcctccaacaaggccacactttctaatagtgctacttcctttgagcctatggggaccattttctttcaaaccaccacaggaactaggggtatatatgcttagaatgcaaggaaaacttgaagctttgtttattttttttagttctatattaaagcatatcaaatatatttttatattaccaaatcattagtttcagttaaattgtgttattttatgctattgccccttaaatgagcttcttaaatccattgacatttaacagtggtattgcttgggttccttttcataggagcatcaagattccatgacccaggatgacatcatggagttagagatggatgagctcaatcaacatgaatgtatggctcccatgatagccctgattaagcacatgcagagaaatgtgattgcacctaagggagaagaggtattttctctgatagtatgctttctttcagtatctcactgatgtcactgtaggactaatttctcatactggttaagctatgctgcacattaaagagctggattctttcttcttcacatcgttctcatgttctttttttttttttttacatgaaagagtatttttattttttcctatacaccaccttaatgatgataccatgtacattttctcagctggcaaataagacacagagcaaaatttcccaatgttcgaagaatcatgagtagtcatctgtctttgggaggattcagtttcctttttttttttttttaaattaggtattttcttcatttacatttccagtgctatcccaaaagtcccccataccctcccctccccatccccctacccacccactcccacttcttggccctggcgtccccctgtactgaggcatataaagtttgcacgaccaatgggcctctctttccactgatggccgactaggccatcttctgattcatatgtagctagagacacgagctctggggggtactggttagttcataatgttgttccacctatagggttgcaaatccctttagctccttgggtactttctctagctcctccactgggggccctgtgatccatccaatagatgactgtgagcatccacttctgtgtttgctaggccctgacatagtctcacaagagacagctatatatcagggtcctttcag

SEQ ID NO: 23866 - DNA, 1175 bp, Mus musculus
ttattgaggctatcttttctctatatgatgcttgttactgaatttctctccctttgaaaacactgtgtgccttcatgcccatagctaataatcttttgagtaatacagacaagatgagatacttttataatcagttctcatcctggttggtttgtttttgcaaatttgacacaagctagggtcatctgagaggagagaacctcaattgagaaaatacttcacctaattggcctgtggggcattatcttgattaataattgataaaggagggcccagctcactgaggcttctgcctctgagtactaggattaaaaatttacttagcctaaacctggtaaaattttttataggataaaaagtaaacttgatcacggagaagtgattcacagttttattaacgccttagaccagctctccaatcctgacctgctcttcaaggtaagaaaacagcttttgacaataaaaatgaatgtggataggatttgtgtatagtctagcttcttgatttttttctttctctttttgcacaggactgggtttctgatacaaaagatgaactaggaaagaatcctgtgaataagaaaaatattgaaaagttgtatgaaaggatgtatgctgccttgggtgaccttcgtgctccaggcctggggccctttcggaggaggttcatacaggtacgggttgatacagctgcttgattaatcaaattaattatttgatagatacagtagcagtgtttgcatttgaattacttcctgcccattgtctcttactgtgatgagcttgctttaaagccgatgctctctgtaagatacagtaatcaaatgtttccattcaatgctgatgtcttgtcttagtcagggttttactgctgcgaacagacaccatgaccaaggtaactctcataaagggcaatgtttaattggggctggcttacaggttcagaggttcagtccattatcaaggcaggagcatggcagcatccagacagatgtgatgctggaggaactgagagttctacatcttcatccaaaggcagacaggagaagactggcttccaggcagctaggaagagggtcttaaagcccacactcacaggccacacctcctaatagtgcccctccctgggctaaggtattcaatccaccacagctggcaagggggtcagtagtaaa

SEQ ID NO: 23867 - DNA, 1242 bp, Mus musculus
acttccctaccttctcaagttctctctctctctctctccctcctctcttttctagcaaataggcacatttaaaaaaaatcaagccagaataaaacaaattgaaaaaataaaaacaccaatcaacaaacatacacatacggatacacacacatatgcaaaagactagtaatgtaaaatggacaaagcatcaggagacaaaatatctccaagagtgcccccgcacaaattttagatgcccctcctggtcccctttcactgtgtaggcacttctggacggctcccccggtccactctttcccgatggcagtgacaatcatggtaaccggccaaacatttgcagttctcaacacaccggccaagctaacgtgttgagttcaaaatgaccatcctacctatcttcagaaatagacgccgctatccagacacacaacccggaaatagcgtcatcaagctgcgcgtcaggccacacccctgcctactgggaaaagcggctcaacctcccgggaaaagcgcctgcaaaagcaaaagccaatcaagtgcagaagcagttggccacaaggcgcgtgcgcagtgacgtcctcagttgctctttactccccaagtttatgtatttcggggtcgggggacaggagtgcgtatccgtttaaaagcaaagctgtttagggaccgtcaacagaactggtaattacacgagatcgtgaatactcgtcatccaacaggcatttgctaagtacccggtatatgccaggtactattctggggtctgctacctaagccagcagtccaagtctgatcgtcaggcagtgatcagcttcccaccaccccaccccatgcctagcacactgccctgtgcacagtagacgttccgaacaagtcaagtaaccgactgtgtaaaggcctcttggaactctcgcctcggtgctggagctgttgacttgcagagactctgtccaacacagatcccttttcaggctatacgaatggcggcggcggcggctgctgctggtggtgctgcactcgcggtttccacaggattggagacagcaacgctgcagaagctggcgcttcggcggaagaaagtgctgggggccgaggagatggagctgtacgagctagctcaggctgctggcgccgccatcgaccccgatgtgttcaagtgagaaagcgggggtcgggactttgagctcatactccctacagataatgccggctttaggactcctcattcctgcatctgctact

SEQ ID NO: 23868 - DNA, 1253 bp, Mus musculus
ggacatatgtcctcaggacactgtgtgacacagacacatgctcagccatgttcatgctgctctattcacatcagtcaggaaatggaaccaacttaaatatccttcagttgacaaacagatgaggcactttcttatgtgcaaatttttatattttatatttttctctgcttcttccaaaggctcagtttaagaaaacagactttgtcaacagccggactgccaaagcctaccactctcttaaagactgatgaagtggggaaaaaaaaacctcaggaattccagtttcacagttctccacttaaaaataaaataagataaacaattaaaaaaacctcctcaaagaaaacacctatttttctactaactgacccaagaaacctcaaaaagcatgctttgtttatattcttttctattttcatccccaaatctagaaaatgaataatcagaatataattttgttaagtgtcctgaagacttccaccaggttgcaccagtatggaatcagttttaccctgtgcagataatgggcatcattattcaggcttatagtatgtgcaaactcgtgtgagtgtgcaccggaggaacacctgagaaagagtgtgtgaatgatgtttctatcctagttgctcatctgcatgtcacttccttaatgagccagaggtgtgtgttcactagtgttggacaggacagagatgaaggaataaagcattgatggcaaatcgctttgtctgtgaccttcgattgttcttgaccctgttgggttgctattctttgctttgccttttctttctctaacataaatgaatgtaaggcatgtatgtagactatagagctatgtggcagtaaggctgagaagcagtcatagaaaacataaagacagctggctacacataaagataagtgctggctctgaaatgtcatgttctccctcagcagtgtgtaaatggcattttttacatcaagaaatcattcacctgtagtgtcagcagtagctgtgactctctctagttacaatataatctaggcttttgtacccagcggaattggtaagagcactgtcattcagcaagggtctcagaggattgagaccagatgggcactgagagcagcttgttttaatgaagcatagtgtcaactttgtccaagcacaggactttatagctcatactctcatccctggtatcaggcaagggagctctagagacaaggcaggaagctcttatggcccgaaactgagaagtgacagcctacag

SEQ ID NO: 23869 - DNA, 1876 bp, Mus musculus
gactgacctggctttaaaagatggagcctggcaagttcctcacataatcaatgtatccacctatccttcatttttatagtcttaaaaaacaaacaaaactcttttgcagtttcaagaaatatataagatcttaaagactcatcaagatgtaggaacagactgtgtaattaatggctcctgagtctacactgccctggtgcattagaaattaaaaatactttgattctaaaaaagcctgaaaatttaatgacttcctgcattaaaaacaactattgggaactgttagtaacaatggctagtcctattagtctctaaatgatccaatgataacctaaatttctcttatttacaaatacagcaattgcaatccagatacacccttaaaatggggcacttaaattgggctccaagactcacagttaaatggaacctaaaattccactctttatccactggtaatagctactttagttccacgccaacagaatacattagactaatggtatgaaaacactagtggacctttattaaagaaaaacatctggacacacacatacatacacctaaaagcttatggacttcattcagggggttagggtaatgtttacaacctattttgtgaaaactgcctgtacaaatcgtcttttaaactaagcattgaaaagttttctcacctagctgggcagtggtggtgcaagcctttaatcccagcacttgggaggcagacgtgggtggaggatctctgagttcaaggccaccgtggttccagacaactagaactacagagaaaccttgtcttgaaaaacccaaaaaattgaaacctaagtagaaatccttgatgtatctagttgtctctgaccaaatgatacattcgttttataaatactaaaattcttttcaggttatggtcaggcatcttatgaaatactattagcaaggaaaacaagaacatgttatctttagtttatgatgcccactgagcaatctcaaaatcataaaagcagtttgatacagtaccggcttgacagtgagtacacactgcctaaatgtgttagcatactttaaaaaaataccctcttatccaactattaggtatcagtgacttaattttttaagaaagatgaccaccactgtagcctttttgaatttgtaaggacaaagaaatgcacctttatccaacatttcaaataaattttaaatggaagatgtttagcactacacactttgtacaaaggaaaacaagcaagaaacagggaaaggggaagcttcctttgtgtgcttttacactgatgtgttctgaaacatggagataatttctggcatatttataagacgactgtatgttctatgtaaataaaaatgctggtgtgcaattgccagtaagtgaattctttctgatgtgcttcaagaaaaggtataaatagctgtatctttcaaatatctgaatctacttcataatgtgacaatttaaattgcactgcaccaaaagttttacaccatttctcctattagataatcacacccaaggccttgttacatctccatgtctacagatgaagatggaaactccttccaagtaacccaaggatgagtgctcagaatgtgagcactacacttttctgcaaggcatccagaagccgatcaacagtttatgcttcaccctgtgtacactgggatggcgctatcttgatttttatagaaaccgttttggagaattaacttgcctcgtgtatacaaacctgaactagtttgacctcaaaacttcctatatctttgctattcttaatgatggtatacttggtgagatgctttttgtttcttaaatttaatttcttaaaatatctgctgtaccagatgctctcagccaaccattgga

SEQ ID NO: 23870 - DNA, 1231 bp, Mus musculus
agtcttcatgttcccttttcaatgctgtctcattagacttttagccccattgattttatctgtctgtttcatggttaaggctaagttattcctaactacctcaggcttaaatacgtttattgtttgaatagaattagcattcttacttatgcctacttatgaactatttattttaaaatggaacataaactttgctataatgtatcgtctgaaatttgaataacaaagttgcttattgaaggtttggaacttaaaattacacaggtacataatttttcccagtaataagaaattactttaaagctatcttaatgtcatgttttctttcttcatagtacaattttaactctggaaggtaaataaattagagttaattatcattgagcataaaatgttatttggagtatagtcatcaagtgtatgaaaatgtttcttatacttttgcaatattgtctgtataataaatttttcatatatagacttctcagggttaggttagcctgtcatattttttttttcacattaaccttattttgttttttataggtgcataacttagtggcaattgagctagcgtatatcaacacaaaacaccccgactttgctgatgcctgtgggctaatgaacaataatatagaggtgagtagggcatcatttttcagagagttggatcaggtgcgagtaagtttgtacaagagatgtggcatattactgctggttgtatgcctaggaaatatggtaaattcattacattgttctgttaattttagatctcagagtcacctgggacaattatttttactttctacttattaatcaaagaggatttattttaatgttaaagaatgttcttgttccttttcagtaactattatagttctttggattgaagtatataaaaccaagtgaatgcttttaattgagaatgttttgttttatttgtttcttggctctgcaagcgatgaaggaaacattcaaagaattacctaacttcataatttggaaaagtgtaggttcttcacagtaaagtgcccacccctttctttaacactcaaaaagcgaattaggcgtgatgtgttaagtggaggtccatataggctacactagcgagatagctaagaagttgagagcactagctgttctttcagaggacctgggttcaattcccagaactcatgcggcagctcacaaccatctgtaacaccaggtccaggggatctggcaccttctt

SEQ ID NO: 23871 - DNA, 1177 bp, Mus musculus
cctggaactcattctgtagaccaggctagcctcgaactcagaaattcgcctgcctctgcctcccaagtgctgggataaaggcatgcgccatcactgcccggcgactctatcccttcttataaacacaggatttcactatgtagtacagaccttgttaaccttttgtctaagtcttccatggttgtccataaaattggtgtgtcccaactcctggaggcatactcatacataacactctaacaatcattattcatctagctgttagctagcattttgactatagtagactcagattcacggtctcagcttccttacccgcccagttcaggtcgatacctgaaaccttctagaataggccttcgcgttccactcagcctgaactacatctcccggcagcctttgcgcgcccacctctgtcgtggcgcgtggcctgccgggagcgggctgggtgctggcccggcccaatgggtgcgggctcccgaggaaagggcggaggagaagaggaagcaagcgggctgtgggtcgagtccccattcattgcagtggcctgctgggttgggggtccagtgtttcgggggtcatggaggcgctgatcccggtcatcaataagctgcaggacgtcttcaacacagtgggtgcggacatcatccagctgcctcagatcgtcgtagtgggaacgcaggtaagatgaggccgcgattgcgaggcctggctcggccgcaggcctgcaggtgtcgccaggaggaggccggcagctcggcgctccgctctgctcccgggcgctcagcgggactgagtggccctgcagcctacagcccggcgcggcttggcccaagggcactcgggggacgcgcgggcgggcgtgtgggcggctgtcgcttccttccggccgctgaggacgcgacggactcaggagttgctgtgagcagacaggcagcaagctagtggtgagtcggtggcccacggagctattacaaagtaaaaataagattaaaagaaaatcccgggtgtagttggaggcctaaagttaggaaggagcaccatgactttggtgtttgtaattttgttactgtgacccaaatttggtataaggttctcaggccttatgtggggtattggcgataagtccaaattttgtatgaaagaatgttgaatagatatctagaatagcagagat

SEQ ID NO: 23872 - DNA, 1174 bp, Mus musculus
tcaagcaggtttattcaggaacacttagcattgcaatgcaggaacaggaatccctcgaacaacccagggtgtgccttaaataccctactgattcctccaattaccccagtcatgtaacggcagtccataggttcacagcaaatgacgacacctcaggcgagctgacaaggcatggcatctgcgaagtgcaggcggctgggatgtggctaagtctgagataatgaggaagtcaggcacaggtcataagacctggcagccatcccaggcaccatcttggggcggcagccacacccactcctcacactccaccacctacccacccactcacccctcaccaccctagcattcccctatgctgtcacatcaagcctttataggaccaagggcctccattcccattgatgccagataaagcaatcctctgctacatatgcagtgagagccatgggttcttccaagtgtactctttggttggtggtttagtccctgggagctctgggaaggtctggttggttgatactgttgttcttcctatggggttgcaaacccctttatctcctccagtcctttctataacttctccattggggtccccaagctcaatctgatggttgaccatacgtatctgtattggtcaggctctggcagagcctctcaggggacagctataccaggctcctgtcagcaagctgtgttggtgtctcatttgtcatgggtggttgggtgaaattctcacctttgtccttggtcactgcagacctcctgagaagcacaccagctgcagtgcttggacgagtatctcctaggctgttgatctggtctagtgtagaagtgggtagtatggaagatagagtgtggatggtcatggggtaggtcccatgtcagctgggctctgtgggtatcccagctggcttggctatttgggcagaattctcacctgtgtccttggttactgtgtacctccttggaagcatgcaggctgtagtgtttgggtgggtatccctctaatttttaatagtgagtaaaagcctcgtgttgtgtgtcatctgtagcagtaaatatttgaagtccactctattctcccagcaggtgtgttcacacctcccacccctaatagccctggattcaagtatgaaagacatgcacatataacctttatattttaatatgcctt

SEQ ID NO: 23873 - DNA, 2636 bp, Mus musculus
aatgagatctgcagccaggtgtccagcccaggcttgtggcttctcattgtacccaaggctgggagggtttggtctgtactaacacacaagctcgcagtcctgcttgactgctggcttcccaaagaggagacattggtcttgctgggaggcacagcaggagagtgacccactgccactgcactctaactgagtactaaggccactagggctttctagacctcgctttccccttgagcttcctggggaggtgaagtgaggtgtgtgtgtgtgtgtgtgtctttgtgtgcttagatttattgcagggaaaggtctaatccagaatcagtattcaggctttgtcatgttgtatcagtgccaaggtgaccctcaaggtcatgtaacttaagcaaagcttagcatttattttattcctgaaaacttaagtattttacttttttgtgtgttcgtggagacatttgcagtattaatgattttatttttcctaaatcgggatggaaacaaacttttccaggttatgttaataagccacttaagtgccttaaacagctttggtgtagatgagaattgctgggtccgtcatggatcctgataggcagacgtgttgaggttctcaaagaggctgcatttgttgtgggaaggcacactttcagccagcactctttctgggaaagtccttttgtgcgtctgggcacctcagaacttccttgaagtgatgggtaaaggctgtgactatgggcacctggggtgacactggcctccttgtccaccttggagtctggctggttcccagctgagagaaccttactgctcttggctagaagattgacacactcaatctctcttgaaactctcttaagtgtgtttgcagttatgttgattgagttgttgaagacagtgcttaggtgaggaacttgggcaagcccagcagtccaccatctttctcctgtgacttgtgtcctaacctgctagactctgtcctgacctgagcagcatgaaagacctccacatccctagagcagtgatggatacagtcaggcaaggaaaccaagtgagggttgggggggataccaagaatagaaggactaggaggccctcaacaagggccaagcgagtcaaggctgctctctgcagacactggcaggtccagagaataatggtggcttagcagaggctcagggaaggatcagtaggaagaagggtggctgtgaggtaggtccccatgaaggagacatagttcacctgtagagtgaaagccctagcaagacttgcagagctttgttcattgcacctaagccctctttgaaaagaagcaagggagctcatacttattcctctgaggcaagttcacttccagcagtaggagagcgagccagccaaatgcagctgggcacccacctgtatgcttgccatttacccattcccacagcagggatggaagagctggggccatgtagttgattccttgatcaagtctcctgataggaacgtgatcactcagatggctgcccacctaatagctaggtattgcttaacttgaaggcctgctgccttccggggggggggggggtgtcagaatccagcatcctcagtgccatctcaacacagggtgtggttgttggtccagcctgcctgtagcagtgaccttcatagagggagataaattgattttggttttctcccatttttgctaacctgatcattgctggtaagagtggaatttgggcctccttggtggtctggattcatactcgcatgtaaagatgtgccaaatatcaaggcctcagtgtaaagggaagcccctttcccaggcttgtctgagtgcctcccccacccttccccctgtctggcaatggtctgggaccaacatcaggcactgctccatcctgatctagtggccaaggaagaccacattctcctactgttgagggctggccttgagcgagttcctaggtacagagaactctttttgtctggactggagttgccagtaccaagcctacaagacttgttggccacctcctcctcagagtctcttcccaaaagaatcccctagccaggataatgggtggcttagtagaggctcagggaaggaacagggagaagggtggctgtgagctcaagtccccctctttgccaccatcacattgtgtgagcggaaccagtcactgcacctctcaggcctcagggaaaggcatggagggcatgcatagcattaccaggagctgccagagcacgggagcccatcctccaccagcagcagagaggggttaagtattattagtgtctattcttaaaattaagtgggctggaacagagctgagttacaggcgccagtgtcttacacagatacaaaagctgaagccgtcagcctgcctttgcaggtacagctgcctcccaaccaaggcctggaggcgttaagaggtgggagggcacaagcaggctttcaggagtgttgaagcaagggatctgcagcatagctttgggcgtctccagaactcatggtgagggaggcaccaacacctagaggtcttaaaagccctgcattcaccatgatctgtctgcccctgcccttttgggttcttctgcatgcagtgcccccctctcctgatgctaagttttggcatgggtgtcctggc

SEQ ID NO: 23874 - DNA, 1489 bp, Mus musculus
tttatttaaagctaaatagctttgacccacagcaccagctacaagagatttagaaacaattactaaaaattctacatgttttatcattactgtaggtccaacgactggttctttggttttctaaaatcaattcacccttaactttggcttttttctcttgatgtttatatttctctttccatttattactatacgtaacactttccacaaaatttagcttgtgttccctataggagcatcttgaaatattgttacattgaaataagctaatgatgtgaattttaacagacttctttaaaaagaaagtatatacctaagggatgaatgttggaaccatcacctaaggtggggagggaggacattcagcctaattttttttttaatttacaaaatggataagttgttccaggaatatagtgctgtccatgtaagttgatttccaactttataaaaactagttaaatgatataaacaatgagcattaggactttttctagctcaagtttgtaataattataaatctctaacattgaagatggactgaggcatacttcagaagttctaatttaataatttcaagatataaatgtaaagtaattatagtgactcagcatctgtcttgatttttgttgctatgataaaatgtcatgaccaaaagcaagttggagaggaaaagagtttatttcagcctacagttccacaattcagtttatcatcaaaccagaacagctcctcctgcccctgcctcctgagtactgagattaaaggtgtgtgccaccaccacctgatggcatctcttaagaaaaccaacttactggttttcattttgtgtcactgtttccaaagtttgatgctcaaactttcatctgtgcacactgctgcagagagctctattctgttactctgactttccccctttctgttgcagggttataccaagtccattgatatttggtctgtgggctgcatcctggcagagatgctatccaacaggcctatcttcccaggaaagcattaccttgaccagctgaatcacatcctgggtaagctctgaacatgatctggatttacgttagtcacctcaggctcactctagcatggttgctttgttttgttttcatgttctctactttaaaaatattaaagatctttttgtaaaaacttgtagtgtaaagtaaatacattaaatatagaatctctgttgccccgtaggtgatgtgtgcaatcttgacaattgacagctaatgttttgtctgataggtattcttggatctccatcacaggaagatctgaattgtataataaatttaaaagctagaaactatttgctttctctcccgcacaaaaataaggtgccatggaacaggttgttcccaaatgctgactccaaaggtaagacttgcttcattgatgttttttcttaaacttagctttagatttacttattgtattggctaaattatcaggctccagcttgaaaactgaacaa

SEQ ID NO: 23875 - DNA, 1229 bp, Mus musculus
aaaaaattaagttttctatgaactttgaagccgtgtgtgtgtggtgtgtgtgtgtgtgtgtgtgtgtgtgtgtgtgtgtgttttattggggagaaagagtttgggggagaatgaactgtagattggtcaaaatatatttttgagggtgcagaatgactgtggagtgaacctaagagaaacactttgttctgacagtgtgtgtgcatgcacattattgtgcatttgtatgaagttgtcatcagatgtcttcagttgctttttaatttctttgggtatgtgggtatggtgtatgagtatatgtatgcatggctgtatgggtgccctcatttatttatatacttctggagaccaaagatctatgttggttatcttcctgaatcactctctgtttccctggacctgcagcttaccatttcagctatgatgagtgaccagcaagcctctgggatctttttgtctctgcctccttgaactggtaatcactctgttgagcctggcttttttatgtagataatggagatccaaagggtctatgggtgtatagcaagcactttgctgagtagtataggaaatgtcaaagtttagtaggcaaaggggcttttgctccagtgctcattttctcctggctgtccattctcctttggcatctgtgatttccatgttgtcagtgcttatgttcacacagttccaaaggatttacaggtaaggctgaaaggttgcctacatcattaacaatactggctgcgctcacagaggactaccaaggttcaactttctgtatgcacacagtagctcacaaccatctgtagctctagtcccaggagatccatcttcttctgacctctgtggacactactcatatggtgcacaacatgcagccaacacacacaggattttttgtgttgtttgtttgtttgtttgtttgtttgtttgtttggcttggttcattttgttatgggttttttggtttgtttggggttttgttctgttttgttttgggggggcggggggttggggttttttggtttggtttttaagattttttttacgtacattggtgtcttgcctgtatgtatatctgtgtaaagatgccagatcccctggaagtggaattacaggctgtcatgagctgccatgtggatgctgggaattcaacctgggttctctacaccagcagtcagtattattaaccactaaaccatctctccagccccattcatatatagttt

SEQ ID NO: 23876 - DNA, 1191 bp, Mus musculus
ttcagactataagccagagttgtgttataaatcagtaaatcactcccttgaccatgacaacttgcgactggtaaatgttcattttgtcttaaagcccattgctgaagcgccattcaagtttgacatggagttggacgacttacctaaggagaagctcaaagaactcatttttgaagagactgctagattccagccaggatacagatcttaaattggtcaggtatctagaactttaactatacagttaaccctttatagcaagggagagatggtgtaagttaaaacatctctaggaggaaaaaagaattcagtttgtccccttccattgatagatcattcattctgattgcttcatggtgtgaaatgaggatgttaggcttcgtctttcacagattatgaggacatgaaataaagtggcagcccttagacactgtgacggtcgtgtgcattgtgggagtggacttttatggaagaaaataactcatgggaaggaatagctttgagtcatttattcccaaaaacttgattttacttcatatgacattttaaatattgagaaattctattgtgtaacttttgtggctttgggactgtgtggttgtttttttggttagttgtggtattaggaattgaatccaaggcctcttgcatgctaagcaagtgctgtaccactgagctacactcagtgtagatttgagaagagggagttaatgggggaagggaaagggggtaagaaggtaacggatgaatatgctcaaaatacattttacatgtatgaaaatgtcagtgaaacgcatcattatgtataattaatatatgctaataaaaacatttaaaaataaagatttgaaaggatagaattttattcactaaacactttgactgaggcacagatatagaagccattcaggacaaacactgatagaagtaagcctacggtatcctaggaagacagggcgtacgaaaggggaaaatcatagagactgtgcaaaagaccgccaggaaaggagaggaggcacagtacgggaagagagaaaaaaagaattcaaaacagtcccaaaaggaactagattttcaaggtgtggcttcatcttgaaaagattcggttggagtggagtagggcatacagtacataactcttgtgcttactggaagccttgggtgacaggtcccaatgctttcaaaagagag

SEQ ID NO: 23877 - DNA, 2279 bp, Mus musculus
tgattgctcttccagaggtcatgaattcaaatcccagcagccacatggtggctcacagccatccttaatgagaaacaaaaaacctatgggccagagggagcagggttggagcgaaagggaaggggagaaaaaaggaagaaaaaagaatgagggcagagactcagccttcaggacctcatgtgtcatgtgcgtgtgagagtgcagtgatctttgacaatctttttattcacattacatttttattttgctattttgtgctattgttgcttttattgttctgacatggctcaatccttactcctgagtttatctttgtttttcaggacaagggctcagaggactggacgagttcagatgtcggtgtccccccagttctttaccctggtcctgtcttcagcccgtctcagcttacccactcttgactcctttgagcctttcagaggggcagtttctggtagtagcagcttttatactttcacggaattccttcagtccagagagttctggcagcaggccgtgcagcagtgtgcactttcaatgcacttaactgcttactgttgtttagtcacgaactgctttctggtttgaaagatgcagtggttcctccctgttctgaatcctttctccatatcatgtgctgaaccatcagcctcatcagagggagagtctttccagacttgttccagttactggcacctcacttcacagtagggaggctaggacataaggcaccttaagtcagtgacagctccaaatttgcacttcatctgttggctagtaactgtctacctagacagtaggagcttgtgggtatccctggatggtattacaggctacaggggcaggggcttctgttgcaggagtcctttggggctattttcctgtgtatcatgttagtcctaaatttaaggtatgtactatttgcccagctttttaaaaatttgatcattgtttaaatgaaataggaaggaagcattgcaccagcagtatctgttgttctgcagattttatatggttacttgtatcgtaatggaggtggagctcttgccaaaatgttacatgctatccttagccagagagtgaaagtaacagctgtgcttgtcatttactgaaaggtggacacacacaaagctgtggaagtttccagaacagtagagagcaagctgacctagatgttcagggcagagctccatataaccttgaacagccacacagaaggctgtttgcgtaaccacattcactacctagggatttagctaaaaggaacactgcatctttaaatgagaaagtgtacagttcttctcctgcagcatgtcagcatctcgagctcacttttcagcagtgtaatgacttgtatgtaataaagccttgatgggctctcctcatgaagctctgctctgttgccaagttagagatgtttctggtactgctgagttaatgtcataaaaggctagcagtaactgttcgagctctcttttatttccttctctcctatattttgttcctgcactgtgtgctgtggagttgatggtgttatcccagtgcggtgcctccagaccccctcactgctctctgatgagaaatatgccttgttcaatacttactgtgctcttgcatgactgttaaggtttctgtgcagagaccaatgtccaagtgtcacatcctttgattgaacgaaatctgttgtgacctctgagttgtattccatgaagagaatgctacccagaagataatgtagaaaagataattatattgttaacttttcatttctcagctgtccttttgttttcttggtttttattttttattttgacatcaatggaaaatgggttctataaagactgcctgctagtatgaacagcaatgcaatgcacttgtaactcatggaaataaatgtacatctttatctttacacccatgataagattcagtgttgattttctctggattggtgtgtcctaagtaggcactcataatcaatttatggcttgtgcttcagacaaaaatgttcatgggccttactctacttctccccactccaccctaccccccatgcactgcccctcacagcagtttacgtatatggctgggaaaggtccttttcagctgcacatggtgccatgcatcgttaatcccagcattcagaagtcagaggcaggtggatctctgaatggaagcaggcctgatttgcatagggaggtccaagacagctggaactctataggtcctgtctcaaaaaaaacagagtcctccccgtctgcctctcagcagcaaatgaa

SEQ ID NO: 23878 - DNA, 1127 bp, Mus musculus
atctctgaggaatcacaaaggtagacacctacactgcatgccacatagtattcagaccacttagggagacttccatttgcttaggataatatttacattaatattagtagttaggtttgaacttttggtgacttctatactacggtaacacattcatatatgcatatgctttgggtccttcatactacttttatatttgtaaatcagtgttttggagcaattccaagtttaagggaaatatttttgtaaatgtgatggttttgaaaatctgagcaattcttttgcttacaagtttttttaaagcatttgtgctttaaaattgtgctagtgtttggaatatgataccctataacccagataagaaacataagaatggagtaaacgctgtcgcttgtcgtgctatgcccagcttggcgtgctggatcagcagtgggactccggagtccctagggtcacaccagctcacctgcagcttgttgcctttctgtgccgtccgcccgcccttcagagcactccagaaagttctgacatggctctgtatctgctctgtactgtggatgcctttttggtgttgtatcccaaactgcatagattatttaggataatgataagtttaaaaaattaatgttgaagaaagattttattaagaatttaaatgttttttcattatattgttaaacttgaacatttatctgtggcttatgtgatttggttaatatgtataaaaattgtaagaggtttatatttcatcttaattcttttgatgttgtaaacgtgcttttcaattcattatttgaatgtttatggcacctgacttgtaaaaagaattacaaaaaaaaaaatccttagaatcattacattgtctcactgtgttgccagggtaacagtgctgttcagtacagtttagtcattccatatagcatgccttctgactgaatttactggtcgctgctaatatagtagatcacaaactgctgctctgggtgactggaatctccatcaggtcttccaggtgattcttcagacactggttacagggaaggaaggcggcctcgcacccctccccatcactagccttcagtagccccagtgctaaggtaggtatcagatgtggccttttcacagca

SEQ ID NO: 23879 - DNA, 1151 bp, Mus musculus
agaaaaatttaaacagggcagagcagcagcagggagccctgcatggacagaggctgctggtgcctaactgtgttctcacactcttctcaggccactcacaagctactacaaggtggtgtcagaagcatcaggaccccagaagccctcggttctcagcgggctctgagaccctgatcctttgctcctagtggatgctgcaggaacgaacgtggctcgccgccgcccccacctccacccccaccctgggaaccttgctgtgtgacgacaggagctttattttatacctcccacagacacgccacagagggctgacagctttggctaggagacagggaggccaaggcgctctgtttgctcgagcttgctggtcctgctgttcttggtgaactccctgtgggttccacagcactgcagtcagccttgctcagcagccgacacctgtccccagggcaggcagctgtgtcctctcctgtcctccagcacagaggacagaccaccagggcttgcatttccatgggtcggttgtctatagcttaaatggtagtgttttagacagtaaagacacttggattttgaaaactgcctgatgagctcatcagaaaataaaggacttttgaggggaaaaaaaatctcatttctgatctcttcaaatacctgacagatgccatcaagaataagcattaaggtataaaaatactatgtatacagtaacaagacaacaaggaaataaaccacatttctaaagcaaagtggcgttcatgacctggtatcacctcccactgttctgaggaaacctctttaaaatagtcacagaatggtgctgtttacaaatgtaaggaggtgagacattcagtggtttaccagcatgcctggttgtggtcttgcatcacttaccctgaagccagctcatggtcagttcttttggtttatatttcacagaaggccaacgcaaaatccaaaaaaaccttgataaatggtttgtttatatccattactccccaatacaggtaagtcatatagagtactagcaaaaacgttccagtcagagctctcacaaaagataatacagagtgctcagttgaggggcagatagcatgcccagagcataaagtctaaatataatcttagtatatacagaagacttctccaag

SEQ ID NO: 23880 - DNA, 1186 bp, Mus musculus
acttagtacctttattaattattttaatattttgatgtgggtttgaatgccatggtacaaatgtgggcagaggacactttgaggagttggtcctctccctccactgtgggttccaggaatagagttcaggttttcaggcttgtgtgatattgaatgccatctcaatggttctgtacgcattttgaatttcagaagtcaggtgttgagagaagggttgactatgaagctcagtggtagagcacacacttaacacatataaggtctgggtttggtagctggcaccaacaagaaagttcagaccttgtagaaatacacagcagtctttattccacaccctccttattcagcccagtgactaccccttacatagtgatatttgtgtgtttataaatctgaggatctgctcacagcctggggcttacagatacatcagtgcaaccactgaactaatatcctagaagcctcaggagtcctggctgtgtcttggagacttcccagagagatctccatttctgtgtaagctgcagagggtcagttgtgcagagatctttctgttctgtccctgttgctcctgtcttggtagcctctgtgttacttcaccctttattaattattgttaattatatgtcttccagaaacttgatgggaagtccttgatcaagctgaacttcgcaaagaacagcgaaggtgaggatccctttaggacacagctccaggactggcccacagagaccccgagctcttactctcagcaacttcctttcctttcttctctctcttttttttttaaatatttatttaatgttgtatgagcatcttgttgctgacacagcagaagaggacatcagatcttattacagatggttgtgaacctccatgtagtcgctgggaattgaactaaacgacctctggaagagcagacagcgctcttaaccactgagccacctctccagtcctcctttcttctcttgtggttggaggctgaccatgggccgcacagtgctacccagtgttctacttcacagactcatcttcagcctccctctcttgtacctttctgacacttgcttttgcttttccagatgtcacatgacttctcaaaggtccaggtggtttaagtaaggatgggtggataaaggcagttagacagttgtgagctgctagtgccatggttgggcccctgtgc

SEQ ID NO: 23881 - DNA, 1375 bp, Mus musculus
gagatctgcctgcctataccttctgagtgctacgcttaaaggcgtgtgccgctgagcctagctagggcaggactcttggcttccattttcatagctgtgaatgctgaaggtcaggaaaaggagcagaggccccaggatactaggtgcaaatatgacggccagacatgcagctcaggggagcttgtgccctctgtgtgactgttcctataccttatactctcaggaggtgagtgcttttggggaagacggtgagggtgatgacctggacctgtggacagtccgatgttctgggcaacactgggagcgagaggccagtgtccgcttccagcacgtgggcacctctgtgttcctgtcggtcactggtgaacagtatggtaaccccatccgtgggcagcatgaggttcatggcatgcctagtgccaatgctcacaacacgtggaaggcaatggaaggaatcttcatcaagcctggagcagatctctccacgggtcacgatgaactctgagaaccagatgagtgatgggagggtggctgagtggcaatctcggggtcactcttgtgtaagactttgtttgtaggggccctcaagtgcctttatgattaaagaatgttggtctgggattatttttgctgtaaccctggggaagatctgaaggtgccagccatatctgtccaagttaccatctcacctgtctcaagcacctgctgaaatttttttttttttttttttttgagactgtctcactatgtatccttggcaggcctggaactcacagagagatccacctgcctctgtctcctgagtgctggtattaaaggtgtacaccaccacaactggccccaacctgttcaataaactcatttttattactaagtgtgagtgcatgagatgtgtttgttgccacctgtacctcagagcagctctctctagtcgcttctcatcttccacctttatgttggttccagagatcactctcagtttgccagcttcacacagtacacatagccatctcactgtcccaaaccttttctggatgcctgtctgtgcagtttaactctgcagtctaccatacagtgtcgtcagagccgccgacctcatttcccaggacttgaccttaggcaatttctctattgaagggccttggccgtaggcagggcccctgccaactgggatgggctcaaactctccagtcctctcatctcttactctcaggaacccattcttctggtggttgcagcagttttgaaacttatctttgactaaaggtctgttgaggattctgcctatctattgggaattaacacctcaggctcccagacttttgatggcaatggcacactcccccttactctgacctgcccatggtgcaggccc

SEQ ID NO: 23882 - DNA, 1192 bp, Mus musculus
aggctgcagtcagtgattgttagattaactgaattgcaggctgttaaccattcttttatatgtgtgtgtgtgtgtgttttatatatgtgtacatatgtatatatacacatatatgtacctatatgtgtgtgtgtatatgtgtatatatatatatatatatatatatatatatatatgtgtgtgtgtgtgtgtgtgtgtgtgtgtgtgcatatatatatatggaaagagagattcattttataagttccattactctagagaacactgactaatacacccaaagcagacattgccactacctgaaaggcttgagtcccaaaaccctgactaggggaagcaagagaattaaggatagacatatagacacatataaaaatgaagctgggccgggcgtggtggcgcacgcctttgatcccagcactcaaggcaggcagatttctgagttcgaggccagcctggtctacaaagtgagttccaggacagccagggctatacagagaaaccctgtctcgaaaaacaaacaacaaaaaaacaaaaacaaaaacaagaaaatgggtttctgctgaggaacaagtcggtcaggaagccgcgcctcagccatggcatttaaagataccggaaagacgcccgtggagcccgaagtggcgatacaccgaattcgaatcatgctcactagccgcaatgtgaagtcgctagaggaggtttgtgtggacttgatcagaggcgccaaggaaaagaatctgaaagtgaaaggaccggtgagcatgcctaccaagactttgagaatcactaccagaaaaacaccgtgcggtgaaggttccaagacctgggatcgtttccagatgaggatccacaagtgactcattgatttacatagcccttctgagattgttaaaaagattacttccatctgtattgagccgggagttgaggttgaagtcaccattgcagatgactaagacaactgaataaatcgacttgtcaaattttgctggaaaaaaaaatgaagctgggataaagtgcggttctctacctggcacaactgggaaccttaacatacttatgttcaaaagatgcaaagattggccagtctgggtaggaggtctccatagataagcagtctcaggttgcaaatgtgacaaccccacccccactcctcagggatcataggccaagagagcaaagggatcag

SEQ ID NO: 23883 - DNA, 2232 bp, Mus musculus
caccaactggcgtccgcttgtggcagttactaactttctacagttttcttaatcaaaagtggtctaggtaacctgtaaagaaggattaaaaaattcagatgttctagttctgcttgctttgttttaaaaatcactgctttagtctacttcaaaagaatggcatttcttttcttgcccaaatttactcaaagttgcagttagcccagaaggtttaaagaaaaaggttgttgtggtttcttcccccttcccctctccccacttttcgattcccacttccacagaccaaggccccagctccccacagaggtggccgcagcactgacaacgtttcctgtgccaacactgcctgtgggtaatgagtagctcacgcaccccattccagcttagtgatgtctttaaaaaattataaaacagtatcaatgccctgtcccaaaggaacatccatgcaaacaaagagaagccgtctttacgtaaaattttagcaaagggtttccacaataataatagacccgacagacagacccccatggtccctatctgtagtcagactgtgctggctgggtctctgcagggaacctgttatagcaggtttgtggtgaccttggagggagggtctgccagcagagaatacagtgcgcttgtgtgatggacttctcacagtcagcagcccttcctgaagctgtggtagacctggtcatcacagaccaaaaaaaaaaaaaaaggccagaatattcttttgaaatttcaagcttctctaccaccaagctctgataggatgtgccaaggagagctcccactcctgagcacagcaggccaccactgccaccctcctcacggcttaccctcagcggggtcagccacgatggctctgcctctctcagagcagctgctgggacagcccaggaacagggtggcttttccctccctctggactccaaacctttccagtccggctccacttgaagctcactcaatatcctttcagtgtgttttatattgttttgattgccttttttttgtagaaataaaatttgagcttagaatttatcatcaaatgaactctgtcaagatttgaatgttaaatgtcttttcaagggaagtgggacggactgtccttgacgcagtagtgacaccctgaggaagctgatggcctgactgcccatgttcaccaactcacttctgctactaggggtctaatcctgtggagaagattgcctcaagaaaccttgctttctgctttaaccttagttctataacttccgggctacctaggcttacagacttgggagacagctctgggttttgcctataaaagaagtaagacatgtcctctcaggcagtgtaacactatttagttttccaagtgtttggctcctgtgatgcataaatgaactatgctttagttcaagttatgcatggggcaggtttctggagacttccatatgcccaggatggtcagagccctgggcctgtgtttctacatctgtctcttcattggcagaaaagtgacaatggattttatttcactcatattcagatttgtaataaaatgccaaactctgtcagaattgtcgaagcaaaccaccattttgttcatgttgcttttctgaatctagagatagtccagctgtctcattgcttagctctacctgcctgttacccgtcactgctctctgctcactatgggagggtactcttatgccagcagcccctctcagggactctcagccccattgttgacaaccatggcctgccctgccttggagtcagtggtgtccctctgggcttgcatgccttgtcctgtccagccctgccctgagcaggctttgagcaaggtggcagggagacctgtggagcagccacccacgcctgacccaagctggctcaggaatccacatccccctggttccttgaagtgcccgggtctcgtcctgctcttcccacaatggcagagaataggctttctaagatgctgtgaccccattctgtccttaataaaaatgttctcagacattagattgggtgtatgggtttctttggggatggccattgctggggggtggggagcggctatttggagactagagagtagtgactgggcctctaatctttcctccacttctcagcctctaaaagaggtgtacaggtggttctgtctgccaggtagaagtagataggggagtcaacactgggaaaatctcaagagaccccatggctatcaaggagactggc

SEQ ID NO: 23884 - DNA, 1174 bp, Mus musculus
attaagtagcttcccacaggggcttttctcatggaattttgtggacttacaggcaggaaaggtaacattttgttagtttttatggtataatagtagatgcaaggaactgagatttgtagcatttttagagtactttttgttgttgttgttgtttttctgagacagggtttctctgtatttccctggctgtcctggaactcactttgtagaccaggctggcctctgaactcagaaatccacttgcctctgcctcccaagtgctgggattaaaggcatgcgccaccacactcagcttttagagtgcttttgaagtagtgttcattccaaactccacattggtgtacctcctcagtctataagcatgtatcaggacacaggagttattcaataacagctcattccttggaatttattgtactgagcagtaaactattttgctcttgaatataggattctatcctcccagcttggtaattaactatagaacagtgacaggtctggtaattgtcttaaggggtgtggggagagctaggtgtgatgatgtttttatgtagggattaaagagcttgaggcaggaagatcactgggagctgggatttccaggctaacttccaacttagtgtgtgtgagactccagttcaaaaaaagaaaggaggtgaggagtgagggaagggctgacttgcttgctggcttcctttcttcctcttttgtttttccttccctcctccaccctcccaagactgattactgtatgtatctctggctgtcctggcactcactttgtagaccaggctgacctcaaactccgtgacctgcctgcttctgcctcctaagcactggaattacaggtgcccaccaccgcccagcactgcccaacctgtaggaagttttttacatgatagacgtcataagccatcttaaatggcttgaatccattttgggaatggattttgggatgttttgttttgtttttttgagacagggtttctgtgtagccctagctgtcctggaactcactctgtagaccaggttggccttgaactcagaaatccaccagcctctgtctcccaagtgctgggattaaaggcgtgcgccactacacccggcagattttgggatttttaaaaaatatatttatttatttattatatgtaagtacactgtagctgtcttc

SEQ ID NO: 23885 - DNA, 1126 bp, Mus musculus
agagctttagcctctttagaggcagagctgaagctctgtactgtaaggcagagtcagtgcctctaggctacggggcctactccaggaactgctggtgttcccatgatgctttgtaagggatccccttgggaaagtatttcctgtatgctttacagaagagcctacggcaatttgaaggagactggtcatgtccaaggttgtgtgacaaccaagagccaccacctcccatggtctttcagggctctccaggctagtgaacagggaggttgggacttcccgcttctcccctcagatacaacagagaactctgccttctagagtgtagccaaagacaactggaagccccctggggccaaaatattgagctgtccaccagctgttccagcaaggaggttaacttggacttgaaggctactatctgaaagtgggaaggagaaaggaactgctgggagcccctcaaaaggtttaaaaatgacatggaaagccagagtggagtcacctgaaactccactcattcaatgctggagagctgaggttgtagagtggagaggaaatccacccagcatccggtaaactggaggtcattgtcctttcctaccagtctctatgacccttgaggaacaagctcagactggctctgcagctaatcagaggagggcacagagaccagctcaccttgctggacttcatgtccaactccggagggcaggtagaaccttttctctctctctttttttgtttgtttgtttgtttgttttgttttgttttgttttttcgagacagggtttctctatatagccctgactgtcctggaactcactttgtagaccaggctggtcttgaacccagaaatccgcctgactctgcctcccaagtgctgggattaaaggcgtgtgccaccatgcccagcgaaccttttctcttaatccatagcaattgagaacaacacctttcacaattgtttttacttaatagggcatttgtatttatacatatgttcctgtacacatatcattgtgtatgtgtggtgtcagaggacaacttgtggcagtcagttctccccttccactgtgtggatcccaaagatcaaactcaggacttcaggcttattggcaagtgcctttta

SEQ ID NO: 23886 - DNA, 1204 bp, Mus musculus
gaaccagcagagggccaagggcttcctgtgtgacgtcatcatcatggtggagaactctatcttccgggcccacaagaatgtcctggctgctagcagcatctacttcaagtccctggtcctgcatgataacctcatcaacttagacacagacatggtcagctccactgtgttccagcagatcctggacttcatctacacaggcaagctcctgcccagtgaccagccatctgagccaaacttcagcactctactcactgctgccagctacctccagctgcctgagttggcagccctctgtcgccgcaaactgaagcgagctggcaagccctttggccctggacgagtgggtactgctggcatagggcgaccaacccgcagtcagcggctgtccacagcctctgtcatccaggctcgatttccagggcttgtagatgtgcgtaaaggacaccctgctccccaggagctccctcaggccaaaggctcagatgatgagctttttctgggcacctccactcaggagagcacacacggcctgggcttggggggtccagctggtggggagatgggcttggggggctgcagcaccagcaccaatgggagtagtgggggctgtgagcaggagctgggcttggacctgtccaagaagagcccacccttacctcctacaacccctggcccccacctcacacccgaggacccagcccagctgagtgacagccagcgagagtcacccgcacccacatcgacctctgccctgcctgtcggcaatagtgcctcatttgttgagctgggggccactcctgaggagcccatggatgtggaaggggctgaggaaaaccacctgagtctgctggaaggacagggtgggcagcctcgcaagagcctccggcattcagcccgcaaaaaagattggaacaaaaaggaacctgtggctgggtccccctttgataggagagaaacaggatctaagggttcctgcccaggggaagaaggtgaagggactggggacagggttcccaatggcgttctggctagcagtgctggtggaggtggccccagtgcatcgtatggggagcagtcattcccctgcaaggaggaggaggagaatggcaaagatgggagtgaggacagtgggcagagtgggagtgaggggggcagcggccatactggcgcccactatgtataccggcaggaaggctatgag

SEQ ID NO: 23887 - DNA, 4422 bp, Mus musculus
cccagcctcctcacgcccagagctttaatcaacagtataccaagggaagccaagagagaagctgaccagtctagccctatgcatgtggtgctggtgactattctacctccctgggcccactgggctttccagctccctgaaggagctgctgaagagccggtgggagtccatcatgtgggtgccagtggggcctggttggttcctttcctgcaggttgggctgggccacagggtttcctgtggccaaaagtggtgcctggagcaggcctagctggcagggacctcggctgtgtgtgtgcatgtgtgcttgtgtctttgcagtgcagtgtgactctggtgttggggtgctggtgctgggtggcagttcctttctctgtgagctggggtggcaactgctagctggcactggaacagtcagggtgacccattgcctacctctctgcaactaaagagccctctgggcctatattgctgttattcctactgagctgttcctatttcttttttacagtttttaaaaattcttttttaaaaccaaaatgaacaatattttcctcctgcctctttggggttgagcctgggtctgcagactgaatgtaaccggggcagctgcccctccctatcattttccctagtcctggtgcttgggcatggttgaacctgcctctccaaggcccagaagcccttcttgcccaaaggcttccctgattctgagccctgcctgcctgggcttcctcaggagaatatgcttttccataatttccaaggaatgtcccttgttagaggtacttatttttattgagaaccacaccctcccccatatacctttttgagatgtggaactggaaggtctgaagtttcagagggtggaggggaggctagattcggtgccagagccatcggtactcttgctctcgtgtgcacacgcatctgtgtgtgcgtgcgcgcgcgcgcgcgcgcgcgcgtgtgtgtgtgtgtgtgtgtgtgtgtgtgtgtgcgcgcgcatgtgcgtgtgtgttgcttatgcacagatgcttcacttccttgctcactgaacatggtggggagccttctgacctttgctacctcttgaattcaatacccagtacagttgaggctgagccacttgcttttgtttttctgtagtgggagtaacctgggcttgggctggcccaagccccttgtgggacccagtgttctctgaagagatgtctgctgctcagggcatgctgtgtgtggggcaggtgctgggcatctgagtaacaggcagaagccattaggaaggagcagctcccttttatgagccagggtcaggtggaagtgagcccaccccatcctgtcccctccagagctcaggtatgtctggtaacctacagcagagccagaggtaatggttgacccctacctatactgactcagtacagggtcaagctaacccttccatgggtgtgtcagccagcctcagatgtttgcatgggcttctgcaaggggcaaggcaagaccaagagtgtctgtgttctgtcccagatgggcctatagaccttatcatgttgcttcatggcttttcattttccttttgatttttacttcagaccaaaaaattccagagtcatcccctgcttgcctccacccctcagagaccctggagcctacattcagtacccagagagtgttgggtgtgggagtgagggcacctggccaaacctccacatagtgcctgtgtactgagccagctctccatcagccctcactgggaatcttagttctctgactgagcatctgagtgcagcccaggcactattctacccagtgaaatagcagggcatgctggcctctgctccccacccacccacctaccagcacttaaggcctaggacacaaggtctgtgtggcctcccaggctgtaggtaccctcatctgcagaaaatcagggactaggagcagagcccctcactgagcatgtctgtgcgacagagtattgtacccaccttagtgttgtaccaagccttttctgtgttttaatgagaaagcaaaacactagtttcctatttgagatttaagggttgttgggatgggtgggatccacacttggattctctttcctttgttctcactgctgcatgcctatgagtgtgtctctgtgtgtgtctgtgtgtgtgtgcagatagaagagcctcatggaaaccaggccataggaggccaaggcagcgaacagttctctgttttagtcatttaattcctgaatgttttggggaaacaggaaacagaaaatagcagatgtcatgtagagaaaaaaaaaagttaaaaaaaaaatcaaaagaaaaaaaaaaaaagctcatacccaaattcacaaaacctattttttaaaccaaagcacattttgaatgagtgtggaacctcagtgggctcagaaaaaaatactaatatatttatctcattgtttacataaacttatacagtttcagacctcagcagctacaacagtcccagggaagctctcccctcccacctgggtccttctgaggcgacccttgagcagctcaagggcagaggcagccctgggtgctgggtaaggactcgaagtccccctagcttcacctgagccctcatccccattttttggggcctcttcaagctcagctgccaccaaagagcatgcaccaagctgaccagcccccaggcttcctagctgaacccaaggggtggatttggccctgcccatgagccttgtgttactttgagagtcactcaagccaaaaaagcaggtagctttatgaagctcagtggactccgtcatgcacgtaccctaccccgggcagcagaagggtctgactggagtctggtccttactaacaaatggtgcagacactctcaacagtgttgtttttgtatcaatgtttgtgcagtgatgaatgtatttatttctcagacttagggcaatccagtggagcaggcctggctctgccagtgcccatttccaccggaccgagctactgcaagggctcttccaaggttgcaaaaaggaaaagatgaacttatgaacacataagaatctcagacttgcagcatagccatacacctcaactgtgactcctgacctcatgtggcccaggaagtgtgttttccgtccatcaacactgaggggagccaggtccccacctgctgtccacactatcagtattcactggacctcaggtccttgtgcaggagtgcgatctgccgggcaatctgtcagcaggcagactgctgccttcctgagtaggggaaaccctgggcagccgggagggcaggcctcagggagcaagcgctatgagtaaaggtggaagccaagggcaaggcctgtaaagactggacaggctctcgaaaccctgctgtgctcgatgaaagggaccaaggtcttcctttccccagtcacgatggggccaatgttactgaacctatgaaatggatgccaggaatgagggatagagagggacccgacctcagtctgacattccagcccaggaaagggtgggagctgtggatccgtgctgcccaggaccccttcctaggaaacctgcagcttcagtcaccttactttaactttctaccagggacccctcccctacctcaccttgctatttattgctgtaatttattgacctcaaaaatgctgcataacagacctcacttgggtcagggagagttcccagggtcctcccctccacttggtggggccccatgggggccaggtgctgagaggaaccccctgtacccacccatcactcgttttcctccaggagccccaggttgggctctatccatcccatttgcaaatacctcaggagggatggggtatctgtttcatttaattggaactggaagagggatcatgacgtcctttatgcccttccccgagcaggggagggatgctgggatcgcactcctgtactggtcacccctattaccacgcatcacattgatttgagtttacttccctaaagagtttggatggatgcattcaggtcagagctgcagctctgcagccctccgatgttagagtgatttatccatgactaatctctccattcaaaagcgtgcagtcttaatgtacagtgatgagaaactgttattttatgatcttttcattaaaagcttgattgaaaactgatgtggagtctgtgactataccctctgacagattgacaaggtgcctccaagtcttaggagagcaggaccttggacaaactcatgccagggggaactctcctttagatgtgggcatggtcatagcaacattggctcaagttaattaagactgtccagaaagcagatacggggacagttagggtgggtgggatgaggaggtgtggccagtaccaggaccacagttgaaaccaaaaaagtgctgggccaaacatcccccctccccccatagtcttag

SEQ ID NO: 23888 - DNA, 1174 bp, Mus musculus
cccaaaatttggtcacatcccagcattccagctacatttgtggccctagcctcctttgtctttcccctgaccttagggcagccccactgagtcagttactttctcctgttatgataaaacaccatggttagacttgtgcaataagtctttattttagctgatgattccagagggcagaggcatggcagcaggtgccagagtgggtagctgagaacactagaatggagcaaggctgtacactctcaacacccatgatggttttataacatccctaaacaatgctaccaactggagacctgttcaaatacgagcctcaaaactctcctgccctagttacatgcctcctactccttctcagacagccactaacctgggacaaagtattcaaatgcccaaaacttacaggaatatgtcattccctgcttccatactgtcctgtatacatgcaataggagcatgcagtaaaaactatactggattgaatctctctgattcccaggcctcttgctgctcttcccacctcacttagactgactgacttgttctggccctgaagctcacctgcacctacctctgtctcttctgtcttctcatttgccctgctgtagctctactagatcctgttgctcctgctctcccaggctgtttctgcctagctgcatcccatttcctttacttagatgaatgtcactgctgaccatctctaggacttgtgtccaatgttctcttccatcccaccagcattctctggccaccctatctaaaacaccttccctctttgcaccatactgctgctttctcagatttagtatgctgcctgttgcttatatcttggaccatccacatttgtttgttcccagagtctgggagaccctatcatagaagtggatcttacacaaatgagtgggagcgtagcctttgcttggttactttatcccatcagttctggggtttcctatacttccaaccaatttggtaccccaacttctaccataaaaaatacatctaacagtaggcagaagccagactccgaaagaagccacagcagggtatatagctccttgatattcttcatttcccacctataacgatgctaccttagcatgaaaggcctttgtcttcaccctcatggcctcccaatggcatctgtgccttcaggaatcacgaggaatag

SEQ ID NO: 23889 - DNA, 2031 bp, Mus musculus
aggatccatgttcatacagaacggaaatgtgttgccttcattgtccctatccccatcttctgttcttgtcctgcactttagcagaaggactcagagcagaactgttaggcccctcttctcacctgttctcacctcatctttccatctctgatggggactttctccactggctcaaagccaactggtaggttggtttgtgtgcatggagtattactgagccctctgcctctgggaatagaaccaaaggccttgtttattcggtgcctggagtctcctcatccatcccagattcccatgcattctccatagctacgaagtgttccacctagtttagggacttcgactccacaaatgatgctaaccttctgtctgtcagatgattcgaccaaaaggcccagagactatcttagctagcttgtgtccactcccttcagtttccaaaagaaaatatttagaagtattaattaaaattgattcttgcaagaatttttccttgtactgccaataaagtcactgaagccacagaacacctgactatcttaaaatcaaactcacatattttgaagaaggtaaaagagacttactagtagatatgtcaaaatctataatgctggtgccttcttgccttaaaacttggctcatgtgccatttgaggatccttccttttgcatctggagtctgcagtaccttaaagcaaagcaagcagtgggttcatctcagtggtcagttatctactcttctctctcggggcctggggttggtctccaccattgaggagaggatcagaaaatggggtaacaggattattactgttcatgtagcaatatgtacacactcttgtcaaaaattatccaacctttctgaaaatacagcaaccacagggagaaagggcccaaatctgaaatctgactgaagtggacctctgtgagttccaggacagccaggacgatatactaagatctgtctcaaacaatatagagagactgatccatatgtatttccactaattggttttgttttgtttttttctataaaaccttccaagtgttataactgtttctcttcatcactatcaggcatagccttttagaaattgatcaatatacctcagtcctaagaaatttacacatgagaatgccttccatggtcatcctagtgtaaatcagctaacttgaggcaaagggacattttatgtacctttctttgttttgctaaattaatgaagccaatcacccctttcccaatctttttttgctccatgaacatgaaacagtcttcctgtaaccattagaggtcctcatccagtctgttcttcagactctgtggtccactgaagttatcccttggcctgctggagactggctgaggcagatgctgccttacaaagcagggttgtttggaagacacagatacaaaggacttggggaaactccagagccagatctgctggctgacacagtaatcacagcacttaggccaaggcagaagggtaaccatgagttccaggttcagggtgagatcttgtctcaccctgaatatcagtggttgtgtgtgtgtcggggggaggggggtgaaggtgggcagggagggagggaagaaagactcactcctgcgctctggcttaggaagagttagtgttggcgaggtggcaggcagaagtggaatggactttctgtctcacagaccagtgaacatatccttgtcatgtgaggtctgcaagacagactgaagcaccctaccttcagaaaggtggcatttgtaactttaggttagctatgtgtatgtgtgctaccaaaacaagtgcattgtcctctggagaagactaaccgttactgacgtgtaacttagcagcattagagtgacgtcttcagttggttttcctcattctgtaggagaggcctgatgttcattcatgtaacaagtaaaacaagagagcagagagtcttaatttccctttctcttcttataaatgtgcaattttaagtgtataatgtatcacttcagtaaaaaaaaaaaaatctactttgcttg

SEQ ID NO: 23890 - DNA, 1120 bp, Mus musculus
ttcttagcaacagattgtgggtgatggtgcatatgtccttgtacacacatgacacaaagtatatttaggatattgttatagactacagaaggtacaatgacagaacattctcacttactgagaatacagtgaaggaacagttccttataggggaaggaactctatatgtttttgacacataccagcatagaataagatttctcttcagaataattgtgtttctctcttaaggtacccaagcccaccagtgggttctgtctcagcacccaacttacctacagcagaagaaaatctggaatatgtacggaccctttatgattttcctgggaatgatgctgaagacctaccctttaaaaagggcgagcttctagtgataatagaaaagcctgaagagcagtggtggagtgcccgcaacaaggacggccgggttgggatgattcctgtcccttacgttgaaaagcttgtgaggtcttcgccacatggaaagcatggaaataggaattctaacagttatggcatcccagaacctgctcatgcgtatgctcaacctcagaccacaactcctctacctacagttgccagtactcctggggcagcgatcaaccctttgccatccacacagaatggacctgtctttgcaaaagcaatccagaagagagtaccttgtgcttatgacaagactgccttggcattggaggtaaacatttatcaagactggtttttgaacgtgggtcttcatttaagttagtcatcccttttagaggtgcctgtgttgttgggaattagactagagagttcacagggtggacttgctatccttgtcctttccaagccctcccttcagtccaggttcttagctactccctctctcctttgctcccagcagggaaagtgataattagacccataacctatgagtaaaattagccatcagaggtacagactacttgtatagatccgtatcattacattgtaattaaggagtaatacaaataaggtgtctaggcagagaaatgagtttactaacctttgcctgttacagattttgtaaatcatgatagaataaagtaggaaaaacttgaacattttcattaccaagtcactgtctttttttgttttt

SEQ ID NO: 23891 - DNA, 4000 bp, Mus musculus
ccctcttcccttacaggttggtgacattgtgaaagtcacaaggatgaatatcaatggccaatgggaaggcgaggtgaatgggcgcaaggggcttttccccttcacacatgttaaaatctttgaccctcagaaccccgatgacaacgagtgattgctgtgctgtccctgctgctgcctccttctgcctgtcagtctcctttgaagtgggaagcactctgtcacatgcaagttacaccgagctgctggcggtcagctttccatacattggcagtccctgcacatacggaatgcctcagcagctgccttgctcgctggctcggcatttgtatcatagtcatgctgtcaaagagtagctgatttagagttcttgtggattgtgaactggaaacactggtggaagcacacagtagagactggaacccagagcagctcttccttcccatccatcactgccttgtttgtactggaggctgacagagagagcaagcaagcctgctgatggtctgcatggagacggtgaggcttggcaaggtctcgctttgctggtccacagaacagtggttttgccaccaactcagttttctttggacgacagaggaagtaaaactccagacaattctgtcccgaactcctcaagtctggctggttttcattttcttttgtttagttttgttttttggaagactaattaattatagttgtgtgttctgaacagatttttaaatagtaggttggtctatgatggtctaaggaacaatccatgtctctgagcttccaaactgaagccactgtacgtaactaaaataggaaaagaccccctccaggggcctttatcttttggttgccacagtaccttgtttaccatgtggcaaacagtgcacagcagcagtcatggtgtaccttgctgtgaagcaccaaggtgggggtgggcctgctgtcatcgctgcctctgacaggagcagacagggtgggcctcttcagtgaaaacgtttgaagtctgtgggcttactagatccgtgagttaaattgcattgctgtgttccaccacagaggccacccagcccttcctgtactgacctagcttgtccaggcagcttgagagtggtgtctgttctggttccacagcctgagtagaaccagaatacagtgcttctgagcaaaagaagacgcccctcgatcatgagccatttttccttgcatgtcagctactacagatatgtgtctgatccctcatccacacatggcaaaccagagctctagaacctttctagagtgcactcttttcagttggaccctgatgaggatacacctccacacagaacgaacgtagcagacctagagatggagtagtggctagtgagcagctctagcatttacagaatatcttctgtaaccatggccctggttctgcaggcctgaggctttgagaactaatggaacatattcaggtgacaaaaccaacaaaaccctttgtccactatatttatttctcttaaagactttaaatttttgtttatgttgggcatggtggacacacctttaatcccagtactcagaaaggcaaaggcaagtggatctctgagagttcaaggctatcctgatctatgtagtgtgtcacaggacaggcaggcctacatacataccttgtatcagaagatggcccaatccccccctcagacctccccccaaaaaaaactgtatatgggtgtttccactacatgtatgtatgtgtatcacatgggtagtttgttaggaggccagaaaagggtgttggttggatcctctggaactgtggagttactctgtgggttctaggaattgaacctgggtcctctgcaagaagaccttaaccactgagccatttcttgagccccattagtttctctttaaatcagtagtccatcaggctaagttctatagtaaagaatgttcatgtgacaaagtaatggtcatttggggtatggggagtgtcacgtctgtagaggttacttctttttgtctctgaaagctgccatttctagccagacctattgagtggacttaagtgttcaggccccagactctgcctaaatcaagatttaagacttgccttctggccagttacacagtttagccccaggcctttgatgtctccactggaatacacaccttgttcactgagggcacaacccccaagggataccccatcactggggcctgaacctcatgccttacacgtgctagataaccggctgccagtaagcttttgaaatccgagatgggatctctataaattgcccatgctggcttcaagatttccatcccagcctcagctgaaattataaaggtttgagtcaccacacccagctcttaaggtcttttaaaactacatttaactgaagggcttggtgccttttgattatagcaccttgcttagcataaacagccatttttgagaacagggtttcccttttcccaagactgttgaccagcaagactctaaggaatacttcatgatcagaatgtcccataaccctggagtttgctttatgtaatcagttaatttggcacatgtaaatgtctatgcagcttcctcagagatccagatctcaaaataaagacttaactttctgaactctcaggatacgtgcgtgcgtgccaacaatagtaattctctgacttagaagctcatcgatttttaatcatggaaatctctctcactgatagaaagcagcatcttccccaagtcccactcttctgggaagacccttggtttcaggggagtacgatggaggcttccttttctcatcatcagtgctgtgtggtctgctctgccatgttgtagaaagtactgggatgataaacccacttgctatggctgttgtatctgagaaggaaacaattaggtagttgagggctttaagggctagttagtcctgggtgacagccccccacctccacctccaaccccatacagaaggcatgcttgtcactctgcactgctctgatgccacctgtttcgaggttgacagggtgtcctggcttttgtcatccagacgtaaccctctgtgctcactggaagagactctgccctcttttcaagttgcacgatcctggcactgtgccagccttcctctacagctgtttacagacaagatgggccaagactgatggccactgctcttgtaacctttactcaaaagaataatgagcatttaaaaaaaaaaaaagggatgatgtgtttttgttccaggtgttcataatttaatcttttaatattatgttcattaacctcttaaaatgagtgaattcttgattgttttaacacagtacctaagactaatgctttctgtggactcctcactctggaaccagtgaacccctccctggttaactgctgtgagcgtggacgctgagctgcttgtatattctgaaggagcaggaggacagttctgagacaggaggacagtggccttgcttctagacggtcttcactgtgtgttttaaaatgacataaaactcttttgacgtgtataacttaaagaacataagcatcaggcaataatattttctgtgtaagcttttaaaattatttttggggatcatagcttgttttattttgtgctataaaattaacagtattaaatgacttatattcttagaatacattgagtgtcttttcttaacagattagtgcctttttatttttgtattccattttgcgttactggtcccagcatcaaaacccttgtttccatggcctgtttgtacattgtctcaataaaacttgcaccagccggcgtggcagcagcctcggtgtttcagtgtctcctcagtcagccccaccagactctcccaacagttcaactgtgctgaagcccctggtactccccagagacccactcacgctgctcctgcctccctcattcaaaaatgacagcttcctaacatgggagcctcctccaaaaggaaataactcttttctgggtgtcgtggaagcaagcacttactcagcattccg

SEQ ID NO: 23892 - DNA, 1139 bp, Mus musculus
ctacgctgaagtcagggaaaaagagttcagagccccagcgttgcattaaagtcttcagctagggcacagactaggttcagatcacctaaaagtcgagtgcaccagcctacaagcacaggccttcagggcacatatgttcctcacaggtcttggagatgtggctgagctacctgcagccatggaggtatgcccctgagaaacaggctcagggcagcgatccccagccacggtgtgtgtcagagaagtggtgagtgtccccagcccacctgtcccagtgatgccattgccctctggtgctaagttaggcatgctgtgcttcaggtcttgagtacacggcgaccctagaaccccatctccttgttcggcctagcctggctccatggtcaccctatcagcacagaggactgaggtggggcatcaggaaggggtaggctttgggagtaaggagcagtgtggccctgcctcctataaggggtctacacggtggtctcactccagctggcccccatcttgctacctgtcttcagggcacccttcatccaggaaaacctgctgatgtacaccaagctgtttgtgagctttctgaaccgtgccctacgcacagaccttgtcagccccaagaatgcactcatggtcttccgagtggctaaggtctttgcccagcccaacctggctgagatgatccagaaaggtgagtcttcagtcccgggcaggctccactgagtgagttagtaccttagctgctgagaagtggcacatagaggaatttggggttgctgcatgcctcaaggatgttctttgtggcttgcagactttgcacatcaaaagtatagtaaaagtttggctaatgtccccttcctagtgctggcatctaggcaatggctatactgagctcaaagacatggacatcagagctctaagctgtagctctccgaactgctgttttaccctatagattggtgggtagtggcgggcattggctgctgtcactctgctagcacagtgtctactgttggcaactgttgcttttgctcaggctcctaagcattagagctgggccctcgagctaccaagcccccgagacagtacacaggtagaggccctggagtacctgcaccagatattcccgttaggccttt

SEQ ID NO: 23893 - DNA, 1193 bp, Mus musculus
agaaggtggaattggggtctctggagctagaattataggtggctgtgagcagctccaggtggggtatgtaagctgtttctgaatggccaagtgggccactgtggcaggccacgtgtcttctgtgacctgaccagtgtggggtaaggagtgcaggtgttgttttccctaagatcccactcagagatggtgtaggaagatgtggagatgtgtccccacatgccagcagtgcctgctaccttgggagaggcacctgattgacttgctctgcagaacagactggccgctgagctgtgaaaggcaggctgaaggggttgcttggtacacagtgattgactggggacctttggagttggtggcctctaggctggcccaggatggcaagaggccaacaggaagctgtcttctccttctagaactgcaatcctttctttgatgaaaggcgggagtacacatcctgtctctttgcctggctctatggtgtcagtccttggagtgcttacagaaacccagtgctgcctttgctagcagtggtgcagtcagccctgtttctgttatctgaggtgccttgagaacagagggcacgctggctccgtggacaacgccaggcctctgagcccaggggactttgatatgtcattcacctcttcagataagctctgccagactagacaggtgctgtggagccagtgcagtcccctcatggatgtgcatgtggctccttgggcacctcacccaattaagatgaggtgaggcagcagcatctgcacagccagagccactttgaccaaggccttgtccttggagctgtcctcctgggagactcatgaaggcactgaggaagacagtcttctgggctagccggggagggtctttactggccctcagagaagagtttcctaggttaggcagaataggacagaacataggaccttccgaggctccctccttatacaccagtgcttgaggagcaggccattaccatatctataccagcccagaaacctgaaatccttgtggtctcccaccaaggagccaggctacctacctggcctttcttctagccccttggataccatgtgttatgtgtgcccagaggtaaggcttgtgcctgagtgaaagaaataagggtggataagatgggatgtcagagcagtggggagtttgtacagggtgtgtgtagcatggagctggct

SEQ ID NO: 23894 - DNA, 1201 bp, Mus musculus
gtgaaagcattgtttgcagtgttgaggatgtttaaacttggagtgtggtaagcaactgctctaccaaggagcctcagcccacagccaagcttctaaggcttgtgattccagagtaccctctgcaagcagaaactcctgggcgcccttattttgagtgactataatatttgctgctgttctcaagtattgccttgtttttggatcttgaagtaatcttataagtgtatggatacattcaagacagttttttgtagtttcccaggagtgagtcgtaacatggctttgagggtctttgcacagtgacagcaagttatctaattaatcaggagctcaaagacctagattagaatttccaaccttgtgtccacatattctgccagtatgcagaaaccacatattgcatctttgtgcatatgaaataccacacaccacagactaggccatcaggcagctctgtgagagttgctggtgtgggggcactaagtgagtagttcttcagcttcattcctagagtgtaccctcagtaggagtgttctggtagagtctataccagtgctagaatgacaggtgtgatgatctgtgcagtaatggtggcagggctcttcacctgggctaagtgttctggaaaggtcagccagccccaagatgtctgttttatatagctatcttatctcattatactcaagtttctgagagagataaaatcaccttcaatggaactttctggggtccaaaaaaacaaaacaaaaaaaaaaaccccaaaaagcagaactatatctttattttcctacacattggtctcttaactttctgttctagtaatataaaactaagcaataacttgcaggtaccaaagaattatcagccaagtcaaacatttgtcatgcatgtatgcacattcaatatagcttacttagaagtgctctttgaccagaccttgacccagagggcctgtatccctgtgagtcctcctaaattgttgccacagttgggatctggcaaagctctattgagtattagaattcctttgcaggtggcagtgtatggagagatagagaagagtcatctttgcaagagttgcacttggtagctgctcatctgatcctgtaaagattttcagtggtttttctctggagtttctgcctcgggtaggccaggtggggctttctttgtcataaagaaaactaaccagggcctggag

SEQ ID NO: 23895 - DNA, 1196 bp, Mus musculus
tgctctccctagggagtgtctgcctttgccctctgcttctctaatctagccacttgttcctgcctgctggaaataagggcctcatactttggtgtctctggaagtctgttgtgggcttactctgtaggagatctggacagagaagaagagtctggttgctggttgagcttgagggctcagcccatcttcagtgcagctgtgcacgtcacagggctccattataatccacattagaacactgacacaggctggactgaaacatggagtatgctctctggttctgagcctcatgttccagcagttccaagtcttgggcccagacttggggaatttcaggcctctggctcctacttgtttgggaatttgaatgggtcaagcacataaaggggagggggtcctctatgtcctgggagccatttacctgtgagattactcagtttgggttcctttcctcaagacattgtgcccttgtgttcccacagaccccatgaatgcactgcagagccttactggtggacccaccccaggagcagctgggattggcatgcctcctcggggcccaggacagtccctgggtgggatgggtggccttggcgctatgggacaaccactgcccctctccgggcaaccaccccctggaacctctggaatggcccctcatggcatggctgtggtgtctacagcaactccacagagtgagtactacactccttggcaggtgacactgcatgctattcttgtgctctccgtgttaatgggaaaagtgtcaaggagcccagatagctctgttgtggacagcaggtattgcaggggaatgctctaagccttctctaaattcagaggagtagtgcttacctgcctgctagctaaggcagtgatgctgaggagaaacttggttatttgtaaacttgtgggttttttctttgcttagggttgttttggttttggtttttagagacagggtttctctgtagctctgactgtcctgaaaccatagaccagcctggtcttggactcagagttctgcctgcctttgccaacggagtgctggatcaaagacttgtgccatcaccaccagcaaggtgtgttttatcagtaaaataggaactattgttaaggtttgtggacacaaataagtgaagtatttgtactctatgccccggtggtgtgcttgaggttatggtacatgcgactcc

SEQ ID NO: 23896 - DNA, 1124 bp, Mus musculus
gttggagctggtctctttggttccgttatgaagacattacttgacatacacagactcttgccttgcgaggattgggatgtggcttgtgtggactgttcattttataggtgagaaatgtagaactgcagtctcacagtactcagatgtagaattgggtaggggctcaggcactcacaggcctagaaatagagtctggctagccacccactgacctaatcaatagtgctgattgtgagcaatctcttgggacagtccccctgtccttaatgcccaggggcttctcttttctttaaggtaattgccttttcttttcaaccttcttatggccctgccctttttctcaaatgtttaactctggccactgccctgctgagtgcctctccttggttcctccccaggacttcagccagactagttccccagggatagtacctgtctaccagggtggacttggtaatgttttgacacatctcttcttttgtatttcagtgaggatgccatgaggaaagctggtgtggcccacagtaaatctagcaaggatatggagagtcatgtgttcctgaaggccaagacccgggtaagaccctgctggccaaagtccccagcagagtaattccaggaggagtgtgttgctgatactgagccccttctacttgtatcctggagaggggagtgcttgcttgctgctctcagatacagctggctttgccacaacactctggaacctcccatgttccatggaagaaaagtcaagactcctagattggcacttctgctacaggccctgcctctgaccctggcctcatttttgaccatgtcatatatatgtagttggccctgtgattcccacaggaagctccttggatcctataaaagagatgctggctttgtgctacacatccctgaggcaggggtctagagtcatctttggtttctctgttcagggaggcagccaatgctggaaaagttgagggtagaacttgccgggtagaattggaagaagactttccaggctagtacagcaccagcctctatgtgaccttctttcagtgtgttagttctcaggagtggaaattagaagtgaaggaagaggctgaacgataactcagcaattacaagaccat

SEQ ID NO: 23897 - DNA, 1171 bp, Mus musculus
agaattttaacagaagaaaagagccaggtatactattggtcacaggaccttggctcttctagtgtgccaggggcagggagtggccaccggttccttctagtctgtggcatctcctgcttcctttgcactcagacttttacctaaaagtaggtgatgtatgtcagacctcctgtgtgccgagtggtgtctgtgcttgtcgtcaggctgtttgttacgactttacccttgtttgtaagtggggactgaggctctgaagggtaaggaacatgccctgtgttaccacagcaggttttaaactaagcctacagaaagtttcagttttctgtcagaagaggttggggtcggttgaggaaagattccactttgcttctcccagtcccagaaggccagctacagggacagccagctctgtatgccttacttctgctgtcatcctgtctttaatattcagatgcagtcctccagctaagacttgagtgggtatccttctttttacagataccagaaattatccacttctgctgtgatttcctcatgtcatgggtagatgaggagaatatccttgatgtctaccggctagcagacctctttgacttgaaccatctgacccaacagctagatacctacatcctcaaaaactttgtggccttctccagaactgacaagtaccgccagcttcccttggagaaggtctactctctcctcagcagcaatcgcctggaggtttcctgtgagactgaagtgtatgaaggggccctgctctaccattactccctagagcaggtgcaggctgaccagatctcactgaatgagccccccaagctcctagagactgtgcgctttcccctgatggaagctgaggtccttcagcggctgcatgacaagcttggtcctagcccactgagggacacagtggccagtgcccttatgtaccaccggaatgagatcctgcagcccagccttcagggcccacagacagagcttcgctcggacttccagtgtgttgtgggctttgggggtattcactccacaccgtctacaatcctcagtgaccaggccaagtacctgaatcctctactgggagagtggaaacacttcactgcctctctggcgccccgaatgtccaatcagggcattgcagtgctcaacaacttcgtgtacttaattggag

SEQ ID NO: 23898 - DNA, 1196 bp, Mus musculus
ctagaactctgatgttgaaactgtaagaaattgccttgtgaaacaaattaattttgtctttgtttccacttgttcttttattttctttctttgaattcatatatacaagtgtattggctttgtatcactactataaaatatctaaagtaattagttgataaagagaggatatttatttactgcatactttggggtatgcccactggtttgtcccctgtgagagtagatggtagcggagggaacactgaacctgttgttacactgtgctccaggacacaggagggagggcagggacccagagttagatgatgttgtttaaagacaggatcttacaaaagaaaagagagaaaaaaggagaaaaaactgagtggtggtggtgtgattgtggtatactcctttaattccagcattcaagaggcaatggcaggtagatctccgagtttgaggccagcctggtctgcagagtgagttccagagcagccaagcttacactaagaaatcctgtctcgagaaatcaaaagtgaggggtgggtggtgggtgatagggggttgattgtcttattctatagtcctggccgacccagaactctacatggaccaggttggctttgaacttggagtgatgctctgcctctgcttccctagtgctacaataggaagtatgtgcagttatagtaggtctcactatcctttgtgtggatcccagtggtcctccccagatggtcaccctgaggatcaggcctctcttagggttactattgctgtgatgaaacaccatatacaaaagcacattgtggaagacagggtttatttcattcatagttccctatcactcacagttcatcatcaaaagcaatgagtgcatgaacctggaggcaggaagtgatttagcgactgtggaggggtgctgcttactagcttgtcttctacagttttctcagcctgatttacagaaaccaggacatccagccctggggcaaccccatgcatgatgagctgggtcctctcacatcaatcactaattaggaaaatgccctatgggcttgcctacagcctgatcctatgaaggcctttttttttcagttggggcttctctgatgactcaccttgtgtcactgacataaaactaggcagcacaaggcctttatatacagacctttagaggacattctacccatgccattctttgtactttt

SEQ ID NO: 23899 - DNA, 1202 bp, Mus musculus
tatttgatgccttgttccaatttttcttccctacagcctacttcctatgagtgggaactatctgcagacagatagcttagctagtgaaacgttgaatccaccaagggcaggtattcgttgctggtgtaattctctggcaacttggaaagtgagccttgacttccttgttccccatccagattgtttcctttagaggcagagaaacacaaaaattacatttagtttctgggtctgtagataacattcccttttggaaagaggttaggggtcaacaagtagggcagtctattcagatagagtcccatacattctcagtatgtgatggtgcatcagctgtggtgaggccttgtctactgtattgtcaggcaggtcagaaagatactggcagtctcagtacattctgcctgactaccttcctcactgccttcttgcctatcccttacctttcctggctctcttggtgtctccaaacaggtatatgcccatgcaggcaccacactgcaggggaagatgtatattacctgtggtcgcagaggagaggactacctgaaagagacacactgctatgacccaggaagcaacacgtggcatactctggctgacgggcctgtgcgacgggcctggcatggcatggctgccctcctcgacaagctgtttgtgattggaggcagcaacaatgatgctggctacagaagggatgtgcaccaggtgagctgggcccagactgcccactttagaatcgagcagaagtccaagaagttcccttgtaccctctggttccatgcatgcatagtttaaccactatgcatatccttgcacattccatatgatgcatacatataccctccatagaagtttcccttgtgcctttagttgttatgtttgtatcaaaaagtcaacttaccaagcccacattgtagaccctaacgaagcatggagaagaatgagaagcactcatatcctctacttgtattcttggttgtcagtctgtcggtgacttacttatagctgttcgtagtcaaagagcatcccaagccaaatgtggtgtccattcctgtaactctagcactcacagtctggggctagagggttgcaagtttgagaccagcctgggctatgcagtgaaatgagattgaacaaaatatgagctagctagcgctctcttctcttctcttctcttctcttctcttctcttctcttct

SEQ ID NO: 23900 - DNA, 1653 bp, Mus musculus
atggcctccgctccagcctttcaaagggagagaagcaggagtggatctagagatgatgaggggaggcatctggactcttaggagctaaaggatgggaaggctagaccaccaaggtgagcatcctccagtgggcctgctatacacctgaccatgggcagaagtgacttggggtgggctggcaacctgtcccagaagctgcctggattgaccctggtcttggctttgcaggtggcttgctacagttgtacatctcgtcagtggtcatcggtctgcccactcccagctgggcatggtgagcctggcattgctgtgctagacagcaggatatatgtgctgggtggccgctctcacaaccgaggcagccgtacaggctacgtgcacatctacgacatggagaaagactgctgggaagagggaccccagctgaacaattccatctcaggcctggcagcctgtgtgctcaccctgcctcgatccctgctccatgagcaaccccgagggacccccaaccgtagccaggcagatgcagactttgcttctgaggtgatgagtgtgtctgactgggaagagtttgacaactctagcgaggactagggctctccccagtgtttgggtgttcaggaagggtaatgggcagtgaaggccgtagagcctgggttagaacaccaggctctaggggaggggcccctccttaagccatcctggttcaccagctgcccctttcactctgtttcttcaaccagccagctgccagcatttgtaaactctgtggctgtgaattacattacaaagaaaagtgctggggggaaggctgctatcatcagagggaatgacccatcctctataaactctgaatgagtgggatctatttggccgcttcttctccctagtctggtccctgatgggttaagtaaggtccttctttcaagagatcctggggagagcactcctagccatagccaaagtttgtggctccctttctgtgaaccgtggtcagtctggtgagcagcgccagctgcctgcagccagggccttgagcactggggagctctcaaggtatactcttagagtaactatatacctgtaactggacctggagatgaagagataccctcattgctctgtgtctgacccaatattgttgaaaaatgaaataaagcattatgcaaaaggtgttacatctaatgtggctacagtctgagtttcttttctctctagttactgcctcagtggcatctagggtggtacaggccagccttcctgggggatggacttggcatgggaattgagtctctgcactaaaaccagggggtcactaccctacttccaacatatgataagctccacaagcagaaagaatgttggtcacacagaaaccaggacctgagctactgaggtggcaagtagttgcctgtctctcagtcagaacatctagaatgtctgccctgaggctcaccagctcctgctgcctcatatccactctagctcctgggcagcctgactctagctgtggtgctgacctagtcccatcctccttggggagctcaaaattgttcgcctcactgcatgtctaaggcagaaagctccgaggattggggtgcaactcagcactagagaacttgcttagaatatccatttatgagaatggaaaga

SEQ ID NO: 23901 - DNA, 2773 bp, Mus musculus
cccagagtggaagcaccccagctacagaagcaccgccagggggtgggcgcctcccccgtgcttccctcaacactgtggtttaggtggctcagcttgtggccccccgtgggctaggagtgtatgtttcttgtccagaagacacctatctcagtgggggacttgaaggggtcctgtcatagcctggaccctactccactgccacatccccaccagctgcgggtgtgtacatagaaactgaaatcaggcactcagagaggagcaagtgcctgtaccatctttacctgggggctgttagtctcttctttaaatggtggaatgacacaggtgttgaaagcacacgtttccaagaagcagaggcagtgggcttcacttataccaagtacatctttggatgggcttgcttactgcattctcacccttaggagccagtcatcagccagtgtagacacagtagagctagcgctagtggctgcttagaggcagcagagcatctgaactgcttctggggaaagcattcacagctgctgtactggctctctgggggcttcctgtccggggccagctgcaaatttcaaggtgccgatcgatccctgggaggaaattgaacttgccacaccatttctagctttgctttgaggccagcactgtggcaggaggccctgctcattcctagcactcttccatggtatacctctgcatggctccccaggagtagactctagacccttgtggagggttggggcatgctggcttttctctgccacactctggatccctgtgctctgcttgctggtgaatgaccactgggtctagccatgcccgttcatcctatctgtgccataaagggttgtttgggaagagaatggttcaagtggacatcctgagttgtcatctgagtccacttcaccccgtgaacactgctggagcccagtgtctgccagccacatacatgcctcccagtccctccacagcaaccgggtacctggggatttttcccaaaggactccattgccagctccagctccatgcagtggtcttgtctcctgacacaggcctttagcatttctaaggtttggagattaagcaaggttctgtgcaatttttagcacattcgtgtcttttttatgttggatgtctgggtctttatatctgtgtgtgtgtcctaatgtggccaaatgtttgcaggtgataatggttcacaggagctcaggacaggggacaataccccacatgagccatttgcccatgggccactcttgcacctttgagcttcttctaggctgtggtcagtgggcctgtgactcctgtgcaggtgagaacaggagtggaggtgactggtgtctgttctgttgtgcatgatcagacccacacagctctaggtgcagccttacactacttggaacctatgtttccccttcccatacggagcatcttcagaccaggtccccagggctgacaggagtatatgattgcttacggatagtctgccccatgtctgagcccacagaccatctgctgcagacatccctctgcagagggcccttgccccctctacccattgctaaggacatcaggaagttcgtcatgcctccagcaagtcctaagtgctgggcgctgggcagccatgctccagagcaacaattgggaattgtgttggtgccaggccacccaaaagagccctaaggaccacacagcagtgcctcaggagactgcacagactggaacttacgtggggaccaaatggctgttggggttgagattaggaggcccagtggagagggtgacctaaagtggactggtgctacagaggtaggcttgtcaggcctgtggggtccgtcccccatgccttaggggtgcatggaaggcctctgttgggggctgtttagactattgctattccagttccaagcactggagtctgccagatctcactggtgaataatcccaaatccaagatttgatgaggtttgtgtgttctttacccatcccgcaaggccccagagggacaggctcctaggaggcccctttcccaggactgccttgccactcttctgaggccaggtgccctctgacctgccttgaagtggaatttgatactgtacattgtctcaatgcctgtttttacatattcctttcattaaaggttttagtttgggtgtatttttttggtcaggttggcattgatcctttcttaagatgctgtgagaaccatttcatccaatgccaaataaacttgtgttatggaaaaagcatggtcagttcttgctgtggccagcccctcgacagggctctcctaagttttcagcccttacaggcatccagttggcttctgacaccccttggttgaggaccagatggctgagcttggagcctctggagggtgcatggcaaggggccacactcctctgaagttacactacagtcaatgccagggctggtatatccccgttactagtgtccagtgcagggagggcgctggacttcatctctgaccatccaggtggctgtaagcagctccttccagcaggagctgcagcttggagggtagcgattggcaacttacacccaggactgggctgttcaatgccttttcctacagggctggaaaggcttgagtcctctgagaagatttcaatctataaaaaattggatgatcttgtctttccagaagtcctaagatgctaaagacttgcatagcctattgccttgggctgaggcctctcctgaaaagagggggttacacccacccactatggcactcagcctgctgggg

SEQ ID NO: 23902 - DNA, 1199 bp, Mus musculus
ttcagggacgccagcacctccttccagctttcacaaggcatgcaggaatgtagtatgcagacgtatatgcagccaaaacacctgtgtttgtgaagtaaaataaaatttaaatttaaaaaagcaaagtcatgggctgaagagatgttggagtggttaagagcacttgttattcttgcagaggaccaaagttcaatttccagcatccatacagtggctcacagccatccataactcgagctccagggatccagtgacctcttctggcttccagggcactgcatgcaaatggtccacagccatataccacacacaaaataaatattaaaaaaaaaaaaaggcagaattaagaacggtggtgtaagttctacactctagctgggagtgcatcctccttttgatccattccctagacatgtgagggcatatgcgagcctttatgagggaatcagacccagggcctccagaacagacagtgctcttaaccagtaagtcatctctccagcaacccccacctcctttttttttaaaggaaaactttattacatttaaactttttgtatgttgggagtgtattatgtgtttggtgcatatgtggggggtcagggaatgacttgcaagagtcaattctctccttttgctatgtgggttccagggatcaaactcagtcatcagacttgccagcaggccaccttacccacccaaccaccccactgctcctcatagtctttgtcaaaagatgaaaccttaagtccagttcctaatcttggataaaattctctataaaatgtcattgtggccttaggagatatctcagtcagtaaagtgttttctatgcaagcatgagggcctgggttcaatacctagcacccatggtacatatttactgtcttgggtgtttggggaggcagaaacaggcagccctggggcttgctggctaaccttaccctaaacagccatctcaggtcaatgagaaaccgtgtctccaaaaacaaagtgggcagcgcctgagaagaacccaataatccaaacaacagcagcagacaacctgtatggaaagtgaggcaggctagggcttaagctcgggagggtgcttgccctccgtgcacaaggcctgggccaccagtgtgctgctgtgtgtctgggccacatggtgagagcctgtctccaaaggaaaggggcatgaggggagagtaaaggaa

SEQ ID NO: 23903 - DNA, 1196 bp, Mus musculus
ctcttgcgccgcccgcccgcgggcatggcgactgcaggcagcgcggccagccgcagggaccccgggcgaccctgccctttctccatcgagcacatcctctccagcctgccggagcgcaggcccgcgacgcggccaccgcagcccgtcggtggtcggaaccccgccgagctagacgaacccgaggcgcccgtccccgctgctccttgcgcctgctgctgctgctgcaacccgcgcgctgcgacccgcggaaccccggagacatcgtccgggccgggtgagtgcgcgcggaggggcaagactaggcggggatctcgcggggcggcctgcggggcgagcctggctccccctaaccctaattggaaccgtaaccctacacctgaccccaccccgccccttaccgccccgcaggcttgcggctggcgtggccgctgaggttggcgcccgccacgccctctcccttgacggcgcctagagcaggctccccggcgctgactggcacgagcggccccggcccgcagaggcgcacgcggcgccaccgtaccatcttcagcgaggagcagctgcaggcgctcgaggcactcttcgtacagaaccagtatcccgacgtaggcacacgcgaacgcttggcggtccgcatccgcctgcgagaggagcgcgtggaggtgggtgttcagcccgcagcctggaggccaactccggcgccactcttatttttcaaagaccgaccttccagaaggggcttcaactcgtagccggctacactgaagggagaccccctatgatcactcgatgagggcgcggggccggttcttccagcacgttatttgggtgtccctggaactggaagaggtcaagagtcgttttctttgactttgtccggctccccagtttcccctgatgatgaaatgcacgtttgttcctgccccagatgtgagaaagttaagaaatgttcaaatctagtcaggcatagtggcatgtatctgtaatcccaacccctgggggatggaggctggatcatgagttcatcaaagtcagtctcctcacacagtaagaagccgcctagccacctaggttacaaggaggagaggtggggtgggaagaaggggagagaggagagagagagagagagagagagagagagagagagagcgcgcctgagcctgggctcaggctgggaaagtgtgtgagggaaggag

SEQ ID NO: 23904 - DNA, 1330 bp, Mus musculus
gccagtgtctttggaaacacacctttggatgtgatcaagaccaggatgcaggtatggatgggaggctgagagagtagggatatgagcactagccagaggctagtgtctaaggactctgccctgcggtgtcctgcagggcctggaggcacacaaataccggaacaccctggactgcggcttgaagatcctaaagaatgaggggccaaaggcgtgagtaggatagaggagagctattgcccccattccaggccctcttttcctaggtggtcttccttcccacattgctcacctcagactctctgctctacccagattctacaagggcaccgttccccggctgggccgagtctgcctggatgtggccatcgtattcatcatctacgatgaagtggtgaagctgctcaataaagtgtggaagacagactaaccctggaggatgcagtggggtatcccagctcctccattccagaccccccgccacctactctgatgattccagtgcagtagtgccaaaaggccccttcctttgtccctcaagttctgtggcctggtgtgtcccatagttctgtatatcccatgtggtctgtgtgtgtgtaacactaccattgtatctgtgtccagcctggccatggctgggtgtctctttggcctgtgaatatgtgctcacttatccatgtgcttgcttgtgagccacatgcctgtttcgtgttctctgtcatgtgaccctgtgccccacttcctggggtgcctatgtgccctggttcatggccttggagccatggtcaggtcacagtccggtgccttccaccccctatggcaagggcgccctgccttggcctaccacagctgcctccaggcttagacctggcttcaccgcattccaggggctataggcccccctgcttttcccgccattggccttaaatggccctcgggccctccctccgcccggaacagggtggcacctgccactctcaggaccaccttgccaaggagaataaaccggatcctgttgcactctcctgtccatccctttgtagatgggggtcattgatgactgagcctcctcagagacctgcctcccctccatcaggagacactgcagttggcagggcagtaagaaagctcagcagcccctagtgagagcgccttaggaggcccagcttgggaccaaaagggatctgtgctacttcctggccttacagggcaattggggtcctgccttcagctgaagggctttgtccacaaggcctcagtggactggcaggacagagggctggaactgaataatgttcccagggtgcctctgcccctccctgagaaggcccgt

SEQ ID NO: 23905 - DNA, 1853 bp, Mus musculus
ctaaaggtagggagagcttaaaaatctatcgccaggctccggtctccaaggtgcctcaagacgggcccactaatttggctaaggtaagaggtaatacaggggccgatcgaacctccctcgtgttccttgaaaggcttatggaagccttcaggcagatcactccctttgatcttacctaggaagcccagaaggcctcagtggccatggcctttcataaggcagtcagctcccgatatcagaaaaaaacttcagagattaaaaggtgtattatgagagagagagacagtcattctatctagtaaaagaggcagagaaagtgtgtgtgtgtgagagagagagaggcgggaggcagaaaaaagaaaaaacaggagggatcttagacaagagaaaaagttgactaaaatcttggccacagtgatagaaaaaaaaaaaaaaagacaggatttagacaggaaacctggacaactgaagaccgagcctcagctaaagaggctcagctctgtgtcagactgaagttacttatttgggatacacccttcgaggtgaaaagcagtggctaaaagaagccagaaaaagactgtaactcagattcccaccccaactacaccaaggcaagtaagagaattcttgggtactgctggcttctacagactctagataccgggttggcgaccttagctgcccagttgtaccccctaaccaaagaaggggaggtgtttgtgtggaccccagatcaccagaaagcctttaaagagattaaaaaggccctactgatggccagcctatgcctgacctaaccaagcctttcactctttatgtgaaagagagagcaggggtcaccagaagagtccttactcagactttgagactttgaaaaaggccagtgacttacctatccaagaagctacaccctgttgccagcgggtggttttcttgcctgaaagctattgctgccataatctgcttgtcaaggatgctgataagctcactctgggacagcaaataagagtgtagtggcatcccacactcttgaaagcattaccaacgctcctgtgacacatcagagctttttgttgtctaaatgagtgaccttcgcttcattccacctgctgtcccactgcgtgagactgcacctactcatcactgcgctgacattctggcagaagaaataatctgaaatatcagatcagccttggcctgagggtacgagctggtacgctgatgacagtagcctcgaggttaaaggtaagcagaaggcggggacagcagtatggtggtgaacagaaaacaagtgatctaggccagcagccttcctgagggacatcggcccagaaagctaaacttgtgactttaagacaagctctataaataaaaaaagaaaagtctacactgacaacaggtatgcttttgccactgtacggggcaatatacaaagagagctgttgacatctacagaaaaagacctaagatgctgtggctaaagaaaatcagatggcagatctaactgccaaacaggtggcccaaggagcaatgatcctggcagtcaaggagcctaaagattattataacatccgagagaccagctttagatacacccctgagcactatcaagttatggacagtatttgacttggcctgggggccaagaaattcaaaggcgtggttaggtcctttgactactatgttacaggactttctgacttgacaaaaaaaaaaaagagtcaaaagctgcaaggcctgtgctatgacgaggtaaaatttctaaaaaaaaaccttcccaaggtaatagacctgcctttgttgcccaggtaaatcaaagactggccaagatattagagattggttaaaagtta

SEQ ID NO: 23906 - DNA, 1050 bp, Mus musculus
cccttaccaaattgacagcggagactggcgctatgattagatagctctcctaccctttgtgctcttcagggatagaaacacccctggacagtttagactgacccccctataaattactctacagggggccccctccactggtaaaaatagcctctgtacatagtgctgacatgctgctttcccagcctttgttctctaggctcaaggtgctccagtgagtgagacagcgagcaaaaaagcagctccagaaggcctactcaagagaagaagacctgctacattagacgtctccacacagaaaaccttaagactccggtggaaaggcccttatcttgtactcttgatgaccctactttctacctttatgggaccccttttgattttgcttctgcttttaattataggtccatgtatgttaaataggcaagtcacctttattaaaacaaaaattagtacagtgtggcttttagttttaaaacaacagtaccatgccctaaagtaaaggatcaagtatgtcagaaaaaaatagtgtctagttctaagattagaactactaacaagtagaaggggggaatgaaagtataacaacgtaaaaacagaattctaggcctttaggcccaggcttgggaatgtggcctttgtaaaggtatgctaatcataaagcaaattgcgacattcctccatccacccgcttcctgggttcaaagagtgctcatttaaagaaagtcacccagaacctgcaatgcaaatgtgctattgttaggggctcttagaagctgtcttgagagttaacaattaccaggtattctttgtgactcttgtaactttacacttccttgtgactcttaactggtatctttggtatcttccaacaacgccctccccacttccttaagttgtggttccttcctttaaatacccccttacccagctactcggggcgccatggtcctctacccctgcgtggtgtatgactatggtcccgagagcgctcttgaataaaaatcctcttgcaatttgcagcaagacctgtttcttgtgggtgatttt

SEQ ID NO: 23907 - DNA, 1146 bp, Mus musculus
tagaggctgtacatggtccaccaagaccaagatcctctcaagatcctcgttcttactgaagctggagtttcagagccaggcatgatggcacatgctataatctcagcacttggaaggctgaagcaggaggattgctaggagtacaataccagcctgggctaccaagtgagatcttgtctcaacacacacacacacacacacacacacacacacacacacacacacacacacacacacacacacacacacgttctgttaggtatctttgtcacagcctgcaaacataatacatctcatttcactaccagagaaactgaggctagaaagacagaccccgcccaggccatgtctttgggagacacatatggggtctgaagaggagtaactgggacatcaggaaggacagaggtgttcacagtcagagctgggaccaggcaaggcctcagctgaatctggcactgctcctgaacagcgggacaagagctaattaattaacataggccattgctaacagggcgctaatgaagacaaagaggcagctgtgagtgcttagtatggacctgtgagcagatgggacagccgaggggtcccctgtcactgcagcttcactggtagtagcaccaagggccaaatgcctgtgtctcctgtttaaatgttccttgctgtgggtggacactctcccccagcttgctgcagtcacctcacagcctgtctcaccacagaaatctcctggtcctgccacttggatctgcaggtgcctctccttttgtagacgtcccctccagcatctctctagcatccctagccaaccaccagagggagcaacccagcaggatgagccccaccctcccctccctgtgtgcgaggggaggggttagcatctcgagagatgtaaactgcatcttactgtactgtgaacgtgcatgttagtttgggtgaggcatgatgtgtactgatgggattctttgatatcttgtgcctatttttctctgtatacccccagaacagtcctttgtgaaatgaattgctgatactttcccattttatcatttatctgttgattttgtttctcctgtgcagctacattttatctttatgaggttgaatatgtttctctctcactttatggcttcaagttttgtataa

SEQ ID NO: 23908 - DNA, 2210 bp, Mus musculus
aggagtgtagatgggtttccccatgtaggacccgtcatgacctggatttcccagctcatcctggagacccctaagttgtctgtagggacagtacaagatagctgagcctagttccccgtttggaaaagtctggccctgggtgcagcatgcatgtgggaaagagacattggcatgctgagccagcacagacttcactcagagtactcctagagctagcttcacttgggtgtgtgaactcctacctttccaggcatgctgtcccttccctggtcttgatacgtgctcagcatgctgagacagggggatattgcctcaccacaacacgtatattgagcatgcagccccagattagcagggagcctccatgcttaaaagtggggaagggcaggtgggagccaggcacctgagcatgggcttcattgttttggtctcaggtgagccctgggagctcttatttaggctgtgtggctacaaaggttctagggcatccctcatgggaacagtagcagctctggccaggccggggaataggagtgtcacccgattttcctgagagactagtgaaagagctgtgtgtccgctgctgggcttcccaatttcaactgcagggagggcccagcagctcaggctcgctgctctttggctgatccaactgggagagatcaatgaacccatgagggggacagaagttctggaaatgtctgtcctgtgacagcataatcctaaggacaaggacacagggctccagtccacacctacatgtgtcctactgcccactgtactgtgttcactgtatgtgcatgtgtgtatatgtgcttgttttgatgcagggatcaccctcagctgaagacccccccaagtaagcttaacgggcagtccccaggcatggcccgtctggggcctgctgccagccccatggggcccaacgccagccctgcccggcacacgctggttaagaaggtgtccggcgtgggtgggactacgtatgaaatctcggtgtgagaactgaccaccactcatctgctgtgatgccacggggaccaggaccccccgcagtagctccccaaccctatcaagttctctgccccagggaggaggctccccaagcctgctgtggacacatcaacaggaaagacagccttgcctccacaagcttgagctccggcctctgcctgttcatctacttacctagtactcacagggcagatgggtccaaggctgtgggctgtgatgggcacctggactgcctccttcatcagccaagctcagccctgcatcctattgccctcattccctaaggccagtccccagcagtcccatgggcccacccactcctgtctggatgggttgctcagccctgttctccagctgctcctaactcacggcctttcactgacaaagctggtcgcttgttgcttggcaaggcctgtgctttgcagggagcataaccctggcctgctccgggttgggatgcatagatgaacgtacggacagatacttgagcggtagcaggggtcccagctccctctgttcgtgtcttgcctggctggtgggttcgtgtccctgtgtctgtatgctgtgctgccgtgccacgtctgatgtgttagtgctcggctgccactgttctttcatcaaagccttaacttctgctttatgctcttgtgggaggtgatggggggtggggtcggccagagcagagagggggccagatgctgcccgggagaccagtggggccgagagccccctccctctctctcgggccttccctgccaaactggagaatcctcaccccaaagcatcccgggttcccagcactggcttggccagcacagctggaaagcacatcagggcgggtccattcgtcccctggcgtcaggggcctgagtaagcacatggcagcgtccgcttgcatcgtgtctgttctatgtttttatatttacatctatatatctataattttattaaaaaaaggaaaaatcattttgagcctttccttgggcaaggctgtggctgtgggtacaggggtgtctcaggaaaggggttggccagctggtgcagggtggcatgttcctcttggacagctctgctggcattgccaagtcaggcctagttggtaacgaatggacttctgctggtgagttgcaaaggtgtcttactcccagtctgtgtcatgccggacggaagggtgtttggtgaaaggctaggacctc

SEQ ID NO: 23909 - DNA, 1193 bp, Mus musculus
agacctgtgtctggagaaacttgccctggccttttactacaaaaccccagtgttggtcaccttaggaagggtctgtgcagcctgttagtgattgtgggtagaagcaggctccacaccagcttccctttggagataaattctgggatcaccatgccaagtcttctgtcccaacttccatccatagtaggcccctgcttccatggctgctgtagtcacagcctcagagttcttggtgctatggggtcaggtaagaggtgaggtgtgtacagtagtaagaataccctgtcctccacaggtcccaggtcctgactcccttactctggcagatgacagcacccacagtctagactttgtgtctgagcccagcctggatctcccagaccacgggccgggtggtctgcgtcctccctacccgccctccccacccctcaacaccactgatgccttctcaggtgccttgcgctccctgagtctcaaggctgccagtcggaggggtggggaccacatgaccttacagccactgcgctctgaaggtgggccccctacacctcaccgtagtctctttgctcctcatgcactgcccaatcgaaatggcagcctgtcatatgacagcctacttaaccctggctcacccagtggccacgcatgccccacacacccctctgttggtatagccagctaccattcaccctacctgcaccctgggccatcagatccaccgcggcccccaccccgcagcttcagccctgtgctgggtccccggcctagggaaccctctcctgtgcgctatgacaacctgtctcggaccatcatggcctctatccaggagcgcaaggacagggaagagcgtgaacggctgctgcgctcccagactgactcactctttggcgactctggtgtctatgatacacccagctcctacagcctgcaacaggccagtgtgttaacggaaggcccccgtggctctgtcctgcgttacggctccagggatgacctcgtggccgggcctggctttggtggtgcccgcaatcctgccctgcagacgtcattgtcctcgctgtccagctccatgagtcgggcacctcggacatcttcctcctccctgcaggctgaccaggccaacaacaatgccccaggaccccggcctggcagtggttcacataggtcacctgcccgtcagggcctgccttccc

SEQ ID NO: 23910 - DNA, 1232 bp, Mus musculus
gctggtactcttgtgaaagtgagccttgcccttggacttggaatataatgtgtatctggtagcccttccaacatgagtagagcctatagtaagaagagctttgacccttgattgtctgattgtgatagacagatagctgagcagagttgatggcctcaggagggactcaactgcagtcattaaatagtcagaaattgtcactggggttgtgcatggttaatcccagcgcttaggaagcagaggaagatggacatcttgagttccaggacagccagggatatgaagcaggatcccatctagaaaaaaatgccactgaggaccatgaattgactgacgcttcagaattttaggatattgccagtctactttgagaactttcagacattagtcccttctctttttacagatgcacaaaagttcaaaacaaagtttgaagaatgcaggaaagaaattgaagagagagaaaagaaaggtgatgtggtgcccgggagtgatgagggtgggtgggttgtggggcttctttgcagattcactctgcacctggctgcagctccagtctggtgctttttccatctgccaaagaaacagtccagaatgctgtggcttcctctgcctatcagaggcagtgcagctgcctggggacacagcctgatgccttccttgtaggctttggcctcacatcggcctcttagcatttgtggtcagtttcaggtactgagctgagttacagctctttggaactcaacagcagtgaaagggcttttaagatatagtcctcgtgccaggtgtggtggcgcacacctttaatcccagcactcgggaggcagaggcaggtggatttctgagtttgaggccagcctggtctacagagtgagttccaggacagccagggctgcacagagaaaccctgtctcgaaaaatgaaacaaacaaacaaacaaaaagatagatttctcattttctcaacaaattgttttctgttcttctgggacagatggggcctgggttagtaagtgaccacacatcaccagcagcttgctggacccatctggggagagtggtgggtgatgcttggggaacaggtcgggcctctgcactaggtaagtgccaagagcagtgtagtctcacagccggacttctctgttgtcttactgcaattgcctgtttttgcaggaccaggcaaaaatgataatgccgaaaaggtggccgagaagctggaagccctttcagtga

SEQ ID NO: 23911 - DNA, 1229 bp, Mus musculus
acctgctttgtgtgttttgcattttcttctgaaaaagttataacagaaaggaatatttcaggctattttggcttaaaataaaacaaaattttagcaccagaaatactcttccgagattgcagtgaagatactgagtgttagtccgattgatcctttttcttatgaagtcttaatgtcctaacagccgtcttctggatactgaagcttccaccttcgataaacttagcaacaattttttacagagatttttgcacaaccaagcccatctgttcatcaatttttaaagcttttatgatgttttaaaatttggaaagaaacttttacagtaagaatgaaagatgcatttcaacagatgaatatgcataaatagggaactggccttcaatgtagcccatcactgaccaagagctgcctggcacattgtacacgataagtagttatggtgttttttgatctcaaggatagctgctctgtgcagccaggcctgattgcaggtttttgtctacctatgctcattggatagcccctgtaaatgggtattgagtagaggggtattcagagccctattacctgttcagaggggctacactctacatcctcagtgtctctaaccatgtacctgaagatacatgggtgacatgtgctgttagaaagataagatggcaactgtgggcctcccaacagcatcttcctcctccttaatcatgtgtgtgacagcagttaatgtttatgttaatcttggcaaaaagaacccttaattcaagttggtagacttggacacttgattcttttctgcctcccattcagttgtgttcagtcttttgactaaccattgcccttaaaacatacttaacattgaaaaagcatatggtaatggtggtatctctgcagcctcaccgacccaggcactgtcaacaggtgctgccacacattcctggtctccagtgccctccctgtctcttacaggtgggtcttatatgtacagtcatgctgcaagggtggggagcctgtgctgatgtgcttctgtgtgttggccaaggctgtagggtgtaccctgatggtctgaacacataaaactgtccaaaagggaatggctggtttctttcttctgatgggagtgctggatctgatttgtggatcttcaactggccaaggttgtctatagtcaattgtgtttttaagtgccttagtggacacacttaactccatatgaactcagcatagatttg

SEQ ID NO: 23912 - DNA, 1193 bp, Mus musculus
ttaaagagaaggaaggaagtgttactaagcagtccagcaaggacactaagcctgtctgaccaggctagtctctctcgtgaggtcatctgacacggtgactgtttccctgggttgtccctgggctttcgtccagctggagatccctgggagaattcagttccttgggtgccttgttttgtttgtttgtttgtttgttttgttttgtttttaaagatttatttgtttgtttgtttgtttattatatgtaagtacactgtagctgtcttcagatacttcagaagagggcatcagattctgttacggatggttgtgagccaccatgtggttgctgggatttgaactcaggaccttcggaagagcggtcggcactcttaaccactgagccatctcaccagctcccgggtgccttgtttttaaccactgagagagtcagaatgggggcacaagtgtttaattaacgtgtcctcatttctcccagacactgcagcatcgatgatccagctaggcttctagaagataccttttttaagctaaggtctcctgtattccaggatgaccttaaactgaaaaatggctgaagataaccttgaccttctgatcttcctgtcttatctcccaagtggtagagttctgtatatagactaccatgcgagtacagaacgactctgttagtttagttctcactgctgcagtacagcaaaacaggtttcaattttctttgtttttcttttcctcctcctcctcctcctcctcctcctcctcttcctcttcctcctcccttttcctcttctaagatattgaacatacataagatgtggtgccgactctggcaagcccccatcttccactggctgcatcatccagaagatggcagtatcaggagcacgtgctttcagctcttgtaatgagtcgcttcttcaaaagcccacaagcaagcaagccctccttaggccttatcaaagccagcatcctcatttacctaagggcctccctctagacctacattcttttaatttattatttatttttatgtgtatgagtgttttgcctgcatgtatgtatgtgtgccacatgcatgtagtgctctcaaatgctagatgagggcgttactgtacatgttacatacagtctgagctgtcatgtgagttctgggtctcaaacccaggtcctctggaagaccacccagtgccttt

SEQ ID NO: 23913 - DNA, 1151 bp, Mus musculus
ctcagggcctgtggctccagattgtcatacactggcacattaaaggtagtgagctcaccatgcaaaccactacaatacccctggaaaacacctgtgcatcaaaggctgcattgaggccagagatgcagtagatcacagtgcgtgcctggcacgcaaaacccctcacggtgaatcctctgcacccaagaacaaaaagggagatttaaaaaaaaaaaaaaagggggactggtgagatggctcagtgggtaagagcacccgactgctcttctgaaggtccagagttcaaatcccagcaaccacatggtggctcacaaccatccgtaacaagatctgatgccctcttctggtgtgtctgaagacagctacagtgtatttacatataataaataaataaatcttttaaaaaaaaaaaaaaaaaaaaaaaaaaaaaaaaaaaaaaaaaaaaaaaaaaaatcaaagcaggtgtcatcctgatggcctcactaactggaagaggagattttttacaaagtttcagtgtgggatccctaggcactgccatcactcagcaagaagtcaggaaactgaacatatccagataccattcggctgtcaccaatggcagcaacgactcagacggtactgtcaccagcaactcataccacatttcatcttaagaatgagtcacaaacttttcaggtatgatggcgcatgcctttaatcccagaatccaggaggcagaggcagatggatctgagttctgtgccagcctggtctacacagtgagttccaggacagccagggctacatagaaatactttgaaaaaaaaagtcataatctcttttatattataaaagaaattaaagatctaaatatttggatataagaaattcactgagttattcttttcagctaccacactgctcttacttggcgcagaacagcctttgtactcatctctgactaaacaggcatggggccacgctgtccccgatgtctctgggataaacagtctctccagttcacaccattgaggcatgtctgccaggcacccagattctgaggaagtgccaacccaagcttaagagtcaccctagcccccatctctttcaagaggctcctcaaggcctcagtaggggcccatttcctagactagaaacaaaggtcagct

SEQ ID NO: 23914 - DNA, 1166 bp, Mus musculus
cattgatacctactgctcagagaaggagtgggccatgaacgtgggtgacgcaaaaggtacatggcccagcagcatgcaagtgacggggaaactgaagtgggtatggcagcgcttataggagagcctgttagagggagagcgaatcatgggtcatgcttctgtctagcccctgtggagaccgaatcatttacactggaaaaggccaggtaggtgggtgagaggggtccctgtgtgtgaaagtccagtgaactctccaagggtgtatgcagcagggtcctctgggctatcagaaggcaaagggcctttctcagcaggtcaggagcatgagaggaatgtgtgttgctggtccggagaggagtaaggccagagttggggatgggtttccctccctctacctgtacttacgccctactcaccaccctcaggccaaatcatggatgcagtgattcgggagtacaggccctcgctggtgctggagctaggagcttattgtggctactcagccgtgcgaatggcccgcctgctgccacctggagccaggcttctcaccatggagattaaccctgactacgctgccatcacccagcaaatgctggacttcgcaggcctacaggacaaagtagggcccagtgtggcagctgaggggtgaagagggggagagctgggcaggcagtgggggagggtgatgagatccttggccagccactaagcacctgccgtatctaacactggagtcaaggaagcaaccccagcaagttaggcacatggtcttactggcctatcctgtagagcaagcaacagccaggactgccagggaaactcaatgcagattcctctccaaagccccaaagagatgtagacacaggtgggggggtccaggcaagctcctgcatgtcacagtgggcacagttctgacagagcattgttccaggtttccatcctcatcggggcatcccaggaccttatcccccagctgaagaagaagtacgatgtggacacattagacatggtctttcttgaccactggaaagaccgctaccttccagacacacttctcctggaggtgagctgaactactgctgctcagcacgatggcctctgtgcggttactgctggggtcactgagccttgacctcttgaacagcccaagggcataggtgggccca
